United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 46

SEQ ID NO: 2057810 - RNA, 17 nt, Human
ugacaggcaaugcuggc

SEQ ID NO: 2057811 - RNA, 13 nt, Human
ugacagcugugcu

SEQ ID NO: 2057812 - RNA, 16 nt, Human
ugacagcugugcugua

SEQ ID NO: 2057813 - RNA, 11 nt, Human
ugacagccucc

SEQ ID NO: 2057814 - RNA, 12 nt, Human
ugacagccuccc

SEQ ID NO: 2057815 - RNA, 13 nt, Human
ugacacugagaac

SEQ ID NO: 2057816 - RNA, 21 nt, Human
ugacauuaacaguuuuccaug

SEQ ID NO: 2057817 - RNA, 17 nt, Human
ugacauuaacaguuuuc

SEQ ID NO: 2057818 - RNA, 19 nt, Human
ugacauuaacaguuuucca

SEQ ID NO: 2057819 - RNA, 22 nt, Human
ugacauuaacaguuuuccauga

SEQ ID NO: 2057820 - RNA, 13 nt, Human
ugacauuaacagu

SEQ ID NO: 2057821 - RNA, 13 nt, Human
ugaaugcggccca

SEQ ID NO: 2057822 - RNA, 22 nt, Human
ugacagagugagacucugucuc

SEQ ID NO: 2057823 - RNA, 19 nt, Human
ugacagauguugaaugccc

SEQ ID NO: 2057824 - RNA, 15 nt, Human
ugacagaguucacua

SEQ ID NO: 2057825 - RNA, 22 nt, Human
agcaccuacaguguacagucuu

SEQ ID NO: 2057826 - RNA, 17 nt, Human
agcaccuagccucgcuc

SEQ ID NO: 2057827 - RNA, 14 nt, Human
agcaccuacagugu

SEQ ID NO: 2057828 - RNA, 15 nt, Human
agcaccuacagugua

SEQ ID NO: 2057829 - RNA, 19 nt, Human
agcaccuacaguguacagu

SEQ ID NO: 2057830 - RNA, 21 nt, Human
agcaccuacaguguacagucu

SEQ ID NO: 2057831 - RNA, 16 nt, Human
agcaccuccugccucg

SEQ ID NO: 2057832 - RNA, 14 nt, Human
agcaccuccugccu

SEQ ID NO: 2057833 - RNA, 13 nt, Human
agcaccuccugcc

SEQ ID NO: 2057834 - RNA, 13 nt, Human
agcaccucccagc

SEQ ID NO: 2057835 - RNA, 14 nt, Human
agcaccucccagcc

SEQ ID NO: 2057836 - RNA, 16 nt, Human
agcaccucccagcccc

SEQ ID NO: 2057837 - RNA, 17 nt, Human
agcaccucccagccccu

SEQ ID NO: 2057838 - RNA, 18 nt, Human
agcaccucccagccccug

SEQ ID NO: 2057839 - RNA, 22 nt, Human
agcaccucccagccccugcccc

SEQ ID NO: 2057840 - RNA, 20 nt, Human
agcacccagcaacuccaacu

SEQ ID NO: 2057841 - RNA, 20 nt, Human
agcacccccacgcccucauu

SEQ ID NO: 2057842 - RNA, 19 nt, Human
agcaccccaugccaaagcu

SEQ ID NO: 2057843 - RNA, 14 nt, Human
agcaagugaauuuu

SEQ ID NO: 2057844 - RNA, 13 nt, Human
agcaauaaaugaa

SEQ ID NO: 2057845 - RNA, 14 nt, Human
agcaauaaaugaau

SEQ ID NO: 2057846 - RNA, 15 nt, Human
agcaauaaaugaaug

SEQ ID NO: 2057847 - RNA, 17 nt, Human
agcaagugagagcuggg

SEQ ID NO: 2057848 - RNA, 14 nt, Human
agcaagguggagug

SEQ ID NO: 2057849 - RNA, 19 nt, Human
agcaagguggaguggaugc

SEQ ID NO: 2057850 - RNA, 16 nt, Human
agcaauauuuaaggag

SEQ ID NO: 2057851 - RNA, 17 nt, Human
agcaauauuuaaggaga

SEQ ID NO: 2057852 - RNA, 18 nt, Human
agcaauauuuaaggagau

SEQ ID NO: 2057853 - RNA, 21 nt, Human
agcaaucagauuuuccugugg

SEQ ID NO: 2057854 - RNA, 17 nt, Human
agcaauccauguuaguu

SEQ ID NO: 2057855 - RNA, 20 nt, Human
agcaauccauguuaguuuuu

SEQ ID NO: 2057856 - RNA, 21 nt, Human
agcacagcuucauuuccugug

SEQ ID NO: 2057857 - RNA, 22 nt, Human
agcaauccauguuaguuuuuac

SEQ ID NO: 2057858 - RNA, 23 nt, Human
agcaauccauguuaguuuuuacu

SEQ ID NO: 2057859 - RNA, 16 nt, Human
agcaagugagacccug

SEQ ID NO: 2057860 - RNA, 16 nt, Human
agcaagugagagcugg

SEQ ID NO: 2057861 - RNA, 15 nt, Human
agcaagugagagcug

SEQ ID NO: 2057862 - RNA, 15 nt, Human
agcaaggggcucugc

SEQ ID NO: 2057863 - RNA, 16 nt, Human
agcaaggggcucugcc

SEQ ID NO: 2057864 - RNA, 15 nt, Human
agcaaggaucuuuca

SEQ ID NO: 2057865 - RNA, 17 nt, Human
agcaagcuuuuuuauuu

SEQ ID NO: 2057866 - RNA, 16 nt, Human
ugagcauguuacugac

SEQ ID NO: 2057867 - RNA, 21 nt, Human
ugagcauuguggcugucagca

SEQ ID NO: 2057868 - RNA, 13 nt, Human
ugagccacugcac

SEQ ID NO: 2057869 - RNA, 12 nt, Human
ugagccacugca

SEQ ID NO: 2057870 - RNA, 16 nt, Human
ugagcaaaccugcccc

SEQ ID NO: 2057871 - RNA, 17 nt, Human
ugagcaaaccugcccca

SEQ ID NO: 2057872 - RNA, 18 nt, Human
ugagcaaaccugccccau

SEQ ID NO: 2057873 - RNA, 19 nt, Human
ugagcaaaccugccccauc

SEQ ID NO: 2057874 - RNA, 20 nt, Human
ugagcaaaccugccccaucc

SEQ ID NO: 2057875 - RNA, 21 nt, Human
ugagcaaaccugccccauccc

SEQ ID NO: 2057876 - RNA, 18 nt, Human
ugagcaaacuaacuugac

SEQ ID NO: 2057877 - RNA, 15 nt, Human
ugagcauguuacuga

SEQ ID NO: 2057878 - RNA, 14 nt, Human
ugagccacugcacc

SEQ ID NO: 2057879 - RNA, 22 nt, Human
ugagcauuguggcugucagcag

SEQ ID NO: 2057880 - RNA, 23 nt, Human
ugagcauuguggcugucagcagg

SEQ ID NO: 2057881 - RNA, 20 nt, Human
agcaagcauuuauguuuauu

SEQ ID NO: 2057882 - RNA, 14 nt, Human
ugagccaaagagaa

SEQ ID NO: 2057883 - RNA, 21 nt, Human
ugagacagaguuuucacucuu

SEQ ID NO: 2057884 - RNA, 11 nt, Human
ugagacagagu

SEQ ID NO: 2057885 - RNA, 17 nt, Human
ugagaaggaauuugagu

SEQ ID NO: 2057886 - RNA, 16 nt, Human
ugagaagccgugggug

SEQ ID NO: 2057887 - RNA, 17 nt, Human
ugagaagccgugggugg

SEQ ID NO: 2057888 - RNA, 13 nt, Human
agauuuuccugug

SEQ ID NO: 2057889 - RNA, 14 nt, Human
agauuuuccugugg

SEQ ID NO: 2057890 - RNA, 20 nt, Human
ugagacucugucucaaaaaa

SEQ ID NO: 2057891 - RNA, 22 nt, Human
ugagacugcgggaugguccugg

SEQ ID NO: 2057892 - RNA, 23 nt, Human
ugagacugcgggaugguccuggg

SEQ ID NO: 2057893 - RNA, 21 nt, Human
ugagacuggauacugcccggg

SEQ ID NO: 2057894 - RNA, 18 nt, Human
ugagacugggucucgcuu

SEQ ID NO: 2057895 - RNA, 14 nt, Human
ugagacuuuuuggu

SEQ ID NO: 2057896 - RNA, 15 nt, Human
ugagacuuuuuggug

SEQ ID NO: 2057897 - RNA, 22 nt, Human
ugagacuuuuugguggauguaa

SEQ ID NO: 2057898 - RNA, 14 nt, Human
ugagagaauggaaa

SEQ ID NO: 2057899 - RNA, 19 nt, Human
ugagagaauggaaaacaga

SEQ ID NO: 2057900 - RNA, 17 nt, Human
ugagagaucugcuguca

SEQ ID NO: 2057901 - RNA, 23 nt, Human
ugagagcaguuugguuucuagca

SEQ ID NO: 2057902 - RNA, 21 nt, Human
ugagagcaguuugguuucuag

SEQ ID NO: 2057903 - RNA, 23 nt, Human
ugagagaauggaaaacagacuca

SEQ ID NO: 2057904 - RNA, 18 nt, Human
ugagagaauuguaucauu

SEQ ID NO: 2057905 - RNA, 19 nt, Human
ugagagaauuguaucauuu

SEQ ID NO: 2057906 - RNA, 21 nt, Human
ugagagacccaaggaggaaaa

SEQ ID NO: 2057907 - RNA, 20 nt, Human
ugagagacccaaggaggaaa

SEQ ID NO: 2057908 - RNA, 14 nt, Human
ugagagagacaaga

SEQ ID NO: 2057909 - RNA, 15 nt, Human
ugagagagacaagaa

SEQ ID NO: 2057910 - RNA, 14 nt, Human
ugagagcugggugu

SEQ ID NO: 2057911 - RNA, 15 nt, Human
ugagagcgaggcuga

SEQ ID NO: 2057912 - RNA, 19 nt, Human
ugagagcgaggcugagccu

SEQ ID NO: 2057913 - RNA, 20 nt, Human
ugagaggcaaugauuguuaa

SEQ ID NO: 2057914 - RNA, 23 nt, Human
ugagaggacuuuucuuuguggcu

SEQ ID NO: 2057915 - RNA, 12 nt, Human
ugagauggcccu

SEQ ID NO: 2057916 - RNA, 15 nt, Human
ugagauggcccucug

SEQ ID NO: 2057917 - RNA, 16 nt, Human
ugagauggcccucugg

SEQ ID NO: 2057918 - RNA, 17 nt, Human
ugagauggcccucuggu

SEQ ID NO: 2057919 - RNA, 18 nt, Human
ugagauggcccucuggua

SEQ ID NO: 2057920 - RNA, 21 nt, Human
ugagauggaacccuuuuggcc

SEQ ID NO: 2057921 - RNA, 15 nt, Human
ugagauuauuuuaau

SEQ ID NO: 2057922 - RNA, 23 nt, Human
ucuuuuuuuuuuuuuaaagacag

SEQ ID NO: 2057923 - RNA, 16 nt, Human
ucuuuuuuugugaugu

SEQ ID NO: 2057924 - RNA, 14 nt, Human
ucuuuuuuugugau

SEQ ID NO: 2057925 - RNA, 12 nt, Human
ugaaaauacaac

SEQ ID NO: 2057926 - RNA, 19 nt, Human
ugaaaauacaacuuaaaua

SEQ ID NO: 2057927 - RNA, 18 nt, Human
ugaaaauuaacacugcuu

SEQ ID NO: 2057928 - RNA, 14 nt, Human
ugaaaauuaacacu

SEQ ID NO: 2057929 - RNA, 13 nt, Human
ugaaaauguuuuu

SEQ ID NO: 2057930 - RNA, 15 nt, Human
ugaaaauuaacacug

SEQ ID NO: 2057931 - RNA, 16 nt, Human
ugaaaauuaacacugc

SEQ ID NO: 2057932 - RNA, 11 nt, Human
ugaaaauguua

SEQ ID NO: 2057933 - RNA, 18 nt, Human
ugaaaauagguauacagu

SEQ ID NO: 2057934 - RNA, 23 nt, Human
ugaaaauacaacuuaaauaauaa

SEQ ID NO: 2057935 - RNA, 23 nt, Human
ugaaaaugcaacaacauguauaa

SEQ ID NO: 2057936 - RNA, 20 nt, Human
ugaaaaugcaacaacaugua

SEQ ID NO: 2057937 - RNA, 21 nt, Human
ugaaaaugcaacaacauguau

SEQ ID NO: 2057938 - RNA, 18 nt, Human
ugaaaaugcaacaacaug

SEQ ID NO: 2057939 - RNA, 13 nt, Human
ugaaaauccuacc

SEQ ID NO: 2057940 - RNA, 15 nt, Human
ugaaaauccuaccaa

SEQ ID NO: 2057941 - RNA, 20 nt, Human
ugaaaauggaaguggcaaua

SEQ ID NO: 2057942 - RNA, 22 nt, Human
ugaaaauguaaguaaaugucug

SEQ ID NO: 2057943 - RNA, 23 nt, Human
agagacugggaagauaggcucug

SEQ ID NO: 2057944 - RNA, 13 nt, Human
agagacugggaag

SEQ ID NO: 2057945 - RNA, 13 nt, Human
agagacuguagau

SEQ ID NO: 2057946 - RNA, 14 nt, Human
agagacuguagauu

SEQ ID NO: 2057947 - RNA, 15 nt, Human
agagacuguagauug

SEQ ID NO: 2057948 - RNA, 22 nt, Human
agagacuguagauugcuucugu

SEQ ID NO: 2057949 - RNA, 20 nt, Human
agagaccgucgggggcugag

SEQ ID NO: 2057950 - RNA, 21 nt, Human
agagaccgucgggggcugagg

SEQ ID NO: 2057951 - RNA, 13 nt, Human
agagauacagagg

SEQ ID NO: 2057952 - RNA, 19 nt, Human
agagauaccaagaugccau

SEQ ID NO: 2057953 - RNA, 20 nt, Human
agagauaccaagaugccauc

SEQ ID NO: 2057954 - RNA, 22 nt, Human
agagauaccaagaugccaucug

SEQ ID NO: 2057955 - RNA, 14 nt, Human
agagaguuaaucaa

SEQ ID NO: 2057956 - RNA, 15 nt, Human
agagaguuaaucaac

SEQ ID NO: 2057957 - RNA, 22 nt, Human
agagaguuaaucaacugaaagu

SEQ ID NO: 2057958 - RNA, 17 nt, Human
agagaguggcuccuccc

SEQ ID NO: 2057959 - RNA, 13 nt, Human
agagaucugcugu

SEQ ID NO: 2057960 - RNA, 14 nt, Human
agagaucugcuguc

SEQ ID NO: 2057961 - RNA, 19 nt, Human
agagaugaagagugagagg

SEQ ID NO: 2057962 - RNA, 17 nt, Human
agagauauggcagcgaa

SEQ ID NO: 2057963 - RNA, 17 nt, Human
agagaugacugaguccu

SEQ ID NO: 2057964 - RNA, 14 nt, Human
agagaugccuccac

SEQ ID NO: 2057965 - RNA, 12 nt, Human
agagaugccucc

SEQ ID NO: 2057966 - RNA, 12 nt, Human
agagaugaauua

SEQ ID NO: 2057967 - RNA, 18 nt, Human
agagaugacugaguccuc

SEQ ID NO: 2057968 - RNA, 13 nt, Human
agagaugccuccc

SEQ ID NO: 2057969 - RNA, 14 nt, Human
agagaugccucccu

SEQ ID NO: 2057970 - RNA, 16 nt, Human
agagaugccuccaccg

SEQ ID NO: 2057971 - RNA, 17 nt, Human
agagaugccuccaccgc

SEQ ID NO: 2057972 - RNA, 21 nt, Human
agagaugccuccaccgcugcc

SEQ ID NO: 2057973 - RNA, 23 nt, Human
agagaugccuccaccgcugccua

SEQ ID NO: 2057974 - RNA, 17 nt, Human
agagacccuuguuugau

SEQ ID NO: 2057975 - RNA, 16 nt, Human
ugaaagagaaccaguu

SEQ ID NO: 2057976 - RNA, 18 nt, Human
ugaaagagaaccaguuuc

SEQ ID NO: 2057977 - RNA, 12 nt, Human
agagacccaagg

SEQ ID NO: 2057978 - RNA, 13 nt, Human
agagacccaagga

SEQ ID NO: 2057979 - RNA, 14 nt, Human
agagacccaaggag

SEQ ID NO: 2057980 - RNA, 16 nt, Human
agagacccaaggagga

SEQ ID NO: 2057981 - RNA, 21 nt, Human
agagacccaaggaggaaaaac

SEQ ID NO: 2057982 - RNA, 21 nt, Human
agagacccccggaacaagccu

SEQ ID NO: 2057983 - RNA, 13 nt, Human
ugaaagagaacca

SEQ ID NO: 2057984 - RNA, 18 nt, Human
ugaaagacuguacaaagu

SEQ ID NO: 2057985 - RNA, 19 nt, Human
ugaaagacuguacaaagua

SEQ ID NO: 2057986 - RNA, 22 nt, Human
ugaaagacuguacaaaguagaa

SEQ ID NO: 2057987 - RNA, 14 nt, Human
ugaaagaaacaguu

SEQ ID NO: 2057988 - RNA, 20 nt, Human
ugaaagaaacaguuaacuuu

SEQ ID NO: 2057989 - RNA, 22 nt, Human
ugaaagaaacaguuaacuuuca

SEQ ID NO: 2057990 - RNA, 20 nt, Human
ugaaagaaaauaugcaucua

SEQ ID NO: 2057991 - RNA, 16 nt, Human
ugaaagacuguacaaa

SEQ ID NO: 2057992 - RNA, 21 nt, Human
agacucuaggacauaaauuag

SEQ ID NO: 2057993 - RNA, 21 nt, Human
agacuccagcuggguuggaaa

SEQ ID NO: 2057994 - RNA, 16 nt, Human
agacucccaagcugga

SEQ ID NO: 2057995 - RNA, 18 nt, Human
agacuccgucucaaggaa

SEQ ID NO: 2057996 - RNA, 16 nt, Human
agacucugaaaucuca

SEQ ID NO: 2057997 - RNA, 20 nt, Human
agacucugaaaucucagaau

SEQ ID NO: 2057998 - RNA, 11 nt, Human
agacuggccug

SEQ ID NO: 2057999 - RNA, 16 nt, Human
agacuggccugaggag

SEQ ID NO: 2058000 - RNA, 18 nt, Human
agacuggccugaggagca

SEQ ID NO: 2058001 - RNA, 14 nt, Human
agacuggcuggcug

SEQ ID NO: 2058002 - RNA, 20 nt, Human
agacuggcuggcugcaguga

SEQ ID NO: 2058003 - RNA, 21 nt, Human
agacugggaagauaggcucug

SEQ ID NO: 2058004 - RNA, 22 nt, Human
agacugggaagauaggcucugc

SEQ ID NO: 2058005 - RNA, 23 nt, Human
agacugggaagauaggcucugca

SEQ ID NO: 2058006 - RNA, 15 nt, Human
ucuuuaaugucacag

SEQ ID NO: 2058007 - RNA, 22 nt, Human
agacaggcaagcaccuccugcc

SEQ ID NO: 2058008 - RNA, 18 nt, Human
agacaggaccugacuauu

SEQ ID NO: 2058009 - RNA, 14 nt, Human
agacaggagaaaug

SEQ ID NO: 2058010 - RNA, 20 nt, Human
agacaggcaagcaccuccug

SEQ ID NO: 2058011 - RNA, 19 nt, Human
ucuuuaaugucacaggcag

SEQ ID NO: 2058012 - RNA, 18 nt, Human
ucuuuaaugucacaggca

SEQ ID NO: 2058013 - RNA, 20 nt, Human
ucuuucccugcuuaaugaaa

SEQ ID NO: 2058014 - RNA, 19 nt, Human
ucuuucuaaugugugaauc

SEQ ID NO: 2058015 - RNA, 18 nt, Human
ucuuucuccuuagucuuc

SEQ ID NO: 2058016 - RNA, 21 nt, Human
ucuuucuccuuagucuucuca

SEQ ID NO: 2058017 - RNA, 24 nt, Human
ucuuucuccuuagucuucucauag

SEQ ID NO: 2058018 - RNA, 14 nt, Human
ucuuuguggcuucc

SEQ ID NO: 2058019 - RNA, 23 nt, Human
ucuuuguaaugucaccaccuucc

SEQ ID NO: 2058020 - RNA, 14 nt, Human
ucuuuguaauuauu

SEQ ID NO: 2058021 - RNA, 21 nt, Human
agagacaccugcaccuccccc

SEQ ID NO: 2058022 - RNA, 22 nt, Human
agagacaccugcaccucccccc

SEQ ID NO: 2058023 - RNA, 13 nt, Human
agagacaccugca

SEQ ID NO: 2058024 - RNA, 14 nt, Human
agagacaccugcac

SEQ ID NO: 2058025 - RNA, 15 nt, Human
agagacaccugcacc

SEQ ID NO: 2058026 - RNA, 16 nt, Human
agagacaccugcaccu

SEQ ID NO: 2058027 - RNA, 18 nt, Human
agagacaccugcaccucc

SEQ ID NO: 2058028 - RNA, 19 nt, Human
agagacaccugcaccuccc

SEQ ID NO: 2058029 - RNA, 20 nt, Human
agagacaccugcaccucccc

SEQ ID NO: 2058030 - RNA, 14 nt, Human
agacuguacaaagu

SEQ ID NO: 2058031 - RNA, 18 nt, Human
agacuggugagcagacug

SEQ ID NO: 2058032 - RNA, 23 nt, Human
agacuggugagcagacugguggg

SEQ ID NO: 2058033 - RNA, 20 nt, Human
ugaagaauuauuuuuuuucu

SEQ ID NO: 2058034 - RNA, 21 nt, Human
ugaagaauuauuuuuuuucuu

SEQ ID NO: 2058035 - RNA, 13 nt, Human
ugaagaacaguaa

SEQ ID NO: 2058036 - RNA, 11 nt, Human
ugaacuccugg

SEQ ID NO: 2058037 - RNA, 15 nt, Human
ugaagaacaguaacu

SEQ ID NO: 2058038 - RNA, 20 nt, Human
ugaagaacaguaacugccau

SEQ ID NO: 2058039 - RNA, 16 nt, Human
ugaacggggagaaaag

SEQ ID NO: 2058040 - RNA, 13 nt, Human
ugaacggccuugc

SEQ ID NO: 2058041 - RNA, 14 nt, Human
ugaacggccuugcu

SEQ ID NO: 2058042 - RNA, 13 nt, Human
ugaacggggagaa

SEQ ID NO: 2058043 - RNA, 15 nt, Human
ugaacggggagaaaa

SEQ ID NO: 2058044 - RNA, 15 nt, Human
ugaacggugagcauu

SEQ ID NO: 2058045 - RNA, 16 nt, Human
ugaacuaauaaaagca

SEQ ID NO: 2058046 - RNA, 13 nt, Human
ugaacccaggagg

SEQ ID NO: 2058047 - RNA, 14 nt, Human
ugaacccaggaggu

SEQ ID NO: 2058048 - RNA, 19 nt, Human
ugaacccaggagguggagg

SEQ ID NO: 2058049 - RNA, 13 nt, Human
ugaacccuugcuu

SEQ ID NO: 2058050 - RNA, 15 nt, Human
ugaacccuugcuugc

SEQ ID NO: 2058051 - RNA, 21 nt, Human
ugaaccaucauuauaaacgug

SEQ ID NO: 2058052 - RNA, 12 nt, Human
ugaacccaggag

SEQ ID NO: 2058053 - RNA, 22 nt, Human
ugaaccaccacacccagcccac

SEQ ID NO: 2058054 - RNA, 21 nt, Human
ugaaccaccacacccagccca

SEQ ID NO: 2058055 - RNA, 16 nt, Human
agagauugugguuuca

SEQ ID NO: 2058056 - RNA, 16 nt, Human
agagaugccucccuga

SEQ ID NO: 2058057 - RNA, 12 nt, Human
agagauggagga

SEQ ID NO: 2058058 - RNA, 13 nt, Human
agagauggaggag

SEQ ID NO: 2058059 - RNA, 14 nt, Human
agagauggaggagg

SEQ ID NO: 2058060 - RNA, 15 nt, Human
agagauggaggagga

SEQ ID NO: 2058061 - RNA, 13 nt, Human
ugaaauacuacuu

SEQ ID NO: 2058062 - RNA, 21 nt, Human
ugaaauaccaaccugaagaca

SEQ ID NO: 2058063 - RNA, 14 nt, Human
ugaaauaccagugu

SEQ ID NO: 2058064 - RNA, 16 nt, Human
ugaaauaccagugugg

SEQ ID NO: 2058065 - RNA, 22 nt, Human
ugaaauuuaauauagcuauuuu

SEQ ID NO: 2058066 - RNA, 13 nt, Human
ugaaauagucugu

SEQ ID NO: 2058067 - RNA, 16 nt, Human
ugaaauagucugugug

SEQ ID NO: 2058068 - RNA, 17 nt, Human
ugaaauagucuguguga

SEQ ID NO: 2058069 - RNA, 18 nt, Human
ugaaauagucugugugaa

SEQ ID NO: 2058070 - RNA, 20 nt, Human
ugaaauuuuuauuaaauuau

SEQ ID NO: 2058071 - RNA, 19 nt, Human
ugaaauuuuuauuaaauua

SEQ ID NO: 2058072 - RNA, 13 nt, Human
ugaaauaagagaa

SEQ ID NO: 2058073 - RNA, 14 nt, Human
ugaacaaaaaaaug

SEQ ID NO: 2058074 - RNA, 18 nt, Human
ugaacaaaaaauaaaaau

SEQ ID NO: 2058075 - RNA, 15 nt, Human
ugaaguaagcaaaga

SEQ ID NO: 2058076 - RNA, 14 nt, Human
ugaaguaaugaauu

SEQ ID NO: 2058077 - RNA, 20 nt, Human
ugaaguaaugaauuuuuaug

SEQ ID NO: 2058078 - RNA, 13 nt, Human
ugaaguacauauu

SEQ ID NO: 2058079 - RNA, 20 nt, Human
ugaaguacauauuaggaaaa

SEQ ID NO: 2058080 - RNA, 15 nt, Human
ugaaguauacuguau

SEQ ID NO: 2058081 - RNA, 13 nt, Human
ugaagucacacag

SEQ ID NO: 2058082 - RNA, 19 nt, Human
ugaauaaauucuauaggaa

SEQ ID NO: 2058083 - RNA, 21 nt, Human
ugaauaaauucuauaggaaca

SEQ ID NO: 2058084 - RNA, 15 nt, Human
ugaauaaccacuuaa

SEQ ID NO: 2058085 - RNA, 12 nt, Human
ugaauaauacag

SEQ ID NO: 2058086 - RNA, 14 nt, Human
ugaauaauuuccca

SEQ ID NO: 2058087 - RNA, 15 nt, Human
ugaauaauuucccaa

SEQ ID NO: 2058088 - RNA, 22 nt, Human
ugaauaauuucccaauuaggaa

SEQ ID NO: 2058089 - RNA, 13 nt, Human
ugaauaauacagu

SEQ ID NO: 2058090 - RNA, 23 nt, Human
ugaauauuugucgauauuuccau

SEQ ID NO: 2058091 - RNA, 11 nt, Human
ugaauauuuau

SEQ ID NO: 2058092 - RNA, 17 nt, Human
ugaauauuuauaacagc

SEQ ID NO: 2058093 - RNA, 18 nt, Human
ugaauauuuauaacagca

SEQ ID NO: 2058094 - RNA, 19 nt, Human
ugaauauuuauaacagcau

SEQ ID NO: 2058095 - RNA, 19 nt, Human
ugaauauuuauauuucacu

SEQ ID NO: 2058096 - RNA, 19 nt, Human
ugaauacagggcaugcauu

SEQ ID NO: 2058097 - RNA, 20 nt, Human
ugaauauuuauauuucacua

SEQ ID NO: 2058098 - RNA, 17 nt, Human
ugaaguaacuugucuua

SEQ ID NO: 2058099 - RNA, 18 nt, Human
ugaaguaacuugucuuaa

SEQ ID NO: 2058100 - RNA, 19 nt, Human
ugaaguaacuugucuuaaa

SEQ ID NO: 2058101 - RNA, 14 nt, Human
ugaaguaagcaaag

SEQ ID NO: 2058102 - RNA, 13 nt, Human
ugaaguaagcaaa

SEQ ID NO: 2058103 - RNA, 13 nt, Human
ugaagcaaacaca

SEQ ID NO: 2058104 - RNA, 15 nt, Human
ugaagcaaacacauu

SEQ ID NO: 2058105 - RNA, 14 nt, Human
ugaagcaaacacau

SEQ ID NO: 2058106 - RNA, 23 nt, Human
ugaagggaaggaagaggaagagu

SEQ ID NO: 2058107 - RNA, 14 nt, Human
ugaagggagagcca

SEQ ID NO: 2058108 - RNA, 18 nt, Human
ugaagggaaaggauauuu

SEQ ID NO: 2058109 - RNA, 21 nt, Human
ugaagggaaaggauauuuucu

SEQ ID NO: 2058110 - RNA, 22 nt, Human
ugaagggaaaggauauuuucuu

SEQ ID NO: 2058111 - RNA, 18 nt, Human
ugaagguuucugaaaauu

SEQ ID NO: 2058112 - RNA, 16 nt, Human
ugaagggagagccagc

SEQ ID NO: 2058113 - RNA, 17 nt, Human
ugaagggagagccagcu

SEQ ID NO: 2058114 - RNA, 19 nt, Human
ugaagggagagccagcucc

SEQ ID NO: 2058115 - RNA, 15 nt, Human
agaguaaaaacugaa

SEQ ID NO: 2058116 - RNA, 15 nt, Human
agaguaagcugcuuu

SEQ ID NO: 2058117 - RNA, 16 nt, Human
agaguaagcugcuuuu

SEQ ID NO: 2058118 - RNA, 22 nt, Human
agagggaugaggugcugggagg

SEQ ID NO: 2058119 - RNA, 23 nt, Human
agagggaugaggugcugggaggg

SEQ ID NO: 2058120 - RNA, 15 nt, Human
agagggagugacaga

SEQ ID NO: 2058121 - RNA, 16 nt, Human
agaggcuggaggcagg

SEQ ID NO: 2058122 - RNA, 20 nt, Human
agagggagugacagaggcag

SEQ ID NO: 2058123 - RNA, 22 nt, Human
agaggcugccucucccaucacu

SEQ ID NO: 2058124 - RNA, 17 nt, Human
agagcuggugucugauu

SEQ ID NO: 2058125 - RNA, 16 nt, Human
agagcugguugggaag

SEQ ID NO: 2058126 - RNA, 22 nt, Human
agagcugguugggaagacaugg

SEQ ID NO: 2058127 - RNA, 11 nt, Human
agagcuggugu

SEQ ID NO: 2058128 - RNA, 15 nt, Human
agagcuggugucuga

SEQ ID NO: 2058129 - RNA, 23 nt, Human
agaggcagccccauucugccugc

SEQ ID NO: 2058130 - RNA, 21 nt, Human
agaggcagggucucacucugu

SEQ ID NO: 2058131 - RNA, 22 nt, Human
agaggcagccccauucugccug

SEQ ID NO: 2058132 - RNA, 21 nt, Human
agaggcagccccauucugccu

SEQ ID NO: 2058133 - RNA, 13 nt, Human
agaggccaaugcc

SEQ ID NO: 2058134 - RNA, 14 nt, Human
agaggccagccugg

SEQ ID NO: 2058135 - RNA, 23 nt, Human
agaggccagccccacccaggagg

SEQ ID NO: 2058136 - RNA, 15 nt, Human
agaggccagccuggc

SEQ ID NO: 2058137 - RNA, 19 nt, Human
agaggccaugauucgccca

SEQ ID NO: 2058138 - RNA, 16 nt, Human
agaggccagccccacc

SEQ ID NO: 2058139 - RNA, 17 nt, Human
agaggccagccccaccc

SEQ ID NO: 2058140 - RNA, 18 nt, Human
agaggccagccccaccca

SEQ ID NO: 2058141 - RNA, 21 nt, Human
agaggccagccccacccagga

SEQ ID NO: 2058142 - RNA, 17 nt, Human
aguagcuggauuacagg

SEQ ID NO: 2058143 - RNA, 22 nt, Human
aguagcugggacuacaggcacc

SEQ ID NO: 2058144 - RNA, 21 nt, Human
aguagcugggacuacaggcac

SEQ ID NO: 2058145 - RNA, 19 nt, Human
aguagcugggacuacaggc

SEQ ID NO: 2058146 - RNA, 14 nt, Human
aguauguucaaagu

SEQ ID NO: 2058147 - RNA, 20 nt, Human
aguauuauaggccaaacugg

SEQ ID NO: 2058148 - RNA, 14 nt, Human
agucacaucacagg

SEQ ID NO: 2058149 - RNA, 17 nt, Human
agucacucaauuguuuu

SEQ ID NO: 2058150 - RNA, 15 nt, Human
agucacaucacagga

SEQ ID NO: 2058151 - RNA, 15 nt, Human
ugucagcauagaagu

SEQ ID NO: 2058152 - RNA, 22 nt, Human
agucacagagauaauucuagcu

SEQ ID NO: 2058153 - RNA, 21 nt, Human
uguauuaaguuguuaauaaaa

SEQ ID NO: 2058154 - RNA, 15 nt, Human
uguauuacauaaaua

SEQ ID NO: 2058155 - RNA, 18 nt, Human
uguauuacauaaauaaau

SEQ ID NO: 2058156 - RNA, 21 nt, Human
uguauuacauaaauaaauuaa

SEQ ID NO: 2058157 - RNA, 15 nt, Human
uguauuagucacaga

SEQ ID NO: 2058158 - RNA, 18 nt, Human
uguauuaggacuggcuuu

SEQ ID NO: 2058159 - RNA, 19 nt, Human
uguauuaggacuggcuuug

SEQ ID NO: 2058160 - RNA, 23 nt, Human
uguauuaggacuggcuuuguccc

SEQ ID NO: 2058161 - RNA, 21 nt, Human
uguauuaggugucauuuccau

SEQ ID NO: 2058162 - RNA, 18 nt, Human
ugucaaacuguagaaaug

SEQ ID NO: 2058163 - RNA, 14 nt, Human
uguauuauaacagu

SEQ ID NO: 2058164 - RNA, 15 nt, Human
uguauuauaacagug

SEQ ID NO: 2058165 - RNA, 14 nt, Human
ugucaaagaaucaa

SEQ ID NO: 2058166 - RNA, 15 nt, Human
ugucaacuaugauau

SEQ ID NO: 2058167 - RNA, 15 nt, Human
ugucaacuuuaugca

SEQ ID NO: 2058168 - RNA, 14 nt, Human
aguagcugggacua

SEQ ID NO: 2058169 - RNA, 13 nt, Human
aguagcugggacu

SEQ ID NO: 2058170 - RNA, 15 nt, Human
uguagagccaggguc

SEQ ID NO: 2058171 - RNA, 12 nt, Human
uguagagccagg

SEQ ID NO: 2058172 - RNA, 16 nt, Human
uguagagcagggcaag

SEQ ID NO: 2058173 - RNA, 20 nt, Human
agguuuguauauugucagau

SEQ ID NO: 2058174 - RNA, 13 nt, Human
agguuuguauauu

SEQ ID NO: 2058175 - RNA, 16 nt, Human
uguauccaugggggca

SEQ ID NO: 2058176 - RNA, 19 nt, Human
uguauccaugggggcaggg

SEQ ID NO: 2058177 - RNA, 12 nt, Human
agguuuguauau

SEQ ID NO: 2058178 - RNA, 16 nt, Human
uguaucccaugagccu

SEQ ID NO: 2058179 - RNA, 15 nt, Human
uguaucccaugagcc

SEQ ID NO: 2058180 - RNA, 14 nt, Human
uguauguguaagua

SEQ ID NO: 2058181 - RNA, 17 nt, Human
uguccugguuagcagag

SEQ ID NO: 2058182 - RNA, 20 nt, Human
uguccuuacccaucugcacc

SEQ ID NO: 2058183 - RNA, 18 nt, Human
ugucccuuucuuggccag

SEQ ID NO: 2058184 - RNA, 16 nt, Human
ugucccuuucuuggcc

SEQ ID NO: 2058185 - RNA, 17 nt, Human
ugucccuuucuuggcca

SEQ ID NO: 2058186 - RNA, 20 nt, Human
ugucccuuucugugugaaga

SEQ ID NO: 2058187 - RNA, 14 nt, Human
ugucccugcacuug

SEQ ID NO: 2058188 - RNA, 21 nt, Human
ugucccuaguaaaaauacaaa

SEQ ID NO: 2058189 - RNA, 14 nt, Human
ugucccuaggucag

SEQ ID NO: 2058190 - RNA, 17 nt, Human
ugucccuaugcauauca

SEQ ID NO: 2058191 - RNA, 21 nt, Human
ugucccucacuguugaauuuu

SEQ ID NO: 2058192 - RNA, 11 nt, Human
ugucccucuca

SEQ ID NO: 2058193 - RNA, 14 nt, Human
ugucccucucaggc

SEQ ID NO: 2058194 - RNA, 21 nt, Human
ugucccucucggaaggcuggc

SEQ ID NO: 2058195 - RNA, 15 nt, Human
ugucccucucaggca

SEQ ID NO: 2058196 - RNA, 15 nt, Human
ugucccucucucugg

SEQ ID NO: 2058197 - RNA, 16 nt, Human
ugucccucucucugga

SEQ ID NO: 2058198 - RNA, 22 nt, Human
ugucccuaccgagucucuucuc

SEQ ID NO: 2058199 - RNA, 21 nt, Human
ugucccuaccgagucucuucu

SEQ ID NO: 2058200 - RNA, 20 nt, Human
ugucccuaccgagucucuuc

SEQ ID NO: 2058201 - RNA, 13 nt, Human
uguccagggcccu

SEQ ID NO: 2058202 - RNA, 19 nt, Human
ugucccuacaccccucccc

SEQ ID NO: 2058203 - RNA, 21 nt, Human
uguccaggcacugcugcccag

SEQ ID NO: 2058204 - RNA, 20 nt, Human
uguccaggcacugcugccca

SEQ ID NO: 2058205 - RNA, 19 nt, Human
uguccaggcacugcugccc

SEQ ID NO: 2058206 - RNA, 15 nt, Human
uguccaccuggcccc

SEQ ID NO: 2058207 - RNA, 17 nt, Human
uguccacccccgccucc

SEQ ID NO: 2058208 - RNA, 11 nt, Human
uguccaccugg

SEQ ID NO: 2058209 - RNA, 12 nt, Human
uguccaccuggc

SEQ ID NO: 2058210 - RNA, 13 nt, Human
uguccaccuggcc

SEQ ID NO: 2058211 - RNA, 14 nt, Human
uguccaccuggccc

SEQ ID NO: 2058212 - RNA, 18 nt, Human
ugucagcuacuaaugaug

SEQ ID NO: 2058213 - RNA, 19 nt, Human
ugucagcuacuaaugaugu

SEQ ID NO: 2058214 - RNA, 21 nt, Human
ugucagcuacuaaugauguuu

SEQ ID NO: 2058215 - RNA, 18 nt, Human
ugucagcaucuucucacu

SEQ ID NO: 2058216 - RNA, 20 nt, Human
uguccacagaugccuccacc

SEQ ID NO: 2058217 - RNA, 17 nt, Human
uguccacauagguuuag

SEQ ID NO: 2058218 - RNA, 14 nt, Human
uguccacagaugcc

SEQ ID NO: 2058219 - RNA, 18 nt, Human
uguccacagaugccucca

SEQ ID NO: 2058220 - RNA, 19 nt, Human
uguccacagaugccuccac

SEQ ID NO: 2058221 - RNA, 20 nt, Human
agucccaccuuggcugcagg

SEQ ID NO: 2058222 - RNA, 23 nt, Human
agucccaccuuggcugcagggag

SEQ ID NO: 2058223 - RNA, 21 nt, Human
agucccaccuuggcugcaggg

SEQ ID NO: 2058224 - RNA, 21 nt, Human
aguccauauuucaauuuccaa

SEQ ID NO: 2058225 - RNA, 15 nt, Human
aguccagucucuucu

SEQ ID NO: 2058226 - RNA, 21 nt, Human
agucaucuugaccaagcagga

SEQ ID NO: 2058227 - RNA, 17 nt, Human
aguccaggucgggcuca

SEQ ID NO: 2058228 - RNA, 18 nt, Human
aguccaggucgggcucag

SEQ ID NO: 2058229 - RNA, 21 nt, Human
aguccaggucgggcucagcuc

SEQ ID NO: 2058230 - RNA, 22 nt, Human
aguccaggucgggcucagcucu

SEQ ID NO: 2058231 - RNA, 23 nt, Human
aguccaggucgggcucagcucug

SEQ ID NO: 2058232 - RNA, 20 nt, Human
agucaucuugaccaagcagg

SEQ ID NO: 2058233 - RNA, 14 nt, Human
agucaugaacacau

SEQ ID NO: 2058234 - RNA, 19 nt, Human
agucaugaacacaucagcu

SEQ ID NO: 2058235 - RNA, 22 nt, Human
agucaugaacacaucagcuagc

SEQ ID NO: 2058236 - RNA, 13 nt, Human
agucaugaagccc

SEQ ID NO: 2058237 - RNA, 14 nt, Human
agucaugaagccca

SEQ ID NO: 2058238 - RNA, 21 nt, Human
agucaugaagcccaagugaaa

SEQ ID NO: 2058239 - RNA, 13 nt, Human
aguccccaggccc

SEQ ID NO: 2058240 - RNA, 16 nt, Human
aguccccaggccccag

SEQ ID NO: 2058241 - RNA, 17 nt, Human
aguccccaggccccagg

SEQ ID NO: 2058242 - RNA, 19 nt, Human
aguccccaggccccaggaa

SEQ ID NO: 2058243 - RNA, 21 nt, Human
aguccccaggccccaggaagc

SEQ ID NO: 2058244 - RNA, 23 nt, Human
aguccauauuucaauuuccaaga

SEQ ID NO: 2058245 - RNA, 13 nt, Human
uguccuuucccuc

SEQ ID NO: 2058246 - RNA, 17 nt, Human
uguccuuucccuccacu

SEQ ID NO: 2058247 - RNA, 21 nt, Human
uguccuucucucaccuccuaa

SEQ ID NO: 2058248 - RNA, 18 nt, Human
uguccuucucucaccucc

SEQ ID NO: 2058249 - RNA, 19 nt, Human
uguccuucucucaccuccu

SEQ ID NO: 2058250 - RNA, 14 nt, Human
uguccuuggggaca

SEQ ID NO: 2058251 - RNA, 13 nt, Human
uguccuugcaccu

SEQ ID NO: 2058252 - RNA, 15 nt, Human
uguccuugcaccugc

SEQ ID NO: 2058253 - RNA, 16 nt, Human
uguccuugcaccugca

SEQ ID NO: 2058254 - RNA, 14 nt, Human
agucagguccaauu

SEQ ID NO: 2058255 - RNA, 14 nt, Human
agucagaugcccag

SEQ ID NO: 2058256 - RNA, 23 nt, Human
agucagaugcccagagggcccag

SEQ ID NO: 2058257 - RNA, 21 nt, Human
agucagucaugauggcaccac

SEQ ID NO: 2058258 - RNA, 19 nt, Human
agucagucugcacuuaaau

SEQ ID NO: 2058259 - RNA, 20 nt, Human
agucagugcccaacuguuau

SEQ ID NO: 2058260 - RNA, 18 nt, Human
agucaucguaggugauuu

SEQ ID NO: 2058261 - RNA, 22 nt, Human
agucaucguaggugauuugaag

SEQ ID NO: 2058262 - RNA, 14 nt, Human
agucaucucaacca

SEQ ID NO: 2058263 - RNA, 15 nt, Human
agucaucucaaccau

SEQ ID NO: 2058264 - RNA, 17 nt, Human
agucaucuccaucagcu

SEQ ID NO: 2058265 - RNA, 18 nt, Human
agucaucuccaucagcug

SEQ ID NO: 2058266 - RNA, 19 nt, Human
agucaucuccaucagcugu

SEQ ID NO: 2058267 - RNA, 20 nt, Human
agucaucuccaucagcugua

SEQ ID NO: 2058268 - RNA, 18 nt, Human
ugucuuguguuucuuuag

SEQ ID NO: 2058269 - RNA, 16 nt, Human
ugucuuguguuuuugu

SEQ ID NO: 2058270 - RNA, 21 nt, Human
ugucuuguguuuuugucuuau

SEQ ID NO: 2058271 - RNA, 15 nt, Human
ugucuuguuaauauu

SEQ ID NO: 2058272 - RNA, 17 nt, Human
ugucuuguuaauauucu

SEQ ID NO: 2058273 - RNA, 18 nt, Human
ugucuuguuaauauucuu

SEQ ID NO: 2058274 - RNA, 19 nt, Human
ugucuuguuaauauucuuu

SEQ ID NO: 2058275 - RNA, 23 nt, Human
ugucuugcuauggggagaaaaga

SEQ ID NO: 2058276 - RNA, 15 nt, Human
ugugaaccaccacac

SEQ ID NO: 2058277 - RNA, 12 nt, Human
ugucuuuauaug

SEQ ID NO: 2058278 - RNA, 15 nt, Human
ugucuuucagauaca

SEQ ID NO: 2058279 - RNA, 16 nt, Human
ugucuuucagauacau

SEQ ID NO: 2058280 - RNA, 14 nt, Human
ugucuuuaaggaaa

SEQ ID NO: 2058281 - RNA, 15 nt, Human
ugucuuuaaggaaaa

SEQ ID NO: 2058282 - RNA, 19 nt, Human
ugucuuuaggcagcagcuu

SEQ ID NO: 2058283 - RNA, 21 nt, Human
ugucuuuaggcagcagcuuuu

SEQ ID NO: 2058284 - RNA, 23 nt, Human
ugugaaccaccacacccagccca

SEQ ID NO: 2058285 - RNA, 22 nt, Human
ugugaaccaccacacccagccc

SEQ ID NO: 2058286 - RNA, 17 nt, Human
ugugaaccaccacaccc

SEQ ID NO: 2058287 - RNA, 16 nt, Human
ugugaaccaccacacc

SEQ ID NO: 2058288 - RNA, 19 nt, Human
ugucuuucagauacauggu

SEQ ID NO: 2058289 - RNA, 20 nt, Human
ugucuuucagauacaugguu

SEQ ID NO: 2058290 - RNA, 21 nt, Human
ugugaacgauuuagaaagaag

SEQ ID NO: 2058291 - RNA, 13 nt, Human
ugucuuccugcau

SEQ ID NO: 2058292 - RNA, 17 nt, Human
ugucuuccugcauucac

SEQ ID NO: 2058293 - RNA, 18 nt, Human
ugucuuccugcauucacc

SEQ ID NO: 2058294 - RNA, 16 nt, Human
ugucuucucaggcucu

SEQ ID NO: 2058295 - RNA, 21 nt, Human
ugucuucucaggcucugcccu

SEQ ID NO: 2058296 - RNA, 22 nt, Human
ugucuucucaggcucugcccug

SEQ ID NO: 2058297 - RNA, 20 nt, Human
ugucuucaauuuguauaaaa

SEQ ID NO: 2058298 - RNA, 21 nt, Human
ugucuucaauuuguauaaaau

SEQ ID NO: 2058299 - RNA, 19 nt, Human
ugucuucacagcucugugu

SEQ ID NO: 2058300 - RNA, 15 nt, Human
ugucuucauagcaga

SEQ ID NO: 2058301 - RNA, 19 nt, Human
ugucuucauccuuagcaac

SEQ ID NO: 2058302 - RNA, 21 nt, Human
ugucuucauccuuagcaacag

SEQ ID NO: 2058303 - RNA, 12 nt, Human
ugucuuccauaa

SEQ ID NO: 2058304 - RNA, 13 nt, Human
ugucuuccauaau

SEQ ID NO: 2058305 - RNA, 14 nt, Human
ugucuuccauaaug

SEQ ID NO: 2058306 - RNA, 17 nt, Human
ugucuuccauaauguau

SEQ ID NO: 2058307 - RNA, 21 nt, Human
ugucuugcaauggcagccuug

SEQ ID NO: 2058308 - RNA, 20 nt, Human
ugucuugcaauggcagccuu

SEQ ID NO: 2058309 - RNA, 18 nt, Human
ugucuugcaauggcagcc

SEQ ID NO: 2058310 - RNA, 17 nt, Human
ugucuugcaauggcagc

SEQ ID NO: 2058311 - RNA, 23 nt, Human
ugucuucucaggcucugcccugc

SEQ ID NO: 2058312 - RNA, 15 nt, Human
ugucuugcaauggca

SEQ ID NO: 2058313 - RNA, 21 nt, Human
ugucucgugguaggacuguag

SEQ ID NO: 2058314 - RNA, 18 nt, Human
ugucucgugguaggacug

SEQ ID NO: 2058315 - RNA, 19 nt, Human
ugucucgugguaggacugu

SEQ ID NO: 2058316 - RNA, 20 nt, Human
ugucucgugguaggacugua

SEQ ID NO: 2058317 - RNA, 13 nt, Human
ugucucucagaau

SEQ ID NO: 2058318 - RNA, 12 nt, Human
agucccugcccc

SEQ ID NO: 2058319 - RNA, 15 nt, Human
ugucuccucucucug

SEQ ID NO: 2058320 - RNA, 13 nt, Human
agucccgucagga

SEQ ID NO: 2058321 - RNA, 11 nt, Human
ugucuccugca

SEQ ID NO: 2058322 - RNA, 19 nt, Human
ugucuccuuugcaggcuca

SEQ ID NO: 2058323 - RNA, 14 nt, Human
ugucuuauuuuuag

SEQ ID NO: 2058324 - RNA, 15 nt, Human
ugucuuauuuuuaga

SEQ ID NO: 2058325 - RNA, 16 nt, Human
ugucuuauuuuuagau

SEQ ID NO: 2058326 - RNA, 17 nt, Human
ugucuuauuuuuagaug

SEQ ID NO: 2058327 - RNA, 23 nt, Human
ugucuuauuuuuagaugguuaca

SEQ ID NO: 2058328 - RNA, 13 nt, Human
ugucuuaauuaag

SEQ ID NO: 2058329 - RNA, 14 nt, Human
ugucuuaauuaagu

SEQ ID NO: 2058330 - RNA, 16 nt, Human
ugucuuaauuaaguaa

SEQ ID NO: 2058331 - RNA, 18 nt, Human
ugucuuaauuaaguaaac

SEQ ID NO: 2058332 - RNA, 20 nt, Human
ugucuuaauuaaguaaacua

SEQ ID NO: 2058333 - RNA, 21 nt, Human
ugucuuaauuaaguaaacuaa

SEQ ID NO: 2058334 - RNA, 22 nt, Human
ugucuuaauuaaguaaacuaau

SEQ ID NO: 2058335 - RNA, 21 nt, Human
ugucucuuuaaugucacaggc

SEQ ID NO: 2058336 - RNA, 22 nt, Human
ugucucuuuaaugucacaggca

SEQ ID NO: 2058337 - RNA, 18 nt, Human
ugucucuuuucucuuucu

SEQ ID NO: 2058338 - RNA, 14 nt, Human
ugucucuuuucucu

SEQ ID NO: 2058339 - RNA, 23 nt, Human
ugucucugggcuuggggcuuccu

SEQ ID NO: 2058340 - RNA, 20 nt, Human
ugucucuuaaaaaaauaaaa

SEQ ID NO: 2058341 - RNA, 18 nt, Human
ugucucuggcgugugggu

SEQ ID NO: 2058342 - RNA, 19 nt, Human
ugucucuggcgugugggua

SEQ ID NO: 2058343 - RNA, 15 nt, Human
agucuuuuccaugaa

SEQ ID NO: 2058344 - RNA, 13 nt, Human
agucuuuuccaug

SEQ ID NO: 2058345 - RNA, 20 nt, Human
agucuucucauagcauuaac

SEQ ID NO: 2058346 - RNA, 21 nt, Human
agucuucucauagcauuaacu

SEQ ID NO: 2058347 - RNA, 12 nt, Human
agucuucucaua

SEQ ID NO: 2058348 - RNA, 13 nt, Human
agucuucucauag

SEQ ID NO: 2058349 - RNA, 18 nt, Human
agucuucucauagcauua

SEQ ID NO: 2058350 - RNA, 11 nt, Human
agugaaaaagg

SEQ ID NO: 2058351 - RNA, 17 nt, Human
agugaaaaaggaggaag

SEQ ID NO: 2058352 - RNA, 20 nt, Human
agugaaaaaggaggaagaga

SEQ ID NO: 2058353 - RNA, 23 nt, Human
agugaaaaaggaggaagagaaaa

SEQ ID NO: 2058354 - RNA, 17 nt, Human
agucuucccuagggcug

SEQ ID NO: 2058355 - RNA, 18 nt, Human
agucuucccuagggcugg

SEQ ID NO: 2058356 - RNA, 19 nt, Human
agucuucccuagggcuggg

SEQ ID NO: 2058357 - RNA, 20 nt, Human
agucuucccuagggcugggu

SEQ ID NO: 2058358 - RNA, 22 nt, Human
agucuucccuagggcugggugu

SEQ ID NO: 2058359 - RNA, 13 nt, Human
agucuucccugau

SEQ ID NO: 2058360 - RNA, 12 nt, Human
agucucugugaa

SEQ ID NO: 2058361 - RNA, 11 nt, Human
agucucuguga

SEQ ID NO: 2058362 - RNA, 16 nt, Human
agucucugcuggccca

SEQ ID NO: 2058363 - RNA, 17 nt, Human
agucucugcuggcccag

SEQ ID NO: 2058364 - RNA, 17 nt, Human
agucuuaacauuucuaa

SEQ ID NO: 2058365 - RNA, 24 nt, Human
agucuuagacuugaaauacuacuu

SEQ ID NO: 2058366 - RNA, 12 nt, Human
agucuccagccc

SEQ ID NO: 2058367 - RNA, 18 nt, Human
agucuccagcccacguuc

SEQ ID NO: 2058368 - RNA, 14 nt, Human
ugugagccagucua

SEQ ID NO: 2058369 - RNA, 14 nt, Human
ugugaagauguuug

SEQ ID NO: 2058370 - RNA, 16 nt, Human
ugugaagauguuugca

SEQ ID NO: 2058371 - RNA, 17 nt, Human
ugugaagauguuugcaa

SEQ ID NO: 2058372 - RNA, 22 nt, Human
ugugaagaugauauacuauuuu

SEQ ID NO: 2058373 - RNA, 18 nt, Human
ugugaagagggagaagca

SEQ ID NO: 2058374 - RNA, 22 nt, Human
ugugaagaucacguuccuuccc

SEQ ID NO: 2058375 - RNA, 14 nt, Human
ugugagcaagaagu

SEQ ID NO: 2058376 - RNA, 19 nt, Human
ugugagcaagcauuuaugu

SEQ ID NO: 2058377 - RNA, 12 nt, Human
agugagcaugcu

SEQ ID NO: 2058378 - RNA, 21 nt, Human
agugagcaugcuuucugaacu

SEQ ID NO: 2058379 - RNA, 13 nt, Human
agugagagagaca

SEQ ID NO: 2058380 - RNA, 18 nt, Human
agugagagagacaagaag

SEQ ID NO: 2058381 - RNA, 14 nt, Human
agugagagcugggu

SEQ ID NO: 2058382 - RNA, 12 nt, Human
agugaaaacuag

SEQ ID NO: 2058383 - RNA, 14 nt, Human
agugaaaauaggua

SEQ ID NO: 2058384 - RNA, 13 nt, Human
agugagacucugu

SEQ ID NO: 2058385 - RNA, 21 nt, Human
agugagacccugucucaaaaa

SEQ ID NO: 2058386 - RNA, 17 nt, Human
agugagacccugucuca

SEQ ID NO: 2058387 - RNA, 16 nt, Human
agugaaagcuagagau

SEQ ID NO: 2058388 - RNA, 14 nt, Human
agugaaagcaucac

SEQ ID NO: 2058389 - RNA, 17 nt, Human
agugagacucugucuca

SEQ ID NO: 2058390 - RNA, 16 nt, Human
agugagacucugucuc

SEQ ID NO: 2058391 - RNA, 22 nt, Human
agugagacucugucucaaaaaa

SEQ ID NO: 2058392 - RNA, 18 nt, Human
agugagaccccugucucc

SEQ ID NO: 2058393 - RNA, 16 nt, Human
agugagacccugucuc

SEQ ID NO: 2058394 - RNA, 17 nt, Human
agugagacccugucucu

SEQ ID NO: 2058395 - RNA, 15 nt, Human
uggugaacauugcaa

SEQ ID NO: 2058396 - RNA, 20 nt, Human
uggugaacauugcaauagaa

SEQ ID NO: 2058397 - RNA, 19 nt, Human
aggguggugaccucugccu

SEQ ID NO: 2058398 - RNA, 18 nt, Human
aggguggugaccucugcc

SEQ ID NO: 2058399 - RNA, 17 nt, Human
aggguggugaccucugc

SEQ ID NO: 2058400 - RNA, 15 nt, Human
aggguugggcuggug

SEQ ID NO: 2058401 - RNA, 13 nt, Human
aggguugggcugg

SEQ ID NO: 2058402 - RNA, 14 nt, Human
aggguuggccccug

SEQ ID NO: 2058403 - RNA, 13 nt, Human
aggguuggccccu

SEQ ID NO: 2058404 - RNA, 14 nt, Human
aggguucaaaaugu

SEQ ID NO: 2058405 - RNA, 18 nt, Human
aggguucaaaaugucugu

SEQ ID NO: 2058406 - RNA, 16 nt, Human
aggguucagagacuca

SEQ ID NO: 2058407 - RNA, 18 nt, Human
aggguucagagacucagg

SEQ ID NO: 2058408 - RNA, 22 nt, Human
aggguucaaaaugucuguagcu

SEQ ID NO: 2058409 - RNA, 15 nt, Human
aggguucccccagcc

SEQ ID NO: 2058410 - RNA, 17 nt, Human
aggguucccccagcccu

SEQ ID NO: 2058411 - RNA, 18 nt, Human
aggguucccccagcccug

SEQ ID NO: 2058412 - RNA, 23 nt, Human
aggguuccuguagaccuagggag

SEQ ID NO: 2058413 - RNA, 17 nt, Human
aggguucuccucucccc

SEQ ID NO: 2058414 - RNA, 21 nt, Human
aggguuccuguagaccuaggg

SEQ ID NO: 2058415 - RNA, 19 nt, Human
aggguucccccagcccugu

SEQ ID NO: 2058416 - RNA, 20 nt, Human
aggguucuccucuccccucu

SEQ ID NO: 2058417 - RNA, 21 nt, Human
aggguugaguuacuuccuauc

SEQ ID NO: 2058418 - RNA, 12 nt, Human
uggucuguguga

SEQ ID NO: 2058419 - RNA, 13 nt, Human
uggucugaauguu

SEQ ID NO: 2058420 - RNA, 18 nt, Human
uggucugacccacugcuu

SEQ ID NO: 2058421 - RNA, 13 nt, Human
uggucucugccau

SEQ ID NO: 2058422 - RNA, 22 nt, Human
uggucucugcugaagguuguaa

SEQ ID NO: 2058423 - RNA, 13 nt, Human
uggucucuugcuu

SEQ ID NO: 2058424 - RNA, 12 nt, Human
uggucugaaugu

SEQ ID NO: 2058425 - RNA, 16 nt, Human
uggucugauuucagga

SEQ ID NO: 2058426 - RNA, 15 nt, Human
uggucugcaggcagg

SEQ ID NO: 2058427 - RNA, 14 nt, Human
uggucugcaggcag

SEQ ID NO: 2058428 - RNA, 21 nt, Human
aggucaaggcugcagugagcc

SEQ ID NO: 2058429 - RNA, 17 nt, Human
aggucaacagagaaggc

SEQ ID NO: 2058430 - RNA, 19 nt, Human
aggucaacagagaaggcag

SEQ ID NO: 2058431 - RNA, 21 nt, Human
aggucaacagagaaggcagga

SEQ ID NO: 2058432 - RNA, 19 nt, Human
aggucaagaagaagaugga

SEQ ID NO: 2058433 - RNA, 16 nt, Human
aggucaagcccaggag

SEQ ID NO: 2058434 - RNA, 18 nt, Human
aggucaagcccaggagga

SEQ ID NO: 2058435 - RNA, 19 nt, Human
aggucaaggccugucccug

SEQ ID NO: 2058436 - RNA, 20 nt, Human
aggucaaggccugucccugg

SEQ ID NO: 2058437 - RNA, 21 nt, Human
aggucaaggccugucccuggc

SEQ ID NO: 2058438 - RNA, 17 nt, Human
aggucaaguaagaagac

SEQ ID NO: 2058439 - RNA, 18 nt, Human
aggucaaguaagaagaca

SEQ ID NO: 2058440 - RNA, 19 nt, Human
aggucaaguaagaagacau

SEQ ID NO: 2058441 - RNA, 15 nt, Human
aggucaguacccacc

SEQ ID NO: 2058442 - RNA, 17 nt, Human
aggucaguacccaccug

SEQ ID NO: 2058443 - RNA, 18 nt, Human
aggucaguacccaccuga

SEQ ID NO: 2058444 - RNA, 19 nt, Human
aggucaguacccaccugag

SEQ ID NO: 2058445 - RNA, 15 nt, Human
aggucaggaguucga

SEQ ID NO: 2058446 - RNA, 17 nt, Human
aggucauagcugagauu

SEQ ID NO: 2058447 - RNA, 21 nt, Human
aggucuugaacuccuggccuc

SEQ ID NO: 2058448 - RNA, 20 nt, Human
aggucuugaacuccuggccu

SEQ ID NO: 2058449 - RNA, 14 nt, Human
aggugaaagggagc

SEQ ID NO: 2058450 - RNA, 16 nt, Human
aggugaaagggagcua

SEQ ID NO: 2058451 - RNA, 21 nt, Human
aggugaaagggagcuaucagg

SEQ ID NO: 2058452 - RNA, 22 nt, Human
aggucuugaacuccuggccuca

SEQ ID NO: 2058453 - RNA, 21 nt, Human
aggugaaaaaagcuuuuauga

SEQ ID NO: 2058454 - RNA, 16 nt, Human
agguccaauuuguaaa

SEQ ID NO: 2058455 - RNA, 21 nt, Human
aggucuuuugacauguggaaa

SEQ ID NO: 2058456 - RNA, 17 nt, Human
agguaugcaaucaaauc

SEQ ID NO: 2058457 - RNA, 20 nt, Human
agguaugaccuucuaggaag

SEQ ID NO: 2058458 - RNA, 13 nt, Human
agguaugaauaag

SEQ ID NO: 2058459 - RNA, 21 nt, Human
agguaucauuuucugcauuua

SEQ ID NO: 2058460 - RNA, 22 nt, Human
agguaugaccuucuaggaagcu

SEQ ID NO: 2058461 - RNA, 23 nt, Human
agguaugaccuucuaggaagcuc

SEQ ID NO: 2058462 - RNA, 16 nt, Human
agguaugaggucuagg

SEQ ID NO: 2058463 - RNA, 14 nt, Human
aggucaacagagaa

SEQ ID NO: 2058464 - RNA, 19 nt, Human
agguagcugaaaggggaag

SEQ ID NO: 2058465 - RNA, 19 nt, Human
agguagcugccccuggcuc

SEQ ID NO: 2058466 - RNA, 21 nt, Human
agguagcccuggccagaggcu

SEQ ID NO: 2058467 - RNA, 19 nt, Human
agguagcccuggccagagg

SEQ ID NO: 2058468 - RNA, 20 nt, Human
agguagcccuggccagaggc

SEQ ID NO: 2058469 - RNA, 14 nt, Human
agguagcugccccu

SEQ ID NO: 2058470 - RNA, 19 nt, Human
agguaggagaauugcuuga

SEQ ID NO: 2058471 - RNA, 21 nt, Human
aggguuguuaauggugcaaau

SEQ ID NO: 2058472 - RNA, 17 nt, Human
aggguugggcugguguc

SEQ ID NO: 2058473 - RNA, 15 nt, Human
aggguuggggagggg

SEQ ID NO: 2058474 - RNA, 17 nt, Human
aggguuggggaggggcg

SEQ ID NO: 2058475 - RNA, 15 nt, Human
aggguuuaucuuuug

SEQ ID NO: 2058476 - RNA, 16 nt, Human
agguagcccuggccag

SEQ ID NO: 2058477 - RNA, 13 nt, Human
aggggaggcagcc

SEQ ID NO: 2058478 - RNA, 21 nt, Human
aggggaggcagccggcaccca

SEQ ID NO: 2058479 - RNA, 23 nt, Human
aggggacgcugguagagauggag

SEQ ID NO: 2058480 - RNA, 14 nt, Human
aggggaggagggcg

SEQ ID NO: 2058481 - RNA, 19 nt, Human
aggggaggaucacuggagc

SEQ ID NO: 2058482 - RNA, 14 nt, Human
aggggacgcuggua

SEQ ID NO: 2058483 - RNA, 17 nt, Human
aggggaggaccucuggg

SEQ ID NO: 2058484 - RNA, 13 nt, Human
aggggaggagggc

SEQ ID NO: 2058485 - RNA, 16 nt, Human
aggggauagagagaga

SEQ ID NO: 2058486 - RNA, 15 nt, Human
aggggcuggacuggc

SEQ ID NO: 2058487 - RNA, 18 nt, Human
aggggcuggacuggcugu

SEQ ID NO: 2058488 - RNA, 19 nt, Human
aggggaggguggcagguga

SEQ ID NO: 2058489 - RNA, 16 nt, Human
aggggaggguggcagg

SEQ ID NO: 2058490 - RNA, 10 nt, Human
aggggcuggu

SEQ ID NO: 2058491 - RNA, 14 nt, Human
aggggcuuucugga

SEQ ID NO: 2058492 - RNA, 16 nt, Human
aggggcuuucuggaga

SEQ ID NO: 2058493 - RNA, 17 nt, Human
aggggcuuucuggagag

SEQ ID NO: 2058494 - RNA, 20 nt, Human
aggggcuuucuggagaggag

SEQ ID NO: 2058495 - RNA, 15 nt, Human
aggguaaggugccuu

SEQ ID NO: 2058496 - RNA, 18 nt, Human
aggggucuccaggaggag

SEQ ID NO: 2058497 - RNA, 19 nt, Human
aggggucuccaggaggaga

SEQ ID NO: 2058498 - RNA, 19 nt, Human
aggggucccagccaccccg

SEQ ID NO: 2058499 - RNA, 15 nt, Human
aggggucccagccac

SEQ ID NO: 2058500 - RNA, 18 nt, Human
aggggucccagccacccc

SEQ ID NO: 2058501 - RNA, 12 nt, Human
aggggggagggg

SEQ ID NO: 2058502 - RNA, 17 nt, Human
aggggggagggggaggg

SEQ ID NO: 2058503 - RNA, 17 nt, Human
aggggggcugccuggcc

SEQ ID NO: 2058504 - RNA, 20 nt, Human
agggggguugcaguggagag

SEQ ID NO: 2058505 - RNA, 14 nt, Human
aggggucagggacc

SEQ ID NO: 2058506 - RNA, 20 nt, Human
aggggucagggaccaaggac

SEQ ID NO: 2058507 - RNA, 24 nt, Human
aggggucagggaccaaggaccccu

SEQ ID NO: 2058508 - RNA, 16 nt, Human
aggguaucaggugcug

SEQ ID NO: 2058509 - RNA, 18 nt, Human
aggguaucaggugcugcc

SEQ ID NO: 2058510 - RNA, 17 nt, Human
aggguagucugguuucu

SEQ ID NO: 2058511 - RNA, 23 nt, Human
aggguaccuugaacacuggggga

SEQ ID NO: 2058512 - RNA, 19 nt, Human
aggguaccuugaacacugg

SEQ ID NO: 2058513 - RNA, 19 nt, Human
aggguacuaaggaaucuuu

SEQ ID NO: 2058514 - RNA, 15 nt, Human
aggguagcagguacc

SEQ ID NO: 2058515 - RNA, 16 nt, Human
uggucaucuuuuucuc

SEQ ID NO: 2058516 - RNA, 15 nt, Human
ugguccagcuugcuc

SEQ ID NO: 2058517 - RNA, 17 nt, Human
ugguccagggaagcugg

SEQ ID NO: 2058518 - RNA, 19 nt, Human
ugguccagggaagcuggcc

SEQ ID NO: 2058519 - RNA, 22 nt, Human
ugguccagcuugcucuucagug

SEQ ID NO: 2058520 - RNA, 22 nt, Human
ugguaauuuaagauuccagaga

SEQ ID NO: 2058521 - RNA, 14 nt, Human
ugguaaaauugcau

SEQ ID NO: 2058522 - RNA, 16 nt, Human
ugguaaaauugcaugg

SEQ ID NO: 2058523 - RNA, 19 nt, Human
ugguaaacgcugucccuag

SEQ ID NO: 2058524 - RNA, 23 nt, Human
ugguaauuuauaguuuauacagu

SEQ ID NO: 2058525 - RNA, 23 nt, Human
uggucaccaaaucagcugcuacu

SEQ ID NO: 2058526 - RNA, 21 nt, Human
uggucaccaaaucagcugcua

SEQ ID NO: 2058527 - RNA, 16 nt, Human
ugguacauggccagug

SEQ ID NO: 2058528 - RNA, 15 nt, Human
ugguacauggccagu

SEQ ID NO: 2058529 - RNA, 22 nt, Human
ugggucuuguuuuuuuuuucca

SEQ ID NO: 2058530 - RNA, 22 nt, Human
ugggucuucagggggccaggug

SEQ ID NO: 2058531 - RNA, 18 nt, Human
ugggugaaagaaaucaug

SEQ ID NO: 2058532 - RNA, 20 nt, Human
ugggugaaagaaaucauguu

SEQ ID NO: 2058533 - RNA, 15 nt, Human
ugggugaagacagag

SEQ ID NO: 2058534 - RNA, 14 nt, Human
uggguggaugccug

SEQ ID NO: 2058535 - RNA, 19 nt, Human
uggguggaaccaggaaccu

SEQ ID NO: 2058536 - RNA, 14 nt, Human
ugguaaaacacuug

SEQ ID NO: 2058537 - RNA, 15 nt, Human
uggguuuuuguuacc

SEQ ID NO: 2058538 - RNA, 22 nt, Human
uggguuuuuguuaccuuuaugg

SEQ ID NO: 2058539 - RNA, 23 nt, Human
uggguggaugccugguggcagcu

SEQ ID NO: 2058540 - RNA, 14 nt, Human
uggguuuucuuccc

SEQ ID NO: 2058541 - RNA, 24 nt, Human
uggguuuucuucccaucacuggag

SEQ ID NO: 2058542 - RNA, 18 nt, Human
uggguuuuguagguacuu

SEQ ID NO: 2058543 - RNA, 13 nt, Human
agggugaggaugg

SEQ ID NO: 2058544 - RNA, 20 nt, Human
aggguacuuccacugaugga

SEQ ID NO: 2058545 - RNA, 22 nt, Human
agggugcugccccaugaagcca

SEQ ID NO: 2058546 - RNA, 17 nt, Human
agggugcugcuucccuc

SEQ ID NO: 2058547 - RNA, 21 nt, Human
agggugcugcuucccucugcc

SEQ ID NO: 2058548 - RNA, 21 nt, Human
uguacauuuccaaauucacaa

SEQ ID NO: 2058549 - RNA, 22 nt, Human
uguacauuuccaaauucacaag

SEQ ID NO: 2058550 - RNA, 13 nt, Human
uguacauuucuga

SEQ ID NO: 2058551 - RNA, 10 nt, Human
uguacauuuc

SEQ ID NO: 2058552 - RNA, 18 nt, Human
uguacauuuccaaauuca

SEQ ID NO: 2058553 - RNA, 16 nt, Human
uguacauuucugaaau

SEQ ID NO: 2058554 - RNA, 16 nt, Human
uguacuuaauaaauuc

SEQ ID NO: 2058555 - RNA, 20 nt, Human
uguacuuaauaaauucagau

SEQ ID NO: 2058556 - RNA, 21 nt, Human
uguacuuaauaaauucagaua

SEQ ID NO: 2058557 - RNA, 22 nt, Human
uguacuuaauaaauucagauau

SEQ ID NO: 2058558 - RNA, 14 nt, Human
uguacuucaaguua

SEQ ID NO: 2058559 - RNA, 16 nt, Human
uguacuugaugacaga

SEQ ID NO: 2058560 - RNA, 13 nt, Human
uguagaaggcaca

SEQ ID NO: 2058561 - RNA, 22 nt, Human
uguagaaguaggaagugaaaau

SEQ ID NO: 2058562 - RNA, 17 nt, Human
uguagaaggagacagag

SEQ ID NO: 2058563 - RNA, 21 nt, Human
uguagaaggagacagagcugg

SEQ ID NO: 2058564 - RNA, 21 nt, Human
uguagaccuagggaggaccuu

SEQ ID NO: 2058565 - RNA, 15 nt, Human
uguaaggaaugcuug

SEQ ID NO: 2058566 - RNA, 19 nt, Human
uguaaggaaugcuuggaau

SEQ ID NO: 2058567 - RNA, 15 nt, Human
uguaagcucuuugaa

SEQ ID NO: 2058568 - RNA, 19 nt, Human
uguaagcucuuugaaacaa

SEQ ID NO: 2058569 - RNA, 13 nt, Human
uguaauuugugua

SEQ ID NO: 2058570 - RNA, 15 nt, Human
uguaauuuguguaau

SEQ ID NO: 2058571 - RNA, 17 nt, Human
uguaauuuguguaauaa

SEQ ID NO: 2058572 - RNA, 20 nt, Human
uguaauuuguguaauaaagu

SEQ ID NO: 2058573 - RNA, 21 nt, Human
uguaauuuuaaauaaaaguga

SEQ ID NO: 2058574 - RNA, 12 nt, Human
uguaauuuucuu

SEQ ID NO: 2058575 - RNA, 17 nt, Human
uguacaaaauaaaguua

SEQ ID NO: 2058576 - RNA, 14 nt, Human
uguacaaaauggaa

SEQ ID NO: 2058577 - RNA, 20 nt, Human
uguacaaaauggaauucauu

SEQ ID NO: 2058578 - RNA, 19 nt, Human
uguacaaaguagaagucuu

SEQ ID NO: 2058579 - RNA, 23 nt, Human
uguacaaaguagaagucuuagau

SEQ ID NO: 2058580 - RNA, 20 nt, Human
uguacauauuugagacuagu

SEQ ID NO: 2058581 - RNA, 19 nt, Human
uguacauauguaaaauaaa

SEQ ID NO: 2058582 - RNA, 21 nt, Human
uguacauauguaaaauaaaau

SEQ ID NO: 2058583 - RNA, 13 nt, Human
uguacauauguaa

SEQ ID NO: 2058584 - RNA, 15 nt, Human
uguacauauguaaaa

SEQ ID NO: 2058585 - RNA, 16 nt, Human
uguacauauguaaaau

SEQ ID NO: 2058586 - RNA, 18 nt, Human
uguacauauguaaaauaa

SEQ ID NO: 2058587 - RNA, 20 nt, Human
aggugugagucaccaagccc

SEQ ID NO: 2058588 - RNA, 14 nt, Human
aggugugagucacc

SEQ ID NO: 2058589 - RNA, 15 nt, Human
agguggucugaaugu

SEQ ID NO: 2058590 - RNA, 16 nt, Human
agguggucugaauguu

SEQ ID NO: 2058591 - RNA, 17 nt, Human
agguggucugaauguuc

SEQ ID NO: 2058592 - RNA, 18 nt, Human
agguggucugaauguucu

SEQ ID NO: 2058593 - RNA, 22 nt, Human
aggugugaaccaccacacccag

SEQ ID NO: 2058594 - RNA, 19 nt, Human
agguggguuuucuucccau

SEQ ID NO: 2058595 - RNA, 21 nt, Human
agguggguuuucuucccauca

SEQ ID NO: 2058596 - RNA, 22 nt, Human
agguggguuuucuucccaucac

SEQ ID NO: 2058597 - RNA, 15 nt, Human
aggugguaugugugu

SEQ ID NO: 2058598 - RNA, 18 nt, Human
aggugguaugugugugua

SEQ ID NO: 2058599 - RNA, 14 nt, Human
agguggucugaaug

SEQ ID NO: 2058600 - RNA, 23 nt, Human
aggugugaaccaccacacccagc

SEQ ID NO: 2058601 - RNA, 13 nt, Human
agguggggcagcu

SEQ ID NO: 2058602 - RNA, 11 nt, Human
agguggggagg

SEQ ID NO: 2058603 - RNA, 22 nt, Human
agguggggaggggguuuggggg

SEQ ID NO: 2058604 - RNA, 23 nt, Human
agguggggaggggguuugggggc

SEQ ID NO: 2058605 - RNA, 13 nt, Human
agguggggaguca

SEQ ID NO: 2058606 - RNA, 14 nt, Human
agguggggcagcuu

SEQ ID NO: 2058607 - RNA, 23 nt, Human
agguggguuuucuucccaucacu

SEQ ID NO: 2058608 - RNA, 22 nt, Human
agguggggucuuugugagagug

SEQ ID NO: 2058609 - RNA, 21 nt, Human
agguggggucuuugugagagu

SEQ ID NO: 2058610 - RNA, 23 nt, Human
agguguuuaacggcacuguggcc

SEQ ID NO: 2058611 - RNA, 14 nt, Human
agguuuaacauaaa

SEQ ID NO: 2058612 - RNA, 15 nt, Human
agguuuaacauaaag

SEQ ID NO: 2058613 - RNA, 17 nt, Human
agguuuaacauaaaggu

SEQ ID NO: 2058614 - RNA, 20 nt, Human
agguugucugaagucacugc

SEQ ID NO: 2058615 - RNA, 12 nt, Human
agguugucugug

SEQ ID NO: 2058616 - RNA, 16 nt, Human
agguugucugaaguca

SEQ ID NO: 2058617 - RNA, 22 nt, Human
agguguucaagaccagccugac

SEQ ID NO: 2058618 - RNA, 17 nt, Human
agguguucuacacucau

SEQ ID NO: 2058619 - RNA, 20 nt, Human
agguguucuacacucaucuu

SEQ ID NO: 2058620 - RNA, 18 nt, Human
uguaagaaaccaaucaag

SEQ ID NO: 2058621 - RNA, 22 nt, Human
uguaagaaaccaaucaagauaa

SEQ ID NO: 2058622 - RNA, 24 nt, Human
uguaagaaaccaaucaagauaaag

SEQ ID NO: 2058623 - RNA, 22 nt, Human
uguaagcucuacugaggugcua

SEQ ID NO: 2058624 - RNA, 17 nt, Human
uguaagaaacacacuga

SEQ ID NO: 2058625 - RNA, 22 nt, Human
uguaagaaacacacugaggcag

SEQ ID NO: 2058626 - RNA, 23 nt, Human
aggugauccacccaccucagccu

SEQ ID NO: 2058627 - RNA, 21 nt, Human
aggugauccacccaccucagc

SEQ ID NO: 2058628 - RNA, 13 nt, Human
uguaaauauuuau

SEQ ID NO: 2058629 - RNA, 12 nt, Human
uguaaauauuua

SEQ ID NO: 2058630 - RNA, 21 nt, Human
uguaaauacacauagcaugua

SEQ ID NO: 2058631 - RNA, 17 nt, Human
ugguuuuaauugaagga

SEQ ID NO: 2058632 - RNA, 20 nt, Human
ugguuuuaauugaaggaaag

SEQ ID NO: 2058633 - RNA, 21 nt, Human
ugguuuuaauugaaggaaaga

SEQ ID NO: 2058634 - RNA, 16 nt, Human
ugguuuuccuaaaugc

SEQ ID NO: 2058635 - RNA, 22 nt, Human
ugguuuuccuaaaugcagugaa

SEQ ID NO: 2058636 - RNA, 23 nt, Human
ugguuugagcuuagugaaauuac

SEQ ID NO: 2058637 - RNA, 15 nt, Human
ugguuugcaaggaag

SEQ ID NO: 2058638 - RNA, 17 nt, Human
ugguuugcaaggaagcc

SEQ ID NO: 2058639 - RNA, 17 nt, Human
ugguuugagcuuaguga

SEQ ID NO: 2058640 - RNA, 15 nt, Human
ugguuugcagagcuu

SEQ ID NO: 2058641 - RNA, 16 nt, Human
ugguuucacuggccca

SEQ ID NO: 2058642 - RNA, 13 nt, Human
ugguuuaguguaa

SEQ ID NO: 2058643 - RNA, 14 nt, Human
ugguuuaguguaaa

SEQ ID NO: 2058644 - RNA, 20 nt, Human
ugguuuaguguaaaaaugag

SEQ ID NO: 2058645 - RNA, 21 nt, Human
ugguuuaguguaaaaaugaga

SEQ ID NO: 2058646 - RNA, 16 nt, Human
ugguuucuagacuugu

SEQ ID NO: 2058647 - RNA, 12 nt, Human
ugguuucuccag

SEQ ID NO: 2058648 - RNA, 20 nt, Human
ugguuuccacgaugaaaaac

SEQ ID NO: 2058649 - RNA, 13 nt, Human
ugguuuccuuccu

SEQ ID NO: 2058650 - RNA, 15 nt, Human
ugguuucuagcauga

SEQ ID NO: 2058651 - RNA, 19 nt, Human
ugguggcagauuuuacaaa

SEQ ID NO: 2058652 - RNA, 17 nt, Human
ugguuucauaggagaca

SEQ ID NO: 2058653 - RNA, 18 nt, Human
ugguuucacuggcccaag

SEQ ID NO: 2058654 - RNA, 13 nt, Human
ugguuucagcaau

SEQ ID NO: 2058655 - RNA, 22 nt, Human
ugguuucagcaauauuuaagga

SEQ ID NO: 2058656 - RNA, 16 nt, Human
ugguuuccaaggagcu

SEQ ID NO: 2058657 - RNA, 17 nt, Human
ugguuuccaaggagcug

SEQ ID NO: 2058658 - RNA, 22 nt, Human
ugguuuccaaggagcugagaau

SEQ ID NO: 2058659 - RNA, 23 nt, Human
ugguuuccaaggagcugagaaua

SEQ ID NO: 2058660 - RNA, 21 nt, Human
ugguuuccacgaugaaaaacu

SEQ ID NO: 2058661 - RNA, 17 nt, Human
ugguguuuuaaagagaa

SEQ ID NO: 2058662 - RNA, 21 nt, Human
ugguguuuuaaagagaaugua

SEQ ID NO: 2058663 - RNA, 17 nt, Human
ugguguugcagaagguu

SEQ ID NO: 2058664 - RNA, 21 nt, Human
ugguuaaguuggcuucuguuu

SEQ ID NO: 2058665 - RNA, 16 nt, Human
ugguuauuuuuauaca

SEQ ID NO: 2058666 - RNA, 17 nt, Human
ugguuauuuuuauacag

SEQ ID NO: 2058667 - RNA, 18 nt, Human
ugguuauuuuuauacagu

SEQ ID NO: 2058668 - RNA, 19 nt, Human
ugguuauuuuuauacagua

SEQ ID NO: 2058669 - RNA, 22 nt, Human
ugguuauuuagggaacugcuug

SEQ ID NO: 2058670 - RNA, 23 nt, Human
ugguucaggguuggccccugccc

SEQ ID NO: 2058671 - RNA, 23 nt, Human
ugguuuaaaagacacacuugucc

SEQ ID NO: 2058672 - RNA, 14 nt, Human
ugguuguuucuucc

SEQ ID NO: 2058673 - RNA, 15 nt, Human
ugguuguuucuucca

SEQ ID NO: 2058674 - RNA, 20 nt, Human
ugguuguuucuuccaagacu

SEQ ID NO: 2058675 - RNA, 22 nt, Human
ugguucaggguuggccccugcc

SEQ ID NO: 2058676 - RNA, 20 nt, Human
ugguucaggguuggccccug

SEQ ID NO: 2058677 - RNA, 12 nt, Human
ugguggcagcug

SEQ ID NO: 2058678 - RNA, 16 nt, Human
ugguguggcaaagccu

SEQ ID NO: 2058679 - RNA, 13 nt, Human
ugguguugcagaa

SEQ ID NO: 2058680 - RNA, 20 nt, Human
auaaccaaagcccaaagugg

SEQ ID NO: 2058681 - RNA, 12 nt, Human
auaaccacugcu

SEQ ID NO: 2058682 - RNA, 14 nt, Human
auaaccaauguuua

SEQ ID NO: 2058683 - RNA, 15 nt, Human
auaaccaauguuuaa

SEQ ID NO: 2058684 - RNA, 20 nt, Human
auaaccaauguuuaaaaaag

SEQ ID NO: 2058685 - RNA, 22 nt, Human
auaaccacuuaaaaaaugucca

SEQ ID NO: 2058686 - RNA, 14 nt, Human
auaaccacugcuuc

SEQ ID NO: 2058687 - RNA, 13 nt, Human
auaaccacuuaaa

SEQ ID NO: 2058688 - RNA, 22 nt, Human
auaacucuguggcauuauugca

SEQ ID NO: 2058689 - RNA, 12 nt, Human
auaacucuuugg

SEQ ID NO: 2058690 - RNA, 13 nt, Human
auaacucuuugga

SEQ ID NO: 2058691 - RNA, 22 nt, Human
auaacucuuuggauagcauguc

SEQ ID NO: 2058692 - RNA, 14 nt, Human
auaacugaaggaga

SEQ ID NO: 2058693 - RNA, 18 nt, Human
auaacugccuuaaaacuu

SEQ ID NO: 2058694 - RNA, 16 nt, Human
auaacugaaggagaag

SEQ ID NO: 2058695 - RNA, 18 nt, Human
auaacugaaggagaaggu

SEQ ID NO: 2058696 - RNA, 12 nt, Human
auaacugacaaa

SEQ ID NO: 2058697 - RNA, 16 nt, Human
auaacugacaaaucaa

SEQ ID NO: 2058698 - RNA, 17 nt, Human
auaacugacaaaucaag

SEQ ID NO: 2058699 - RNA, 18 nt, Human
auaacugacaaaucaagu

SEQ ID NO: 2058700 - RNA, 21 nt, Human
auaacugacaaaucaaguuuc

SEQ ID NO: 2058701 - RNA, 12 nt, Human
auaaauaaaugu

SEQ ID NO: 2058702 - RNA, 16 nt, Human
auaaauaaaugcaaua

SEQ ID NO: 2058703 - RNA, 15 nt, Human
auaaauaaauaaaua

SEQ ID NO: 2058704 - RNA, 21 nt, Human
auaaaugucauuaaaauaaau

SEQ ID NO: 2058705 - RNA, 13 nt, Human
auaaauuauaagu

SEQ ID NO: 2058706 - RNA, 11 nt, Human
auaaauuaaau

SEQ ID NO: 2058707 - RNA, 12 nt, Human
auaaauuaaaua

SEQ ID NO: 2058708 - RNA, 19 nt, Human
auaaauuaaauauauguau

SEQ ID NO: 2058709 - RNA, 13 nt, Human
uuacaugcauuug

SEQ ID NO: 2058710 - RNA, 23 nt, Human
uuaccauuuugggguacccacug

SEQ ID NO: 2058711 - RNA, 12 nt, Human
uuacccuucugu

SEQ ID NO: 2058712 - RNA, 16 nt, Human
uuacccuucugugccc

SEQ ID NO: 2058713 - RNA, 17 nt, Human
uuacccuucugugccca

SEQ ID NO: 2058714 - RNA, 19 nt, Human
uuacccuucugugcccagc

SEQ ID NO: 2058715 - RNA, 20 nt, Human
uuacccuucugugcccagcu

SEQ ID NO: 2058716 - RNA, 21 nt, Human
uuacccuucugugcccagcuc

SEQ ID NO: 2058717 - RNA, 22 nt, Human
uuacccuucugugcccagcuca

SEQ ID NO: 2058718 - RNA, 13 nt, Human
uuaccauuuguaa

SEQ ID NO: 2058719 - RNA, 14 nt, Human
uuaccauuuguaau

SEQ ID NO: 2058720 - RNA, 15 nt, Human
uuaccauuuguaaua

SEQ ID NO: 2058721 - RNA, 20 nt, Human
uuaccauuuguaauaaagua

SEQ ID NO: 2058722 - RNA, 23 nt, Human
uuaccauuuguaauaaaguauau

SEQ ID NO: 2058723 - RNA, 17 nt, Human
uuacccaauaagauaca

SEQ ID NO: 2058724 - RNA, 15 nt, Human
uuacaugagaacaga

SEQ ID NO: 2058725 - RNA, 17 nt, Human
uuacaugagaacagacu

SEQ ID NO: 2058726 - RNA, 21 nt, Human
uuacaucuguuuuaaauuuau

SEQ ID NO: 2058727 - RNA, 15 nt, Human
uuacaucuuucacau

SEQ ID NO: 2058728 - RNA, 15 nt, Human
auaaacucauuucua

SEQ ID NO: 2058729 - RNA, 20 nt, Human
auaaacgugaugaucagcug

SEQ ID NO: 2058730 - RNA, 22 nt, Human
auaaacagcuucaugccuuugu

SEQ ID NO: 2058731 - RNA, 18 nt, Human
auaaacuauuggaaagua

SEQ ID NO: 2058732 - RNA, 17 nt, Human
auaaacuguccucuuuc

SEQ ID NO: 2058733 - RNA, 12 nt, Human
auaaacugugug

SEQ ID NO: 2058734 - RNA, 14 nt, Human
auaaacugugugca

SEQ ID NO: 2058735 - RNA, 16 nt, Human
auaaacuguguuuacu

SEQ ID NO: 2058736 - RNA, 23 nt, Human
auaaacuuagugcggacaaguuu

SEQ ID NO: 2058737 - RNA, 13 nt, Human
auaaauaaaacau

SEQ ID NO: 2058738 - RNA, 15 nt, Human
auaaauaaaaaugga

SEQ ID NO: 2058739 - RNA, 17 nt, Human
auaaauaaaaauggaua

SEQ ID NO: 2058740 - RNA, 14 nt, Human
auaaaguaucuaca

SEQ ID NO: 2058741 - RNA, 16 nt, Human
auaaaguauuccaccu

SEQ ID NO: 2058742 - RNA, 18 nt, Human
auaaaguauuccaccuua

SEQ ID NO: 2058743 - RNA, 20 nt, Human
auaaaguauuccaccuuaaa

SEQ ID NO: 2058744 - RNA, 23 nt, Human
auaaaguauuccaccuuaaauua

SEQ ID NO: 2058745 - RNA, 21 nt, Human
aguuugguuguguaagagaau

SEQ ID NO: 2058746 - RNA, 16 nt, Human
aguuuuccuaaaugua

SEQ ID NO: 2058747 - RNA, 17 nt, Human
aguuuuccuaaauguau

SEQ ID NO: 2058748 - RNA, 18 nt, Human
aguuuuccuaaauguaua

SEQ ID NO: 2058749 - RNA, 12 nt, Human
aguuuuccuucu

SEQ ID NO: 2058750 - RNA, 14 nt, Human
aguuuuccuucuca

SEQ ID NO: 2058751 - RNA, 18 nt, Human
aguuuuccuucucaucug

SEQ ID NO: 2058752 - RNA, 22 nt, Human
aguuuuccuucucaucugugau

SEQ ID NO: 2058753 - RNA, 23 nt, Human
aguuuuccuucucaucugugauu

SEQ ID NO: 2058754 - RNA, 16 nt, Human
auaaacaucacacaca

SEQ ID NO: 2058755 - RNA, 22 nt, Human
auaaacaguggaauauaaggaa

SEQ ID NO: 2058756 - RNA, 17 nt, Human
auaaacaucacacacac

SEQ ID NO: 2058757 - RNA, 21 nt, Human
auaaacauccuucaagaacuc

SEQ ID NO: 2058758 - RNA, 15 nt, Human
auaauaaauugcaug

SEQ ID NO: 2058759 - RNA, 13 nt, Human
auaauaagcuaaa

SEQ ID NO: 2058760 - RNA, 15 nt, Human
auaauaagcuaaaga

SEQ ID NO: 2058761 - RNA, 20 nt, Human
auaaguuucacugacuuaga

SEQ ID NO: 2058762 - RNA, 10 nt, Human
auaagcaaaa

SEQ ID NO: 2058763 - RNA, 22 nt, Human
auaaguuaacuuccaauuuaca

SEQ ID NO: 2058764 - RNA, 21 nt, Human
uuaccucugauaccucaaccc

SEQ ID NO: 2058765 - RNA, 11 nt, Human
uuaccucugau

SEQ ID NO: 2058766 - RNA, 13 nt, Human
uuaccuaauuaga

SEQ ID NO: 2058767 - RNA, 23 nt, Human
auaagcaaagggagcacuggguu

SEQ ID NO: 2058768 - RNA, 12 nt, Human
auaagcaagaga

SEQ ID NO: 2058769 - RNA, 14 nt, Human
auaagcaagagaga

SEQ ID NO: 2058770 - RNA, 15 nt, Human
auaagcaagagagau

SEQ ID NO: 2058771 - RNA, 17 nt, Human
auaagcaagagagaugu

SEQ ID NO: 2058772 - RNA, 17 nt, Human
auaaguuaacuuccaau

SEQ ID NO: 2058773 - RNA, 16 nt, Human
auaagcagauuuaaca

SEQ ID NO: 2058774 - RNA, 16 nt, Human
auaagcaagagagaug

SEQ ID NO: 2058775 - RNA, 14 nt, Human
auaauucuacuuug

SEQ ID NO: 2058776 - RNA, 16 nt, Human
auaauuaugacaguua

SEQ ID NO: 2058777 - RNA, 14 nt, Human
auaauuaugacagu

SEQ ID NO: 2058778 - RNA, 12 nt, Human
auaauucccuau

SEQ ID NO: 2058779 - RNA, 17 nt, Human
auaauucccuaucuuuu

SEQ ID NO: 2058780 - RNA, 19 nt, Human
auaauucccuaucuuuuag

SEQ ID NO: 2058781 - RNA, 17 nt, Human
auaauuauccagaguuu

SEQ ID NO: 2058782 - RNA, 16 nt, Human
auaauuaucggaagca

SEQ ID NO: 2058783 - RNA, 19 nt, Human
auaauuaucggaagcagug

SEQ ID NO: 2058784 - RNA, 20 nt, Human
auaauuaucggaagcagugc

SEQ ID NO: 2058785 - RNA, 21 nt, Human
auaauuaucggaagcagugcc

SEQ ID NO: 2058786 - RNA, 22 nt, Human
auaauuaucggaagcagugccu

SEQ ID NO: 2058787 - RNA, 21 nt, Human
auaaucagcaagaauuugauc

SEQ ID NO: 2058788 - RNA, 13 nt, Human
auaaucagccucu

SEQ ID NO: 2058789 - RNA, 17 nt, Human
auaauacagccaaagau

SEQ ID NO: 2058790 - RNA, 21 nt, Human
auaauacagccaaagauaauc

SEQ ID NO: 2058791 - RNA, 12 nt, Human
auaauaauacaa

SEQ ID NO: 2058792 - RNA, 13 nt, Human
auaauaauacaag

SEQ ID NO: 2058793 - RNA, 19 nt, Human
auaauacaguaucucaggg

SEQ ID NO: 2058794 - RNA, 14 nt, Human
auaaucagccucuu

SEQ ID NO: 2058795 - RNA, 15 nt, Human
auaaucagccucuua

SEQ ID NO: 2058796 - RNA, 16 nt, Human
auaaucagccucuuaa

SEQ ID NO: 2058797 - RNA, 17 nt, Human
auaaucagccucuuaaa

SEQ ID NO: 2058798 - RNA, 13 nt, Human
auaaucuuugggu

SEQ ID NO: 2058799 - RNA, 14 nt, Human
uuagauuauauuga

SEQ ID NO: 2058800 - RNA, 22 nt, Human
uuagauuauauugagacaaaaa

SEQ ID NO: 2058801 - RNA, 13 nt, Human
uuagaugguuaca

SEQ ID NO: 2058802 - RNA, 16 nt, Human
uuagaugguuacacug

SEQ ID NO: 2058803 - RNA, 17 nt, Human
uuagaugguuacacugu

SEQ ID NO: 2058804 - RNA, 18 nt, Human
uuagaugguuacacuguu

SEQ ID NO: 2058805 - RNA, 13 nt, Human
uuagauuuuaauc

SEQ ID NO: 2058806 - RNA, 18 nt, Human
uuagcaggaagcugugag

SEQ ID NO: 2058807 - RNA, 18 nt, Human
uuagcacguuuaaaguuc

SEQ ID NO: 2058808 - RNA, 22 nt, Human
uuagcacguuuaaaguucugug

SEQ ID NO: 2058809 - RNA, 20 nt, Human
auaauucccuaucuuuuagu

SEQ ID NO: 2058810 - RNA, 14 nt, Human
uuauaguuuauaca

SEQ ID NO: 2058811 - RNA, 15 nt, Human
uuauaguuuauacag

SEQ ID NO: 2058812 - RNA, 17 nt, Human
uuauaguuuauacaguu

SEQ ID NO: 2058813 - RNA, 17 nt, Human
uuauauaaagagaaaau

SEQ ID NO: 2058814 - RNA, 19 nt, Human
uuauauaaagagaaaauug

SEQ ID NO: 2058815 - RNA, 22 nt, Human
uuauauaaagagaaaauugaau

SEQ ID NO: 2058816 - RNA, 15 nt, Human
uuauauaauuauguu

SEQ ID NO: 2058817 - RNA, 16 nt, Human
uuauauaauuauguua

SEQ ID NO: 2058818 - RNA, 17 nt, Human
uuauauaauuauguuau

SEQ ID NO: 2058819 - RNA, 13 nt, Human
auaauuuucuuca

SEQ ID NO: 2058820 - RNA, 17 nt, Human
auaauuuucuucaugca

SEQ ID NO: 2058821 - RNA, 22 nt, Human
auaauuuucuucaugcaaugac

SEQ ID NO: 2058822 - RNA, 23 nt, Human
auaauuuucuucaugcaaugaca

SEQ ID NO: 2058823 - RNA, 16 nt, Human
auaauuuugcauaaaa

SEQ ID NO: 2058824 - RNA, 21 nt, Human
auaauuuugcauaaaauugga

SEQ ID NO: 2058825 - RNA, 19 nt, Human
auaauuuuaugaaugucuu

SEQ ID NO: 2058826 - RNA, 13 nt, Human
auaauuuuaagau

SEQ ID NO: 2058827 - RNA, 12 nt, Human
auaauuuuauga

SEQ ID NO: 2058828 - RNA, 13 nt, Human
auaauuuuaugaa

SEQ ID NO: 2058829 - RNA, 15 nt, Human
auaauuuuaugaaug

SEQ ID NO: 2058830 - RNA, 20 nt, Human
uuauagugguguuuuaaaga

SEQ ID NO: 2058831 - RNA, 13 nt, Human
uuauauagcuuga

SEQ ID NO: 2058832 - RNA, 14 nt, Human
uuauauagcuugaa

SEQ ID NO: 2058833 - RNA, 18 nt, Human
uuauauagcuugaaacau

SEQ ID NO: 2058834 - RNA, 18 nt, Human
uuauauaguuuacuauuu

SEQ ID NO: 2058835 - RNA, 15 nt, Human
auaauuuuuaaagua

SEQ ID NO: 2058836 - RNA, 22 nt, Human
auaauuuuuuucaauauuuauu

SEQ ID NO: 2058837 - RNA, 21 nt, Human
auaauuuuuuucaauauuuau

SEQ ID NO: 2058838 - RNA, 20 nt, Human
auaauuuuuuucaauauuua

SEQ ID NO: 2058839 - RNA, 18 nt, Human
auaauuuuuaaaguauau

SEQ ID NO: 2058840 - RNA, 19 nt, Human
auaauuuuuaaaguauaua

SEQ ID NO: 2058841 - RNA, 21 nt, Human
auaauuuuuaaaguauauauu

SEQ ID NO: 2058842 - RNA, 23 nt, Human
auaauuuuuaaaguauauauuua

SEQ ID NO: 2058843 - RNA, 17 nt, Human
uuauaacagcauucuug

SEQ ID NO: 2058844 - RNA, 16 nt, Human
uuauaacucaucauaa

SEQ ID NO: 2058845 - RNA, 17 nt, Human
uuauaacucaucauaaa

SEQ ID NO: 2058846 - RNA, 18 nt, Human
uuauaacucaucauaaaa

SEQ ID NO: 2058847 - RNA, 18 nt, Human
uuauaacugaaggagaag

SEQ ID NO: 2058848 - RNA, 19 nt, Human
uuauaacucaucauaaaau

SEQ ID NO: 2058849 - RNA, 20 nt, Human
uuauaacucaucauaaaaua

SEQ ID NO: 2058850 - RNA, 21 nt, Human
uuauaacucaucauaaaauaa

SEQ ID NO: 2058851 - RNA, 22 nt, Human
uuauaacucaucauaaaauaaa

SEQ ID NO: 2058852 - RNA, 16 nt, Human
uuauacaugacacuga

SEQ ID NO: 2058853 - RNA, 20 nt, Human
uuauacaugacacugaaaug

SEQ ID NO: 2058854 - RNA, 22 nt, Human
uuauacaugacacugaaaugcc

SEQ ID NO: 2058855 - RNA, 23 nt, Human
uuauacaugacacugaaaugccu

SEQ ID NO: 2058856 - RNA, 13 nt, Human
uuauaacuuaaaa

SEQ ID NO: 2058857 - RNA, 15 nt, Human
uuauaacuuaaaaaa

SEQ ID NO: 2058858 - RNA, 17 nt, Human
uuauaacuuaaaauauu

SEQ ID NO: 2058859 - RNA, 14 nt, Human
uuagccccauaauu

SEQ ID NO: 2058860 - RNA, 16 nt, Human
uuagcaguuugcuuug

SEQ ID NO: 2058861 - RNA, 17 nt, Human
uuagcagugauuuuuau

SEQ ID NO: 2058862 - RNA, 12 nt, Human
uuagcaguucug

SEQ ID NO: 2058863 - RNA, 16 nt, Human
uuagcaguucugcaaa

SEQ ID NO: 2058864 - RNA, 18 nt, Human
uuagcaguucugcaaaua

SEQ ID NO: 2058865 - RNA, 21 nt, Human
uuagcaguucugcaaauagaa

SEQ ID NO: 2058866 - RNA, 21 nt, Human
uuagccguggugauuuagcag

SEQ ID NO: 2058867 - RNA, 13 nt, Human
uuagccgggcgug

SEQ ID NO: 2058868 - RNA, 15 nt, Human
uuagccucccugaaa

SEQ ID NO: 2058869 - RNA, 11 nt, Human
uuauaaauuaa

SEQ ID NO: 2058870 - RNA, 12 nt, Human
uuauaaauuaaa

SEQ ID NO: 2058871 - RNA, 13 nt, Human
uuauaaauuaaau

SEQ ID NO: 2058872 - RNA, 15 nt, Human
uuauaaauuaaauau

SEQ ID NO: 2058873 - RNA, 18 nt, Human
uuauaaauuaaauauaug

SEQ ID NO: 2058874 - RNA, 16 nt, Human
uuauagaaguuuagau

SEQ ID NO: 2058875 - RNA, 14 nt, Human
uuauagaaaguuca

SEQ ID NO: 2058876 - RNA, 15 nt, Human
uuauagacaaauaau

SEQ ID NO: 2058877 - RNA, 23 nt, Human
uuauagaauauuuauuaccucug

SEQ ID NO: 2058878 - RNA, 15 nt, Human
uuauagaauauuuau

SEQ ID NO: 2058879 - RNA, 15 nt, Human
uuagcagaaucaaaa

SEQ ID NO: 2058880 - RNA, 22 nt, Human
uuauacuguacuuaauaaauuc

SEQ ID NO: 2058881 - RNA, 16 nt, Human
uuauacuaagaaaaga

SEQ ID NO: 2058882 - RNA, 12 nt, Human
uuauacuaagaa

SEQ ID NO: 2058883 - RNA, 17 nt, Human
uuauaggucacuccugg

SEQ ID NO: 2058884 - RNA, 18 nt, Human
uuauaggucacuccuggg

SEQ ID NO: 2058885 - RNA, 21 nt, Human
uuauagugaauuaucccuuuu

SEQ ID NO: 2058886 - RNA, 16 nt, Human
uuauagccgaaaugau

SEQ ID NO: 2058887 - RNA, 16 nt, Human
uuauagcucaguuuau

SEQ ID NO: 2058888 - RNA, 21 nt, Human
auacagggcaugcauuuugca

SEQ ID NO: 2058889 - RNA, 16 nt, Human
auacaggggaauauuu

SEQ ID NO: 2058890 - RNA, 18 nt, Human
auacaggggaauauuuua

SEQ ID NO: 2058891 - RNA, 19 nt, Human
auacaggggaauauuuuau

SEQ ID NO: 2058892 - RNA, 20 nt, Human
auacaggggaauauuuuauu

SEQ ID NO: 2058893 - RNA, 22 nt, Human
auacaggaaaagcugcugacag

SEQ ID NO: 2058894 - RNA, 20 nt, Human
auacaggaaaagcugcugac

SEQ ID NO: 2058895 - RNA, 19 nt, Human
auacaggaaaagcugcuga

SEQ ID NO: 2058896 - RNA, 14 nt, Human
auacaggaaaagcu

SEQ ID NO: 2058897 - RNA, 19 nt, Human
auacaaaggcuuauuaauu

SEQ ID NO: 2058898 - RNA, 19 nt, Human
auacaaacauauuuguuaa

SEQ ID NO: 2058899 - RNA, 18 nt, Human
auacagccaaagauaauc

SEQ ID NO: 2058900 - RNA, 14 nt, Human
auacaguauucugu

SEQ ID NO: 2058901 - RNA, 15 nt, Human
auacaguauucugua

SEQ ID NO: 2058902 - RNA, 15 nt, Human
auacaguacaggcag

SEQ ID NO: 2058903 - RNA, 16 nt, Human
auacaguacaggcagc

SEQ ID NO: 2058904 - RNA, 19 nt, Human
auacaguacaggcagcaca

SEQ ID NO: 2058905 - RNA, 15 nt, Human
auacaguacaguggu

SEQ ID NO: 2058906 - RNA, 16 nt, Human
auacaguacagugguu

SEQ ID NO: 2058907 - RNA, 10 nt, Human
auacaguagu

SEQ ID NO: 2058908 - RNA, 17 nt, Human
auacaguagugagaaga

SEQ ID NO: 2058909 - RNA, 19 nt, Human
auacaguagugagaagaau

SEQ ID NO: 2058910 - RNA, 20 nt, Human
auacaguagugagaagaaua

SEQ ID NO: 2058911 - RNA, 15 nt, Human
auacaguuuuaaaga

SEQ ID NO: 2058912 - RNA, 16 nt, Human
auacaguuuuaaagaa

SEQ ID NO: 2058913 - RNA, 17 nt, Human
auacaguuuuaaagaau

SEQ ID NO: 2058914 - RNA, 23 nt, Human
auacaguuuuaaagaaucauuau

SEQ ID NO: 2058915 - RNA, 15 nt, Human
auacaguuuuccuaa

SEQ ID NO: 2058916 - RNA, 20 nt, Human
auacaguuuuccuaaaugua

SEQ ID NO: 2058917 - RNA, 21 nt, Human
auacaguuuuccuaaauguau

SEQ ID NO: 2058918 - RNA, 14 nt, Human
auacaugacacuga

SEQ ID NO: 2058919 - RNA, 15 nt, Human
auacaugacacugaa

SEQ ID NO: 2058920 - RNA, 16 nt, Human
auacaugacacugaaa

SEQ ID NO: 2058921 - RNA, 19 nt, Human
auacaugacacugaaaugc

SEQ ID NO: 2058922 - RNA, 15 nt, Human
auacauuuauaaugu

SEQ ID NO: 2058923 - RNA, 20 nt, Human
auacauuuauaauguuugcu

SEQ ID NO: 2058924 - RNA, 21 nt, Human
auacauuuauaauguuugcua

SEQ ID NO: 2058925 - RNA, 23 nt, Human
auacauuuauaauguuugcuauu

SEQ ID NO: 2058926 - RNA, 16 nt, Human
auacauuugauaaagu

SEQ ID NO: 2058927 - RNA, 12 nt, Human
auacauuuguau

SEQ ID NO: 2058928 - RNA, 17 nt, Human
auacauuuguauguugu

SEQ ID NO: 2058929 - RNA, 21 nt, Human
auacauuuguauguugugaag

SEQ ID NO: 2058930 - RNA, 19 nt, Human
auaccaaaauuauuucaga

SEQ ID NO: 2058931 - RNA, 18 nt, Human
auaccaaaauuauuucag

SEQ ID NO: 2058932 - RNA, 20 nt, Human
auaccaaaauuauuucagaa

SEQ ID NO: 2058933 - RNA, 13 nt, Human
uuaucaagcuaau

SEQ ID NO: 2058934 - RNA, 20 nt, Human
uuaucaagcuaauaaaauau

SEQ ID NO: 2058935 - RNA, 18 nt, Human
uuaucacugacacaaaaa

SEQ ID NO: 2058936 - RNA, 15 nt, Human
uuaucacuuuucugu

SEQ ID NO: 2058937 - RNA, 20 nt, Human
auacuaagauguucacugug

SEQ ID NO: 2058938 - RNA, 11 nt, Human
uuaucaugcaa

SEQ ID NO: 2058939 - RNA, 16 nt, Human
uuaucagugacagagu

SEQ ID NO: 2058940 - RNA, 17 nt, Human
uuaucagugacagaguu

SEQ ID NO: 2058941 - RNA, 16 nt, Human
uuaucaugcaaaugcu

SEQ ID NO: 2058942 - RNA, 13 nt, Human
uuaucaugcuguc

SEQ ID NO: 2058943 - RNA, 16 nt, Human
uuaucaugcugucuuu

SEQ ID NO: 2058944 - RNA, 14 nt, Human
auacuaagaaaaga

SEQ ID NO: 2058945 - RNA, 23 nt, Human
auaccagcuacuccggaggcuga

SEQ ID NO: 2058946 - RNA, 18 nt, Human
auaccagcuuagauuuua

SEQ ID NO: 2058947 - RNA, 17 nt, Human
auaccaggccgccccag

SEQ ID NO: 2058948 - RNA, 14 nt, Human
auaccagguugaaa

SEQ ID NO: 2058949 - RNA, 16 nt, Human
auaccagguugaaaga

SEQ ID NO: 2058950 - RNA, 12 nt, Human
auaccagugugg

SEQ ID NO: 2058951 - RNA, 11 nt, Human
auaccaucagc

SEQ ID NO: 2058952 - RNA, 17 nt, Human
auaccaucagcaaagaa

SEQ ID NO: 2058953 - RNA, 16 nt, Human
auacuagccagagcuc

SEQ ID NO: 2058954 - RNA, 18 nt, Human
auacuagccagagcuccu

SEQ ID NO: 2058955 - RNA, 22 nt, Human
auacuagccagagcuccuccuu

SEQ ID NO: 2058956 - RNA, 20 nt, Human
auacuauuuaguuuuuguaa

SEQ ID NO: 2058957 - RNA, 23 nt, Human
auacuauuuaguuuuuguaauuu

SEQ ID NO: 2058958 - RNA, 17 nt, Human
aguguacagucuuguau

SEQ ID NO: 2058959 - RNA, 13 nt, Human
aguguaccauaau

SEQ ID NO: 2058960 - RNA, 22 nt, Human
agugguguuuuaaagagaaugu

SEQ ID NO: 2058961 - RNA, 23 nt, Human
aguguacauggaauaacauguaa

SEQ ID NO: 2058962 - RNA, 19 nt, Human
aguguagauuuguuuugug

SEQ ID NO: 2058963 - RNA, 16 nt, Human
aguguagccccaagaa

SEQ ID NO: 2058964 - RNA, 17 nt, Human
aguguagccccaagaag

SEQ ID NO: 2058965 - RNA, 21 nt, Human
aguguagccccaagaaggcug

SEQ ID NO: 2058966 - RNA, 22 nt, Human
aguguagccccaagaaggcugg

SEQ ID NO: 2058967 - RNA, 13 nt, Human
aguguagccuugc

SEQ ID NO: 2058968 - RNA, 18 nt, Human
aguguaggcuuuacuuag

SEQ ID NO: 2058969 - RNA, 19 nt, Human
aguguaggcuuuacuuagc

SEQ ID NO: 2058970 - RNA, 22 nt, Human
aguguaggcuuuacuuagcuua

SEQ ID NO: 2058971 - RNA, 12 nt, Human
uguuaugauaaa

SEQ ID NO: 2058972 - RNA, 15 nt, Human
uguuaugauaaaaaa

SEQ ID NO: 2058973 - RNA, 19 nt, Human
uguuaugauaaaaaauuuu

SEQ ID NO: 2058974 - RNA, 21 nt, Human
uguuaugauaaaaaauuuugu

SEQ ID NO: 2058975 - RNA, 15 nt, Human
aguguagccuugccc

SEQ ID NO: 2058976 - RNA, 17 nt, Human
aguguagccuugcccgg

SEQ ID NO: 2058977 - RNA, 18 nt, Human
aguguagccuugcccgga

SEQ ID NO: 2058978 - RNA, 19 nt, Human
uguuauuuucuuugaaauu

SEQ ID NO: 2058979 - RNA, 18 nt, Human
uguuauuuucuguugaag

SEQ ID NO: 2058980 - RNA, 16 nt, Human
uguuauuuuuguuucu

SEQ ID NO: 2058981 - RNA, 21 nt, Human
uguuauuuuuguuucuuccaa

SEQ ID NO: 2058982 - RNA, 16 nt, Human
uguucccauucuugca

SEQ ID NO: 2058983 - RNA, 18 nt, Human
uguuauggcuuaaugaca

SEQ ID NO: 2058984 - RNA, 14 nt, Human
uguuauggaaacug

SEQ ID NO: 2058985 - RNA, 16 nt, Human
uguucuuaagacguga

SEQ ID NO: 2058986 - RNA, 18 nt, Human
uguucuguuuuguuuugu

SEQ ID NO: 2058987 - RNA, 13 nt, Human
uguucugggacac

SEQ ID NO: 2058988 - RNA, 12 nt, Human
uguucugggaca

SEQ ID NO: 2058989 - RNA, 22 nt, Human
uguuccccacugacagccuccc

SEQ ID NO: 2058990 - RNA, 15 nt, Human
uguucugggacacag

SEQ ID NO: 2058991 - RNA, 14 nt, Human
uguucugggacaca

SEQ ID NO: 2058992 - RNA, 13 nt, Human
aguguacagucuu

SEQ ID NO: 2058993 - RNA, 15 nt, Human
aguguacagucuugu

SEQ ID NO: 2058994 - RNA, 16 nt, Human
aguguacagucuugua

SEQ ID NO: 2058995 - RNA, 21 nt, Human
aguguacauggaauaacaugu

SEQ ID NO: 2058996 - RNA, 22 nt, Human
aguguacauggaauaacaugua

SEQ ID NO: 2058997 - RNA, 20 nt, Human
agugguucuacaaucuauuu

SEQ ID NO: 2058998 - RNA, 21 nt, Human
agugguucuacaaucuauuua

SEQ ID NO: 2058999 - RNA, 22 nt, Human
agugguuucauaggagacacau

SEQ ID NO: 2059000 - RNA, 22 nt, Human
aguguaacauaugcaaacauaa

SEQ ID NO: 2059001 - RNA, 13 nt, Human
aguguaaguguga

SEQ ID NO: 2059002 - RNA, 13 nt, Human
aguguaaaaauga

SEQ ID NO: 2059003 - RNA, 14 nt, Human
aguguaaaaaugag

SEQ ID NO: 2059004 - RNA, 15 nt, Human
aguguaaaaaugaga

SEQ ID NO: 2059005 - RNA, 16 nt, Human
aguguaaaaaugagaa

SEQ ID NO: 2059006 - RNA, 17 nt, Human
aguguaaaaaugagaac

SEQ ID NO: 2059007 - RNA, 16 nt, Human
aguggugcgaucuggg

SEQ ID NO: 2059008 - RNA, 13 nt, Human
aguggucuuucug

SEQ ID NO: 2059009 - RNA, 15 nt, Human
aguggucuuucugga

SEQ ID NO: 2059010 - RNA, 16 nt, Human
aguggucuuucuggag

SEQ ID NO: 2059011 - RNA, 18 nt, Human
aguggucuuucuggagag

SEQ ID NO: 2059012 - RNA, 20 nt, Human
aguggucuuucuggagaggu

SEQ ID NO: 2059013 - RNA, 19 nt, Human
agugggugaauaauacagu

SEQ ID NO: 2059014 - RNA, 21 nt, Human
aguggguuucacaagugaaaa

SEQ ID NO: 2059015 - RNA, 15 nt, Human
aguggguuucacaag

SEQ ID NO: 2059016 - RNA, 11 nt, Human
aguggcagcug

SEQ ID NO: 2059017 - RNA, 15 nt, Human
ugugcaacagacaag

SEQ ID NO: 2059018 - RNA, 14 nt, Human
ugugcaacagacaa

SEQ ID NO: 2059019 - RNA, 13 nt, Human
ugugcaaaaauuu

SEQ ID NO: 2059020 - RNA, 14 nt, Human
ugugcaaaaauuuu

SEQ ID NO: 2059021 - RNA, 15 nt, Human
ugugcaaaaauuuuu

SEQ ID NO: 2059022 - RNA, 17 nt, Human
ugugcaaaaauuuuugg

SEQ ID NO: 2059023 - RNA, 18 nt, Human
ugugcaaaaauuuuugga

SEQ ID NO: 2059024 - RNA, 12 nt, Human
ugugcaaauccu

SEQ ID NO: 2059025 - RNA, 13 nt, Human
aguggcagcugcu

SEQ ID NO: 2059026 - RNA, 12 nt, Human
aguggcagcugc

SEQ ID NO: 2059027 - RNA, 20 nt, Human
aguggcagcugcuuuugucu

SEQ ID NO: 2059028 - RNA, 14 nt, Human
aguggcagcugcuu

SEQ ID NO: 2059029 - RNA, 18 nt, Human
agugggggaucacagccu

SEQ ID NO: 2059030 - RNA, 13 nt, Human
agugggugaauaa

SEQ ID NO: 2059031 - RNA, 18 nt, Human
agugggugaauaauacag

SEQ ID NO: 2059032 - RNA, 12 nt, Human
aguggggcuggg

SEQ ID NO: 2059033 - RNA, 14 nt, Human
uguuguaaauauuu

SEQ ID NO: 2059034 - RNA, 15 nt, Human
uguuguaaagaguug

SEQ ID NO: 2059035 - RNA, 21 nt, Human
uguuguaaauauuuauguaaa

SEQ ID NO: 2059036 - RNA, 13 nt, Human
uguugucagcuga

SEQ ID NO: 2059037 - RNA, 19 nt, Human
aguucgagaccagccuggc

SEQ ID NO: 2059038 - RNA, 18 nt, Human
aguucgagaccagccugg

SEQ ID NO: 2059039 - RNA, 21 nt, Human
aguucgagaccagccuggcca

SEQ ID NO: 2059040 - RNA, 18 nt, Human
aguuauuucuuguuuguu

SEQ ID NO: 2059041 - RNA, 13 nt, Human
aguucaaacaaga

SEQ ID NO: 2059042 - RNA, 21 nt, Human
aguuauuuuuauuuauuuaaa

SEQ ID NO: 2059043 - RNA, 17 nt, Human
aguucccuacuuccugu

SEQ ID NO: 2059044 - RNA, 14 nt, Human
aguucccugaaaac

SEQ ID NO: 2059045 - RNA, 19 nt, Human
aguucccugaaaacccaga

SEQ ID NO: 2059046 - RNA, 20 nt, Human
aguucccugaaaacccagag

SEQ ID NO: 2059047 - RNA, 24 nt, Human
aguucccugaaaacccagagagga

SEQ ID NO: 2059048 - RNA, 21 nt, Human
aguucccugaaaacccagaga

SEQ ID NO: 2059049 - RNA, 13 nt, Human
aguucccuuggcc

SEQ ID NO: 2059050 - RNA, 20 nt, Human
aguuccugucccuucucuua

SEQ ID NO: 2059051 - RNA, 15 nt, Human
aguucccuuggccuc

SEQ ID NO: 2059052 - RNA, 16 nt, Human
aguucccuuggccuca

SEQ ID NO: 2059053 - RNA, 17 nt, Human
aguucccuuggccucag

SEQ ID NO: 2059054 - RNA, 18 nt, Human
aguucccuuggccucaga

SEQ ID NO: 2059055 - RNA, 20 nt, Human
aguuccuugaucuguauaua

SEQ ID NO: 2059056 - RNA, 14 nt, Human
aguuccuuauguau

SEQ ID NO: 2059057 - RNA, 20 nt, Human
aguuccuucagcuuccauuu

SEQ ID NO: 2059058 - RNA, 21 nt, Human
aguuccugucccuucucuuaa

SEQ ID NO: 2059059 - RNA, 23 nt, Human
aguuccugucccuucucuuaauu

SEQ ID NO: 2059060 - RNA, 17 nt, Human
aguucgagaccagccug

SEQ ID NO: 2059061 - RNA, 14 nt, Human
aguucgagaccagc

SEQ ID NO: 2059062 - RNA, 18 nt, Human
aguucgagaccaaccuga

SEQ ID NO: 2059063 - RNA, 21 nt, Human
aguucgaugggcccaauucuu

SEQ ID NO: 2059064 - RNA, 17 nt, Human
aguuauugacaaacucu

SEQ ID NO: 2059065 - RNA, 18 nt, Human
aguuauugacaaacucuc

SEQ ID NO: 2059066 - RNA, 17 nt, Human
aguuauuaauuucuuca

SEQ ID NO: 2059067 - RNA, 15 nt, Human
aguuaugugaaugau

SEQ ID NO: 2059068 - RNA, 13 nt, Human
aguuaugugaaug

SEQ ID NO: 2059069 - RNA, 14 nt, Human
aguuaugugaauga

SEQ ID NO: 2059070 - RNA, 21 nt, Human
aguuauggccuauacacuauu

SEQ ID NO: 2059071 - RNA, 18 nt, Human
aguuauggccuauacacu

SEQ ID NO: 2059072 - RNA, 12 nt, Human
aguuauaaauca

SEQ ID NO: 2059073 - RNA, 15 nt, Human
aguguuguuuguaaa

SEQ ID NO: 2059074 - RNA, 18 nt, Human
aguguuguuuguaaauaa

SEQ ID NO: 2059075 - RNA, 19 nt, Human
aguguuguuuguaaauaag

SEQ ID NO: 2059076 - RNA, 20 nt, Human
aguguuguuuguaaauaaga

SEQ ID NO: 2059077 - RNA, 21 nt, Human
aguguuguuuguaaauaagag

SEQ ID NO: 2059078 - RNA, 22 nt, Human
aguguuguuuguaaauaagaga

SEQ ID NO: 2059079 - RNA, 14 nt, Human
aguguuucaugggu

SEQ ID NO: 2059080 - RNA, 15 nt, Human
aguguuucccauaau

SEQ ID NO: 2059081 - RNA, 16 nt, Human
aguguuucccauaauu

SEQ ID NO: 2059082 - RNA, 19 nt, Human
aguguuucgacagcugauu

SEQ ID NO: 2059083 - RNA, 15 nt, Human
aguuaguagcauguu

SEQ ID NO: 2059084 - RNA, 18 nt, Human
aguuagguuuaacauaaa

SEQ ID NO: 2059085 - RNA, 19 nt, Human
aguuagguuuaacauaaag

SEQ ID NO: 2059086 - RNA, 23 nt, Human
aguuagguuuaacauaaagguua

SEQ ID NO: 2059087 - RNA, 14 nt, Human
aguuaguagcaugu

SEQ ID NO: 2059088 - RNA, 16 nt, Human
aguuaguagcauguug

SEQ ID NO: 2059089 - RNA, 17 nt, Human
aguuaguagcauguuga

SEQ ID NO: 2059090 - RNA, 16 nt, Human
aguuaguuucuuuggg

SEQ ID NO: 2059091 - RNA, 17 nt, Human
aguuaguuucuuuggga

SEQ ID NO: 2059092 - RNA, 17 nt, Human
aguuaggaaauaaaacc

SEQ ID NO: 2059093 - RNA, 17 nt, Human
aguuagggaauggcaca

SEQ ID NO: 2059094 - RNA, 18 nt, Human
aguuaggcuauucacaac

SEQ ID NO: 2059095 - RNA, 18 nt, Human
aguuaggaaauaaaaccu

SEQ ID NO: 2059096 - RNA, 20 nt, Human
aguuaggaaauaaaaccuuu

SEQ ID NO: 2059097 - RNA, 21 nt, Human
aguuaggaaauaaaaccuuuc

SEQ ID NO: 2059098 - RNA, 22 nt, Human
aguuaggaaauaaaaccuuuca

SEQ ID NO: 2059099 - RNA, 13 nt, Human
aguucuguguauu

SEQ ID NO: 2059100 - RNA, 16 nt, Human
aguucuguguauuuaa

SEQ ID NO: 2059101 - RNA, 21 nt, Human
aguucuguguauuuaauugua

SEQ ID NO: 2059102 - RNA, 22 nt, Human
aguucuguguauuuaauuguaa

SEQ ID NO: 2059103 - RNA, 13 nt, Human
aguugauucagcu

SEQ ID NO: 2059104 - RNA, 15 nt, Human
aguugauguugcauu

SEQ ID NO: 2059105 - RNA, 16 nt, Human
aguugauguugcauuu

SEQ ID NO: 2059106 - RNA, 23 nt, Human
aguugauucagcucugcaagaau

SEQ ID NO: 2059107 - RNA, 21 nt, Human
aguugauuuuacaauugaaau

SEQ ID NO: 2059108 - RNA, 23 nt, Human
aguugauuuuacaauugaaauga

SEQ ID NO: 2059109 - RNA, 14 nt, Human
aguugauucagcuc

SEQ ID NO: 2059110 - RNA, 15 nt, Human
aguugauucagcucu

SEQ ID NO: 2059111 - RNA, 17 nt, Human
aguugauucagcucugc

SEQ ID NO: 2059112 - RNA, 18 nt, Human
aguugauucagcucugca

SEQ ID NO: 2059113 - RNA, 15 nt, Human
uguuugcucagaaca

SEQ ID NO: 2059114 - RNA, 17 nt, Human
uguuugcucagaacaca

SEQ ID NO: 2059115 - RNA, 23 nt, Human
uguuugcucagaacacauucuuu

SEQ ID NO: 2059116 - RNA, 20 nt, Human
uguuugcucagcuucuccaa

SEQ ID NO: 2059117 - RNA, 11 nt, Human
uguuuggcugg

SEQ ID NO: 2059118 - RNA, 15 nt, Human
uguuuggggaugaga

SEQ ID NO: 2059119 - RNA, 12 nt, Human
uguuuggcuggg

SEQ ID NO: 2059120 - RNA, 19 nt, Human
uguuuggggaugagaaagg

SEQ ID NO: 2059121 - RNA, 14 nt, Human
uguugucagcugaa

SEQ ID NO: 2059122 - RNA, 15 nt, Human
uguugucagcaucuu

SEQ ID NO: 2059123 - RNA, 17 nt, Human
uguugucagcaucuucu

SEQ ID NO: 2059124 - RNA, 15 nt, Human
uguugucauugcuuu

SEQ ID NO: 2059125 - RNA, 16 nt, Human
uguugucauugcuuua

SEQ ID NO: 2059126 - RNA, 17 nt, Human
uguugucauugcuuuac

SEQ ID NO: 2059127 - RNA, 19 nt, Human
uguugucauugcuuuacug

SEQ ID NO: 2059128 - RNA, 20 nt, Human
uguugucauugcuuuacugg

SEQ ID NO: 2059129 - RNA, 16 nt, Human
uguuugccucugccuc

SEQ ID NO: 2059130 - RNA, 14 nt, Human
uguuugccucugcc

SEQ ID NO: 2059131 - RNA, 22 nt, Human
uguuuucaaaccaguauacaag

SEQ ID NO: 2059132 - RNA, 23 nt, Human
uguuuucaaaccaguauacaaga

SEQ ID NO: 2059133 - RNA, 15 nt, Human
uguuuucagacucag

SEQ ID NO: 2059134 - RNA, 15 nt, Human
uguuuucaguguaca

SEQ ID NO: 2059135 - RNA, 14 nt, Human
uguuuuaggagcau

SEQ ID NO: 2059136 - RNA, 14 nt, Human
uguuuuacugcuuu

SEQ ID NO: 2059137 - RNA, 16 nt, Human
uguuuuacugcuuuua

SEQ ID NO: 2059138 - RNA, 19 nt, Human
uguuuuagaaugaugcaca

SEQ ID NO: 2059139 - RNA, 24 nt, Human
uguuuuagaaugaugcacauuuca

SEQ ID NO: 2059140 - RNA, 17 nt, Human
uguuuucaguguacaug

SEQ ID NO: 2059141 - RNA, 15 nt, Human
uguuuucucuugaga

SEQ ID NO: 2059142 - RNA, 20 nt, Human
aguuuccucaggcugcugga

SEQ ID NO: 2059143 - RNA, 23 nt, Human
aguuuccucaggcugcuggagga

SEQ ID NO: 2059144 - RNA, 15 nt, Human
aguuucucagcuccc

SEQ ID NO: 2059145 - RNA, 16 nt, Human
aguuucucagcuccca

SEQ ID NO: 2059146 - RNA, 12 nt, Human
uuaaauaaaugu

SEQ ID NO: 2059147 - RNA, 21 nt, Human
uuaaauuauaacuuaaaauau

SEQ ID NO: 2059148 - RNA, 16 nt, Human
aguuucaauucagugc

SEQ ID NO: 2059149 - RNA, 18 nt, Human
aguuuccucaggcugcug

SEQ ID NO: 2059150 - RNA, 22 nt, Human
aguuucaaguauccuuguugac

SEQ ID NO: 2059151 - RNA, 21 nt, Human
aguuuuauugagaauuuuaaa

SEQ ID NO: 2059152 - RNA, 16 nt, Human
aguuuuauugagaauu

SEQ ID NO: 2059153 - RNA, 22 nt, Human
aguuuucacucuuauugcccac

SEQ ID NO: 2059154 - RNA, 16 nt, Human
aguuuucagaaccucu

SEQ ID NO: 2059155 - RNA, 12 nt, Human
aguuuuccauga

SEQ ID NO: 2059156 - RNA, 13 nt, Human
aguuuuccaugaa

SEQ ID NO: 2059157 - RNA, 16 nt, Human
aguuuuccaugaaaac

SEQ ID NO: 2059158 - RNA, 21 nt, Human
aguuuuccauggucacagaga

SEQ ID NO: 2059159 - RNA, 21 nt, Human
aguuuuccaugaaaacguuuu

SEQ ID NO: 2059160 - RNA, 22 nt, Human
aguuuucagaaccucuucccca

SEQ ID NO: 2059161 - RNA, 17 nt, Human
aguuuucagaaccucuu

SEQ ID NO: 2059162 - RNA, 18 nt, Human
aguuuucagaaccucuuc

SEQ ID NO: 2059163 - RNA, 20 nt, Human
aguuuucagaaccucuuccc

SEQ ID NO: 2059164 - RNA, 21 nt, Human
aguuuucagaaccucuucccc

SEQ ID NO: 2059165 - RNA, 23 nt, Human
aguuuguacagacguaugcuuau

SEQ ID NO: 2059166 - RNA, 22 nt, Human
aguuuguaugccaagugagaag

SEQ ID NO: 2059167 - RNA, 14 nt, Human
aguuugucagacuu

SEQ ID NO: 2059168 - RNA, 16 nt, Human
aguuugguuucuagca

SEQ ID NO: 2059169 - RNA, 22 nt, Human
aguuuguacagacguaugcuua

SEQ ID NO: 2059170 - RNA, 20 nt, Human
aguuuggggguuuugcuguu

SEQ ID NO: 2059171 - RNA, 17 nt, Human
aguugcacacucacugg

SEQ ID NO: 2059172 - RNA, 20 nt, Human
aguugcaauugaauuaaauu

SEQ ID NO: 2059173 - RNA, 18 nt, Human
aguugcaauugaauuaaa

SEQ ID NO: 2059174 - RNA, 19 nt, Human
aguugcaauugaauuaaau

SEQ ID NO: 2059175 - RNA, 17 nt, Human
uuaaaacaacacucaca

SEQ ID NO: 2059176 - RNA, 20 nt, Human
uuaaaaauaauagagcccca

SEQ ID NO: 2059177 - RNA, 16 nt, Human
uuaaaaagucugcauu

SEQ ID NO: 2059178 - RNA, 17 nt, Human
uuaaaaagucugcauua

SEQ ID NO: 2059179 - RNA, 21 nt, Human
uuaaaaagucugcauuacauu

SEQ ID NO: 2059180 - RNA, 22 nt, Human
uuaaaaagucugcauuacauuc

SEQ ID NO: 2059181 - RNA, 20 nt, Human
uuaaaaaguuauaaccaacu

SEQ ID NO: 2059182 - RNA, 18 nt, Human
uuaaaaaguggaaaaaua

SEQ ID NO: 2059183 - RNA, 13 nt, Human
uuaaaaaacuugu

SEQ ID NO: 2059184 - RNA, 12 nt, Human
uuaaauuauaag

SEQ ID NO: 2059185 - RNA, 13 nt, Human
uuaaauuauaagg

SEQ ID NO: 2059186 - RNA, 14 nt, Human
uuaaauuauaagga

SEQ ID NO: 2059187 - RNA, 15 nt, Human
uuaaauuauaaggac

SEQ ID NO: 2059188 - RNA, 17 nt, Human
uuaaauuauaaggacug

SEQ ID NO: 2059189 - RNA, 18 nt, Human
uuaaauuauaaggacugc

SEQ ID NO: 2059190 - RNA, 19 nt, Human
uuaaauuauaaggacugca

SEQ ID NO: 2059191 - RNA, 20 nt, Human
uuaaauuauaaggacugcau

SEQ ID NO: 2059192 - RNA, 13 nt, Human
uuaaauaaaucau

SEQ ID NO: 2059193 - RNA, 15 nt, Human
uuaaauaaaucauaa

SEQ ID NO: 2059194 - RNA, 20 nt, Human
uuaaauaaaagaaaugcaca

SEQ ID NO: 2059195 - RNA, 21 nt, Human
uuaaauaaaagaaaugcacaa

SEQ ID NO: 2059196 - RNA, 22 nt, Human
uuaaauaaaagaaaugcacaau

SEQ ID NO: 2059197 - RNA, 12 nt, Human
uuaaaacaaaca

SEQ ID NO: 2059198 - RNA, 13 nt, Human
uuaaauaaaagug

SEQ ID NO: 2059199 - RNA, 14 nt, Human
uuaaauaaaaguga

SEQ ID NO: 2059200 - RNA, 20 nt, Human
uuaaauaaaagugaucaaua

SEQ ID NO: 2059201 - RNA, 12 nt, Human
uuaaauaaaaua

SEQ ID NO: 2059202 - RNA, 15 nt, Human
uuaaauaaaauaacc

SEQ ID NO: 2059203 - RNA, 20 nt, Human
uuaaaauauauauguugauu

SEQ ID NO: 2059204 - RNA, 12 nt, Human
uuaaaauauauu

SEQ ID NO: 2059205 - RNA, 22 nt, Human
uuaaaaauuggcuaguugaauc

SEQ ID NO: 2059206 - RNA, 12 nt, Human
uuaaaauauuuu

SEQ ID NO: 2059207 - RNA, 14 nt, Human
uuaaaauauuuuau

SEQ ID NO: 2059208 - RNA, 12 nt, Human
uuaaaaucacua

SEQ ID NO: 2059209 - RNA, 17 nt, Human
uuaaaaucacuaacauu

SEQ ID NO: 2059210 - RNA, 19 nt, Human
uuaaaaucacuaacauuau

SEQ ID NO: 2059211 - RNA, 20 nt, Human
uuaaaaucacuaacauuaua

SEQ ID NO: 2059212 - RNA, 21 nt, Human
uuaaaaucacuaacauuauau

SEQ ID NO: 2059213 - RNA, 23 nt, Human
uuaaaaucacuaacauuauauug

SEQ ID NO: 2059214 - RNA, 19 nt, Human
uuaaaauauuccugcauuu

SEQ ID NO: 2059215 - RNA, 16 nt, Human
uuaaaauauuccugca

SEQ ID NO: 2059216 - RNA, 17 nt, Human
uuaaaccgccaaggcug

SEQ ID NO: 2059217 - RNA, 20 nt, Human
uuaaacccuggaucaguccu

SEQ ID NO: 2059218 - RNA, 14 nt, Human
uuaaaccuauacuc

SEQ ID NO: 2059219 - RNA, 17 nt, Human
uuaaaccuauacucacu

SEQ ID NO: 2059220 - RNA, 21 nt, Human
ugauuucagcaccuacagugu

SEQ ID NO: 2059221 - RNA, 20 nt, Human
ugauuucagcaccuacagug

SEQ ID NO: 2059222 - RNA, 20 nt, Human
ugauuuagcaggaagcugug

SEQ ID NO: 2059223 - RNA, 17 nt, Human
ugauuuagauugaguaa

SEQ ID NO: 2059224 - RNA, 20 nt, Human
ugauuuagauugaguaagau

SEQ ID NO: 2059225 - RNA, 17 nt, Human
ugauuuagcaggaagcu

SEQ ID NO: 2059226 - RNA, 19 nt, Human
ugauuucaggauacucugu

SEQ ID NO: 2059227 - RNA, 11 nt, Human
ugauuucagga

SEQ ID NO: 2059228 - RNA, 18 nt, Human
ugauuucaggauacucug

SEQ ID NO: 2059229 - RNA, 23 nt, Human
ugauuucaggauacucugucaga

SEQ ID NO: 2059230 - RNA, 17 nt, Human
ugauuucuuguaacauc

SEQ ID NO: 2059231 - RNA, 13 nt, Human
ugauucuccugcc

SEQ ID NO: 2059232 - RNA, 23 nt, Human
ugauucccaagcucugcuccucu

SEQ ID NO: 2059233 - RNA, 22 nt, Human
ugauucccaagcucugcuccuc

SEQ ID NO: 2059234 - RNA, 18 nt, Human
ugauucccuccugcuacu

SEQ ID NO: 2059235 - RNA, 17 nt, Human
ugauucccuccugcuac

SEQ ID NO: 2059236 - RNA, 13 nt, Human
agcccagcuggug

SEQ ID NO: 2059237 - RNA, 16 nt, Human
agcccagcugguggga

SEQ ID NO: 2059238 - RNA, 21 nt, Human
agcccagccauuaccauggag

SEQ ID NO: 2059239 - RNA, 15 nt, Human
agcccagcagggccu

SEQ ID NO: 2059240 - RNA, 20 nt, Human
agcccagcagggccucaaag

SEQ ID NO: 2059241 - RNA, 20 nt, Human
agcccagcuggugggaagcg

SEQ ID NO: 2059242 - RNA, 13 nt, Human
agccaucauggau

SEQ ID NO: 2059243 - RNA, 12 nt, Human
agccaucaugua

SEQ ID NO: 2059244 - RNA, 21 nt, Human
agccaggcugccaaggccaga

SEQ ID NO: 2059245 - RNA, 20 nt, Human
agccagggauggggccacag

SEQ ID NO: 2059246 - RNA, 21 nt, Human
agccagggauggggccacagc

SEQ ID NO: 2059247 - RNA, 22 nt, Human
agccagggauggggccacagcc

SEQ ID NO: 2059248 - RNA, 23 nt, Human
agccagggauggggccacagcca

SEQ ID NO: 2059249 - RNA, 13 nt, Human
agccagcucucag

SEQ ID NO: 2059250 - RNA, 14 nt, Human
agccagcucucagc

SEQ ID NO: 2059251 - RNA, 15 nt, Human
agccagcucucagcc

SEQ ID NO: 2059252 - RNA, 16 nt, Human
agccagcucucagcca

SEQ ID NO: 2059253 - RNA, 18 nt, Human
agccaggcucaggccaug

SEQ ID NO: 2059254 - RNA, 20 nt, Human
agccaggcugccaaggccag

SEQ ID NO: 2059255 - RNA, 15 nt, Human
agcccacuucugcca

SEQ ID NO: 2059256 - RNA, 14 nt, Human
agcccacuucugcc

SEQ ID NO: 2059257 - RNA, 13 nt, Human
agcccacuucugc

SEQ ID NO: 2059258 - RNA, 12 nt, Human
agcccacuggau

SEQ ID NO: 2059259 - RNA, 14 nt, Human
agcccacuggauca

SEQ ID NO: 2059260 - RNA, 20 nt, Human
agcccacuggaucagaaaga

SEQ ID NO: 2059261 - RNA, 18 nt, Human
agccauggacucuacacu

SEQ ID NO: 2059262 - RNA, 18 nt, Human
agccaugaggaguugcug

SEQ ID NO: 2059263 - RNA, 19 nt, Human
agccaugaggaguugcugu

SEQ ID NO: 2059264 - RNA, 20 nt, Human
agccaugaggaguugcuguu

SEQ ID NO: 2059265 - RNA, 20 nt, Human
agccaugacuugagaaacaa

SEQ ID NO: 2059266 - RNA, 22 nt, Human
agccaucggugaaacuaacaga

SEQ ID NO: 2059267 - RNA, 22 nt, Human
agccaucucucuacuccuaccu

SEQ ID NO: 2059268 - RNA, 12 nt, Human
agccagcccucc

SEQ ID NO: 2059269 - RNA, 13 nt, Human
agccagcccuccc

SEQ ID NO: 2059270 - RNA, 15 nt, Human
agccagcccucccug

SEQ ID NO: 2059271 - RNA, 16 nt, Human
agccagcccucccugu

SEQ ID NO: 2059272 - RNA, 18 nt, Human
agccagcccucccugucc

SEQ ID NO: 2059273 - RNA, 20 nt, Human
agccagcccucccuguccuc

SEQ ID NO: 2059274 - RNA, 22 nt, Human
agccagcccucccuguccuccu

SEQ ID NO: 2059275 - RNA, 23 nt, Human
agccagcccucccuguccuccuc

SEQ ID NO: 2059276 - RNA, 12 nt, Human
agccagcccagc

SEQ ID NO: 2059277 - RNA, 14 nt, Human
agccagcccagccc

SEQ ID NO: 2059278 - RNA, 15 nt, Human
agccagcccagccca

SEQ ID NO: 2059279 - RNA, 16 nt, Human
agccagcccagcccag

SEQ ID NO: 2059280 - RNA, 17 nt, Human
agccagcccagcccagc

SEQ ID NO: 2059281 - RNA, 18 nt, Human
agccagcccagcccagcu

SEQ ID NO: 2059282 - RNA, 19 nt, Human
agccacugcaccgggccac

SEQ ID NO: 2059283 - RNA, 18 nt, Human
agccacugcaccgggcca

SEQ ID NO: 2059284 - RNA, 20 nt, Human
agccacugcaccgggccaca

SEQ ID NO: 2059285 - RNA, 15 nt, Human
agccacucaggaggc

SEQ ID NO: 2059286 - RNA, 22 nt, Human
agccacucaggaggcugaggca

SEQ ID NO: 2059287 - RNA, 22 nt, Human
agccacguuccuuacugcagaa

SEQ ID NO: 2059288 - RNA, 23 nt, Human
agccacguuccuuacugcagaau

SEQ ID NO: 2059289 - RNA, 16 nt, Human
agccacugcaccgggc

SEQ ID NO: 2059290 - RNA, 17 nt, Human
agccacguuccuuacug

SEQ ID NO: 2059291 - RNA, 18 nt, Human
agccacguuccuuacugc

SEQ ID NO: 2059292 - RNA, 20 nt, Human
agccacguuccuuacugcag

SEQ ID NO: 2059293 - RNA, 21 nt, Human
agccacguuccuuacugcaga

SEQ ID NO: 2059294 - RNA, 14 nt, Human
ugauuaaugcuaaa

SEQ ID NO: 2059295 - RNA, 16 nt, Human
ugauggugaugaaaug

SEQ ID NO: 2059296 - RNA, 15 nt, Human
ugauggugaugaaau

SEQ ID NO: 2059297 - RNA, 17 nt, Human
ugauggugaugaaaugu

SEQ ID NO: 2059298 - RNA, 19 nt, Human
ugauuaaccacuucagcug

SEQ ID NO: 2059299 - RNA, 15 nt, Human
ugaugacccaggcug

SEQ ID NO: 2059300 - RNA, 22 nt, Human
ugaugacccaggcugccugagc

SEQ ID NO: 2059301 - RNA, 20 nt, Human
ugaugaagaaaagugggcca

SEQ ID NO: 2059302 - RNA, 14 nt, Human
ugaugacagacacu

SEQ ID NO: 2059303 - RNA, 15 nt, Human
ugaugacuggaauuu

SEQ ID NO: 2059304 - RNA, 17 nt, Human
ugaugacuggaauuuuu

SEQ ID NO: 2059305 - RNA, 20 nt, Human
ugaugacuggaauuuuuauu

SEQ ID NO: 2059306 - RNA, 23 nt, Human
ugaugacuggaauuuuuauuaug

SEQ ID NO: 2059307 - RNA, 18 nt, Human
ugaugaagaaaagugggc

SEQ ID NO: 2059308 - RNA, 21 nt, Human
ugauccucccaccucagccuc

SEQ ID NO: 2059309 - RNA, 16 nt, Human
ugauccucccaccuca

SEQ ID NO: 2059310 - RNA, 22 nt, Human
ugauccucccaccucagccucc

SEQ ID NO: 2059311 - RNA, 17 nt, Human
ugauccuccaacuucau

SEQ ID NO: 2059312 - RNA, 21 nt, Human
agcaccugccgaccucguccu

SEQ ID NO: 2059313 - RNA, 22 nt, Human
ugauccuaaugaaugcauaaaa

SEQ ID NO: 2059314 - RNA, 22 nt, Human
agcaccugccgaccucguccuc

SEQ ID NO: 2059315 - RNA, 15 nt, Human
ugauccucccaccuc

SEQ ID NO: 2059316 - RNA, 11 nt, Human
agcaccugccg

SEQ ID NO: 2059317 - RNA, 15 nt, Human
agcaccugccgaccu

SEQ ID NO: 2059318 - RNA, 16 nt, Human
agcaccugccgaccuc

SEQ ID NO: 2059319 - RNA, 19 nt, Human
agcaccugccgaccucguc

SEQ ID NO: 2059320 - RNA, 20 nt, Human
agcaccugccgaccucgucc

SEQ ID NO: 2059321 - RNA, 14 nt, Human
ugauggaaacaaag

SEQ ID NO: 2059322 - RNA, 15 nt, Human
ugauggaaacaaagu

SEQ ID NO: 2059323 - RNA, 17 nt, Human
ugauggaaacaaagugg

SEQ ID NO: 2059324 - RNA, 23 nt, Human
ugauggaaacaaaguggaaggaa

SEQ ID NO: 2059325 - RNA, 15 nt, Human
ugaugagcuccucuu

SEQ ID NO: 2059326 - RNA, 21 nt, Human
ugaugcuuguaacaagaaaac

SEQ ID NO: 2059327 - RNA, 22 nt, Human
ugaugcuuguaacaagaaaaca

SEQ ID NO: 2059328 - RNA, 23 nt, Human
ugaugcuuguaacaagaaaacau

SEQ ID NO: 2059329 - RNA, 15 nt, Human
ugcacucuagccgga

SEQ ID NO: 2059330 - RNA, 16 nt, Human
ugcagacucaauaaaa

SEQ ID NO: 2059331 - RNA, 19 nt, Human
ugcagacucaauaaaauca

SEQ ID NO: 2059332 - RNA, 22 nt, Human
ugcagacaggcaagcaccuccu

SEQ ID NO: 2059333 - RNA, 17 nt, Human
agccgagaucacgccac

SEQ ID NO: 2059334 - RNA, 21 nt, Human
agcccuuagcagggaaacagc

SEQ ID NO: 2059335 - RNA, 12 nt, Human
agcccuuggguu

SEQ ID NO: 2059336 - RNA, 16 nt, Human
agcccuuagcagggaa

SEQ ID NO: 2059337 - RNA, 18 nt, Human
agcccugucuccucucuc

SEQ ID NO: 2059338 - RNA, 12 nt, Human
agcccuguggaa

SEQ ID NO: 2059339 - RNA, 11 nt, Human
agcccugucuc

SEQ ID NO: 2059340 - RNA, 17 nt, Human
ugcagacucuacagagg

SEQ ID NO: 2059341 - RNA, 16 nt, Human
ugcagacucuacagag

SEQ ID NO: 2059342 - RNA, 18 nt, Human
ugcagacucuacagaggc

SEQ ID NO: 2059343 - RNA, 14 nt, Human
ugcagacucaguuu

SEQ ID NO: 2059344 - RNA, 15 nt, Human
ugcagacucaguuug

SEQ ID NO: 2059345 - RNA, 20 nt, Human
agcccugucagugcagcccg

SEQ ID NO: 2059346 - RNA, 19 nt, Human
ugcagacucaguuugucag

SEQ ID NO: 2059347 - RNA, 20 nt, Human
ugcagacucaguuugucaga

SEQ ID NO: 2059348 - RNA, 17 nt, Human
agcccugucagugcagc

SEQ ID NO: 2059349 - RNA, 19 nt, Human
agcccugucagugcagccc

SEQ ID NO: 2059350 - RNA, 21 nt, Human
agccuccaagcuccaucucca

SEQ ID NO: 2059351 - RNA, 17 nt, Human
agccucauccgaggcag

SEQ ID NO: 2059352 - RNA, 18 nt, Human
agccucauccgaggcagg

SEQ ID NO: 2059353 - RNA, 20 nt, Human
agccuccacugccucuggaa

SEQ ID NO: 2059354 - RNA, 17 nt, Human
agccuccaugcugccuc

SEQ ID NO: 2059355 - RNA, 23 nt, Human
agccucugaaaaccaauguucuc

SEQ ID NO: 2059356 - RNA, 17 nt, Human
agccucucuuccuaucc

SEQ ID NO: 2059357 - RNA, 20 nt, Human
agccucucuuccuaucccau

SEQ ID NO: 2059358 - RNA, 21 nt, Human
agccucucuuccuaucccauc

SEQ ID NO: 2059359 - RNA, 16 nt, Human
agccucugccugugca

SEQ ID NO: 2059360 - RNA, 18 nt, Human
agccucugagccccuggg

SEQ ID NO: 2059361 - RNA, 19 nt, Human
agccucugaaguuggacag

SEQ ID NO: 2059362 - RNA, 20 nt, Human
agccucugaaguuggacagc

SEQ ID NO: 2059363 - RNA, 23 nt, Human
ugcagccucaaccuccugggcua

SEQ ID NO: 2059364 - RNA, 22 nt, Human
ugcagccucaaccuccugggcu

SEQ ID NO: 2059365 - RNA, 21 nt, Human
ugcagccucaaccuccugggc

SEQ ID NO: 2059366 - RNA, 20 nt, Human
ugcagccucaaccuccuggg

SEQ ID NO: 2059367 - RNA, 20 nt, Human
agccucuggcuagaggccag

SEQ ID NO: 2059368 - RNA, 12 nt, Human
agccucuggcua

SEQ ID NO: 2059369 - RNA, 13 nt, Human
agccucuggcuag

SEQ ID NO: 2059370 - RNA, 14 nt, Human
agccucuggcuaga

SEQ ID NO: 2059371 - RNA, 15 nt, Human
agccucuggcuagag

SEQ ID NO: 2059372 - RNA, 12 nt, Human
agccucugcugc

SEQ ID NO: 2059373 - RNA, 13 nt, Human
agccucugcugcc

SEQ ID NO: 2059374 - RNA, 14 nt, Human
agccucugcugcca

SEQ ID NO: 2059375 - RNA, 18 nt, Human
agccucugcugccauggc

SEQ ID NO: 2059376 - RNA, 14 nt, Human
agccucauccgagg

SEQ ID NO: 2059377 - RNA, 22 nt, Human
agccucacuugaaugugucacu

SEQ ID NO: 2059378 - RNA, 18 nt, Human
agccgagaucacgccacu

SEQ ID NO: 2059379 - RNA, 19 nt, Human
agccucaaccuccugggcu

SEQ ID NO: 2059380 - RNA, 20 nt, Human
agccucaaccuccugggcua

SEQ ID NO: 2059381 - RNA, 21 nt, Human
agcccuuugggaggcugaggc

SEQ ID NO: 2059382 - RNA, 22 nt, Human
agcccuuugggaggcugaggcg

SEQ ID NO: 2059383 - RNA, 15 nt, Human
agccucacagaagaa

SEQ ID NO: 2059384 - RNA, 16 nt, Human
agccucacuugaaugu

SEQ ID NO: 2059385 - RNA, 17 nt, Human
agccucacuugaaugug

SEQ ID NO: 2059386 - RNA, 22 nt, Human
ugcaaguauguuuuagcaugug

SEQ ID NO: 2059387 - RNA, 17 nt, Human
ugcaagucacaaaggaa

SEQ ID NO: 2059388 - RNA, 18 nt, Human
ugcaagucacaaaggaau

SEQ ID NO: 2059389 - RNA, 18 nt, Human
ugcaaguaugugagugug

SEQ ID NO: 2059390 - RNA, 22 nt, Human
ugcaaguaugugagugugucca

SEQ ID NO: 2059391 - RNA, 19 nt, Human
ugcaaguauguuuuagcau

SEQ ID NO: 2059392 - RNA, 21 nt, Human
ugcaaguauguuuuagcaugu

SEQ ID NO: 2059393 - RNA, 15 nt, Human
ugcaaguaugugagu

SEQ ID NO: 2059394 - RNA, 16 nt, Human
ugauuuguuuuagaau

SEQ ID NO: 2059395 - RNA, 17 nt, Human
agcccaggaggacugcc

SEQ ID NO: 2059396 - RNA, 12 nt, Human
agcccaggagga

SEQ ID NO: 2059397 - RNA, 14 nt, Human
ugcaauagagacug

SEQ ID NO: 2059398 - RNA, 16 nt, Human
ugcaauagagacugua

SEQ ID NO: 2059399 - RNA, 19 nt, Human
ugcaauagagacuguagau

SEQ ID NO: 2059400 - RNA, 18 nt, Human
ugcaagugucugugugca

SEQ ID NO: 2059401 - RNA, 21 nt, Human
ugcaaguguaugcacgugugc

SEQ ID NO: 2059402 - RNA, 16 nt, Human
ugcaagugucugugug

SEQ ID NO: 2059403 - RNA, 17 nt, Human
ugcaagugucugugugc

SEQ ID NO: 2059404 - RNA, 16 nt, Human
ugcaagugacaucucu

SEQ ID NO: 2059405 - RNA, 20 nt, Human
ugcaagugagcaaaccugcc

SEQ ID NO: 2059406 - RNA, 22 nt, Human
ugcaagugagcaaaccugcccc

SEQ ID NO: 2059407 - RNA, 23 nt, Human
ugcaagugagcaaaccugcccca

SEQ ID NO: 2059408 - RNA, 22 nt, Human
agccccauucugccugcccagg

SEQ ID NO: 2059409 - RNA, 21 nt, Human
agccccauucugccugcccag

SEQ ID NO: 2059410 - RNA, 20 nt, Human
agccccauucugccugccca

SEQ ID NO: 2059411 - RNA, 22 nt, Human
agcccauucucucuccugucca

SEQ ID NO: 2059412 - RNA, 20 nt, Human
agcccauucucucuccuguc

SEQ ID NO: 2059413 - RNA, 21 nt, Human
agcccauucucucuccugucc

SEQ ID NO: 2059414 - RNA, 16 nt, Human
agcccauucucucucc

SEQ ID NO: 2059415 - RNA, 17 nt, Human
agcccauucucucuccu

SEQ ID NO: 2059416 - RNA, 18 nt, Human
agcccauucucucuccug

SEQ ID NO: 2059417 - RNA, 19 nt, Human
agcccauucucucuccugu

SEQ ID NO: 2059418 - RNA, 15 nt, Human
agcccauucucucuc

SEQ ID NO: 2059419 - RNA, 16 nt, Human
agcccaggguuccccc

SEQ ID NO: 2059420 - RNA, 10 nt, Human
agcccagggu

SEQ ID NO: 2059421 - RNA, 11 nt, Human
agcccaggagu

SEQ ID NO: 2059422 - RNA, 19 nt, Human
agcccaggaguuugaggcu

SEQ ID NO: 2059423 - RNA, 18 nt, Human
agcccagggagcggaaag

SEQ ID NO: 2059424 - RNA, 19 nt, Human
agcccagggagcggaaagc

SEQ ID NO: 2059425 - RNA, 20 nt, Human
agcccagggagcggaaagca

SEQ ID NO: 2059426 - RNA, 21 nt, Human
agcccagggagcggaaagcag

SEQ ID NO: 2059427 - RNA, 22 nt, Human
agcccagggagcggaaagcagc

SEQ ID NO: 2059428 - RNA, 23 nt, Human
agcccagggagcggaaagcagcu

SEQ ID NO: 2059429 - RNA, 23 nt, Human
agccccauucugccugcccaggc

SEQ ID NO: 2059430 - RNA, 17 nt, Human
agcccccaggcugcugg

SEQ ID NO: 2059431 - RNA, 18 nt, Human
agcccccaggcugcugga

SEQ ID NO: 2059432 - RNA, 23 nt, Human
agcccccgccccgccccacauuc

SEQ ID NO: 2059433 - RNA, 22 nt, Human
agcccccgccccgccccacauu

SEQ ID NO: 2059434 - RNA, 10 nt, Human
agccccucuu

SEQ ID NO: 2059435 - RNA, 16 nt, Human
agccccucuugccccc

SEQ ID NO: 2059436 - RNA, 17 nt, Human
agccccucuugcccccc

SEQ ID NO: 2059437 - RNA, 20 nt, Human
agccccucuugccccccacc

SEQ ID NO: 2059438 - RNA, 23 nt, Human
agccccucuugccccccacccca

SEQ ID NO: 2059439 - RNA, 21 nt, Human
agccccucuugccccccaccc

SEQ ID NO: 2059440 - RNA, 22 nt, Human
agccccucuugccccccacccc

SEQ ID NO: 2059441 - RNA, 19 nt, Human
agcccgcacccccacccuu

SEQ ID NO: 2059442 - RNA, 21 nt, Human
agcccgcacccccacccuuug

SEQ ID NO: 2059443 - RNA, 12 nt, Human
agcccgcaugca

SEQ ID NO: 2059444 - RNA, 14 nt, Human
agcccgcaugcagc

SEQ ID NO: 2059445 - RNA, 16 nt, Human
agcccgcaugcagcag

SEQ ID NO: 2059446 - RNA, 17 nt, Human
agcccgcaugcagcagc

SEQ ID NO: 2059447 - RNA, 18 nt, Human
agcccgcaugcagcagcu

SEQ ID NO: 2059448 - RNA, 20 nt, Human
agcccgcaugcagcagcuug

SEQ ID NO: 2059449 - RNA, 21 nt, Human
agcccgcaugcagcagcuugc

SEQ ID NO: 2059450 - RNA, 16 nt, Human
agcccgcacccccacc

SEQ ID NO: 2059451 - RNA, 17 nt, Human
agcccgcacccccaccc

SEQ ID NO: 2059452 - RNA, 18 nt, Human
agcccgcacccccacccu

SEQ ID NO: 2059453 - RNA, 19 nt, Human
agcccgaggcaccaguguc

SEQ ID NO: 2059454 - RNA, 15 nt, Human
agcccgcacccccac

SEQ ID NO: 2059455 - RNA, 13 nt, Human
agccccugccccu

SEQ ID NO: 2059456 - RNA, 14 nt, Human
agccccugccccuc

SEQ ID NO: 2059457 - RNA, 14 nt, Human
agcccggaugcuuc

SEQ ID NO: 2059458 - RNA, 17 nt, Human
agcccugcuuugggcug

SEQ ID NO: 2059459 - RNA, 20 nt, Human
agcccugcuuugggcugccc

SEQ ID NO: 2059460 - RNA, 19 nt, Human
agcccugcuuugggcugcc

SEQ ID NO: 2059461 - RNA, 12 nt, Human
agcccuggcagg

SEQ ID NO: 2059462 - RNA, 13 nt, Human
agcccuggcagga

SEQ ID NO: 2059463 - RNA, 17 nt, Human
agcccuggcaggaugac

SEQ ID NO: 2059464 - RNA, 13 nt, Human
agcccuggccaga

SEQ ID NO: 2059465 - RNA, 21 nt, Human
agcccuggcaggaugacccug

SEQ ID NO: 2059466 - RNA, 23 nt, Human
agcccuggauuucagaaagagca

SEQ ID NO: 2059467 - RNA, 14 nt, Human
agcccuggccagag

SEQ ID NO: 2059468 - RNA, 15 nt, Human
agcccuggccagagg

SEQ ID NO: 2059469 - RNA, 16 nt, Human
agcccuggccagaggc

SEQ ID NO: 2059470 - RNA, 17 nt, Human
agcccuggccagaggcu

SEQ ID NO: 2059471 - RNA, 16 nt, Human
agcccugguggcagug

SEQ ID NO: 2059472 - RNA, 15 nt, Human
agcccugguggcagu

SEQ ID NO: 2059473 - RNA, 14 nt, Human
agcccugguggcag

SEQ ID NO: 2059474 - RNA, 18 nt, Human
ugcacacaccagagccca

SEQ ID NO: 2059475 - RNA, 17 nt, Human
ugcacacaccagagccc

SEQ ID NO: 2059476 - RNA, 21 nt, Human
ugcacacaccagagcccaccu

SEQ ID NO: 2059477 - RNA, 17 nt, Human
ugccucagccuccugag

SEQ ID NO: 2059478 - RNA, 12 nt, Human
ugccucagaacg

SEQ ID NO: 2059479 - RNA, 18 nt, Human
ugccucaguaaaaugaac

SEQ ID NO: 2059480 - RNA, 15 nt, Human
ugccuccccaacccu

SEQ ID NO: 2059481 - RNA, 16 nt, Human
ugccuccccaacccug

SEQ ID NO: 2059482 - RNA, 18 nt, Human
ugccuccccaacccugcc

SEQ ID NO: 2059483 - RNA, 14 nt, Human
ugccucagccuccg

SEQ ID NO: 2059484 - RNA, 18 nt, Human
ugccuccccggcucgagc

SEQ ID NO: 2059485 - RNA, 19 nt, Human
ugccuccccaacccugccc

SEQ ID NO: 2059486 - RNA, 20 nt, Human
ugccuccccaacccugcccc

SEQ ID NO: 2059487 - RNA, 21 nt, Human
ugccuccccaacccugccccu

SEQ ID NO: 2059488 - RNA, 22 nt, Human
ugccuccccaacccugccccug

SEQ ID NO: 2059489 - RNA, 23 nt, Human
ugccuccccaacccugccccugc

SEQ ID NO: 2059490 - RNA, 17 nt, Human
ugcccuucacaguguuu

SEQ ID NO: 2059491 - RNA, 23 nt, Human
ugcccuucagcauccucaguucc

SEQ ID NO: 2059492 - RNA, 20 nt, Human
ugccgcccgagguggcugcc

SEQ ID NO: 2059493 - RNA, 23 nt, Human
ugccgcccgagguggcugccugg

SEQ ID NO: 2059494 - RNA, 16 nt, Human
ugccgccucaaugugg

SEQ ID NO: 2059495 - RNA, 13 nt, Human
ugccgccucccag

SEQ ID NO: 2059496 - RNA, 14 nt, Human
ugccgccucccagc

SEQ ID NO: 2059497 - RNA, 16 nt, Human
ugccgccucccagccu

SEQ ID NO: 2059498 - RNA, 16 nt, Human
agcucuucuccaggcu

SEQ ID NO: 2059499 - RNA, 15 nt, Human
agcucuucuccaggc

SEQ ID NO: 2059500 - RNA, 10 nt, Human
ugccugcuga

SEQ ID NO: 2059501 - RNA, 23 nt, Human
ugccugcugaaugauuuccaaag

SEQ ID NO: 2059502 - RNA, 14 nt, Human
ugccugcuuuagaa

SEQ ID NO: 2059503 - RNA, 10 nt, Human
agcugccugu

SEQ ID NO: 2059504 - RNA, 22 nt, Human
agcugcuuuugucuaugggacu

SEQ ID NO: 2059505 - RNA, 13 nt, Human
agcugccuguuca

SEQ ID NO: 2059506 - RNA, 14 nt, Human
agcugccuguaguu

SEQ ID NO: 2059507 - RNA, 15 nt, Human
agcugccuguaguua

SEQ ID NO: 2059508 - RNA, 18 nt, Human
agcugccuguaguuagga

SEQ ID NO: 2059509 - RNA, 19 nt, Human
agcugccuguaguuaggaa

SEQ ID NO: 2059510 - RNA, 20 nt, Human
agcugccuguaguuaggaaa

SEQ ID NO: 2059511 - RNA, 22 nt, Human
agcugccuguaguuaggaaaua

SEQ ID NO: 2059512 - RNA, 23 nt, Human
agcugccuguaguuaggaaauaa

SEQ ID NO: 2059513 - RNA, 24 nt, Human
agcugcuuuugucuaugggacuca

SEQ ID NO: 2059514 - RNA, 23 nt, Human
agcugcuuuugucuaugggacuc

SEQ ID NO: 2059515 - RNA, 15 nt, Human
agcugggacuacagg

SEQ ID NO: 2059516 - RNA, 17 nt, Human
ugccugcggucaaggcc

SEQ ID NO: 2059517 - RNA, 18 nt, Human
ugccugcggucaaggcca

SEQ ID NO: 2059518 - RNA, 19 nt, Human
ugccugcggucaaggccag

SEQ ID NO: 2059519 - RNA, 19 nt, Human
ugccugcggaguugugcac

SEQ ID NO: 2059520 - RNA, 19 nt, Human
ugccugcccaggccccugc

SEQ ID NO: 2059521 - RNA, 18 nt, Human
ugccugcccaggccccug

SEQ ID NO: 2059522 - RNA, 17 nt, Human
ugccugcccaggccccu

SEQ ID NO: 2059523 - RNA, 12 nt, Human
ugccucugccuc

SEQ ID NO: 2059524 - RNA, 11 nt, Human
ugccucugccu

SEQ ID NO: 2059525 - RNA, 16 nt, Human
ugccucugacacacag

SEQ ID NO: 2059526 - RNA, 14 nt, Human
ugccucugacacac

SEQ ID NO: 2059527 - RNA, 22 nt, Human
agcuccccaaaaaccucacccg

SEQ ID NO: 2059528 - RNA, 14 nt, Human
agcuccccaccacc

SEQ ID NO: 2059529 - RNA, 17 nt, Human
agcuccccaccacccca

SEQ ID NO: 2059530 - RNA, 20 nt, Human
agcuccccaccaccccagcu

SEQ ID NO: 2059531 - RNA, 21 nt, Human
agcuccccaccaccccagcug

SEQ ID NO: 2059532 - RNA, 20 nt, Human
agcuccccgcuucugccugc

SEQ ID NO: 2059533 - RNA, 21 nt, Human
agcuccccgcuucugccugca

SEQ ID NO: 2059534 - RNA, 23 nt, Human
agcuccuucuguccuacucugug

SEQ ID NO: 2059535 - RNA, 22 nt, Human
agcuccuucuguccuacucugu

SEQ ID NO: 2059536 - RNA, 22 nt, Human
agcuccuugagggcaagagcca

SEQ ID NO: 2059537 - RNA, 12 nt, Human
agcuccuuggga

SEQ ID NO: 2059538 - RNA, 21 nt, Human
agcuccuugagggcaagagcc

SEQ ID NO: 2059539 - RNA, 15 nt, Human
agcuccuugggaggc

SEQ ID NO: 2059540 - RNA, 19 nt, Human
agcuccuugggaggcccca

SEQ ID NO: 2059541 - RNA, 20 nt, Human
agcuccuugggaggccccac

SEQ ID NO: 2059542 - RNA, 23 nt, Human
agcucccaccccacccccuucag

SEQ ID NO: 2059543 - RNA, 13 nt, Human
agcucccacccca

SEQ ID NO: 2059544 - RNA, 15 nt, Human
agcucccaccccacc

SEQ ID NO: 2059545 - RNA, 17 nt, Human
agcucccaccccacccc

SEQ ID NO: 2059546 - RNA, 21 nt, Human
agcuccaucuccacuccagau

SEQ ID NO: 2059547 - RNA, 17 nt, Human
ugcccuagagcacacug

SEQ ID NO: 2059548 - RNA, 19 nt, Human
agcuccagcucaccagccc

SEQ ID NO: 2059549 - RNA, 18 nt, Human
agcuccagcucaccagcc

SEQ ID NO: 2059550 - RNA, 21 nt, Human
agcuccagcucaccagcccca

SEQ ID NO: 2059551 - RNA, 19 nt, Human
agcuccagacccccagcaa

SEQ ID NO: 2059552 - RNA, 13 nt, Human
agcuccagggcca

SEQ ID NO: 2059553 - RNA, 15 nt, Human
agcuccagggccaga

SEQ ID NO: 2059554 - RNA, 14 nt, Human
agcuccaguccugc

SEQ ID NO: 2059555 - RNA, 20 nt, Human
agcucugaggacugcaccau

SEQ ID NO: 2059556 - RNA, 21 nt, Human
agcucugcagagcaggaaaca

SEQ ID NO: 2059557 - RNA, 16 nt, Human
agcucuagacaacccu

SEQ ID NO: 2059558 - RNA, 17 nt, Human
agcucuagacaacccug

SEQ ID NO: 2059559 - RNA, 19 nt, Human
agcucuagacaacccugca

SEQ ID NO: 2059560 - RNA, 20 nt, Human
agcucuagacaacccugcaa

SEQ ID NO: 2059561 - RNA, 13 nt, Human
agcucuucaggcc

SEQ ID NO: 2059562 - RNA, 15 nt, Human
agcucuucaggccuc

SEQ ID NO: 2059563 - RNA, 16 nt, Human
agcucuucaggccucc

SEQ ID NO: 2059564 - RNA, 17 nt, Human
agcucuucaggccuccc

SEQ ID NO: 2059565 - RNA, 18 nt, Human
agcucuucaggccucccu

SEQ ID NO: 2059566 - RNA, 12 nt, Human
agcucugucugu

SEQ ID NO: 2059567 - RNA, 14 nt, Human
agcucugucugucc

SEQ ID NO: 2059568 - RNA, 18 nt, Human
agcucuguguugccaugu

SEQ ID NO: 2059569 - RNA, 23 nt, Human
agcucuguguugccaugugugcu

SEQ ID NO: 2059570 - RNA, 14 nt, Human
agcucuggagccac

SEQ ID NO: 2059571 - RNA, 16 nt, Human
agcucuggagccaccu

SEQ ID NO: 2059572 - RNA, 17 nt, Human
agcucuggagccaccug

SEQ ID NO: 2059573 - RNA, 18 nt, Human
agcucuggagccaccugu

SEQ ID NO: 2059574 - RNA, 19 nt, Human
agcucuggagccaccuguc

SEQ ID NO: 2059575 - RNA, 12 nt, Human
agcucuggcuca

SEQ ID NO: 2059576 - RNA, 15 nt, Human
agcucuggcucacag

SEQ ID NO: 2059577 - RNA, 19 nt, Human
agcucuggcucacagacug

SEQ ID NO: 2059578 - RNA, 20 nt, Human
agcucuggcucacagacugg

SEQ ID NO: 2059579 - RNA, 15 nt, Human
agcucuguguugcca

SEQ ID NO: 2059580 - RNA, 16 nt, Human
agcucuguguugccau

SEQ ID NO: 2059581 - RNA, 15 nt, Human
ugcccuacucacucu

SEQ ID NO: 2059582 - RNA, 13 nt, Human
ugcccuccauccc

SEQ ID NO: 2059583 - RNA, 14 nt, Human
ugcccuccaucccg

SEQ ID NO: 2059584 - RNA, 17 nt, Human
ugcccuccaucccgaca

SEQ ID NO: 2059585 - RNA, 20 nt, Human
ugcccuccaucccgacaugg

SEQ ID NO: 2059586 - RNA, 15 nt, Human
ugcccucccuccuuc

SEQ ID NO: 2059587 - RNA, 16 nt, Human
ugcccucccuccuucc

SEQ ID NO: 2059588 - RNA, 19 nt, Human
ugcccucgggcgagucacu

SEQ ID NO: 2059589 - RNA, 20 nt, Human
ugcccucgggcgagucacug

SEQ ID NO: 2059590 - RNA, 22 nt, Human
ugcccucgggcgagucacugcc

SEQ ID NO: 2059591 - RNA, 23 nt, Human
ugcccucgggcgagucacugccu

SEQ ID NO: 2059592 - RNA, 14 nt, Human
agcuccagaccccc

SEQ ID NO: 2059593 - RNA, 16 nt, Human
agcuccagacccccag

SEQ ID NO: 2059594 - RNA, 17 nt, Human
agcuccagacccccagc

SEQ ID NO: 2059595 - RNA, 18 nt, Human
agcuccagacccccagca

SEQ ID NO: 2059596 - RNA, 23 nt, Human
agcuccagacccccagcaacccu

SEQ ID NO: 2059597 - RNA, 17 nt, Human
agcuccagcucaccagc

SEQ ID NO: 2059598 - RNA, 13 nt, Human
agcuccagcucac

SEQ ID NO: 2059599 - RNA, 22 nt, Human
agcuccacacccucucccagga

SEQ ID NO: 2059600 - RNA, 23 nt, Human
agcuccacacccucucccaggac

SEQ ID NO: 2059601 - RNA, 21 nt, Human
agcuccacacccucucccagg

SEQ ID NO: 2059602 - RNA, 11 nt, Human
ugcccucuguu

SEQ ID NO: 2059603 - RNA, 21 nt, Human
ugcauucugccgugugcccuc

SEQ ID NO: 2059604 - RNA, 16 nt, Human
ugcauucacccagaca

SEQ ID NO: 2059605 - RNA, 14 nt, Human
ugcauucacccaga

SEQ ID NO: 2059606 - RNA, 20 nt, Human
ugcauucacccagacagcuc

SEQ ID NO: 2059607 - RNA, 18 nt, Human
ugcauuuaccggcagugc

SEQ ID NO: 2059608 - RNA, 14 nt, Human
ugcauuuagcacaa

SEQ ID NO: 2059609 - RNA, 22 nt, Human
ugcauuuagcacaaaaaaaauu

SEQ ID NO: 2059610 - RNA, 13 nt, Human
agcggaaagcagc

SEQ ID NO: 2059611 - RNA, 14 nt, Human
agcggaaagcagcu

SEQ ID NO: 2059612 - RNA, 17 nt, Human
agcggaaagcagcucaa

SEQ ID NO: 2059613 - RNA, 23 nt, Human
agcggaaagcagcucaaaggcac

SEQ ID NO: 2059614 - RNA, 12 nt, Human
agcgcaccugcc

SEQ ID NO: 2059615 - RNA, 14 nt, Human
agcgcaccugcccc

SEQ ID NO: 2059616 - RNA, 17 nt, Human
agcgcaccugcccccug

SEQ ID NO: 2059617 - RNA, 21 nt, Human
agcgcaccugcccccuggugg

SEQ ID NO: 2059618 - RNA, 18 nt, Human
agcgcaccugcccccugg

SEQ ID NO: 2059619 - RNA, 19 nt, Human
agcgcaccugcccccuggu

SEQ ID NO: 2059620 - RNA, 20 nt, Human
agcgcugccgcaccccagag

SEQ ID NO: 2059621 - RNA, 21 nt, Human
agcgcugccgcaccccagagu

SEQ ID NO: 2059622 - RNA, 22 nt, Human
ugcagcucuccccuucucugua

SEQ ID NO: 2059623 - RNA, 20 nt, Human
ugcagcucuccccuucucug

SEQ ID NO: 2059624 - RNA, 19 nt, Human
agccuucccccucccaggg

SEQ ID NO: 2059625 - RNA, 20 nt, Human
agccuuccccuugcccaggg

SEQ ID NO: 2059626 - RNA, 22 nt, Human
agccuuccccuugcccagggcu

SEQ ID NO: 2059627 - RNA, 22 nt, Human
agcgauucuucugcuucagccu

SEQ ID NO: 2059628 - RNA, 21 nt, Human
agccuugcccggauucuggga

SEQ ID NO: 2059629 - RNA, 20 nt, Human
agcggggacagcuccuucug

SEQ ID NO: 2059630 - RNA, 19 nt, Human
agcggggacagcuccuucu

SEQ ID NO: 2059631 - RNA, 23 nt, Human
agcggcuggcagcccaccccuca

SEQ ID NO: 2059632 - RNA, 22 nt, Human
agcggggacagcuccuucuguc

SEQ ID NO: 2059633 - RNA, 21 nt, Human
agcggggccccagggcuaccc

SEQ ID NO: 2059634 - RNA, 17 nt, Human
agcggcuggugcagggc

SEQ ID NO: 2059635 - RNA, 19 nt, Human
agcggcuggugcagggccu

SEQ ID NO: 2059636 - RNA, 13 nt, Human
agcggcuggcagc

SEQ ID NO: 2059637 - RNA, 11 nt, Human
ugccagugccu

SEQ ID NO: 2059638 - RNA, 13 nt, Human
ugccagugccuua

SEQ ID NO: 2059639 - RNA, 15 nt, Human
ugccagugccuuacc

SEQ ID NO: 2059640 - RNA, 20 nt, Human
ugccagucccccugccccag

SEQ ID NO: 2059641 - RNA, 18 nt, Human
ugccagcuuaucucaggg

SEQ ID NO: 2059642 - RNA, 19 nt, Human
ugccacugccucuuccucc

SEQ ID NO: 2059643 - RNA, 18 nt, Human
ugccacugccucuuccuc

SEQ ID NO: 2059644 - RNA, 20 nt, Human
ugccacugccucuuccuccc

SEQ ID NO: 2059645 - RNA, 22 nt, Human
ugccacugcccgagcuggugca

SEQ ID NO: 2059646 - RNA, 15 nt, Human
ugccagagauggagg

SEQ ID NO: 2059647 - RNA, 21 nt, Human
ugccagagauggagguucucu

SEQ ID NO: 2059648 - RNA, 19 nt, Human
ugccagagcaaagggccag

SEQ ID NO: 2059649 - RNA, 20 nt, Human
ugccagagcaaagggccagg

SEQ ID NO: 2059650 - RNA, 23 nt, Human
ugccagagcaaagggccaggaag

SEQ ID NO: 2059651 - RNA, 20 nt, Human
ugccacugcccgagcuggug

SEQ ID NO: 2059652 - RNA, 21 nt, Human
ugccacugcccgagcuggugc

SEQ ID NO: 2059653 - RNA, 17 nt, Human
ugccacugccucuuccu

SEQ ID NO: 2059654 - RNA, 13 nt, Human
ugccacugccucu

SEQ ID NO: 2059655 - RNA, 21 nt, Human
ugccagaugccuuuauggcug

SEQ ID NO: 2059656 - RNA, 11 nt, Human
ugccagccaca

SEQ ID NO: 2059657 - RNA, 11 nt, Human
ugccagccagc

SEQ ID NO: 2059658 - RNA, 12 nt, Human
ugccagccagca

SEQ ID NO: 2059659 - RNA, 16 nt, Human
ugccagcacccccacg

SEQ ID NO: 2059660 - RNA, 17 nt, Human
ugccagcacccccacgc

SEQ ID NO: 2059661 - RNA, 15 nt, Human
ugccagccagcagcc

SEQ ID NO: 2059662 - RNA, 23 nt, Human
ugccccgaacauguuuuucuucu

SEQ ID NO: 2059663 - RNA, 13 nt, Human
ugccccgcccagc

SEQ ID NO: 2059664 - RNA, 17 nt, Human
ugccccgcuuugcggac

SEQ ID NO: 2059665 - RNA, 17 nt, Human
ugcccccacaccuggcc

SEQ ID NO: 2059666 - RNA, 18 nt, Human
ugcccccacaccuggccc

SEQ ID NO: 2059667 - RNA, 19 nt, Human
ugcccccacaccuggcccu

SEQ ID NO: 2059668 - RNA, 22 nt, Human
ugcccccacaccuggcccuggg

SEQ ID NO: 2059669 - RNA, 15 nt, Human
ugccccaugccuguc

SEQ ID NO: 2059670 - RNA, 23 nt, Human
ugccccaugccuguccagccugg

SEQ ID NO: 2059671 - RNA, 19 nt, Human
ugcccaggagagccagccc

SEQ ID NO: 2059672 - RNA, 20 nt, Human
ugcccaggagagccagcccu

SEQ ID NO: 2059673 - RNA, 21 nt, Human
ugccccaugaagccacagccc

SEQ ID NO: 2059674 - RNA, 23 nt, Human
ugccccaugaagccacagcccag

SEQ ID NO: 2059675 - RNA, 12 nt, Human
ugccccaugccu

SEQ ID NO: 2059676 - RNA, 22 nt, Human
ugcccccgcucaugggccccuc

SEQ ID NO: 2059677 - RNA, 18 nt, Human
ugccccccuugccagaca

SEQ ID NO: 2059678 - RNA, 18 nt, Human
ugcccaggccccugccac

SEQ ID NO: 2059679 - RNA, 17 nt, Human
ugcccaggccccugcca

SEQ ID NO: 2059680 - RNA, 15 nt, Human
ugcccaggccccugc

SEQ ID NO: 2059681 - RNA, 16 nt, Human
ugcccaggagagccag

SEQ ID NO: 2059682 - RNA, 17 nt, Human
ugcccaggagagccagc

SEQ ID NO: 2059683 - RNA, 18 nt, Human
ugcccaggagagccagcc

SEQ ID NO: 2059684 - RNA, 21 nt, Human
ugcccaggagagccagcccuc

SEQ ID NO: 2059685 - RNA, 15 nt, Human
ugcccagcucagucu

SEQ ID NO: 2059686 - RNA, 21 nt, Human
ugcccagcucagucuucccua

SEQ ID NO: 2059687 - RNA, 12 nt, Human
ugcccagcucag

SEQ ID NO: 2059688 - RNA, 17 nt, Human
ugcccagcucagagggu

SEQ ID NO: 2059689 - RNA, 15 nt, Human
ugcccaaaucugccu

SEQ ID NO: 2059690 - RNA, 21 nt, Human
ugccauuuuggguuaggagaa

SEQ ID NO: 2059691 - RNA, 23 nt, Human
ugcccaaagcagcacuuauaaau

SEQ ID NO: 2059692 - RNA, 17 nt, Human
agcucaggugucccugc

SEQ ID NO: 2059693 - RNA, 13 nt, Human
ugccauugucuuu

SEQ ID NO: 2059694 - RNA, 14 nt, Human
ugccauugucuuua

SEQ ID NO: 2059695 - RNA, 16 nt, Human
ugccauugucuuuaua

SEQ ID NO: 2059696 - RNA, 17 nt, Human
ugccauugucuuuauau

SEQ ID NO: 2059697 - RNA, 18 nt, Human
ugccauugucuuuauaug

SEQ ID NO: 2059698 - RNA, 22 nt, Human
ugccauuugcacccuccgccuu

SEQ ID NO: 2059699 - RNA, 19 nt, Human
ugccauuugcacccuccgc

SEQ ID NO: 2059700 - RNA, 21 nt, Human
ugccauuugcacccuccgccu

SEQ ID NO: 2059701 - RNA, 16 nt, Human
ugccauuugcacccuc

SEQ ID NO: 2059702 - RNA, 17 nt, Human
ugccauuugcacccucc

SEQ ID NO: 2059703 - RNA, 17 nt, Human
agcucaggaggcuugga

SEQ ID NO: 2059704 - RNA, 19 nt, Human
agcuauucaguaauaacuc

SEQ ID NO: 2059705 - RNA, 21 nt, Human
agcuauucaguugguaagcuu

SEQ ID NO: 2059706 - RNA, 22 nt, Human
agcgugaaggccgagaagcaag

SEQ ID NO: 2059707 - RNA, 23 nt, Human
agcgugaaggccgagaagcaaga

SEQ ID NO: 2059708 - RNA, 14 nt, Human
agcuacaggaagca

SEQ ID NO: 2059709 - RNA, 22 nt, Human
agcuacaggaagcaccccaugc

SEQ ID NO: 2059710 - RNA, 21 nt, Human
agcuaggugcuaauuaauaaa

SEQ ID NO: 2059711 - RNA, 22 nt, Human
agcuacccaggaggcugaggug

SEQ ID NO: 2059712 - RNA, 21 nt, Human
agcuaggccuggccagaugca

SEQ ID NO: 2059713 - RNA, 13 nt, Human
agcuaccaugaca

SEQ ID NO: 2059714 - RNA, 14 nt, Human
agcuaccaugacaa

SEQ ID NO: 2059715 - RNA, 17 nt, Human
agcuauauccauguacu

SEQ ID NO: 2059716 - RNA, 18 nt, Human
agcuauccggacagagca

SEQ ID NO: 2059717 - RNA, 14 nt, Human
agcuaucaggaaca

SEQ ID NO: 2059718 - RNA, 20 nt, Human
agcuauauccauguacugua

SEQ ID NO: 2059719 - RNA, 22 nt, Human
agcuauauccauguacuguagu

SEQ ID NO: 2059720 - RNA, 18 nt, Human
agcuauauuuaaguauuc

SEQ ID NO: 2059721 - RNA, 22 nt, Human
agcuauauuuaaguauucaaga

SEQ ID NO: 2059722 - RNA, 15 nt, Human
agcuaucuaggugga

SEQ ID NO: 2059723 - RNA, 18 nt, Human
agcuaucuagguggaguu

SEQ ID NO: 2059724 - RNA, 18 nt, Human
agcuaucuauauggaauu

SEQ ID NO: 2059725 - RNA, 17 nt, Human
agcuaucucucagugaa

SEQ ID NO: 2059726 - RNA, 16 nt, Human
uggccaaguucuuagu

SEQ ID NO: 2059727 - RNA, 17 nt, Human
uggccaggcuggucuca

SEQ ID NO: 2059728 - RNA, 15 nt, Human
uggccaggcuggucu

SEQ ID NO: 2059729 - RNA, 15 nt, Human
uggcauggcuccagu

SEQ ID NO: 2059730 - RNA, 16 nt, Human
uggcauggcuccaguc

SEQ ID NO: 2059731 - RNA, 14 nt, Human
uggcauggcaccug

SEQ ID NO: 2059732 - RNA, 16 nt, Human
uggcauggcaccuguc

SEQ ID NO: 2059733 - RNA, 17 nt, Human
uggcauggcuccagucu

SEQ ID NO: 2059734 - RNA, 13 nt, Human
aggccugccuguu

SEQ ID NO: 2059735 - RNA, 23 nt, Human
aggccugccagacggcacccacc

SEQ ID NO: 2059736 - RNA, 15 nt, Human
uggcaugccuuccag

SEQ ID NO: 2059737 - RNA, 19 nt, Human
uggcaugccuuccagcacc

SEQ ID NO: 2059738 - RNA, 12 nt, Human
aggccucugggc

SEQ ID NO: 2059739 - RNA, 18 nt, Human
aggccucugggccuccuc

SEQ ID NO: 2059740 - RNA, 15 nt, Human
aggccucccucucuc

SEQ ID NO: 2059741 - RNA, 22 nt, Human
aggccucccucucucuucugcu

SEQ ID NO: 2059742 - RNA, 13 nt, Human
aggccucccucaa

SEQ ID NO: 2059743 - RNA, 13 nt, Human
aggccucagugga

SEQ ID NO: 2059744 - RNA, 23 nt, Human
aggccucaguggacuuuccaccc

SEQ ID NO: 2059745 - RNA, 15 nt, Human
aggccucaguggacu

SEQ ID NO: 2059746 - RNA, 16 nt, Human
aggccucaguggacuu

SEQ ID NO: 2059747 - RNA, 14 nt, Human
aggccuccagcuca

SEQ ID NO: 2059748 - RNA, 15 nt, Human
aggccuccagcucag

SEQ ID NO: 2059749 - RNA, 16 nt, Human
aggccuccagcucagc

SEQ ID NO: 2059750 - RNA, 17 nt, Human
aggccuccagcucagca

SEQ ID NO: 2059751 - RNA, 18 nt, Human
aggccuccagcucagcag

SEQ ID NO: 2059752 - RNA, 20 nt, Human
aggccuccagcucagcagug

SEQ ID NO: 2059753 - RNA, 12 nt, Human
uggccuggccag

SEQ ID NO: 2059754 - RNA, 18 nt, Human
uggccuggccaggagcuc

SEQ ID NO: 2059755 - RNA, 21 nt, Human
uggccuggccaggagcucuuc

SEQ ID NO: 2059756 - RNA, 13 nt, Human
uggccuggccagg

SEQ ID NO: 2059757 - RNA, 15 nt, Human
uggccuggccaggag

SEQ ID NO: 2059758 - RNA, 16 nt, Human
uggccuggccaggagc

SEQ ID NO: 2059759 - RNA, 17 nt, Human
uggccuggccaggagcu

SEQ ID NO: 2059760 - RNA, 21 nt, Human
aggccuggccagaugcaccag

SEQ ID NO: 2059761 - RNA, 17 nt, Human
aggccuggccagaugca

SEQ ID NO: 2059762 - RNA, 16 nt, Human
aggccuggccagaugc

SEQ ID NO: 2059763 - RNA, 15 nt, Human
aggccuggccagaug

SEQ ID NO: 2059764 - RNA, 23 nt, Human
aggccuggccagaugcaccagcc

SEQ ID NO: 2059765 - RNA, 22 nt, Human
aggccuggccagaugcaccagc

SEQ ID NO: 2059766 - RNA, 13 nt, Human
uggccgggcacag

SEQ ID NO: 2059767 - RNA, 14 nt, Human
uggccgggcacagc

SEQ ID NO: 2059768 - RNA, 15 nt, Human
uggccgggcacagcu

SEQ ID NO: 2059769 - RNA, 16 nt, Human
uggccgggcacagcug

SEQ ID NO: 2059770 - RNA, 19 nt, Human
uggccgggcacagcugugg

SEQ ID NO: 2059771 - RNA, 17 nt, Human
uggcccgacagccuggc

SEQ ID NO: 2059772 - RNA, 16 nt, Human
uggcccgacagccugg

SEQ ID NO: 2059773 - RNA, 15 nt, Human
uggcccgacagccug

SEQ ID NO: 2059774 - RNA, 14 nt, Human
uggcccgacagccu

SEQ ID NO: 2059775 - RNA, 19 nt, Human
uggcccgacagccuggcac

SEQ ID NO: 2059776 - RNA, 18 nt, Human
uggcccgacagccuggca

SEQ ID NO: 2059777 - RNA, 16 nt, Human
uggccccuucacuucu

SEQ ID NO: 2059778 - RNA, 21 nt, Human
uggccccugcccggcugcgga

SEQ ID NO: 2059779 - RNA, 14 nt, Human
uggccccugccuug

SEQ ID NO: 2059780 - RNA, 11 nt, Human
uggccccuuca

SEQ ID NO: 2059781 - RNA, 13 nt, Human
uggccccuucacu

SEQ ID NO: 2059782 - RNA, 21 nt, Human
uggccccuucacuucugacca

SEQ ID NO: 2059783 - RNA, 13 nt, Human
aggccaaaaaaau

SEQ ID NO: 2059784 - RNA, 15 nt, Human
uggacgcacacagcu

SEQ ID NO: 2059785 - RNA, 16 nt, Human
uggaccuugagaccac

SEQ ID NO: 2059786 - RNA, 22 nt, Human
aggccaacccaaaauaagcagg

SEQ ID NO: 2059787 - RNA, 18 nt, Human
aggccaaggugggaggau

SEQ ID NO: 2059788 - RNA, 21 nt, Human
aggccaaacuggcaaacuuca

SEQ ID NO: 2059789 - RNA, 19 nt, Human
uggaugccugguggcagcu

SEQ ID NO: 2059790 - RNA, 18 nt, Human
uggaugccugguggcagc

SEQ ID NO: 2059791 - RNA, 20 nt, Human
uggaugccugguggcagcug

SEQ ID NO: 2059792 - RNA, 15 nt, Human
uggaugccugguggc

SEQ ID NO: 2059793 - RNA, 14 nt, Human
uggaguccagucuc

SEQ ID NO: 2059794 - RNA, 15 nt, Human
uggaguccagucucu

SEQ ID NO: 2059795 - RNA, 22 nt, Human
uggagucaugguccgguguccu

SEQ ID NO: 2059796 - RNA, 14 nt, Human
aggccaagugcagg

SEQ ID NO: 2059797 - RNA, 15 nt, Human
aggccaagugcaggc

SEQ ID NO: 2059798 - RNA, 21 nt, Human
aggccaagugcaggcuggcac

SEQ ID NO: 2059799 - RNA, 15 nt, Human
uggcacccggccccu

SEQ ID NO: 2059800 - RNA, 16 nt, Human
uggcacccggccccug

SEQ ID NO: 2059801 - RNA, 20 nt, Human
uggcagauaaucagccucuu

SEQ ID NO: 2059802 - RNA, 21 nt, Human
uggcagauaaucagccucuua

SEQ ID NO: 2059803 - RNA, 19 nt, Human
uggcagauaaucagccucu

SEQ ID NO: 2059804 - RNA, 12 nt, Human
uggauguucuga

SEQ ID NO: 2059805 - RNA, 12 nt, Human
uggauguaaaua

SEQ ID NO: 2059806 - RNA, 18 nt, Human
uggcaccagcagccugga

SEQ ID NO: 2059807 - RNA, 22 nt, Human
aggccaccauauucagugcugu

SEQ ID NO: 2059808 - RNA, 13 nt, Human
uggcagccuuggc

SEQ ID NO: 2059809 - RNA, 21 nt, Human
aggccacaccaucuccuuuca

SEQ ID NO: 2059810 - RNA, 22 nt, Human
aggccacaccaucuccuuucag

SEQ ID NO: 2059811 - RNA, 13 nt, Human
aggccacggcagc

SEQ ID NO: 2059812 - RNA, 21 nt, Human
aggccaccugcccccuucucc

SEQ ID NO: 2059813 - RNA, 22 nt, Human
aggccaccugcccccuucuccc

SEQ ID NO: 2059814 - RNA, 13 nt, Human
aggccacuccucc

SEQ ID NO: 2059815 - RNA, 14 nt, Human
aggccacuccucca

SEQ ID NO: 2059816 - RNA, 19 nt, Human
aggccacuccuccaaagga

SEQ ID NO: 2059817 - RNA, 23 nt, Human
uggcagccgugccuucagcucua

SEQ ID NO: 2059818 - RNA, 22 nt, Human
uggcagccgugccuucagcucu

SEQ ID NO: 2059819 - RNA, 22 nt, Human
uggcagccuacuagggaccugg

SEQ ID NO: 2059820 - RNA, 14 nt, Human
uggcagccccagca

SEQ ID NO: 2059821 - RNA, 15 nt, Human
uggcagccccagcac

SEQ ID NO: 2059822 - RNA, 11 nt, Human
uggcagcccug

SEQ ID NO: 2059823 - RNA, 12 nt, Human
uggcagcccugu

SEQ ID NO: 2059824 - RNA, 16 nt, Human
uggcagccgugccuuc

SEQ ID NO: 2059825 - RNA, 14 nt, Human
uggcagcccuguag

SEQ ID NO: 2059826 - RNA, 17 nt, Human
uggcagcccuguaggga

SEQ ID NO: 2059827 - RNA, 20 nt, Human
aggcuggaguggaguggcgu

SEQ ID NO: 2059828 - RNA, 22 nt, Human
aggcuggauuuugaauuuucuu

SEQ ID NO: 2059829 - RNA, 16 nt, Human
aggcuggaggcagggc

SEQ ID NO: 2059830 - RNA, 17 nt, Human
aggcuggaggcagggcc

SEQ ID NO: 2059831 - RNA, 18 nt, Human
aggcuggaggcagggccu

SEQ ID NO: 2059832 - RNA, 19 nt, Human
aggcuggaggcagggccuu

SEQ ID NO: 2059833 - RNA, 23 nt, Human
aggcuggaggcagggccuugccc

SEQ ID NO: 2059834 - RNA, 13 nt, Human
aggcuggagccca

SEQ ID NO: 2059835 - RNA, 15 nt, Human
aggcuggagcccagg

SEQ ID NO: 2059836 - RNA, 18 nt, Human
aggcuggagcccagggag

SEQ ID NO: 2059837 - RNA, 12 nt, Human
aggcuggagcug

SEQ ID NO: 2059838 - RNA, 14 nt, Human
aggcuggagcuggc

SEQ ID NO: 2059839 - RNA, 17 nt, Human
aggcuggagcuggcguc

SEQ ID NO: 2059840 - RNA, 18 nt, Human
aggcuggagcuggcgucu

SEQ ID NO: 2059841 - RNA, 15 nt, Human
aggcuggaggaaggg

SEQ ID NO: 2059842 - RNA, 13 nt, Human
aggcuggaggcag

SEQ ID NO: 2059843 - RNA, 14 nt, Human
aggcuggaggcagg

SEQ ID NO: 2059844 - RNA, 15 nt, Human
aggcuggaggcaggg

SEQ ID NO: 2059845 - RNA, 19 nt, Human
aggcuggcaccgccuucuc

SEQ ID NO: 2059846 - RNA, 20 nt, Human
aggcuggcaccgccuucucu

SEQ ID NO: 2059847 - RNA, 15 nt, Human
aggcuggcagguaug

SEQ ID NO: 2059848 - RNA, 13 nt, Human
aggcuggccucag

SEQ ID NO: 2059849 - RNA, 14 nt, Human
aggcuggccucaga

SEQ ID NO: 2059850 - RNA, 15 nt, Human
aggcuggccucagac

SEQ ID NO: 2059851 - RNA, 16 nt, Human
aggcuggccucagacu

SEQ ID NO: 2059852 - RNA, 17 nt, Human
aggcuggcgugcagugg

SEQ ID NO: 2059853 - RNA, 13 nt, Human
aggcuggcgugca

SEQ ID NO: 2059854 - RNA, 17 nt, Human
aggcugcucagggcugg

SEQ ID NO: 2059855 - RNA, 16 nt, Human
aggcugcucagggcug

SEQ ID NO: 2059856 - RNA, 15 nt, Human
aggcugcucagggcu

SEQ ID NO: 2059857 - RNA, 23 nt, Human
aggcucugcccugcccuagcucc

SEQ ID NO: 2059858 - RNA, 14 nt, Human
aggcucugcccugc

SEQ ID NO: 2059859 - RNA, 17 nt, Human
aggcucugcccugcccu

SEQ ID NO: 2059860 - RNA, 16 nt, Human
aggcugcucugccugu

SEQ ID NO: 2059861 - RNA, 13 nt, Human
aggcugcuggagg

SEQ ID NO: 2059862 - RNA, 14 nt, Human
aggcugcuggagga

SEQ ID NO: 2059863 - RNA, 15 nt, Human
aggcugcuggaggaa

SEQ ID NO: 2059864 - RNA, 16 nt, Human
aggcugcuggaggaaa

SEQ ID NO: 2059865 - RNA, 13 nt, Human
aggcugcuuggga

SEQ ID NO: 2059866 - RNA, 14 nt, Human
aggcuggacuccag

SEQ ID NO: 2059867 - RNA, 15 nt, Human
aggcuggacuccaga

SEQ ID NO: 2059868 - RNA, 16 nt, Human
aggcuggacuccagau

SEQ ID NO: 2059869 - RNA, 17 nt, Human
aggcuggacuccagauc

SEQ ID NO: 2059870 - RNA, 21 nt, Human
aggcuggacuccagaucugca

SEQ ID NO: 2059871 - RNA, 22 nt, Human
aggcuggacuccagaucugcac

SEQ ID NO: 2059872 - RNA, 17 nt, Human
aggccugggugcuggcu

SEQ ID NO: 2059873 - RNA, 15 nt, Human
aggccugucccuggc

SEQ ID NO: 2059874 - RNA, 16 nt, Human
aggccugucccuggcc

SEQ ID NO: 2059875 - RNA, 17 nt, Human
aggccugucccuggcca

SEQ ID NO: 2059876 - RNA, 22 nt, Human
aggccugucccuggccaucucu

SEQ ID NO: 2059877 - RNA, 23 nt, Human
aggccugucccuggccaucucug

SEQ ID NO: 2059878 - RNA, 23 nt, Human
aggccugggugcuggcugcccag

SEQ ID NO: 2059879 - RNA, 22 nt, Human
aggccuguccugaccugucuca

SEQ ID NO: 2059880 - RNA, 16 nt, Human
aggccugggucugugu

SEQ ID NO: 2059881 - RNA, 17 nt, Human
aggccugggucuguguc

SEQ ID NO: 2059882 - RNA, 19 nt, Human
aggccugggucugugucuc

SEQ ID NO: 2059883 - RNA, 21 nt, Human
aggccugggucugugucucuu

SEQ ID NO: 2059884 - RNA, 12 nt, Human
aggccugggugc

SEQ ID NO: 2059885 - RNA, 16 nt, Human
aggccugggugcuggc

SEQ ID NO: 2059886 - RNA, 19 nt, Human
aggcuccuuuagcgcccag

SEQ ID NO: 2059887 - RNA, 13 nt, Human
aggcuccuuccug

SEQ ID NO: 2059888 - RNA, 15 nt, Human
aggcuccuuccuguc

SEQ ID NO: 2059889 - RNA, 16 nt, Human
aggcuccuuccugucu

SEQ ID NO: 2059890 - RNA, 23 nt, Human
aggcuccuuccugucuuccugca

SEQ ID NO: 2059891 - RNA, 18 nt, Human
aggcucuaaccacacagc

SEQ ID NO: 2059892 - RNA, 20 nt, Human
aggcucuaaccacacagccu

SEQ ID NO: 2059893 - RNA, 23 nt, Human
aggcucuaaccacacagccuaca

SEQ ID NO: 2059894 - RNA, 18 nt, Human
aggcucugaaagccagcu

SEQ ID NO: 2059895 - RNA, 11 nt, Human
aggcucugccc

SEQ ID NO: 2059896 - RNA, 12 nt, Human
aggcucugcccu

SEQ ID NO: 2059897 - RNA, 13 nt, Human
aggcucugcacag

SEQ ID NO: 2059898 - RNA, 15 nt, Human
aggcucugcacagau

SEQ ID NO: 2059899 - RNA, 17 nt, Human
aggcucugcacagaugg

SEQ ID NO: 2059900 - RNA, 13 nt, Human
aggcucugcccug

SEQ ID NO: 2059901 - RNA, 20 nt, Human
aggcuggcgugcaguggugc

SEQ ID NO: 2059902 - RNA, 18 nt, Human
aggcuggcgugcaguggu

SEQ ID NO: 2059903 - RNA, 13 nt, Human
aggcuggcuggcc

SEQ ID NO: 2059904 - RNA, 22 nt, Human
aggcuggcuggcccgucauguu

SEQ ID NO: 2059905 - RNA, 14 nt, Human
aggcuggcuugucc

SEQ ID NO: 2059906 - RNA, 22 nt, Human
aggcuggcuuguccccuccuca

SEQ ID NO: 2059907 - RNA, 20 nt, Human
aggcuggcuuguccccuccu

SEQ ID NO: 2059908 - RNA, 15 nt, Human
uggcuagaguccuca

SEQ ID NO: 2059909 - RNA, 16 nt, Human
uggcuagaguccucac

SEQ ID NO: 2059910 - RNA, 18 nt, Human
uggcuagaguccucacuc

SEQ ID NO: 2059911 - RNA, 21 nt, Human
uggcuagaguccucacuccca

SEQ ID NO: 2059912 - RNA, 22 nt, Human
uggcuauuagagaucaaccccu

SEQ ID NO: 2059913 - RNA, 16 nt, Human
uggcuauuuaaagaca

SEQ ID NO: 2059914 - RNA, 16 nt, Human
uggcuagucagagaga

SEQ ID NO: 2059915 - RNA, 15 nt, Human
uggcuaguccuuguu

SEQ ID NO: 2059916 - RNA, 18 nt, Human
uggcucaaguccucuuuu

SEQ ID NO: 2059917 - RNA, 12 nt, Human
uggcugcaaagg

SEQ ID NO: 2059918 - RNA, 20 nt, Human
uggcugaggauuucaagccu

SEQ ID NO: 2059919 - RNA, 14 nt, Human
uggcugcagggagu

SEQ ID NO: 2059920 - RNA, 13 nt, Human
uggcugcagggag

SEQ ID NO: 2059921 - RNA, 13 nt, Human
uggcugauaaaag

SEQ ID NO: 2059922 - RNA, 19 nt, Human
uggcugauaaaagauacau

SEQ ID NO: 2059923 - RNA, 15 nt, Human
uggcugcagggaguc

SEQ ID NO: 2059924 - RNA, 13 nt, Human
uggcugcccacac

SEQ ID NO: 2059925 - RNA, 20 nt, Human
uggcugcccagaccccucug

SEQ ID NO: 2059926 - RNA, 23 nt, Human
uggcugcccagaccccucuggcc

SEQ ID NO: 2059927 - RNA, 21 nt, Human
uggcugcccagaccccucugg

SEQ ID NO: 2059928 - RNA, 15 nt, Human
uggcugcuagcacuu

SEQ ID NO: 2059929 - RNA, 13 nt, Human
uggcugcuagcac

SEQ ID NO: 2059930 - RNA, 14 nt, Human
uggcugcuagcacu

SEQ ID NO: 2059931 - RNA, 16 nt, Human
uggcugcggcacccuu

SEQ ID NO: 2059932 - RNA, 17 nt, Human
uggcugcggcacccuug

SEQ ID NO: 2059933 - RNA, 14 nt, Human
uggcugccuggagc

SEQ ID NO: 2059934 - RNA, 15 nt, Human
uggcugccuggagcc

SEQ ID NO: 2059935 - RNA, 16 nt, Human
uggcugccuggagccc

SEQ ID NO: 2059936 - RNA, 17 nt, Human
uggcuuaaaacaacacu

SEQ ID NO: 2059937 - RNA, 15 nt, Human
uggcuguuggcuggg

SEQ ID NO: 2059938 - RNA, 13 nt, Human
uggcuguuggcug

SEQ ID NO: 2059939 - RNA, 22 nt, Human
uggcuucacggaagagccuugc

SEQ ID NO: 2059940 - RNA, 20 nt, Human
uggcuuacuacaugugggag

SEQ ID NO: 2059941 - RNA, 23 nt, Human
uggcuuacuacaugugggagcuu

SEQ ID NO: 2059942 - RNA, 23 nt, Human
uggcuucacggaagagccuugcg

SEQ ID NO: 2059943 - RNA, 22 nt, Human
uggcuuccagaaaaccccagca

SEQ ID NO: 2059944 - RNA, 23 nt, Human
uggcuuccagaaaaccccagcau

SEQ ID NO: 2059945 - RNA, 13 nt, Human
ugggaacuagacu

SEQ ID NO: 2059946 - RNA, 24 nt, Human
ugggaacgcagaugauccaugagu

SEQ ID NO: 2059947 - RNA, 16 nt, Human
ugggaacgugacugcc

SEQ ID NO: 2059948 - RNA, 18 nt, Human
ugggaacgugacugcccc

SEQ ID NO: 2059949 - RNA, 17 nt, Human
ugggaacucccaagaac

SEQ ID NO: 2059950 - RNA, 22 nt, Human
ugggaacucccaagaacagcag

SEQ ID NO: 2059951 - RNA, 12 nt, Human
ugggaagaaaca

SEQ ID NO: 2059952 - RNA, 14 nt, Human
ugggaagaaacaaa

SEQ ID NO: 2059953 - RNA, 13 nt, Human
ugggaagacauga

SEQ ID NO: 2059954 - RNA, 21 nt, Human
ugggaagacauggggaggaag

SEQ ID NO: 2059955 - RNA, 21 nt, Human
ugggaagggagagcggggcag

SEQ ID NO: 2059956 - RNA, 15 nt, Human
ugggaagggguuucu

SEQ ID NO: 2059957 - RNA, 13 nt, Human
ugggaagggagag

SEQ ID NO: 2059958 - RNA, 22 nt, Human
ugggaagauaggcucugcacag

SEQ ID NO: 2059959 - RNA, 17 nt, Human
ugggaagauaggcucug

SEQ ID NO: 2059960 - RNA, 20 nt, Human
ugggaagauaggcucugcac

SEQ ID NO: 2059961 - RNA, 12 nt, Human
ugggaaggacuu

SEQ ID NO: 2059962 - RNA, 13 nt, Human
ugggaaggacuug

SEQ ID NO: 2059963 - RNA, 22 nt, Human
ugggaaggacuuggcgcgcccu

SEQ ID NO: 2059964 - RNA, 12 nt, Human
ugggaaggaggg

SEQ ID NO: 2059965 - RNA, 16 nt, Human
uggcuucccgcucagc

SEQ ID NO: 2059966 - RNA, 15 nt, Human
uggcuucccgcucag

SEQ ID NO: 2059967 - RNA, 17 nt, Human
uggcuucccgcucagcc

SEQ ID NO: 2059968 - RNA, 16 nt, Human
ugggaaaggaguagaa

SEQ ID NO: 2059969 - RNA, 17 nt, Human
ugggaaauaagagagaa

SEQ ID NO: 2059970 - RNA, 17 nt, Human
ugggaaaggaguagaaa

SEQ ID NO: 2059971 - RNA, 20 nt, Human
ugggaaagggauuuucagcc

SEQ ID NO: 2059972 - RNA, 16 nt, Human
ugggaaccuuccuguc

SEQ ID NO: 2059973 - RNA, 21 nt, Human
ugggaacgcagaugauccaug

SEQ ID NO: 2059974 - RNA, 20 nt, Human
aggacugaauuguccccagu

SEQ ID NO: 2059975 - RNA, 17 nt, Human
aggacugaauugucccc

SEQ ID NO: 2059976 - RNA, 19 nt, Human
aggacugaauuguccccag

SEQ ID NO: 2059977 - RNA, 21 nt, Human
aggacuguuuuuuccugagcu

SEQ ID NO: 2059978 - RNA, 18 nt, Human
aggacuguuuuuuccuga

SEQ ID NO: 2059979 - RNA, 22 nt, Human
aggacuguuuuuuccugagcuu

SEQ ID NO: 2059980 - RNA, 20 nt, Human
aggacuuggucugauuucag

SEQ ID NO: 2059981 - RNA, 23 nt, Human
aggacuugcccucgugguggaaa

SEQ ID NO: 2059982 - RNA, 16 nt, Human
aggacuuggucugauu

SEQ ID NO: 2059983 - RNA, 18 nt, Human
aggacauugcggacagcc

SEQ ID NO: 2059984 - RNA, 17 nt, Human
aggacauugcggacagc

SEQ ID NO: 2059985 - RNA, 15 nt, Human
aggacauugcggaca

SEQ ID NO: 2059986 - RNA, 16 nt, Human
aggacauguucccuuc

SEQ ID NO: 2059987 - RNA, 23 nt, Human
aggacauugcggacagccacggc

SEQ ID NO: 2059988 - RNA, 19 nt, Human
aggacauugcggacagcca

SEQ ID NO: 2059989 - RNA, 15 nt, Human
aggacauuucccagg

SEQ ID NO: 2059990 - RNA, 19 nt, Human
aggacucugccuccucuuc

SEQ ID NO: 2059991 - RNA, 23 nt, Human
aggacuuggucugauuucaggau

SEQ ID NO: 2059992 - RNA, 12 nt, Human
aggagaaacaca

SEQ ID NO: 2059993 - RNA, 23 nt, Human
aggacuuuucuuuguggcuuccu

SEQ ID NO: 2059994 - RNA, 21 nt, Human
aggacuuuauagaucagccag

SEQ ID NO: 2059995 - RNA, 20 nt, Human
aggacuuuauagaucagcca

SEQ ID NO: 2059996 - RNA, 14 nt, Human
aggagaugggccuu

SEQ ID NO: 2059997 - RNA, 14 nt, Human
aggagaaacacauc

SEQ ID NO: 2059998 - RNA, 13 nt, Human
aggagaaacacau

SEQ ID NO: 2059999 - RNA, 14 nt, Human
aggagaaacagaga

SEQ ID NO: 2060000 - RNA, 17 nt, Human
aggagauggggacaggg

SEQ ID NO: 2060001 - RNA, 17 nt, Human
aggagauguaagagcuu

SEQ ID NO: 2060002 - RNA, 22 nt, Human
aggagauguaagagcuuuacaa

SEQ ID NO: 2060003 - RNA, 16 nt, Human
aggagaaacagagaca

SEQ ID NO: 2060004 - RNA, 18 nt, Human
aggagaaacagagacagg

SEQ ID NO: 2060005 - RNA, 22 nt, Human
aggagccccgaggccuucucug

SEQ ID NO: 2060006 - RNA, 19 nt, Human
aggagcaggagccugagcc

SEQ ID NO: 2060007 - RNA, 21 nt, Human
ugcuuugggcugcccuggugc

SEQ ID NO: 2060008 - RNA, 20 nt, Human
ugcuuugggcugcccuggug

SEQ ID NO: 2060009 - RNA, 19 nt, Human
ugcuuugggcugcccuggu

SEQ ID NO: 2060010 - RNA, 18 nt, Human
ugcuuugggcugcccugg

SEQ ID NO: 2060011 - RNA, 17 nt, Human
ugcuuugggcugcccug

SEQ ID NO: 2060012 - RNA, 15 nt, Human
uggaaauacacagug

SEQ ID NO: 2060013 - RNA, 14 nt, Human
uggaaauacacagu

SEQ ID NO: 2060014 - RNA, 15 nt, Human
uggaaauauuaagaa

SEQ ID NO: 2060015 - RNA, 22 nt, Human
ugcuuuuccuuggggcaggcag

SEQ ID NO: 2060016 - RNA, 14 nt, Human
uggaaagccucugc

SEQ ID NO: 2060017 - RNA, 15 nt, Human
uggaaagccucugcu

SEQ ID NO: 2060018 - RNA, 16 nt, Human
uggaaagccucugcug

SEQ ID NO: 2060019 - RNA, 18 nt, Human
uggaaagccucugcugcc

SEQ ID NO: 2060020 - RNA, 19 nt, Human
ugcuugccuagggccuggu

SEQ ID NO: 2060021 - RNA, 22 nt, Human
ugcuugccuagggccuggucca

SEQ ID NO: 2060022 - RNA, 19 nt, Human
ugcuugccugcguuuugga

SEQ ID NO: 2060023 - RNA, 18 nt, Human
ugcuugccgaaacuggaa

SEQ ID NO: 2060024 - RNA, 20 nt, Human
ugcuugccgaaacuggaagu

SEQ ID NO: 2060025 - RNA, 14 nt, Human
ugcuugccuagggc

SEQ ID NO: 2060026 - RNA, 19 nt, Human
aggauuuugauccaagcug

SEQ ID NO: 2060027 - RNA, 13 nt, Human
aggaugcccaggg

SEQ ID NO: 2060028 - RNA, 14 nt, Human
aggaugcccagggc

SEQ ID NO: 2060029 - RNA, 22 nt, Human
aggaugcccagggccacucugc

SEQ ID NO: 2060030 - RNA, 17 nt, Human
aggcaacucaucuuagg

SEQ ID NO: 2060031 - RNA, 17 nt, Human
aggcaacugaacaaaaa

SEQ ID NO: 2060032 - RNA, 18 nt, Human
aggcaacugaacaaaaaa

SEQ ID NO: 2060033 - RNA, 19 nt, Human
aggcaacugaacaaaaaaa

SEQ ID NO: 2060034 - RNA, 14 nt, Human
aggcaacugaggca

SEQ ID NO: 2060035 - RNA, 15 nt, Human
aggcaacugaggcag

SEQ ID NO: 2060036 - RNA, 16 nt, Human
aggcaacugaggcaga

SEQ ID NO: 2060037 - RNA, 11 nt, Human
uggaauugcuu

SEQ ID NO: 2060038 - RNA, 16 nt, Human
uggaauugcuuaccaa

SEQ ID NO: 2060039 - RNA, 18 nt, Human
uggaauugcuuaccaaag

SEQ ID NO: 2060040 - RNA, 23 nt, Human
uggaauugcuuaccaaaggauag

SEQ ID NO: 2060041 - RNA, 17 nt, Human
aggcaacugaggcagac

SEQ ID NO: 2060042 - RNA, 19 nt, Human
aggcaacugaggcagacag

SEQ ID NO: 2060043 - RNA, 13 nt, Human
uggaccgaguaga

SEQ ID NO: 2060044 - RNA, 17 nt, Human
uggaccgaguagaggca

SEQ ID NO: 2060045 - RNA, 15 nt, Human
uggaccucaccaagc

SEQ ID NO: 2060046 - RNA, 17 nt, Human
uggaccucgugcuuuaa

SEQ ID NO: 2060047 - RNA, 13 nt, Human
uggaccuaacauu

SEQ ID NO: 2060048 - RNA, 15 nt, Human
uggaccuaacauucg

SEQ ID NO: 2060049 - RNA, 17 nt, Human
uggaccuaacauucgau

SEQ ID NO: 2060050 - RNA, 18 nt, Human
uggacacagcucuucucc

SEQ ID NO: 2060051 - RNA, 23 nt, Human
aggcaaaaggcaguggggcuggg

SEQ ID NO: 2060052 - RNA, 16 nt, Human
uggacacagcucuucu

SEQ ID NO: 2060053 - RNA, 15 nt, Human
uggacacagcucuuc

SEQ ID NO: 2060054 - RNA, 17 nt, Human
uggaccaguggugccuu

SEQ ID NO: 2060055 - RNA, 20 nt, Human
uggacccagggaugacaugu

SEQ ID NO: 2060056 - RNA, 13 nt, Human
uggaccaggacag

SEQ ID NO: 2060057 - RNA, 14 nt, Human
uggaccaggacagg

SEQ ID NO: 2060058 - RNA, 18 nt, Human
uggaccaggacaggacca

SEQ ID NO: 2060059 - RNA, 19 nt, Human
uggaccaggacaggaccag

SEQ ID NO: 2060060 - RNA, 20 nt, Human
aggaucuguuuuuaaaaauc

SEQ ID NO: 2060061 - RNA, 23 nt, Human
aggaucuguuuuuaaaaaucaua

SEQ ID NO: 2060062 - RNA, 22 nt, Human
aggaucuuucacccacagaaag

SEQ ID NO: 2060063 - RNA, 23 nt, Human
aggaucuuucacccacagaaaga

SEQ ID NO: 2060064 - RNA, 21 nt, Human
aggaucucuugagccugggag

SEQ ID NO: 2060065 - RNA, 22 nt, Human
aggaucucuugagccugggagg

SEQ ID NO: 2060066 - RNA, 18 nt, Human
aggauaaacuuuuagaaa

SEQ ID NO: 2060067 - RNA, 21 nt, Human
aggauaaacuuuuagaaacuu

SEQ ID NO: 2060068 - RNA, 18 nt, Human
aggauaacacaaguaaaa

SEQ ID NO: 2060069 - RNA, 20 nt, Human
uggaaauauuaagaaagacu

SEQ ID NO: 2060070 - RNA, 22 nt, Human
uggaaauaucaguuacucagcc

SEQ ID NO: 2060071 - RNA, 13 nt, Human
uggaaauauuaug

SEQ ID NO: 2060072 - RNA, 15 nt, Human
uggaaauauuaugca

SEQ ID NO: 2060073 - RNA, 16 nt, Human
uggaaauauuaugcaa

SEQ ID NO: 2060074 - RNA, 19 nt, Human
uggaaauauuaugcaaauu

SEQ ID NO: 2060075 - RNA, 23 nt, Human
uggaaauauuaugcaaauuccca

SEQ ID NO: 2060076 - RNA, 20 nt, Human
aggaggcuuggaaagcauca

SEQ ID NO: 2060077 - RNA, 20 nt, Human
aggaggcagagguugcagug

SEQ ID NO: 2060078 - RNA, 12 nt, Human
aggagcugcugg

SEQ ID NO: 2060079 - RNA, 13 nt, Human
aggagcugcuggc

SEQ ID NO: 2060080 - RNA, 17 nt, Human
aggagcugcuggcuugc

SEQ ID NO: 2060081 - RNA, 12 nt, Human
aggaggaggagg

SEQ ID NO: 2060082 - RNA, 14 nt, Human
aggagcugcuggcu

SEQ ID NO: 2060083 - RNA, 16 nt, Human
aggagcugcuggcuug

SEQ ID NO: 2060084 - RNA, 23 nt, Human
aggaggaggcaauugggauggcg

SEQ ID NO: 2060085 - RNA, 21 nt, Human
aggaggagguuuaggucaaga

SEQ ID NO: 2060086 - RNA, 20 nt, Human
aggaggauugcuugagccca

SEQ ID NO: 2060087 - RNA, 21 nt, Human
aggaggauugcuugagcccag

SEQ ID NO: 2060088 - RNA, 23 nt, Human
aggaggauugcuugagcccagga

SEQ ID NO: 2060089 - RNA, 14 nt, Human
aggaggcagaaagc

SEQ ID NO: 2060090 - RNA, 20 nt, Human
aggaggcagaaagcagaggc

SEQ ID NO: 2060091 - RNA, 22 nt, Human
aggaggcagaaagcagaggcug

SEQ ID NO: 2060092 - RNA, 12 nt, Human
aggaauugacuu

SEQ ID NO: 2060093 - RNA, 23 nt, Human
aggaaggagacucaccucugccu

SEQ ID NO: 2060094 - RNA, 15 nt, Human
aggaaggagagccug

SEQ ID NO: 2060095 - RNA, 17 nt, Human
aggaaggagagccugcu

SEQ ID NO: 2060096 - RNA, 15 nt, Human
aggaaggagaggaga

SEQ ID NO: 2060097 - RNA, 21 nt, Human
aggaaggagagaaggggagga

SEQ ID NO: 2060098 - RNA, 18 nt, Human
aggaaggagagccugcug

SEQ ID NO: 2060099 - RNA, 18 nt, Human
aggaagcugugagagcag

SEQ ID NO: 2060100 - RNA, 13 nt, Human
aggaagcuuucuc

SEQ ID NO: 2060101 - RNA, 17 nt, Human
aggaagcuuucucugcu

SEQ ID NO: 2060102 - RNA, 18 nt, Human
aggaagcuuucucugcuu

SEQ ID NO: 2060103 - RNA, 19 nt, Human
aggaagcuuucucugcuuc

SEQ ID NO: 2060104 - RNA, 20 nt, Human
aggaagcuuucucugcuuca

SEQ ID NO: 2060105 - RNA, 21 nt, Human
aggaagcuuucucugcuucag

SEQ ID NO: 2060106 - RNA, 22 nt, Human
aggaagcuuucucugcuucagc

SEQ ID NO: 2060107 - RNA, 18 nt, Human
aggaagcaccccaugcca

SEQ ID NO: 2060108 - RNA, 18 nt, Human
agcugggacuacaggcac

SEQ ID NO: 2060109 - RNA, 16 nt, Human
agcugggacuacaggc

SEQ ID NO: 2060110 - RNA, 19 nt, Human
agcugggacuacaggcacc

SEQ ID NO: 2060111 - RNA, 15 nt, Human
ugcuccaccacaucc

SEQ ID NO: 2060112 - RNA, 16 nt, Human
ugcuccagcuguucag

SEQ ID NO: 2060113 - RNA, 19 nt, Human
ugcuccagcuguucagcug

SEQ ID NO: 2060114 - RNA, 15 nt, Human
ugcuccagccaaccc

SEQ ID NO: 2060115 - RNA, 17 nt, Human
ugcuccagccaaccccu

SEQ ID NO: 2060116 - RNA, 18 nt, Human
ugcuccagccaaccccug

SEQ ID NO: 2060117 - RNA, 20 nt, Human
ugcuccagccaaccccugug

SEQ ID NO: 2060118 - RNA, 23 nt, Human
ugcuccagccaaccccuguggag

SEQ ID NO: 2060119 - RNA, 22 nt, Human
ugcuccagccaaccccugugga

SEQ ID NO: 2060120 - RNA, 22 nt, Human
ugcuccacccuuggccugucuc

SEQ ID NO: 2060121 - RNA, 23 nt, Human
ugcuccacccuuggccugucuca

SEQ ID NO: 2060122 - RNA, 15 nt, Human
ugcuccaccccacuc

SEQ ID NO: 2060123 - RNA, 16 nt, Human
ugcuccaccccacuca

SEQ ID NO: 2060124 - RNA, 17 nt, Human
ugcuccaccccacucac

SEQ ID NO: 2060125 - RNA, 16 nt, Human
ugcuccacccuuggcc

SEQ ID NO: 2060126 - RNA, 17 nt, Human
ugcuccacccuuggccu

SEQ ID NO: 2060127 - RNA, 18 nt, Human
ugcuccacccuuggccug

SEQ ID NO: 2060128 - RNA, 19 nt, Human
ugcuccacccuuggccugu

SEQ ID NO: 2060129 - RNA, 15 nt, Human
ugcugaccuccacag

SEQ ID NO: 2060130 - RNA, 16 nt, Human
ugcugaccuccacagc

SEQ ID NO: 2060131 - RNA, 18 nt, Human
ugcucugcuggucuucaa

SEQ ID NO: 2060132 - RNA, 13 nt, Human
ugcucccccaucc

SEQ ID NO: 2060133 - RNA, 20 nt, Human
ugcucccuccccugcccugg

SEQ ID NO: 2060134 - RNA, 14 nt, Human
ugcucccccacccc

SEQ ID NO: 2060135 - RNA, 16 nt, Human
ugcucccccacccccu

SEQ ID NO: 2060136 - RNA, 21 nt, Human
ugcucccccacccccucccca

SEQ ID NO: 2060137 - RNA, 23 nt, Human
ugcucccccacccccuccccagg

SEQ ID NO: 2060138 - RNA, 15 nt, Human
ugcucccccauccuc

SEQ ID NO: 2060139 - RNA, 19 nt, Human
ugcucccuccccugcccug

SEQ ID NO: 2060140 - RNA, 18 nt, Human
ugcuccgccucugcuggc

SEQ ID NO: 2060141 - RNA, 22 nt, Human
ugcucugcugacagacacaggc

SEQ ID NO: 2060142 - RNA, 21 nt, Human
ugcucugcugacagacacagg

SEQ ID NO: 2060143 - RNA, 18 nt, Human
ugcuuaugaauauuuaua

SEQ ID NO: 2060144 - RNA, 19 nt, Human
ugcuuaugaauauuuauaa

SEQ ID NO: 2060145 - RNA, 20 nt, Human
ugcuuaugaauauuuauaac

SEQ ID NO: 2060146 - RNA, 13 nt, Human
ugcuuauacacuu

SEQ ID NO: 2060147 - RNA, 18 nt, Human
ugcugugaccauuuauaa

SEQ ID NO: 2060148 - RNA, 19 nt, Human
ugcugugaccauuuauaau

SEQ ID NO: 2060149 - RNA, 18 nt, Human
ugcugugaacaagugaac

SEQ ID NO: 2060150 - RNA, 23 nt, Human
ugcugugaacaagugaacacauu

SEQ ID NO: 2060151 - RNA, 15 nt, Human
ugcuucacaacccau

SEQ ID NO: 2060152 - RNA, 17 nt, Human
ugcuucacaacccaucu

SEQ ID NO: 2060153 - RNA, 14 nt, Human
ugcuucagccuccc

SEQ ID NO: 2060154 - RNA, 13 nt, Human
ugcuucagccucc

SEQ ID NO: 2060155 - RNA, 19 nt, Human
aggacacuaaccacgcugg

SEQ ID NO: 2060156 - RNA, 23 nt, Human
aggacacuaaccacgcuggaccu

SEQ ID NO: 2060157 - RNA, 21 nt, Human
ugcuucauagcugguuccugc

SEQ ID NO: 2060158 - RNA, 12 nt, Human
ugcuucagccug

SEQ ID NO: 2060159 - RNA, 14 nt, Human
ugcuucagccugag

SEQ ID NO: 2060160 - RNA, 15 nt, Human
ugcuucagccugagg

SEQ ID NO: 2060161 - RNA, 17 nt, Human
ugcuucagccugaggcu

SEQ ID NO: 2060162 - RNA, 22 nt, Human
ugcuucagccugaggcugagac

SEQ ID NO: 2060163 - RNA, 23 nt, Human
ugcuucagccugaggcugagacu

SEQ ID NO: 2060164 - RNA, 14 nt, Human
ugcuucagcuugcu

SEQ ID NO: 2060165 - RNA, 15 nt, Human
ugcuucagcuugcuu

SEQ ID NO: 2060166 - RNA, 22 nt, Human
aggacagccuguggcggugccu

SEQ ID NO: 2060167 - RNA, 23 nt, Human
aggacagccuguggcggugccug

SEQ ID NO: 2060168 - RNA, 18 nt, Human
aggacaggaccagauuuu

SEQ ID NO: 2060169 - RNA, 16 nt, Human
aggacaggcagaaaga

SEQ ID NO: 2060170 - RNA, 17 nt, Human
aggacaggcagaaagag

SEQ ID NO: 2060171 - RNA, 14 nt, Human
aggacaggcaggug

SEQ ID NO: 2060172 - RNA, 12 nt, Human
aggacaggcccg

SEQ ID NO: 2060173 - RNA, 22 nt, Human
aggacagggaggugaccccagg

SEQ ID NO: 2060174 - RNA, 21 nt, Human
aggacaugauggagcgcaccu

SEQ ID NO: 2060175 - RNA, 21 nt, Human
ugcuggcugccuuagaaccuu

SEQ ID NO: 2060176 - RNA, 12 nt, Human
ugcuggccccuc

SEQ ID NO: 2060177 - RNA, 13 nt, Human
ugcuggccccuca

SEQ ID NO: 2060178 - RNA, 15 nt, Human
ugcuggccccucacc

SEQ ID NO: 2060179 - RNA, 14 nt, Human
ugcuggcugccuua

SEQ ID NO: 2060180 - RNA, 15 nt, Human
ugcuggcugccuuag

SEQ ID NO: 2060181 - RNA, 18 nt, Human
ugcuggcuguuggcuggg

SEQ ID NO: 2060182 - RNA, 19 nt, Human
aggaauuugaagcugcagu

SEQ ID NO: 2060183 - RNA, 16 nt, Human
ugcucuggaagagagg

SEQ ID NO: 2060184 - RNA, 15 nt, Human
aggaauuucugagug

SEQ ID NO: 2060185 - RNA, 14 nt, Human
ugcuguauuuucuu

SEQ ID NO: 2060186 - RNA, 18 nt, Human
ugcuguauuuucuuuuua

SEQ ID NO: 2060187 - RNA, 14 nt, Human
ugcugucuaugugg

SEQ ID NO: 2060188 - RNA, 23 nt, Human
ugcuguccuaggccacaccaucu

SEQ ID NO: 2060189 - RNA, 18 nt, Human
ugcuguccgguggagauc

SEQ ID NO: 2060190 - RNA, 14 nt, Human
ugcuguccuaggcc

SEQ ID NO: 2060191 - RNA, 16 nt, Human
ugcuguccuaggccac

SEQ ID NO: 2060192 - RNA, 13 nt, Human
ugcuggagcggcu

SEQ ID NO: 2060193 - RNA, 15 nt, Human
ugcugggacuggcca

SEQ ID NO: 2060194 - RNA, 17 nt, Human
ugcugggacuggccagg

SEQ ID NO: 2060195 - RNA, 13 nt, Human
auccaauuggaua

SEQ ID NO: 2060196 - RNA, 15 nt, Human
auccacacacagagg

SEQ ID NO: 2060197 - RNA, 22 nt, Human
auccaagacagaauaaugaaug

SEQ ID NO: 2060198 - RNA, 16 nt, Human
auccacacacagagga

SEQ ID NO: 2060199 - RNA, 20 nt, Human
auccacacacagaggaagag

SEQ ID NO: 2060200 - RNA, 23 nt, Human
auccacacacagaggaagagcag

SEQ ID NO: 2060201 - RNA, 17 nt, Human
auccagguucagcuugu

SEQ ID NO: 2060202 - RNA, 16 nt, Human
auccaguacauuuaau

SEQ ID NO: 2060203 - RNA, 18 nt, Human
auccaguacauuuaauug

SEQ ID NO: 2060204 - RNA, 19 nt, Human
auccaguacauuuaauuga

SEQ ID NO: 2060205 - RNA, 16 nt, Human
uucugccugcccaggc

SEQ ID NO: 2060206 - RNA, 15 nt, Human
uucugccugcccagg

SEQ ID NO: 2060207 - RNA, 18 nt, Human
auccaaccccccaccugc

SEQ ID NO: 2060208 - RNA, 20 nt, Human
auccaaccccccaccugcca

SEQ ID NO: 2060209 - RNA, 18 nt, Human
aucccaugagccucagca

SEQ ID NO: 2060210 - RNA, 17 nt, Human
aucccaugagccucagc

SEQ ID NO: 2060211 - RNA, 16 nt, Human
aucccugaggcuggac

SEQ ID NO: 2060212 - RNA, 18 nt, Human
aucccugaggcuggacuc

SEQ ID NO: 2060213 - RNA, 20 nt, Human
aucccugaggcuggacucca

SEQ ID NO: 2060214 - RNA, 21 nt, Human
aucccagcacuuugggaggcc

SEQ ID NO: 2060215 - RNA, 16 nt, Human
aucccaugagccucag

SEQ ID NO: 2060216 - RNA, 22 nt, Human
aucccagcacuuugggaggcug

SEQ ID NO: 2060217 - RNA, 19 nt, Human
aucccagcacuuugggagg

SEQ ID NO: 2060218 - RNA, 20 nt, Human
aucccacggaaaaugccaau

SEQ ID NO: 2060219 - RNA, 23 nt, Human
aucccacggaaaaugccaaucuc

SEQ ID NO: 2060220 - RNA, 18 nt, Human
aucccacucacaacagcu

SEQ ID NO: 2060221 - RNA, 12 nt, Human
aucccacuccua

SEQ ID NO: 2060222 - RNA, 16 nt, Human
aucccacuugccccug

SEQ ID NO: 2060223 - RNA, 16 nt, Human
auccaugggggcaggg

SEQ ID NO: 2060224 - RNA, 19 nt, Human
auccaugggggcagggcau

SEQ ID NO: 2060225 - RNA, 19 nt, Human
auccaugaguuugcccugg

SEQ ID NO: 2060226 - RNA, 23 nt, Human
uucuucgagguggaucacagagg

SEQ ID NO: 2060227 - RNA, 20 nt, Human
uucuucggggaacuccugga

SEQ ID NO: 2060228 - RNA, 11 nt, Human
uucuucucccu

SEQ ID NO: 2060229 - RNA, 16 nt, Human
uucuugccaaugaggu

SEQ ID NO: 2060230 - RNA, 12 nt, Human
uucuuugauuau

SEQ ID NO: 2060231 - RNA, 17 nt, Human
uucuuugagacuggguc

SEQ ID NO: 2060232 - RNA, 21 nt, Human
uucuugccuacuaugccagau

SEQ ID NO: 2060233 - RNA, 14 nt, Human
uucuuacauguuuu

SEQ ID NO: 2060234 - RNA, 14 nt, Human
uucuuacaugcauu

SEQ ID NO: 2060235 - RNA, 16 nt, Human
uucuuacaugcauuug

SEQ ID NO: 2060236 - RNA, 13 nt, Human
uucuuacauguuu

SEQ ID NO: 2060237 - RNA, 22 nt, Human
uucuuacuauuaagcaguaaaa

SEQ ID NO: 2060238 - RNA, 13 nt, Human
uucuuacugcuug

SEQ ID NO: 2060239 - RNA, 16 nt, Human
uucuuagauaucuuuu

SEQ ID NO: 2060240 - RNA, 18 nt, Human
uucuuagauaucuuuuua

SEQ ID NO: 2060241 - RNA, 17 nt, Human
uucuuagccuguggcag

SEQ ID NO: 2060242 - RNA, 18 nt, Human
uucuuagccuguggcagu

SEQ ID NO: 2060243 - RNA, 23 nt, Human
uucuuagccuguggcaguaaaga

SEQ ID NO: 2060244 - RNA, 14 nt, Human
uucuuacugcuugg

SEQ ID NO: 2060245 - RNA, 23 nt, Human
uucuuacuugaugaguguaacaa

SEQ ID NO: 2060246 - RNA, 21 nt, Human
uucuuaaaugggcuacuuugu

SEQ ID NO: 2060247 - RNA, 14 nt, Human
uucuguuuguuaaa

SEQ ID NO: 2060248 - RNA, 11 nt, Human
uucuguuucuu

SEQ ID NO: 2060249 - RNA, 14 nt, Human
uucuguuucuaguu

SEQ ID NO: 2060250 - RNA, 15 nt, Human
uucuguuucuaguug

SEQ ID NO: 2060251 - RNA, 20 nt, Human
uucuguuucuauucucuccu

SEQ ID NO: 2060252 - RNA, 22 nt, Human
uucuguuucuauucucuccuca

SEQ ID NO: 2060253 - RNA, 14 nt, Human
aucccugccagcuc

SEQ ID NO: 2060254 - RNA, 15 nt, Human
aucccugccagcucu

SEQ ID NO: 2060255 - RNA, 17 nt, Human
uucuccuuucacaaccu

SEQ ID NO: 2060256 - RNA, 21 nt, Human
uucucccguucacguugccua

SEQ ID NO: 2060257 - RNA, 20 nt, Human
aucauuguuuggcauugaaa

SEQ ID NO: 2060258 - RNA, 20 nt, Human
uucucuaaaauagccacuua

SEQ ID NO: 2060259 - RNA, 13 nt, Human
uucucucaccucc

SEQ ID NO: 2060260 - RNA, 22 nt, Human
uucuccuuucacaaccuucugu

SEQ ID NO: 2060261 - RNA, 18 nt, Human
uucuccuuucacaaccuu

SEQ ID NO: 2060262 - RNA, 23 nt, Human
uucucuaaaugaggggccucagg

SEQ ID NO: 2060263 - RNA, 16 nt, Human
uucuccuuuuuacccc

SEQ ID NO: 2060264 - RNA, 16 nt, Human
aucauaaacugugugc

SEQ ID NO: 2060265 - RNA, 15 nt, Human
aucacuaugcauuuu

SEQ ID NO: 2060266 - RNA, 20 nt, Human
aucauauauauacauacaug

SEQ ID NO: 2060267 - RNA, 15 nt, Human
aucauaaaacuugau

SEQ ID NO: 2060268 - RNA, 19 nt, Human
aucaguugcgcguucugaa

SEQ ID NO: 2060269 - RNA, 20 nt, Human
aucaguugcgcguucugaaa

SEQ ID NO: 2060270 - RNA, 22 nt, Human
aucaguugaggccaggaguuua

SEQ ID NO: 2060271 - RNA, 14 nt, Human
aucauaaacugugu

SEQ ID NO: 2060272 - RNA, 13 nt, Human
aucauaaaauaaa

SEQ ID NO: 2060273 - RNA, 22 nt, Human
aucaguuugcuagcagaaaucu

SEQ ID NO: 2060274 - RNA, 12 nt, Human
aucauaaaauaa

SEQ ID NO: 2060275 - RNA, 23 nt, Human
aucauccacugugccaugugcca

SEQ ID NO: 2060276 - RNA, 17 nt, Human
aucauuaaauuuuuccu

SEQ ID NO: 2060277 - RNA, 23 nt, Human
aucauuaaauuuuuccuuagcau

SEQ ID NO: 2060278 - RNA, 15 nt, Human
aucauuaagacaacu

SEQ ID NO: 2060279 - RNA, 21 nt, Human
aucauccacugugccaugugc

SEQ ID NO: 2060280 - RNA, 16 nt, Human
aucauuauaaacguga

SEQ ID NO: 2060281 - RNA, 23 nt, Human
aucauuauaaacgugaugaucag

SEQ ID NO: 2060282 - RNA, 20 nt, Human
aucauuauaacugaaggaga

SEQ ID NO: 2060283 - RNA, 22 nt, Human
aucauuauaacugaaggagaag

SEQ ID NO: 2060284 - RNA, 19 nt, Human
aucagucugauucccaagc

SEQ ID NO: 2060285 - RNA, 14 nt, Human
aucaggugcugcca

SEQ ID NO: 2060286 - RNA, 12 nt, Human
aucaguguuaaa

SEQ ID NO: 2060287 - RNA, 13 nt, Human
aucaguguuaaaa

SEQ ID NO: 2060288 - RNA, 14 nt, Human
aucaguguuaaaaa

SEQ ID NO: 2060289 - RNA, 19 nt, Human
aucaguguuaaaaaauuuu

SEQ ID NO: 2060290 - RNA, 15 nt, Human
aucaguuacucagcc

SEQ ID NO: 2060291 - RNA, 16 nt, Human
aucaguuacucagccc

SEQ ID NO: 2060292 - RNA, 17 nt, Human
aucaguuacucagcccu

SEQ ID NO: 2060293 - RNA, 18 nt, Human
aucaguuacucagcccug

SEQ ID NO: 2060294 - RNA, 19 nt, Human
aucaguuacucagcccugg

SEQ ID NO: 2060295 - RNA, 21 nt, Human
aucaguuacucagcccugggc

SEQ ID NO: 2060296 - RNA, 18 nt, Human
aucaguuacucugaaggg

SEQ ID NO: 2060297 - RNA, 15 nt, Human
aucaggugcugccau

SEQ ID NO: 2060298 - RNA, 19 nt, Human
aucaggugcugccauccag

SEQ ID NO: 2060299 - RNA, 17 nt, Human
aucaggugcugccaucc

SEQ ID NO: 2060300 - RNA, 19 nt, Human
auccugcuucugauaugca

SEQ ID NO: 2060301 - RNA, 21 nt, Human
auccugcuucugauaugcagu

SEQ ID NO: 2060302 - RNA, 21 nt, Human
auccuggcacccggccccugc

SEQ ID NO: 2060303 - RNA, 20 nt, Human
auccuggcacccggccccug

SEQ ID NO: 2060304 - RNA, 19 nt, Human
auccuggcacccggccccu

SEQ ID NO: 2060305 - RNA, 17 nt, Human
auccuggcacccggccc

SEQ ID NO: 2060306 - RNA, 20 nt, Human
auccuggggcauuaaaaaaa

SEQ ID NO: 2060307 - RNA, 22 nt, Human
auccuggguggucugcaggcag

SEQ ID NO: 2060308 - RNA, 23 nt, Human
auccuggguggucugcaggcagg

SEQ ID NO: 2060309 - RNA, 22 nt, Human
auccugguugguguugcagaag

SEQ ID NO: 2060310 - RNA, 15 nt, Human
auccuggcuuugccc

SEQ ID NO: 2060311 - RNA, 16 nt, Human
auccuggcuuugccca

SEQ ID NO: 2060312 - RNA, 18 nt, Human
auccuggcuuugcccaac

SEQ ID NO: 2060313 - RNA, 19 nt, Human
auccuggcucuguggcuug

SEQ ID NO: 2060314 - RNA, 22 nt, Human
auccuggcucuguggcuugcua

SEQ ID NO: 2060315 - RNA, 18 nt, Human
auccuggcucuguggcuu

SEQ ID NO: 2060316 - RNA, 23 nt, Human
auccuggcacccggccccugcug

SEQ ID NO: 2060317 - RNA, 22 nt, Human
auccuggcacccggccccugcu

SEQ ID NO: 2060318 - RNA, 14 nt, Human
auccuguccucagc

SEQ ID NO: 2060319 - RNA, 21 nt, Human
auccugucuuuaaggaaaaaa

SEQ ID NO: 2060320 - RNA, 23 nt, Human
auccugucuuuaaggaaaaaaag

SEQ ID NO: 2060321 - RNA, 17 nt, Human
auccugucuguucaugg

SEQ ID NO: 2060322 - RNA, 19 nt, Human
auccugucuuuaaggaaaa

SEQ ID NO: 2060323 - RNA, 17 nt, Human
auccuguccucagcuuc

SEQ ID NO: 2060324 - RNA, 18 nt, Human
auccuguccucagcuucu

SEQ ID NO: 2060325 - RNA, 15 nt, Human
auccugugugguuua

SEQ ID NO: 2060326 - RNA, 20 nt, Human
auccugugugguuuagugua

SEQ ID NO: 2060327 - RNA, 21 nt, Human
auccugugugguuuaguguaa

SEQ ID NO: 2060328 - RNA, 14 nt, Human
auccuguguuucua

SEQ ID NO: 2060329 - RNA, 18 nt, Human
auccuuaaguaucagaaa

SEQ ID NO: 2060330 - RNA, 19 nt, Human
auccuuaaguaucagaaag

SEQ ID NO: 2060331 - RNA, 18 nt, Human
auccuguguuucuaggga

SEQ ID NO: 2060332 - RNA, 12 nt, Human
auccuguugaaa

SEQ ID NO: 2060333 - RNA, 13 nt, Human
auccuguugaaaa

SEQ ID NO: 2060334 - RNA, 14 nt, Human
auccuguugaaaag

SEQ ID NO: 2060335 - RNA, 15 nt, Human
auccuguugaaaagc

SEQ ID NO: 2060336 - RNA, 17 nt, Human
auccuguugaaaagcca

SEQ ID NO: 2060337 - RNA, 18 nt, Human
auccuguugaaaagccau

SEQ ID NO: 2060338 - RNA, 19 nt, Human
auccuguugaaaagccaug

SEQ ID NO: 2060339 - RNA, 13 nt, Human
auccuguggguga

SEQ ID NO: 2060340 - RNA, 15 nt, Human
aucgggaacaguguu

SEQ ID NO: 2060341 - RNA, 16 nt, Human
aucgggaacaguguuu

SEQ ID NO: 2060342 - RNA, 17 nt, Human
aucgggaacaguguuuc

SEQ ID NO: 2060343 - RNA, 21 nt, Human
aucgggaacaguguuucccau

SEQ ID NO: 2060344 - RNA, 16 nt, Human
aucgggagcagugucu

SEQ ID NO: 2060345 - RNA, 17 nt, Human
aucgggagcagugucuu

SEQ ID NO: 2060346 - RNA, 18 nt, Human
aucgggagcagugucuuc

SEQ ID NO: 2060347 - RNA, 21 nt, Human
aucgggagcagugucuuccau

SEQ ID NO: 2060348 - RNA, 14 nt, Human
aucggggccagagg

SEQ ID NO: 2060349 - RNA, 15 nt, Human
aucgggggcuggggc

SEQ ID NO: 2060350 - RNA, 14 nt, Human
aucgguccugucuc

SEQ ID NO: 2060351 - RNA, 18 nt, Human
aucggugaaacuaacaga

SEQ ID NO: 2060352 - RNA, 19 nt, Human
aucggugaaacuaacagau

SEQ ID NO: 2060353 - RNA, 21 nt, Human
aucggugaaacuaacagauaa

SEQ ID NO: 2060354 - RNA, 15 nt, Human
aucgguguccauuua

SEQ ID NO: 2060355 - RNA, 17 nt, Human
aucgguguccauuuaua

SEQ ID NO: 2060356 - RNA, 23 nt, Human
aucgguguccauuuauagaauaa

SEQ ID NO: 2060357 - RNA, 14 nt, Human
uucuuuugccauga

SEQ ID NO: 2060358 - RNA, 21 nt, Human
uucuuuugcccuucacagugu

SEQ ID NO: 2060359 - RNA, 22 nt, Human
uucuuuugcccuucacaguguu

SEQ ID NO: 2060360 - RNA, 23 nt, Human
uucuuuugcccuucacaguguuu

SEQ ID NO: 2060361 - RNA, 12 nt, Human
uucuuuuguaaa

SEQ ID NO: 2060362 - RNA, 16 nt, Human
uucuguuuugccugaa

SEQ ID NO: 2060363 - RNA, 14 nt, Human
auccugcccagugu

SEQ ID NO: 2060364 - RNA, 15 nt, Human
auccugcccaguguu

SEQ ID NO: 2060365 - RNA, 21 nt, Human
auccugcccaguguuguuugu

SEQ ID NO: 2060366 - RNA, 22 nt, Human
auccugcccaguguuguuugua

SEQ ID NO: 2060367 - RNA, 13 nt, Human
auccugcuaaguu

SEQ ID NO: 2060368 - RNA, 24 nt, Human
auccugagccaucggugaaacuaa

SEQ ID NO: 2060369 - RNA, 12 nt, Human
auccugagccau

SEQ ID NO: 2060370 - RNA, 17 nt, Human
uugagaagcguauguuu

SEQ ID NO: 2060371 - RNA, 15 nt, Human
uugagaaaugaauaa

SEQ ID NO: 2060372 - RNA, 16 nt, Human
uugagaaaugaauaau

SEQ ID NO: 2060373 - RNA, 22 nt, Human
uugagaaaugaauaauuuccca

SEQ ID NO: 2060374 - RNA, 19 nt, Human
uugagaacugcauauguuu

SEQ ID NO: 2060375 - RNA, 21 nt, Human
uugagaacugcauauguuucg

SEQ ID NO: 2060376 - RNA, 20 nt, Human
uugacauaacacuauaaagg

SEQ ID NO: 2060377 - RNA, 19 nt, Human
uugacagggcacaccgggc

SEQ ID NO: 2060378 - RNA, 16 nt, Human
uugacaguaacuuggu

SEQ ID NO: 2060379 - RNA, 19 nt, Human
uugacaguaacuugguuau

SEQ ID NO: 2060380 - RNA, 22 nt, Human
uugacaguaacuugguuauaca

SEQ ID NO: 2060381 - RNA, 23 nt, Human
uugacaguaacuugguuauacau

SEQ ID NO: 2060382 - RNA, 12 nt, Human
uugauaaaguaa

SEQ ID NO: 2060383 - RNA, 21 nt, Human
uugagguggucugaauguucu

SEQ ID NO: 2060384 - RNA, 21 nt, Human
uugaguuuuguuuuaaaauua

SEQ ID NO: 2060385 - RNA, 12 nt, Human
uugaguuuuguu

SEQ ID NO: 2060386 - RNA, 17 nt, Human
uugagauagaagaacug

SEQ ID NO: 2060387 - RNA, 18 nt, Human
uugagauagaagaacugc

SEQ ID NO: 2060388 - RNA, 17 nt, Human
uugaggucuuuugacau

SEQ ID NO: 2060389 - RNA, 18 nt, Human
uugaggucuuuugacaug

SEQ ID NO: 2060390 - RNA, 19 nt, Human
uugaggucuuuugacaugu

SEQ ID NO: 2060391 - RNA, 22 nt, Human
uugaggucuuuugacaugugga

SEQ ID NO: 2060392 - RNA, 23 nt, Human
uugaggucuuuugacauguggaa

SEQ ID NO: 2060393 - RNA, 19 nt, Human
uugagguggaagcccuccu

SEQ ID NO: 2060394 - RNA, 22 nt, Human
uugagguggaagcccuccuucc

SEQ ID NO: 2060395 - RNA, 12 nt, Human
uugauaacagcu

SEQ ID NO: 2060396 - RNA, 13 nt, Human
uugauaacagcua

SEQ ID NO: 2060397 - RNA, 18 nt, Human
uugauaaauuccacugga

SEQ ID NO: 2060398 - RNA, 11 nt, Human
uugauaacagc

SEQ ID NO: 2060399 - RNA, 19 nt, Human
uugauaaauuccacuggac

SEQ ID NO: 2060400 - RNA, 21 nt, Human
uugauaaauuccacuggacuu

SEQ ID NO: 2060401 - RNA, 11 nt, Human
uugauaauaaa

SEQ ID NO: 2060402 - RNA, 16 nt, Human
aucuaagccuuuccau

SEQ ID NO: 2060403 - RNA, 18 nt, Human
aucuaagccuuuccauaa

SEQ ID NO: 2060404 - RNA, 17 nt, Human
aucuaagccuuuccaua

SEQ ID NO: 2060405 - RNA, 13 nt, Human
uugaauauauuau

SEQ ID NO: 2060406 - RNA, 19 nt, Human
uugaauauauuauaaucuu

SEQ ID NO: 2060407 - RNA, 15 nt, Human
uugaauauaaacacu

SEQ ID NO: 2060408 - RNA, 16 nt, Human
uugaauauaaacacua

SEQ ID NO: 2060409 - RNA, 18 nt, Human
uugaauauaaacacuaua

SEQ ID NO: 2060410 - RNA, 15 nt, Human
uugaagucacccggc

SEQ ID NO: 2060411 - RNA, 12 nt, Human
uugaaguaauga

SEQ ID NO: 2060412 - RNA, 16 nt, Human
uugaaguaaugaauuu

SEQ ID NO: 2060413 - RNA, 17 nt, Human
uugaaguaaugaauuuu

SEQ ID NO: 2060414 - RNA, 19 nt, Human
uugaaggucuugauuuguu

SEQ ID NO: 2060415 - RNA, 17 nt, Human
uugaaggaaagauuugu

SEQ ID NO: 2060416 - RNA, 16 nt, Human
uugaaggaugcugucu

SEQ ID NO: 2060417 - RNA, 14 nt, Human
uugaaggaugcugu

SEQ ID NO: 2060418 - RNA, 21 nt, Human
uugaaggaugcugucuucgua

SEQ ID NO: 2060419 - RNA, 15 nt, Human
uugaaggaucuguuu

SEQ ID NO: 2060420 - RNA, 15 nt, Human
aucuaaauguugaaa

SEQ ID NO: 2060421 - RNA, 15 nt, Human
aucuaacaauggaag

SEQ ID NO: 2060422 - RNA, 16 nt, Human
aucuaacaauggaaga

SEQ ID NO: 2060423 - RNA, 16 nt, Human
aucuaaacuuuaauau

SEQ ID NO: 2060424 - RNA, 18 nt, Human
aucuaaacuuuaauaugu

SEQ ID NO: 2060425 - RNA, 21 nt, Human
aucuaaacuuuaauauguauu

SEQ ID NO: 2060426 - RNA, 22 nt, Human
aucuaaacuuuaauauguauuu

SEQ ID NO: 2060427 - RNA, 15 nt, Human
aucgugacaacacuu

SEQ ID NO: 2060428 - RNA, 14 nt, Human
aucgugacaacacu

SEQ ID NO: 2060429 - RNA, 23 nt, Human
aucgucucucccucccuuugaaa

SEQ ID NO: 2060430 - RNA, 18 nt, Human
aucgugccguuacucucc

SEQ ID NO: 2060431 - RNA, 13 nt, Human
auauuguacaguu

SEQ ID NO: 2060432 - RNA, 14 nt, Human
auauuguacaguuu

SEQ ID NO: 2060433 - RNA, 12 nt, Human
auauugucagau

SEQ ID NO: 2060434 - RNA, 15 nt, Human
auauugucagauauu

SEQ ID NO: 2060435 - RNA, 17 nt, Human
auauugucagauauuuu

SEQ ID NO: 2060436 - RNA, 16 nt, Human
auauugucagauauuu

SEQ ID NO: 2060437 - RNA, 13 nt, Human
auauugugaagua

SEQ ID NO: 2060438 - RNA, 13 nt, Human
auauuguuuucag

SEQ ID NO: 2060439 - RNA, 17 nt, Human
auauuguuuucagugua

SEQ ID NO: 2060440 - RNA, 12 nt, Human
auauuguuucua

SEQ ID NO: 2060441 - RNA, 19 nt, Human
auauuuaaauguaaagaca

SEQ ID NO: 2060442 - RNA, 21 nt, Human
auauuuaaauguaaagacaaa

SEQ ID NO: 2060443 - RNA, 14 nt, Human
auauuuaagaaaau

SEQ ID NO: 2060444 - RNA, 16 nt, Human
auauuuaagaaaauac

SEQ ID NO: 2060445 - RNA, 18 nt, Human
auauuuaagaaaauacaa

SEQ ID NO: 2060446 - RNA, 19 nt, Human
auauuuaagaaaauacaau

SEQ ID NO: 2060447 - RNA, 20 nt, Human
auauuuaagaaaauacaaua

SEQ ID NO: 2060448 - RNA, 22 nt, Human
auauuuaagaaaauacaauaaa

SEQ ID NO: 2060449 - RNA, 23 nt, Human
auauuuaagaaaauacaauaaac

SEQ ID NO: 2060450 - RNA, 15 nt, Human
auauuuaaguauuca

SEQ ID NO: 2060451 - RNA, 19 nt, Human
auauuuaaguauucaagaa

SEQ ID NO: 2060452 - RNA, 20 nt, Human
auauuuaaguauucaagaaa

SEQ ID NO: 2060453 - RNA, 14 nt, Human
auauuuaaggagau

SEQ ID NO: 2060454 - RNA, 23 nt, Human
auauuuaaggagauguaagagcu

SEQ ID NO: 2060455 - RNA, 12 nt, Human
auauuguacagu

SEQ ID NO: 2060456 - RNA, 15 nt, Human
auauugauaugcuua

SEQ ID NO: 2060457 - RNA, 15 nt, Human
auauugagacaaaaa

SEQ ID NO: 2060458 - RNA, 16 nt, Human
auauugagacaaaaau

SEQ ID NO: 2060459 - RNA, 20 nt, Human
auauugagacaaaaauuauc

SEQ ID NO: 2060460 - RNA, 21 nt, Human
auauuccugcauuugugaaau

SEQ ID NO: 2060461 - RNA, 16 nt, Human
auauguucaacuggag

SEQ ID NO: 2060462 - RNA, 18 nt, Human
auauguucuuuaaaaaua

SEQ ID NO: 2060463 - RNA, 17 nt, Human
auauguguuuuucacau

SEQ ID NO: 2060464 - RNA, 19 nt, Human
auauguguuuuucacauuu

SEQ ID NO: 2060465 - RNA, 22 nt, Human
auauguguuuuucacauuugcg

SEQ ID NO: 2060466 - RNA, 20 nt, Human
auauguuaaccucaguguca

SEQ ID NO: 2060467 - RNA, 12 nt, Human
auauguucaacu

SEQ ID NO: 2060468 - RNA, 15 nt, Human
auauguucaacugga

SEQ ID NO: 2060469 - RNA, 23 nt, Human
uucccagugacacuucagagagc

SEQ ID NO: 2060470 - RNA, 23 nt, Human
uucccagcucucccucuggcccu

SEQ ID NO: 2060471 - RNA, 14 nt, Human
uucccagcucuccc

SEQ ID NO: 2060472 - RNA, 21 nt, Human
uuccagugagcuuaucaugcu

SEQ ID NO: 2060473 - RNA, 16 nt, Human
uucccagcucucccuc

SEQ ID NO: 2060474 - RNA, 17 nt, Human
uucccagcucucccucu

SEQ ID NO: 2060475 - RNA, 18 nt, Human
uucccagcucucccucug

SEQ ID NO: 2060476 - RNA, 19 nt, Human
uucccagcucucccucugg

SEQ ID NO: 2060477 - RNA, 20 nt, Human
uucccagcucucccucuggc

SEQ ID NO: 2060478 - RNA, 15 nt, Human
uucccagcugccccu

SEQ ID NO: 2060479 - RNA, 19 nt, Human
uucccagcugccccucccu

SEQ ID NO: 2060480 - RNA, 20 nt, Human
uucccagcugccccucccug

SEQ ID NO: 2060481 - RNA, 13 nt, Human
uucccagcugucu

SEQ ID NO: 2060482 - RNA, 18 nt, Human
uucccagcuucugccaca

SEQ ID NO: 2060483 - RNA, 16 nt, Human
auauuaagaaagacua

SEQ ID NO: 2060484 - RNA, 15 nt, Human
auauuaagaaagacu

SEQ ID NO: 2060485 - RNA, 17 nt, Human
auauuaagaaagacuau

SEQ ID NO: 2060486 - RNA, 22 nt, Human
auauuaagaaagacuaucuaaa

SEQ ID NO: 2060487 - RNA, 20 nt, Human
auauuacacaaauacuuauu

SEQ ID NO: 2060488 - RNA, 22 nt, Human
auauuacacaaauacuuauuca

SEQ ID NO: 2060489 - RNA, 23 nt, Human
auauuacacaaauacuuauucau

SEQ ID NO: 2060490 - RNA, 14 nt, Human
auauuaaaaauggu

SEQ ID NO: 2060491 - RNA, 15 nt, Human
auauuaaaaauggua

SEQ ID NO: 2060492 - RNA, 16 nt, Human
auauuaaaaaugguaa

SEQ ID NO: 2060493 - RNA, 19 nt, Human
auauuaaaaaugguaaaau

SEQ ID NO: 2060494 - RNA, 20 nt, Human
auauuaaaaaugguaaaauu

SEQ ID NO: 2060495 - RNA, 21 nt, Human
auauuaaaaaugguaaaauug

SEQ ID NO: 2060496 - RNA, 23 nt, Human
auauuaaaaaugguaaaauugca

SEQ ID NO: 2060497 - RNA, 14 nt, Human
auauuaaaaauugg

SEQ ID NO: 2060498 - RNA, 14 nt, Human
auauguugaugaaa

SEQ ID NO: 2060499 - RNA, 22 nt, Human
auauguugaugaaaaauagcaa

SEQ ID NO: 2060500 - RNA, 16 nt, Human
aucaauucauaucuau

SEQ ID NO: 2060501 - RNA, 18 nt, Human
aucaauguucauuguaau

SEQ ID NO: 2060502 - RNA, 13 nt, Human
aucaauuaaaugu

SEQ ID NO: 2060503 - RNA, 14 nt, Human
aucaauguucauug

SEQ ID NO: 2060504 - RNA, 15 nt, Human
aucaauguucauugu

SEQ ID NO: 2060505 - RNA, 16 nt, Human
aucaauguucauugua

SEQ ID NO: 2060506 - RNA, 17 nt, Human
aucaauguucauuguaa

SEQ ID NO: 2060507 - RNA, 15 nt, Human
aucaauuaaauguag

SEQ ID NO: 2060508 - RNA, 14 nt, Human
aucaauuaaaugua

SEQ ID NO: 2060509 - RNA, 15 nt, Human
aucaaggucguuuuu

SEQ ID NO: 2060510 - RNA, 23 nt, Human
aucaacugaaaguguuuccuuca

SEQ ID NO: 2060511 - RNA, 13 nt, Human
aucaauguucauu

SEQ ID NO: 2060512 - RNA, 13 nt, Human
aucaacucuaaua

SEQ ID NO: 2060513 - RNA, 14 nt, Human
aucaaggucguuuu

SEQ ID NO: 2060514 - RNA, 17 nt, Human
aucacgccacugcacua

SEQ ID NO: 2060515 - RNA, 15 nt, Human
aucacgccacugcac

SEQ ID NO: 2060516 - RNA, 14 nt, Human
aucaauuugucauu

SEQ ID NO: 2060517 - RNA, 18 nt, Human
aucaauuugucauuuuga

SEQ ID NO: 2060518 - RNA, 19 nt, Human
aucaauuugucauuuugaa

SEQ ID NO: 2060519 - RNA, 20 nt, Human
aucaauuugucauuuugaag

SEQ ID NO: 2060520 - RNA, 22 nt, Human
aucaauuugucauuuugaagcu

SEQ ID NO: 2060521 - RNA, 17 nt, Human
aucacgccacugcacuc

SEQ ID NO: 2060522 - RNA, 20 nt, Human
aucacgccacugcacuccag

SEQ ID NO: 2060523 - RNA, 23 nt, Human
aucacgccacugcacuccagccu

SEQ ID NO: 2060524 - RNA, 21 nt, Human
aucacucucagugcuucuuac

SEQ ID NO: 2060525 - RNA, 13 nt, Human
uuccuuaaacugu

SEQ ID NO: 2060526 - RNA, 15 nt, Human
uuccuuaaacugugu

SEQ ID NO: 2060527 - RNA, 16 nt, Human
uuccuuaaacugugug

SEQ ID NO: 2060528 - RNA, 17 nt, Human
uuccuuaaacugugugg

SEQ ID NO: 2060529 - RNA, 16 nt, Human
uuccuuacugcagaau

SEQ ID NO: 2060530 - RNA, 15 nt, Human
auauuuuuguuuguu

SEQ ID NO: 2060531 - RNA, 16 nt, Human
auauuuuuguuuguuu

SEQ ID NO: 2060532 - RNA, 19 nt, Human
auauuuuuguuuguuuugu

SEQ ID NO: 2060533 - RNA, 20 nt, Human
auauuuuuguuuguuuugug

SEQ ID NO: 2060534 - RNA, 20 nt, Human
uuccgacaaccgaugcucca

SEQ ID NO: 2060535 - RNA, 22 nt, Human
uuccgacaaccgaugcuccagc

SEQ ID NO: 2060536 - RNA, 23 nt, Human
uuccgacaaccgaugcuccagcc

SEQ ID NO: 2060537 - RNA, 15 nt, Human
uucccuaccucaggc

SEQ ID NO: 2060538 - RNA, 13 nt, Human
uucccuaccucag

SEQ ID NO: 2060539 - RNA, 14 nt, Human
uucccuaccucagg

SEQ ID NO: 2060540 - RNA, 19 nt, Human
uucccuaagccaagggccu

SEQ ID NO: 2060541 - RNA, 15 nt, Human
uucccuaagccaagg

SEQ ID NO: 2060542 - RNA, 12 nt, Human
uucccgcucagc

SEQ ID NO: 2060543 - RNA, 15 nt, Human
uucccgcucagcccu

SEQ ID NO: 2060544 - RNA, 14 nt, Human
uucccgcucagccc

SEQ ID NO: 2060545 - RNA, 23 nt, Human
uucccgaaccccaaggagggaga

SEQ ID NO: 2060546 - RNA, 14 nt, Human
uuccccuuucccca

SEQ ID NO: 2060547 - RNA, 17 nt, Human
uuccccuuuccccacuc

SEQ ID NO: 2060548 - RNA, 15 nt, Human
auauuuacauaugaa

SEQ ID NO: 2060549 - RNA, 22 nt, Human
uuccuguuguuauggaaacugu

SEQ ID NO: 2060550 - RNA, 14 nt, Human
uuccuggcuucuua

SEQ ID NO: 2060551 - RNA, 22 nt, Human
uuccucuuuuuauuuaguuccu

SEQ ID NO: 2060552 - RNA, 12 nt, Human
uuccugaaagaa

SEQ ID NO: 2060553 - RNA, 15 nt, Human
uuccugaaaugcagu

SEQ ID NO: 2060554 - RNA, 17 nt, Human
uuccugaaagaaacagu

SEQ ID NO: 2060555 - RNA, 18 nt, Human
uuccugaaagaaacaguu

SEQ ID NO: 2060556 - RNA, 18 nt, Human
uuccucuccacugccuuc

SEQ ID NO: 2060557 - RNA, 16 nt, Human
uuccucuccacugccu

SEQ ID NO: 2060558 - RNA, 19 nt, Human
uuccucuccacugccuucg

SEQ ID NO: 2060559 - RNA, 14 nt, Human
uuccuaaaugcagu

SEQ ID NO: 2060560 - RNA, 13 nt, Human
uuccuaaaugcag

SEQ ID NO: 2060561 - RNA, 21 nt, Human
uuccggaauccuguccucagc

SEQ ID NO: 2060562 - RNA, 17 nt, Human
uuccuaaggcacccaca

SEQ ID NO: 2060563 - RNA, 19 nt, Human
uuccuaacaggauuagaca

SEQ ID NO: 2060564 - RNA, 16 nt, Human
uuccuaaaugcaguga

SEQ ID NO: 2060565 - RNA, 14 nt, Human
uuccuaacacagca

SEQ ID NO: 2060566 - RNA, 18 nt, Human
uuccuaacacagcaugug

SEQ ID NO: 2060567 - RNA, 19 nt, Human
uuccuaacacagcaugugu

SEQ ID NO: 2060568 - RNA, 20 nt, Human
uucauaucuauuuauuaaau

SEQ ID NO: 2060569 - RNA, 13 nt, Human
uucagucuuucau

SEQ ID NO: 2060570 - RNA, 13 nt, Human
uucagucuuuucc

SEQ ID NO: 2060571 - RNA, 14 nt, Human
uucagucuuuuccu

SEQ ID NO: 2060572 - RNA, 20 nt, Human
uucagugagggucuucuuac

SEQ ID NO: 2060573 - RNA, 16 nt, Human
uucagugaaagcauca

SEQ ID NO: 2060574 - RNA, 14 nt, Human
uucaguaagccgug

SEQ ID NO: 2060575 - RNA, 15 nt, Human
uucagguuuuguaaa

SEQ ID NO: 2060576 - RNA, 19 nt, Human
uucagguuuuguaaagaug

SEQ ID NO: 2060577 - RNA, 15 nt, Human
uucaguaaaaaacaa

SEQ ID NO: 2060578 - RNA, 16 nt, Human
uucaguaauaaaacau

SEQ ID NO: 2060579 - RNA, 18 nt, Human
uucaguaauaaaacaucu

SEQ ID NO: 2060580 - RNA, 20 nt, Human
uucaguaauaaacuguguuu

SEQ ID NO: 2060581 - RNA, 19 nt, Human
uucagguagcugccccugg

SEQ ID NO: 2060582 - RNA, 14 nt, Human
uucagguacuaaau

SEQ ID NO: 2060583 - RNA, 17 nt, Human
uucagguaacaggcaga

SEQ ID NO: 2060584 - RNA, 20 nt, Human
uucagguguuuaguugcaga

SEQ ID NO: 2060585 - RNA, 13 nt, Human
auauauguguuuu

SEQ ID NO: 2060586 - RNA, 15 nt, Human
auauauguguuuuuc

SEQ ID NO: 2060587 - RNA, 21 nt, Human
auauauguguuuuucacauuu

SEQ ID NO: 2060588 - RNA, 23 nt, Human
auauauguguuuuucacauuugc

SEQ ID NO: 2060589 - RNA, 15 nt, Human
uucaucaguguuaaa

SEQ ID NO: 2060590 - RNA, 16 nt, Human
uucaucaguguuaaaa

SEQ ID NO: 2060591 - RNA, 10 nt, Human
auauauuuau

SEQ ID NO: 2060592 - RNA, 12 nt, Human
auauauuuauaa

SEQ ID NO: 2060593 - RNA, 13 nt, Human
auauauuuauaac

SEQ ID NO: 2060594 - RNA, 16 nt, Human
auauauguugauuucu

SEQ ID NO: 2060595 - RNA, 20 nt, Human
auauauguugauuucuugua

SEQ ID NO: 2060596 - RNA, 22 nt, Human
auauauguuuuaagaggcaggg

SEQ ID NO: 2060597 - RNA, 21 nt, Human
auauauguuuuaagaggcagg

SEQ ID NO: 2060598 - RNA, 13 nt, Human
auauauuuuaauu

SEQ ID NO: 2060599 - RNA, 23 nt, Human
auauauuuauaacucaucauaaa

SEQ ID NO: 2060600 - RNA, 14 nt, Human
auauauuucagaua

SEQ ID NO: 2060601 - RNA, 14 nt, Human
auauauuuauaacu

SEQ ID NO: 2060602 - RNA, 15 nt, Human
auauauuuauaacuc

SEQ ID NO: 2060603 - RNA, 16 nt, Human
auauauuuauaacuca

SEQ ID NO: 2060604 - RNA, 21 nt, Human
auauauuuauaacucaucaua

SEQ ID NO: 2060605 - RNA, 22 nt, Human
uucagauauaaaagacugacca

SEQ ID NO: 2060606 - RNA, 16 nt, Human
uucagaaccucuuccc

SEQ ID NO: 2060607 - RNA, 17 nt, Human
uucagaaccucuucccc

SEQ ID NO: 2060608 - RNA, 18 nt, Human
uucagaaccucuucccca

SEQ ID NO: 2060609 - RNA, 19 nt, Human
uucagaaccucuuccccag

SEQ ID NO: 2060610 - RNA, 16 nt, Human
uucagaagacacugca

SEQ ID NO: 2060611 - RNA, 16 nt, Human
uucagauauauuuuuc

SEQ ID NO: 2060612 - RNA, 19 nt, Human
uucacuuucacauagaugu

SEQ ID NO: 2060613 - RNA, 20 nt, Human
uucagaacaccaagacuuga

SEQ ID NO: 2060614 - RNA, 12 nt, Human
uucagaaccucu

SEQ ID NO: 2060615 - RNA, 15 nt, Human
uucagaaccucuucc

SEQ ID NO: 2060616 - RNA, 12 nt, Human
uucagaaaacag

SEQ ID NO: 2060617 - RNA, 17 nt, Human
uucagaaaacagaaaaa

SEQ ID NO: 2060618 - RNA, 18 nt, Human
uucagaaaacagaaaaaa

SEQ ID NO: 2060619 - RNA, 19 nt, Human
uucagaaaacagaaaaaaa

SEQ ID NO: 2060620 - RNA, 22 nt, Human
uucagaaaacagaaaaaaaaca

SEQ ID NO: 2060621 - RNA, 23 nt, Human
uucagaaaacagaaaaaaaacac

SEQ ID NO: 2060622 - RNA, 23 nt, Human
uucagaaaacccuuuucuacagu

SEQ ID NO: 2060623 - RNA, 16 nt, Human
uucagcauauuuauag

SEQ ID NO: 2060624 - RNA, 13 nt, Human
uucagcauucuua

SEQ ID NO: 2060625 - RNA, 19 nt, Human
uucagcauucuuagccugu

SEQ ID NO: 2060626 - RNA, 20 nt, Human
uucagcauucuuagccugug

SEQ ID NO: 2060627 - RNA, 16 nt, Human
uucagguaacaggcag

SEQ ID NO: 2060628 - RNA, 15 nt, Human
uucagguaacaggca

SEQ ID NO: 2060629 - RNA, 22 nt, Human
uucaggguuggccccugcccgg

SEQ ID NO: 2060630 - RNA, 19 nt, Human
uucaggguuggccccugcc

SEQ ID NO: 2060631 - RNA, 17 nt, Human
uucaggguuggccccug

SEQ ID NO: 2060632 - RNA, 16 nt, Human
uucaggguuggccccu

SEQ ID NO: 2060633 - RNA, 18 nt, Human
uucagcucacacaugaga

SEQ ID NO: 2060634 - RNA, 14 nt, Human
uucaggguuggccc

SEQ ID NO: 2060635 - RNA, 13 nt, Human
auauauguuuuaa

SEQ ID NO: 2060636 - RNA, 14 nt, Human
auaugaaauuuaau

SEQ ID NO: 2060637 - RNA, 14 nt, Human
auaugacagcuguc

SEQ ID NO: 2060638 - RNA, 15 nt, Human
auaugacagcugucc

SEQ ID NO: 2060639 - RNA, 21 nt, Human
auaugacagcugucccuguca

SEQ ID NO: 2060640 - RNA, 22 nt, Human
auaugaauacagggcaugcauu

SEQ ID NO: 2060641 - RNA, 16 nt, Human
auaugacggaagaaca

SEQ ID NO: 2060642 - RNA, 13 nt, Human
auaugacucacau

SEQ ID NO: 2060643 - RNA, 18 nt, Human
auaugacggaagaacaua

SEQ ID NO: 2060644 - RNA, 20 nt, Human
auaugacggaagaacauaga

SEQ ID NO: 2060645 - RNA, 20 nt, Human
auaugacucacaugaugcau

SEQ ID NO: 2060646 - RNA, 23 nt, Human
auaugacggaagaacauagaacu

SEQ ID NO: 2060647 - RNA, 12 nt, Human
auaugaacauag

SEQ ID NO: 2060648 - RNA, 18 nt, Human
auaugcaaacauaacaaa

SEQ ID NO: 2060649 - RNA, 21 nt, Human
auaugcaaacauaacaaaauc

SEQ ID NO: 2060650 - RNA, 22 nt, Human
auaugcaaacauaacaaaauca

SEQ ID NO: 2060651 - RNA, 18 nt, Human
auauguaguauaaagaaa

SEQ ID NO: 2060652 - RNA, 19 nt, Human
auauguaguauaaagaaaa

SEQ ID NO: 2060653 - RNA, 16 nt, Human
auauguagaaggcaca

SEQ ID NO: 2060654 - RNA, 23 nt, Human
auauggggggccaacaccaggga

SEQ ID NO: 2060655 - RNA, 18 nt, Human
auauggggggccaacacc

SEQ ID NO: 2060656 - RNA, 16 nt, Human
auauggggaugcagca

SEQ ID NO: 2060657 - RNA, 20 nt, Human
auauggggaugcagcauuau

SEQ ID NO: 2060658 - RNA, 17 nt, Human
auauggggggccaacac

SEQ ID NO: 2060659 - RNA, 16 nt, Human
auauguguguguaugu

SEQ ID NO: 2060660 - RNA, 20 nt, Human
auauguguguguauguuugc

SEQ ID NO: 2060661 - RNA, 15 nt, Human
uucauuaaagcauuu

SEQ ID NO: 2060662 - RNA, 13 nt, Human
uucauuaaagcau

SEQ ID NO: 2060663 - RNA, 21 nt, Human
uucauugccuuaacuggagcc

SEQ ID NO: 2060664 - RNA, 15 nt, Human
uucauugccaguguc

SEQ ID NO: 2060665 - RNA, 16 nt, Human
uucauugccagugucu

SEQ ID NO: 2060666 - RNA, 17 nt, Human
uucauugccagugucuu

SEQ ID NO: 2060667 - RNA, 19 nt, Human
uucauugccagugucuuuc

SEQ ID NO: 2060668 - RNA, 13 nt, Human
uuccaacugcugc

SEQ ID NO: 2060669 - RNA, 15 nt, Human
uuccaacugcugccc

SEQ ID NO: 2060670 - RNA, 16 nt, Human
uuccaacugcugcccc

SEQ ID NO: 2060671 - RNA, 22 nt, Human
uuccaacugcugccccaaagga

SEQ ID NO: 2060672 - RNA, 12 nt, Human
uuccaagacauu

SEQ ID NO: 2060673 - RNA, 13 nt, Human
uuccaagacauug

SEQ ID NO: 2060674 - RNA, 14 nt, Human
uuccaagacauugu

SEQ ID NO: 2060675 - RNA, 13 nt, Human
uucauugggcugu

SEQ ID NO: 2060676 - RNA, 17 nt, Human
uucauuguaauguuacu

SEQ ID NO: 2060677 - RNA, 11 nt, Human
uuccacaaaau

SEQ ID NO: 2060678 - RNA, 18 nt, Human
uuccacaaaaucugucca

SEQ ID NO: 2060679 - RNA, 13 nt, Human
uuccaauuuggaa

SEQ ID NO: 2060680 - RNA, 22 nt, Human
uuccaauuuacauacucugcuu

SEQ ID NO: 2060681 - RNA, 16 nt, Human
uuccaagaccugacuc

SEQ ID NO: 2060682 - RNA, 18 nt, Human
uuccaagacuccagcccu

SEQ ID NO: 2060683 - RNA, 16 nt, Human
uuccaagacauuguca

SEQ ID NO: 2060684 - RNA, 17 nt, Human
uuccaagacauugucaa

SEQ ID NO: 2060685 - RNA, 19 nt, Human
uuccaagacauugucaaua

SEQ ID NO: 2060686 - RNA, 20 nt, Human
uuccaagacauugucaauaa

SEQ ID NO: 2060687 - RNA, 16 nt, Human
uucauugacuaucaaa

SEQ ID NO: 2060688 - RNA, 19 nt, Human
uucauucuugaaagcugug

SEQ ID NO: 2060689 - RNA, 13 nt, Human
uucauucuugaaa

SEQ ID NO: 2060690 - RNA, 18 nt, Human
uucauugauaugaaaaau

SEQ ID NO: 2060691 - RNA, 20 nt, Human
uucauuauuggaauuaaccu

SEQ ID NO: 2060692 - RNA, 14 nt, Human
uucauucuggucuc

SEQ ID NO: 2060693 - RNA, 13 nt, Human
uucauuauuggaa

SEQ ID NO: 2060694 - RNA, 17 nt, Human
uucauuauuggaauuaa

SEQ ID NO: 2060695 - RNA, 18 nt, Human
uucauuauuggaauuaac

SEQ ID NO: 2060696 - RNA, 17 nt, Human
uuccacaggucucagaa

SEQ ID NO: 2060697 - RNA, 20 nt, Human
uuccacauccggaggagaag

SEQ ID NO: 2060698 - RNA, 14 nt, Human
uuccacgaugaaaa

SEQ ID NO: 2060699 - RNA, 19 nt, Human
uuccacgaugaaaaacuuc

SEQ ID NO: 2060700 - RNA, 15 nt, Human
uuccacgcugucucc

SEQ ID NO: 2060701 - RNA, 15 nt, Human
uuccaccuucccaug

SEQ ID NO: 2060702 - RNA, 18 nt, Human
uuccacgcugucuccaga

SEQ ID NO: 2060703 - RNA, 19 nt, Human
uuccacgcugucuccagac

SEQ ID NO: 2060704 - RNA, 13 nt, Human
uuccaccuggaag

SEQ ID NO: 2060705 - RNA, 13 nt, Human
uuccaccuuaaau

SEQ ID NO: 2060706 - RNA, 14 nt, Human
uuccaccuuaaauu

SEQ ID NO: 2060707 - RNA, 16 nt, Human
uuccaccuuaaauuaa

SEQ ID NO: 2060708 - RNA, 17 nt, Human
uuccaccuuaaauuaaa

SEQ ID NO: 2060709 - RNA, 18 nt, Human
uuccaccuuaaauuaaac

SEQ ID NO: 2060710 - RNA, 20 nt, Human
uuccaccuuaaauuaaacaa

SEQ ID NO: 2060711 - RNA, 12 nt, Human
uuccaccagccu

SEQ ID NO: 2060712 - RNA, 11 nt, Human
uuccaccagcc

SEQ ID NO: 2060713 - RNA, 19 nt, Human
uuccacguacugcagccuc

SEQ ID NO: 2060714 - RNA, 18 nt, Human
uuccagguuuaagcuguu

SEQ ID NO: 2060715 - RNA, 17 nt, Human
uuccagguuuaagcugu

SEQ ID NO: 2060716 - RNA, 19 nt, Human
uuccaguaccuuugucaca

SEQ ID NO: 2060717 - RNA, 17 nt, Human
uuccaguaccuuuguca

SEQ ID NO: 2060718 - RNA, 18 nt, Human
uuccaguaccuuugucac

SEQ ID NO: 2060719 - RNA, 15 nt, Human
uuucaguuuucagga

SEQ ID NO: 2060720 - RNA, 12 nt, Human
uuucagaaaaca

SEQ ID NO: 2060721 - RNA, 13 nt, Human
uuucagaaaacag

SEQ ID NO: 2060722 - RNA, 16 nt, Human
uuucagaaaacagaaa

SEQ ID NO: 2060723 - RNA, 19 nt, Human
uuucagaaaacagaaaaaa

SEQ ID NO: 2060724 - RNA, 21 nt, Human
uuucaguugaucacuggcaau

SEQ ID NO: 2060725 - RNA, 21 nt, Human
uuucacuuucacauagauguc

SEQ ID NO: 2060726 - RNA, 24 nt, Human
uuucacugcuggcugccuuagaac

SEQ ID NO: 2060727 - RNA, 24 nt, Human
uuucacucuuauugcccacgcugg

SEQ ID NO: 2060728 - RNA, 14 nt, Human
uuuauuuuuuucua

SEQ ID NO: 2060729 - RNA, 15 nt, Human
uuuauuuuuuauaca

SEQ ID NO: 2060730 - RNA, 16 nt, Human
uuuauuuuuuauacag

SEQ ID NO: 2060731 - RNA, 16 nt, Human
uuucaccuacuuugua

SEQ ID NO: 2060732 - RNA, 17 nt, Human
uuucaccuacuuuguaa

SEQ ID NO: 2060733 - RNA, 20 nt, Human
uuucaccuacuuuguaagug

SEQ ID NO: 2060734 - RNA, 15 nt, Human
uuucacccacagaaa

SEQ ID NO: 2060735 - RNA, 17 nt, Human
uuucacccacagaaaga

SEQ ID NO: 2060736 - RNA, 18 nt, Human
uuucacccacagaaagag

SEQ ID NO: 2060737 - RNA, 19 nt, Human
uuucacccacagaaagaga

SEQ ID NO: 2060738 - RNA, 20 nt, Human
uuucacccacagaaagagag

SEQ ID NO: 2060739 - RNA, 22 nt, Human
uuucaccccacccuuccccucc

SEQ ID NO: 2060740 - RNA, 19 nt, Human
uuuccagguuuaagcuguu

SEQ ID NO: 2060741 - RNA, 14 nt, Human
uuucauaaauuuga

SEQ ID NO: 2060742 - RNA, 15 nt, Human
uuuccauaaggaaug

SEQ ID NO: 2060743 - RNA, 15 nt, Human
uuuccaguaccuuug

SEQ ID NO: 2060744 - RNA, 19 nt, Human
uuuccagugagcuuaucau

SEQ ID NO: 2060745 - RNA, 12 nt, Human
uuuccagugcaa

SEQ ID NO: 2060746 - RNA, 22 nt, Human
uuuccaguggccuggcuccgcu

SEQ ID NO: 2060747 - RNA, 12 nt, Human
uuucccauaauu

SEQ ID NO: 2060748 - RNA, 14 nt, Human
uuucccauaauuuu

SEQ ID NO: 2060749 - RNA, 21 nt, Human
augcuuauuuuaaaauuuuau

SEQ ID NO: 2060750 - RNA, 23 nt, Human
auggaacccuuuuggcccccgag

SEQ ID NO: 2060751 - RNA, 17 nt, Human
auggaaccgcaggaagc

SEQ ID NO: 2060752 - RNA, 14 nt, Human
augcuuauuuuaaa

SEQ ID NO: 2060753 - RNA, 16 nt, Human
augcuuauuuuaaaau

SEQ ID NO: 2060754 - RNA, 19 nt, Human
augcuuaucaucuaaagau

SEQ ID NO: 2060755 - RNA, 14 nt, Human
uuuauuuuuuaagu

SEQ ID NO: 2060756 - RNA, 15 nt, Human
uuuauuuuuuacauu

SEQ ID NO: 2060757 - RNA, 17 nt, Human
uuuauuuuuuaaguauu

SEQ ID NO: 2060758 - RNA, 21 nt, Human
uuuauuuucuuuuguaaaugu

SEQ ID NO: 2060759 - RNA, 16 nt, Human
uuuauuuuccucccca

SEQ ID NO: 2060760 - RNA, 22 nt, Human
uuuauuuucugguagauagaaa

SEQ ID NO: 2060761 - RNA, 15 nt, Human
uuuauuuuagcaguu

SEQ ID NO: 2060762 - RNA, 19 nt, Human
uuuauuuuagcaguucugc

SEQ ID NO: 2060763 - RNA, 23 nt, Human
uuuauuuuagcaguucugcaaau

SEQ ID NO: 2060764 - RNA, 11 nt, Human
uuuauuuuaua

SEQ ID NO: 2060765 - RNA, 21 nt, Human
uuuauuuuauauaauaaagua

SEQ ID NO: 2060766 - RNA, 14 nt, Human
auggaauaacaugu

SEQ ID NO: 2060767 - RNA, 15 nt, Human
auggaauaacaugua

SEQ ID NO: 2060768 - RNA, 16 nt, Human
auggaauaacucugug

SEQ ID NO: 2060769 - RNA, 16 nt, Human
auggaaccgcaggaag

SEQ ID NO: 2060770 - RNA, 17 nt, Human
auggaagguuuguauau

SEQ ID NO: 2060771 - RNA, 22 nt, Human
auggaagguuuguauauuguca

SEQ ID NO: 2060772 - RNA, 12 nt, Human
uuuauuaagaug

SEQ ID NO: 2060773 - RNA, 14 nt, Human
uuuauuacuuauuu

SEQ ID NO: 2060774 - RNA, 22 nt, Human
augcuggcuguuggcugggggc

SEQ ID NO: 2060775 - RNA, 17 nt, Human
uuuauuaugcauaacug

SEQ ID NO: 2060776 - RNA, 20 nt, Human
uuuauuaugcauaacugaca

SEQ ID NO: 2060777 - RNA, 14 nt, Human
augcuggugagcca

SEQ ID NO: 2060778 - RNA, 21 nt, Human
augcugguuuuccuaaaugca

SEQ ID NO: 2060779 - RNA, 22 nt, Human
augcuggggcaagucccugacu

SEQ ID NO: 2060780 - RNA, 14 nt, Human
uuuauaugaacaua

SEQ ID NO: 2060781 - RNA, 19 nt, Human
augcuguauucuucuuugg

SEQ ID NO: 2060782 - RNA, 14 nt, Human
augcuguauauguu

SEQ ID NO: 2060783 - RNA, 19 nt, Human
uuuauuaaauguagaaagu

SEQ ID NO: 2060784 - RNA, 18 nt, Human
uuuauuaacaaauuaugu

SEQ ID NO: 2060785 - RNA, 12 nt, Human
uuuauuaacaaa

SEQ ID NO: 2060786 - RNA, 15 nt, Human
uuuauuaagauggau

SEQ ID NO: 2060787 - RNA, 16 nt, Human
uuuaugguuucuccag

SEQ ID NO: 2060788 - RNA, 16 nt, Human
uuuauguauguuuaca

SEQ ID NO: 2060789 - RNA, 20 nt, Human
uuuauguauguuuacacugu

SEQ ID NO: 2060790 - RNA, 21 nt, Human
uuuauguauguuuacacuguc

SEQ ID NO: 2060791 - RNA, 22 nt, Human
uuuauguauguuuacacuguca

SEQ ID NO: 2060792 - RNA, 17 nt, Human
uuuauaucccauuuuua

SEQ ID NO: 2060793 - RNA, 15 nt, Human
uuuauauauuuauaa

SEQ ID NO: 2060794 - RNA, 16 nt, Human
uuuauauauuuauaac

SEQ ID NO: 2060795 - RNA, 12 nt, Human
uuuauauauuua

SEQ ID NO: 2060796 - RNA, 19 nt, Human
uuuauguaaaauuuugccu

SEQ ID NO: 2060797 - RNA, 22 nt, Human
uuuauguaaacugcauuagaaa

SEQ ID NO: 2060798 - RNA, 22 nt, Human
uuuaggucaagaagaagaugga

SEQ ID NO: 2060799 - RNA, 19 nt, Human
uuuaguacccaccugagcu

SEQ ID NO: 2060800 - RNA, 16 nt, Human
uuuauauagcuugaaa

SEQ ID NO: 2060801 - RNA, 19 nt, Human
uuuauauagcuugaaacau

SEQ ID NO: 2060802 - RNA, 15 nt, Human
uuuagccuaguucau

SEQ ID NO: 2060803 - RNA, 23 nt, Human
uuuacuacuguggaaaaauauuu

SEQ ID NO: 2060804 - RNA, 21 nt, Human
uuuacuacuguggaaaaauau

SEQ ID NO: 2060805 - RNA, 12 nt, Human
uuuagcaugugu

SEQ ID NO: 2060806 - RNA, 18 nt, Human
uuuagcaguucugcaaau

SEQ ID NO: 2060807 - RNA, 21 nt, Human
uuuagcaguucugcaaauaga

SEQ ID NO: 2060808 - RNA, 23 nt, Human
uuuagcaguucugcaaauagaaa

SEQ ID NO: 2060809 - RNA, 16 nt, Human
uuuagcauaaaauuuu

SEQ ID NO: 2060810 - RNA, 20 nt, Human
uuuagcaugacaagccccag

SEQ ID NO: 2060811 - RNA, 23 nt, Human
uuuagcaugacaagccccaggca

SEQ ID NO: 2060812 - RNA, 13 nt, Human
uuuacucauuauc

SEQ ID NO: 2060813 - RNA, 13 nt, Human
uuuacuauuuuac

SEQ ID NO: 2060814 - RNA, 13 nt, Human
uuuaaagaaaagu

SEQ ID NO: 2060815 - RNA, 15 nt, Human
uuuaaagaaaaguuu

SEQ ID NO: 2060816 - RNA, 17 nt, Human
uuuaaagaaaaguuuug

SEQ ID NO: 2060817 - RNA, 21 nt, Human
uuuaaagaaaaguuuuguaaa

SEQ ID NO: 2060818 - RNA, 22 nt, Human
augccgcugcauccgugagcag

SEQ ID NO: 2060819 - RNA, 20 nt, Human
augcggcccaggauggcuuu

SEQ ID NO: 2060820 - RNA, 16 nt, Human
augcggcccaggaugg

SEQ ID NO: 2060821 - RNA, 18 nt, Human
augcggcaagaaggaauu

SEQ ID NO: 2060822 - RNA, 15 nt, Human
augccuaagaagaug

SEQ ID NO: 2060823 - RNA, 16 nt, Human
augccuaagaagauga

SEQ ID NO: 2060824 - RNA, 20 nt, Human
augccuaagaagaugacuuc

SEQ ID NO: 2060825 - RNA, 21 nt, Human
augccuaagaagaugacuucc

SEQ ID NO: 2060826 - RNA, 19 nt, Human
augcggccgcauucccuga

SEQ ID NO: 2060827 - RNA, 21 nt, Human
uuuaccugugcguuacuaauu

SEQ ID NO: 2060828 - RNA, 15 nt, Human
uuuaccugugaaaua

SEQ ID NO: 2060829 - RNA, 16 nt, Human
uuuaccugugaaauag

SEQ ID NO: 2060830 - RNA, 13 nt, Human
uuuacguagugua

SEQ ID NO: 2060831 - RNA, 19 nt, Human
uuuccuuaaauuaucuaaa

SEQ ID NO: 2060832 - RNA, 23 nt, Human
uuuccuuaaacuguguggacugu

SEQ ID NO: 2060833 - RNA, 21 nt, Human
uuuccuguuuuuguuaacuuu

SEQ ID NO: 2060834 - RNA, 16 nt, Human
uuuccuuaaacugugu

SEQ ID NO: 2060835 - RNA, 13 nt, Human
uuuccuguucagc

SEQ ID NO: 2060836 - RNA, 15 nt, Human
uuuccuguucagcau

SEQ ID NO: 2060837 - RNA, 16 nt, Human
uuuccuguucagcauu

SEQ ID NO: 2060838 - RNA, 18 nt, Human
uuuccuguucagcauucu

SEQ ID NO: 2060839 - RNA, 12 nt, Human
uuuccugugucu

SEQ ID NO: 2060840 - RNA, 17 nt, Human
augggccuccugugugu

SEQ ID NO: 2060841 - RNA, 19 nt, Human
uuuccuuccaucccuaccc

SEQ ID NO: 2060842 - RNA, 14 nt, Human
uuuccuuccauccc

SEQ ID NO: 2060843 - RNA, 15 nt, Human
uuuccuuccaucccu

SEQ ID NO: 2060844 - RNA, 16 nt, Human
uuuccuucccucaaag

SEQ ID NO: 2060845 - RNA, 16 nt, Human
uuuccuuccuucccug

SEQ ID NO: 2060846 - RNA, 15 nt, Human
uuuccuucucaucug

SEQ ID NO: 2060847 - RNA, 13 nt, Human
uuuccuucagugc

SEQ ID NO: 2060848 - RNA, 23 nt, Human
uuuccuucauucaacccaccugc

SEQ ID NO: 2060849 - RNA, 21 nt, Human
uuuccuucauucaacccaccu

SEQ ID NO: 2060850 - RNA, 21 nt, Human
uuuccuuuuaaaacacuucca

SEQ ID NO: 2060851 - RNA, 18 nt, Human
uuuccuuggggcaggcag

SEQ ID NO: 2060852 - RNA, 19 nt, Human
uuuccuuggggcaggcagu

SEQ ID NO: 2060853 - RNA, 18 nt, Human
uuuccuucucaucuguga

SEQ ID NO: 2060854 - RNA, 18 nt, Human
uuuccuuccuucccuggc

SEQ ID NO: 2060855 - RNA, 18 nt, Human
uuucgcaggauucuuccu

SEQ ID NO: 2060856 - RNA, 22 nt, Human
uuucgcaggauucuuccucccu

SEQ ID NO: 2060857 - RNA, 19 nt, Human
uuucgccguugaagaggaa

SEQ ID NO: 2060858 - RNA, 13 nt, Human
uuucguuaacauu

SEQ ID NO: 2060859 - RNA, 15 nt, Human
uuucguuaacauuga

SEQ ID NO: 2060860 - RNA, 18 nt, Human
uuucguuaacauugacca

SEQ ID NO: 2060861 - RNA, 19 nt, Human
uuucguuaacauugaccaa

SEQ ID NO: 2060862 - RNA, 12 nt, Human
uuucguuuguuu

SEQ ID NO: 2060863 - RNA, 14 nt, Human
uuucuaaaaaacag

SEQ ID NO: 2060864 - RNA, 21 nt, Human
augggacuggagucccuguga

SEQ ID NO: 2060865 - RNA, 15 nt, Human
augggccuccugugu

SEQ ID NO: 2060866 - RNA, 21 nt, Human
augggcaacccccagccugcu

SEQ ID NO: 2060867 - RNA, 19 nt, Human
augggcaacccccagccug

SEQ ID NO: 2060868 - RNA, 18 nt, Human
augggcaacccccagccu

SEQ ID NO: 2060869 - RNA, 22 nt, Human
augggagccccagggucuuccc

SEQ ID NO: 2060870 - RNA, 13 nt, Human
augggagccccag

SEQ ID NO: 2060871 - RNA, 13 nt, Human
augggacugggag

SEQ ID NO: 2060872 - RNA, 21 nt, Human
auggacccaauauuuaccaga

SEQ ID NO: 2060873 - RNA, 12 nt, Human
auggaccuaaca

SEQ ID NO: 2060874 - RNA, 13 nt, Human
auggaccuaacau

SEQ ID NO: 2060875 - RNA, 14 nt, Human
auggaccuaacauu

SEQ ID NO: 2060876 - RNA, 15 nt, Human
auggaccuaacauuc

SEQ ID NO: 2060877 - RNA, 21 nt, Human
auggccucagcugccucacuu

SEQ ID NO: 2060878 - RNA, 18 nt, Human
auggccucagcugccuca

SEQ ID NO: 2060879 - RNA, 19 nt, Human
auggccucagcugccucac

SEQ ID NO: 2060880 - RNA, 16 nt, Human
auggccucagcugccu

SEQ ID NO: 2060881 - RNA, 17 nt, Human
auggccucagcugccuc

SEQ ID NO: 2060882 - RNA, 19 nt, Human
auggacaugaucuucuuua

SEQ ID NO: 2060883 - RNA, 17 nt, Human
auggaauugcuuaccaa

SEQ ID NO: 2060884 - RNA, 21 nt, Human
uuucuuuaguuuuugugaagu

SEQ ID NO: 2060885 - RNA, 13 nt, Human
uuucuuuguggcu

SEQ ID NO: 2060886 - RNA, 22 nt, Human
uuucuuuugcccuucacagugu

SEQ ID NO: 2060887 - RNA, 16 nt, Human
uuucuuuuguaaaugu

SEQ ID NO: 2060888 - RNA, 21 nt, Human
uuucuggacugaagccugcag

SEQ ID NO: 2060889 - RNA, 23 nt, Human
uuucuggacugaagccugcagga

SEQ ID NO: 2060890 - RNA, 16 nt, Human
uuucuggccugccuuc

SEQ ID NO: 2060891 - RNA, 23 nt, Human
uuucuuguuuaucagcaguuguu

SEQ ID NO: 2060892 - RNA, 13 nt, Human
uuucugcccugcc

SEQ ID NO: 2060893 - RNA, 24 nt, Human
uuugaaacaacuuucucuuguaaa

SEQ ID NO: 2060894 - RNA, 14 nt, Human
uuugaaauaauaaa

SEQ ID NO: 2060895 - RNA, 19 nt, Human
uuugaaauagucuguguga

SEQ ID NO: 2060896 - RNA, 20 nt, Human
uuugaaauagucugugugaa

SEQ ID NO: 2060897 - RNA, 20 nt, Human
uuugaaaaggcgguacuagu

SEQ ID NO: 2060898 - RNA, 15 nt, Human
auggggagaaaagac

SEQ ID NO: 2060899 - RNA, 18 nt, Human
augggcuuguuuucuugc

SEQ ID NO: 2060900 - RNA, 20 nt, Human
auggggagaucggggccaga

SEQ ID NO: 2060901 - RNA, 23 nt, Human
auggggagaucggggccagaggc

SEQ ID NO: 2060902 - RNA, 16 nt, Human
auggggaaggaggcug

SEQ ID NO: 2060903 - RNA, 23 nt, Human
augggcuuguuuucuugccaaug

SEQ ID NO: 2060904 - RNA, 14 nt, Human
uuucucaaagaaau

SEQ ID NO: 2060905 - RNA, 15 nt, Human
uuucucaaagaaauu

SEQ ID NO: 2060906 - RNA, 16 nt, Human
uuucucaaagaaauuu

SEQ ID NO: 2060907 - RNA, 23 nt, Human
uuucucagccgcuucugacugcu

SEQ ID NO: 2060908 - RNA, 12 nt, Human
uuucucccagcu

SEQ ID NO: 2060909 - RNA, 20 nt, Human
uuucucccaggccaggcucc

SEQ ID NO: 2060910 - RNA, 12 nt, Human
uuucugcccugc

SEQ ID NO: 2060911 - RNA, 16 nt, Human
uuucugccagggagcu

SEQ ID NO: 2060912 - RNA, 14 nt, Human
uuucuaguugagga

SEQ ID NO: 2060913 - RNA, 16 nt, Human
uuucuaguugaggagu

SEQ ID NO: 2060914 - RNA, 14 nt, Human
uuucuagggaaaug

SEQ ID NO: 2060915 - RNA, 23 nt, Human
uuucuaggucaaggccugucccu

SEQ ID NO: 2060916 - RNA, 15 nt, Human
uuucuagggaaauga

SEQ ID NO: 2060917 - RNA, 18 nt, Human
uuucuagggaaaugaaag

SEQ ID NO: 2060918 - RNA, 18 nt, Human
augagccaccgcgcccag

SEQ ID NO: 2060919 - RNA, 21 nt, Human
augagccaccgcgcccagccu

SEQ ID NO: 2060920 - RNA, 14 nt, Human
augagccagacaaa

SEQ ID NO: 2060921 - RNA, 15 nt, Human
augagcagaagcucu

SEQ ID NO: 2060922 - RNA, 16 nt, Human
augagccucagcaucc

SEQ ID NO: 2060923 - RNA, 15 nt, Human
augagccucagcauc

SEQ ID NO: 2060924 - RNA, 12 nt, Human
augagccucagc

SEQ ID NO: 2060925 - RNA, 11 nt, Human
augagccagac

SEQ ID NO: 2060926 - RNA, 22 nt, Human
augagaucuaggugaggauuga

SEQ ID NO: 2060927 - RNA, 13 nt, Human
augagauccuuua

SEQ ID NO: 2060928 - RNA, 22 nt, Human
augagaucuaagccuuuccaua

SEQ ID NO: 2060929 - RNA, 23 nt, Human
augagaucuaagccuuuccauaa

SEQ ID NO: 2060930 - RNA, 15 nt, Human
augagauagaagaug

SEQ ID NO: 2060931 - RNA, 21 nt, Human
augagauagaagauguuugcu

SEQ ID NO: 2060932 - RNA, 19 nt, Human
augagaucccgccucuucu

SEQ ID NO: 2060933 - RNA, 13 nt, Human
augacauguguca

SEQ ID NO: 2060934 - RNA, 24 nt, Human
augacaucuucaaagcuugaagau

SEQ ID NO: 2060935 - RNA, 22 nt, Human
augacaguuauacugucgguuu

SEQ ID NO: 2060936 - RNA, 20 nt, Human
uuguccgguggaaggccuuc

SEQ ID NO: 2060937 - RNA, 21 nt, Human
uuguccgguggaaggccuucu

SEQ ID NO: 2060938 - RNA, 18 nt, Human
uugucccgauuguaacuc

SEQ ID NO: 2060939 - RNA, 13 nt, Human
uugucauuuugaa

SEQ ID NO: 2060940 - RNA, 15 nt, Human
uugucauuuugaagc

SEQ ID NO: 2060941 - RNA, 16 nt, Human
uugucauuuugaagcu

SEQ ID NO: 2060942 - RNA, 19 nt, Human
uugucauuuugaagcuaau

SEQ ID NO: 2060943 - RNA, 21 nt, Human
uugucauuuugaagcuaauua

SEQ ID NO: 2060944 - RNA, 13 nt, Human
uugucauugcuuu

SEQ ID NO: 2060945 - RNA, 15 nt, Human
uugucauugcuuuac

SEQ ID NO: 2060946 - RNA, 18 nt, Human
uugucauugcuuuacugg

SEQ ID NO: 2060947 - RNA, 22 nt, Human
uugucacucaacaaaagugcuu

SEQ ID NO: 2060948 - RNA, 21 nt, Human
uugucaucuuucuucuauuuu

SEQ ID NO: 2060949 - RNA, 19 nt, Human
uugucaucuuucuucuauu

SEQ ID NO: 2060950 - RNA, 18 nt, Human
uugucacacacuuuggcu

SEQ ID NO: 2060951 - RNA, 15 nt, Human
augauaaaacacaaa

SEQ ID NO: 2060952 - RNA, 21 nt, Human
augaguuuuugauagcuuuau

SEQ ID NO: 2060953 - RNA, 15 nt, Human
augauaaaaaauuuu

SEQ ID NO: 2060954 - RNA, 17 nt, Human
augauaaaaaauuuugu

SEQ ID NO: 2060955 - RNA, 21 nt, Human
augauaaaaaauuuuguaauu

SEQ ID NO: 2060956 - RNA, 22 nt, Human
augauaaaaaauuuuguaauuu

SEQ ID NO: 2060957 - RNA, 13 nt, Human
augaguuuuugau

SEQ ID NO: 2060958 - RNA, 19 nt, Human
augaguuuuugauagcuuu

SEQ ID NO: 2060959 - RNA, 20 nt, Human
augaguuuuugauagcuuua

SEQ ID NO: 2060960 - RNA, 16 nt, Human
augaguguaacaagaa

SEQ ID NO: 2060961 - RNA, 17 nt, Human
augaguguaacaagaaa

SEQ ID NO: 2060962 - RNA, 19 nt, Human
augaguguaacaagaaagg

SEQ ID NO: 2060963 - RNA, 20 nt, Human
augaguguaacaagaaagga

SEQ ID NO: 2060964 - RNA, 21 nt, Human
augaguguaacaagaaaggag

SEQ ID NO: 2060965 - RNA, 22 nt, Human
augaguguaacaagaaaggaga

SEQ ID NO: 2060966 - RNA, 23 nt, Human
augaguguaacaagaaaggagag

SEQ ID NO: 2060967 - RNA, 18 nt, Human
augagccucagcauccug

SEQ ID NO: 2060968 - RNA, 17 nt, Human
augagccucagcauccu

SEQ ID NO: 2060969 - RNA, 14 nt, Human
augaggucccaggc

SEQ ID NO: 2060970 - RNA, 15 nt, Human
augaggucccaggca

SEQ ID NO: 2060971 - RNA, 16 nt, Human
augaggucccaggcag

SEQ ID NO: 2060972 - RNA, 17 nt, Human
augaggucccaggcaga

SEQ ID NO: 2060973 - RNA, 18 nt, Human
augaggucccaggcagag

SEQ ID NO: 2060974 - RNA, 19 nt, Human
augaggucccaggcagaga

SEQ ID NO: 2060975 - RNA, 20 nt, Human
augaggucccaggcagagaa

SEQ ID NO: 2060976 - RNA, 14 nt, Human
augaggucugaaau

SEQ ID NO: 2060977 - RNA, 17 nt, Human
augaggucugaaaugga

SEQ ID NO: 2060978 - RNA, 15 nt, Human
augaggucugaaaug

SEQ ID NO: 2060979 - RNA, 14 nt, Human
augaggugcuggga

SEQ ID NO: 2060980 - RNA, 15 nt, Human
augaggugcugggag

SEQ ID NO: 2060981 - RNA, 16 nt, Human
augaggugcugggagg

SEQ ID NO: 2060982 - RNA, 17 nt, Human
augaggugcugggaggg

SEQ ID NO: 2060983 - RNA, 18 nt, Human
augaggugcugggaggga

SEQ ID NO: 2060984 - RNA, 19 nt, Human
augaggugcugggagggau

SEQ ID NO: 2060985 - RNA, 19 nt, Human
uuguuuuuuuuuuccacuu

SEQ ID NO: 2060986 - RNA, 22 nt, Human
uuuaaaaaaaauccuucuaauc

SEQ ID NO: 2060987 - RNA, 13 nt, Human
uuuaaaaaaguuu

SEQ ID NO: 2060988 - RNA, 14 nt, Human
uuuaaaaaaguuua

SEQ ID NO: 2060989 - RNA, 16 nt, Human
uuuaaaaaaguuuaaa

SEQ ID NO: 2060990 - RNA, 18 nt, Human
uuuaaaaaaguuuaaaau

SEQ ID NO: 2060991 - RNA, 21 nt, Human
uuuaaaaaaguuuaaaaugua

SEQ ID NO: 2060992 - RNA, 12 nt, Human
uuguuuuuauga

SEQ ID NO: 2060993 - RNA, 13 nt, Human
uuguuuuuccuug

SEQ ID NO: 2060994 - RNA, 21 nt, Human
uuguuuuuccuuguauuuaaa

SEQ ID NO: 2060995 - RNA, 22 nt, Human
uuguuuuuccuuguauuuaaau

SEQ ID NO: 2060996 - RNA, 16 nt, Human
uuguuuuuuaaagucu

SEQ ID NO: 2060997 - RNA, 21 nt, Human
uuguuuuuuaaagucuugcug

SEQ ID NO: 2060998 - RNA, 14 nt, Human
uuguuuuuuaguuc

SEQ ID NO: 2060999 - RNA, 12 nt, Human
uuguuuuuuauc

SEQ ID NO: 2061000 - RNA, 14 nt, Human
uuguuuuuuaucuu

SEQ ID NO: 2061001 - RNA, 18 nt, Human
uuguuuuuuuuuuccacu

SEQ ID NO: 2061002 - RNA, 16 nt, Human
uuguuuugugcagaga

SEQ ID NO: 2061003 - RNA, 14 nt, Human
uuguuuuguuuuaa

SEQ ID NO: 2061004 - RNA, 21 nt, Human
augcaaggcacuguacuaggc

SEQ ID NO: 2061005 - RNA, 15 nt, Human
augcaaagaaaauca

SEQ ID NO: 2061006 - RNA, 15 nt, Human
augaucuucuuuaua

SEQ ID NO: 2061007 - RNA, 18 nt, Human
augaucuucuuuauaauu

SEQ ID NO: 2061008 - RNA, 19 nt, Human
uuguugcaaguacugcugu

SEQ ID NO: 2061009 - RNA, 22 nt, Human
uuguugagguggucugaauguu

SEQ ID NO: 2061010 - RNA, 21 nt, Human
uuguugauaaauuccacugga

SEQ ID NO: 2061011 - RNA, 20 nt, Human
uuguugcucagcaaggggcu

SEQ ID NO: 2061012 - RNA, 21 nt, Human
uuguuggaaaagaauacagaa

SEQ ID NO: 2061013 - RNA, 20 nt, Human
augauauuuuuuuaagucuu

SEQ ID NO: 2061014 - RNA, 21 nt, Human
augauauuuuuuuaagucuuu

SEQ ID NO: 2061015 - RNA, 19 nt, Human
augauauuccauaguauau

SEQ ID NO: 2061016 - RNA, 13 nt, Human
augauauugcaua

SEQ ID NO: 2061017 - RNA, 18 nt, Human
augauauugcauaugcau

SEQ ID NO: 2061018 - RNA, 15 nt, Human
augaucacggcucac

SEQ ID NO: 2061019 - RNA, 19 nt, Human
augaucacggcucacugca

SEQ ID NO: 2061020 - RNA, 18 nt, Human
augaucacggcucacugc

SEQ ID NO: 2061021 - RNA, 23 nt, Human
augaucacggcucacugcagccu

SEQ ID NO: 2061022 - RNA, 18 nt, Human
augaucagcuguuuguca

SEQ ID NO: 2061023 - RNA, 19 nt, Human
augaucagcuguuugucau

SEQ ID NO: 2061024 - RNA, 16 nt, Human
augauccuaggcauuu

SEQ ID NO: 2061025 - RNA, 20 nt, Human
augaucagcuguuugucaua

SEQ ID NO: 2061026 - RNA, 15 nt, Human
augauccuaaugaau

SEQ ID NO: 2061027 - RNA, 14 nt, Human
augaucuucuuuau

SEQ ID NO: 2061028 - RNA, 14 nt, Human
augaucucugauga

SEQ ID NO: 2061029 - RNA, 19 nt, Human
uugugaagaaaaauaaagu

SEQ ID NO: 2061030 - RNA, 17 nt, Human
uugugaagauguuugca

SEQ ID NO: 2061031 - RNA, 14 nt, Human
uugugaaguacaua

SEQ ID NO: 2061032 - RNA, 19 nt, Human
uugugugugggcugugagu

SEQ ID NO: 2061033 - RNA, 20 nt, Human
uuguuccuaaguucuuagau

SEQ ID NO: 2061034 - RNA, 14 nt, Human
uuguucccucuccc

SEQ ID NO: 2061035 - RNA, 17 nt, Human
uuguucucucuauggua

SEQ ID NO: 2061036 - RNA, 18 nt, Human
uuguucucucuaugguaa

SEQ ID NO: 2061037 - RNA, 14 nt, Human
uuguugaggugguc

SEQ ID NO: 2061038 - RNA, 21 nt, Human
uuguugagguggucugaaugu

SEQ ID NO: 2061039 - RNA, 20 nt, Human
uuguugauaaauuccacugg

SEQ ID NO: 2061040 - RNA, 13 nt, Human
aucuuuccuuccu

SEQ ID NO: 2061041 - RNA, 15 nt, Human
aucuuuccuuccucu

SEQ ID NO: 2061042 - RNA, 11 nt, Human
aucuuuuacau

SEQ ID NO: 2061043 - RNA, 17 nt, Human
aucuuucacacuuccac

SEQ ID NO: 2061044 - RNA, 22 nt, Human
aucuuucacacuuccaccagcc

SEQ ID NO: 2061045 - RNA, 12 nt, Human
aucuuucaggaa

SEQ ID NO: 2061046 - RNA, 18 nt, Human
aucuuucacccacagaaa

SEQ ID NO: 2061047 - RNA, 19 nt, Human
aucuuucacccacagaaag

SEQ ID NO: 2061048 - RNA, 20 nt, Human
aucuuucacccacagaaaga

SEQ ID NO: 2061049 - RNA, 20 nt, Human
augaaagacuguacaaagua

SEQ ID NO: 2061050 - RNA, 23 nt, Human
augaaagauggcugugccucugc

SEQ ID NO: 2061051 - RNA, 20 nt, Human
augaaagauggcugugccuc

SEQ ID NO: 2061052 - RNA, 19 nt, Human
augaaagauggcugugccu

SEQ ID NO: 2061053 - RNA, 14 nt, Human
augaaaugagguca

SEQ ID NO: 2061054 - RNA, 14 nt, Human
uuggcugcagggag

SEQ ID NO: 2061055 - RNA, 22 nt, Human
uuggcuaggaccccuccaugug

SEQ ID NO: 2061056 - RNA, 22 nt, Human
uuggccugucucauccccaggg

SEQ ID NO: 2061057 - RNA, 17 nt, Human
uuggaccucgugcuuua

SEQ ID NO: 2061058 - RNA, 18 nt, Human
uuggaccucgugcuuuaa

SEQ ID NO: 2061059 - RNA, 21 nt, Human
uuggacggccugaugcucccu

SEQ ID NO: 2061060 - RNA, 13 nt, Human
uuggacuauuaua

SEQ ID NO: 2061061 - RNA, 15 nt, Human
uuggacgcacacagc

SEQ ID NO: 2061062 - RNA, 16 nt, Human
uuggacgcacacagcu

SEQ ID NO: 2061063 - RNA, 17 nt, Human
uuggacgcacacagcuu

SEQ ID NO: 2061064 - RNA, 13 nt, Human
uuggacggccuga

SEQ ID NO: 2061065 - RNA, 16 nt, Human
uuggccugucucaucc

SEQ ID NO: 2061066 - RNA, 23 nt, Human
uuggccugucucauccccagggg

SEQ ID NO: 2061067 - RNA, 22 nt, Human
uugcuacuuccugccuggucuc

SEQ ID NO: 2061068 - RNA, 19 nt, Human
uugcuagcuaugugaccuu

SEQ ID NO: 2061069 - RNA, 16 nt, Human
uugcuagcuaugugac

SEQ ID NO: 2061070 - RNA, 21 nt, Human
uugcuaucaaaauaaauugaa

SEQ ID NO: 2061071 - RNA, 14 nt, Human
uugaguaaucugau

SEQ ID NO: 2061072 - RNA, 18 nt, Human
uugcuaaucggguuguca

SEQ ID NO: 2061073 - RNA, 12 nt, Human
uugcuccacccc

SEQ ID NO: 2061074 - RNA, 16 nt, Human
uugcuccaccccacuc

SEQ ID NO: 2061075 - RNA, 17 nt, Human
uugcuccaccccacuca

SEQ ID NO: 2061076 - RNA, 20 nt, Human
uugcuccaccccacucacag

SEQ ID NO: 2061077 - RNA, 16 nt, Human
uugcuccccagugaag

SEQ ID NO: 2061078 - RNA, 13 nt, Human
uugcuccgccucu

SEQ ID NO: 2061079 - RNA, 19 nt, Human
uugcugaauacagaggcaa

SEQ ID NO: 2061080 - RNA, 11 nt, Human
uugcugagagc

SEQ ID NO: 2061081 - RNA, 23 nt, Human
uugcucaugcauagucccagcua

SEQ ID NO: 2061082 - RNA, 22 nt, Human
uugcugaaucggaaucucuggg

SEQ ID NO: 2061083 - RNA, 16 nt, Human
uugcuuggacuauuau

SEQ ID NO: 2061084 - RNA, 14 nt, Human
uugcuuuuuuaugg

SEQ ID NO: 2061085 - RNA, 16 nt, Human
uugcuuuaauuguuaa

SEQ ID NO: 2061086 - RNA, 18 nt, Human
uugcuuuaauuguuaaga

SEQ ID NO: 2061087 - RNA, 12 nt, Human
uugcuuuacugg

SEQ ID NO: 2061088 - RNA, 16 nt, Human
augacacugagaacag

SEQ ID NO: 2061089 - RNA, 21 nt, Human
augacacugagaacagaucuc

SEQ ID NO: 2061090 - RNA, 13 nt, Human
augacagagccag

SEQ ID NO: 2061091 - RNA, 16 nt, Human
augacagauguugaau

SEQ ID NO: 2061092 - RNA, 15 nt, Human
augacagcugucccu

SEQ ID NO: 2061093 - RNA, 16 nt, Human
augacagcugucccug

SEQ ID NO: 2061094 - RNA, 17 nt, Human
augacaggauguuugcu

SEQ ID NO: 2061095 - RNA, 17 nt, Human
augacagcugucccugu

SEQ ID NO: 2061096 - RNA, 19 nt, Human
augacagcugucccuguca

SEQ ID NO: 2061097 - RNA, 21 nt, Human
augacagcugucccugucacc

SEQ ID NO: 2061098 - RNA, 19 nt, Human
augacaagugagacaaaaa

SEQ ID NO: 2061099 - RNA, 18 nt, Human
augacaagccccaggcag

SEQ ID NO: 2061100 - RNA, 20 nt, Human
augacaagccccaggcaggc

SEQ ID NO: 2061101 - RNA, 19 nt, Human
augacacucguauaagcau

SEQ ID NO: 2061102 - RNA, 14 nt, Human
augacacugaaaug

SEQ ID NO: 2061103 - RNA, 15 nt, Human
augacacugaaaugc

SEQ ID NO: 2061104 - RNA, 16 nt, Human
augacacugaaaugcc

SEQ ID NO: 2061105 - RNA, 17 nt, Human
augacacugaaaugccu

SEQ ID NO: 2061106 - RNA, 15 nt, Human
augacaagccccagg

SEQ ID NO: 2061107 - RNA, 16 nt, Human
augacaagccccaggc

SEQ ID NO: 2061108 - RNA, 18 nt, Human
augacaacuucuaauugc

SEQ ID NO: 2061109 - RNA, 19 nt, Human
augacaacuucuaauugcc

SEQ ID NO: 2061110 - RNA, 20 nt, Human
augacaacuucuaauugcca

SEQ ID NO: 2061111 - RNA, 17 nt, Human
augacaaauaaguggaa

SEQ ID NO: 2061112 - RNA, 14 nt, Human
augacaacuucuaa

SEQ ID NO: 2061113 - RNA, 16 nt, Human
augacaacuucuaauu

SEQ ID NO: 2061114 - RNA, 23 nt, Human
augaauuuuuuucaucuucucug

SEQ ID NO: 2061115 - RNA, 21 nt, Human
uuguauauuauggaagauuuu

SEQ ID NO: 2061116 - RNA, 18 nt, Human
uuguauauuauggaagau

SEQ ID NO: 2061117 - RNA, 20 nt, Human
uuguauauuauggaagauuu

SEQ ID NO: 2061118 - RNA, 12 nt, Human
uuguauaaaaau

SEQ ID NO: 2061119 - RNA, 20 nt, Human
uuguauaaaaauagaagaau

SEQ ID NO: 2061120 - RNA, 14 nt, Human
uuguaaugucacca

SEQ ID NO: 2061121 - RNA, 15 nt, Human
uuguaauguuacuga

SEQ ID NO: 2061122 - RNA, 21 nt, Human
uuguaagugagagagacaaga

SEQ ID NO: 2061123 - RNA, 19 nt, Human
uuguaaguaaacugcccug

SEQ ID NO: 2061124 - RNA, 22 nt, Human
uugggguacccacugcucuggu

SEQ ID NO: 2061125 - RNA, 21 nt, Human
uugggguagcuagaggaacca

SEQ ID NO: 2061126 - RNA, 13 nt, Human
uugguuauacaug

SEQ ID NO: 2061127 - RNA, 14 nt, Human
uugguuauacauga

SEQ ID NO: 2061128 - RNA, 16 nt, Human
uugguuauacaugaca

SEQ ID NO: 2061129 - RNA, 18 nt, Human
uugguuauacaugacacu

SEQ ID NO: 2061130 - RNA, 21 nt, Human
uugguuauacaugacacugaa

SEQ ID NO: 2061131 - RNA, 23 nt, Human
uugguuauacaugacacugaaau

SEQ ID NO: 2061132 - RNA, 17 nt, Human
uugguucaucaguguua

SEQ ID NO: 2061133 - RNA, 18 nt, Human
uugguucaucaguguuaa

SEQ ID NO: 2061134 - RNA, 20 nt, Human
uugguucaucaguguuaaaa

SEQ ID NO: 2061135 - RNA, 14 nt, Human
uuguaacuccacca

SEQ ID NO: 2061136 - RNA, 20 nt, Human
uuguaagaaaccaaucaaga

SEQ ID NO: 2061137 - RNA, 23 nt, Human
uuguaagaaaccaaucaagauaa

SEQ ID NO: 2061138 - RNA, 21 nt, Human
uuguaaaaacagcauugcuuu

SEQ ID NO: 2061139 - RNA, 19 nt, Human
uuguaaaaacagcauugcu

SEQ ID NO: 2061140 - RNA, 20 nt, Human
uuguaaaaacagcauugcuu

SEQ ID NO: 2061141 - RNA, 23 nt, Human
uuguaaaaacagcauugcuuucu

SEQ ID NO: 2061142 - RNA, 21 nt, Human
augaacauagacuagagaaac

SEQ ID NO: 2061143 - RNA, 13 nt, Human
augaaccacaucu

SEQ ID NO: 2061144 - RNA, 20 nt, Human
augaaccacaucuugcucug

SEQ ID NO: 2061145 - RNA, 13 nt, Human
uugggcugagacu

SEQ ID NO: 2061146 - RNA, 15 nt, Human
uugggcugagacugg

SEQ ID NO: 2061147 - RNA, 17 nt, Human
uugggguacccacugcu

SEQ ID NO: 2061148 - RNA, 17 nt, Human
auuuuacuuuuuccugg

SEQ ID NO: 2061149 - RNA, 16 nt, Human
auuuuacuuuuuccug

SEQ ID NO: 2061150 - RNA, 13 nt, Human
auuuuaccaaguu

SEQ ID NO: 2061151 - RNA, 17 nt, Human
auuuuaccaaguuauau

SEQ ID NO: 2061152 - RNA, 18 nt, Human
auuuuaccaaguuauaua

SEQ ID NO: 2061153 - RNA, 19 nt, Human
auuuuaccaaguuauauaa

SEQ ID NO: 2061154 - RNA, 20 nt, Human
auuuuaccaaguuauauaaa

SEQ ID NO: 2061155 - RNA, 22 nt, Human
auuuuaccaaguuauauaaaga

SEQ ID NO: 2061156 - RNA, 23 nt, Human
auuuuaccaaguuauauaaagag

SEQ ID NO: 2061157 - RNA, 17 nt, Human
auuuuaccacugcugug

SEQ ID NO: 2061158 - RNA, 12 nt, Human
auuuuaauuuau

SEQ ID NO: 2061159 - RNA, 15 nt, Human
auuuuaauuagguua

SEQ ID NO: 2061160 - RNA, 18 nt, Human
auuuuaauuagguuaacu

SEQ ID NO: 2061161 - RNA, 20 nt, Human
auuuuaauuagguuaacuau

SEQ ID NO: 2061162 - RNA, 23 nt, Human
auuuuaauuagguuaacuaugua

SEQ ID NO: 2061163 - RNA, 17 nt, Human
auuuuaaaauuuuaucu

SEQ ID NO: 2061164 - RNA, 18 nt, Human
auuuuaaaauuuuaucuc

SEQ ID NO: 2061165 - RNA, 23 nt, Human
auuugaagcugcagugagcugug

SEQ ID NO: 2061166 - RNA, 20 nt, Human
auuugaagacaaaaauacuc

SEQ ID NO: 2061167 - RNA, 21 nt, Human
auuugaagacaaaaauacucu

SEQ ID NO: 2061168 - RNA, 14 nt, Human
auuugaaucagccu

SEQ ID NO: 2061169 - RNA, 17 nt, Human
auuugaaggucuugauu

SEQ ID NO: 2061170 - RNA, 11 nt, Human
auuugaaugaa

SEQ ID NO: 2061171 - RNA, 23 nt, Human
auuugaaucagccuacaggccuc

SEQ ID NO: 2061172 - RNA, 16 nt, Human
auuugaaucucaauuu

SEQ ID NO: 2061173 - RNA, 18 nt, Human
auuugaaucucaauuuga

SEQ ID NO: 2061174 - RNA, 13 nt, Human
auuugaaugaaaa

SEQ ID NO: 2061175 - RNA, 14 nt, Human
auuugaaugaaaaa

SEQ ID NO: 2061176 - RNA, 15 nt, Human
auuugaaugaaaaau

SEQ ID NO: 2061177 - RNA, 16 nt, Human
auuugaaugaaaaauu

SEQ ID NO: 2061178 - RNA, 21 nt, Human
auuuguuuuguguuguuugaa

SEQ ID NO: 2061179 - RNA, 12 nt, Human
auuuucagaauc

SEQ ID NO: 2061180 - RNA, 14 nt, Human
auuuucagaaucug

SEQ ID NO: 2061181 - RNA, 15 nt, Human
auuuucagaaucuga

SEQ ID NO: 2061182 - RNA, 17 nt, Human
auuuucagaaucugaau

SEQ ID NO: 2061183 - RNA, 20 nt, Human
auuuucagaaucugaaugua

SEQ ID NO: 2061184 - RNA, 21 nt, Human
auuuucagaaucugaauguaa

SEQ ID NO: 2061185 - RNA, 22 nt, Human
auuuucagaaucugaauguaau

SEQ ID NO: 2061186 - RNA, 12 nt, Human
auuuucagaccc

SEQ ID NO: 2061187 - RNA, 21 nt, Human
auuuucaguagggcuacaaaa

SEQ ID NO: 2061188 - RNA, 22 nt, Human
auuuucaguagggcuacaaaac

SEQ ID NO: 2061189 - RNA, 11 nt, Human
auuuucaguau

SEQ ID NO: 2061190 - RNA, 19 nt, Human
auuuucaguauaauuuaac

SEQ ID NO: 2061191 - RNA, 18 nt, Human
auuuucauguauaugugu

SEQ ID NO: 2061192 - RNA, 17 nt, Human
auuuucauguauaugug

SEQ ID NO: 2061193 - RNA, 12 nt, Human
auuuuccucccc

SEQ ID NO: 2061194 - RNA, 23 nt, Human
auuuuccacaagauucccagaga

SEQ ID NO: 2061195 - RNA, 20 nt, Human
auuuuccacaagauucccag

SEQ ID NO: 2061196 - RNA, 21 nt, Human
auuuuccacaagauucccaga

SEQ ID NO: 2061197 - RNA, 13 nt, Human
auuuuccucccca

SEQ ID NO: 2061198 - RNA, 14 nt, Human
auuuuccuccccag

SEQ ID NO: 2061199 - RNA, 15 nt, Human
auuuuccuccccagc

SEQ ID NO: 2061200 - RNA, 16 nt, Human
auuuuccuccccagca

SEQ ID NO: 2061201 - RNA, 14 nt, Human
auuuuauucaaggu

SEQ ID NO: 2061202 - RNA, 16 nt, Human
auuuuauucaagguaa

SEQ ID NO: 2061203 - RNA, 23 nt, Human
auuuuauucaagguaaaauucua

SEQ ID NO: 2061204 - RNA, 12 nt, Human
auuuuauucaag

SEQ ID NO: 2061205 - RNA, 17 nt, Human
auuuuauuuuuuucuac

SEQ ID NO: 2061206 - RNA, 20 nt, Human
auuuuauuuuuuucucucug

SEQ ID NO: 2061207 - RNA, 14 nt, Human
auuuuagcaguucu

SEQ ID NO: 2061208 - RNA, 19 nt, Human
auuuuagcaguucugcaaa

SEQ ID NO: 2061209 - RNA, 20 nt, Human
auuuuagcaguucugcaaau

SEQ ID NO: 2061210 - RNA, 21 nt, Human
auuuuagcaguucugcaaaua

SEQ ID NO: 2061211 - RNA, 12 nt, Human
auuuuagacaaa

SEQ ID NO: 2061212 - RNA, 16 nt, Human
auuuuagacaaaucua

SEQ ID NO: 2061213 - RNA, 20 nt, Human
auuuuagacaaaucuaaggg

SEQ ID NO: 2061214 - RNA, 22 nt, Human
auuuucaagcaucuccugagga

SEQ ID NO: 2061215 - RNA, 20 nt, Human
auuuucaacgcagcccugcu

SEQ ID NO: 2061216 - RNA, 17 nt, Human
auuuucaaaguacauaa

SEQ ID NO: 2061217 - RNA, 18 nt, Human
auuuucaaauuguaucua

SEQ ID NO: 2061218 - RNA, 18 nt, Human
auuuucaacgcagcccug

SEQ ID NO: 2061219 - RNA, 14 nt, Human
auuuucaauucaaa

SEQ ID NO: 2061220 - RNA, 20 nt, Human
auuuucaauucaaaaaugua

SEQ ID NO: 2061221 - RNA, 22 nt, Human
auuuucaauucaaaaauguaca

SEQ ID NO: 2061222 - RNA, 20 nt, Human
auuuucacacaauacaauaa

SEQ ID NO: 2061223 - RNA, 15 nt, Human
auuuucacauaaaau

SEQ ID NO: 2061224 - RNA, 19 nt, Human
auuuucaaguaauugugaa

SEQ ID NO: 2061225 - RNA, 12 nt, Human
auuuucaaguaa

SEQ ID NO: 2061226 - RNA, 16 nt, Human
auuuucaaguaauugu

SEQ ID NO: 2061227 - RNA, 21 nt, Human
auuuucaccuguuuuuaagcu

SEQ ID NO: 2061228 - RNA, 22 nt, Human
auuuucaccccacccuuccccu

SEQ ID NO: 2061229 - RNA, 15 nt, Human
auuuucaccccaccc

SEQ ID NO: 2061230 - RNA, 16 nt, Human
auuuucaccccacccu

SEQ ID NO: 2061231 - RNA, 22 nt, Human
auuuccacucaggucuguuuuc

SEQ ID NO: 2061232 - RNA, 13 nt, Human
auuuccaguaccu

SEQ ID NO: 2061233 - RNA, 17 nt, Human
auuuccaguaccuuugu

SEQ ID NO: 2061234 - RNA, 20 nt, Human
auuuccaguaccuuugucac

SEQ ID NO: 2061235 - RNA, 17 nt, Human
auuuccagccaaagccu

SEQ ID NO: 2061236 - RNA, 23 nt, Human
auuuccccagaccugagcucccc

SEQ ID NO: 2061237 - RNA, 15 nt, Human
auuuccccagaccug

SEQ ID NO: 2061238 - RNA, 13 nt, Human
auuucaaaauaua

SEQ ID NO: 2061239 - RNA, 15 nt, Human
auuugaaauuuagcu

SEQ ID NO: 2061240 - RNA, 15 nt, Human
auuugaaccaaaaca

SEQ ID NO: 2061241 - RNA, 17 nt, Human
auuugaaccaaaacauu

SEQ ID NO: 2061242 - RNA, 20 nt, Human
auuugaaccaaaacauuccg

SEQ ID NO: 2061243 - RNA, 11 nt, Human
auuugaaauuu

SEQ ID NO: 2061244 - RNA, 21 nt, Human
auuucuagaacaucccugcca

SEQ ID NO: 2061245 - RNA, 23 nt, Human
auuucuagaacaucccugccagc

SEQ ID NO: 2061246 - RNA, 12 nt, Human
auuucccuucuu

SEQ ID NO: 2061247 - RNA, 15 nt, Human
auuucccuucuucug

SEQ ID NO: 2061248 - RNA, 18 nt, Human
auuucccuucuucuguca

SEQ ID NO: 2061249 - RNA, 15 nt, Human
auuuauuuaauguua

SEQ ID NO: 2061250 - RNA, 17 nt, Human
auuuauuuaauguuaug

SEQ ID NO: 2061251 - RNA, 13 nt, Human
auuuauucugcuc

SEQ ID NO: 2061252 - RNA, 19 nt, Human
auuuauucaauuccucugg

SEQ ID NO: 2061253 - RNA, 18 nt, Human
auuuauucaauuccucug

SEQ ID NO: 2061254 - RNA, 14 nt, Human
auuuauuuauuuaa

SEQ ID NO: 2061255 - RNA, 17 nt, Human
auuuauuuauuaagaug

SEQ ID NO: 2061256 - RNA, 24 nt, Human
auuuauuuacugagcuucucugug

SEQ ID NO: 2061257 - RNA, 14 nt, Human
auuuauuuauuaag

SEQ ID NO: 2061258 - RNA, 16 nt, Human
auuuauuuauuaagau

SEQ ID NO: 2061259 - RNA, 21 nt, Human
auuuauuauuuucaccuguuu

SEQ ID NO: 2061260 - RNA, 12 nt, Human
auuuauucaaga

SEQ ID NO: 2061261 - RNA, 14 nt, Human
auuuauucaagaaa

SEQ ID NO: 2061262 - RNA, 14 nt, Human
auuuauuauuuuca

SEQ ID NO: 2061263 - RNA, 15 nt, Human
auuuauuaagaugga

SEQ ID NO: 2061264 - RNA, 16 nt, Human
auuuauuaagauggau

SEQ ID NO: 2061265 - RNA, 21 nt, Human
auuuauuaagauggauucuca

SEQ ID NO: 2061266 - RNA, 22 nt, Human
auuuauuaagauggauucucag

SEQ ID NO: 2061267 - RNA, 23 nt, Human
auuuauuaagauggauucucaga

SEQ ID NO: 2061268 - RNA, 19 nt, Human
auuuaguuuuuguaauuua

SEQ ID NO: 2061269 - RNA, 20 nt, Human
auuuaguuuuuguaauuuau

SEQ ID NO: 2061270 - RNA, 20 nt, Human
auuuagugaaagcuagagau

SEQ ID NO: 2061271 - RNA, 19 nt, Human
auuuagagcuagucuuuca

SEQ ID NO: 2061272 - RNA, 22 nt, Human
auuuagagaugaauuaaauuua

SEQ ID NO: 2061273 - RNA, 18 nt, Human
auuuagauuguuaaaaua

SEQ ID NO: 2061274 - RNA, 13 nt, Human
auuuagcacaaaa

SEQ ID NO: 2061275 - RNA, 23 nt, Human
auuuagcacauacuacacauuca

SEQ ID NO: 2061276 - RNA, 22 nt, Human
auuuagcaugacaagccccagg

SEQ ID NO: 2061277 - RNA, 17 nt, Human
auuuagagaugaauuaa

SEQ ID NO: 2061278 - RNA, 23 nt, Human
auuuagagaugaauuaaauuuaa

SEQ ID NO: 2061279 - RNA, 15 nt, Human
auuuaacaaugcgaa

SEQ ID NO: 2061280 - RNA, 20 nt, Human
auuuaacaaugcgaauggua

SEQ ID NO: 2061281 - RNA, 21 nt, Human
auuuaacaaugcgaaugguag

SEQ ID NO: 2061282 - RNA, 21 nt, Human
auuuacugagcuucucuguga

SEQ ID NO: 2061283 - RNA, 11 nt, Human
auuuaaaacaa

SEQ ID NO: 2061284 - RNA, 12 nt, Human
auuuaaaacaaa

SEQ ID NO: 2061285 - RNA, 14 nt, Human
auuuaaaacaaaca

SEQ ID NO: 2061286 - RNA, 14 nt, Human
auuuaaauucuuuu

SEQ ID NO: 2061287 - RNA, 16 nt, Human
auuuaaauucuuuuuu

SEQ ID NO: 2061288 - RNA, 19 nt, Human
auuuaaauucuuuuuuaaa

SEQ ID NO: 2061289 - RNA, 17 nt, Human
auuuacuucuuauacau

SEQ ID NO: 2061290 - RNA, 14 nt, Human
auuuacuucuuaua

SEQ ID NO: 2061291 - RNA, 16 nt, Human
auuuacuucuuauaca

SEQ ID NO: 2061292 - RNA, 15 nt, Human
auuuagaaauauaau

SEQ ID NO: 2061293 - RNA, 22 nt, Human
auuuagaaagaagcccaauauu

SEQ ID NO: 2061294 - RNA, 14 nt, Human
auuuauucugcuca

SEQ ID NO: 2061295 - RNA, 16 nt, Human
auugugaccaaguuau

SEQ ID NO: 2061296 - RNA, 14 nt, Human
auugugaauugaua

SEQ ID NO: 2061297 - RNA, 19 nt, Human
auugugaauugauaauaaa

SEQ ID NO: 2061298 - RNA, 15 nt, Human
auugugaccaaguua

SEQ ID NO: 2061299 - RNA, 14 nt, Human
auugugaaguacau

SEQ ID NO: 2061300 - RNA, 15 nt, Human
auugugaaguacaua

SEQ ID NO: 2061301 - RNA, 16 nt, Human
auugugagccaccacg

SEQ ID NO: 2061302 - RNA, 17 nt, Human
auugugaccaaguuaua

SEQ ID NO: 2061303 - RNA, 14 nt, Human
auuguauuuuagua

SEQ ID NO: 2061304 - RNA, 15 nt, Human
auuguauuuuaguau

SEQ ID NO: 2061305 - RNA, 23 nt, Human
auuguauuaggugucauuuccau

SEQ ID NO: 2061306 - RNA, 21 nt, Human
auugguggcagauuuuacaaa

SEQ ID NO: 2061307 - RNA, 15 nt, Human
auuguguauauucau

SEQ ID NO: 2061308 - RNA, 20 nt, Human
auugugguuauuuuuauaca

SEQ ID NO: 2061309 - RNA, 22 nt, Human
auugugguuauuuuuauacagu

SEQ ID NO: 2061310 - RNA, 23 nt, Human
auugugguuauuuuuauacagua

SEQ ID NO: 2061311 - RNA, 19 nt, Human
auugugcacauacuugaga

SEQ ID NO: 2061312 - RNA, 13 nt, Human
auucugcagcaug

SEQ ID NO: 2061313 - RNA, 15 nt, Human
auucugcagcaugac

SEQ ID NO: 2061314 - RNA, 19 nt, Human
auucugcaagcacaucugc

SEQ ID NO: 2061315 - RNA, 22 nt, Human
auucugcaagcacaucugcauu

SEQ ID NO: 2061316 - RNA, 22 nt, Human
auucugcagcaugaccugugac

SEQ ID NO: 2061317 - RNA, 14 nt, Human
auucugccaggccc

SEQ ID NO: 2061318 - RNA, 23 nt, Human
auucugccaggcccccaagccug

SEQ ID NO: 2061319 - RNA, 18 nt, Human
auucuggcugauaaaaga

SEQ ID NO: 2061320 - RNA, 19 nt, Human
auucuggcugauaaaagau

SEQ ID NO: 2061321 - RNA, 17 nt, Human
auucuguguguuuucau

SEQ ID NO: 2061322 - RNA, 21 nt, Human
auucuguguguuuucauaaua

SEQ ID NO: 2061323 - RNA, 15 nt, Human
auucuggucucucua

SEQ ID NO: 2061324 - RNA, 12 nt, Human
auucuguuucuu

SEQ ID NO: 2061325 - RNA, 22 nt, Human
auucuguguguuuucauaauaa

SEQ ID NO: 2061326 - RNA, 23 nt, Human
auucuguguguuuucauaauaaa

SEQ ID NO: 2061327 - RNA, 20 nt, Human
auucuuaaaauauauuucag

SEQ ID NO: 2061328 - RNA, 23 nt, Human
auucuuaaaauauauuucagaua

SEQ ID NO: 2061329 - RNA, 22 nt, Human
auucuuccucccucccucuuuc

SEQ ID NO: 2061330 - RNA, 13 nt, Human
auucuuccucccu

SEQ ID NO: 2061331 - RNA, 19 nt, Human
auucuuugggcguugguca

SEQ ID NO: 2061332 - RNA, 19 nt, Human
auucuuugcuugaacacag

SEQ ID NO: 2061333 - RNA, 20 nt, Human
auucuuugcuugaacacagu

SEQ ID NO: 2061334 - RNA, 23 nt, Human
auucuuugcuugaacacaguauu

SEQ ID NO: 2061335 - RNA, 13 nt, Human
auucuuauuuaau

SEQ ID NO: 2061336 - RNA, 15 nt, Human
auucuuacauguuuu

SEQ ID NO: 2061337 - RNA, 17 nt, Human
auucuuacauguuuucu

SEQ ID NO: 2061338 - RNA, 17 nt, Human
auucuuagccuguggca

SEQ ID NO: 2061339 - RNA, 18 nt, Human
auucuuagccuguggcag

SEQ ID NO: 2061340 - RNA, 20 nt, Human
auucuuagccuguggcagua

SEQ ID NO: 2061341 - RNA, 14 nt, Human
auucuuauuuaaug

SEQ ID NO: 2061342 - RNA, 18 nt, Human
auucuuauuuaaugaaag

SEQ ID NO: 2061343 - RNA, 14 nt, Human
auugaaaaggaaga

SEQ ID NO: 2061344 - RNA, 15 nt, Human
auugaaaaggaagau

SEQ ID NO: 2061345 - RNA, 17 nt, Human
auugaaaaggaagauca

SEQ ID NO: 2061346 - RNA, 13 nt, Human
auugaaaaggaca

SEQ ID NO: 2061347 - RNA, 16 nt, Human
auugaaaauguaagua

SEQ ID NO: 2061348 - RNA, 20 nt, Human
auugaaaauguaaguaaaug

SEQ ID NO: 2061349 - RNA, 22 nt, Human
auugaaaauaggagagagauca

SEQ ID NO: 2061350 - RNA, 15 nt, Human
auugaaagagaacca

SEQ ID NO: 2061351 - RNA, 18 nt, Human
auugaaagagaaccaguu

SEQ ID NO: 2061352 - RNA, 18 nt, Human
auugaaaggcauucucug

SEQ ID NO: 2061353 - RNA, 15 nt, Human
auugacaguaacuug

SEQ ID NO: 2061354 - RNA, 20 nt, Human
auugacaguaacuugguuau

SEQ ID NO: 2061355 - RNA, 23 nt, Human
auugacaguaacuugguuauaca

SEQ ID NO: 2061356 - RNA, 17 nt, Human
auugacaucagcaucac

SEQ ID NO: 2061357 - RNA, 18 nt, Human
auugacaucagcaucacc

SEQ ID NO: 2061358 - RNA, 22 nt, Human
auugacaucagcaucaccuaga

SEQ ID NO: 2061359 - RNA, 14 nt, Human
auugaccaagaacu

SEQ ID NO: 2061360 - RNA, 15 nt, Human
auugaccaagaacug

SEQ ID NO: 2061361 - RNA, 16 nt, Human
auugaccaagaacugc

SEQ ID NO: 2061362 - RNA, 17 nt, Human
auugaccaagaacugca

SEQ ID NO: 2061363 - RNA, 18 nt, Human
auugaccaagaacugcau

SEQ ID NO: 2061364 - RNA, 20 nt, Human
auugaccaagaacugcaugg

SEQ ID NO: 2061365 - RNA, 12 nt, Human
auugggguuauu

SEQ ID NO: 2061366 - RNA, 15 nt, Human
auuggguaucaccac

SEQ ID NO: 2061367 - RNA, 14 nt, Human
auugggguuauuuu

SEQ ID NO: 2061368 - RNA, 20 nt, Human
auugaaauauaaugcaaacc

SEQ ID NO: 2061369 - RNA, 19 nt, Human
auuggggaagacuguggcu

SEQ ID NO: 2061370 - RNA, 16 nt, Human
auugggauuuucuaca

SEQ ID NO: 2061371 - RNA, 18 nt, Human
auucuccugccucagccu

SEQ ID NO: 2061372 - RNA, 17 nt, Human
auucuccugccucagcc

SEQ ID NO: 2061373 - RNA, 15 nt, Human
auucuccugccucag

SEQ ID NO: 2061374 - RNA, 19 nt, Human
auucuccugccucagccuc

SEQ ID NO: 2061375 - RNA, 20 nt, Human
auucuccugccucagccucc

SEQ ID NO: 2061376 - RNA, 13 nt, Human
auucuccugccuc

SEQ ID NO: 2061377 - RNA, 14 nt, Human
auucuccugccuca

SEQ ID NO: 2061378 - RNA, 11 nt, Human
auucuccugcc

SEQ ID NO: 2061379 - RNA, 16 nt, Human
auucuaucucucuuua

SEQ ID NO: 2061380 - RNA, 17 nt, Human
auucuaguuuugucaaa

SEQ ID NO: 2061381 - RNA, 16 nt, Human
auucuaaauaaaauau

SEQ ID NO: 2061382 - RNA, 19 nt, Human
auucuaaauaaaauauaau

SEQ ID NO: 2061383 - RNA, 20 nt, Human
auucuaaauaaaauauaauu

SEQ ID NO: 2061384 - RNA, 21 nt, Human
auucuaaauaaaauauaauug

SEQ ID NO: 2061385 - RNA, 16 nt, Human
auucucaagcccugca

SEQ ID NO: 2061386 - RNA, 19 nt, Human
auucucaagccgcauccca

SEQ ID NO: 2061387 - RNA, 20 nt, Human
auucucaagccgcaucccag

SEQ ID NO: 2061388 - RNA, 21 nt, Human
auucucaagccgcaucccaga

SEQ ID NO: 2061389 - RNA, 23 nt, Human
auucucaagccgcaucccagacu

SEQ ID NO: 2061390 - RNA, 15 nt, Human
auucucaagcccugc

SEQ ID NO: 2061391 - RNA, 13 nt, Human
auucucaaagcag

SEQ ID NO: 2061392 - RNA, 14 nt, Human
auucucaaagcagg

SEQ ID NO: 2061393 - RNA, 21 nt, Human
auucccuccugcuacucuguu

SEQ ID NO: 2061394 - RNA, 14 nt, Human
auucccuccugcua

SEQ ID NO: 2061395 - RNA, 19 nt, Human
auucccugagucaccagga

SEQ ID NO: 2061396 - RNA, 20 nt, Human
auucccugagucaccaggaa

SEQ ID NO: 2061397 - RNA, 14 nt, Human
auucccuggaccag

SEQ ID NO: 2061398 - RNA, 19 nt, Human
auucccuggaccagaugcu

SEQ ID NO: 2061399 - RNA, 15 nt, Human
auucccaagcucugc

SEQ ID NO: 2061400 - RNA, 14 nt, Human
auucccaagcucug

SEQ ID NO: 2061401 - RNA, 16 nt, Human
auucccaagcucugcu

SEQ ID NO: 2061402 - RNA, 22 nt, Human
auucccuaucuuuuaguuuuag

SEQ ID NO: 2061403 - RNA, 12 nt, Human
auuccaggcucc

SEQ ID NO: 2061404 - RNA, 15 nt, Human
auuccaguuuguuua

SEQ ID NO: 2061405 - RNA, 23 nt, Human
auuccaguuuguuuauuacuuau

SEQ ID NO: 2061406 - RNA, 20 nt, Human
auuccauaauuccauaugcu

SEQ ID NO: 2061407 - RNA, 14 nt, Human
auuccauaguauau

SEQ ID NO: 2061408 - RNA, 16 nt, Human
auuccauaguauauua

SEQ ID NO: 2061409 - RNA, 18 nt, Human
auuccauaguauauuaaa

SEQ ID NO: 2061410 - RNA, 19 nt, Human
auuccauaguauauuaaaa

SEQ ID NO: 2061411 - RNA, 21 nt, Human
auuccauaguauauuaaaaau

SEQ ID NO: 2061412 - RNA, 22 nt, Human
auuccauaguauauuaaaaaug

SEQ ID NO: 2061413 - RNA, 23 nt, Human
auuccauaguauauuaaaaaugg

SEQ ID NO: 2061414 - RNA, 11 nt, Human
auuccaucucc

SEQ ID NO: 2061415 - RNA, 12 nt, Human
auuccaucuccu

SEQ ID NO: 2061416 - RNA, 13 nt, Human
auuccaugaaugu

SEQ ID NO: 2061417 - RNA, 14 nt, Human
auuccaacagcuca

SEQ ID NO: 2061418 - RNA, 20 nt, Human
auuccaacagcucaagucuu

SEQ ID NO: 2061419 - RNA, 15 nt, Human
auucaguaauaacuc

SEQ ID NO: 2061420 - RNA, 19 nt, Human
auucaguaauaacucuacc

SEQ ID NO: 2061421 - RNA, 15 nt, Human
auucagugagggucu

SEQ ID NO: 2061422 - RNA, 19 nt, Human
auucaguauuaaagggggg

SEQ ID NO: 2061423 - RNA, 18 nt, Human
auucagauauauuuuuca

SEQ ID NO: 2061424 - RNA, 21 nt, Human
auucagauauauuuuucacag

SEQ ID NO: 2061425 - RNA, 14 nt, Human
uuuucaguuuucag

SEQ ID NO: 2061426 - RNA, 12 nt, Human
uuuucaguuuuc

SEQ ID NO: 2061427 - RNA, 20 nt, Human
uuuucaguuucaauucagug

SEQ ID NO: 2061428 - RNA, 18 nt, Human
uuuucauacuuuuaccuu

SEQ ID NO: 2061429 - RNA, 12 nt, Human
uuuucauaauaa

SEQ ID NO: 2061430 - RNA, 11 nt, Human
uuuuauuuuau

SEQ ID NO: 2061431 - RNA, 20 nt, Human
uuuuaggccaaaaaaaugua

SEQ ID NO: 2061432 - RNA, 12 nt, Human
uuuuauuaugca

SEQ ID NO: 2061433 - RNA, 14 nt, Human
uuuuauuaugcaua

SEQ ID NO: 2061434 - RNA, 19 nt, Human
uuuuauuaugcauaacuga

SEQ ID NO: 2061435 - RNA, 23 nt, Human
uuuuauuaugcauaacugacaaa

SEQ ID NO: 2061436 - RNA, 13 nt, Human
uuuuauuaugcau

SEQ ID NO: 2061437 - RNA, 13 nt, Human
uuuucugaaacua

SEQ ID NO: 2061438 - RNA, 15 nt, Human
uuuucugaaacuaau

SEQ ID NO: 2061439 - RNA, 17 nt, Human
uuuucucuaacucagaa

SEQ ID NO: 2061440 - RNA, 21 nt, Human
uuuucaucuucucuggcgaca

SEQ ID NO: 2061441 - RNA, 17 nt, Human
uuuucauugauaugaaa

SEQ ID NO: 2061442 - RNA, 14 nt, Human
auguuuaugagcca

SEQ ID NO: 2061443 - RNA, 15 nt, Human
auguuuaugagccag

SEQ ID NO: 2061444 - RNA, 16 nt, Human
auguuuaugagccaga

SEQ ID NO: 2061445 - RNA, 20 nt, Human
auguuuaugagccagacaaa

SEQ ID NO: 2061446 - RNA, 21 nt, Human
auguuuaugagccagacaaau

SEQ ID NO: 2061447 - RNA, 22 nt, Human
auguuuaugcaaggaaggaaag

SEQ ID NO: 2061448 - RNA, 18 nt, Human
auguuuaugcaaggaagg

SEQ ID NO: 2061449 - RNA, 20 nt, Human
auguuuaugcaaggaaggaa

SEQ ID NO: 2061450 - RNA, 11 nt, Human
uuuucuccuga

SEQ ID NO: 2061451 - RNA, 16 nt, Human
auguuuaaaaaaguuu

SEQ ID NO: 2061452 - RNA, 17 nt, Human
auguuuaaaaaaguuua

SEQ ID NO: 2061453 - RNA, 21 nt, Human
auguuuaaaaaaguuuaaaau

SEQ ID NO: 2061454 - RNA, 16 nt, Human
uuuucugguagauaga

SEQ ID NO: 2061455 - RNA, 19 nt, Human
uuuucugguagauagaaau

SEQ ID NO: 2061456 - RNA, 20 nt, Human
uuuucugguagauagaaaua

SEQ ID NO: 2061457 - RNA, 14 nt, Human
auguuuuguuucug

SEQ ID NO: 2061458 - RNA, 16 nt, Human
auguuuuguuucugaa

SEQ ID NO: 2061459 - RNA, 19 nt, Human
auguuuuguuucugaaaau

SEQ ID NO: 2061460 - RNA, 20 nt, Human
auguuuuguuucugaaaauu

SEQ ID NO: 2061461 - RNA, 21 nt, Human
auguuuuguuucugaaaauuc

SEQ ID NO: 2061462 - RNA, 13 nt, Human
auguuuuguaaga

SEQ ID NO: 2061463 - RNA, 22 nt, Human
auuaaaacuuaaccgcaucaga

SEQ ID NO: 2061464 - RNA, 14 nt, Human
auuaaacccuggau

SEQ ID NO: 2061465 - RNA, 21 nt, Human
auguuaaacuuacuuaguguu

SEQ ID NO: 2061466 - RNA, 23 nt, Human
auguguguuuugcuaaaggaaaa

SEQ ID NO: 2061467 - RNA, 14 nt, Human
auguguugaaaaaa

SEQ ID NO: 2061468 - RNA, 13 nt, Human
auguuacugacca

SEQ ID NO: 2061469 - RNA, 14 nt, Human
auguuacugaccag

SEQ ID NO: 2061470 - RNA, 13 nt, Human
auguuacugauca

SEQ ID NO: 2061471 - RNA, 16 nt, Human
auguuacugaucaugc

SEQ ID NO: 2061472 - RNA, 18 nt, Human
auguuaauccuagcugug

SEQ ID NO: 2061473 - RNA, 19 nt, Human
auguuaggaaaauuucaca

SEQ ID NO: 2061474 - RNA, 15 nt, Human
auguuaggcugggcc

SEQ ID NO: 2061475 - RNA, 20 nt, Human
auguuaggcugggcccagag

SEQ ID NO: 2061476 - RNA, 16 nt, Human
auguuagggugcucug

SEQ ID NO: 2061477 - RNA, 22 nt, Human
auguuacugaucaugcauuguu

SEQ ID NO: 2061478 - RNA, 18 nt, Human
auguuacugaucaugcau

SEQ ID NO: 2061479 - RNA, 19 nt, Human
auguuacugaucaugcauu

SEQ ID NO: 2061480 - RNA, 20 nt, Human
auguuacugaucaugcauug

SEQ ID NO: 2061481 - RNA, 21 nt, Human
auguuacugaucaugcauugu

SEQ ID NO: 2061482 - RNA, 18 nt, Human
auguuaggaaaauuucac

SEQ ID NO: 2061483 - RNA, 15 nt, Human
auguuagcaaagagu

SEQ ID NO: 2061484 - RNA, 12 nt, Human
auguugcccagg

SEQ ID NO: 2061485 - RNA, 16 nt, Human
auguugcccaggcagg

SEQ ID NO: 2061486 - RNA, 17 nt, Human
auguugcccaggcaggu

SEQ ID NO: 2061487 - RNA, 12 nt, Human
uuuuagaaacuu

SEQ ID NO: 2061488 - RNA, 14 nt, Human
uuuuagaacagaaa

SEQ ID NO: 2061489 - RNA, 17 nt, Human
uuuuagaacagaaaaca

SEQ ID NO: 2061490 - RNA, 18 nt, Human
uuuuagaacagaaaacaa

SEQ ID NO: 2061491 - RNA, 14 nt, Human
uuuuagaaaacagc

SEQ ID NO: 2061492 - RNA, 20 nt, Human
auguugcccaggcaggucuu

SEQ ID NO: 2061493 - RNA, 22 nt, Human
augugccagguuuuuggucuga

SEQ ID NO: 2061494 - RNA, 19 nt, Human
augugcccaguuaaucuug

SEQ ID NO: 2061495 - RNA, 12 nt, Human
augugcccccag

SEQ ID NO: 2061496 - RNA, 14 nt, Human
augugcccccagac

SEQ ID NO: 2061497 - RNA, 15 nt, Human
augugccugcaccag

SEQ ID NO: 2061498 - RNA, 17 nt, Human
augugccugcaccagga

SEQ ID NO: 2061499 - RNA, 19 nt, Human
augugccugcaccaggaga

SEQ ID NO: 2061500 - RNA, 22 nt, Human
augugccugcaccaggagacag

SEQ ID NO: 2061501 - RNA, 21 nt, Human
augugccguguuauuguauua

SEQ ID NO: 2061502 - RNA, 14 nt, Human
augugcgugugugc

SEQ ID NO: 2061503 - RNA, 15 nt, Human
augugcgugugugca

SEQ ID NO: 2061504 - RNA, 18 nt, Human
augugcgugugugcaagu

SEQ ID NO: 2061505 - RNA, 20 nt, Human
augugcgugugugcaagugu

SEQ ID NO: 2061506 - RNA, 19 nt, Human
auggggcugaacggggaga

SEQ ID NO: 2061507 - RNA, 22 nt, Human
auggggcugaacggggagaaaa

SEQ ID NO: 2061508 - RNA, 11 nt, Human
augugugugca

SEQ ID NO: 2061509 - RNA, 16 nt, Human
augugugugcaagugu

SEQ ID NO: 2061510 - RNA, 19 nt, Human
augugugugcaagugugug

SEQ ID NO: 2061511 - RNA, 22 nt, Human
auguggcuguaucuuguuuuuc

SEQ ID NO: 2061512 - RNA, 19 nt, Human
uuugaaagaaggaagacuu

SEQ ID NO: 2061513 - RNA, 16 nt, Human
auguggcagcugucuc

SEQ ID NO: 2061514 - RNA, 13 nt, Human
auguggcccuggc

SEQ ID NO: 2061515 - RNA, 14 nt, Human
auguggcccuggcc

SEQ ID NO: 2061516 - RNA, 15 nt, Human
auguggcccuggccu

SEQ ID NO: 2061517 - RNA, 16 nt, Human
auguggcccuggccug

SEQ ID NO: 2061518 - RNA, 19 nt, Human
auguggcccuggccugcug

SEQ ID NO: 2061519 - RNA, 20 nt, Human
auguggcccuggccugcugg

SEQ ID NO: 2061520 - RNA, 19 nt, Human
auguggccuaaaaaugcaa

SEQ ID NO: 2061521 - RNA, 15 nt, Human
auguguguguaugcu

SEQ ID NO: 2061522 - RNA, 16 nt, Human
auguguguguaugcua

SEQ ID NO: 2061523 - RNA, 19 nt, Human
auguguguguaugcuacua

SEQ ID NO: 2061524 - RNA, 21 nt, Human
auguguguguaugcuacuaca

SEQ ID NO: 2061525 - RNA, 15 nt, Human
augugugugcucagg

SEQ ID NO: 2061526 - RNA, 12 nt, Human
auguguguguau

SEQ ID NO: 2061527 - RNA, 13 nt, Human
auguguguguaug

SEQ ID NO: 2061528 - RNA, 16 nt, Human
auguguguuuugcuaa

SEQ ID NO: 2061529 - RNA, 15 nt, Human
auguguguguauguu

SEQ ID NO: 2061530 - RNA, 21 nt, Human
auguguguguauguuugcaca

SEQ ID NO: 2061531 - RNA, 16 nt, Human
auguggcauuugugau

SEQ ID NO: 2061532 - RNA, 23 nt, Human
auguggagcacaaaagccucuca

SEQ ID NO: 2061533 - RNA, 19 nt, Human
auguggagaaacuguaguc

SEQ ID NO: 2061534 - RNA, 20 nt, Human
augugcuacugauuguuuca

SEQ ID NO: 2061535 - RNA, 14 nt, Human
augugcuacugauu

SEQ ID NO: 2061536 - RNA, 15 nt, Human
auguggaauauaaag

SEQ ID NO: 2061537 - RNA, 17 nt, Human
auguggaauauaaagau

SEQ ID NO: 2061538 - RNA, 14 nt, Human
auuaaguuguuaau

SEQ ID NO: 2061539 - RNA, 16 nt, Human
auuaaguacuauguau

SEQ ID NO: 2061540 - RNA, 14 nt, Human
auuaaguacuaugu

SEQ ID NO: 2061541 - RNA, 19 nt, Human
auuaaguuguuaauaaaag

SEQ ID NO: 2061542 - RNA, 20 nt, Human
auuaaguuguuaauaaaagu

SEQ ID NO: 2061543 - RNA, 13 nt, Human
auuaaguuguuaa

SEQ ID NO: 2061544 - RNA, 15 nt, Human
auuacagugggugcc

SEQ ID NO: 2061545 - RNA, 14 nt, Human
auuacauaaauaaa

SEQ ID NO: 2061546 - RNA, 22 nt, Human
auuacauaaauaaauuaaauaa

SEQ ID NO: 2061547 - RNA, 14 nt, Human
auuacauccuugug

SEQ ID NO: 2061548 - RNA, 15 nt, Human
auuacauccuugugg

SEQ ID NO: 2061549 - RNA, 17 nt, Human
auuacauccuuguggca

SEQ ID NO: 2061550 - RNA, 18 nt, Human
auuacauccuuguggcac

SEQ ID NO: 2061551 - RNA, 15 nt, Human
auuacaucuuucaca

SEQ ID NO: 2061552 - RNA, 21 nt, Human
auuacauauuugcauauguau

SEQ ID NO: 2061553 - RNA, 16 nt, Human
auuacaucuuucacau

SEQ ID NO: 2061554 - RNA, 18 nt, Human
auuacaucuuucacauug

SEQ ID NO: 2061555 - RNA, 22 nt, Human
auuacaucuuucacauuggcua

SEQ ID NO: 2061556 - RNA, 22 nt, Human
auuacccccucauuguuuauua

SEQ ID NO: 2061557 - RNA, 13 nt, Human
auuaccauggaga

SEQ ID NO: 2061558 - RNA, 15 nt, Human
auuaccauggagaca

SEQ ID NO: 2061559 - RNA, 21 nt, Human
auuaccaguaaaguguaacau

SEQ ID NO: 2061560 - RNA, 23 nt, Human
auuaccaguaaaguguaacauau

SEQ ID NO: 2061561 - RNA, 19 nt, Human
auuacauguaaaacauuau

SEQ ID NO: 2061562 - RNA, 16 nt, Human
auuacauguaaaacau

SEQ ID NO: 2061563 - RNA, 17 nt, Human
auuacauuccuugauaa

SEQ ID NO: 2061564 - RNA, 21 nt, Human
auuacauuccuugauaauguu

SEQ ID NO: 2061565 - RNA, 22 nt, Human
auuacauuccuugauaauguug

SEQ ID NO: 2061566 - RNA, 14 nt, Human
uuuuuguuaacuuu

SEQ ID NO: 2061567 - RNA, 20 nt, Human
uuuuuguagagccagggucu

SEQ ID NO: 2061568 - RNA, 19 nt, Human
uuuuuguagagccaggguc

SEQ ID NO: 2061569 - RNA, 15 nt, Human
uuuuuguguauuugu

SEQ ID NO: 2061570 - RNA, 22 nt, Human
uuuuuguguuuuguucuuuaaa

SEQ ID NO: 2061571 - RNA, 13 nt, Human
uuuuugucuuuuc

SEQ ID NO: 2061572 - RNA, 13 nt, Human
uuuuuaucuuuuc

SEQ ID NO: 2061573 - RNA, 17 nt, Human
uuuuuaucuuuucuaca

SEQ ID NO: 2061574 - RNA, 21 nt, Human
uuuuuaucuuuucuacagcaa

SEQ ID NO: 2061575 - RNA, 11 nt, Human
uuuuuaucuuu

SEQ ID NO: 2061576 - RNA, 14 nt, Human
uuuuuauuaugcau

SEQ ID NO: 2061577 - RNA, 15 nt, Human
uuuuuauuaugcaua

SEQ ID NO: 2061578 - RNA, 11 nt, Human
uuuuuauucuu

SEQ ID NO: 2061579 - RNA, 14 nt, Human
uuuuuauucuugug

SEQ ID NO: 2061580 - RNA, 13 nt, Human
uuuuuauuaugca

SEQ ID NO: 2061581 - RNA, 12 nt, Human
uuuuuauugaug

SEQ ID NO: 2061582 - RNA, 13 nt, Human
uuuuuauugaugu

SEQ ID NO: 2061583 - RNA, 15 nt, Human
uuuuuauugaugugc

SEQ ID NO: 2061584 - RNA, 18 nt, Human
uuuuuauugaugugcaaa

SEQ ID NO: 2061585 - RNA, 13 nt, Human
uuuuuguaauuua

SEQ ID NO: 2061586 - RNA, 18 nt, Human
auuaguauuuauuuaaug

SEQ ID NO: 2061587 - RNA, 23 nt, Human
auuaguauuuauuuaauguuaug

SEQ ID NO: 2061588 - RNA, 13 nt, Human
auuagucauagaa

SEQ ID NO: 2061589 - RNA, 17 nt, Human
auuagucauagaagaac

SEQ ID NO: 2061590 - RNA, 19 nt, Human
auuagucauagaagaacua

SEQ ID NO: 2061591 - RNA, 20 nt, Human
auuacuacaaaauuugaaau

SEQ ID NO: 2061592 - RNA, 21 nt, Human
auuacuacaaaauuugaaauu

SEQ ID NO: 2061593 - RNA, 15 nt, Human
auuacuacaaaauuu

SEQ ID NO: 2061594 - RNA, 15 nt, Human
auuacggcuccucuc

SEQ ID NO: 2061595 - RNA, 16 nt, Human
auuacggcuccucucu

SEQ ID NO: 2061596 - RNA, 15 nt, Human
auuacccuucuuucc

SEQ ID NO: 2061597 - RNA, 16 nt, Human
auuacccuucuuucca

SEQ ID NO: 2061598 - RNA, 12 nt, Human
uuuuguuucaua

SEQ ID NO: 2061599 - RNA, 19 nt, Human
uuuuguuucauauugaugu

SEQ ID NO: 2061600 - RNA, 16 nt, Human
uuuuguuucauccugu

SEQ ID NO: 2061601 - RNA, 15 nt, Human
uuuuguuucuuccaa

SEQ ID NO: 2061602 - RNA, 15 nt, Human
uuuuguuccacaagu

SEQ ID NO: 2061603 - RNA, 21 nt, Human
uuuuguuccacaaguuaaaua

SEQ ID NO: 2061604 - RNA, 13 nt, Human
uuuugcuguagaa

SEQ ID NO: 2061605 - RNA, 14 nt, Human
uuuugcuguagaag

SEQ ID NO: 2061606 - RNA, 21 nt, Human
uuuugugaugucccaacuugu

SEQ ID NO: 2061607 - RNA, 14 nt, Human
uuuuuagaacagaa

SEQ ID NO: 2061608 - RNA, 17 nt, Human
uuuuuagaacagaaaac

SEQ ID NO: 2061609 - RNA, 17 nt, Human
uuuuuagaugguuacac

SEQ ID NO: 2061610 - RNA, 20 nt, Human
uuuuuagaugguuacacugu

SEQ ID NO: 2061611 - RNA, 22 nt, Human
uuuuuagacagagucucacugu

SEQ ID NO: 2061612 - RNA, 16 nt, Human
uuuuuacuacaguugu

SEQ ID NO: 2061613 - RNA, 22 nt, Human
uuuuuaccuaccacagugucug

SEQ ID NO: 2061614 - RNA, 17 nt, Human
uuuuuauacaggggaau

SEQ ID NO: 2061615 - RNA, 12 nt, Human
uuuuuauacagu

SEQ ID NO: 2061616 - RNA, 23 nt, Human
uuuuuaucuccccuucacaugca

SEQ ID NO: 2061617 - RNA, 13 nt, Human
uuuugcauuuaug

SEQ ID NO: 2061618 - RNA, 19 nt, Human
uuuugcauuugaauaaagc

SEQ ID NO: 2061619 - RNA, 23 nt, Human
uuuugccauguuggccaggcugg

SEQ ID NO: 2061620 - RNA, 18 nt, Human
uuuugcccuucacagugu

SEQ ID NO: 2061621 - RNA, 23 nt, Human
uuuugccuaauacauuaaagcag

SEQ ID NO: 2061622 - RNA, 21 nt, Human
uuuugcagcccagacaaaugu

SEQ ID NO: 2061623 - RNA, 14 nt, Human
uuuugcagcaguga

SEQ ID NO: 2061624 - RNA, 22 nt, Human
uuuugcaguagagucaucucca

SEQ ID NO: 2061625 - RNA, 13 nt, Human
uuuugcaaaauuu

SEQ ID NO: 2061626 - RNA, 15 nt, Human
uuuugauguuugugg

SEQ ID NO: 2061627 - RNA, 20 nt, Human
uuuugauguuuguggccuca

SEQ ID NO: 2061628 - RNA, 22 nt, Human
uuuugauguuuguggccucaga

SEQ ID NO: 2061629 - RNA, 22 nt, Human
uuuugauuuaauaacauaacaa

SEQ ID NO: 2061630 - RNA, 15 nt, Human
auuaagcaguaaaaa

SEQ ID NO: 2061631 - RNA, 19 nt, Human
auuaagcaguaaaaacugu

SEQ ID NO: 2061632 - RNA, 14 nt, Human
auuaagcaucacaa

SEQ ID NO: 2061633 - RNA, 18 nt, Human
auuaagcaucacaaauga

SEQ ID NO: 2061634 - RNA, 13 nt, Human
auuaaagaaaaua

SEQ ID NO: 2061635 - RNA, 18 nt, Human
auuaaagaaaauaaaauu

SEQ ID NO: 2061636 - RNA, 20 nt, Human
auuaaagcauuuacuuugaa

SEQ ID NO: 2061637 - RNA, 13 nt, Human
auuaaagacagag

SEQ ID NO: 2061638 - RNA, 23 nt, Human
auuaaagcagucacuuuuccugu

SEQ ID NO: 2061639 - RNA, 15 nt, Human
auuaaagcauuuacu

SEQ ID NO: 2061640 - RNA, 15 nt, Human
uuuugauagcuuuau

SEQ ID NO: 2061641 - RNA, 17 nt, Human
uuuugauccaagcuggu

SEQ ID NO: 2061642 - RNA, 18 nt, Human
uuuugaguggaugauguu

SEQ ID NO: 2061643 - RNA, 14 nt, Human
caauauuguacagu

SEQ ID NO: 2061644 - RNA, 20 nt, Human
caaucugaagauacaugucu

SEQ ID NO: 2061645 - RNA, 17 nt, Human
caauauucgcuguguca

SEQ ID NO: 2061646 - RNA, 12 nt, Human
caauauagcaag

SEQ ID NO: 2061647 - RNA, 13 nt, Human
caauauagcaaga

SEQ ID NO: 2061648 - RNA, 18 nt, Human
caauacaguacaggcagc

SEQ ID NO: 2061649 - RNA, 17 nt, Human
caauacaguacaggcag

SEQ ID NO: 2061650 - RNA, 19 nt, Human
caauacaguacaggcagca

SEQ ID NO: 2061651 - RNA, 18 nt, Human
caauagcuuuacccucag

SEQ ID NO: 2061652 - RNA, 21 nt, Human
caauagcuuuacccucaggca

SEQ ID NO: 2061653 - RNA, 23 nt, Human
caauagcuuuacccucaggcaua

SEQ ID NO: 2061654 - RNA, 18 nt, Human
caauauaaccaauguuua

SEQ ID NO: 2061655 - RNA, 19 nt, Human
caauauaaccaauguuuaa

SEQ ID NO: 2061656 - RNA, 20 nt, Human
caauauaaccaauguuuaaa

SEQ ID NO: 2061657 - RNA, 21 nt, Human
caauauaaccaauguuuaaaa

SEQ ID NO: 2061658 - RNA, 16 nt, Human
caaguuauaaaucaau

SEQ ID NO: 2061659 - RNA, 13 nt, Human
caaguuauuaauu

SEQ ID NO: 2061660 - RNA, 20 nt, Human
caaguuauaaaucaauguca

SEQ ID NO: 2061661 - RNA, 19 nt, Human
caaguuauauaaagagaaa

SEQ ID NO: 2061662 - RNA, 21 nt, Human
caaguuauauaaagagaaaau

SEQ ID NO: 2061663 - RNA, 14 nt, Human
caaguuagcucagg

SEQ ID NO: 2061664 - RNA, 16 nt, Human
caaguuagcucaggag

SEQ ID NO: 2061665 - RNA, 17 nt, Human
caaguuagcucaggagg

SEQ ID NO: 2061666 - RNA, 19 nt, Human
caaguuagcucaggaggcu

SEQ ID NO: 2061667 - RNA, 13 nt, Human
caaguuagcucag

SEQ ID NO: 2061668 - RNA, 22 nt, Human
caauaauuucagguuuuguaaa

SEQ ID NO: 2061669 - RNA, 14 nt, Human
caauaauuucaggu

SEQ ID NO: 2061670 - RNA, 16 nt, Human
caaugucaggaacaga

SEQ ID NO: 2061671 - RNA, 15 nt, Human
caaugucaaggugcu

SEQ ID NO: 2061672 - RNA, 15 nt, Human
caaugugauaaaacc

SEQ ID NO: 2061673 - RNA, 17 nt, Human
caaugugauaaaacccc

SEQ ID NO: 2061674 - RNA, 12 nt, Human
caauguucauug

SEQ ID NO: 2061675 - RNA, 13 nt, Human
caauguucauugu

SEQ ID NO: 2061676 - RNA, 14 nt, Human
caauguucauugua

SEQ ID NO: 2061677 - RNA, 15 nt, Human
caauguucauuguaa

SEQ ID NO: 2061678 - RNA, 18 nt, Human
caauguucauuguaaugu

SEQ ID NO: 2061679 - RNA, 22 nt, Human
caauguucauuguaauguuacu

SEQ ID NO: 2061680 - RNA, 23 nt, Human
caauguucauuguaauguuacug

SEQ ID NO: 2061681 - RNA, 23 nt, Human
caauucucauuugucacacacuu

SEQ ID NO: 2061682 - RNA, 17 nt, Human
caaugaggucugaaaug

SEQ ID NO: 2061683 - RNA, 19 nt, Human
caaugagauagaagauguu

SEQ ID NO: 2061684 - RNA, 22 nt, Human
caaugagauagaagauguuugc

SEQ ID NO: 2061685 - RNA, 18 nt, Human
caaugaggucugaaaugg

SEQ ID NO: 2061686 - RNA, 14 nt, Human
caaugucacuuaaa

SEQ ID NO: 2061687 - RNA, 14 nt, Human
caaugucaggaaca

SEQ ID NO: 2061688 - RNA, 19 nt, Human
caaugucaggaacagaagg

SEQ ID NO: 2061689 - RNA, 17 nt, Human
caauguagaaagcuuug

SEQ ID NO: 2061690 - RNA, 14 nt, Human
caauguucucucuu

SEQ ID NO: 2061691 - RNA, 17 nt, Human
caagccguggcuucccg

SEQ ID NO: 2061692 - RNA, 17 nt, Human
caagcaggaagcucaga

SEQ ID NO: 2061693 - RNA, 21 nt, Human
caagcaggaagcucagacugg

SEQ ID NO: 2061694 - RNA, 15 nt, Human
caagcaggaagcuca

SEQ ID NO: 2061695 - RNA, 16 nt, Human
caagcaggaagcucag

SEQ ID NO: 2061696 - RNA, 22 nt, Human
caagcgauucuucugcuucagc

SEQ ID NO: 2061697 - RNA, 20 nt, Human
caagcgauucuucugcuuca

SEQ ID NO: 2061698 - RNA, 19 nt, Human
caagcgauucuucugcuuc

SEQ ID NO: 2061699 - RNA, 22 nt, Human
caagccugcagucaucuugacc

SEQ ID NO: 2061700 - RNA, 14 nt, Human
caagccugccuagg

SEQ ID NO: 2061701 - RNA, 18 nt, Human
caagccguggcuucccgc

SEQ ID NO: 2061702 - RNA, 21 nt, Human
caagccugaccacgcuuucua

SEQ ID NO: 2061703 - RNA, 12 nt, Human
caaggagggaga

SEQ ID NO: 2061704 - RNA, 12 nt, Human
caaggaggaaaa

SEQ ID NO: 2061705 - RNA, 13 nt, Human
caaggaggaaaaa

SEQ ID NO: 2061706 - RNA, 14 nt, Human
caaggaggaaaaac

SEQ ID NO: 2061707 - RNA, 20 nt, Human
caaggaggaaaaacagacaa

SEQ ID NO: 2061708 - RNA, 20 nt, Human
caaggcugaccaagagagaa

SEQ ID NO: 2061709 - RNA, 21 nt, Human
caaggcugaccaagagagaaa

SEQ ID NO: 2061710 - RNA, 13 nt, Human
caaggagcugaga

SEQ ID NO: 2061711 - RNA, 14 nt, Human
caaggagcugagaa

SEQ ID NO: 2061712 - RNA, 18 nt, Human
caaggagcugagaauaga

SEQ ID NO: 2061713 - RNA, 20 nt, Human
caaggagcugagaauagaag

SEQ ID NO: 2061714 - RNA, 22 nt, Human
caaggagcugagaauagaagga

SEQ ID NO: 2061715 - RNA, 23 nt, Human
caaggagcugagaauagaaggaa

SEQ ID NO: 2061716 - RNA, 16 nt, Human
caaggacuugaaagca

SEQ ID NO: 2061717 - RNA, 18 nt, Human
caaggacuugaaagcauc

SEQ ID NO: 2061718 - RNA, 20 nt, Human
caaggacuugaaagcaucca

SEQ ID NO: 2061719 - RNA, 22 nt, Human
caaggacugcagggacugccag

SEQ ID NO: 2061720 - RNA, 14 nt, Human
caaggacugccgac

SEQ ID NO: 2061721 - RNA, 11 nt, Human
caaggacaaag

SEQ ID NO: 2061722 - RNA, 17 nt, Human
caaggacaaagucucca

SEQ ID NO: 2061723 - RNA, 18 nt, Human
caaggacaaagucuccag

SEQ ID NO: 2061724 - RNA, 19 nt, Human
caaggacaaagucuccagc

SEQ ID NO: 2061725 - RNA, 22 nt, Human
caaggacaaagucuccagccca

SEQ ID NO: 2061726 - RNA, 23 nt, Human
caaggacaaagucuccagcccac

SEQ ID NO: 2061727 - RNA, 15 nt, Human
caaggacugcaggga

SEQ ID NO: 2061728 - RNA, 18 nt, Human
caaggaaggaaagaaaga

SEQ ID NO: 2061729 - RNA, 23 nt, Human
caaggaaggaaagaaagaaggaa

SEQ ID NO: 2061730 - RNA, 19 nt, Human
caagcuggucccacucagu

SEQ ID NO: 2061731 - RNA, 12 nt, Human
caaggaaggaaa

SEQ ID NO: 2061732 - RNA, 13 nt, Human
caaggaaggaaag

SEQ ID NO: 2061733 - RNA, 16 nt, Human
caaggaaggaaagaaa

SEQ ID NO: 2061734 - RNA, 17 nt, Human
caaggaaggaaagaaag

SEQ ID NO: 2061735 - RNA, 17 nt, Human
caagcuggucccacuca

SEQ ID NO: 2061736 - RNA, 17 nt, Human
caagugagagcugggug

SEQ ID NO: 2061737 - RNA, 15 nt, Human
caagugagagcuggg

SEQ ID NO: 2061738 - RNA, 14 nt, Human
caagugagagcugg

SEQ ID NO: 2061739 - RNA, 21 nt, Human
caaguccucuuuucugagagg

SEQ ID NO: 2061740 - RNA, 18 nt, Human
caagugagagcugggugu

SEQ ID NO: 2061741 - RNA, 16 nt, Human
caagugagcaaaccug

SEQ ID NO: 2061742 - RNA, 19 nt, Human
caagugagcaaaccugccc

SEQ ID NO: 2061743 - RNA, 20 nt, Human
caagugagcaaaccugcccc

SEQ ID NO: 2061744 - RNA, 21 nt, Human
caagugagcaaaccugcccca

SEQ ID NO: 2061745 - RNA, 19 nt, Human
caaguggcucccacacccu

SEQ ID NO: 2061746 - RNA, 19 nt, Human
caaguggaccuugagacca

SEQ ID NO: 2061747 - RNA, 14 nt, Human
caaguuaaauaaau

SEQ ID NO: 2061748 - RNA, 22 nt, Human
caaguguaugcacgugugcaca

SEQ ID NO: 2061749 - RNA, 17 nt, Human
caagugucucaguccac

SEQ ID NO: 2061750 - RNA, 20 nt, Human
caagugucucaguccaccug

SEQ ID NO: 2061751 - RNA, 17 nt, Human
caaguggcaugugcugu

SEQ ID NO: 2061752 - RNA, 19 nt, Human
caaguggcaugugcuguga

SEQ ID NO: 2061753 - RNA, 14 nt, Human
caaguccucuuuuc

SEQ ID NO: 2061754 - RNA, 19 nt, Human
caaggucguuuuuuucauu

SEQ ID NO: 2061755 - RNA, 21 nt, Human
caaggucuagguggagguggg

SEQ ID NO: 2061756 - RNA, 16 nt, Human
caaggucgguaaguug

SEQ ID NO: 2061757 - RNA, 14 nt, Human
caaggggugccugg

SEQ ID NO: 2061758 - RNA, 15 nt, Human
caaggggugccuggg

SEQ ID NO: 2061759 - RNA, 18 nt, Human
caaggggugccugggaac

SEQ ID NO: 2061760 - RNA, 17 nt, Human
caagggguuucuguuuc

SEQ ID NO: 2061761 - RNA, 15 nt, Human
caagggggacugucu

SEQ ID NO: 2061762 - RNA, 18 nt, Human
caaggggcccaaauucuu

SEQ ID NO: 2061763 - RNA, 17 nt, Human
caaggggcccaaauucu

SEQ ID NO: 2061764 - RNA, 12 nt, Human
caaggcugcagu

SEQ ID NO: 2061765 - RNA, 15 nt, Human
caaggcugcagugag

SEQ ID NO: 2061766 - RNA, 23 nt, Human
caaggcugaccaagagagaaaga

SEQ ID NO: 2061767 - RNA, 17 nt, Human
caagcaccuccugccuc

SEQ ID NO: 2061768 - RNA, 16 nt, Human
caagcaccuccugccu

SEQ ID NO: 2061769 - RNA, 15 nt, Human
caagagggcacuggu

SEQ ID NO: 2061770 - RNA, 14 nt, Human
caagagggcacugg

SEQ ID NO: 2061771 - RNA, 15 nt, Human
caagcaccuccugcc

SEQ ID NO: 2061772 - RNA, 13 nt, Human
caagagggcacug

SEQ ID NO: 2061773 - RNA, 20 nt, Human
caagaggcuguucccaccag

SEQ ID NO: 2061774 - RNA, 15 nt, Human
caagacucugucuca

SEQ ID NO: 2061775 - RNA, 18 nt, Human
caagacucuuuggacacu

SEQ ID NO: 2061776 - RNA, 13 nt, Human
caagaacagcagg

SEQ ID NO: 2061777 - RNA, 14 nt, Human
caagaacagcaggc

SEQ ID NO: 2061778 - RNA, 17 nt, Human
caagaacagcaggccca

SEQ ID NO: 2061779 - RNA, 21 nt, Human
caagaacagcaggcccaccua

SEQ ID NO: 2061780 - RNA, 15 nt, Human
caagaacugaaaaca

SEQ ID NO: 2061781 - RNA, 16 nt, Human
caagaacugaaaacau

SEQ ID NO: 2061782 - RNA, 17 nt, Human
caagaacugaaaacaua

SEQ ID NO: 2061783 - RNA, 21 nt, Human
caagaacugaaaacauaaaaa

SEQ ID NO: 2061784 - RNA, 12 nt, Human
caagaacugcau

SEQ ID NO: 2061785 - RNA, 13 nt, Human
caagaacugcaug

SEQ ID NO: 2061786 - RNA, 16 nt, Human
caagaacugcauggac

SEQ ID NO: 2061787 - RNA, 18 nt, Human
caagaacugcauggaccu

SEQ ID NO: 2061788 - RNA, 19 nt, Human
caagaacugcauggaccua

SEQ ID NO: 2061789 - RNA, 23 nt, Human
caagaacugcauggaccuaacau

SEQ ID NO: 2061790 - RNA, 13 nt, Human
caacuuuucuauu

SEQ ID NO: 2061791 - RNA, 22 nt, Human
caacugaggcagacagcagcuc

SEQ ID NO: 2061792 - RNA, 19 nt, Human
caacugaccagccuccaug

SEQ ID NO: 2061793 - RNA, 13 nt, Human
caacugaggcaga

SEQ ID NO: 2061794 - RNA, 14 nt, Human
caacugaggcagac

SEQ ID NO: 2061795 - RNA, 16 nt, Human
caacugaggcagacag

SEQ ID NO: 2061796 - RNA, 17 nt, Human
caacugaggcagacagc

SEQ ID NO: 2061797 - RNA, 20 nt, Human
caacugaggcagacagcagc

SEQ ID NO: 2061798 - RNA, 21 nt, Human
caacugaggcagacagcagcu

SEQ ID NO: 2061799 - RNA, 14 nt, Human
caagaacucugggc

SEQ ID NO: 2061800 - RNA, 13 nt, Human
caacccucagagc

SEQ ID NO: 2061801 - RNA, 16 nt, Human
caacccgaggcccgca

SEQ ID NO: 2061802 - RNA, 23 nt, Human
caacccugccccugccccgucac

SEQ ID NO: 2061803 - RNA, 22 nt, Human
caacccugccccugccccguca

SEQ ID NO: 2061804 - RNA, 14 nt, Human
caaccgaugcucca

SEQ ID NO: 2061805 - RNA, 17 nt, Human
caaccgaugcuccagcc

SEQ ID NO: 2061806 - RNA, 18 nt, Human
caaccgaugcuccagcca

SEQ ID NO: 2061807 - RNA, 21 nt, Human
caaccgaugcuccagccaacc

SEQ ID NO: 2061808 - RNA, 15 nt, Human
caacccuccuaucac

SEQ ID NO: 2061809 - RNA, 19 nt, Human
caacccuccuaucaccucc

SEQ ID NO: 2061810 - RNA, 22 nt, Human
caacccuccuaucaccuccccu

SEQ ID NO: 2061811 - RNA, 19 nt, Human
caacccucccucagccccu

SEQ ID NO: 2061812 - RNA, 20 nt, Human
caacccucccucagccccuc

SEQ ID NO: 2061813 - RNA, 21 nt, Human
caacccucccucagccccucu

SEQ ID NO: 2061814 - RNA, 22 nt, Human
caacccucccucagccccucuu

SEQ ID NO: 2061815 - RNA, 11 nt, Human
caacccugcaa

SEQ ID NO: 2061816 - RNA, 12 nt, Human
caacccugcaaa

SEQ ID NO: 2061817 - RNA, 22 nt, Human
caacccugcaaaggacuguuuu

SEQ ID NO: 2061818 - RNA, 11 nt, Human
caacccugccc

SEQ ID NO: 2061819 - RNA, 13 nt, Human
caacccugccccu

SEQ ID NO: 2061820 - RNA, 14 nt, Human
caacccugccccug

SEQ ID NO: 2061821 - RNA, 15 nt, Human
caacccugccccugc

SEQ ID NO: 2061822 - RNA, 16 nt, Human
caacccugccccugcc

SEQ ID NO: 2061823 - RNA, 22 nt, Human
caacacucacauuuauucugcu

SEQ ID NO: 2061824 - RNA, 22 nt, Human
caaccccuucgcuccugugucu

SEQ ID NO: 2061825 - RNA, 11 nt, Human
caaauuucaca

SEQ ID NO: 2061826 - RNA, 14 nt, Human
caaccuuacuuaca

SEQ ID NO: 2061827 - RNA, 23 nt, Human
caaccuuacuuacagcauaaggg

SEQ ID NO: 2061828 - RNA, 14 nt, Human
caacggcaagacag

SEQ ID NO: 2061829 - RNA, 21 nt, Human
caacggagagcgccugccccu

SEQ ID NO: 2061830 - RNA, 14 nt, Human
caaccugugaucaa

SEQ ID NO: 2061831 - RNA, 18 nt, Human
caaccugugaucaagcaa

SEQ ID NO: 2061832 - RNA, 17 nt, Human
caacugaccagccucca

SEQ ID NO: 2061833 - RNA, 15 nt, Human
caacugaccagccuc

SEQ ID NO: 2061834 - RNA, 22 nt, Human
caaccgaugcuccagccaaccc

SEQ ID NO: 2061835 - RNA, 19 nt, Human
caaccggggagcccccgcc

SEQ ID NO: 2061836 - RNA, 20 nt, Human
caaccggggagcccccgccc

SEQ ID NO: 2061837 - RNA, 14 nt, Human
caaccuccugggcu

SEQ ID NO: 2061838 - RNA, 18 nt, Human
caaccguuggaaacauaa

SEQ ID NO: 2061839 - RNA, 12 nt, Human
caaccuguaaau

SEQ ID NO: 2061840 - RNA, 13 nt, Human
caaccuguaaauu

SEQ ID NO: 2061841 - RNA, 16 nt, Human
caaccuguaaauuauu

SEQ ID NO: 2061842 - RNA, 21 nt, Human
caaccuguaaauuauuuuaaa

SEQ ID NO: 2061843 - RNA, 15 nt, Human
caaccuguaagacug

SEQ ID NO: 2061844 - RNA, 17 nt, Human
caaccucggcuccugga

SEQ ID NO: 2061845 - RNA, 18 nt, Human
caaccucggcuccuggac

SEQ ID NO: 2061846 - RNA, 20 nt, Human
caaccucggcuccuggacuc

SEQ ID NO: 2061847 - RNA, 15 nt, Human
caaccuccugggcua

SEQ ID NO: 2061848 - RNA, 19 nt, Human
caaagugcugggauuacag

SEQ ID NO: 2061849 - RNA, 19 nt, Human
caaaggguaucaggugcug

SEQ ID NO: 2061850 - RNA, 20 nt, Human
caaagugcugggauuacagg

SEQ ID NO: 2061851 - RNA, 23 nt, Human
caaagugcugggauuacaggugu

SEQ ID NO: 2061852 - RNA, 24 nt, Human
caaaggguacuuccacugauggaa

SEQ ID NO: 2061853 - RNA, 14 nt, Human
caaauacucuuagg

SEQ ID NO: 2061854 - RNA, 20 nt, Human
caaauggugguuguuucuuc

SEQ ID NO: 2061855 - RNA, 21 nt, Human
caaauggugguuguuucuucc

SEQ ID NO: 2061856 - RNA, 22 nt, Human
caaauggugguuguuucuucca

SEQ ID NO: 2061857 - RNA, 23 nt, Human
caaauggugguuguuucuuccaa

SEQ ID NO: 2061858 - RNA, 16 nt, Human
caaauuaucaagcuaa

SEQ ID NO: 2061859 - RNA, 17 nt, Human
caaauuaucaagcuaau

SEQ ID NO: 2061860 - RNA, 21 nt, Human
caaauuaucaagcuaauaaaa

SEQ ID NO: 2061861 - RNA, 18 nt, Human
caaauuaucaagcuaaua

SEQ ID NO: 2061862 - RNA, 20 nt, Human
caaauuaucaagcuaauaaa

SEQ ID NO: 2061863 - RNA, 14 nt, Human
caaauuaucuuaaa

SEQ ID NO: 2061864 - RNA, 18 nt, Human
caaauguccuccagaagc

SEQ ID NO: 2061865 - RNA, 19 nt, Human
caaauguccuccagaagcc

SEQ ID NO: 2061866 - RNA, 18 nt, Human
caaauguaauugaauaaa

SEQ ID NO: 2061867 - RNA, 21 nt, Human
caaauguaauugaauaaaguu

SEQ ID NO: 2061868 - RNA, 13 nt, Human
caaauuuauaauu

SEQ ID NO: 2061869 - RNA, 14 nt, Human
caaauuuauaauuu

SEQ ID NO: 2061870 - RNA, 15 nt, Human
caaauuuauaauuuu

SEQ ID NO: 2061871 - RNA, 16 nt, Human
caaauuuauaauuuua

SEQ ID NO: 2061872 - RNA, 22 nt, Human
caaauuguaucuagugcagcug

SEQ ID NO: 2061873 - RNA, 18 nt, Human
caaauuguaucuagugca

SEQ ID NO: 2061874 - RNA, 19 nt, Human
caaauuguaucuagugcag

SEQ ID NO: 2061875 - RNA, 14 nt, Human
caaaguggaaggaa

SEQ ID NO: 2061876 - RNA, 15 nt, Human
caaaguggaaggaaa

SEQ ID NO: 2061877 - RNA, 16 nt, Human
caaaguggaaggaaag

SEQ ID NO: 2061878 - RNA, 22 nt, Human
caaaaugucuguagcuccucaa

SEQ ID NO: 2061879 - RNA, 13 nt, Human
caaaaugucugua

SEQ ID NO: 2061880 - RNA, 15 nt, Human
caaaauguaggguua

SEQ ID NO: 2061881 - RNA, 18 nt, Human
caaaauggaauucauucu

SEQ ID NO: 2061882 - RNA, 15 nt, Human
caaaauuauuucaga

SEQ ID NO: 2061883 - RNA, 21 nt, Human
caaaauuauagaaguuuagau

SEQ ID NO: 2061884 - RNA, 17 nt, Human
caaaauuauuucagaaa

SEQ ID NO: 2061885 - RNA, 16 nt, Human
caaaauuauuucagaa

SEQ ID NO: 2061886 - RNA, 15 nt, Human
caaacacauacagga

SEQ ID NO: 2061887 - RNA, 23 nt, Human
caaacacauuaagccuuccacac

SEQ ID NO: 2061888 - RNA, 23 nt, Human
caaaauugggaaaggaguagaaa

SEQ ID NO: 2061889 - RNA, 13 nt, Human
caaacacauuaag

SEQ ID NO: 2061890 - RNA, 18 nt, Human
caaaccuccaaaagcccu

SEQ ID NO: 2061891 - RNA, 19 nt, Human
caaagcuaggccuggccag

SEQ ID NO: 2061892 - RNA, 14 nt, Human
caaagcuaggccug

SEQ ID NO: 2061893 - RNA, 13 nt, Human
caaagcuaggccu

SEQ ID NO: 2061894 - RNA, 22 nt, Human
caaagcugaagccgccaggacc

SEQ ID NO: 2061895 - RNA, 18 nt, Human
caaagcugacgaggcugg

SEQ ID NO: 2061896 - RNA, 20 nt, Human
caaagcugacgaggcugggc

SEQ ID NO: 2061897 - RNA, 22 nt, Human
caaagcugacgaggcugggcca

SEQ ID NO: 2061898 - RNA, 21 nt, Human
caaagcuaggguggcccuugc

SEQ ID NO: 2061899 - RNA, 22 nt, Human
caaagcuaggguggcccuugca

SEQ ID NO: 2061900 - RNA, 13 nt, Human
caaagcgggggga

SEQ ID NO: 2061901 - RNA, 16 nt, Human
caaagcggggggaggg

SEQ ID NO: 2061902 - RNA, 17 nt, Human
caaagcggggggagggu

SEQ ID NO: 2061903 - RNA, 18 nt, Human
caaaggguaucaggugcu

SEQ ID NO: 2061904 - RNA, 16 nt, Human
caaaggguaucaggug

SEQ ID NO: 2061905 - RNA, 23 nt, Human
caaaggcgcagugcuucucuaca

SEQ ID NO: 2061906 - RNA, 20 nt, Human
caaaggaagcuuucucugcu

SEQ ID NO: 2061907 - RNA, 23 nt, Human
caaaggaagcuuucucugcuuca

SEQ ID NO: 2061908 - RNA, 20 nt, Human
caaaggcacagugaaggcug

SEQ ID NO: 2061909 - RNA, 22 nt, Human
caaaggaaucuccaguuuucag

SEQ ID NO: 2061910 - RNA, 21 nt, Human
caaaggaauggaggcucuaau

SEQ ID NO: 2061911 - RNA, 19 nt, Human
caaaggaaucuccaguuuu

SEQ ID NO: 2061912 - RNA, 16 nt, Human
caaaggaagucuagga

SEQ ID NO: 2061913 - RNA, 14 nt, Human
caaacgguacacag

SEQ ID NO: 2061914 - RNA, 15 nt, Human
caaacuguguaacug

SEQ ID NO: 2061915 - RNA, 20 nt, Human
caaacuguguaacugcccaa

SEQ ID NO: 2061916 - RNA, 13 nt, Human
caaacuguugauu

SEQ ID NO: 2061917 - RNA, 17 nt, Human
caaacuuaagaaacacu

SEQ ID NO: 2061918 - RNA, 19 nt, Human
caaacuuaagaaacacuga

SEQ ID NO: 2061919 - RNA, 17 nt, Human
caaagccuccuccagcc

SEQ ID NO: 2061920 - RNA, 18 nt, Human
caaagccuccuccagccg

SEQ ID NO: 2061921 - RNA, 18 nt, Human
caaagcccuuccaugucg

SEQ ID NO: 2061922 - RNA, 18 nt, Human
caaacuguguaacugccc

SEQ ID NO: 2061923 - RNA, 22 nt, Human
caaagccaacagucaaaacaga

SEQ ID NO: 2061924 - RNA, 22 nt, Human
caaagccaaagcuaggccuggc

SEQ ID NO: 2061925 - RNA, 13 nt, Human
caaagccagaagc

SEQ ID NO: 2061926 - RNA, 14 nt, Human
caaagccagaagcu

SEQ ID NO: 2061927 - RNA, 16 nt, Human
caaagccagaagcuga

SEQ ID NO: 2061928 - RNA, 18 nt, Human
caaagccagaagcugagc

SEQ ID NO: 2061929 - RNA, 14 nt, Human
caaagccagacagc

SEQ ID NO: 2061930 - RNA, 15 nt, Human
caaagccagacagca

SEQ ID NO: 2061931 - RNA, 19 nt, Human
auuuuggguuuugggucuu

SEQ ID NO: 2061932 - RNA, 23 nt, Human
auuuugggguacccacugcucug

SEQ ID NO: 2061933 - RNA, 22 nt, Human
auuuugggguacccacugcucu

SEQ ID NO: 2061934 - RNA, 21 nt, Human
auuuugggguacccacugcuc

SEQ ID NO: 2061935 - RNA, 14 nt, Human
auuuucuacaagua

SEQ ID NO: 2061936 - RNA, 13 nt, Human
caaaaacagccuc

SEQ ID NO: 2061937 - RNA, 14 nt, Human
caaaaacagccuca

SEQ ID NO: 2061938 - RNA, 18 nt, Human
caaaaaauuagccgggcg

SEQ ID NO: 2061939 - RNA, 16 nt, Human
caaaaaauuagccggg

SEQ ID NO: 2061940 - RNA, 21 nt, Human
caaaaagacacuugauacuug

SEQ ID NO: 2061941 - RNA, 18 nt, Human
caaaaagaaucugcauuu

SEQ ID NO: 2061942 - RNA, 19 nt, Human
caaaaagaaucugcauuua

SEQ ID NO: 2061943 - RNA, 22 nt, Human
caaaaagaaucugcauuuagca

SEQ ID NO: 2061944 - RNA, 23 nt, Human
caaaaagaaucugcauuuagcac

SEQ ID NO: 2061945 - RNA, 13 nt, Human
caaaaaggcagga

SEQ ID NO: 2061946 - RNA, 17 nt, Human
caaaaaccucacccgag

SEQ ID NO: 2061947 - RNA, 17 nt, Human
caaaaacgaaagcuggg

SEQ ID NO: 2061948 - RNA, 16 nt, Human
caaaaacuacacauau

SEQ ID NO: 2061949 - RNA, 22 nt, Human
caaaaacagccucacagaagaa

SEQ ID NO: 2061950 - RNA, 15 nt, Human
caaaaacagccucac

SEQ ID NO: 2061951 - RNA, 16 nt, Human
caaaaacagccucaca

SEQ ID NO: 2061952 - RNA, 19 nt, Human
caaaagaacaagaauuucu

SEQ ID NO: 2061953 - RNA, 17 nt, Human
caaaauaaaaaugaggu

SEQ ID NO: 2061954 - RNA, 21 nt, Human
caaaagaaaaaaaaaagcacc

SEQ ID NO: 2061955 - RNA, 13 nt, Human
caaaaccacagcc

SEQ ID NO: 2061956 - RNA, 21 nt, Human
caaaacaguauugacuuguau

SEQ ID NO: 2061957 - RNA, 22 nt, Human
caaaacaugcuaccugauccca

SEQ ID NO: 2061958 - RNA, 20 nt, Human
caaaaauuuggaauucuguu

SEQ ID NO: 2061959 - RNA, 15 nt, Human
caaaacauuccguuu

SEQ ID NO: 2061960 - RNA, 16 nt, Human
caaaacacuuguaauu

SEQ ID NO: 2061961 - RNA, 18 nt, Human
caaaacacuuguaauuuu

SEQ ID NO: 2061962 - RNA, 19 nt, Human
caaaacagagaugugauaa

SEQ ID NO: 2061963 - RNA, 18 nt, Human
caaaaccugauguuaaaa

SEQ ID NO: 2061964 - RNA, 21 nt, Human
caaaaccugauguuaaaauuc

SEQ ID NO: 2061965 - RNA, 15 nt, Human
caaaaccauugcuuc

SEQ ID NO: 2061966 - RNA, 16 nt, Human
caaaaccauugcuuca

SEQ ID NO: 2061967 - RNA, 17 nt, Human
caaaaccauugcuucac

SEQ ID NO: 2061968 - RNA, 16 nt, Human
caaaaccacagcccug

SEQ ID NO: 2061969 - RNA, 18 nt, Human
caaaaccacagcccuguc

SEQ ID NO: 2061970 - RNA, 19 nt, Human
caaaaccacagcccuguca

SEQ ID NO: 2061971 - RNA, 21 nt, Human
caaaaccacagcccugucagu

SEQ ID NO: 2061972 - RNA, 17 nt, Human
caaaaauucacaagcug

SEQ ID NO: 2061973 - RNA, 20 nt, Human
caaaaauucacaagcugccu

SEQ ID NO: 2061974 - RNA, 23 nt, Human
caaaaauucacaagcugccuccc

SEQ ID NO: 2061975 - RNA, 11 nt, Human
caaaaauuauc

SEQ ID NO: 2061976 - RNA, 13 nt, Human
caaaaauuugaac

SEQ ID NO: 2061977 - RNA, 22 nt, Human
caaaaauuugaaccaaaacauu

SEQ ID NO: 2061978 - RNA, 11 nt, Human
caaaaauuuuu

SEQ ID NO: 2061979 - RNA, 13 nt, Human
caaaaauuuuugg

SEQ ID NO: 2061980 - RNA, 15 nt, Human
caaaaauuuuuggau

SEQ ID NO: 2061981 - RNA, 18 nt, Human
caaaaauuuuuggauuga

SEQ ID NO: 2061982 - RNA, 21 nt, Human
caaaaauuuuuggauugacag

SEQ ID NO: 2061983 - RNA, 22 nt, Human
caaaaauuuuuggauugacagu

SEQ ID NO: 2061984 - RNA, 14 nt, Human
caaaaauguacaaa

SEQ ID NO: 2061985 - RNA, 19 nt, Human
caaaaauguacaaaauaaa

SEQ ID NO: 2061986 - RNA, 21 nt, Human
caaaaauguacaaaauaaagu

SEQ ID NO: 2061987 - RNA, 22 nt, Human
caaaaauguacaaaauaaaguu

SEQ ID NO: 2061988 - RNA, 19 nt, Human
caaaaaugaaagcaugucu

SEQ ID NO: 2061989 - RNA, 17 nt, Human
caaaaauuagccgggca

SEQ ID NO: 2061990 - RNA, 15 nt, Human
caaaaauuagccggg

SEQ ID NO: 2061991 - RNA, 17 nt, Human
caaaaauuagccgggcg

SEQ ID NO: 2061992 - RNA, 20 nt, Human
caaaaauuagccgggcgugg

SEQ ID NO: 2061993 - RNA, 19 nt, Human
caaaaauuaucuauuugua

SEQ ID NO: 2061994 - RNA, 20 nt, Human
caaaaauuaucuauuuguau

SEQ ID NO: 2061995 - RNA, 21 nt, Human
caaaaauuaucuauuuguaua

SEQ ID NO: 2061996 - RNA, 23 nt, Human
caaaaauuaucuauuuguauaua

SEQ ID NO: 2061997 - RNA, 13 nt, Human
caaaaagcuuccc

SEQ ID NO: 2061998 - RNA, 14 nt, Human
caaaaagcuucccc

SEQ ID NO: 2061999 - RNA, 20 nt, Human
caaaaagggaaacuauuguc

SEQ ID NO: 2062000 - RNA, 14 nt, Human
caaaaauacucuaa

SEQ ID NO: 2062001 - RNA, 15 nt, Human
caaaaauacucuaau

SEQ ID NO: 2062002 - RNA, 17 nt, Human
caaaaauacucuaauuc

SEQ ID NO: 2062003 - RNA, 18 nt, Human
caaaaauacucuaauucu

SEQ ID NO: 2062004 - RNA, 19 nt, Human
caaaaauacucuaauucua

SEQ ID NO: 2062005 - RNA, 20 nt, Human
caaaaauacucuaauucuaa

SEQ ID NO: 2062006 - RNA, 23 nt, Human
caaacucauaacagucuuacugc

SEQ ID NO: 2062007 - RNA, 14 nt, Human
cacauagauucacc

SEQ ID NO: 2062008 - RNA, 16 nt, Human
cacauagauucaccug

SEQ ID NO: 2062009 - RNA, 17 nt, Human
cacauagauucaccugu

SEQ ID NO: 2062010 - RNA, 19 nt, Human
cacauagauucaccuguaa

SEQ ID NO: 2062011 - RNA, 22 nt, Human
cacauagauucaccuguaaaac

SEQ ID NO: 2062012 - RNA, 18 nt, Human
cacauagcauguaauggu

SEQ ID NO: 2062013 - RNA, 16 nt, Human
cacauacuugagacug

SEQ ID NO: 2062014 - RNA, 22 nt, Human
cacaguuccucgcccugggucu

SEQ ID NO: 2062015 - RNA, 22 nt, Human
cacagcuucauuuccugugucu

SEQ ID NO: 2062016 - RNA, 21 nt, Human
cacagcuucauuuccuguguc

SEQ ID NO: 2062017 - RNA, 12 nt, Human
cacagcuguggu

SEQ ID NO: 2062018 - RNA, 22 nt, Human
cacagcuguggugagguugggc

SEQ ID NO: 2062019 - RNA, 17 nt, Human
cacagcuucagccagga

SEQ ID NO: 2062020 - RNA, 14 nt, Human
cacagcuucagcca

SEQ ID NO: 2062021 - RNA, 19 nt, Human
caauuuguaaaaacagcau

SEQ ID NO: 2062022 - RNA, 16 nt, Human
caauuuguauaaaaug

SEQ ID NO: 2062023 - RNA, 16 nt, Human
caauuugucauuuuga

SEQ ID NO: 2062024 - RNA, 17 nt, Human
caauuugucauuuugaa

SEQ ID NO: 2062025 - RNA, 18 nt, Human
caauuugucauuuugaag

SEQ ID NO: 2062026 - RNA, 22 nt, Human
caauuugucauuuugaagcuaa

SEQ ID NO: 2062027 - RNA, 23 nt, Human
caauuugucauuuugaagcuaau

SEQ ID NO: 2062028 - RNA, 23 nt, Human
caauuuguucagucuuucauuua

SEQ ID NO: 2062029 - RNA, 23 nt, Human
caauuuguaaaaacagcauugcu

SEQ ID NO: 2062030 - RNA, 15 nt, Human
cacagcuuccccucu

SEQ ID NO: 2062031 - RNA, 19 nt, Human
cacagcuucagccaggagc

SEQ ID NO: 2062032 - RNA, 18 nt, Human
cacagcuucagccaggag

SEQ ID NO: 2062033 - RNA, 22 nt, Human
cacagcuucagccaggagcugg

SEQ ID NO: 2062034 - RNA, 14 nt, Human
cacagcuuccccuc

SEQ ID NO: 2062035 - RNA, 22 nt, Human
cacaggaggagaaaucucacuu

SEQ ID NO: 2062036 - RNA, 15 nt, Human
cacaggcagguccag

SEQ ID NO: 2062037 - RNA, 14 nt, Human
cacaggcaggucca

SEQ ID NO: 2062038 - RNA, 11 nt, Human
cacaggcaggu

SEQ ID NO: 2062039 - RNA, 16 nt, Human
cacaguuccucgcccu

SEQ ID NO: 2062040 - RNA, 19 nt, Human
cacaguuccucgcccuggg

SEQ ID NO: 2062041 - RNA, 20 nt, Human
cacaguuccucgcccugggu

SEQ ID NO: 2062042 - RNA, 19 nt, Human
cacagugggagccagggcu

SEQ ID NO: 2062043 - RNA, 18 nt, Human
cacagugggagccagggc

SEQ ID NO: 2062044 - RNA, 14 nt, Human
cacagugggagcca

SEQ ID NO: 2062045 - RNA, 18 nt, Human
cacagugucuguaucgga

SEQ ID NO: 2062046 - RNA, 21 nt, Human
cacagugagucgaggacaggg

SEQ ID NO: 2062047 - RNA, 22 nt, Human
cacagugagucgaggacaggga

SEQ ID NO: 2062048 - RNA, 14 nt, Human
cacagugcaucuca

SEQ ID NO: 2062049 - RNA, 16 nt, Human
cacugcaacuucugcc

SEQ ID NO: 2062050 - RNA, 17 nt, Human
cacugcaacuucugccu

SEQ ID NO: 2062051 - RNA, 13 nt, Human
cacugcaagagcc

SEQ ID NO: 2062052 - RNA, 15 nt, Human
cacugcaagagccuu

SEQ ID NO: 2062053 - RNA, 16 nt, Human
cacugcaagagccuug

SEQ ID NO: 2062054 - RNA, 20 nt, Human
cacugcaagagccuuggugu

SEQ ID NO: 2062055 - RNA, 17 nt, Human
cacugcaagagccuugg

SEQ ID NO: 2062056 - RNA, 18 nt, Human
cacugcaagagccuuggu

SEQ ID NO: 2062057 - RNA, 19 nt, Human
cacugcaagagccuuggug

SEQ ID NO: 2062058 - RNA, 14 nt, Human
cacugacuccugug

SEQ ID NO: 2062059 - RNA, 22 nt, Human
cacugcacagugcaucucagcc

SEQ ID NO: 2062060 - RNA, 21 nt, Human
cacugcacagugcaucucagc

SEQ ID NO: 2062061 - RNA, 19 nt, Human
cacugcacagugcaucuca

SEQ ID NO: 2062062 - RNA, 18 nt, Human
cacugcacagugcaucuc

SEQ ID NO: 2062063 - RNA, 13 nt, Human
cacugcaaccucc

SEQ ID NO: 2062064 - RNA, 16 nt, Human
cacugauuuggagaua

SEQ ID NO: 2062065 - RNA, 14 nt, Human
cacugauuuggaga

SEQ ID NO: 2062066 - RNA, 15 nt, Human
cacugcaacaggaac

SEQ ID NO: 2062067 - RNA, 16 nt, Human
cacugcaaccuccgcc

SEQ ID NO: 2062068 - RNA, 14 nt, Human
cacugcaaccuccg

SEQ ID NO: 2062069 - RNA, 23 nt, Human
cacugcaaccuccgccucuuggg

SEQ ID NO: 2062070 - RNA, 14 nt, Human
cacugagcaaagca

SEQ ID NO: 2062071 - RNA, 13 nt, Human
cacugaggcaggg

SEQ ID NO: 2062072 - RNA, 14 nt, Human
cacugaggcaggga

SEQ ID NO: 2062073 - RNA, 16 nt, Human
cacugaggcagggaag

SEQ ID NO: 2062074 - RNA, 17 nt, Human
cacugaggcagggaagu

SEQ ID NO: 2062075 - RNA, 19 nt, Human
cacugaggcagggaagucc

SEQ ID NO: 2062076 - RNA, 24 nt, Human
cacugaugggcaacccccagccug

SEQ ID NO: 2062077 - RNA, 18 nt, Human
cacugaugggcaaccccc

SEQ ID NO: 2062078 - RNA, 14 nt, Human
cacugaugggcaac

SEQ ID NO: 2062079 - RNA, 19 nt, Human
cacugauggaaacaaagug

SEQ ID NO: 2062080 - RNA, 20 nt, Human
cacugauggaaacaaagugg

SEQ ID NO: 2062081 - RNA, 18 nt, Human
cacugaggcagggaaguc

SEQ ID NO: 2062082 - RNA, 23 nt, Human
cacugaccauccacucuacccuc

SEQ ID NO: 2062083 - RNA, 14 nt, Human
cacugacccacagc

SEQ ID NO: 2062084 - RNA, 19 nt, Human
cacugacccacagccucug

SEQ ID NO: 2062085 - RNA, 22 nt, Human
cacugacccacagccucugccu

SEQ ID NO: 2062086 - RNA, 16 nt, Human
cacugaccauccacuc

SEQ ID NO: 2062087 - RNA, 17 nt, Human
cacugaccauccacucu

SEQ ID NO: 2062088 - RNA, 20 nt, Human
cacugacagccucccacccc

SEQ ID NO: 2062089 - RNA, 16 nt, Human
cacugacagccuccca

SEQ ID NO: 2062090 - RNA, 17 nt, Human
cacugacagccucccac

SEQ ID NO: 2062091 - RNA, 13 nt, Human
cacugacagccuc

SEQ ID NO: 2062092 - RNA, 14 nt, Human
cacugacagccucc

SEQ ID NO: 2062093 - RNA, 15 nt, Human
cacugacagccuccc

SEQ ID NO: 2062094 - RNA, 23 nt, Human
cacugacauuguuggccaaagcc

SEQ ID NO: 2062095 - RNA, 19 nt, Human
cacucugucgcccagucug

SEQ ID NO: 2062096 - RNA, 16 nt, Human
cacucugucgcccagu

SEQ ID NO: 2062097 - RNA, 15 nt, Human
cacucugucgcccag

SEQ ID NO: 2062098 - RNA, 13 nt, Human
cacuggcagcccc

SEQ ID NO: 2062099 - RNA, 14 nt, Human
cacuggcagcccca

SEQ ID NO: 2062100 - RNA, 15 nt, Human
cacuggcagccccag

SEQ ID NO: 2062101 - RNA, 17 nt, Human
cacuggcagccccagca

SEQ ID NO: 2062102 - RNA, 19 nt, Human
cacuggcagccccagcacc

SEQ ID NO: 2062103 - RNA, 16 nt, Human
cacuggcaucuuugcu

SEQ ID NO: 2062104 - RNA, 16 nt, Human
cacuggcaaugaaaaa

SEQ ID NO: 2062105 - RNA, 15 nt, Human
cacuggaugcagaaa

SEQ ID NO: 2062106 - RNA, 23 nt, Human
cacuggaugcaaagaaaaucaga

SEQ ID NO: 2062107 - RNA, 19 nt, Human
cacuggaugcaaagaaaau

SEQ ID NO: 2062108 - RNA, 16 nt, Human
cacuggaguccagucu

SEQ ID NO: 2062109 - RNA, 15 nt, Human
cacuggagcccagga

SEQ ID NO: 2062110 - RNA, 11 nt, Human
cacuggagccc

SEQ ID NO: 2062111 - RNA, 12 nt, Human
cacuggagccca

SEQ ID NO: 2062112 - RNA, 13 nt, Human
cacuggagcccag

SEQ ID NO: 2062113 - RNA, 14 nt, Human
cacuggagcccagg

SEQ ID NO: 2062114 - RNA, 16 nt, Human
cacuggagcaccaggc

SEQ ID NO: 2062115 - RNA, 17 nt, Human
cacuggagcaccaggca

SEQ ID NO: 2062116 - RNA, 21 nt, Human
cacuggagcaccaggcacgaa

SEQ ID NO: 2062117 - RNA, 21 nt, Human
cacugcuuuuggucuguguga

SEQ ID NO: 2062118 - RNA, 20 nt, Human
cacugcuuuuggucugugug

SEQ ID NO: 2062119 - RNA, 17 nt, Human
cacugcuuccauuuaau

SEQ ID NO: 2062120 - RNA, 11 nt, Human
cacugcuguga

SEQ ID NO: 2062121 - RNA, 17 nt, Human
cacugcugugaacaagu

SEQ ID NO: 2062122 - RNA, 21 nt, Human
cacugcuggcugccuuagaac

SEQ ID NO: 2062123 - RNA, 16 nt, Human
cacugcuggcugccuu

SEQ ID NO: 2062124 - RNA, 15 nt, Human
cacugcuggcugccu

SEQ ID NO: 2062125 - RNA, 14 nt, Human
cacugcuggcugcc

SEQ ID NO: 2062126 - RNA, 13 nt, Human
cacugcuggcugc

SEQ ID NO: 2062127 - RNA, 12 nt, Human
cacugcuggcug

SEQ ID NO: 2062128 - RNA, 13 nt, Human
cacugcucacacu

SEQ ID NO: 2062129 - RNA, 23 nt, Human
cacugcuaggugggccagccccu

SEQ ID NO: 2062130 - RNA, 16 nt, Human
cacugcuaggugggcc

SEQ ID NO: 2062131 - RNA, 17 nt, Human
cacugcuaggugggcca

SEQ ID NO: 2062132 - RNA, 22 nt, Human
cacugcuaggugggccagcccc

SEQ ID NO: 2062133 - RNA, 17 nt, Human
cacugcugcccagccuc

SEQ ID NO: 2062134 - RNA, 16 nt, Human
cacugcugcugccuuu

SEQ ID NO: 2062135 - RNA, 15 nt, Human
cacugcugcccagcc

SEQ ID NO: 2062136 - RNA, 12 nt, Human
cacugcucuggu

SEQ ID NO: 2062137 - RNA, 14 nt, Human
cacugccugcccac

SEQ ID NO: 2062138 - RNA, 15 nt, Human
cacugccugcccacc

SEQ ID NO: 2062139 - RNA, 18 nt, Human
cacugccucucccuggcc

SEQ ID NO: 2062140 - RNA, 19 nt, Human
cacugccucucccuggccc

SEQ ID NO: 2062141 - RNA, 15 nt, Human
cacugccucuggaau

SEQ ID NO: 2062142 - RNA, 10 nt, Human
cacugccugc

SEQ ID NO: 2062143 - RNA, 22 nt, Human
cacugccuucgauacaccgggc

SEQ ID NO: 2062144 - RNA, 20 nt, Human
cacugccuucgauacaccgg

SEQ ID NO: 2062145 - RNA, 18 nt, Human
cacugcacuauagccuag

SEQ ID NO: 2062146 - RNA, 19 nt, Human
cacugcaccgggccacaga

SEQ ID NO: 2062147 - RNA, 18 nt, Human
cacugcaccgggccacag

SEQ ID NO: 2062148 - RNA, 16 nt, Human
cacugcaccgggccac

SEQ ID NO: 2062149 - RNA, 23 nt, Human
cacugcacagugcaucucagccc

SEQ ID NO: 2062150 - RNA, 15 nt, Human
cacugcaccgggcca

SEQ ID NO: 2062151 - RNA, 14 nt, Human
cacugcaccgggcc

SEQ ID NO: 2062152 - RNA, 13 nt, Human
cacugcccuucuc

SEQ ID NO: 2062153 - RNA, 12 nt, Human
cacugcccucug

SEQ ID NO: 2062154 - RNA, 17 nt, Human
cacugcccucuguucag

SEQ ID NO: 2062155 - RNA, 21 nt, Human
cacugcccgagcuggugcauu

SEQ ID NO: 2062156 - RNA, 16 nt, Human
cacugccucuuccucc

SEQ ID NO: 2062157 - RNA, 20 nt, Human
cacugccucucccuggcccu

SEQ ID NO: 2062158 - RNA, 16 nt, Human
cacugccucucccugg

SEQ ID NO: 2062159 - RNA, 17 nt, Human
cacugccauggaggcac

SEQ ID NO: 2062160 - RNA, 19 nt, Human
cacugccauggaggcacac

SEQ ID NO: 2062161 - RNA, 22 nt, Human
cacugccauggaggcacacagc

SEQ ID NO: 2062162 - RNA, 15 nt, Human
cacugcccgagcugg

SEQ ID NO: 2062163 - RNA, 16 nt, Human
cacugcccgagcuggu

SEQ ID NO: 2062164 - RNA, 17 nt, Human
cacugcccgagcuggug

SEQ ID NO: 2062165 - RNA, 18 nt, Human
cacugcccgagcuggugc

SEQ ID NO: 2062166 - RNA, 19 nt, Human
cacugcccgagcuggugca

SEQ ID NO: 2062167 - RNA, 22 nt, Human
cacuguaguaaauggcaauucu

SEQ ID NO: 2062168 - RNA, 16 nt, Human
cacuguaugcuggacg

SEQ ID NO: 2062169 - RNA, 18 nt, Human
cacuguaugcuggacggc

SEQ ID NO: 2062170 - RNA, 15 nt, Human
cacuguauaccccgu

SEQ ID NO: 2062171 - RNA, 22 nt, Human
cacuguauaccccgugaagcau

SEQ ID NO: 2062172 - RNA, 18 nt, Human
cacuguaaaaugaaauua

SEQ ID NO: 2062173 - RNA, 21 nt, Human
cacuguagcauuacagugggu

SEQ ID NO: 2062174 - RNA, 22 nt, Human
cacuggccccuagaaucagccu

SEQ ID NO: 2062175 - RNA, 16 nt, Human
cacuguaaaaugaaau

SEQ ID NO: 2062176 - RNA, 17 nt, Human
cacuguaaaaugaaauu

SEQ ID NO: 2062177 - RNA, 13 nt, Human
cacuguaaaauga

SEQ ID NO: 2062178 - RNA, 14 nt, Human
cacuguaaaaugaa

SEQ ID NO: 2062179 - RNA, 14 nt, Human
cacugugccaugug

SEQ ID NO: 2062180 - RNA, 16 nt, Human
cacugugaccuugacu

SEQ ID NO: 2062181 - RNA, 13 nt, Human
cacugugaagaga

SEQ ID NO: 2062182 - RNA, 14 nt, Human
cacugucuugaaga

SEQ ID NO: 2062183 - RNA, 12 nt, Human
cacugucucagu

SEQ ID NO: 2062184 - RNA, 18 nt, Human
cacuguauuacauaaaua

SEQ ID NO: 2062185 - RNA, 23 nt, Human
cacuguauuacauaaauaaauua

SEQ ID NO: 2062186 - RNA, 16 nt, Human
cacugucacuguuucu

SEQ ID NO: 2062187 - RNA, 18 nt, Human
cacugucacuguuucucu

SEQ ID NO: 2062188 - RNA, 19 nt, Human
cacugucacuguuucucug

SEQ ID NO: 2062189 - RNA, 22 nt, Human
cacugucacuguuucucugcug

SEQ ID NO: 2062190 - RNA, 16 nt, Human
cacugugggacucuuc

SEQ ID NO: 2062191 - RNA, 13 nt, Human
cacuguuagaaca

SEQ ID NO: 2062192 - RNA, 14 nt, Human
cacuguuagaacac

SEQ ID NO: 2062193 - RNA, 15 nt, Human
cacuguuagaacacu

SEQ ID NO: 2062194 - RNA, 16 nt, Human
cacuguuagaacacua

SEQ ID NO: 2062195 - RNA, 17 nt, Human
cacuguuagaacacuau

SEQ ID NO: 2062196 - RNA, 18 nt, Human
cacuguuagaacacuauu

SEQ ID NO: 2062197 - RNA, 19 nt, Human
cacuguuagaacacuauuu

SEQ ID NO: 2062198 - RNA, 20 nt, Human
cacuguuagaacacuauuuu

SEQ ID NO: 2062199 - RNA, 21 nt, Human
cacuguuagaacacuauuuuc

SEQ ID NO: 2062200 - RNA, 23 nt, Human
cacuguuagaacacuauuuucag

SEQ ID NO: 2062201 - RNA, 18 nt, Human
cacugugccaugugccag

SEQ ID NO: 2062202 - RNA, 16 nt, Human
cacugugccaugugcc

SEQ ID NO: 2062203 - RNA, 15 nt, Human
cacugugccaugugc

SEQ ID NO: 2062204 - RNA, 12 nt, Human
cacuguggccuu

SEQ ID NO: 2062205 - RNA, 20 nt, Human
cacuuauuuaugaaccugcc

SEQ ID NO: 2062206 - RNA, 17 nt, Human
cacuguugaauuuucuc

SEQ ID NO: 2062207 - RNA, 19 nt, Human
cacuguucugaaagugacu

SEQ ID NO: 2062208 - RNA, 13 nt, Human
cacuguugaauuu

SEQ ID NO: 2062209 - RNA, 18 nt, Human
cacuucacuccagccugg

SEQ ID NO: 2062210 - RNA, 13 nt, Human
cacuucagagagc

SEQ ID NO: 2062211 - RNA, 15 nt, Human
cacuucagagagcug

SEQ ID NO: 2062212 - RNA, 16 nt, Human
cacuucagagagcugg

SEQ ID NO: 2062213 - RNA, 17 nt, Human
cacuucagagagcuggu

SEQ ID NO: 2062214 - RNA, 14 nt, Human
cacuucacccugga

SEQ ID NO: 2062215 - RNA, 18 nt, Human
cacuucacacacaggcaa

SEQ ID NO: 2062216 - RNA, 22 nt, Human
cacuucaggguucuccucuccc

SEQ ID NO: 2062217 - RNA, 18 nt, Human
cacuucagagagcuggua

SEQ ID NO: 2062218 - RNA, 23 nt, Human
cacuucaggcucuucuccuuuca

SEQ ID NO: 2062219 - RNA, 22 nt, Human
cacuucauucuugaaagcugug

SEQ ID NO: 2062220 - RNA, 18 nt, Human
cacuucaggucaggaguu

SEQ ID NO: 2062221 - RNA, 20 nt, Human
cacuucaggcucuucuccuu

SEQ ID NO: 2062222 - RNA, 16 nt, Human
cacuucaggcucuucu

SEQ ID NO: 2062223 - RNA, 15 nt, Human
cacuucaggcucuuc

SEQ ID NO: 2062224 - RNA, 14 nt, Human
cacuucaggcucuu

SEQ ID NO: 2062225 - RNA, 12 nt, Human
cacuucagcuga

SEQ ID NO: 2062226 - RNA, 21 nt, Human
cacuucagcugacuuuucugu

SEQ ID NO: 2062227 - RNA, 17 nt, Human
cacuucuaaaugaagug

SEQ ID NO: 2062228 - RNA, 18 nt, Human
cacuucuaaaugaagugc

SEQ ID NO: 2062229 - RNA, 17 nt, Human
cacuucuaaauagcaau

SEQ ID NO: 2062230 - RNA, 21 nt, Human
cacuucgggaggucgaggcag

SEQ ID NO: 2062231 - RNA, 23 nt, Human
cacuucgggaggucgaggcagga

SEQ ID NO: 2062232 - RNA, 22 nt, Human
cacuucugccauauucuguugg

SEQ ID NO: 2062233 - RNA, 19 nt, Human
cacuucugaccacacuucc

SEQ ID NO: 2062234 - RNA, 16 nt, Human
cacuucugaccacacu

SEQ ID NO: 2062235 - RNA, 13 nt, Human
cacuucugaccac

SEQ ID NO: 2062236 - RNA, 17 nt, Human
cacuuccuacaagagca

SEQ ID NO: 2062237 - RNA, 23 nt, Human
cacuuccuacaagagcagccugu

SEQ ID NO: 2062238 - RNA, 12 nt, Human
cacuuccugucc

SEQ ID NO: 2062239 - RNA, 13 nt, Human
cacuuccugucca

SEQ ID NO: 2062240 - RNA, 14 nt, Human
cacuuccuguccag

SEQ ID NO: 2062241 - RNA, 17 nt, Human
cacuuccuguccagaga

SEQ ID NO: 2062242 - RNA, 18 nt, Human
cacuuccuguccagagag

SEQ ID NO: 2062243 - RNA, 20 nt, Human
cacuuccaccagccugcacu

SEQ ID NO: 2062244 - RNA, 20 nt, Human
cacuuccauaaucuggacuc

SEQ ID NO: 2062245 - RNA, 14 nt, Human
cacuuccaccagcc

SEQ ID NO: 2062246 - RNA, 15 nt, Human
cacuuccaccagccu

SEQ ID NO: 2062247 - RNA, 16 nt, Human
cacuuccaccagccug

SEQ ID NO: 2062248 - RNA, 17 nt, Human
cacuuccaccagccugc

SEQ ID NO: 2062249 - RNA, 18 nt, Human
cacuuccaccagccugca

SEQ ID NO: 2062250 - RNA, 19 nt, Human
cacuuccaccagccugcac

SEQ ID NO: 2062251 - RNA, 16 nt, Human
cacuucccuacaugga

SEQ ID NO: 2062252 - RNA, 22 nt, Human
cacuugcagacucuacagaggc

SEQ ID NO: 2062253 - RNA, 19 nt, Human
cacuugcagacucuacaga

SEQ ID NO: 2062254 - RNA, 18 nt, Human
cacuugcagacucuacag

SEQ ID NO: 2062255 - RNA, 14 nt, Human
cacuugcagacucu

SEQ ID NO: 2062256 - RNA, 24 nt, Human
cacuugcagacucuacagaggcca

SEQ ID NO: 2062257 - RNA, 12 nt, Human
cacuugcauuuc

SEQ ID NO: 2062258 - RNA, 18 nt, Human
cacuugcaguggaagaua

SEQ ID NO: 2062259 - RNA, 18 nt, Human
cacuugccccuguuaccu

SEQ ID NO: 2062260 - RNA, 22 nt, Human
cacuugcggauauucuggacug

SEQ ID NO: 2062261 - RNA, 12 nt, Human
cacuuggagcca

SEQ ID NO: 2062262 - RNA, 16 nt, Human
cacuuggccucuggau

SEQ ID NO: 2062263 - RNA, 13 nt, Human
cacuugcagacuc

SEQ ID NO: 2062264 - RNA, 22 nt, Human
cacuugaggucaggaguuccua

SEQ ID NO: 2062265 - RNA, 23 nt, Human
cacuugcacgcccaugugugagu

SEQ ID NO: 2062266 - RNA, 19 nt, Human
cacuugaugacccccaacc

SEQ ID NO: 2062267 - RNA, 18 nt, Human
cacuugaggucaggaguu

SEQ ID NO: 2062268 - RNA, 13 nt, Human
cacuugaguccag

SEQ ID NO: 2062269 - RNA, 17 nt, Human
cacuugagaauuacccu

SEQ ID NO: 2062270 - RNA, 15 nt, Human
cacuucuuuuauaac

SEQ ID NO: 2062271 - RNA, 20 nt, Human
cacuugagaauuacccuuuu

SEQ ID NO: 2062272 - RNA, 18 nt, Human
cacuucuuguuccccacu

SEQ ID NO: 2062273 - RNA, 23 nt, Human
cacuucuucuuggucuuauuuau

SEQ ID NO: 2062274 - RNA, 22 nt, Human
cacuucugugagacccccacac

SEQ ID NO: 2062275 - RNA, 20 nt, Human
cacuucugugagacccccac

SEQ ID NO: 2062276 - RNA, 21 nt, Human
cacuucugugagacccccaca

SEQ ID NO: 2062277 - RNA, 16 nt, Human
cacucaggucuguuuu

SEQ ID NO: 2062278 - RNA, 21 nt, Human
cacucaggaggcugaggcagg

SEQ ID NO: 2062279 - RNA, 16 nt, Human
cacucaguccauagca

SEQ ID NO: 2062280 - RNA, 19 nt, Human
cacucaggaggcugaggca

SEQ ID NO: 2062281 - RNA, 20 nt, Human
cacucaggaggcugaggcag

SEQ ID NO: 2062282 - RNA, 19 nt, Human
cacucaggccaacaagcca

SEQ ID NO: 2062283 - RNA, 17 nt, Human
cacuccuaggacauguu

SEQ ID NO: 2062284 - RNA, 15 nt, Human
cacuccuccaaagga

SEQ ID NO: 2062285 - RNA, 17 nt, Human
cacuccucccugaugua

SEQ ID NO: 2062286 - RNA, 18 nt, Human
cacuccucccugauguac

SEQ ID NO: 2062287 - RNA, 14 nt, Human
cacuccuaccuggu

SEQ ID NO: 2062288 - RNA, 13 nt, Human
cacuccuaccugg

SEQ ID NO: 2062289 - RNA, 22 nt, Human
cacuccggugugccugcagccc

SEQ ID NO: 2062290 - RNA, 17 nt, Human
cacuccggugugccugc

SEQ ID NO: 2062291 - RNA, 19 nt, Human
cacuccggugugccugcag

SEQ ID NO: 2062292 - RNA, 20 nt, Human
cacuccggugugccugcagc

SEQ ID NO: 2062293 - RNA, 21 nt, Human
cacuccggugugccugcagcc

SEQ ID NO: 2062294 - RNA, 19 nt, Human
cacucccuucccauaagcu

SEQ ID NO: 2062295 - RNA, 14 nt, Human
cacucccuucuccu

SEQ ID NO: 2062296 - RNA, 15 nt, Human
cacucccuucuccuu

SEQ ID NO: 2062297 - RNA, 14 nt, Human
cacucuacuuagca

SEQ ID NO: 2062298 - RNA, 18 nt, Human
cacucuacccucccaccc

SEQ ID NO: 2062299 - RNA, 19 nt, Human
cacucuacccucccacccc

SEQ ID NO: 2062300 - RNA, 17 nt, Human
cacucuacccuauacaa

SEQ ID NO: 2062301 - RNA, 15 nt, Human
cacucuacccuccca

SEQ ID NO: 2062302 - RNA, 16 nt, Human
cacucuacccucccac

SEQ ID NO: 2062303 - RNA, 17 nt, Human
cacucuacccucccacc

SEQ ID NO: 2062304 - RNA, 21 nt, Human
cacucuacccucccacccccu

SEQ ID NO: 2062305 - RNA, 17 nt, Human
cacucucauuccccagg

SEQ ID NO: 2062306 - RNA, 21 nt, Human
cacucuccccacacuaaccug

SEQ ID NO: 2062307 - RNA, 18 nt, Human
cacucucauuccccaggu

SEQ ID NO: 2062308 - RNA, 12 nt, Human
cacucuccccac

SEQ ID NO: 2062309 - RNA, 14 nt, Human
cacucuccccacac

SEQ ID NO: 2062310 - RNA, 15 nt, Human
cacucuccccacacu

SEQ ID NO: 2062311 - RNA, 20 nt, Human
cacucgugugcaacagacaa

SEQ ID NO: 2062312 - RNA, 22 nt, Human
cacucgugugcaacagacaagu

SEQ ID NO: 2062313 - RNA, 16 nt, Human
cacucgcuucccccau

SEQ ID NO: 2062314 - RNA, 20 nt, Human
cacucgcuucccccauagcc

SEQ ID NO: 2062315 - RNA, 10 nt, Human
cacuccuggg

SEQ ID NO: 2062316 - RNA, 11 nt, Human
cacuccugggg

SEQ ID NO: 2062317 - RNA, 12 nt, Human
cacuccuggggc

SEQ ID NO: 2062318 - RNA, 19 nt, Human
cacuccuggggccucuugg

SEQ ID NO: 2062319 - RNA, 13 nt, Human
cacuccuguacac

SEQ ID NO: 2062320 - RNA, 11 nt, Human
cacuccuuccu

SEQ ID NO: 2062321 - RNA, 15 nt, Human
cacuccuuccugcca

SEQ ID NO: 2062322 - RNA, 17 nt, Human
cacuccuuccugccacc

SEQ ID NO: 2062323 - RNA, 18 nt, Human
cacuccuuccugccaccu

SEQ ID NO: 2062324 - RNA, 21 nt, Human
cacuccuuccugccaccugcu

SEQ ID NO: 2062325 - RNA, 24 nt, Human
cacuccuuccugccaccugcugcu

SEQ ID NO: 2062326 - RNA, 13 nt, Human
cacucgcuucccc

SEQ ID NO: 2062327 - RNA, 19 nt, Human
cacucugcuuugacugagc

SEQ ID NO: 2062328 - RNA, 21 nt, Human
cacucugcuuugacugagcag

SEQ ID NO: 2062329 - RNA, 23 nt, Human
cacucugaguuuaccauuuguaa

SEQ ID NO: 2062330 - RNA, 19 nt, Human
cacucugacuggcacaguc

SEQ ID NO: 2062331 - RNA, 20 nt, Human
cacucugccucugccugcau

SEQ ID NO: 2062332 - RNA, 15 nt, Human
cacucugccucugcc

SEQ ID NO: 2062333 - RNA, 17 nt, Human
cacucugccucugccug

SEQ ID NO: 2062334 - RNA, 19 nt, Human
cacucugccucugccugca

SEQ ID NO: 2062335 - RNA, 11 nt, Human
cacucuccugg

SEQ ID NO: 2062336 - RNA, 12 nt, Human
cacucuccuggg

SEQ ID NO: 2062337 - RNA, 13 nt, Human
cacucuccugggc

SEQ ID NO: 2062338 - RNA, 14 nt, Human
cacucuccugggcc

SEQ ID NO: 2062339 - RNA, 15 nt, Human
cacucuccugggccc

SEQ ID NO: 2062340 - RNA, 16 nt, Human
cacucuccugggcccc

SEQ ID NO: 2062341 - RNA, 18 nt, Human
cacucuccugggccccuc

SEQ ID NO: 2062342 - RNA, 19 nt, Human
cacucuccugggccccucc

SEQ ID NO: 2062343 - RNA, 20 nt, Human
cacucuccugggccccuccc

SEQ ID NO: 2062344 - RNA, 21 nt, Human
cacucuccugggccccucccu

SEQ ID NO: 2062345 - RNA, 23 nt, Human
cacucuccugggccccucccuac

SEQ ID NO: 2062346 - RNA, 18 nt, Human
cacuaaccacgcuggacc

SEQ ID NO: 2062347 - RNA, 19 nt, Human
cacuaacgacuucagggca

SEQ ID NO: 2062348 - RNA, 18 nt, Human
cacuaaggugugcucuga

SEQ ID NO: 2062349 - RNA, 17 nt, Human
cacuaaggugugcucug

SEQ ID NO: 2062350 - RNA, 16 nt, Human
cacuaaccacgcugga

SEQ ID NO: 2062351 - RNA, 15 nt, Human
cacuaaccacgcugg

SEQ ID NO: 2062352 - RNA, 18 nt, Human
cacuaacauuauauugca

SEQ ID NO: 2062353 - RNA, 20 nt, Human
cacuaacauuauauugcaau

SEQ ID NO: 2062354 - RNA, 14 nt, Human
cacuaaccacgcug

SEQ ID NO: 2062355 - RNA, 13 nt, Human
cacuaaagcagug

SEQ ID NO: 2062356 - RNA, 19 nt, Human
cacuauaaaugguguuuuu

SEQ ID NO: 2062357 - RNA, 21 nt, Human
cacuauagccuaggugacaga

SEQ ID NO: 2062358 - RNA, 14 nt, Human
cacuauagccuagg

SEQ ID NO: 2062359 - RNA, 18 nt, Human
cacuauaauguaagcucu

SEQ ID NO: 2062360 - RNA, 14 nt, Human
cacuauaauguaag

SEQ ID NO: 2062361 - RNA, 15 nt, Human
cacuagucugugugc

SEQ ID NO: 2062362 - RNA, 20 nt, Human
cacuagucugugugcugugg

SEQ ID NO: 2062363 - RNA, 21 nt, Human
cacuagucugugugcuguggu

SEQ ID NO: 2062364 - RNA, 12 nt, Human
cacuauaaaugg

SEQ ID NO: 2062365 - RNA, 19 nt, Human
cacuauguugcccaggcag

SEQ ID NO: 2062366 - RNA, 18 nt, Human
cacuauguugcccaggca

SEQ ID NO: 2062367 - RNA, 17 nt, Human
cacuauguugcccaggc

SEQ ID NO: 2062368 - RNA, 16 nt, Human
cacuauguugcccagg

SEQ ID NO: 2062369 - RNA, 14 nt, Human
cacuaugaagaugu

SEQ ID NO: 2062370 - RNA, 21 nt, Human
cacuaugaagauguuucaaaa

SEQ ID NO: 2062371 - RNA, 15 nt, Human
cacuauguugcccag

SEQ ID NO: 2062372 - RNA, 17 nt, Human
cacuaugguauuugagu

SEQ ID NO: 2062373 - RNA, 12 nt, Human
cacuaugcauuu

SEQ ID NO: 2062374 - RNA, 14 nt, Human
cacuaugcauuuua

SEQ ID NO: 2062375 - RNA, 15 nt, Human
cacuaugcauuuuaa

SEQ ID NO: 2062376 - RNA, 17 nt, Human
cacuaugaagcuaccuc

SEQ ID NO: 2062377 - RNA, 21 nt, Human
cacuauguugcccaggcaggu

SEQ ID NO: 2062378 - RNA, 20 nt, Human
cacuauguugcccaggcagg

SEQ ID NO: 2062379 - RNA, 19 nt, Human
cacuauuuaucugugcaaa

SEQ ID NO: 2062380 - RNA, 12 nt, Human
cacuauuuucag

SEQ ID NO: 2062381 - RNA, 13 nt, Human
cacuauuuucaga

SEQ ID NO: 2062382 - RNA, 14 nt, Human
cacuauuuucagaa

SEQ ID NO: 2062383 - RNA, 16 nt, Human
cacuauuuucagaauc

SEQ ID NO: 2062384 - RNA, 17 nt, Human
cacuauuuucagaaucu

SEQ ID NO: 2062385 - RNA, 18 nt, Human
cacuauuuucagaaucug

SEQ ID NO: 2062386 - RNA, 20 nt, Human
cacuauuuucagaaucugaa

SEQ ID NO: 2062387 - RNA, 21 nt, Human
cacuauuuucagaaucugaau

SEQ ID NO: 2062388 - RNA, 17 nt, Human
cacuauuuuuauuuaua

SEQ ID NO: 2062389 - RNA, 22 nt, Human
cacuauuuuuauuuauauuuuu

SEQ ID NO: 2062390 - RNA, 15 nt, Human
cacucaaaagcuggg

SEQ ID NO: 2062391 - RNA, 17 nt, Human
cacucaaaagcugggca

SEQ ID NO: 2062392 - RNA, 18 nt, Human
cacucaaaagcugggcag

SEQ ID NO: 2062393 - RNA, 19 nt, Human
cacucaaaagcugggcagg

SEQ ID NO: 2062394 - RNA, 12 nt, Human
cacucaagccaa

SEQ ID NO: 2062395 - RNA, 16 nt, Human
cacucaaguucaagga

SEQ ID NO: 2062396 - RNA, 18 nt, Human
cacucaaguucaaggacc

SEQ ID NO: 2062397 - RNA, 19 nt, Human
cacucaaguucaaggacca

SEQ ID NO: 2062398 - RNA, 16 nt, Human
cacucaagccaagcag

SEQ ID NO: 2062399 - RNA, 18 nt, Human
cacucaagccaagcagcc

SEQ ID NO: 2062400 - RNA, 17 nt, Human
cacucacaacagcugcc

SEQ ID NO: 2062401 - RNA, 20 nt, Human
cacucaaaagcugggcaggu

SEQ ID NO: 2062402 - RNA, 22 nt, Human
cacucaacaaaagugcuuugga

SEQ ID NO: 2062403 - RNA, 23 nt, Human
cacuauuuuuauuuauauuuuug

SEQ ID NO: 2062404 - RNA, 17 nt, Human
cacucagaagacacuga

SEQ ID NO: 2062405 - RNA, 16 nt, Human
cacucagaagacacug

SEQ ID NO: 2062406 - RNA, 12 nt, Human
cacucagaagac

SEQ ID NO: 2062407 - RNA, 20 nt, Human
cacucacauuuauucugcuc

SEQ ID NO: 2062408 - RNA, 19 nt, Human
cacucacauuuauucugcu

SEQ ID NO: 2062409 - RNA, 17 nt, Human
cacucacagagacacag

SEQ ID NO: 2062410 - RNA, 18 nt, Human
cacucacagagacacagg

SEQ ID NO: 2062411 - RNA, 12 nt, Human
cacucacaugcu

SEQ ID NO: 2062412 - RNA, 14 nt, Human
cacucacaugcugg

SEQ ID NO: 2062413 - RNA, 23 nt, Human
cacucacaugcuggacaggucug

SEQ ID NO: 2062414 - RNA, 19 nt, Human
cacucagaagacacugaug

SEQ ID NO: 2062415 - RNA, 18 nt, Human
cacucagaagacacugau

SEQ ID NO: 2062416 - RNA, 15 nt, Human
cacucacuggcaucu

SEQ ID NO: 2062417 - RNA, 22 nt, Human
cacucagaagacacugaugggc

SEQ ID NO: 2062418 - RNA, 14 nt, Human
cacucagcaccccc

SEQ ID NO: 2062419 - RNA, 21 nt, Human
cacucagcacccccuucucug

SEQ ID NO: 2062420 - RNA, 13 nt, Human
cacgccacugcac

SEQ ID NO: 2062421 - RNA, 15 nt, Human
cacgccacugcacua

SEQ ID NO: 2062422 - RNA, 14 nt, Human
cacgcccaugugug

SEQ ID NO: 2062423 - RNA, 15 nt, Human
cacgcccauguguga

SEQ ID NO: 2062424 - RNA, 23 nt, Human
cacgcccaugugugagugugugc

SEQ ID NO: 2062425 - RNA, 14 nt, Human
cacgccacugcacu

SEQ ID NO: 2062426 - RNA, 22 nt, Human
cacgccacugcacuccagccug

SEQ ID NO: 2062427 - RNA, 20 nt, Human
cacgcccucauuacggcucc

SEQ ID NO: 2062428 - RNA, 23 nt, Human
cacgagcaaagugaagacacugg

SEQ ID NO: 2062429 - RNA, 12 nt, Human
cacgaugaaaaa

SEQ ID NO: 2062430 - RNA, 20 nt, Human
cacgauaaauaaucggccca

SEQ ID NO: 2062431 - RNA, 15 nt, Human
cacgaugaaaaacuu

SEQ ID NO: 2062432 - RNA, 14 nt, Human
cacgauguggcccu

SEQ ID NO: 2062433 - RNA, 15 nt, Human
cacgauguggcccug

SEQ ID NO: 2062434 - RNA, 16 nt, Human
cacgauguggcccugg

SEQ ID NO: 2062435 - RNA, 17 nt, Human
cacgauguggcccuggc

SEQ ID NO: 2062436 - RNA, 18 nt, Human
cacgauguggcccuggcc

SEQ ID NO: 2062437 - RNA, 22 nt, Human
cacgauguggcccuggccugcu

SEQ ID NO: 2062438 - RNA, 18 nt, Human
caccuugaacaccacgcu

SEQ ID NO: 2062439 - RNA, 17 nt, Human
cacgcacuucgggaggu

SEQ ID NO: 2062440 - RNA, 22 nt, Human
cacgcacacacacacacaggag

SEQ ID NO: 2062441 - RNA, 14 nt, Human
cacgcaccucccau

SEQ ID NO: 2062442 - RNA, 15 nt, Human
cacgcaccucccauc

SEQ ID NO: 2062443 - RNA, 19 nt, Human
cacgcaccucccauccuaa

SEQ ID NO: 2062444 - RNA, 12 nt, Human
cacgcaccuccc

SEQ ID NO: 2062445 - RNA, 15 nt, Human
cacgcacacacacac

SEQ ID NO: 2062446 - RNA, 20 nt, Human
cacgcacacacacacacagg

SEQ ID NO: 2062447 - RNA, 15 nt, Human
cacgcacacugucug

SEQ ID NO: 2062448 - RNA, 21 nt, Human
cacgauguggcccuggccugc

SEQ ID NO: 2062449 - RNA, 14 nt, Human
cacgcacacacaca

SEQ ID NO: 2062450 - RNA, 22 nt, Human
caccuugaagaaccucucacuu

SEQ ID NO: 2062451 - RNA, 18 nt, Human
caccuugacagggcacac

SEQ ID NO: 2062452 - RNA, 16 nt, Human
caccuugacagggcac

SEQ ID NO: 2062453 - RNA, 15 nt, Human
caccuugacagggca

SEQ ID NO: 2062454 - RNA, 14 nt, Human
caccuucccaugcc

SEQ ID NO: 2062455 - RNA, 13 nt, Human
caccuucccaugc

SEQ ID NO: 2062456 - RNA, 17 nt, Human
caccuucccagcucucc

SEQ ID NO: 2062457 - RNA, 19 nt, Human
caccuucccagcucucccu

SEQ ID NO: 2062458 - RNA, 21 nt, Human
caccuucccagcucucccucu

SEQ ID NO: 2062459 - RNA, 22 nt, Human
caccuucccagcucucccucug

SEQ ID NO: 2062460 - RNA, 13 nt, Human
caccuugacaggg

SEQ ID NO: 2062461 - RNA, 17 nt, Human
cacgacugcccggcagg

SEQ ID NO: 2062462 - RNA, 16 nt, Human
cacgacugcccggcag

SEQ ID NO: 2062463 - RNA, 14 nt, Human
cacgaacccaccug

SEQ ID NO: 2062464 - RNA, 16 nt, Human
cacgaacccaccugcu

SEQ ID NO: 2062465 - RNA, 18 nt, Human
cacgaacccaccugcuga

SEQ ID NO: 2062466 - RNA, 22 nt, Human
cacgaacccaccugcugagaga

SEQ ID NO: 2062467 - RNA, 12 nt, Human
caccuucccagc

SEQ ID NO: 2062468 - RNA, 13 nt, Human
caccuucccagcu

SEQ ID NO: 2062469 - RNA, 15 nt, Human
caccuucccagcucu

SEQ ID NO: 2062470 - RNA, 20 nt, Human
caccuucagaggcugaggug

SEQ ID NO: 2062471 - RNA, 19 nt, Human
caccuucaauuccugggcc

SEQ ID NO: 2062472 - RNA, 15 nt, Human
caccuuaucuuaaag

SEQ ID NO: 2062473 - RNA, 19 nt, Human
caccuuaucuuaaagcacu

SEQ ID NO: 2062474 - RNA, 17 nt, Human
caccuucaauuccuggg

SEQ ID NO: 2062475 - RNA, 18 nt, Human
caccuucaauuccugggc

SEQ ID NO: 2062476 - RNA, 15 nt, Human
caccuuauauuuacg

SEQ ID NO: 2062477 - RNA, 18 nt, Human
caccuuaggcagggaagu

SEQ ID NO: 2062478 - RNA, 13 nt, Human
caccuuaggcagg

SEQ ID NO: 2062479 - RNA, 14 nt, Human
caccuuaggcaggg

SEQ ID NO: 2062480 - RNA, 17 nt, Human
caccuuaggcagggaag

SEQ ID NO: 2062481 - RNA, 20 nt, Human
caccuguuuuuaagcuguuu

SEQ ID NO: 2062482 - RNA, 13 nt, Human
caccuuaaauuaa

SEQ ID NO: 2062483 - RNA, 14 nt, Human
caccuuaaauuaaa

SEQ ID NO: 2062484 - RNA, 15 nt, Human
caccuuaaauuaaac

SEQ ID NO: 2062485 - RNA, 16 nt, Human
caccuuaaauuaaaca

SEQ ID NO: 2062486 - RNA, 18 nt, Human
caccuuaaauuaaacaau

SEQ ID NO: 2062487 - RNA, 22 nt, Human
caccuuaaauuaaacaauuuau

SEQ ID NO: 2062488 - RNA, 19 nt, Human
caccuguuuuuaagcuguu

SEQ ID NO: 2062489 - RNA, 20 nt, Human
caccugugaguuuaaagcaa

SEQ ID NO: 2062490 - RNA, 19 nt, Human
caccugugaguuuaaagca

SEQ ID NO: 2062491 - RNA, 15 nt, Human
cacgggagauuucuu

SEQ ID NO: 2062492 - RNA, 20 nt, Human
cacggcucacugcagccuca

SEQ ID NO: 2062493 - RNA, 19 nt, Human
cacggcucacugcagccuc

SEQ ID NO: 2062494 - RNA, 17 nt, Human
cacggcucacugcagcc

SEQ ID NO: 2062495 - RNA, 16 nt, Human
cacggcucacugcagc

SEQ ID NO: 2062496 - RNA, 17 nt, Human
cacgcuggaccuugaac

SEQ ID NO: 2062497 - RNA, 20 nt, Human
cacgcuggaccuugaacugg

SEQ ID NO: 2062498 - RNA, 21 nt, Human
cacgcgugcacacaccagagc

SEQ ID NO: 2062499 - RNA, 16 nt, Human
cacgcgugcacacacc

SEQ ID NO: 2062500 - RNA, 15 nt, Human
cacgcgugcacacac

SEQ ID NO: 2062501 - RNA, 20 nt, Human
cacgccuguaaucccagcac

SEQ ID NO: 2062502 - RNA, 21 nt, Human
cacgccuguaaucccagcacu

SEQ ID NO: 2062503 - RNA, 12 nt, Human
cacgccugugca

SEQ ID NO: 2062504 - RNA, 23 nt, Human
cacgcgugcacacaccagagccc

SEQ ID NO: 2062505 - RNA, 22 nt, Human
cacgcuaaucccgauucacccu

SEQ ID NO: 2062506 - RNA, 20 nt, Human
cacgccuguaaucccagcag

SEQ ID NO: 2062507 - RNA, 21 nt, Human
cacgccuguaaucccagcagu

SEQ ID NO: 2062508 - RNA, 18 nt, Human
cacgccuguaaucccagc

SEQ ID NO: 2062509 - RNA, 19 nt, Human
cacgccuguaaucccagca

SEQ ID NO: 2062510 - RNA, 16 nt, Human
cacgccuguaauccca

SEQ ID NO: 2062511 - RNA, 14 nt, Human
cacgccuguaaucc

SEQ ID NO: 2062512 - RNA, 19 nt, Human
cacgccuguaauccuagca

SEQ ID NO: 2062513 - RNA, 20 nt, Human
cacgccuguaauccuagcac

SEQ ID NO: 2062514 - RNA, 18 nt, Human
cacgccuaugaucccagc

SEQ ID NO: 2062515 - RNA, 19 nt, Human
cacgccuaugaucccagca

SEQ ID NO: 2062516 - RNA, 21 nt, Human
cacgccuaugaucccagcacu

SEQ ID NO: 2062517 - RNA, 22 nt, Human
cacgccuaugaucccagcacuu

SEQ ID NO: 2062518 - RNA, 18 nt, Human
cacgugguaaaacacuug

SEQ ID NO: 2062519 - RNA, 13 nt, Human
cacguucaccccu

SEQ ID NO: 2062520 - RNA, 19 nt, Human
cacguuccuuacugcagaa

SEQ ID NO: 2062521 - RNA, 20 nt, Human
cacguuccuucccccgcaau

SEQ ID NO: 2062522 - RNA, 21 nt, Human
cacgugcagcagcaacacaau

SEQ ID NO: 2062523 - RNA, 11 nt, Human
cacguguguga

SEQ ID NO: 2062524 - RNA, 12 nt, Human
cacgugugugac

SEQ ID NO: 2062525 - RNA, 16 nt, Human
cacgugugugacucag

SEQ ID NO: 2062526 - RNA, 12 nt, Human
cacuaaagcagu

SEQ ID NO: 2062527 - RNA, 21 nt, Human
cacuaaagcaggccuuuugau

SEQ ID NO: 2062528 - RNA, 15 nt, Human
cacguucucucugcc

SEQ ID NO: 2062529 - RNA, 16 nt, Human
cacgucugacccucuc

SEQ ID NO: 2062530 - RNA, 17 nt, Human
cacgucugacccucucc

SEQ ID NO: 2062531 - RNA, 18 nt, Human
cacgucugacccucucca

SEQ ID NO: 2062532 - RNA, 14 nt, Human
cacgucugucuuca

SEQ ID NO: 2062533 - RNA, 15 nt, Human
cacgucugucuucac

SEQ ID NO: 2062534 - RNA, 18 nt, Human
cacgugacagugccuggg

SEQ ID NO: 2062535 - RNA, 13 nt, Human
cacgugccaggcc

SEQ ID NO: 2062536 - RNA, 14 nt, Human
cacgugccaggccc

SEQ ID NO: 2062537 - RNA, 15 nt, Human
cacgugccaggcccg

SEQ ID NO: 2062538 - RNA, 15 nt, Human
cacguggcuucugau

SEQ ID NO: 2062539 - RNA, 16 nt, Human
cacguggcuucugaug

SEQ ID NO: 2062540 - RNA, 21 nt, Human
cacguggcuucugaugaaucu

SEQ ID NO: 2062541 - RNA, 16 nt, Human
cacgugccaggcccgg

SEQ ID NO: 2062542 - RNA, 13 nt, Human
cacguggagagcu

SEQ ID NO: 2062543 - RNA, 15 nt, Human
cacguggagagcugg

SEQ ID NO: 2062544 - RNA, 23 nt, Human
cacguggagagcuggugcccgga

SEQ ID NO: 2062545 - RNA, 20 nt, Human
cacguggaggaaugcucccc

SEQ ID NO: 2062546 - RNA, 17 nt, Human
cacgucauguuucuuca

SEQ ID NO: 2062547 - RNA, 16 nt, Human
cacguacuuaaaugaa

SEQ ID NO: 2062548 - RNA, 23 nt, Human
cacguagcccccaggcugcugga

SEQ ID NO: 2062549 - RNA, 17 nt, Human
cacguaguagggucagg

SEQ ID NO: 2062550 - RNA, 19 nt, Human
cacguaguagggucaggcc

SEQ ID NO: 2062551 - RNA, 20 nt, Human
cacguaguagggucaggcca

SEQ ID NO: 2062552 - RNA, 21 nt, Human
cacguaguagggucaggccac

SEQ ID NO: 2062553 - RNA, 23 nt, Human
cacguaguagggucaggccacgg

SEQ ID NO: 2062554 - RNA, 14 nt, Human
cacguacacacaca

SEQ ID NO: 2062555 - RNA, 19 nt, Human
cacguacacacacauacac

SEQ ID NO: 2062556 - RNA, 18 nt, Human
cacguacacacacauaca

SEQ ID NO: 2062557 - RNA, 20 nt, Human
caccccucaacaccucugca

SEQ ID NO: 2062558 - RNA, 15 nt, Human
caccccuccccugcc

SEQ ID NO: 2062559 - RNA, 22 nt, Human
caccccuccccugcccuagagc

SEQ ID NO: 2062560 - RNA, 12 nt, Human
caccccuccuuc

SEQ ID NO: 2062561 - RNA, 14 nt, Human
caccccuccuuccu

SEQ ID NO: 2062562 - RNA, 23 nt, Human
caccccuccuuccuugaccagca

SEQ ID NO: 2062563 - RNA, 15 nt, Human
caccccugcccuggg

SEQ ID NO: 2062564 - RNA, 16 nt, Human
caccccugcccuggga

SEQ ID NO: 2062565 - RNA, 24 nt, Human
caccccugcccugggauguccaca

SEQ ID NO: 2062566 - RNA, 14 nt, Human
cacccgacuccuca

SEQ ID NO: 2062567 - RNA, 15 nt, Human
cacccgacuccucaa

SEQ ID NO: 2062568 - RNA, 16 nt, Human
cacccgacuccucaaa

SEQ ID NO: 2062569 - RNA, 12 nt, Human
cacccgaggcug

SEQ ID NO: 2062570 - RNA, 15 nt, Human
cacccgaggcugccc

SEQ ID NO: 2062571 - RNA, 16 nt, Human
cacccgaggcugccca

SEQ ID NO: 2062572 - RNA, 17 nt, Human
cacccgaggcugcccac

SEQ ID NO: 2062573 - RNA, 18 nt, Human
cacccgaggcugcccacu

SEQ ID NO: 2062574 - RNA, 14 nt, Human
caccccuuccccac

SEQ ID NO: 2062575 - RNA, 15 nt, Human
caccccuuccccacu

SEQ ID NO: 2062576 - RNA, 18 nt, Human
caccccuuccccacugcc

SEQ ID NO: 2062577 - RNA, 11 nt, Human
caccccuuccc

SEQ ID NO: 2062578 - RNA, 12 nt, Human
caccccuucccc

SEQ ID NO: 2062579 - RNA, 13 nt, Human
caccccuucccca

SEQ ID NO: 2062580 - RNA, 21 nt, Human
cacccggccccugcugguuca

SEQ ID NO: 2062581 - RNA, 18 nt, Human
cacccggccccugcuggu

SEQ ID NO: 2062582 - RNA, 17 nt, Human
cacccggccccugcugg

SEQ ID NO: 2062583 - RNA, 16 nt, Human
cacccggccccugcug

SEQ ID NO: 2062584 - RNA, 14 nt, Human
cacccggccccugc

SEQ ID NO: 2062585 - RNA, 13 nt, Human
cacccggccccug

SEQ ID NO: 2062586 - RNA, 12 nt, Human
cacccggccccu

SEQ ID NO: 2062587 - RNA, 16 nt, Human
cacccguggagauggg

SEQ ID NO: 2062588 - RNA, 17 nt, Human
cacccguggagauggga

SEQ ID NO: 2062589 - RNA, 20 nt, Human
cacccuaauguggcagcugu

SEQ ID NO: 2062590 - RNA, 16 nt, Human
cacccuagucccuucc

SEQ ID NO: 2062591 - RNA, 17 nt, Human
cacccuagucccuuccc

SEQ ID NO: 2062592 - RNA, 18 nt, Human
cacccuagucccuucccc

SEQ ID NO: 2062593 - RNA, 20 nt, Human
cacccuagucccuuccccuc

SEQ ID NO: 2062594 - RNA, 20 nt, Human
cacccucagaugcacaugag

SEQ ID NO: 2062595 - RNA, 22 nt, Human
cacccuuggaggcugucuucuc

SEQ ID NO: 2062596 - RNA, 21 nt, Human
cacccuuggccugucucaucc

SEQ ID NO: 2062597 - RNA, 23 nt, Human
cacccuuggccugucucaucccc

SEQ ID NO: 2062598 - RNA, 13 nt, Human
caccgagaauguu

SEQ ID NO: 2062599 - RNA, 18 nt, Human
caccgagaguagccgaga

SEQ ID NO: 2062600 - RNA, 17 nt, Human
cacccuuggaggcuguc

SEQ ID NO: 2062601 - RNA, 19 nt, Human
cacccuuggaggcugucuu

SEQ ID NO: 2062602 - RNA, 20 nt, Human
cacccuuggaggcugucuuc

SEQ ID NO: 2062603 - RNA, 21 nt, Human
cacccuuggaggcugucuucu

SEQ ID NO: 2062604 - RNA, 12 nt, Human
cacccuuggccu

SEQ ID NO: 2062605 - RNA, 13 nt, Human
cacccuuggccug

SEQ ID NO: 2062606 - RNA, 15 nt, Human
cacccuuggccuguc

SEQ ID NO: 2062607 - RNA, 18 nt, Human
cacccuuggccugucuca

SEQ ID NO: 2062608 - RNA, 13 nt, Human
cacccuuccccuc

SEQ ID NO: 2062609 - RNA, 14 nt, Human
cacccuuccccucc

SEQ ID NO: 2062610 - RNA, 22 nt, Human
cacccuuccccuccuucucccu

SEQ ID NO: 2062611 - RNA, 23 nt, Human
cacccuuccccuccuucucccuu

SEQ ID NO: 2062612 - RNA, 22 nt, Human
caccugcaccuccccccacugc

SEQ ID NO: 2062613 - RNA, 17 nt, Human
caccugcaccucccccc

SEQ ID NO: 2062614 - RNA, 19 nt, Human
caccugcaccuccccccac

SEQ ID NO: 2062615 - RNA, 11 nt, Human
caccugcaccu

SEQ ID NO: 2062616 - RNA, 13 nt, Human
caccugcaccucc

SEQ ID NO: 2062617 - RNA, 14 nt, Human
caccugcaccuccc

SEQ ID NO: 2062618 - RNA, 15 nt, Human
caccugcaccucccc

SEQ ID NO: 2062619 - RNA, 10 nt, Human
caccugagcu

SEQ ID NO: 2062620 - RNA, 14 nt, Human
caccugagcuuugg

SEQ ID NO: 2062621 - RNA, 16 nt, Human
caccugagcuuuggac

SEQ ID NO: 2062622 - RNA, 18 nt, Human
caccugagcuuuggacac

SEQ ID NO: 2062623 - RNA, 20 nt, Human
caccugagcuuuggacgcac

SEQ ID NO: 2062624 - RNA, 21 nt, Human
caccugagcccggaugcuucu

SEQ ID NO: 2062625 - RNA, 23 nt, Human
caccugagcccggaugcuucucc

SEQ ID NO: 2062626 - RNA, 18 nt, Human
caccugagguuaggaguu

SEQ ID NO: 2062627 - RNA, 14 nt, Human
caccugcaggucac

SEQ ID NO: 2062628 - RNA, 22 nt, Human
caccugcauccguaguucccug

SEQ ID NO: 2062629 - RNA, 22 nt, Human
caccugcuggccccucaccugg

SEQ ID NO: 2062630 - RNA, 22 nt, Human
caccuggaagcccucucuggcu

SEQ ID NO: 2062631 - RNA, 13 nt, Human
caccugcuggccc

SEQ ID NO: 2062632 - RNA, 14 nt, Human
caccugcuggcccc

SEQ ID NO: 2062633 - RNA, 15 nt, Human
caccugcuggccccu

SEQ ID NO: 2062634 - RNA, 16 nt, Human
caccugcuggccccuc

SEQ ID NO: 2062635 - RNA, 17 nt, Human
caccugcuggccccuca

SEQ ID NO: 2062636 - RNA, 18 nt, Human
caccugcuggccccucac

SEQ ID NO: 2062637 - RNA, 20 nt, Human
caccugcuggccccucaccu

SEQ ID NO: 2062638 - RNA, 17 nt, Human
caccugcugauguggca

SEQ ID NO: 2062639 - RNA, 13 nt, Human
caccugcugcugc

SEQ ID NO: 2062640 - RNA, 18 nt, Human
caccugcugagagaccca

SEQ ID NO: 2062641 - RNA, 19 nt, Human
caccugcugagagacccaa

SEQ ID NO: 2062642 - RNA, 22 nt, Human
caccugcugagagacccaagga

SEQ ID NO: 2062643 - RNA, 15 nt, Human
caccugaagacucau

SEQ ID NO: 2062644 - RNA, 14 nt, Human
caccugaagacuca

SEQ ID NO: 2062645 - RNA, 23 nt, Human
caccugaagacucauucuucugu

SEQ ID NO: 2062646 - RNA, 18 nt, Human
caccucuuaugcacaccu

SEQ ID NO: 2062647 - RNA, 13 nt, Human
caccucuggacug

SEQ ID NO: 2062648 - RNA, 17 nt, Human
caccucuggacuggcua

SEQ ID NO: 2062649 - RNA, 18 nt, Human
caccucuggacuggcuag

SEQ ID NO: 2062650 - RNA, 19 nt, Human
caccucuggacuggcuaga

SEQ ID NO: 2062651 - RNA, 18 nt, Human
caccucugcacaagcugc

SEQ ID NO: 2062652 - RNA, 19 nt, Human
caccucugcacaagcugca

SEQ ID NO: 2062653 - RNA, 14 nt, Human
caccucugccucaa

SEQ ID NO: 2062654 - RNA, 13 nt, Human
caccucugccuca

SEQ ID NO: 2062655 - RNA, 11 nt, Human
caccugggcac

SEQ ID NO: 2062656 - RNA, 13 nt, Human
caccuggcccugg

SEQ ID NO: 2062657 - RNA, 14 nt, Human
caccuggcccuggg

SEQ ID NO: 2062658 - RNA, 16 nt, Human
caccuggcccuggggc

SEQ ID NO: 2062659 - RNA, 17 nt, Human
caccuggcccuggggcc

SEQ ID NO: 2062660 - RNA, 19 nt, Human
caccuggcccuggggccug

SEQ ID NO: 2062661 - RNA, 20 nt, Human
caccuggccccaugucucuc

SEQ ID NO: 2062662 - RNA, 22 nt, Human
caccuggccccaugucucucag

SEQ ID NO: 2062663 - RNA, 11 nt, Human
caccuggcccc

SEQ ID NO: 2062664 - RNA, 14 nt, Human
caccuggccccaug

SEQ ID NO: 2062665 - RNA, 15 nt, Human
caccuggccccaugu

SEQ ID NO: 2062666 - RNA, 16 nt, Human
caccuggccccauguc

SEQ ID NO: 2062667 - RNA, 19 nt, Human
caccugucucagccuccca

SEQ ID NO: 2062668 - RNA, 15 nt, Human
caccugucgcccagu

SEQ ID NO: 2062669 - RNA, 17 nt, Human
caccugucgcccagugc

SEQ ID NO: 2062670 - RNA, 18 nt, Human
caccugucgcccagugcc

SEQ ID NO: 2062671 - RNA, 15 nt, Human
caccugucucagccu

SEQ ID NO: 2062672 - RNA, 17 nt, Human
caccugucucagccucc

SEQ ID NO: 2062673 - RNA, 18 nt, Human
caccugucucagccuccc

SEQ ID NO: 2062674 - RNA, 23 nt, Human
caccugucaaacaaagccagaag

SEQ ID NO: 2062675 - RNA, 13 nt, Human
caccugucccacc

SEQ ID NO: 2062676 - RNA, 14 nt, Human
caccugucccaccu

SEQ ID NO: 2062677 - RNA, 15 nt, Human
caccugucccaccuc

SEQ ID NO: 2062678 - RNA, 16 nt, Human
caccugucccaccuca

SEQ ID NO: 2062679 - RNA, 14 nt, Human
caccuguacuggag

SEQ ID NO: 2062680 - RNA, 15 nt, Human
caccuguacuggaga

SEQ ID NO: 2062681 - RNA, 16 nt, Human
caccuguacuggagag

SEQ ID NO: 2062682 - RNA, 17 nt, Human
caccuguacuggagagc

SEQ ID NO: 2062683 - RNA, 23 nt, Human
caccuguacucaggaggcugagg

SEQ ID NO: 2062684 - RNA, 11 nt, Human
caccuggcccu

SEQ ID NO: 2062685 - RNA, 15 nt, Human
caccuguacucagga

SEQ ID NO: 2062686 - RNA, 16 nt, Human
caccuguacucaggag

SEQ ID NO: 2062687 - RNA, 22 nt, Human
caccuguacucaggaggcugag

SEQ ID NO: 2062688 - RNA, 15 nt, Human
caccuguagucccag

SEQ ID NO: 2062689 - RNA, 16 nt, Human
caccuguagucccagc

SEQ ID NO: 2062690 - RNA, 18 nt, Human
caccuguagucccagcua

SEQ ID NO: 2062691 - RNA, 20 nt, Human
caccuguagucccagcuacu

SEQ ID NO: 2062692 - RNA, 19 nt, Human
caccuguagucccagcuac

SEQ ID NO: 2062693 - RNA, 13 nt, Human
caccugucaaaca

SEQ ID NO: 2062694 - RNA, 20 nt, Human
caccugucaaacaaagccag

SEQ ID NO: 2062695 - RNA, 21 nt, Human
caccugucaaacaaagccaga

SEQ ID NO: 2062696 - RNA, 23 nt, Human
caccuggggcagucaccugccca

SEQ ID NO: 2062697 - RNA, 10 nt, Human
caccuggggu

SEQ ID NO: 2062698 - RNA, 18 nt, Human
caccuggggugugggagg

SEQ ID NO: 2062699 - RNA, 22 nt, Human
caccuggggugugggaggcccg

SEQ ID NO: 2062700 - RNA, 14 nt, Human
caccuggggagugg

SEQ ID NO: 2062701 - RNA, 15 nt, Human
caccuggggaguggg

SEQ ID NO: 2062702 - RNA, 17 nt, Human
caccuggggagugggac

SEQ ID NO: 2062703 - RNA, 22 nt, Human
caccuggggagugggacagagu

SEQ ID NO: 2062704 - RNA, 14 nt, Human
caccuggggcaguc

SEQ ID NO: 2062705 - RNA, 15 nt, Human
caccuggggcaguca

SEQ ID NO: 2062706 - RNA, 19 nt, Human
caccuggggcagucaccug

SEQ ID NO: 2062707 - RNA, 20 nt, Human
caccuggggcagucaccugc

SEQ ID NO: 2062708 - RNA, 12 nt, Human
caccugggcacc

SEQ ID NO: 2062709 - RNA, 15 nt, Human
caccugggcaccugg

SEQ ID NO: 2062710 - RNA, 19 nt, Human
caccugggcaccuggggag

SEQ ID NO: 2062711 - RNA, 21 nt, Human
caccuguaaucccagcuacuu

SEQ ID NO: 2062712 - RNA, 18 nt, Human
caccuguaaucccagcac

SEQ ID NO: 2062713 - RNA, 16 nt, Human
caccuguaaucccagc

SEQ ID NO: 2062714 - RNA, 13 nt, Human
caccuguaaaacu

SEQ ID NO: 2062715 - RNA, 15 nt, Human
caccuguaaaacuuu

SEQ ID NO: 2062716 - RNA, 17 nt, Human
caccuguaaaacuuuau

SEQ ID NO: 2062717 - RNA, 23 nt, Human
caccuguaaaacuuuauuuuaua

SEQ ID NO: 2062718 - RNA, 20 nt, Human
caccuggggugugggaggcc

SEQ ID NO: 2062719 - RNA, 15 nt, Human
caccugguggccucu

SEQ ID NO: 2062720 - RNA, 17 nt, Human
caccugguggccucugc

SEQ ID NO: 2062721 - RNA, 16 nt, Human
caccugguuccggaau

SEQ ID NO: 2062722 - RNA, 20 nt, Human
caccugguuccggaauccug

SEQ ID NO: 2062723 - RNA, 21 nt, Human
caccugguuccggaauccugu

SEQ ID NO: 2062724 - RNA, 23 nt, Human
caccugguuccggaauccugucc

SEQ ID NO: 2062725 - RNA, 13 nt, Human
caccgggccugga

SEQ ID NO: 2062726 - RNA, 18 nt, Human
caccgggccacagagaaa

SEQ ID NO: 2062727 - RNA, 15 nt, Human
caccgggccacagag

SEQ ID NO: 2062728 - RNA, 22 nt, Human
caccgggcacucagaagacacu

SEQ ID NO: 2062729 - RNA, 15 nt, Human
caccgggcacucaga

SEQ ID NO: 2062730 - RNA, 15 nt, Human
caccguggcuaagag

SEQ ID NO: 2062731 - RNA, 15 nt, Human
caccgguugcuucug

SEQ ID NO: 2062732 - RNA, 17 nt, Human
caccgguugcuucuggg

SEQ ID NO: 2062733 - RNA, 18 nt, Human
caccgguugcuucuggga

SEQ ID NO: 2062734 - RNA, 19 nt, Human
caccgguugcuucugggaa

SEQ ID NO: 2062735 - RNA, 21 nt, Human
caccgguugcuucugggaagg

SEQ ID NO: 2062736 - RNA, 19 nt, Human
caccguaaagugagcaugc

SEQ ID NO: 2062737 - RNA, 20 nt, Human
caccguaaagugagcaugcu

SEQ ID NO: 2062738 - RNA, 11 nt, Human
caccucaguuc

SEQ ID NO: 2062739 - RNA, 17 nt, Human
caccucaguucccuugg

SEQ ID NO: 2062740 - RNA, 18 nt, Human
caccucaguucccuuggc

SEQ ID NO: 2062741 - RNA, 19 nt, Human
caccucaguucccuuggcc

SEQ ID NO: 2062742 - RNA, 20 nt, Human
caccucaguucccuuggccu

SEQ ID NO: 2062743 - RNA, 21 nt, Human
caccucaguucccuuggccuc

SEQ ID NO: 2062744 - RNA, 22 nt, Human
caccucaguucccuuggccuca

SEQ ID NO: 2062745 - RNA, 23 nt, Human
caccucaguucccuuggccucag

SEQ ID NO: 2062746 - RNA, 15 nt, Human
caccggauccugggu

SEQ ID NO: 2062747 - RNA, 21 nt, Human
caccggauccuggguggucug

SEQ ID NO: 2062748 - RNA, 22 nt, Human
caccggauccuggguggucugc

SEQ ID NO: 2062749 - RNA, 14 nt, Human
caccgggcacucag

SEQ ID NO: 2062750 - RNA, 21 nt, Human
caccgagaguagccgagagcc

SEQ ID NO: 2062751 - RNA, 13 nt, Human
caccgcuccccag

SEQ ID NO: 2062752 - RNA, 18 nt, Human
caccgccggccagcuggg

SEQ ID NO: 2062753 - RNA, 19 nt, Human
caccgccggccagcuggga

SEQ ID NO: 2062754 - RNA, 22 nt, Human
caccggagcuuucaaagaagga

SEQ ID NO: 2062755 - RNA, 22 nt, Human
caccgcugccuaaguggcugcu

SEQ ID NO: 2062756 - RNA, 19 nt, Human
caccgcugccuaaguggcu

SEQ ID NO: 2062757 - RNA, 14 nt, Human
caccgcuccccagc

SEQ ID NO: 2062758 - RNA, 16 nt, Human
caccgcuccccagccc

SEQ ID NO: 2062759 - RNA, 17 nt, Human
caccgcuccccagccca

SEQ ID NO: 2062760 - RNA, 18 nt, Human
caccgcuccccagcccag

SEQ ID NO: 2062761 - RNA, 20 nt, Human
caccgcuccccagcccaggg

SEQ ID NO: 2062762 - RNA, 21 nt, Human
caccgcuccccagcccagggu

SEQ ID NO: 2062763 - RNA, 12 nt, Human
caccgcugccua

SEQ ID NO: 2062764 - RNA, 13 nt, Human
caccgcugccuaa

SEQ ID NO: 2062765 - RNA, 14 nt, Human
caccuccccccacu

SEQ ID NO: 2062766 - RNA, 15 nt, Human
caccuccccccacug

SEQ ID NO: 2062767 - RNA, 16 nt, Human
caccuccccccacugc

SEQ ID NO: 2062768 - RNA, 17 nt, Human
caccuccccccacugca

SEQ ID NO: 2062769 - RNA, 18 nt, Human
caccuccccccacugcag

SEQ ID NO: 2062770 - RNA, 21 nt, Human
caccuccccccacugcaggcc

SEQ ID NO: 2062771 - RNA, 22 nt, Human
caccuccccccacugcaggccc

SEQ ID NO: 2062772 - RNA, 23 nt, Human
caccuccccccacugcaggcccc

SEQ ID NO: 2062773 - RNA, 13 nt, Human
caccuccccuauc

SEQ ID NO: 2062774 - RNA, 14 nt, Human
caccuccccuaucc

SEQ ID NO: 2062775 - RNA, 18 nt, Human
caccuccccuauccaccc

SEQ ID NO: 2062776 - RNA, 14 nt, Human
caccuccccagccu

SEQ ID NO: 2062777 - RNA, 21 nt, Human
caccuccccaggccguggcug

SEQ ID NO: 2062778 - RNA, 14 nt, Human
caccuccccaggcc

SEQ ID NO: 2062779 - RNA, 15 nt, Human
caccuccccaggccg

SEQ ID NO: 2062780 - RNA, 15 nt, Human
caccuccccuccuug

SEQ ID NO: 2062781 - RNA, 23 nt, Human
caccuccccuccuugccuccugu

SEQ ID NO: 2062782 - RNA, 19 nt, Human
caccuccccuauccaccca

SEQ ID NO: 2062783 - RNA, 20 nt, Human
caccuccccuauccacccag

SEQ ID NO: 2062784 - RNA, 11 nt, Human
caccuccccuc

SEQ ID NO: 2062785 - RNA, 14 nt, Human
caccuccccuccuu

SEQ ID NO: 2062786 - RNA, 13 nt, Human
caccucccagccc

SEQ ID NO: 2062787 - RNA, 14 nt, Human
caccucccagcccc

SEQ ID NO: 2062788 - RNA, 15 nt, Human
caccucccagccccu

SEQ ID NO: 2062789 - RNA, 16 nt, Human
caccucccagccccug

SEQ ID NO: 2062790 - RNA, 18 nt, Human
caccucccagccccugcc

SEQ ID NO: 2062791 - RNA, 13 nt, Human
caccucccauccu

SEQ ID NO: 2062792 - RNA, 16 nt, Human
caccucccauccuaau

SEQ ID NO: 2062793 - RNA, 11 nt, Human
caccuccugcc

SEQ ID NO: 2062794 - RNA, 13 nt, Human
caccuccugccuc

SEQ ID NO: 2062795 - RNA, 14 nt, Human
caccuccugccucg

SEQ ID NO: 2062796 - RNA, 19 nt, Human
caccucccugaaccauccc

SEQ ID NO: 2062797 - RNA, 21 nt, Human
caccucguuagggaagagaaa

SEQ ID NO: 2062798 - RNA, 15 nt, Human
cacucaagccaagca

SEQ ID NO: 2062799 - RNA, 23 nt, Human
cagagucucgcucuguugcccag

SEQ ID NO: 2062800 - RNA, 23 nt, Human
cagagucggaacggagaaaggug

SEQ ID NO: 2062801 - RNA, 15 nt, Human
cagagucggaacgga

SEQ ID NO: 2062802 - RNA, 18 nt, Human
cagagucggaacggagaa

SEQ ID NO: 2062803 - RNA, 23 nt, Human
cagagucucacuguugcccaggc

SEQ ID NO: 2062804 - RNA, 22 nt, Human
cagagucucacuguugcccagg

SEQ ID NO: 2062805 - RNA, 18 nt, Human
cagagugagacucugucu

SEQ ID NO: 2062806 - RNA, 17 nt, Human
cagagugagacucuguc

SEQ ID NO: 2062807 - RNA, 16 nt, Human
cagagugagacucugu

SEQ ID NO: 2062808 - RNA, 15 nt, Human
cagagugagacccug

SEQ ID NO: 2062809 - RNA, 19 nt, Human
cagagugagacccugucuc

SEQ ID NO: 2062810 - RNA, 20 nt, Human
cagagugagacucugucuca

SEQ ID NO: 2062811 - RNA, 19 nt, Human
cagagugagacucugucuc

SEQ ID NO: 2062812 - RNA, 20 nt, Human
cagagugagacccugucucu

SEQ ID NO: 2062813 - RNA, 12 nt, Human
cagagugcccca

SEQ ID NO: 2062814 - RNA, 14 nt, Human
cagagugccccacc

SEQ ID NO: 2062815 - RNA, 15 nt, Human
cagagugccccaccu

SEQ ID NO: 2062816 - RNA, 16 nt, Human
cagagugccccaccug

SEQ ID NO: 2062817 - RNA, 17 nt, Human
cagagugccccaccugc

SEQ ID NO: 2062818 - RNA, 18 nt, Human
cagagugccccaccugcc

SEQ ID NO: 2062819 - RNA, 19 nt, Human
cagagugccccaccugcca

SEQ ID NO: 2062820 - RNA, 20 nt, Human
cagagugccccaccugccac

SEQ ID NO: 2062821 - RNA, 21 nt, Human
cagagugccccaccugccacu

SEQ ID NO: 2062822 - RNA, 23 nt, Human
cagagugccccaccugccacuag

SEQ ID NO: 2062823 - RNA, 15 nt, Human
cagagugcccagaac

SEQ ID NO: 2062824 - RNA, 13 nt, Human
cagagugcccaga

SEQ ID NO: 2062825 - RNA, 14 nt, Human
cagagugcccagaa

SEQ ID NO: 2062826 - RNA, 12 nt, Human
cagaguggccug

SEQ ID NO: 2062827 - RNA, 13 nt, Human
cagaguggccugg

SEQ ID NO: 2062828 - RNA, 15 nt, Human
cagaguggccuggcc

SEQ ID NO: 2062829 - RNA, 16 nt, Human
cagaguggccuggcca

SEQ ID NO: 2062830 - RNA, 17 nt, Human
cagaguggccuggccag

SEQ ID NO: 2062831 - RNA, 18 nt, Human
cagaguggccuggccagg

SEQ ID NO: 2062832 - RNA, 21 nt, Human
cagaguggccuggccaggagc

SEQ ID NO: 2062833 - RNA, 22 nt, Human
cagaguggccuggccaggagcu

SEQ ID NO: 2062834 - RNA, 23 nt, Human
cagaguggccuggccaggagcuc

SEQ ID NO: 2062835 - RNA, 15 nt, Human
cagaguggucuuucu

SEQ ID NO: 2062836 - RNA, 23 nt, Human
cagagggagugacagaggcagcc

SEQ ID NO: 2062837 - RNA, 22 nt, Human
cagagggagugacagaggcagc

SEQ ID NO: 2062838 - RNA, 21 nt, Human
cagagggagugacagaggcag

SEQ ID NO: 2062839 - RNA, 20 nt, Human
cagagggagugacagaggca

SEQ ID NO: 2062840 - RNA, 19 nt, Human
cagagggacuuuguauaga

SEQ ID NO: 2062841 - RNA, 22 nt, Human
cagagggaggaaucgaggaacc

SEQ ID NO: 2062842 - RNA, 23 nt, Human
cagagggaggaaucgaggaacca

SEQ ID NO: 2062843 - RNA, 16 nt, Human
cagagggcagaggcug

SEQ ID NO: 2062844 - RNA, 17 nt, Human
cagagggcagaggcugg

SEQ ID NO: 2062845 - RNA, 18 nt, Human
cagagggcagaggcugga

SEQ ID NO: 2062846 - RNA, 13 nt, Human
cagagggcccagg

SEQ ID NO: 2062847 - RNA, 15 nt, Human
cagagggcccaggca

SEQ ID NO: 2062848 - RNA, 16 nt, Human
cagagggcccaggcag

SEQ ID NO: 2062849 - RNA, 18 nt, Human
cagagggcccaggcaggc

SEQ ID NO: 2062850 - RNA, 21 nt, Human
cagagucucacuguugcccag

SEQ ID NO: 2062851 - RNA, 20 nt, Human
cagagucucacuguugccca

SEQ ID NO: 2062852 - RNA, 19 nt, Human
cagagucucacuguugccc

SEQ ID NO: 2062853 - RNA, 17 nt, Human
cagagucucacuguugc

SEQ ID NO: 2062854 - RNA, 14 nt, Human
cagaguccaggccc

SEQ ID NO: 2062855 - RNA, 15 nt, Human
cagaguccaggcccc

SEQ ID NO: 2062856 - RNA, 16 nt, Human
cagaguccaggcccca

SEQ ID NO: 2062857 - RNA, 22 nt, Human
cagagggcccaggcaggccacc

SEQ ID NO: 2062858 - RNA, 15 nt, Human
cagagucagcagaac

SEQ ID NO: 2062859 - RNA, 13 nt, Human
cagagucucacug

SEQ ID NO: 2062860 - RNA, 22 nt, Human
cagaggcagccccauucugccu

SEQ ID NO: 2062861 - RNA, 20 nt, Human
cagaggcagccccauucugc

SEQ ID NO: 2062862 - RNA, 19 nt, Human
cagaggcagccccauucug

SEQ ID NO: 2062863 - RNA, 18 nt, Human
cagaggcagccccauucu

SEQ ID NO: 2062864 - RNA, 15 nt, Human
cagaggcagccccau

SEQ ID NO: 2062865 - RNA, 14 nt, Human
cagaggcagcccca

SEQ ID NO: 2062866 - RNA, 13 nt, Human
cagaggcagcccc

SEQ ID NO: 2062867 - RNA, 12 nt, Human
cagaggcagccc

SEQ ID NO: 2062868 - RNA, 14 nt, Human
cagaggccauggca

SEQ ID NO: 2062869 - RNA, 21 nt, Human
cagaggccaugggccuccugu

SEQ ID NO: 2062870 - RNA, 20 nt, Human
cagaggccaugggccuccug

SEQ ID NO: 2062871 - RNA, 16 nt, Human
cagaggccaugggccu

SEQ ID NO: 2062872 - RNA, 19 nt, Human
cagaggccaugggccuccu

SEQ ID NO: 2062873 - RNA, 23 nt, Human
cagaggcagccccauucugccug

SEQ ID NO: 2062874 - RNA, 16 nt, Human
cagaggcacagccggg

SEQ ID NO: 2062875 - RNA, 21 nt, Human
cagaggcacagccggggccug

SEQ ID NO: 2062876 - RNA, 13 nt, Human
cagaggcagaacc

SEQ ID NO: 2062877 - RNA, 17 nt, Human
cagaggcagaacccugg

SEQ ID NO: 2062878 - RNA, 18 nt, Human
cagaggcagaacccuggu

SEQ ID NO: 2062879 - RNA, 19 nt, Human
cagagggagugacagaggc

SEQ ID NO: 2062880 - RNA, 18 nt, Human
cagagggagugacagagg

SEQ ID NO: 2062881 - RNA, 16 nt, Human
cagagggagugacaga

SEQ ID NO: 2062882 - RNA, 14 nt, Human
cagagggagugaca

SEQ ID NO: 2062883 - RNA, 23 nt, Human
cagaggcugccucucccaucacu

SEQ ID NO: 2062884 - RNA, 13 nt, Human
cagaggcuggagg

SEQ ID NO: 2062885 - RNA, 13 nt, Human
cagaggcugaggu

SEQ ID NO: 2062886 - RNA, 14 nt, Human
cagaggcuggaggc

SEQ ID NO: 2062887 - RNA, 16 nt, Human
cagaggcuggaggcag

SEQ ID NO: 2062888 - RNA, 17 nt, Human
cagaggcuggaggcagg

SEQ ID NO: 2062889 - RNA, 18 nt, Human
cagaggcuggaggcaggg

SEQ ID NO: 2062890 - RNA, 19 nt, Human
cagaggcuggaggcagggc

SEQ ID NO: 2062891 - RNA, 20 nt, Human
cagaggcuggaggcagggcc

SEQ ID NO: 2062892 - RNA, 14 nt, Human
cagaggcuggccuc

SEQ ID NO: 2062893 - RNA, 15 nt, Human
cagaggcuggccuca

SEQ ID NO: 2062894 - RNA, 16 nt, Human
cagaggcuggccucag

SEQ ID NO: 2062895 - RNA, 17 nt, Human
cagaggcuggccucaga

SEQ ID NO: 2062896 - RNA, 21 nt, Human
cagaggcuggaggcagggccu

SEQ ID NO: 2062897 - RNA, 15 nt, Human
cagaggcuucuucag

SEQ ID NO: 2062898 - RNA, 16 nt, Human
cagaggcuucuucaga

SEQ ID NO: 2062899 - RNA, 20 nt, Human
cagaggcuucuucagaucag

SEQ ID NO: 2062900 - RNA, 23 nt, Human
cagagggaaaguaaauauuucag

SEQ ID NO: 2062901 - RNA, 19 nt, Human
cagagggaagaaaagagcu

SEQ ID NO: 2062902 - RNA, 13 nt, Human
cagaggcugccuc

SEQ ID NO: 2062903 - RNA, 20 nt, Human
cagaggccuagucagccaca

SEQ ID NO: 2062904 - RNA, 23 nt, Human
cagaggccuagucagccacaugg

SEQ ID NO: 2062905 - RNA, 16 nt, Human
cagaugcaccagcccu

SEQ ID NO: 2062906 - RNA, 14 nt, Human
cagaugcaccagcc

SEQ ID NO: 2062907 - RNA, 13 nt, Human
cagaugcaccagc

SEQ ID NO: 2062908 - RNA, 15 nt, Human
cagaugcaaugugcu

SEQ ID NO: 2062909 - RNA, 21 nt, Human
cagaugcaaugugcuacugau

SEQ ID NO: 2062910 - RNA, 17 nt, Human
cagaugcacaugagcug

SEQ ID NO: 2062911 - RNA, 22 nt, Human
cagaugcaccagcccuuagcag

SEQ ID NO: 2062912 - RNA, 17 nt, Human
cagaugcaccagcccuu

SEQ ID NO: 2062913 - RNA, 13 nt, Human
cagaugaccccuc

SEQ ID NO: 2062914 - RNA, 14 nt, Human
cagaugaccccucc

SEQ ID NO: 2062915 - RNA, 18 nt, Human
cagaugaccccuccccua

SEQ ID NO: 2062916 - RNA, 14 nt, Human
cagaugacuagaaa

SEQ ID NO: 2062917 - RNA, 16 nt, Human
cagaugagcagaagcu

SEQ ID NO: 2062918 - RNA, 20 nt, Human
cagaugagcagaagcucucg

SEQ ID NO: 2062919 - RNA, 16 nt, Human
cagaugcaaagaggca

SEQ ID NO: 2062920 - RNA, 14 nt, Human
cagaugauccauga

SEQ ID NO: 2062921 - RNA, 17 nt, Human
cagaugcaaagaggcaa

SEQ ID NO: 2062922 - RNA, 18 nt, Human
cagaugcaaagaggcaag

SEQ ID NO: 2062923 - RNA, 23 nt, Human
cagaugcaaagaggcaagaggcu

SEQ ID NO: 2062924 - RNA, 22 nt, Human
cagaugaacucuuucuggccug

SEQ ID NO: 2062925 - RNA, 23 nt, Human
cagaugaacucuuucuggccugc

SEQ ID NO: 2062926 - RNA, 18 nt, Human
cagaucugugccccaugc

SEQ ID NO: 2062927 - RNA, 20 nt, Human
cagaucugugccccaugccu

SEQ ID NO: 2062928 - RNA, 21 nt, Human
cagaucugugccccaugccug

SEQ ID NO: 2062929 - RNA, 23 nt, Human
cagaucugugccccaugccuguc

SEQ ID NO: 2062930 - RNA, 22 nt, Human
cagauacaggaaaagcugcuga

SEQ ID NO: 2062931 - RNA, 21 nt, Human
cagauacaggaaaagcugcug

SEQ ID NO: 2062932 - RNA, 20 nt, Human
cagauacaggaaaagcugcu

SEQ ID NO: 2062933 - RNA, 14 nt, Human
cagaucuccaaagc

SEQ ID NO: 2062934 - RNA, 16 nt, Human
cagaucuccaaagcuu

SEQ ID NO: 2062935 - RNA, 13 nt, Human
cagaucugcaccg

SEQ ID NO: 2062936 - RNA, 15 nt, Human
cagaucugcaccgcc

SEQ ID NO: 2062937 - RNA, 17 nt, Human
cagaucuggucccuugc

SEQ ID NO: 2062938 - RNA, 18 nt, Human
cagaucuggucccuugca

SEQ ID NO: 2062939 - RNA, 23 nt, Human
cagaucuguauauuuuuuucuaa

SEQ ID NO: 2062940 - RNA, 12 nt, Human
cagaucugugcc

SEQ ID NO: 2062941 - RNA, 13 nt, Human
cagaucugugccc

SEQ ID NO: 2062942 - RNA, 14 nt, Human
cagaucugugcccc

SEQ ID NO: 2062943 - RNA, 15 nt, Human
cagaucugugcccca

SEQ ID NO: 2062944 - RNA, 20 nt, Human
cagauaagcaagagagaugu

SEQ ID NO: 2062945 - RNA, 22 nt, Human
cagauaagcaagagagauguuu

SEQ ID NO: 2062946 - RNA, 19 nt, Human
cagauaagaaugcugguuu

SEQ ID NO: 2062947 - RNA, 21 nt, Human
cagauaagaaugcugguuuuc

SEQ ID NO: 2062948 - RNA, 15 nt, Human
cagauaaucccugua

SEQ ID NO: 2062949 - RNA, 19 nt, Human
cagauaaucagccucuuaa

SEQ ID NO: 2062950 - RNA, 15 nt, Human
cagauaaucagccuc

SEQ ID NO: 2062951 - RNA, 16 nt, Human
cagauaaucagccucu

SEQ ID NO: 2062952 - RNA, 17 nt, Human
cagauaaucagccucuu

SEQ ID NO: 2062953 - RNA, 18 nt, Human
cagauaaucagccucuua

SEQ ID NO: 2062954 - RNA, 23 nt, Human
cagaguuuagaggaaaaaaauga

SEQ ID NO: 2062955 - RNA, 23 nt, Human
cagaguugugcacauggcuuagu

SEQ ID NO: 2062956 - RNA, 12 nt, Human
cagaguucacua

SEQ ID NO: 2062957 - RNA, 14 nt, Human
cagaguucacuaua

SEQ ID NO: 2062958 - RNA, 20 nt, Human
cagaguucacuauaaauggu

SEQ ID NO: 2062959 - RNA, 22 nt, Human
cagaguggucuuucuggagagg

SEQ ID NO: 2062960 - RNA, 21 nt, Human
cagaguggucuuucuggagag

SEQ ID NO: 2062961 - RNA, 23 nt, Human
cagaguguggccuucggacaacu

SEQ ID NO: 2062962 - RNA, 19 nt, Human
cagagugugggaagggaga

SEQ ID NO: 2062963 - RNA, 20 nt, Human
cagagugugggaagggagag

SEQ ID NO: 2062964 - RNA, 11 nt, Human
cagaggcagcc

SEQ ID NO: 2062965 - RNA, 22 nt, Human
cagaggacaccuguacuggaga

SEQ ID NO: 2062966 - RNA, 23 nt, Human
cagaggacaccuguacuggagag

SEQ ID NO: 2062967 - RNA, 16 nt, Human
cagaggaagagcaggc

SEQ ID NO: 2062968 - RNA, 13 nt, Human
cagagccugcagu

SEQ ID NO: 2062969 - RNA, 13 nt, Human
cagaggaaggaga

SEQ ID NO: 2062970 - RNA, 14 nt, Human
cagaggaagagcag

SEQ ID NO: 2062971 - RNA, 15 nt, Human
cagaggaagagcagg

SEQ ID NO: 2062972 - RNA, 12 nt, Human
cagaggaagagc

SEQ ID NO: 2062973 - RNA, 20 nt, Human
cagagccccacccucagaug

SEQ ID NO: 2062974 - RNA, 20 nt, Human
cagagccuccuuucuggcuu

SEQ ID NO: 2062975 - RNA, 12 nt, Human
cagagccugcag

SEQ ID NO: 2062976 - RNA, 13 nt, Human
cagagccccacac

SEQ ID NO: 2062977 - RNA, 16 nt, Human
cagagccccacacgga

SEQ ID NO: 2062978 - RNA, 23 nt, Human
cagagccccacacggaggcaucu

SEQ ID NO: 2062979 - RNA, 20 nt, Human
cagagccccacacggaggca

SEQ ID NO: 2062980 - RNA, 20 nt, Human
cagagcccaccuuggcucaa

SEQ ID NO: 2062981 - RNA, 19 nt, Human
cagagcccaccuuggcuca

SEQ ID NO: 2062982 - RNA, 17 nt, Human
cagagcccaccuuggcu

SEQ ID NO: 2062983 - RNA, 15 nt, Human
cagagcccaccuugg

SEQ ID NO: 2062984 - RNA, 11 nt, Human
cagagccaugg

SEQ ID NO: 2062985 - RNA, 14 nt, Human
cagagccauggacu

SEQ ID NO: 2062986 - RNA, 22 nt, Human
cagagccaccccuaaagagaua

SEQ ID NO: 2062987 - RNA, 14 nt, Human
cagagcaggggcag

SEQ ID NO: 2062988 - RNA, 15 nt, Human
cagagcaggggcagg

SEQ ID NO: 2062989 - RNA, 13 nt, Human
cagagcacuguau

SEQ ID NO: 2062990 - RNA, 16 nt, Human
cagagcacuguauacc

SEQ ID NO: 2062991 - RNA, 13 nt, Human
cagagacaccugc

SEQ ID NO: 2062992 - RNA, 14 nt, Human
cagagacaccugca

SEQ ID NO: 2062993 - RNA, 15 nt, Human
cagagacaccugcac

SEQ ID NO: 2062994 - RNA, 16 nt, Human
cagagacaccugcacc

SEQ ID NO: 2062995 - RNA, 17 nt, Human
cagagacaccugcaccu

SEQ ID NO: 2062996 - RNA, 18 nt, Human
cagagacaccugcaccuc

SEQ ID NO: 2062997 - RNA, 20 nt, Human
cagagacaccugcaccuccc

SEQ ID NO: 2062998 - RNA, 22 nt, Human
cagagacaccugcaccuccccc

SEQ ID NO: 2062999 - RNA, 14 nt, Human
cagagacagagagg

SEQ ID NO: 2063000 - RNA, 16 nt, Human
cagagacagagaggac

SEQ ID NO: 2063001 - RNA, 23 nt, Human
cagagacaggcccaagagaugaa

SEQ ID NO: 2063002 - RNA, 22 nt, Human
cagagacaggaagucuucaggg

SEQ ID NO: 2063003 - RNA, 14 nt, Human
cagagacaggccca

SEQ ID NO: 2063004 - RNA, 19 nt, Human
cagagacaggcccaagaga

SEQ ID NO: 2063005 - RNA, 13 nt, Human
cagagacaggaaa

SEQ ID NO: 2063006 - RNA, 14 nt, Human
cagagacaggaaaa

SEQ ID NO: 2063007 - RNA, 15 nt, Human
cagagacaggaaaau

SEQ ID NO: 2063008 - RNA, 21 nt, Human
cagagacaggaaaauccucug

SEQ ID NO: 2063009 - RNA, 22 nt, Human
cagagacaggaaaauccucugg

SEQ ID NO: 2063010 - RNA, 23 nt, Human
cagagacaggaaaauccucuggc

SEQ ID NO: 2063011 - RNA, 17 nt, Human
cagagaacuaguggugg

SEQ ID NO: 2063012 - RNA, 20 nt, Human
cagagaagccaaaagauugg

SEQ ID NO: 2063013 - RNA, 21 nt, Human
cagagaaugaaagggcccaga

SEQ ID NO: 2063014 - RNA, 20 nt, Human
cagagaaugaaagggcccag

SEQ ID NO: 2063015 - RNA, 11 nt, Human
cagagaaguuc

SEQ ID NO: 2063016 - RNA, 19 nt, Human
cagagaaucauacuuagca

SEQ ID NO: 2063017 - RNA, 21 nt, Human
cagagaauugcugauucuuga

SEQ ID NO: 2063018 - RNA, 15 nt, Human
cagagaauucucuua

SEQ ID NO: 2063019 - RNA, 19 nt, Human
cagagaaugaaagggccca

SEQ ID NO: 2063020 - RNA, 20 nt, Human
cagagaaggcaggaaugugu

SEQ ID NO: 2063021 - RNA, 18 nt, Human
cagagaaggccaggggcu

SEQ ID NO: 2063022 - RNA, 14 nt, Human
cagagaaggaaugu

SEQ ID NO: 2063023 - RNA, 15 nt, Human
cagagaaggcagcag

SEQ ID NO: 2063024 - RNA, 16 nt, Human
cagagaaggcagcagg

SEQ ID NO: 2063025 - RNA, 13 nt, Human
cagagaaggcagg

SEQ ID NO: 2063026 - RNA, 14 nt, Human
cagagaaggcagga

SEQ ID NO: 2063027 - RNA, 17 nt, Human
cagagaaggcaggaaug

SEQ ID NO: 2063028 - RNA, 14 nt, Human
cagagaguggcucc

SEQ ID NO: 2063029 - RNA, 13 nt, Human
cagagaguggcuc

SEQ ID NO: 2063030 - RNA, 18 nt, Human
cagagaguggcuccuccc

SEQ ID NO: 2063031 - RNA, 15 nt, Human
cagagaguggcuccu

SEQ ID NO: 2063032 - RNA, 16 nt, Human
cagagauaaagaccuu

SEQ ID NO: 2063033 - RNA, 15 nt, Human
cagagauaggccugu

SEQ ID NO: 2063034 - RNA, 23 nt, Human
cagagaugggacugggagggccc

SEQ ID NO: 2063035 - RNA, 19 nt, Human
cagagaugggacugggagg

SEQ ID NO: 2063036 - RNA, 22 nt, Human
cagagaugggacugggagggcc

SEQ ID NO: 2063037 - RNA, 21 nt, Human
cagagauggagguucucucgg

SEQ ID NO: 2063038 - RNA, 23 nt, Human
cagagauggagguucucucggag

SEQ ID NO: 2063039 - RNA, 15 nt, Human
cagagaugggacugg

SEQ ID NO: 2063040 - RNA, 18 nt, Human
cagagaugggacugggag

SEQ ID NO: 2063041 - RNA, 13 nt, Human
cagagaugccucc

SEQ ID NO: 2063042 - RNA, 14 nt, Human
cagagaugccucca

SEQ ID NO: 2063043 - RNA, 15 nt, Human
cagagaugccuccac

SEQ ID NO: 2063044 - RNA, 16 nt, Human
cagagaugccuccacc

SEQ ID NO: 2063045 - RNA, 18 nt, Human
cagagaugccuccaccgc

SEQ ID NO: 2063046 - RNA, 19 nt, Human
cagagaugccuccaccgcu

SEQ ID NO: 2063047 - RNA, 21 nt, Human
cagagaugccuccaccgcugc

SEQ ID NO: 2063048 - RNA, 18 nt, Human
cagagcacagcagccccu

SEQ ID NO: 2063049 - RNA, 14 nt, Human
cagagcaagugaga

SEQ ID NO: 2063050 - RNA, 20 nt, Human
cagagcaagugagacccugu

SEQ ID NO: 2063051 - RNA, 16 nt, Human
cagagcaaagggccag

SEQ ID NO: 2063052 - RNA, 17 nt, Human
cagagcaaagggccagg

SEQ ID NO: 2063053 - RNA, 20 nt, Human
cagagcaagacucugucuca

SEQ ID NO: 2063054 - RNA, 18 nt, Human
cagagcaagauccugucu

SEQ ID NO: 2063055 - RNA, 20 nt, Human
cagagcaagauccugucuuu

SEQ ID NO: 2063056 - RNA, 16 nt, Human
cagagcaagcuuuuuu

SEQ ID NO: 2063057 - RNA, 19 nt, Human
cagagcaagcuuuuuuauu

SEQ ID NO: 2063058 - RNA, 20 nt, Human
cagagcaagcuuuuuuauuu

SEQ ID NO: 2063059 - RNA, 19 nt, Human
cagagacucagggccccag

SEQ ID NO: 2063060 - RNA, 20 nt, Human
cagagacucagggccccagc

SEQ ID NO: 2063061 - RNA, 21 nt, Human
cagagacucagggccccagca

SEQ ID NO: 2063062 - RNA, 22 nt, Human
cagagacucagggccccagcac

SEQ ID NO: 2063063 - RNA, 23 nt, Human
cagagacucagggccccagcacu

SEQ ID NO: 2063064 - RNA, 15 nt, Human
cagaugccccagagc

SEQ ID NO: 2063065 - RNA, 13 nt, Human
cagcagcccuccu

SEQ ID NO: 2063066 - RNA, 20 nt, Human
cagaaacaccuagaucagaa

SEQ ID NO: 2063067 - RNA, 19 nt, Human
cagaaaauuguacaaccug

SEQ ID NO: 2063068 - RNA, 23 nt, Human
cagaaacagauuuggugaauuug

SEQ ID NO: 2063069 - RNA, 18 nt, Human
cagaaacaggugcaucug

SEQ ID NO: 2063070 - RNA, 22 nt, Human
cagaaacaggugcaucugggga

SEQ ID NO: 2063071 - RNA, 17 nt, Human
cagaaacaucaguuacu

SEQ ID NO: 2063072 - RNA, 19 nt, Human
cagaaacaucaguuacucu

SEQ ID NO: 2063073 - RNA, 22 nt, Human
cagaaacaucaguuacucugaa

SEQ ID NO: 2063074 - RNA, 20 nt, Human
cagaaagacugagcucaagg

SEQ ID NO: 2063075 - RNA, 11 nt, Human
cagaaagaguu

SEQ ID NO: 2063076 - RNA, 19 nt, Human
cagaaagauggaugugcuu

SEQ ID NO: 2063077 - RNA, 24 nt, Human
cagaaagaaguggggacagagcag

SEQ ID NO: 2063078 - RNA, 20 nt, Human
cagaaacuugugaaguggaa

SEQ ID NO: 2063079 - RNA, 14 nt, Human
cagaaaccaguuau

SEQ ID NO: 2063080 - RNA, 15 nt, Human
cagaaaccaguuaug

SEQ ID NO: 2063081 - RNA, 23 nt, Human
cagaaacaucaguuacucugaag

SEQ ID NO: 2063082 - RNA, 13 nt, Human
cagaaaccaguua

SEQ ID NO: 2063083 - RNA, 18 nt, Human
cagaaagcauaaaauucu

SEQ ID NO: 2063084 - RNA, 21 nt, Human
cagaaagauggaugugcuuug

SEQ ID NO: 2063085 - RNA, 15 nt, Human
cagaaagcagaggcu

SEQ ID NO: 2063086 - RNA, 16 nt, Human
cagaaagcagaggcug

SEQ ID NO: 2063087 - RNA, 17 nt, Human
cagaaagcagaggcugg

SEQ ID NO: 2063088 - RNA, 20 nt, Human
cagaaagcagaggcuggccu

SEQ ID NO: 2063089 - RNA, 22 nt, Human
cagaaagcagaggcuggccuca

SEQ ID NO: 2063090 - RNA, 19 nt, Human
cagaaagccccaagcaauu

SEQ ID NO: 2063091 - RNA, 19 nt, Human
cagaacaguuaagcagccg

SEQ ID NO: 2063092 - RNA, 22 nt, Human
cagaacaguuaagcagccgcca

SEQ ID NO: 2063093 - RNA, 16 nt, Human
cagaacaguuuguaca

SEQ ID NO: 2063094 - RNA, 14 nt, Human
cagaaaagcaccug

SEQ ID NO: 2063095 - RNA, 20 nt, Human
cagaaaacgguuaaaacugu

SEQ ID NO: 2063096 - RNA, 13 nt, Human
cagaaaacuagaa

SEQ ID NO: 2063097 - RNA, 18 nt, Human
cagaaaacuagaauuuca

SEQ ID NO: 2063098 - RNA, 15 nt, Human
cagaaaagcaccugc

SEQ ID NO: 2063099 - RNA, 16 nt, Human
cagaaaagcaccugcc

SEQ ID NO: 2063100 - RNA, 17 nt, Human
cagaaaagcaccugccg

SEQ ID NO: 2063101 - RNA, 19 nt, Human
cagaaaagcaccugccgac

SEQ ID NO: 2063102 - RNA, 12 nt, Human
cacuuuucucca

SEQ ID NO: 2063103 - RNA, 15 nt, Human
cacuuuugagacuuu

SEQ ID NO: 2063104 - RNA, 19 nt, Human
cacuuugggaggccaagga

SEQ ID NO: 2063105 - RNA, 14 nt, Human
cagaaaaacaauaa

SEQ ID NO: 2063106 - RNA, 16 nt, Human
cagaaaaacaauaaga

SEQ ID NO: 2063107 - RNA, 21 nt, Human
cacuuuuuugaguggaugaug

SEQ ID NO: 2063108 - RNA, 21 nt, Human
cagaaaaauaacuucaagcaa

SEQ ID NO: 2063109 - RNA, 16 nt, Human
cagaaaaacucuggga

SEQ ID NO: 2063110 - RNA, 19 nt, Human
cagaaaaacucugggaaau

SEQ ID NO: 2063111 - RNA, 14 nt, Human
cagaaaacaacaaa

SEQ ID NO: 2063112 - RNA, 16 nt, Human
cagaaaacaacaaaaa

SEQ ID NO: 2063113 - RNA, 17 nt, Human
cagaaaacaacaaaaaa

SEQ ID NO: 2063114 - RNA, 18 nt, Human
cagaaaacaacaaaaaau

SEQ ID NO: 2063115 - RNA, 19 nt, Human
cagaaaacaacaaaaaaua

SEQ ID NO: 2063116 - RNA, 20 nt, Human
cagaaaacaacaaaaaauaa

SEQ ID NO: 2063117 - RNA, 10 nt, Human
cagaaaacag

SEQ ID NO: 2063118 - RNA, 11 nt, Human
cagaaaacaga

SEQ ID NO: 2063119 - RNA, 12 nt, Human
cagaaaacagaa

SEQ ID NO: 2063120 - RNA, 13 nt, Human
cagaaaacagaaa

SEQ ID NO: 2063121 - RNA, 14 nt, Human
cagaaaacagaaaa

SEQ ID NO: 2063122 - RNA, 16 nt, Human
cagaaaacagaaaaaa

SEQ ID NO: 2063123 - RNA, 17 nt, Human
cagaaaacagaaaaaaa

SEQ ID NO: 2063124 - RNA, 20 nt, Human
cagaaaacagaaaaaaaaca

SEQ ID NO: 2063125 - RNA, 14 nt, Human
cagaaaaccccagc

SEQ ID NO: 2063126 - RNA, 19 nt, Human
cagaaaacgguuaaaacug

SEQ ID NO: 2063127 - RNA, 20 nt, Human
cacuuuggaaguuuguguuc

SEQ ID NO: 2063128 - RNA, 13 nt, Human
cacuuugcucuga

SEQ ID NO: 2063129 - RNA, 16 nt, Human
cacuuugggaggccaa

SEQ ID NO: 2063130 - RNA, 23 nt, Human
cacuuugggaggccaaggagggc

SEQ ID NO: 2063131 - RNA, 19 nt, Human
cacuuugguacauggccag

SEQ ID NO: 2063132 - RNA, 20 nt, Human
cacuuugguacauggccagu

SEQ ID NO: 2063133 - RNA, 12 nt, Human
cacuuugggagg

SEQ ID NO: 2063134 - RNA, 13 nt, Human
cacuuugggaggc

SEQ ID NO: 2063135 - RNA, 13 nt, Human
cagaagggaaaca

SEQ ID NO: 2063136 - RNA, 14 nt, Human
cagaagggaaacag

SEQ ID NO: 2063137 - RNA, 15 nt, Human
cagaagggaaacagu

SEQ ID NO: 2063138 - RNA, 16 nt, Human
cagaagggaaacaguc

SEQ ID NO: 2063139 - RNA, 15 nt, Human
cagaagguauuccuu

SEQ ID NO: 2063140 - RNA, 23 nt, Human
cagaagguggggguuggcugggu

SEQ ID NO: 2063141 - RNA, 16 nt, Human
cagaagguugugauga

SEQ ID NO: 2063142 - RNA, 15 nt, Human
cagaagggggucucu

SEQ ID NO: 2063143 - RNA, 18 nt, Human
cagaagggggccaugagg

SEQ ID NO: 2063144 - RNA, 14 nt, Human
cagaagggggccau

SEQ ID NO: 2063145 - RNA, 15 nt, Human
cagaagggggccaug

SEQ ID NO: 2063146 - RNA, 16 nt, Human
cagaagggggccauga

SEQ ID NO: 2063147 - RNA, 20 nt, Human
cagaagucacucaauuguuu

SEQ ID NO: 2063148 - RNA, 22 nt, Human
cagaagucacucaauuguuuuu

SEQ ID NO: 2063149 - RNA, 17 nt, Human
cagaaucucaaauaacu

SEQ ID NO: 2063150 - RNA, 18 nt, Human
cagaaucucaaauaacua

SEQ ID NO: 2063151 - RNA, 23 nt, Human
cagaaucgcuccaccuugcagcu

SEQ ID NO: 2063152 - RNA, 16 nt, Human
cagaagucaugaagcc

SEQ ID NO: 2063153 - RNA, 17 nt, Human
cagaagucaugaagccc

SEQ ID NO: 2063154 - RNA, 18 nt, Human
cagaagucaugaagccca

SEQ ID NO: 2063155 - RNA, 18 nt, Human
cagaaggccaagaggcug

SEQ ID NO: 2063156 - RNA, 14 nt, Human
cagaaggccaagag

SEQ ID NO: 2063157 - RNA, 13 nt, Human
cagaaggcaggga

SEQ ID NO: 2063158 - RNA, 13 nt, Human
cagaaggccaaga

SEQ ID NO: 2063159 - RNA, 13 nt, Human
cagaaggaggagg

SEQ ID NO: 2063160 - RNA, 14 nt, Human
cagaaggaggagga

SEQ ID NO: 2063161 - RNA, 17 nt, Human
cagaaggaugaaugagg

SEQ ID NO: 2063162 - RNA, 18 nt, Human
cagaaggagaaggaagga

SEQ ID NO: 2063163 - RNA, 20 nt, Human
cagaaggagaaggaaggaga

SEQ ID NO: 2063164 - RNA, 14 nt, Human
cagaaggaccuccu

SEQ ID NO: 2063165 - RNA, 14 nt, Human
cagaaggagaagga

SEQ ID NO: 2063166 - RNA, 12 nt, Human
cagaagcuucca

SEQ ID NO: 2063167 - RNA, 19 nt, Human
cagaagcugagcaccaggg

SEQ ID NO: 2063168 - RNA, 21 nt, Human
cagaagcugagcaccagggga

SEQ ID NO: 2063169 - RNA, 16 nt, Human
cagaagcugagcacca

SEQ ID NO: 2063170 - RNA, 15 nt, Human
cagaagcucucgaug

SEQ ID NO: 2063171 - RNA, 18 nt, Human
cagaagcgggacgagacc

SEQ ID NO: 2063172 - RNA, 19 nt, Human
cagaagccugaggcuggga

SEQ ID NO: 2063173 - RNA, 14 nt, Human
cagaagccugaggc

SEQ ID NO: 2063174 - RNA, 15 nt, Human
cagaagccugaggcu

SEQ ID NO: 2063175 - RNA, 19 nt, Human
cagaagccucuggcuagag

SEQ ID NO: 2063176 - RNA, 14 nt, Human
cagaagccucuggc

SEQ ID NO: 2063177 - RNA, 15 nt, Human
cagaagccucuggcu

SEQ ID NO: 2063178 - RNA, 22 nt, Human
cagaacccuggugaggaagcuc

SEQ ID NO: 2063179 - RNA, 12 nt, Human
cagaaccucuuc

SEQ ID NO: 2063180 - RNA, 14 nt, Human
cagaaccucuuccc

SEQ ID NO: 2063181 - RNA, 15 nt, Human
cagaaccucuucccc

SEQ ID NO: 2063182 - RNA, 16 nt, Human
cagaaccucuucccca

SEQ ID NO: 2063183 - RNA, 18 nt, Human
cagaaccucuuccccaga

SEQ ID NO: 2063184 - RNA, 22 nt, Human
cagaacccuuggagccaaugga

SEQ ID NO: 2063185 - RNA, 21 nt, Human
cagaaccucuuccccagaaag

SEQ ID NO: 2063186 - RNA, 14 nt, Human
cagaaccuguccuu

SEQ ID NO: 2063187 - RNA, 13 nt, Human
cagaacugagcuc

SEQ ID NO: 2063188 - RNA, 15 nt, Human
cagaacugagcuccu

SEQ ID NO: 2063189 - RNA, 16 nt, Human
cagaacugagcuccuc

SEQ ID NO: 2063190 - RNA, 17 nt, Human
cagaacugagcuccucu

SEQ ID NO: 2063191 - RNA, 20 nt, Human
cagaacugagcuccucuggg

SEQ ID NO: 2063192 - RNA, 23 nt, Human
cagaacugagcuccucugggcag

SEQ ID NO: 2063193 - RNA, 24 nt, Human
cagaacugagcuccucugggcagg

SEQ ID NO: 2063194 - RNA, 13 nt, Human
cagaacugcuuua

SEQ ID NO: 2063195 - RNA, 13 nt, Human
cagaacuggacuc

SEQ ID NO: 2063196 - RNA, 18 nt, Human
cagaacuggacucaggau

SEQ ID NO: 2063197 - RNA, 21 nt, Human
cagaagacacugaugggcaac

SEQ ID NO: 2063198 - RNA, 22 nt, Human
cagaagaauugaacccaggagg

SEQ ID NO: 2063199 - RNA, 20 nt, Human
cagaagagaugggcuuguuu

SEQ ID NO: 2063200 - RNA, 19 nt, Human
cagaagacacugcaaaggc

SEQ ID NO: 2063201 - RNA, 18 nt, Human
cagaagacuucccagcuu

SEQ ID NO: 2063202 - RNA, 21 nt, Human
cagaagagaugggcuuguuuu

SEQ ID NO: 2063203 - RNA, 15 nt, Human
cagaagaaggcagca

SEQ ID NO: 2063204 - RNA, 18 nt, Human
cagaagaauaugacagcu

SEQ ID NO: 2063205 - RNA, 17 nt, Human
cagaagaauugaaccca

SEQ ID NO: 2063206 - RNA, 19 nt, Human
cagaagaauugaacccagg

SEQ ID NO: 2063207 - RNA, 20 nt, Human
cagaagaauugaacccagga

SEQ ID NO: 2063208 - RNA, 21 nt, Human
cagaagaauugaacccaggag

SEQ ID NO: 2063209 - RNA, 14 nt, Human
cagaagaaggcagc

SEQ ID NO: 2063210 - RNA, 14 nt, Human
cagaagcaggauag

SEQ ID NO: 2063211 - RNA, 16 nt, Human
cagaagccuauuguaa

SEQ ID NO: 2063212 - RNA, 17 nt, Human
cagaagccuauuguaaa

SEQ ID NO: 2063213 - RNA, 18 nt, Human
cagaagccuauuguaaau

SEQ ID NO: 2063214 - RNA, 22 nt, Human
cagaagccuauuguaaauacaa

SEQ ID NO: 2063215 - RNA, 20 nt, Human
cagaagccucacugcaagca

SEQ ID NO: 2063216 - RNA, 13 nt, Human
cagaagccucugg

SEQ ID NO: 2063217 - RNA, 12 nt, Human
cagaccagagcu

SEQ ID NO: 2063218 - RNA, 13 nt, Human
cagaccagagcuc

SEQ ID NO: 2063219 - RNA, 15 nt, Human
cagaccagagcucug

SEQ ID NO: 2063220 - RNA, 17 nt, Human
cagaccagagcucugga

SEQ ID NO: 2063221 - RNA, 14 nt, Human
cagaccacaaaacu

SEQ ID NO: 2063222 - RNA, 20 nt, Human
cagaccacaaaacuuuucua

SEQ ID NO: 2063223 - RNA, 18 nt, Human
cagaccccuggcuuuuca

SEQ ID NO: 2063224 - RNA, 16 nt, Human
cagaccccuggcuuuu

SEQ ID NO: 2063225 - RNA, 15 nt, Human
cagaccccuggcuuu

SEQ ID NO: 2063226 - RNA, 14 nt, Human
cagaccccuggcuu

SEQ ID NO: 2063227 - RNA, 13 nt, Human
cagaccccuggcu

SEQ ID NO: 2063228 - RNA, 17 nt, Human
cagaccccucuggccag

SEQ ID NO: 2063229 - RNA, 18 nt, Human
cagaccccucuggccagg

SEQ ID NO: 2063230 - RNA, 20 nt, Human
cagaccccucuggccaggau

SEQ ID NO: 2063231 - RNA, 21 nt, Human
cagaccccucuggccaggaug

SEQ ID NO: 2063232 - RNA, 18 nt, Human
cagacccccagcaacccu

SEQ ID NO: 2063233 - RNA, 13 nt, Human
cagaccccucugg

SEQ ID NO: 2063234 - RNA, 16 nt, Human
cagaccccucuggcca

SEQ ID NO: 2063235 - RNA, 17 nt, Human
cagaccauugucucaga

SEQ ID NO: 2063236 - RNA, 12 nt, Human
cagaccccagcg

SEQ ID NO: 2063237 - RNA, 14 nt, Human
cagaccccagcggc

SEQ ID NO: 2063238 - RNA, 16 nt, Human
cagaccccagcggcug

SEQ ID NO: 2063239 - RNA, 15 nt, Human
cagaccccagcggcu

SEQ ID NO: 2063240 - RNA, 13 nt, Human
cagacccccaccc

SEQ ID NO: 2063241 - RNA, 14 nt, Human
cagacccccacccc

SEQ ID NO: 2063242 - RNA, 15 nt, Human
cagacccccaccccu

SEQ ID NO: 2063243 - RNA, 17 nt, Human
cagacccccaccccuuc

SEQ ID NO: 2063244 - RNA, 18 nt, Human
cagacccccaccccuucc

SEQ ID NO: 2063245 - RNA, 19 nt, Human
cagacccccaccccuuccc

SEQ ID NO: 2063246 - RNA, 20 nt, Human
cagacccccaccccuucccc

SEQ ID NO: 2063247 - RNA, 21 nt, Human
cagacccccaccccuucccca

SEQ ID NO: 2063248 - RNA, 22 nt, Human
cagacccccaccccuuccccac

SEQ ID NO: 2063249 - RNA, 23 nt, Human
cagacccccaccccuuccccacu

SEQ ID NO: 2063250 - RNA, 13 nt, Human
cagacccccacuc

SEQ ID NO: 2063251 - RNA, 14 nt, Human
cagacccccacucu

SEQ ID NO: 2063252 - RNA, 16 nt, Human
cagacccccacucuca

SEQ ID NO: 2063253 - RNA, 13 nt, Human
cagacccccagca

SEQ ID NO: 2063254 - RNA, 17 nt, Human
cagacccccagcaaccc

SEQ ID NO: 2063255 - RNA, 18 nt, Human
cagacccuaccccaccac

SEQ ID NO: 2063256 - RNA, 15 nt, Human
cagacccuaccccac

SEQ ID NO: 2063257 - RNA, 16 nt, Human
cagacccuaccccacc

SEQ ID NO: 2063258 - RNA, 17 nt, Human
cagacccuaccccacca

SEQ ID NO: 2063259 - RNA, 22 nt, Human
cagaccccuggcuuuucacugc

SEQ ID NO: 2063260 - RNA, 21 nt, Human
cagaccccuggcuuuucacug

SEQ ID NO: 2063261 - RNA, 23 nt, Human
cagaccccuggcuuuucacugcu

SEQ ID NO: 2063262 - RNA, 22 nt, Human
cagaccccucuggccaggaugg

SEQ ID NO: 2063263 - RNA, 14 nt, Human
cagacccggcugcg

SEQ ID NO: 2063264 - RNA, 12 nt, Human
cagacccggcug

SEQ ID NO: 2063265 - RNA, 16 nt, Human
cagacccggcugcgug

SEQ ID NO: 2063266 - RNA, 20 nt, Human
cagacuuuuuuuaaauagua

SEQ ID NO: 2063267 - RNA, 23 nt, Human
cagagaaaguacuucuccacccu

SEQ ID NO: 2063268 - RNA, 19 nt, Human
cagagaaaguacuucucca

SEQ ID NO: 2063269 - RNA, 20 nt, Human
cagacuucuccagacccacc

SEQ ID NO: 2063270 - RNA, 15 nt, Human
cagacuuuaaagaau

SEQ ID NO: 2063271 - RNA, 13 nt, Human
cagacuucuccag

SEQ ID NO: 2063272 - RNA, 14 nt, Human
cagacuucuccaga

SEQ ID NO: 2063273 - RNA, 15 nt, Human
cagacuucuccagac

SEQ ID NO: 2063274 - RNA, 16 nt, Human
cagacuucuccagacc

SEQ ID NO: 2063275 - RNA, 13 nt, Human
cagacuugagaac

SEQ ID NO: 2063276 - RNA, 19 nt, Human
cagacuugagaacuugaca

SEQ ID NO: 2063277 - RNA, 21 nt, Human
cagacuucccugaauguauug

SEQ ID NO: 2063278 - RNA, 15 nt, Human
cagacuucacacugc

SEQ ID NO: 2063279 - RNA, 16 nt, Human
cagacucaguuuguca

SEQ ID NO: 2063280 - RNA, 14 nt, Human
cagacucaauaaaa

SEQ ID NO: 2063281 - RNA, 17 nt, Human
cagacucaguuugucag

SEQ ID NO: 2063282 - RNA, 18 nt, Human
cagacucaguuugucaga

SEQ ID NO: 2063283 - RNA, 16 nt, Human
cagacucauacagaag

SEQ ID NO: 2063284 - RNA, 18 nt, Human
cagacucauacagaaggu

SEQ ID NO: 2063285 - RNA, 19 nt, Human
cagacucauacagaaggug

SEQ ID NO: 2063286 - RNA, 20 nt, Human
cagacucauacagaaggugg

SEQ ID NO: 2063287 - RNA, 21 nt, Human
cagacucauacagaagguggg

SEQ ID NO: 2063288 - RNA, 15 nt, Human
cagacgccuuacugg

SEQ ID NO: 2063289 - RNA, 15 nt, Human
cagacggcacccacc

SEQ ID NO: 2063290 - RNA, 16 nt, Human
cagacggcacccaccc

SEQ ID NO: 2063291 - RNA, 17 nt, Human
cagacggcacccaccca

SEQ ID NO: 2063292 - RNA, 17 nt, Human
cagacgguucaccagcc

SEQ ID NO: 2063293 - RNA, 19 nt, Human
cagacgguucaccagccuc

SEQ ID NO: 2063294 - RNA, 20 nt, Human
cagacguaugcuuauuuuaa

SEQ ID NO: 2063295 - RNA, 15 nt, Human
cagacgucccuccac

SEQ ID NO: 2063296 - RNA, 22 nt, Human
cagaccugagcuccccaccacc

SEQ ID NO: 2063297 - RNA, 12 nt, Human
cagaccugagcu

SEQ ID NO: 2063298 - RNA, 17 nt, Human
cagaccugagcucccca

SEQ ID NO: 2063299 - RNA, 17 nt, Human
cagacgcacgugggucu

SEQ ID NO: 2063300 - RNA, 13 nt, Human
cagaccuuuuauc

SEQ ID NO: 2063301 - RNA, 22 nt, Human
cagacaccuugacagggcacac

SEQ ID NO: 2063302 - RNA, 20 nt, Human
cagacaccuugacagggcac

SEQ ID NO: 2063303 - RNA, 19 nt, Human
cagacaccuugacagggca

SEQ ID NO: 2063304 - RNA, 14 nt, Human
cagacacuuuggaa

SEQ ID NO: 2063305 - RNA, 15 nt, Human
cagacacuuuggaag

SEQ ID NO: 2063306 - RNA, 19 nt, Human
cagacacuuuggaaguuug

SEQ ID NO: 2063307 - RNA, 21 nt, Human
cagacacuuuuuugaguggau

SEQ ID NO: 2063308 - RNA, 21 nt, Human
cagacacugaccauccacucu

SEQ ID NO: 2063309 - RNA, 18 nt, Human
cagacauguggugggaca

SEQ ID NO: 2063310 - RNA, 22 nt, Human
cagacauguggugggacaggga

SEQ ID NO: 2063311 - RNA, 16 nt, Human
cagacauuaaauaauc

SEQ ID NO: 2063312 - RNA, 13 nt, Human
cagacauucugcc

SEQ ID NO: 2063313 - RNA, 16 nt, Human
cagacauucugccagg

SEQ ID NO: 2063314 - RNA, 21 nt, Human
cagacauucugccaggccccc

SEQ ID NO: 2063315 - RNA, 23 nt, Human
cagacacaggcccggcuccaggc

SEQ ID NO: 2063316 - RNA, 22 nt, Human
cagacacaggcccggcuccagg

SEQ ID NO: 2063317 - RNA, 21 nt, Human
cagacacaggcccggcuccag

SEQ ID NO: 2063318 - RNA, 18 nt, Human
cagacacaggcccggcuc

SEQ ID NO: 2063319 - RNA, 17 nt, Human
cagacacaggcccggcu

SEQ ID NO: 2063320 - RNA, 15 nt, Human
cagacacaggcccgg

SEQ ID NO: 2063321 - RNA, 14 nt, Human
cagacacaggcccg

SEQ ID NO: 2063322 - RNA, 13 nt, Human
cagacacaggccc

SEQ ID NO: 2063323 - RNA, 18 nt, Human
cagacacacgcacacaca

SEQ ID NO: 2063324 - RNA, 13 nt, Human
cagacacaaacaa

SEQ ID NO: 2063325 - RNA, 14 nt, Human
cagacacacacaca

SEQ ID NO: 2063326 - RNA, 12 nt, Human
cagacacacaca

SEQ ID NO: 2063327 - RNA, 21 nt, Human
cagacaagugacuguaucugu

SEQ ID NO: 2063328 - RNA, 16 nt, Human
cagacaagguagcccu

SEQ ID NO: 2063329 - RNA, 23 nt, Human
cagacaagguagcccuggccaga

SEQ ID NO: 2063330 - RNA, 17 nt, Human
cagacaacagaagucau

SEQ ID NO: 2063331 - RNA, 22 nt, Human
cagacaacagaagucaugaagc

SEQ ID NO: 2063332 - RNA, 22 nt, Human
cagacaaaugugguuacacacu

SEQ ID NO: 2063333 - RNA, 17 nt, Human
cagacaaaccagaagca

SEQ ID NO: 2063334 - RNA, 22 nt, Human
cagacaaaaacagccucacaga

SEQ ID NO: 2063335 - RNA, 17 nt, Human
cagacaacacguuacua

SEQ ID NO: 2063336 - RNA, 13 nt, Human
cagacaacagaag

SEQ ID NO: 2063337 - RNA, 14 nt, Human
cagacaacagaagu

SEQ ID NO: 2063338 - RNA, 15 nt, Human
cagacaacagaaguc

SEQ ID NO: 2063339 - RNA, 16 nt, Human
cagacaacagaaguca

SEQ ID NO: 2063340 - RNA, 18 nt, Human
cagacaaaaacagccuca

SEQ ID NO: 2063341 - RNA, 19 nt, Human
cagacaaaaacagccucac

SEQ ID NO: 2063342 - RNA, 20 nt, Human
cagacaaaaacagccucaca

SEQ ID NO: 2063343 - RNA, 21 nt, Human
cagacaaaaacagccucacag

SEQ ID NO: 2063344 - RNA, 21 nt, Human
cagaaucuuuccuuccucuca

SEQ ID NO: 2063345 - RNA, 14 nt, Human
cagaaucugaaugu

SEQ ID NO: 2063346 - RNA, 15 nt, Human
cagaaucugaaugua

SEQ ID NO: 2063347 - RNA, 16 nt, Human
cagaaucugaauguaa

SEQ ID NO: 2063348 - RNA, 18 nt, Human
cagaaucugaauguaauu

SEQ ID NO: 2063349 - RNA, 12 nt, Human
cagaaugucaga

SEQ ID NO: 2063350 - RNA, 13 nt, Human
cagaaugucagau

SEQ ID NO: 2063351 - RNA, 22 nt, Human
cagaaugucagauuccuuuccc

SEQ ID NO: 2063352 - RNA, 18 nt, Human
cagaauggggugcaugaa

SEQ ID NO: 2063353 - RNA, 21 nt, Human
cagaauucugcuaccucacug

SEQ ID NO: 2063354 - RNA, 23 nt, Human
cagaauucugcuaccucacuggg

SEQ ID NO: 2063355 - RNA, 15 nt, Human
cagaauucccagcug

SEQ ID NO: 2063356 - RNA, 23 nt, Human
cagaauucccagcugucuguguc

SEQ ID NO: 2063357 - RNA, 15 nt, Human
cagaauuccuuuucu

SEQ ID NO: 2063358 - RNA, 13 nt, Human
cagaauucugcua

SEQ ID NO: 2063359 - RNA, 14 nt, Human
cagaauucugcuac

SEQ ID NO: 2063360 - RNA, 11 nt, Human
cagaauucuca

SEQ ID NO: 2063361 - RNA, 11 nt, Human
cagaaaacaac

SEQ ID NO: 2063362 - RNA, 20 nt, Human
cagccuccugaguagcugga

SEQ ID NO: 2063363 - RNA, 17 nt, Human
cagccucgaacuccugg

SEQ ID NO: 2063364 - RNA, 18 nt, Human
cagccucgaacuccuggg

SEQ ID NO: 2063365 - RNA, 20 nt, Human
cagccucgaacuccugggcu

SEQ ID NO: 2063366 - RNA, 21 nt, Human
cagccucgaacuccugggcuc

SEQ ID NO: 2063367 - RNA, 22 nt, Human
cagccucgaacuccugggcuca

SEQ ID NO: 2063368 - RNA, 23 nt, Human
cagccucgaacuccugggcucaa

SEQ ID NO: 2063369 - RNA, 20 nt, Human
cagccugcuccagcuguuca

SEQ ID NO: 2063370 - RNA, 18 nt, Human
cagccuccguauuucaga

SEQ ID NO: 2063371 - RNA, 19 nt, Human
cagccuccguauuucagac

SEQ ID NO: 2063372 - RNA, 13 nt, Human
cagcccugcccuu

SEQ ID NO: 2063373 - RNA, 13 nt, Human
cagccucccucug

SEQ ID NO: 2063374 - RNA, 14 nt, Human
cagccucccucuga

SEQ ID NO: 2063375 - RNA, 15 nt, Human
cagccucccucugac

SEQ ID NO: 2063376 - RNA, 21 nt, Human
cagccucccucugaccugcag

SEQ ID NO: 2063377 - RNA, 22 nt, Human
cagccucccucugaccugcagg

SEQ ID NO: 2063378 - RNA, 23 nt, Human
cagccucccucugaccugcaggc

SEQ ID NO: 2063379 - RNA, 23 nt, Human
cagccucccgaguagcugggacu

SEQ ID NO: 2063380 - RNA, 22 nt, Human
cagccucccgaguagcugggac

SEQ ID NO: 2063381 - RNA, 21 nt, Human
cagccucccgaguagcuggga

SEQ ID NO: 2063382 - RNA, 20 nt, Human
cagccucccgaguagcuggg

SEQ ID NO: 2063383 - RNA, 19 nt, Human
cagccucccgaguagcugg

SEQ ID NO: 2063384 - RNA, 23 nt, Human
cagccucccgaauagcugggacu

SEQ ID NO: 2063385 - RNA, 14 nt, Human
cagccuggcuucug

SEQ ID NO: 2063386 - RNA, 15 nt, Human
cagccuggcuucugg

SEQ ID NO: 2063387 - RNA, 16 nt, Human
cagccuggcuucugga

SEQ ID NO: 2063388 - RNA, 17 nt, Human
cagccuggcuucuggag

SEQ ID NO: 2063389 - RNA, 19 nt, Human
cagccuggcuucuggagcc

SEQ ID NO: 2063390 - RNA, 23 nt, Human
cagccuggcgaaaccccaucucu

SEQ ID NO: 2063391 - RNA, 10 nt, Human
cagccuggca

SEQ ID NO: 2063392 - RNA, 13 nt, Human
cagccuggaggcc

SEQ ID NO: 2063393 - RNA, 12 nt, Human
cagccuggaggc

SEQ ID NO: 2063394 - RNA, 20 nt, Human
cagccuggcacagggcagug

SEQ ID NO: 2063395 - RNA, 13 nt, Human
cagccuggcacag

SEQ ID NO: 2063396 - RNA, 21 nt, Human
cagccuggcacagggcagugg

SEQ ID NO: 2063397 - RNA, 15 nt, Human
cagccuggacccugu

SEQ ID NO: 2063398 - RNA, 19 nt, Human
cagccuggacccuguggau

SEQ ID NO: 2063399 - RNA, 21 nt, Human
cagccuuggauaaugcuguug

SEQ ID NO: 2063400 - RNA, 17 nt, Human
cagccuuucucccaggc

SEQ ID NO: 2063401 - RNA, 18 nt, Human
cagccuuucucccaggcc

SEQ ID NO: 2063402 - RNA, 19 nt, Human
cagccuuucucccaggcca

SEQ ID NO: 2063403 - RNA, 20 nt, Human
cagccuuucucccaggccag

SEQ ID NO: 2063404 - RNA, 23 nt, Human
cagccuuucucccaggccaggcu

SEQ ID NO: 2063405 - RNA, 19 nt, Human
cagccuuugaucagguggg

SEQ ID NO: 2063406 - RNA, 22 nt, Human
cagccuuugaucagguggggag

SEQ ID NO: 2063407 - RNA, 23 nt, Human
cagccuuugaucagguggggagu

SEQ ID NO: 2063408 - RNA, 17 nt, Human
cagccuuugccuccccg

SEQ ID NO: 2063409 - RNA, 21 nt, Human
cagcgaaaggauguaaacagu

SEQ ID NO: 2063410 - RNA, 22 nt, Human
cagccuguggcggugccugggu

SEQ ID NO: 2063411 - RNA, 14 nt, Human
cagccuucccccuc

SEQ ID NO: 2063412 - RNA, 18 nt, Human
cagccuguggcggugccu

SEQ ID NO: 2063413 - RNA, 19 nt, Human
cagccuguggcggugccug

SEQ ID NO: 2063414 - RNA, 20 nt, Human
cagccuguggcggugccugg

SEQ ID NO: 2063415 - RNA, 21 nt, Human
cagccuguggcggugccuggg

SEQ ID NO: 2063416 - RNA, 23 nt, Human
cagccuuccccuugcccagggcu

SEQ ID NO: 2063417 - RNA, 20 nt, Human
cagccuucccccucccaggg

SEQ ID NO: 2063418 - RNA, 21 nt, Human
cagccuucccccucccagggc

SEQ ID NO: 2063419 - RNA, 16 nt, Human
cagccuuccccuugcc

SEQ ID NO: 2063420 - RNA, 21 nt, Human
cagccuuccccuugcccaggg

SEQ ID NO: 2063421 - RNA, 18 nt, Human
cagccuggccaacauggu

SEQ ID NO: 2063422 - RNA, 20 nt, Human
cagccugggcaacacagcga

SEQ ID NO: 2063423 - RNA, 19 nt, Human
cagccugggcaacagagca

SEQ ID NO: 2063424 - RNA, 20 nt, Human
cagccugggcaacagagcaa

SEQ ID NO: 2063425 - RNA, 20 nt, Human
cagccuggcuucuggagccc

SEQ ID NO: 2063426 - RNA, 21 nt, Human
cagccuggcuucuggagcccu

SEQ ID NO: 2063427 - RNA, 16 nt, Human
cagccugggcaaugug

SEQ ID NO: 2063428 - RNA, 19 nt, Human
cagccugggcaaugugaua

SEQ ID NO: 2063429 - RNA, 11 nt, Human
cagccugggcg

SEQ ID NO: 2063430 - RNA, 15 nt, Human
cagccugggcgacag

SEQ ID NO: 2063431 - RNA, 20 nt, Human
cagccugggcagcauagcaa

SEQ ID NO: 2063432 - RNA, 17 nt, Human
cagccugggcagccagg

SEQ ID NO: 2063433 - RNA, 18 nt, Human
cagccugggcagccaggc

SEQ ID NO: 2063434 - RNA, 19 nt, Human
cagccugggcagccaggcu

SEQ ID NO: 2063435 - RNA, 20 nt, Human
cagccugggcagccaggcug

SEQ ID NO: 2063436 - RNA, 21 nt, Human
cagccugggcagccaggcugc

SEQ ID NO: 2063437 - RNA, 20 nt, Human
cagccuggucaacaugguga

SEQ ID NO: 2063438 - RNA, 15 nt, Human
cagccuggugggccu

SEQ ID NO: 2063439 - RNA, 16 nt, Human
cagccuggugggccuc

SEQ ID NO: 2063440 - RNA, 17 nt, Human
cagccuggugggccucc

SEQ ID NO: 2063441 - RNA, 18 nt, Human
cagccuggugggccuccu

SEQ ID NO: 2063442 - RNA, 23 nt, Human
cagccuggugggccuccucuguc

SEQ ID NO: 2063443 - RNA, 14 nt, Human
cagccugugcugcc

SEQ ID NO: 2063444 - RNA, 16 nt, Human
cagccugugcugcccg

SEQ ID NO: 2063445 - RNA, 12 nt, Human
cagccuguggca

SEQ ID NO: 2063446 - RNA, 15 nt, Human
cagccuguggcaucu

SEQ ID NO: 2063447 - RNA, 19 nt, Human
cagccuguggcaucuuugc

SEQ ID NO: 2063448 - RNA, 21 nt, Human
cagccuguggcaucuuugccu

SEQ ID NO: 2063449 - RNA, 12 nt, Human
cagccuguggcg

SEQ ID NO: 2063450 - RNA, 19 nt, Human
cagcuaaucagcauucuca

SEQ ID NO: 2063451 - RNA, 19 nt, Human
cagcuaaggacauuuccca

SEQ ID NO: 2063452 - RNA, 16 nt, Human
cagcuaaugggacacu

SEQ ID NO: 2063453 - RNA, 15 nt, Human
cagcuaaugggacac

SEQ ID NO: 2063454 - RNA, 15 nt, Human
cagcuacuccggagg

SEQ ID NO: 2063455 - RNA, 22 nt, Human
cagcuacucagaagccugaggc

SEQ ID NO: 2063456 - RNA, 23 nt, Human
cagcuacucagaagccugaggcu

SEQ ID NO: 2063457 - RNA, 12 nt, Human
cagcuacucagg

SEQ ID NO: 2063458 - RNA, 13 nt, Human
cagcuacucagga

SEQ ID NO: 2063459 - RNA, 16 nt, Human
cagcuacucaggaggc

SEQ ID NO: 2063460 - RNA, 18 nt, Human
cagcuacucaggaggcug

SEQ ID NO: 2063461 - RNA, 24 nt, Human
cagcuacccaggaggcugaggugg

SEQ ID NO: 2063462 - RNA, 17 nt, Human
cagcuacuaaugauguu

SEQ ID NO: 2063463 - RNA, 18 nt, Human
cagcuaccagguguucua

SEQ ID NO: 2063464 - RNA, 15 nt, Human
cagcuaccaugacaa

SEQ ID NO: 2063465 - RNA, 19 nt, Human
cagcuacuaaugauguuuu

SEQ ID NO: 2063466 - RNA, 19 nt, Human
cagcuacucaagaggcuga

SEQ ID NO: 2063467 - RNA, 20 nt, Human
cagcuacucaagaggcugag

SEQ ID NO: 2063468 - RNA, 23 nt, Human
cagcuacucaagaggcugaggca

SEQ ID NO: 2063469 - RNA, 14 nt, Human
cagcuacucagaag

SEQ ID NO: 2063470 - RNA, 15 nt, Human
cagcuacucagaagc

SEQ ID NO: 2063471 - RNA, 16 nt, Human
cagcuacucagaagcc

SEQ ID NO: 2063472 - RNA, 19 nt, Human
cagcuacucagaagccuga

SEQ ID NO: 2063473 - RNA, 20 nt, Human
cagcuacucagaagccugag

SEQ ID NO: 2063474 - RNA, 21 nt, Human
cagcuacucagaagccugagg

SEQ ID NO: 2063475 - RNA, 20 nt, Human
cagcgagcccugguggcagu

SEQ ID NO: 2063476 - RNA, 19 nt, Human
cagcgagcccugguggcag

SEQ ID NO: 2063477 - RNA, 17 nt, Human
cagcgagcccugguggc

SEQ ID NO: 2063478 - RNA, 16 nt, Human
cagcgagcccuggugg

SEQ ID NO: 2063479 - RNA, 13 nt, Human
cagcgagcccugg

SEQ ID NO: 2063480 - RNA, 22 nt, Human
cagcgaguuguggaaagccucu

SEQ ID NO: 2063481 - RNA, 21 nt, Human
cagcgagcccugguggcagug

SEQ ID NO: 2063482 - RNA, 19 nt, Human
cagcucaccagccccagug

SEQ ID NO: 2063483 - RNA, 17 nt, Human
cagcucaccagccccag

SEQ ID NO: 2063484 - RNA, 16 nt, Human
cagcucaccagcccca

SEQ ID NO: 2063485 - RNA, 15 nt, Human
cagcucaccagcccc

SEQ ID NO: 2063486 - RNA, 13 nt, Human
cagcucaccagcc

SEQ ID NO: 2063487 - RNA, 13 nt, Human
cagcucaagucuu

SEQ ID NO: 2063488 - RNA, 19 nt, Human
cagcucaagucuucccuga

SEQ ID NO: 2063489 - RNA, 13 nt, Human
cagcuauuuuuau

SEQ ID NO: 2063490 - RNA, 19 nt, Human
cagcucaaaggcacaguga

SEQ ID NO: 2063491 - RNA, 15 nt, Human
cagcucaaaggcaca

SEQ ID NO: 2063492 - RNA, 18 nt, Human
cagcuauugauauaaaua

SEQ ID NO: 2063493 - RNA, 18 nt, Human
cagcuaucucucagugaa

SEQ ID NO: 2063494 - RNA, 17 nt, Human
cagcuaucucucaguga

SEQ ID NO: 2063495 - RNA, 13 nt, Human
cagcuaugggagc

SEQ ID NO: 2063496 - RNA, 15 nt, Human
cagcuaugggagccc

SEQ ID NO: 2063497 - RNA, 17 nt, Human
cagcuaugggagcccca

SEQ ID NO: 2063498 - RNA, 18 nt, Human
cagcuaugggagccccag

SEQ ID NO: 2063499 - RNA, 20 nt, Human
cagcuaugggagccccaggg

SEQ ID NO: 2063500 - RNA, 21 nt, Human
cagcuaugggagccccagggu

SEQ ID NO: 2063501 - RNA, 22 nt, Human
cagcuaugggagccccaggguc

SEQ ID NO: 2063502 - RNA, 23 nt, Human
cagcuaugggagccccagggucu

SEQ ID NO: 2063503 - RNA, 13 nt, Human
cagcuagagcuuc

SEQ ID NO: 2063504 - RNA, 15 nt, Human
cagcuagcaaaagaa

SEQ ID NO: 2063505 - RNA, 19 nt, Human
cagcuagcaaaagaaguaa

SEQ ID NO: 2063506 - RNA, 21 nt, Human
cagcuagcaaaagaaguaaca

SEQ ID NO: 2063507 - RNA, 16 nt, Human
cagcuacuugggaggc

SEQ ID NO: 2063508 - RNA, 15 nt, Human
cagcuacuugggagg

SEQ ID NO: 2063509 - RNA, 19 nt, Human
cagcuagguggggccuaga

SEQ ID NO: 2063510 - RNA, 21 nt, Human
cagcucaccagccccagugcc

SEQ ID NO: 2063511 - RNA, 20 nt, Human
cagcucaccagccccagugc

SEQ ID NO: 2063512 - RNA, 22 nt, Human
cagcucaccagccccagugccc

SEQ ID NO: 2063513 - RNA, 22 nt, Human
cagcucaagucuucccugauca

SEQ ID NO: 2063514 - RNA, 17 nt, Human
cagcucacgucacacuu

SEQ ID NO: 2063515 - RNA, 23 nt, Human
cagcccugcuuugggcugcccug

SEQ ID NO: 2063516 - RNA, 22 nt, Human
cagcccugcuuugggcugcccu

SEQ ID NO: 2063517 - RNA, 21 nt, Human
cagcccugcuuugggcugccc

SEQ ID NO: 2063518 - RNA, 20 nt, Human
cagcccugcuuugggcugcc

SEQ ID NO: 2063519 - RNA, 19 nt, Human
cagcccugcuuugggcugc

SEQ ID NO: 2063520 - RNA, 13 nt, Human
cagcccugcuuug

SEQ ID NO: 2063521 - RNA, 11 nt, Human
cagcccugcuu

SEQ ID NO: 2063522 - RNA, 23 nt, Human
cagcccugggccccaccaccuag

SEQ ID NO: 2063523 - RNA, 16 nt, Human
cagccggggccugccu

SEQ ID NO: 2063524 - RNA, 17 nt, Human
cagccggggccugccua

SEQ ID NO: 2063525 - RNA, 18 nt, Human
cagccggggccugccuag

SEQ ID NO: 2063526 - RNA, 19 nt, Human
cagccggggccugccuagc

SEQ ID NO: 2063527 - RNA, 20 nt, Human
cagccggggccugccuagca

SEQ ID NO: 2063528 - RNA, 12 nt, Human
cagcccugggcc

SEQ ID NO: 2063529 - RNA, 13 nt, Human
cagcccugggccc

SEQ ID NO: 2063530 - RNA, 17 nt, Human
cagcccugggccccacc

SEQ ID NO: 2063531 - RNA, 18 nt, Human
cagcccugggccccacca

SEQ ID NO: 2063532 - RNA, 19 nt, Human
cagcccugggccccaccac

SEQ ID NO: 2063533 - RNA, 20 nt, Human
cagcccugggccccaccacc

SEQ ID NO: 2063534 - RNA, 21 nt, Human
cagcccugggccccaccaccu

SEQ ID NO: 2063535 - RNA, 22 nt, Human
cagcccugggccccaccaccua

SEQ ID NO: 2063536 - RNA, 11 nt, Human
cagcccugggc

SEQ ID NO: 2063537 - RNA, 20 nt, Human
cagccgugccuucagcucua

SEQ ID NO: 2063538 - RNA, 18 nt, Human
cagccgugccuucagcuc

SEQ ID NO: 2063539 - RNA, 16 nt, Human
cagccgugccuucagc

SEQ ID NO: 2063540 - RNA, 14 nt, Human
cagccgugccuuca

SEQ ID NO: 2063541 - RNA, 9 nt, Human
cagccgugc

SEQ ID NO: 2063542 - RNA, 18 nt, Human
cagccgucagccaaaugu

SEQ ID NO: 2063543 - RNA, 19 nt, Human
cagccgucagccaaaugua

SEQ ID NO: 2063544 - RNA, 16 nt, Human
cagccuaagaugaaga

SEQ ID NO: 2063545 - RNA, 16 nt, Human
cagccuacaggccuca

SEQ ID NO: 2063546 - RNA, 14 nt, Human
cagccuacaggccu

SEQ ID NO: 2063547 - RNA, 21 nt, Human
cagccguguaaccauggaccc

SEQ ID NO: 2063548 - RNA, 20 nt, Human
cagccuacuagggaccuggg

SEQ ID NO: 2063549 - RNA, 22 nt, Human
cagccuacuagggaccugggga

SEQ ID NO: 2063550 - RNA, 15 nt, Human
cagccuagccgaccu

SEQ ID NO: 2063551 - RNA, 17 nt, Human
cagccuagccgaccuca

SEQ ID NO: 2063552 - RNA, 18 nt, Human
cagccuagccgaccucag

SEQ ID NO: 2063553 - RNA, 19 nt, Human
cagccuagccgaccucagc

SEQ ID NO: 2063554 - RNA, 20 nt, Human
cagccuagccgaccucagcc

SEQ ID NO: 2063555 - RNA, 21 nt, Human
cagccuagccgaccucagccu

SEQ ID NO: 2063556 - RNA, 22 nt, Human
cagccuagccgaccucagccuu

SEQ ID NO: 2063557 - RNA, 22 nt, Human
cagcccucccugccccucccuu

SEQ ID NO: 2063558 - RNA, 18 nt, Human
cagcccucccugccccuc

SEQ ID NO: 2063559 - RNA, 17 nt, Human
cagcccucccugccccu

SEQ ID NO: 2063560 - RNA, 16 nt, Human
cagcccucccugcccc

SEQ ID NO: 2063561 - RNA, 13 nt, Human
cagcccucccugu

SEQ ID NO: 2063562 - RNA, 14 nt, Human
cagcccucccuguc

SEQ ID NO: 2063563 - RNA, 15 nt, Human
cagcccucccugucc

SEQ ID NO: 2063564 - RNA, 16 nt, Human
cagcccucccuguccu

SEQ ID NO: 2063565 - RNA, 18 nt, Human
cagcccucccuguccucc

SEQ ID NO: 2063566 - RNA, 19 nt, Human
cagcccucccuguccuccu

SEQ ID NO: 2063567 - RNA, 20 nt, Human
cagcccucccuguccuccuc

SEQ ID NO: 2063568 - RNA, 21 nt, Human
cagcccucccuguccuccucg

SEQ ID NO: 2063569 - RNA, 22 nt, Human
cagcccucccuguccuccucgg

SEQ ID NO: 2063570 - RNA, 12 nt, Human
cagcccuccuca

SEQ ID NO: 2063571 - RNA, 13 nt, Human
cagcccuccucac

SEQ ID NO: 2063572 - RNA, 14 nt, Human
cagcccuccucacc

SEQ ID NO: 2063573 - RNA, 16 nt, Human
cagcccuccucacccc

SEQ ID NO: 2063574 - RNA, 15 nt, Human
cagcccucucacugu

SEQ ID NO: 2063575 - RNA, 18 nt, Human
cagcccucucacuguguc

SEQ ID NO: 2063576 - RNA, 22 nt, Human
cagcccuccucaccccgucugg

SEQ ID NO: 2063577 - RNA, 12 nt, Human
cagcccugaggu

SEQ ID NO: 2063578 - RNA, 22 nt, Human
cagcccugaggugaaagggagc

SEQ ID NO: 2063579 - RNA, 19 nt, Human
cagccuaggggucagggac

SEQ ID NO: 2063580 - RNA, 18 nt, Human
cagccuaggggucaggga

SEQ ID NO: 2063581 - RNA, 18 nt, Human
cagccucaaccuccuggg

SEQ ID NO: 2063582 - RNA, 17 nt, Human
cagccucaaccuccugg

SEQ ID NO: 2063583 - RNA, 21 nt, Human
cagccucaaccuccugggcua

SEQ ID NO: 2063584 - RNA, 20 nt, Human
cagccucaaccuccugggcu

SEQ ID NO: 2063585 - RNA, 19 nt, Human
cagccucaaccuccugggc

SEQ ID NO: 2063586 - RNA, 20 nt, Human
cagccuccaagcuccaucuc

SEQ ID NO: 2063587 - RNA, 12 nt, Human
cagccuccagag

SEQ ID NO: 2063588 - RNA, 14 nt, Human
cagccuccaagcuc

SEQ ID NO: 2063589 - RNA, 12 nt, Human
cagccucacaga

SEQ ID NO: 2063590 - RNA, 13 nt, Human
cagccucacagaa

SEQ ID NO: 2063591 - RNA, 14 nt, Human
cagccucacagaag

SEQ ID NO: 2063592 - RNA, 22 nt, Human
cagccucccgaauagcugggac

SEQ ID NO: 2063593 - RNA, 21 nt, Human
cagccucccgaauagcuggga

SEQ ID NO: 2063594 - RNA, 20 nt, Human
cagccucccgaauagcuggg

SEQ ID NO: 2063595 - RNA, 14 nt, Human
cagccucccacccc

SEQ ID NO: 2063596 - RNA, 19 nt, Human
cagccucccacccccaucu

SEQ ID NO: 2063597 - RNA, 16 nt, Human
cagccucccaccccca

SEQ ID NO: 2063598 - RNA, 18 nt, Human
cagccucccacccccauc

SEQ ID NO: 2063599 - RNA, 23 nt, Human
cagccucccccuguccccucuau

SEQ ID NO: 2063600 - RNA, 14 nt, Human
cagccuccaugcug

SEQ ID NO: 2063601 - RNA, 20 nt, Human
cagccuccaugcugccucca

SEQ ID NO: 2063602 - RNA, 17 nt, Human
cagccuccaugcugccu

SEQ ID NO: 2063603 - RNA, 15 nt, Human
cagccuccaugcugc

SEQ ID NO: 2063604 - RNA, 23 nt, Human
cagccucccaaagugcugggauu

SEQ ID NO: 2063605 - RNA, 21 nt, Human
cagccucccaaagugcuggga

SEQ ID NO: 2063606 - RNA, 20 nt, Human
cagccucccaaagugcuggg

SEQ ID NO: 2063607 - RNA, 19 nt, Human
cagccucccaaagugcugg

SEQ ID NO: 2063608 - RNA, 14 nt, Human
cagccccauucugc

SEQ ID NO: 2063609 - RNA, 13 nt, Human
cagccccauucug

SEQ ID NO: 2063610 - RNA, 18 nt, Human
cagccccauucugccugc

SEQ ID NO: 2063611 - RNA, 17 nt, Human
cagccccauucugccug

SEQ ID NO: 2063612 - RNA, 16 nt, Human
cagccccauucugccu

SEQ ID NO: 2063613 - RNA, 12 nt, Human
cagccccagccc

SEQ ID NO: 2063614 - RNA, 13 nt, Human
cagccccagccca

SEQ ID NO: 2063615 - RNA, 14 nt, Human
cagccccagcccag

SEQ ID NO: 2063616 - RNA, 15 nt, Human
cagccccagcccagc

SEQ ID NO: 2063617 - RNA, 16 nt, Human
cagccccagcccagcc

SEQ ID NO: 2063618 - RNA, 21 nt, Human
cagccccagcccagcccagcu

SEQ ID NO: 2063619 - RNA, 14 nt, Human
cagccccagcacca

SEQ ID NO: 2063620 - RNA, 11 nt, Human
cagccccaccc

SEQ ID NO: 2063621 - RNA, 12 nt, Human
cagccccaccca

SEQ ID NO: 2063622 - RNA, 13 nt, Human
cagccccacccag

SEQ ID NO: 2063623 - RNA, 14 nt, Human
cagccccacccagg

SEQ ID NO: 2063624 - RNA, 15 nt, Human
cagccccacccagga

SEQ ID NO: 2063625 - RNA, 16 nt, Human
cagccccacccaggag

SEQ ID NO: 2063626 - RNA, 21 nt, Human
cagccccacccaggagggagg

SEQ ID NO: 2063627 - RNA, 22 nt, Human
cagccccacccaggagggaggg

SEQ ID NO: 2063628 - RNA, 18 nt, Human
cagccccagugcccacag

SEQ ID NO: 2063629 - RNA, 17 nt, Human
cagccccagugcccaca

SEQ ID NO: 2063630 - RNA, 16 nt, Human
cagccccagugcccac

SEQ ID NO: 2063631 - RNA, 15 nt, Human
cagccccagugccca

SEQ ID NO: 2063632 - RNA, 14 nt, Human
cagccccagugccc

SEQ ID NO: 2063633 - RNA, 13 nt, Human
cagccccagugcc

SEQ ID NO: 2063634 - RNA, 13 nt, Human
cagcccucagaau

SEQ ID NO: 2063635 - RNA, 15 nt, Human
cagcccucccugccc

SEQ ID NO: 2063636 - RNA, 13 nt, Human
cagcccucccugc

SEQ ID NO: 2063637 - RNA, 17 nt, Human
cagcccguguggccccu

SEQ ID NO: 2063638 - RNA, 18 nt, Human
cagcccguguggccccuu

SEQ ID NO: 2063639 - RNA, 20 nt, Human
cagcccguguggccccuuca

SEQ ID NO: 2063640 - RNA, 21 nt, Human
cagcccguguggccccuucac

SEQ ID NO: 2063641 - RNA, 15 nt, Human
cagcccguguggccc

SEQ ID NO: 2063642 - RNA, 17 nt, Human
cagccccuugagaaacc

SEQ ID NO: 2063643 - RNA, 18 nt, Human
cagccccuugagaaaccu

SEQ ID NO: 2063644 - RNA, 15 nt, Human
cagcccgcaugcagc

SEQ ID NO: 2063645 - RNA, 19 nt, Human
cagcccgcaugcagcagcu

SEQ ID NO: 2063646 - RNA, 21 nt, Human
cagcccgcaugcagcagcuug

SEQ ID NO: 2063647 - RNA, 23 nt, Human
cagcccgcaugcagcagcuugcu

SEQ ID NO: 2063648 - RNA, 18 nt, Human
cagcuggagaaauauggu

SEQ ID NO: 2063649 - RNA, 15 nt, Human
cagcuggcagcagag

SEQ ID NO: 2063650 - RNA, 18 nt, Human
cagcuggcagcagagugu

SEQ ID NO: 2063651 - RNA, 14 nt, Human
cagcuggcagcaga

SEQ ID NO: 2063652 - RNA, 22 nt, Human
cagcugcuuuugucuaugggac

SEQ ID NO: 2063653 - RNA, 11 nt, Human
cagcugcuucu

SEQ ID NO: 2063654 - RNA, 23 nt, Human
cagcugcuuuugucuaugggacu

SEQ ID NO: 2063655 - RNA, 19 nt, Human
cagcugggaucugacugca

SEQ ID NO: 2063656 - RNA, 20 nt, Human
cagcugggaucugacugcac

SEQ ID NO: 2063657 - RNA, 22 nt, Human
cagcugggaucugacugcacgu

SEQ ID NO: 2063658 - RNA, 12 nt, Human
cagcugggagaa

SEQ ID NO: 2063659 - RNA, 15 nt, Human
cagcugggagaaggg

SEQ ID NO: 2063660 - RNA, 17 nt, Human
cagcuggguuggaaaac

SEQ ID NO: 2063661 - RNA, 16 nt, Human
cagcuggguuggaaaa

SEQ ID NO: 2063662 - RNA, 18 nt, Human
cagcugguugagguuuca

SEQ ID NO: 2063663 - RNA, 19 nt, Human
cagcuggugguaucugagu

SEQ ID NO: 2063664 - RNA, 20 nt, Human
cagcuggugggaagcgucug

SEQ ID NO: 2063665 - RNA, 22 nt, Human
cagcuggugggaagcgucuguc

SEQ ID NO: 2063666 - RNA, 19 nt, Human
cagcuguaagaagagacug

SEQ ID NO: 2063667 - RNA, 20 nt, Human
cagcuguaagaagagacugg

SEQ ID NO: 2063668 - RNA, 24 nt, Human
cagcugcgguccacccaggagccc

SEQ ID NO: 2063669 - RNA, 23 nt, Human
cagcugcgguccacccaggagcc

SEQ ID NO: 2063670 - RNA, 22 nt, Human
cagcugcgguccacccaggagc

SEQ ID NO: 2063671 - RNA, 21 nt, Human
cagcugcgguccacccaggag

SEQ ID NO: 2063672 - RNA, 20 nt, Human
cagcugcgguccacccagga

SEQ ID NO: 2063673 - RNA, 19 nt, Human
cagcugcgguccacccagg

SEQ ID NO: 2063674 - RNA, 18 nt, Human
cagcugcgguccacccag

SEQ ID NO: 2063675 - RNA, 16 nt, Human
cagcugaccuuuguca

SEQ ID NO: 2063676 - RNA, 22 nt, Human
cagcucuuugaaauagucugug

SEQ ID NO: 2063677 - RNA, 22 nt, Human
cagcugaacaguguuggcuuuc

SEQ ID NO: 2063678 - RNA, 15 nt, Human
cagcugaaauacuga

SEQ ID NO: 2063679 - RNA, 11 nt, Human
cagcugcucug

SEQ ID NO: 2063680 - RNA, 12 nt, Human
cagcugcucugc

SEQ ID NO: 2063681 - RNA, 14 nt, Human
cagcugcucugccc

SEQ ID NO: 2063682 - RNA, 15 nt, Human
cagcugcucugccca

SEQ ID NO: 2063683 - RNA, 16 nt, Human
cagcugcucugcccag

SEQ ID NO: 2063684 - RNA, 17 nt, Human
cagcugcucugcccaga

SEQ ID NO: 2063685 - RNA, 18 nt, Human
cagcugcucugcccagag

SEQ ID NO: 2063686 - RNA, 19 nt, Human
cagcugcucugcccagagc

SEQ ID NO: 2063687 - RNA, 20 nt, Human
cagcugcucugcccagagcu

SEQ ID NO: 2063688 - RNA, 21 nt, Human
cagcugcucugcccagagcug

SEQ ID NO: 2063689 - RNA, 22 nt, Human
cagcugcucugcccagagcugg

SEQ ID NO: 2063690 - RNA, 23 nt, Human
cagcugcucugcccagagcuggg

SEQ ID NO: 2063691 - RNA, 17 nt, Human
cagcugcuacuacuccu

SEQ ID NO: 2063692 - RNA, 13 nt, Human
cagcugcuccccu

SEQ ID NO: 2063693 - RNA, 15 nt, Human
cagcugcuccccucc

SEQ ID NO: 2063694 - RNA, 16 nt, Human
cagcugcuccccuccc

SEQ ID NO: 2063695 - RNA, 17 nt, Human
cagcugcuccccucccu

SEQ ID NO: 2063696 - RNA, 18 nt, Human
cagcugcuccccucccuc

SEQ ID NO: 2063697 - RNA, 20 nt, Human
cagcugcuccccucccuccu

SEQ ID NO: 2063698 - RNA, 21 nt, Human
cagcugcuccccucccuccuc

SEQ ID NO: 2063699 - RNA, 12 nt, Human
cagcucaggcac

SEQ ID NO: 2063700 - RNA, 21 nt, Human
cagcucaggcacacuucuucu

SEQ ID NO: 2063701 - RNA, 23 nt, Human
cagcuccuucuguccuacucugu

SEQ ID NO: 2063702 - RNA, 21 nt, Human
cagcuccuucuguccuacucu

SEQ ID NO: 2063703 - RNA, 17 nt, Human
cagcuccuucuguccua

SEQ ID NO: 2063704 - RNA, 16 nt, Human
cagcuccuucuguccu

SEQ ID NO: 2063705 - RNA, 23 nt, Human
cagcucaggcacacuucuucuug

SEQ ID NO: 2063706 - RNA, 23 nt, Human
cagcucaggcuguuuuugggugc

SEQ ID NO: 2063707 - RNA, 12 nt, Human
cagcucaguccc

SEQ ID NO: 2063708 - RNA, 18 nt, Human
cagcucagucccaucaga

SEQ ID NO: 2063709 - RNA, 22 nt, Human
cagcucauuauaaugucauuaa

SEQ ID NO: 2063710 - RNA, 16 nt, Human
cagcucagucuucccu

SEQ ID NO: 2063711 - RNA, 15 nt, Human
cagcucugcaagaau

SEQ ID NO: 2063712 - RNA, 16 nt, Human
cagcucugcaagaauu

SEQ ID NO: 2063713 - RNA, 19 nt, Human
cagcucucccucuggcccu

SEQ ID NO: 2063714 - RNA, 20 nt, Human
cagcucucccucuggcccug

SEQ ID NO: 2063715 - RNA, 21 nt, Human
cagcucucccucuggcccugc

SEQ ID NO: 2063716 - RNA, 23 nt, Human
cagcucucccucuggcccugccu

SEQ ID NO: 2063717 - RNA, 21 nt, Human
cagcucugcaagaauugaagc

SEQ ID NO: 2063718 - RNA, 12 nt, Human
cagcucugcuug

SEQ ID NO: 2063719 - RNA, 13 nt, Human
cagcucugcuugc

SEQ ID NO: 2063720 - RNA, 22 nt, Human
cagcucugcuugccgaaacugg

SEQ ID NO: 2063721 - RNA, 23 nt, Human
cagcucugcuugccgaaacugga

SEQ ID NO: 2063722 - RNA, 21 nt, Human
cagcucuagacaacccugcaa

SEQ ID NO: 2063723 - RNA, 13 nt, Human
cagcucucagcca

SEQ ID NO: 2063724 - RNA, 12 nt, Human
cagcucucagcc

SEQ ID NO: 2063725 - RNA, 17 nt, Human
cagcucuagacaacccu

SEQ ID NO: 2063726 - RNA, 20 nt, Human
cagcucuagacaacccugca

SEQ ID NO: 2063727 - RNA, 12 nt, Human
cagcucucccuc

SEQ ID NO: 2063728 - RNA, 14 nt, Human
cagcucucccucug

SEQ ID NO: 2063729 - RNA, 15 nt, Human
cagcucucccucugg

SEQ ID NO: 2063730 - RNA, 16 nt, Human
cagcucucccucuggc

SEQ ID NO: 2063731 - RNA, 17 nt, Human
cagcucucccucuggcc

SEQ ID NO: 2063732 - RNA, 18 nt, Human
cagcucucccucuggccc

SEQ ID NO: 2063733 - RNA, 16 nt, Human
cagcucuccccuucuc

SEQ ID NO: 2063734 - RNA, 23 nt, Human
cagcucuucuccaggcuguaucc

SEQ ID NO: 2063735 - RNA, 13 nt, Human
cagcucuucugcc

SEQ ID NO: 2063736 - RNA, 22 nt, Human
cagcucuucugccggcccuggg

SEQ ID NO: 2063737 - RNA, 23 nt, Human
cagcucuucugccggcccugggg

SEQ ID NO: 2063738 - RNA, 19 nt, Human
cagcucuucuccaggcugu

SEQ ID NO: 2063739 - RNA, 18 nt, Human
cagcucuucuccaggcug

SEQ ID NO: 2063740 - RNA, 17 nt, Human
cagcucuucuccaggcu

SEQ ID NO: 2063741 - RNA, 16 nt, Human
cagcucuucuccaggc

SEQ ID NO: 2063742 - RNA, 15 nt, Human
cagcucuucuccagg

SEQ ID NO: 2063743 - RNA, 14 nt, Human
cagcucuucuccag

SEQ ID NO: 2063744 - RNA, 13 nt, Human
cagcucuucucca

SEQ ID NO: 2063745 - RNA, 23 nt, Human
cagcucuguccugggagugagcu

SEQ ID NO: 2063746 - RNA, 17 nt, Human
cagcucuguguugccau

SEQ ID NO: 2063747 - RNA, 21 nt, Human
cagcucuguguugccaugugu

SEQ ID NO: 2063748 - RNA, 18 nt, Human
cagcucuguccugggagu

SEQ ID NO: 2063749 - RNA, 17 nt, Human
cagcucuguccugggag

SEQ ID NO: 2063750 - RNA, 16 nt, Human
cagcucuguccuggga

SEQ ID NO: 2063751 - RNA, 14 nt, Human
cagcucuguccugg

SEQ ID NO: 2063752 - RNA, 13 nt, Human
cagcucuguccug

SEQ ID NO: 2063753 - RNA, 12 nt, Human
cagcucuguccu

SEQ ID NO: 2063754 - RNA, 13 nt, Human
cagcucuggcuca

SEQ ID NO: 2063755 - RNA, 17 nt, Human
cagcucuggcucacaga

SEQ ID NO: 2063756 - RNA, 20 nt, Human
cagcucuggcucacagacug

SEQ ID NO: 2063757 - RNA, 12 nt, Human
cagcucuggcuu

SEQ ID NO: 2063758 - RNA, 14 nt, Human
cagcucuggcuucc

SEQ ID NO: 2063759 - RNA, 17 nt, Human
caggaccuguggccaag

SEQ ID NO: 2063760 - RNA, 13 nt, Human
caggaccugacua

SEQ ID NO: 2063761 - RNA, 20 nt, Human
caggaauuugaagcugcagu

SEQ ID NO: 2063762 - RNA, 15 nt, Human
caggacaacgaggaa

SEQ ID NO: 2063763 - RNA, 16 nt, Human
caggacaacgaggaag

SEQ ID NO: 2063764 - RNA, 18 nt, Human
caggacaacgaggaagcc

SEQ ID NO: 2063765 - RNA, 19 nt, Human
caggacaacgaggaagccc

SEQ ID NO: 2063766 - RNA, 18 nt, Human
caggaauguuaaagucag

SEQ ID NO: 2063767 - RNA, 19 nt, Human
caggaauguuaaagucagu

SEQ ID NO: 2063768 - RNA, 17 nt, Human
caggaauguguggcaga

SEQ ID NO: 2063769 - RNA, 16 nt, Human
caggaagucuucaggg

SEQ ID NO: 2063770 - RNA, 10 nt, Human
caggaaguga

SEQ ID NO: 2063771 - RNA, 12 nt, Human
caggaauaaggc

SEQ ID NO: 2063772 - RNA, 23 nt, Human
caggaauaaggccuuaauauguu

SEQ ID NO: 2063773 - RNA, 22 nt, Human
caggaagggucaaaacauuuua

SEQ ID NO: 2063774 - RNA, 21 nt, Human
caggaagggcaggaaggagag

SEQ ID NO: 2063775 - RNA, 22 nt, Human
caggaagggccuacagcccauu

SEQ ID NO: 2063776 - RNA, 15 nt, Human
caggaaggggcugga

SEQ ID NO: 2063777 - RNA, 23 nt, Human
caggaaggggcuggacuggcugu

SEQ ID NO: 2063778 - RNA, 19 nt, Human
caggaaggcugagaggaga

SEQ ID NO: 2063779 - RNA, 17 nt, Human
caggaaggagagccugc

SEQ ID NO: 2063780 - RNA, 18 nt, Human
caggaaggagagccugcu

SEQ ID NO: 2063781 - RNA, 18 nt, Human
caggaaggaugagcauuu

SEQ ID NO: 2063782 - RNA, 16 nt, Human
caggaagcaccccaug

SEQ ID NO: 2063783 - RNA, 17 nt, Human
caggaagcaccccaugc

SEQ ID NO: 2063784 - RNA, 14 nt, Human
caggaagcacccca

SEQ ID NO: 2063785 - RNA, 15 nt, Human
caggaagcaccccau

SEQ ID NO: 2063786 - RNA, 19 nt, Human
caggaacuagacugccugg

SEQ ID NO: 2063787 - RNA, 13 nt, Human
caggaaccuggac

SEQ ID NO: 2063788 - RNA, 15 nt, Human
caggaaccuggacca

SEQ ID NO: 2063789 - RNA, 19 nt, Human
caggaaccuggaccaaagc

SEQ ID NO: 2063790 - RNA, 21 nt, Human
caggaaccuggaccaaagcug

SEQ ID NO: 2063791 - RNA, 12 nt, Human
caggaagcucag

SEQ ID NO: 2063792 - RNA, 21 nt, Human
caggaagccgugcccugcccc

SEQ ID NO: 2063793 - RNA, 17 nt, Human
caggaagcucagacugg

SEQ ID NO: 2063794 - RNA, 12 nt, Human
caggaaggagag

SEQ ID NO: 2063795 - RNA, 14 nt, Human
caggaaggaaguca

SEQ ID NO: 2063796 - RNA, 13 nt, Human
caggaaggagagc

SEQ ID NO: 2063797 - RNA, 14 nt, Human
caggaaggagagcc

SEQ ID NO: 2063798 - RNA, 15 nt, Human
caggaaggagagccu

SEQ ID NO: 2063799 - RNA, 16 nt, Human
caggaaggagagccug

SEQ ID NO: 2063800 - RNA, 18 nt, Human
caggaagcugcuccgugc

SEQ ID NO: 2063801 - RNA, 15 nt, Human
caggaagcugcuccg

SEQ ID NO: 2063802 - RNA, 17 nt, Human
caggaagcugcuccgug

SEQ ID NO: 2063803 - RNA, 22 nt, Human
caggaagcugugagagcaguuu

SEQ ID NO: 2063804 - RNA, 14 nt, Human
caggaagcugugag

SEQ ID NO: 2063805 - RNA, 13 nt, Human
caggaagcuguga

SEQ ID NO: 2063806 - RNA, 20 nt, Human
cagcuuguaaauagcucagg

SEQ ID NO: 2063807 - RNA, 19 nt, Human
cagcuuguaaauagcucag

SEQ ID NO: 2063808 - RNA, 18 nt, Human
cagcuuguaaauagcuca

SEQ ID NO: 2063809 - RNA, 22 nt, Human
cagcuuguaaauagcucaggug

SEQ ID NO: 2063810 - RNA, 21 nt, Human
cagcuuguaaauagcucaggu

SEQ ID NO: 2063811 - RNA, 17 nt, Human
cagcuuguuauuuauaa

SEQ ID NO: 2063812 - RNA, 17 nt, Human
cagcuuucaugauuagc

SEQ ID NO: 2063813 - RNA, 20 nt, Human
cagcuuucaugauuagcaag

SEQ ID NO: 2063814 - RNA, 16 nt, Human
cagcuuucaugauuag

SEQ ID NO: 2063815 - RNA, 12 nt, Human
cagcuuuguuug

SEQ ID NO: 2063816 - RNA, 21 nt, Human
cagcuuuguuuguugucagcu

SEQ ID NO: 2063817 - RNA, 22 nt, Human
cagcuuuguuuguugucagcug

SEQ ID NO: 2063818 - RNA, 23 nt, Human
cagcuuuguuuguugucagcuga

SEQ ID NO: 2063819 - RNA, 18 nt, Human
cagcuuugccuuccacgc

SEQ ID NO: 2063820 - RNA, 15 nt, Human
cagcuuugccuucca

SEQ ID NO: 2063821 - RNA, 16 nt, Human
cagcuuugccuuccac

SEQ ID NO: 2063822 - RNA, 17 nt, Human
cagcuuggggccaucgg

SEQ ID NO: 2063823 - RNA, 14 nt, Human
cagcuuugccuucc

SEQ ID NO: 2063824 - RNA, 13 nt, Human
cagcuuuuugucu

SEQ ID NO: 2063825 - RNA, 16 nt, Human
cagcuuuuugucuuuu

SEQ ID NO: 2063826 - RNA, 19 nt, Human
cagcuuuuugucuuuucug

SEQ ID NO: 2063827 - RNA, 18 nt, Human
cagcuuuuaguacccacc

SEQ ID NO: 2063828 - RNA, 19 nt, Human
cagcuuuuaguacccaccu

SEQ ID NO: 2063829 - RNA, 20 nt, Human
cagcuuuuaguacccaccug

SEQ ID NO: 2063830 - RNA, 21 nt, Human
cagcuuuuaguacccaccuga

SEQ ID NO: 2063831 - RNA, 22 nt, Human
cagcuuuuaguacccaccugag

SEQ ID NO: 2063832 - RNA, 23 nt, Human
cagcuuuuaguacccaccugagc

SEQ ID NO: 2063833 - RNA, 14 nt, Human
caggaaaaaggaca

SEQ ID NO: 2063834 - RNA, 16 nt, Human
caggaaaaaggacagg

SEQ ID NO: 2063835 - RNA, 22 nt, Human
caggaaaaaggacaggcagaaa

SEQ ID NO: 2063836 - RNA, 14 nt, Human
caggaaaaaaacuu

SEQ ID NO: 2063837 - RNA, 15 nt, Human
caggaaaaaaacuuu

SEQ ID NO: 2063838 - RNA, 16 nt, Human
caggaaaaaaacuuuu

SEQ ID NO: 2063839 - RNA, 18 nt, Human
caggaaaaaaacuuuuau

SEQ ID NO: 2063840 - RNA, 19 nt, Human
caggaaaacugacagagga

SEQ ID NO: 2063841 - RNA, 20 nt, Human
caggaaaacugacagaggag

SEQ ID NO: 2063842 - RNA, 15 nt, Human
caggaacagaaggau

SEQ ID NO: 2063843 - RNA, 18 nt, Human
caggaacagaaggaugaa

SEQ ID NO: 2063844 - RNA, 14 nt, Human
caggaacagcuaug

SEQ ID NO: 2063845 - RNA, 20 nt, Human
caggaacagcuaugggagcc

SEQ ID NO: 2063846 - RNA, 22 nt, Human
caggaacagcuaugggagcccc

SEQ ID NO: 2063847 - RNA, 23 nt, Human
caggaacagcuaugggagcccca

SEQ ID NO: 2063848 - RNA, 18 nt, Human
cagcuuccccucucuccu

SEQ ID NO: 2063849 - RNA, 22 nt, Human
cagcuuccccucucuccuccug

SEQ ID NO: 2063850 - RNA, 23 nt, Human
cagcuuccccucucuccuccugc

SEQ ID NO: 2063851 - RNA, 21 nt, Human
cagcuucauuuccugugucuu

SEQ ID NO: 2063852 - RNA, 20 nt, Human
cagcuucauuuccugugucu

SEQ ID NO: 2063853 - RNA, 21 nt, Human
cagcuguaagaagagacuggg

SEQ ID NO: 2063854 - RNA, 22 nt, Human
cagcuguaagaagagacuggga

SEQ ID NO: 2063855 - RNA, 19 nt, Human
cagcuucauuuccuguguc

SEQ ID NO: 2063856 - RNA, 19 nt, Human
cagcuucugccacauaaaa

SEQ ID NO: 2063857 - RNA, 21 nt, Human
cagcuucucauccugcaggca

SEQ ID NO: 2063858 - RNA, 19 nt, Human
cagcuucucauccugcagg

SEQ ID NO: 2063859 - RNA, 20 nt, Human
cagcuucucauccugcaggc

SEQ ID NO: 2063860 - RNA, 18 nt, Human
cagcuucucauccugcag

SEQ ID NO: 2063861 - RNA, 22 nt, Human
cagcuucuuaauauaacugccu

SEQ ID NO: 2063862 - RNA, 15 nt, Human
cagcuugaggguugg

SEQ ID NO: 2063863 - RNA, 14 nt, Human
cagcuugaggguug

SEQ ID NO: 2063864 - RNA, 21 nt, Human
cagcuugaggguugggcuggu

SEQ ID NO: 2063865 - RNA, 20 nt, Human
cagcuugaggguugggcugg

SEQ ID NO: 2063866 - RNA, 19 nt, Human
cagcuugaggguugggcug

SEQ ID NO: 2063867 - RNA, 18 nt, Human
cagcuugaggguugggcu

SEQ ID NO: 2063868 - RNA, 17 nt, Human
cagcuugcugcccuagg

SEQ ID NO: 2063869 - RNA, 19 nt, Human
cagcuugcugcccuaggcu

SEQ ID NO: 2063870 - RNA, 15 nt, Human
cagcuugcucuucag

SEQ ID NO: 2063871 - RNA, 23 nt, Human
cagcuugcucuucagugggagaa

SEQ ID NO: 2063872 - RNA, 13 nt, Human
cagcuugcugcac

SEQ ID NO: 2063873 - RNA, 14 nt, Human
cagcuugcugcacc

SEQ ID NO: 2063874 - RNA, 14 nt, Human
cagcuugcugcccu

SEQ ID NO: 2063875 - RNA, 22 nt, Human
cagcuugcguuagaaugaggag

SEQ ID NO: 2063876 - RNA, 14 nt, Human
cagcaagguggagu

SEQ ID NO: 2063877 - RNA, 15 nt, Human
cagcaagguggagug

SEQ ID NO: 2063878 - RNA, 12 nt, Human
cagcaagugaga

SEQ ID NO: 2063879 - RNA, 17 nt, Human
cagcaagugagagcugg

SEQ ID NO: 2063880 - RNA, 16 nt, Human
cagcaagugagagcug

SEQ ID NO: 2063881 - RNA, 15 nt, Human
cagcaagugagagcu

SEQ ID NO: 2063882 - RNA, 14 nt, Human
cagcaagugagagc

SEQ ID NO: 2063883 - RNA, 12 nt, Human
cagcaaggggcu

SEQ ID NO: 2063884 - RNA, 14 nt, Human
cagcaaggggcucu

SEQ ID NO: 2063885 - RNA, 16 nt, Human
cagcaaggggcucugc

SEQ ID NO: 2063886 - RNA, 17 nt, Human
cagcaaggggcucugcc

SEQ ID NO: 2063887 - RNA, 20 nt, Human
cagcaaggggcucugcccuc

SEQ ID NO: 2063888 - RNA, 20 nt, Human
cagcaacuugucuuuuucug

SEQ ID NO: 2063889 - RNA, 21 nt, Human
cagcaagugagagcugggugu

SEQ ID NO: 2063890 - RNA, 19 nt, Human
cagcaagugagagcugggu

SEQ ID NO: 2063891 - RNA, 13 nt, Human
cagcaauauuuaa

SEQ ID NO: 2063892 - RNA, 17 nt, Human
cagcaauauuuaaggag

SEQ ID NO: 2063893 - RNA, 19 nt, Human
cagcaauauuuaaggagau

SEQ ID NO: 2063894 - RNA, 14 nt, Human
cagcacugucucag

SEQ ID NO: 2063895 - RNA, 17 nt, Human
cagcagaucccagcuca

SEQ ID NO: 2063896 - RNA, 18 nt, Human
cagcagaucccagcucac

SEQ ID NO: 2063897 - RNA, 21 nt, Human
cagcagaucccagcucacguc

SEQ ID NO: 2063898 - RNA, 12 nt, Human
cagcagaucugu

SEQ ID NO: 2063899 - RNA, 13 nt, Human
cagcagagugugg

SEQ ID NO: 2063900 - RNA, 15 nt, Human
cagcagaucccagcu

SEQ ID NO: 2063901 - RNA, 16 nt, Human
cagcagaucccagcuc

SEQ ID NO: 2063902 - RNA, 23 nt, Human
cagcagccccugcacaaagcccu

SEQ ID NO: 2063903 - RNA, 16 nt, Human
cagcagccccugcaca

SEQ ID NO: 2063904 - RNA, 13 nt, Human
cagcagccccugc

SEQ ID NO: 2063905 - RNA, 18 nt, Human
cagcagcccuccucaccc

SEQ ID NO: 2063906 - RNA, 13 nt, Human
cagcagccucuga

SEQ ID NO: 2063907 - RNA, 16 nt, Human
cagcagccucugaagu

SEQ ID NO: 2063908 - RNA, 18 nt, Human
cagcagccucugaaguug

SEQ ID NO: 2063909 - RNA, 23 nt, Human
cagcagccucugaaguuggacag

SEQ ID NO: 2063910 - RNA, 11 nt, Human
cagcagcccuc

SEQ ID NO: 2063911 - RNA, 12 nt, Human
cagcagcccucc

SEQ ID NO: 2063912 - RNA, 14 nt, Human
cagcagcccuccuc

SEQ ID NO: 2063913 - RNA, 15 nt, Human
cagcagcccuccuca

SEQ ID NO: 2063914 - RNA, 17 nt, Human
cagcagcccuccucacc

SEQ ID NO: 2063915 - RNA, 19 nt, Human
cagcagcccuccucacccc

SEQ ID NO: 2063916 - RNA, 20 nt, Human
cagcagccagcucucagcca

SEQ ID NO: 2063917 - RNA, 21 nt, Human
cagcagccagcucucagccaa

SEQ ID NO: 2063918 - RNA, 13 nt, Human
cagcagccagcuc

SEQ ID NO: 2063919 - RNA, 14 nt, Human
cagcagccagcucu

SEQ ID NO: 2063920 - RNA, 15 nt, Human
cagcagccagcucuc

SEQ ID NO: 2063921 - RNA, 17 nt, Human
cagcagccagcucucag

SEQ ID NO: 2063922 - RNA, 18 nt, Human
cagcagccagcucucagc

SEQ ID NO: 2063923 - RNA, 19 nt, Human
cagcagccagcucucagcc

SEQ ID NO: 2063924 - RNA, 14 nt, Human
cagcagacuaugaa

SEQ ID NO: 2063925 - RNA, 22 nt, Human
cagcacuuugggaggcugaggu

SEQ ID NO: 2063926 - RNA, 23 nt, Human
cagcacuuugggaggcugaggug

SEQ ID NO: 2063927 - RNA, 20 nt, Human
cagcacuuugggaggccaag

SEQ ID NO: 2063928 - RNA, 22 nt, Human
cagcacuuugggaggccaagga

SEQ ID NO: 2063929 - RNA, 23 nt, Human
cagcacuuugggaggccaaggag

SEQ ID NO: 2063930 - RNA, 18 nt, Human
cagcacuuugggaggcug

SEQ ID NO: 2063931 - RNA, 19 nt, Human
cagcacuuugggaggcuga

SEQ ID NO: 2063932 - RNA, 20 nt, Human
cagcacuuugggaggcugag

SEQ ID NO: 2063933 - RNA, 22 nt, Human
cagcacuuugggaggcugaggc

SEQ ID NO: 2063934 - RNA, 23 nt, Human
cagcacuuugggaggcugaggcg

SEQ ID NO: 2063935 - RNA, 15 nt, Human
cagcacuuugggagg

SEQ ID NO: 2063936 - RNA, 16 nt, Human
cagcacuuugggaggc

SEQ ID NO: 2063937 - RNA, 18 nt, Human
cagcacuuugggaggcca

SEQ ID NO: 2063938 - RNA, 15 nt, Human
cagcacugucucagu

SEQ ID NO: 2063939 - RNA, 23 nt, Human
cagcacugucucaguuucacuuu

SEQ ID NO: 2063940 - RNA, 19 nt, Human
cagauuuuuuacagcugcc

SEQ ID NO: 2063941 - RNA, 22 nt, Human
cagauuuuuuacagcugccugc

SEQ ID NO: 2063942 - RNA, 12 nt, Human
cagauuuuccug

SEQ ID NO: 2063943 - RNA, 14 nt, Human
cagauuuuccugug

SEQ ID NO: 2063944 - RNA, 14 nt, Human
cagauuuuacaaaa

SEQ ID NO: 2063945 - RNA, 16 nt, Human
cagauuuuacaaaaga

SEQ ID NO: 2063946 - RNA, 17 nt, Human
cagauuuuacaaaagau

SEQ ID NO: 2063947 - RNA, 18 nt, Human
cagauuuuacaaaagaug

SEQ ID NO: 2063948 - RNA, 19 nt, Human
cagauuuuacaaaagaugu

SEQ ID NO: 2063949 - RNA, 23 nt, Human
cagauuuuaauuuugaauaaaua

SEQ ID NO: 2063950 - RNA, 15 nt, Human
cagauuuuaauuuug

SEQ ID NO: 2063951 - RNA, 18 nt, Human
cagcaaaagaugcuucuc

SEQ ID NO: 2063952 - RNA, 12 nt, Human
cagcaaaaccau

SEQ ID NO: 2063953 - RNA, 13 nt, Human
cagcaaaaccauu

SEQ ID NO: 2063954 - RNA, 17 nt, Human
cagcaaaaccauugcuu

SEQ ID NO: 2063955 - RNA, 18 nt, Human
cagcaaaaccauugcuuc

SEQ ID NO: 2063956 - RNA, 19 nt, Human
cagcaaaaccauugcuuca

SEQ ID NO: 2063957 - RNA, 20 nt, Human
cagcaaaaccauugcuucac

SEQ ID NO: 2063958 - RNA, 15 nt, Human
cagcaaaacuccauc

SEQ ID NO: 2063959 - RNA, 14 nt, Human
cagcaaauuuauaa

SEQ ID NO: 2063960 - RNA, 16 nt, Human
cagcaaauuuauaauu

SEQ ID NO: 2063961 - RNA, 17 nt, Human
cagcaaauuuauaauuu

SEQ ID NO: 2063962 - RNA, 19 nt, Human
cagcaaauuuauaauuuua

SEQ ID NO: 2063963 - RNA, 20 nt, Human
cagcaacggggaggccaagu

SEQ ID NO: 2063964 - RNA, 14 nt, Human
cagcaacuccaacu

SEQ ID NO: 2063965 - RNA, 15 nt, Human
cagcaacuugucuuu

SEQ ID NO: 2063966 - RNA, 18 nt, Human
cagcaacuugucuuuuuc

SEQ ID NO: 2063967 - RNA, 19 nt, Human
cagcaacuugucuuuuucu

SEQ ID NO: 2063968 - RNA, 22 nt, Human
cagcaacuugucuuuuucugga

SEQ ID NO: 2063969 - RNA, 14 nt, Human
cagcaacacaaugu

SEQ ID NO: 2063970 - RNA, 14 nt, Human
cagcaaccagagca

SEQ ID NO: 2063971 - RNA, 15 nt, Human
cagcaaccagagcac

SEQ ID NO: 2063972 - RNA, 16 nt, Human
cagcaaccagagcacu

SEQ ID NO: 2063973 - RNA, 17 nt, Human
cagcaaccagagcacug

SEQ ID NO: 2063974 - RNA, 18 nt, Human
cagcaaccagagcacugu

SEQ ID NO: 2063975 - RNA, 19 nt, Human
cagcaaccagagcacugua

SEQ ID NO: 2063976 - RNA, 20 nt, Human
cagcaaccagagcacuguau

SEQ ID NO: 2063977 - RNA, 21 nt, Human
cagcaaccagagcacuguaua

SEQ ID NO: 2063978 - RNA, 14 nt, Human
cagcaacccuccua

SEQ ID NO: 2063979 - RNA, 13 nt, Human
cagcaaccuguaa

SEQ ID NO: 2063980 - RNA, 18 nt, Human
cagcaaccuguaagacug

SEQ ID NO: 2063981 - RNA, 19 nt, Human
cagcaaccuguaagacuga

SEQ ID NO: 2063982 - RNA, 23 nt, Human
cagauguugaaugcccacaggca

SEQ ID NO: 2063983 - RNA, 15 nt, Human
cagauucauuuuucu

SEQ ID NO: 2063984 - RNA, 21 nt, Human
cagauuccaggcgaugugcaa

SEQ ID NO: 2063985 - RNA, 23 nt, Human
cagauuccaggcgaugugcaagu

SEQ ID NO: 2063986 - RNA, 14 nt, Human
cagauuccuuuccc

SEQ ID NO: 2063987 - RNA, 16 nt, Human
cagauuccuuucccuu

SEQ ID NO: 2063988 - RNA, 20 nt, Human
cagauuccuuucccuuuagc

SEQ ID NO: 2063989 - RNA, 13 nt, Human
cagauucaauuuu

SEQ ID NO: 2063990 - RNA, 12 nt, Human
cagaugcuucug

SEQ ID NO: 2063991 - RNA, 13 nt, Human
cagaugcuucugg

SEQ ID NO: 2063992 - RNA, 17 nt, Human
cagaugcuucugggaga

SEQ ID NO: 2063993 - RNA, 22 nt, Human
cagaugccuccaccccccagaa

SEQ ID NO: 2063994 - RNA, 14 nt, Human
cagaugccuccacc

SEQ ID NO: 2063995 - RNA, 18 nt, Human
cagaugccccagagcugu

SEQ ID NO: 2063996 - RNA, 13 nt, Human
cagaugccagagc

SEQ ID NO: 2063997 - RNA, 14 nt, Human
cagaugccagagca

SEQ ID NO: 2063998 - RNA, 18 nt, Human
cagaugccagagcaaagg

SEQ ID NO: 2063999 - RNA, 15 nt, Human
cagaugcccagaggg

SEQ ID NO: 2064000 - RNA, 19 nt, Human
cagaugcccagagggccca

SEQ ID NO: 2064001 - RNA, 20 nt, Human
cagaugcccagagggcccag

SEQ ID NO: 2064002 - RNA, 22 nt, Human
cagaugcccagagggcccaggc

SEQ ID NO: 2064003 - RNA, 13 nt, Human
cagaugccccaga

SEQ ID NO: 2064004 - RNA, 16 nt, Human
cagaugccccagagcu

SEQ ID NO: 2064005 - RNA, 22 nt, Human
cagauggauuugccugugccac

SEQ ID NO: 2064006 - RNA, 21 nt, Human
cagauggaaccgcaggaagcu

SEQ ID NO: 2064007 - RNA, 22 nt, Human
cagauggaaccgcaggaagcug

SEQ ID NO: 2064008 - RNA, 15 nt, Human
cagauggauuugccu

SEQ ID NO: 2064009 - RNA, 21 nt, Human
cagauggauuugccugugcca

SEQ ID NO: 2064010 - RNA, 14 nt, Human
cagauggaaccgca

SEQ ID NO: 2064011 - RNA, 18 nt, Human
cagauggaaccgcaggaa

SEQ ID NO: 2064012 - RNA, 19 nt, Human
cagauggaaccgcaggaag

SEQ ID NO: 2064013 - RNA, 20 nt, Human
cagauggaaccgcaggaagc

SEQ ID NO: 2064014 - RNA, 11 nt, Human
cagcccagcug

SEQ ID NO: 2064015 - RNA, 13 nt, Human
cagcccagcugcu

SEQ ID NO: 2064016 - RNA, 16 nt, Human
cagcccagcugcucug

SEQ ID NO: 2064017 - RNA, 17 nt, Human
cagcccagcugcucugc

SEQ ID NO: 2064018 - RNA, 18 nt, Human
cagcccagcugcucugcc

SEQ ID NO: 2064019 - RNA, 19 nt, Human
cagcccagcugcucugccc

SEQ ID NO: 2064020 - RNA, 20 nt, Human
cagcccagcugcucugccca

SEQ ID NO: 2064021 - RNA, 21 nt, Human
cagcccagcugcucugcccag

SEQ ID NO: 2064022 - RNA, 23 nt, Human
cagcccagcugcucugcccagag

SEQ ID NO: 2064023 - RNA, 13 nt, Human
cagcccagcccag

SEQ ID NO: 2064024 - RNA, 14 nt, Human
cagcccagcccagc

SEQ ID NO: 2064025 - RNA, 15 nt, Human
cagcccagcccagcu

SEQ ID NO: 2064026 - RNA, 18 nt, Human
cagcccagcccagcugcu

SEQ ID NO: 2064027 - RNA, 17 nt, Human
cagcccagcccagcugg

SEQ ID NO: 2064028 - RNA, 12 nt, Human
cagcccaggccu

SEQ ID NO: 2064029 - RNA, 13 nt, Human
cagcccaggccuc

SEQ ID NO: 2064030 - RNA, 17 nt, Human
cagcccaggccuccagc

SEQ ID NO: 2064031 - RNA, 20 nt, Human
cagcccaggccuccagcuca

SEQ ID NO: 2064032 - RNA, 18 nt, Human
cagcccacuucugccaua

SEQ ID NO: 2064033 - RNA, 14 nt, Human
cagcccacugagaa

SEQ ID NO: 2064034 - RNA, 16 nt, Human
cagcccacugagaagu

SEQ ID NO: 2064035 - RNA, 15 nt, Human
cagcccacuggauca

SEQ ID NO: 2064036 - RNA, 20 nt, Human
cagcccacuggaucagaaag

SEQ ID NO: 2064037 - RNA, 11 nt, Human
cagcccagggu

SEQ ID NO: 2064038 - RNA, 17 nt, Human
cagcccaggguuccccc

SEQ ID NO: 2064039 - RNA, 18 nt, Human
cagcccaggguuccccca

SEQ ID NO: 2064040 - RNA, 19 nt, Human
cagcccaggguucccccag

SEQ ID NO: 2064041 - RNA, 14 nt, Human
cagcccaucuugcc

SEQ ID NO: 2064042 - RNA, 16 nt, Human
cagcccaucuugccuc

SEQ ID NO: 2064043 - RNA, 17 nt, Human
cagcccaucuugccucc

SEQ ID NO: 2064044 - RNA, 18 nt, Human
cagcccaucuugccucca

SEQ ID NO: 2064045 - RNA, 15 nt, Human
cagcccaugcccacc

SEQ ID NO: 2064046 - RNA, 16 nt, Human
cagcccaugcccaccu

SEQ ID NO: 2064047 - RNA, 17 nt, Human
cagcccaugcccaccug

SEQ ID NO: 2064048 - RNA, 24 nt, Human
cagcccaugcccaccugcccauca

SEQ ID NO: 2064049 - RNA, 19 nt, Human
cagcccaugcccaccugcc

SEQ ID NO: 2064050 - RNA, 21 nt, Human
cagcccaugcccaccugccca

SEQ ID NO: 2064051 - RNA, 18 nt, Human
cagcccauucucucuccu

SEQ ID NO: 2064052 - RNA, 20 nt, Human
cagcccauucucucuccugu

SEQ ID NO: 2064053 - RNA, 21 nt, Human
cagcccauucucucuccuguc

SEQ ID NO: 2064054 - RNA, 22 nt, Human
cagcccauucucucuccugucc

SEQ ID NO: 2064055 - RNA, 15 nt, Human
cagcccacuucugcc

SEQ ID NO: 2064056 - RNA, 11 nt, Human
cagcccacccc

SEQ ID NO: 2064057 - RNA, 12 nt, Human
cagcccaccccc

SEQ ID NO: 2064058 - RNA, 19 nt, Human
cagcccacauagugauggu

SEQ ID NO: 2064059 - RNA, 14 nt, Human
cagcccaccccccu

SEQ ID NO: 2064060 - RNA, 16 nt, Human
cagcccaccccccuca

SEQ ID NO: 2064061 - RNA, 17 nt, Human
cagcccaccccccucau

SEQ ID NO: 2064062 - RNA, 19 nt, Human
cagcccaccccccucauuu

SEQ ID NO: 2064063 - RNA, 15 nt, Human
cagcccaccccucaa

SEQ ID NO: 2064064 - RNA, 18 nt, Human
cagccaugaggaguugcu

SEQ ID NO: 2064065 - RNA, 16 nt, Human
cagccauuaccaugga

SEQ ID NO: 2064066 - RNA, 22 nt, Human
cagccaugaggaguugcuguuu

SEQ ID NO: 2064067 - RNA, 17 nt, Human
cagcccaaagaaggaaa

SEQ ID NO: 2064068 - RNA, 20 nt, Human
cagccauuaccauggagaca

SEQ ID NO: 2064069 - RNA, 15 nt, Human
cagccaccucucuuu

SEQ ID NO: 2064070 - RNA, 16 nt, Human
cagccaccucucuuuu

SEQ ID NO: 2064071 - RNA, 22 nt, Human
cagccaccccgggcucucugcu

SEQ ID NO: 2064072 - RNA, 17 nt, Human
cagccaccccgggcucu

SEQ ID NO: 2064073 - RNA, 20 nt, Human
cagccaccccgggcucucug

SEQ ID NO: 2064074 - RNA, 21 nt, Human
cagccaccccgggcucucugc

SEQ ID NO: 2064075 - RNA, 11 nt, Human
cagccaccccg

SEQ ID NO: 2064076 - RNA, 16 nt, Human
cagcauggugcaugcc

SEQ ID NO: 2064077 - RNA, 22 nt, Human
cagccaagucgguuaguggaag

SEQ ID NO: 2064078 - RNA, 12 nt, Human
cagccacacugu

SEQ ID NO: 2064079 - RNA, 22 nt, Human
cagccacggccaggccagaggg

SEQ ID NO: 2064080 - RNA, 21 nt, Human
cagccacggccaggccagagg

SEQ ID NO: 2064081 - RNA, 19 nt, Human
cagccacggccaggccaga

SEQ ID NO: 2064082 - RNA, 18 nt, Human
cagccacggccaggccag

SEQ ID NO: 2064083 - RNA, 17 nt, Human
cagccacggccaggcca

SEQ ID NO: 2064084 - RNA, 16 nt, Human
cagccacggccaggcc

SEQ ID NO: 2064085 - RNA, 15 nt, Human
cagccacggccaggc

SEQ ID NO: 2064086 - RNA, 14 nt, Human
cagccacggccagg

SEQ ID NO: 2064087 - RNA, 17 nt, Human
cagccagaaccccgagc

SEQ ID NO: 2064088 - RNA, 22 nt, Human
cagccagaaccccgagcccuac

SEQ ID NO: 2064089 - RNA, 15 nt, Human
cagccacaugggaaa

SEQ ID NO: 2064090 - RNA, 23 nt, Human
cagccacggccaggccagaggga

SEQ ID NO: 2064091 - RNA, 16 nt, Human
cagccagugaccugag

SEQ ID NO: 2064092 - RNA, 19 nt, Human
cagccagugaccugaggaa

SEQ ID NO: 2064093 - RNA, 20 nt, Human
cagccagugaccugaggaag

SEQ ID NO: 2064094 - RNA, 21 nt, Human
cagccagugaccugaggaagc

SEQ ID NO: 2064095 - RNA, 22 nt, Human
cagccagugaccugaggaagcg

SEQ ID NO: 2064096 - RNA, 20 nt, Human
cagcauccuggcacccggcc

SEQ ID NO: 2064097 - RNA, 19 nt, Human
cagcauccuggcacccggc

SEQ ID NO: 2064098 - RNA, 21 nt, Human
cagcauccuggcacccggccc

SEQ ID NO: 2064099 - RNA, 22 nt, Human
cagcauccuuaaguaucagaaa

SEQ ID NO: 2064100 - RNA, 23 nt, Human
cagcauccuuuucugcagagggg

SEQ ID NO: 2064101 - RNA, 20 nt, Human
cagcaggguagucugguuuc

SEQ ID NO: 2064102 - RNA, 17 nt, Human
cagcagggccucaaagu

SEQ ID NO: 2064103 - RNA, 13 nt, Human
cagcaucuucuca

SEQ ID NO: 2064104 - RNA, 22 nt, Human
cagcauguguauuuccagugca

SEQ ID NO: 2064105 - RNA, 21 nt, Human
cagcaugaccugugaccagca

SEQ ID NO: 2064106 - RNA, 23 nt, Human
cagcaugaccugugaccagcacu

SEQ ID NO: 2064107 - RNA, 14 nt, Human
cagcauucucacuc

SEQ ID NO: 2064108 - RNA, 15 nt, Human
cagcauucucacucc

SEQ ID NO: 2064109 - RNA, 18 nt, Human
cagcauucuuagccugug

SEQ ID NO: 2064110 - RNA, 21 nt, Human
cagcauucuuagccuguggca

SEQ ID NO: 2064111 - RNA, 19 nt, Human
cagcauucuugucacaaua

SEQ ID NO: 2064112 - RNA, 20 nt, Human
cagcauucuugucacaauaa

SEQ ID NO: 2064113 - RNA, 21 nt, Human
cagcauucuugucacaauaaa

SEQ ID NO: 2064114 - RNA, 22 nt, Human
cagcauucuugucacaauaaau

SEQ ID NO: 2064115 - RNA, 15 nt, Human
cagccaaagccuccu

SEQ ID NO: 2064116 - RNA, 16 nt, Human
cagccaaagccuccuc

SEQ ID NO: 2064117 - RNA, 16 nt, Human
cagccaaacccaugag

SEQ ID NO: 2064118 - RNA, 17 nt, Human
cagccaaacccaugagg

SEQ ID NO: 2064119 - RNA, 19 nt, Human
cagccaaacccaugaggca

SEQ ID NO: 2064120 - RNA, 15 nt, Human
cagccaaacccuguc

SEQ ID NO: 2064121 - RNA, 16 nt, Human
cagccaaacccugucu

SEQ ID NO: 2064122 - RNA, 17 nt, Human
cagccaaacccugucug

SEQ ID NO: 2064123 - RNA, 14 nt, Human
cagcauugcuuucu

SEQ ID NO: 2064124 - RNA, 16 nt, Human
cagcauugcuuucuga

SEQ ID NO: 2064125 - RNA, 12 nt, Human
cagcauugcuuu

SEQ ID NO: 2064126 - RNA, 13 nt, Human
cagcauugcuuuc

SEQ ID NO: 2064127 - RNA, 18 nt, Human
cagccaaagccuccucca

SEQ ID NO: 2064128 - RNA, 21 nt, Human
cagccaaagccuccuccagcc

SEQ ID NO: 2064129 - RNA, 17 nt, Human
cagccaaagauaaucuc

SEQ ID NO: 2064130 - RNA, 20 nt, Human
cagccaaagauaaucucuca

SEQ ID NO: 2064131 - RNA, 22 nt, Human
cagccaaauguaauugaauaaa

SEQ ID NO: 2064132 - RNA, 12 nt, Human
cagccaaccccu

SEQ ID NO: 2064133 - RNA, 14 nt, Human
cagccaaccccugu

SEQ ID NO: 2064134 - RNA, 15 nt, Human
cagccaaccccugug

SEQ ID NO: 2064135 - RNA, 21 nt, Human
cagccaaccccuguggagccc

SEQ ID NO: 2064136 - RNA, 16 nt, Human
cagccaaccccugugg

SEQ ID NO: 2064137 - RNA, 18 nt, Human
cagccaaccccuguggag

SEQ ID NO: 2064138 - RNA, 20 nt, Human
cagccaaccuuacuuacagc

SEQ ID NO: 2064139 - RNA, 21 nt, Human
cagccaacgaguaauuuauug

SEQ ID NO: 2064140 - RNA, 15 nt, Human
cagcagcuugcugca

SEQ ID NO: 2064141 - RNA, 17 nt, Human
cagcagcuuuuaauaca

SEQ ID NO: 2064142 - RNA, 14 nt, Human
cagcagcucaggca

SEQ ID NO: 2064143 - RNA, 15 nt, Human
cagcagcucaggcac

SEQ ID NO: 2064144 - RNA, 16 nt, Human
cagcagcucaggcaca

SEQ ID NO: 2064145 - RNA, 19 nt, Human
cagcagccuggacccugug

SEQ ID NO: 2064146 - RNA, 22 nt, Human
cagcagccuggacccuguggau

SEQ ID NO: 2064147 - RNA, 12 nt, Human
cagcagcucagg

SEQ ID NO: 2064148 - RNA, 13 nt, Human
cagcagcucaggc

SEQ ID NO: 2064149 - RNA, 12 nt, Human
cagcagccugga

SEQ ID NO: 2064150 - RNA, 14 nt, Human
cagcagccuggacc

SEQ ID NO: 2064151 - RNA, 15 nt, Human
cagcagccuggaccc

SEQ ID NO: 2064152 - RNA, 18 nt, Human
cagcagccuggacccugu

SEQ ID NO: 2064153 - RNA, 17 nt, Human
cagcauccuggcacccg

SEQ ID NO: 2064154 - RNA, 16 nt, Human
cagcauccuggcaccc

SEQ ID NO: 2064155 - RNA, 15 nt, Human
cagcauccuggcacc

SEQ ID NO: 2064156 - RNA, 14 nt, Human
cagcauccuggcac

SEQ ID NO: 2064157 - RNA, 20 nt, Human
cagcagggagggcuucugcc

SEQ ID NO: 2064158 - RNA, 14 nt, Human
cagcagggccucaa

SEQ ID NO: 2064159 - RNA, 15 nt, Human
cagcagggccucaaa

SEQ ID NO: 2064160 - RNA, 13 nt, Human
cagcaggcccacc

SEQ ID NO: 2064161 - RNA, 14 nt, Human
cagcaggcccaccu

SEQ ID NO: 2064162 - RNA, 18 nt, Human
cagcaggcccaccuaccu

SEQ ID NO: 2064163 - RNA, 13 nt, Human
cagcaggccuguu

SEQ ID NO: 2064164 - RNA, 21 nt, Human
cagcaggccuguugcuuuuuu

SEQ ID NO: 2064165 - RNA, 23 nt, Human
cagcaggcggccuuuguugcuca

SEQ ID NO: 2064166 - RNA, 18 nt, Human
cagcagggagggcuucug

SEQ ID NO: 2064167 - RNA, 23 nt, Human
cagcccauucucucuccugucca

SEQ ID NO: 2064168 - RNA, 18 nt, Human
cagccuccaugcugccuc

SEQ ID NO: 2064169 - RNA, 14 nt, Human
cagcucaccagccc

SEQ ID NO: 2064170 - RNA, 16 nt, Human
cagucuuggcucacug

SEQ ID NO: 2064171 - RNA, 17 nt, Human
cagucuuguauuaaguu

SEQ ID NO: 2064172 - RNA, 16 nt, Human
cagucuuccaccugga

SEQ ID NO: 2064173 - RNA, 17 nt, Human
cagucuuccaccuggaa

SEQ ID NO: 2064174 - RNA, 18 nt, Human
cagucuuccaccuggaag

SEQ ID NO: 2064175 - RNA, 19 nt, Human
cagucuuccaccuggaagc

SEQ ID NO: 2064176 - RNA, 20 nt, Human
cagucuucccuagggcuggg

SEQ ID NO: 2064177 - RNA, 22 nt, Human
cagucuucccuagggcugggug

SEQ ID NO: 2064178 - RNA, 23 nt, Human
cagucuucccuagggcugggugu

SEQ ID NO: 2064179 - RNA, 15 nt, Human
cagucuugaauuucu

SEQ ID NO: 2064180 - RNA, 22 nt, Human
cagucuugaauuucuaaaaaac

SEQ ID NO: 2064181 - RNA, 23 nt, Human
cagucuugaauuucuaaaaaaca

SEQ ID NO: 2064182 - RNA, 19 nt, Human
cagucuggaaugcaguggu

SEQ ID NO: 2064183 - RNA, 12 nt, Human
cagucuggaggg

SEQ ID NO: 2064184 - RNA, 13 nt, Human
cagucuggagggg

SEQ ID NO: 2064185 - RNA, 16 nt, Human
cagucuggaggggcau

SEQ ID NO: 2064186 - RNA, 18 nt, Human
cagucuggaggggcaugg

SEQ ID NO: 2064187 - RNA, 21 nt, Human
cagucuggaggggcauggcca

SEQ ID NO: 2064188 - RNA, 13 nt, Human
caguccucuuuca

SEQ ID NO: 2064189 - RNA, 17 nt, Human
caguccugccucagccu

SEQ ID NO: 2064190 - RNA, 19 nt, Human
caguccugccucagccucc

SEQ ID NO: 2064191 - RNA, 12 nt, Human
caguccugccug

SEQ ID NO: 2064192 - RNA, 13 nt, Human
caguccugccugg

SEQ ID NO: 2064193 - RNA, 14 nt, Human
caguccugccuggc

SEQ ID NO: 2064194 - RNA, 15 nt, Human
caguccugccuggcc

SEQ ID NO: 2064195 - RNA, 18 nt, Human
caguccugccuggccagg

SEQ ID NO: 2064196 - RNA, 13 nt, Human
caguccugcucuc

SEQ ID NO: 2064197 - RNA, 14 nt, Human
caguccugcucucu

SEQ ID NO: 2064198 - RNA, 17 nt, Human
caguccugcucucuacc

SEQ ID NO: 2064199 - RNA, 18 nt, Human
caguccugcucucuaccc

SEQ ID NO: 2064200 - RNA, 22 nt, Human
caguccugcucucuacccagcc

SEQ ID NO: 2064201 - RNA, 23 nt, Human
caguccugcucucuacccagccc

SEQ ID NO: 2064202 - RNA, 16 nt, Human
caguccugccuggcca

SEQ ID NO: 2064203 - RNA, 17 nt, Human
caguccugccuggccag

SEQ ID NO: 2064204 - RNA, 21 nt, Human
caguccugccuggccaggcag

SEQ ID NO: 2064205 - RNA, 12 nt, Human
caguccugggag

SEQ ID NO: 2064206 - RNA, 13 nt, Human
caguccugggaga

SEQ ID NO: 2064207 - RNA, 21 nt, Human
caguccugggagaaccucagg

SEQ ID NO: 2064208 - RNA, 22 nt, Human
caguccugggagaaccucaggc

SEQ ID NO: 2064209 - RNA, 23 nt, Human
caguccugggagaaccucaggcu

SEQ ID NO: 2064210 - RNA, 18 nt, Human
cagucuggaaugcagugg

SEQ ID NO: 2064211 - RNA, 24 nt, Human
cagugagccgagauugcaccacug

SEQ ID NO: 2064212 - RNA, 13 nt, Human
cagugagccaaga

SEQ ID NO: 2064213 - RNA, 13 nt, Human
cagugagcugaga

SEQ ID NO: 2064214 - RNA, 19 nt, Human
cagugagccgcaucuucuc

SEQ ID NO: 2064215 - RNA, 13 nt, Human
cagugaggcccag

SEQ ID NO: 2064216 - RNA, 22 nt, Human
cagugagcuuggaaaggaccag

SEQ ID NO: 2064217 - RNA, 18 nt, Human
cagugagucgaggacagg

SEQ ID NO: 2064218 - RNA, 17 nt, Human
cagugagucgaggacag

SEQ ID NO: 2064219 - RNA, 21 nt, Human
cagugaggcccagggagaggc

SEQ ID NO: 2064220 - RNA, 23 nt, Human
cagugagggguauaucugggcug

SEQ ID NO: 2064221 - RNA, 16 nt, Human
cagugaggcccaggga

SEQ ID NO: 2064222 - RNA, 17 nt, Human
cagugaggcccagggag

SEQ ID NO: 2064223 - RNA, 16 nt, Human
cagugacgugcaccug

SEQ ID NO: 2064224 - RNA, 17 nt, Human
cagugaccugaggaagc

SEQ ID NO: 2064225 - RNA, 18 nt, Human
cagugaccugaggaagcg

SEQ ID NO: 2064226 - RNA, 19 nt, Human
cagugaccugaggaagcgu

SEQ ID NO: 2064227 - RNA, 15 nt, Human
cagugacaugagacu

SEQ ID NO: 2064228 - RNA, 14 nt, Human
cagugaccugagga

SEQ ID NO: 2064229 - RNA, 16 nt, Human
cagugaccugaggaag

SEQ ID NO: 2064230 - RNA, 17 nt, Human
cagugacgugcaccugu

SEQ ID NO: 2064231 - RNA, 18 nt, Human
cagugacgugcaccugua

SEQ ID NO: 2064232 - RNA, 22 nt, Human
cagugacgugcaccuguacuca

SEQ ID NO: 2064233 - RNA, 20 nt, Human
cagugacuguggccaugguc

SEQ ID NO: 2064234 - RNA, 11 nt, Human
cagucuuccac

SEQ ID NO: 2064235 - RNA, 13 nt, Human
cagugaaaacuag

SEQ ID NO: 2064236 - RNA, 13 nt, Human
cagugaaagcauc

SEQ ID NO: 2064237 - RNA, 14 nt, Human
cagugaaagcauca

SEQ ID NO: 2064238 - RNA, 16 nt, Human
cagugacacuucagag

SEQ ID NO: 2064239 - RNA, 20 nt, Human
cagugaauuguguaggagag

SEQ ID NO: 2064240 - RNA, 17 nt, Human
cagugacacuucagaga

SEQ ID NO: 2064241 - RNA, 18 nt, Human
cagugacacuucagagag

SEQ ID NO: 2064242 - RNA, 19 nt, Human
cagugacacuucagagagc

SEQ ID NO: 2064243 - RNA, 22 nt, Human
cagugacacuucagagagcugg

SEQ ID NO: 2064244 - RNA, 23 nt, Human
cagugacacuucagagagcuggu

SEQ ID NO: 2064245 - RNA, 16 nt, Human
cagugacagaguucac

SEQ ID NO: 2064246 - RNA, 18 nt, Human
cagugacagaguucacua

SEQ ID NO: 2064247 - RNA, 20 nt, Human
cagugacagaguucacuaua

SEQ ID NO: 2064248 - RNA, 23 nt, Human
cagugauguaccaugaaacaaag

SEQ ID NO: 2064249 - RNA, 20 nt, Human
cagugauuaaggucucucuu

SEQ ID NO: 2064250 - RNA, 21 nt, Human
cagugauuaaggucucucuuu

SEQ ID NO: 2064251 - RNA, 23 nt, Human
cagugauuaaggucucucuuugg

SEQ ID NO: 2064252 - RNA, 13 nt, Human
cagugaucuccau

SEQ ID NO: 2064253 - RNA, 15 nt, Human
cagugaucuccauau

SEQ ID NO: 2064254 - RNA, 16 nt, Human
cagugaucuccauaug

SEQ ID NO: 2064255 - RNA, 21 nt, Human
cagugaucuccauauguuaca

SEQ ID NO: 2064256 - RNA, 18 nt, Human
cagugaugcuggaugcuc

SEQ ID NO: 2064257 - RNA, 20 nt, Human
cagugaugcuggaugcuccu

SEQ ID NO: 2064258 - RNA, 15 nt, Human
cagugagguccuggg

SEQ ID NO: 2064259 - RNA, 17 nt, Human
cagugagguccuggggg

SEQ ID NO: 2064260 - RNA, 18 nt, Human
cagugagguccugggggc

SEQ ID NO: 2064261 - RNA, 19 nt, Human
cagugagguccugggggcc

SEQ ID NO: 2064262 - RNA, 20 nt, Human
cagugagguccugggggccu

SEQ ID NO: 2064263 - RNA, 21 nt, Human
cagugagguccugggggccug

SEQ ID NO: 2064264 - RNA, 23 nt, Human
cagugagguccugggggccugac

SEQ ID NO: 2064265 - RNA, 16 nt, Human
cagugagggucuucuu

SEQ ID NO: 2064266 - RNA, 23 nt, Human
cagugagggucuucuuacaugca

SEQ ID NO: 2064267 - RNA, 13 nt, Human
cagugagcugugu

SEQ ID NO: 2064268 - RNA, 15 nt, Human
cagugagucucuuca

SEQ ID NO: 2064269 - RNA, 17 nt, Human
cagugagucucuucaga

SEQ ID NO: 2064270 - RNA, 18 nt, Human
cagugagucucuucagaa

SEQ ID NO: 2064271 - RNA, 23 nt, Human
cagugagucgaggacagggaggu

SEQ ID NO: 2064272 - RNA, 22 nt, Human
cagugagucgaggacagggagg

SEQ ID NO: 2064273 - RNA, 20 nt, Human
cagugagucgaggacaggga

SEQ ID NO: 2064274 - RNA, 19 nt, Human
cagugagucgaggacaggg

SEQ ID NO: 2064275 - RNA, 14 nt, Human
cagugcccuggggc

SEQ ID NO: 2064276 - RNA, 24 nt, Human
cagugcccuggggcugaucucagg

SEQ ID NO: 2064277 - RNA, 15 nt, Human
cagugccgagaagga

SEQ ID NO: 2064278 - RNA, 18 nt, Human
cagugccgagaaggaagc

SEQ ID NO: 2064279 - RNA, 10 nt, Human
cagugccugc

SEQ ID NO: 2064280 - RNA, 11 nt, Human
cagugccugcu

SEQ ID NO: 2064281 - RNA, 13 nt, Human
cagugccugcuga

SEQ ID NO: 2064282 - RNA, 12 nt, Human
cagugccugcug

SEQ ID NO: 2064283 - RNA, 14 nt, Human
cagugccugggaau

SEQ ID NO: 2064284 - RNA, 20 nt, Human
cagugccugggaauguauua

SEQ ID NO: 2064285 - RNA, 18 nt, Human
cagugccugggaauguau

SEQ ID NO: 2064286 - RNA, 17 nt, Human
cagugccuuaccuccug

SEQ ID NO: 2064287 - RNA, 18 nt, Human
cagugccuuaccuccugc

SEQ ID NO: 2064288 - RNA, 19 nt, Human
cagugccuuaccuccugcc

SEQ ID NO: 2064289 - RNA, 20 nt, Human
cagugccuuaccuccugccc

SEQ ID NO: 2064290 - RNA, 21 nt, Human
cagugccuuaccuccugccca

SEQ ID NO: 2064291 - RNA, 22 nt, Human
cagugccuuaccuccugcccag

SEQ ID NO: 2064292 - RNA, 23 nt, Human
cagugccuuaccuccugcccagg

SEQ ID NO: 2064293 - RNA, 17 nt, Human
cagugcuguggccuggg

SEQ ID NO: 2064294 - RNA, 21 nt, Human
cagugcgggaggaauuucuga

SEQ ID NO: 2064295 - RNA, 23 nt, Human
cagugccuuucuucucuccagug

SEQ ID NO: 2064296 - RNA, 24 nt, Human
cagugcgcgugcacguggagagcu

SEQ ID NO: 2064297 - RNA, 14 nt, Human
cagugccuuccaua

SEQ ID NO: 2064298 - RNA, 15 nt, Human
cagugccuuccauaa

SEQ ID NO: 2064299 - RNA, 16 nt, Human
cagugccuuccauaau

SEQ ID NO: 2064300 - RNA, 17 nt, Human
cagugccuuccauaauu

SEQ ID NO: 2064301 - RNA, 23 nt, Human
cagugccuuccauaauuaugaca

SEQ ID NO: 2064302 - RNA, 20 nt, Human
cagucaucguaggugauuug

SEQ ID NO: 2064303 - RNA, 22 nt, Human
cagucaucguaggugauuugaa

SEQ ID NO: 2064304 - RNA, 18 nt, Human
cagucaucuugaccaagc

SEQ ID NO: 2064305 - RNA, 16 nt, Human
cagucaguaauugcca

SEQ ID NO: 2064306 - RNA, 21 nt, Human
cagucaucuugaccaagcagg

SEQ ID NO: 2064307 - RNA, 22 nt, Human
cagucaucuugaccaagcagga

SEQ ID NO: 2064308 - RNA, 24 nt, Human
cagucaucuugaccaagcaggaag

SEQ ID NO: 2064309 - RNA, 21 nt, Human
cagucagguaguugcaauuga

SEQ ID NO: 2064310 - RNA, 19 nt, Human
caguauuacuucugcuaca

SEQ ID NO: 2064311 - RNA, 19 nt, Human
caguauuaaaggggggagg

SEQ ID NO: 2064312 - RNA, 20 nt, Human
caguauuaaaggggggaggg

SEQ ID NO: 2064313 - RNA, 21 nt, Human
caguauuaaaggggggagggg

SEQ ID NO: 2064314 - RNA, 18 nt, Human
caguauuacuucugcuac

SEQ ID NO: 2064315 - RNA, 16 nt, Human
caguauuacuucugcu

SEQ ID NO: 2064316 - RNA, 19 nt, Human
caguauguucaaagucaaa

SEQ ID NO: 2064317 - RNA, 19 nt, Human
cagucccaucagagagcga

SEQ ID NO: 2064318 - RNA, 16 nt, Human
caguccauagcagaga

SEQ ID NO: 2064319 - RNA, 15 nt, Human
caguccaccugagcu

SEQ ID NO: 2064320 - RNA, 16 nt, Human
caguccaccugagcug

SEQ ID NO: 2064321 - RNA, 18 nt, Human
caguccaccugagcugcc

SEQ ID NO: 2064322 - RNA, 20 nt, Human
caguccaccugagcugccau

SEQ ID NO: 2064323 - RNA, 17 nt, Human
caguccaaauguccucc

SEQ ID NO: 2064324 - RNA, 18 nt, Human
caguccaaauguccucca

SEQ ID NO: 2064325 - RNA, 21 nt, Human
caguccaaauguccuccagaa

SEQ ID NO: 2064326 - RNA, 22 nt, Human
caguccaaauguccuccagaag

SEQ ID NO: 2064327 - RNA, 23 nt, Human
caguccaaauguccuccagaagc

SEQ ID NO: 2064328 - RNA, 13 nt, Human
cagucauuaugag

SEQ ID NO: 2064329 - RNA, 23 nt, Human
cagucauuaugagaggcaaugau

SEQ ID NO: 2064330 - RNA, 24 nt, Human
cagucauggcaccaaagccaccag

SEQ ID NO: 2064331 - RNA, 13 nt, Human
caguaucucaggg

SEQ ID NO: 2064332 - RNA, 14 nt, Human
caguauauuuauag

SEQ ID NO: 2064333 - RNA, 15 nt, Human
caguauauuuauagu

SEQ ID NO: 2064334 - RNA, 14 nt, Human
caguaucaggccug

SEQ ID NO: 2064335 - RNA, 17 nt, Human
caguaucaggccugcca

SEQ ID NO: 2064336 - RNA, 20 nt, Human
caguaucaggccugccagac

SEQ ID NO: 2064337 - RNA, 24 nt, Human
caguaucaggccugccagacggca

SEQ ID NO: 2064338 - RNA, 17 nt, Human
caguauacaagauaagc

SEQ ID NO: 2064339 - RNA, 22 nt, Human
caguauacaagauaagcuucca

SEQ ID NO: 2064340 - RNA, 13 nt, Human
caguauauuuaua

SEQ ID NO: 2064341 - RNA, 22 nt, Human
caguauauuuauagucacaaga

SEQ ID NO: 2064342 - RNA, 15 nt, Human
caguaucucagggcc

SEQ ID NO: 2064343 - RNA, 16 nt, Human
caguagugagaagaau

SEQ ID NO: 2064344 - RNA, 22 nt, Human
caguagugagaagaauauuguu

SEQ ID NO: 2064345 - RNA, 22 nt, Human
caguaguagccuccagguuucc

SEQ ID NO: 2064346 - RNA, 17 nt, Human
caguagagucaucucca

SEQ ID NO: 2064347 - RNA, 15 nt, Human
caguagagucaucuc

SEQ ID NO: 2064348 - RNA, 16 nt, Human
caguagagucaucucc

SEQ ID NO: 2064349 - RNA, 18 nt, Human
caguagaaauaauaugca

SEQ ID NO: 2064350 - RNA, 19 nt, Human
caguagaaauaauaugcau

SEQ ID NO: 2064351 - RNA, 20 nt, Human
caguagcuguggugaggugg

SEQ ID NO: 2064352 - RNA, 18 nt, Human
caguagcaguagaugcau

SEQ ID NO: 2064353 - RNA, 17 nt, Human
cagucccccugccccag

SEQ ID NO: 2064354 - RNA, 16 nt, Human
cagucccccugcccca

SEQ ID NO: 2064355 - RNA, 23 nt, Human
caguccccgugaaggagagcccu

SEQ ID NO: 2064356 - RNA, 12 nt, Human
cagucccugggg

SEQ ID NO: 2064357 - RNA, 20 nt, Human
cagucccugggggaagcccu

SEQ ID NO: 2064358 - RNA, 21 nt, Human
cagucccugggggaagcccug

SEQ ID NO: 2064359 - RNA, 22 nt, Human
cagucccugggggaagcccugg

SEQ ID NO: 2064360 - RNA, 14 nt, Human
caggugacagugag

SEQ ID NO: 2064361 - RNA, 16 nt, Human
caggugacagugaggu

SEQ ID NO: 2064362 - RNA, 19 nt, Human
caggugacagugagguccu

SEQ ID NO: 2064363 - RNA, 20 nt, Human
caggugacagugagguccug

SEQ ID NO: 2064364 - RNA, 21 nt, Human
caggugacagugagguccugg

SEQ ID NO: 2064365 - RNA, 17 nt, Human
caggugaccuucuggga

SEQ ID NO: 2064366 - RNA, 22 nt, Human
caggucuccucuuaaaaaauaa

SEQ ID NO: 2064367 - RNA, 21 nt, Human
caggugagaagcagaggaagg

SEQ ID NO: 2064368 - RNA, 18 nt, Human
caggugaccuucugggaa

SEQ ID NO: 2064369 - RNA, 13 nt, Human
caggugagaagca

SEQ ID NO: 2064370 - RNA, 20 nt, Human
caggugagaagcagaggaag

SEQ ID NO: 2064371 - RNA, 15 nt, Human
cagguggccacucca

SEQ ID NO: 2064372 - RNA, 21 nt, Human
cagguggccacuccagacccc

SEQ ID NO: 2064373 - RNA, 19 nt, Human
cagguggccacuccagacc

SEQ ID NO: 2064374 - RNA, 16 nt, Human
cagguggccacuccag

SEQ ID NO: 2064375 - RNA, 14 nt, Human
cagguggcugaccc

SEQ ID NO: 2064376 - RNA, 15 nt, Human
cagguggcugaccca

SEQ ID NO: 2064377 - RNA, 16 nt, Human
cagguggcugacccag

SEQ ID NO: 2064378 - RNA, 19 nt, Human
cagguggcugacccagucc

SEQ ID NO: 2064379 - RNA, 20 nt, Human
cagguggcugacccaguccc

SEQ ID NO: 2064380 - RNA, 23 nt, Human
cagguggcugacccagucccugg

SEQ ID NO: 2064381 - RNA, 23 nt, Human
caggucuugaacuccuggccuca

SEQ ID NO: 2064382 - RNA, 22 nt, Human
caggucuugaacuccuggccuc

SEQ ID NO: 2064383 - RNA, 21 nt, Human
caggucuugaacuccuggccu

SEQ ID NO: 2064384 - RNA, 20 nt, Human
caggucuugaacuccuggcc

SEQ ID NO: 2064385 - RNA, 19 nt, Human
caggucuugaacuccuggc

SEQ ID NO: 2064386 - RNA, 18 nt, Human
caggucuugaacuccugg

SEQ ID NO: 2064387 - RNA, 17 nt, Human
caggucugggagaggca

SEQ ID NO: 2064388 - RNA, 18 nt, Human
caggucugggagaggcag

SEQ ID NO: 2064389 - RNA, 20 nt, Human
caggucugggagaggcagag

SEQ ID NO: 2064390 - RNA, 15 nt, Human
caggucuccucuuaa

SEQ ID NO: 2064391 - RNA, 17 nt, Human
caggucuccucuuaaaa

SEQ ID NO: 2064392 - RNA, 13 nt, Human
caggucuccucuu

SEQ ID NO: 2064393 - RNA, 14 nt, Human
caggucuccucuua

SEQ ID NO: 2064394 - RNA, 20 nt, Human
caggucucagaaucuuuccu

SEQ ID NO: 2064395 - RNA, 13 nt, Human
caggucucccggg

SEQ ID NO: 2064396 - RNA, 11 nt, Human
caggucuccuc

SEQ ID NO: 2064397 - RNA, 13 nt, Human
caggucgggcuca

SEQ ID NO: 2064398 - RNA, 15 nt, Human
caggucgggcucagc

SEQ ID NO: 2064399 - RNA, 16 nt, Human
caggucgggcucagcu

SEQ ID NO: 2064400 - RNA, 17 nt, Human
caggucgggcucagcuc

SEQ ID NO: 2064401 - RNA, 18 nt, Human
caggucgggcucagcucu

SEQ ID NO: 2064402 - RNA, 19 nt, Human
caggucgggcucagcucug

SEQ ID NO: 2064403 - RNA, 22 nt, Human
caggucgggcucagcucuggcu

SEQ ID NO: 2064404 - RNA, 22 nt, Human
caggucaauacaguacaggcag

SEQ ID NO: 2064405 - RNA, 23 nt, Human
caggucaauacaguacaggcagc

SEQ ID NO: 2064406 - RNA, 23 nt, Human
cagguauggaaggguuuguggcu

SEQ ID NO: 2064407 - RNA, 20 nt, Human
caggucaggaguucgagacc

SEQ ID NO: 2064408 - RNA, 19 nt, Human
caggucaucuccuuucauc

SEQ ID NO: 2064409 - RNA, 16 nt, Human
caggucagggugagga

SEQ ID NO: 2064410 - RNA, 15 nt, Human
cagguaccccagcuc

SEQ ID NO: 2064411 - RNA, 20 nt, Human
cagguaccccagcucugcuu

SEQ ID NO: 2064412 - RNA, 13 nt, Human
cagguaaugugaa

SEQ ID NO: 2064413 - RNA, 19 nt, Human
cagguaaugugaauaaauu

SEQ ID NO: 2064414 - RNA, 14 nt, Human
cagguacagagaag

SEQ ID NO: 2064415 - RNA, 16 nt, Human
cagguacagagaagga

SEQ ID NO: 2064416 - RNA, 21 nt, Human
cagguaacaggcagauacagg

SEQ ID NO: 2064417 - RNA, 20 nt, Human
cagguaacaggcagauacag

SEQ ID NO: 2064418 - RNA, 18 nt, Human
cagguaguugcaauugaa

SEQ ID NO: 2064419 - RNA, 23 nt, Human
cagguaguugcaauugaauuaaa

SEQ ID NO: 2064420 - RNA, 20 nt, Human
cagguaugaccuucuaggaa

SEQ ID NO: 2064421 - RNA, 22 nt, Human
cagguagcugccccuggcucug

SEQ ID NO: 2064422 - RNA, 20 nt, Human
cagguagcugccccuggcuc

SEQ ID NO: 2064423 - RNA, 21 nt, Human
cagguagcugccccuggcucu

SEQ ID NO: 2064424 - RNA, 23 nt, Human
cagguagcugccccuggcucuga

SEQ ID NO: 2064425 - RNA, 18 nt, Human
cagguagcugaaagggga

SEQ ID NO: 2064426 - RNA, 14 nt, Human
cagguagcugcccc

SEQ ID NO: 2064427 - RNA, 15 nt, Human
cagguagcugccccu

SEQ ID NO: 2064428 - RNA, 16 nt, Human
cagguagcugccccug

SEQ ID NO: 2064429 - RNA, 18 nt, Human
cagguagcugccccuggc

SEQ ID NO: 2064430 - RNA, 19 nt, Human
cagguagcugccccuggcu

SEQ ID NO: 2064431 - RNA, 19 nt, Human
cagguagaacacaagguca

SEQ ID NO: 2064432 - RNA, 14 nt, Human
cagggucaggagag

SEQ ID NO: 2064433 - RNA, 21 nt, Human
caggguauuccagagugggga

SEQ ID NO: 2064434 - RNA, 20 nt, Human
caggguauuccagagugggg

SEQ ID NO: 2064435 - RNA, 14 nt, Human
caggguaaauuauu

SEQ ID NO: 2064436 - RNA, 14 nt, Human
caggguagaaaaag

SEQ ID NO: 2064437 - RNA, 19 nt, Human
caggguagaaaaaggagcu

SEQ ID NO: 2064438 - RNA, 23 nt, Human
caggguagauaaccuguacuuca

SEQ ID NO: 2064439 - RNA, 13 nt, Human
caggguagcaggu

SEQ ID NO: 2064440 - RNA, 16 nt, Human
caggguagcagguacc

SEQ ID NO: 2064441 - RNA, 15 nt, Human
cagggucucacucug

SEQ ID NO: 2064442 - RNA, 23 nt, Human
cagggucucacuauguugcccag

SEQ ID NO: 2064443 - RNA, 22 nt, Human
cagggucucacuauguugccca

SEQ ID NO: 2064444 - RNA, 21 nt, Human
cagggucucacuauguugccc

SEQ ID NO: 2064445 - RNA, 12 nt, Human
caggguccugcu

SEQ ID NO: 2064446 - RNA, 13 nt, Human
caggguccugcua

SEQ ID NO: 2064447 - RNA, 14 nt, Human
caggguccugcuau

SEQ ID NO: 2064448 - RNA, 20 nt, Human
caggguccugcuauuuccca

SEQ ID NO: 2064449 - RNA, 18 nt, Human
caggguccuguagcccua

SEQ ID NO: 2064450 - RNA, 17 nt, Human
cagguaacaggcagaua

SEQ ID NO: 2064451 - RNA, 16 nt, Human
cagguaacaggcagau

SEQ ID NO: 2064452 - RNA, 15 nt, Human
cagguaacaggcaga

SEQ ID NO: 2064453 - RNA, 14 nt, Human
cagguaacaggcag

SEQ ID NO: 2064454 - RNA, 16 nt, Human
cagggucucacucugu

SEQ ID NO: 2064455 - RNA, 16 nt, Human
caggguuuugccaugu

SEQ ID NO: 2064456 - RNA, 16 nt, Human
caggguuuuaucucug

SEQ ID NO: 2064457 - RNA, 17 nt, Human
caggguuuuaucucugu

SEQ ID NO: 2064458 - RNA, 19 nt, Human
caggguuuuaucucugucu

SEQ ID NO: 2064459 - RNA, 18 nt, Human
caggggucccagccaccc

SEQ ID NO: 2064460 - RNA, 20 nt, Human
caggggucccagccaccccg

SEQ ID NO: 2064461 - RNA, 18 nt, Human
caggggucgucaccaccu

SEQ ID NO: 2064462 - RNA, 21 nt, Human
caggggucgucaccaccucuc

SEQ ID NO: 2064463 - RNA, 13 nt, Human
cagggguggagga

SEQ ID NO: 2064464 - RNA, 17 nt, Human
cagggguggaggagagc

SEQ ID NO: 2064465 - RNA, 18 nt, Human
cagggguggaggagagcc

SEQ ID NO: 2064466 - RNA, 22 nt, Human
cagggguggaggagagccuggu

SEQ ID NO: 2064467 - RNA, 21 nt, Human
caggugucauauauggggggc

SEQ ID NO: 2064468 - RNA, 16 nt, Human
caggugugagucacca

SEQ ID NO: 2064469 - RNA, 21 nt, Human
caggugugagucaccaagccc

SEQ ID NO: 2064470 - RNA, 20 nt, Human
caggugugagucaccaagcc

SEQ ID NO: 2064471 - RNA, 23 nt, Human
caggugugaaccaccacacccag

SEQ ID NO: 2064472 - RNA, 22 nt, Human
caggugugaaccaccacaccca

SEQ ID NO: 2064473 - RNA, 19 nt, Human
caggugugaaccaccacac

SEQ ID NO: 2064474 - RNA, 16 nt, Human
caggugugaaccacca

SEQ ID NO: 2064475 - RNA, 23 nt, Human
caggugugagucaccaagcccag

SEQ ID NO: 2064476 - RNA, 22 nt, Human
caggugugagucaccaagccca

SEQ ID NO: 2064477 - RNA, 12 nt, Human
cagguguuuaua

SEQ ID NO: 2064478 - RNA, 20 nt, Human
cagguguucuacacucaucu

SEQ ID NO: 2064479 - RNA, 16 nt, Human
cagguguuuaguugca

SEQ ID NO: 2064480 - RNA, 12 nt, Human
caggugugaacc

SEQ ID NO: 2064481 - RNA, 19 nt, Human
caggugucccugcacuugc

SEQ ID NO: 2064482 - RNA, 18 nt, Human
caggugucccugcacuug

SEQ ID NO: 2064483 - RNA, 16 nt, Human
caggugucccugcacu

SEQ ID NO: 2064484 - RNA, 15 nt, Human
caggugucccugcac

SEQ ID NO: 2064485 - RNA, 16 nt, Human
caguaagaccggaagc

SEQ ID NO: 2064486 - RNA, 17 nt, Human
caguaagaccggaagcu

SEQ ID NO: 2064487 - RNA, 21 nt, Human
caguaagaccggaagcuccug

SEQ ID NO: 2064488 - RNA, 22 nt, Human
caguaagaccggaagcuccugg

SEQ ID NO: 2064489 - RNA, 23 nt, Human
caguaagaccggaagcuccuggu

SEQ ID NO: 2064490 - RNA, 14 nt, Human
caguaacuugguua

SEQ ID NO: 2064491 - RNA, 16 nt, Human
caguaacuugguuaua

SEQ ID NO: 2064492 - RNA, 18 nt, Human
caguaacuugguuauaca

SEQ ID NO: 2064493 - RNA, 19 nt, Human
caguaacuugguuauacau

SEQ ID NO: 2064494 - RNA, 18 nt, Human
caguaacagggccuugcu

SEQ ID NO: 2064495 - RNA, 20 nt, Human
caguaacagggccuugcuaa

SEQ ID NO: 2064496 - RNA, 13 nt, Human
cagguucagcuug

SEQ ID NO: 2064497 - RNA, 17 nt, Human
cagguuauacuccuccu

SEQ ID NO: 2064498 - RNA, 12 nt, Human
cagguucagcuu

SEQ ID NO: 2064499 - RNA, 17 nt, Human
caguaccuuugucacaa

SEQ ID NO: 2064500 - RNA, 15 nt, Human
caguaccuuugucac

SEQ ID NO: 2064501 - RNA, 16 nt, Human
caguaccuuugucaca

SEQ ID NO: 2064502 - RNA, 16 nt, Human
caguacauuuaauuga

SEQ ID NO: 2064503 - RNA, 13 nt, Human
caguacuggagcu

SEQ ID NO: 2064504 - RNA, 16 nt, Human
caguacagugguucua

SEQ ID NO: 2064505 - RNA, 17 nt, Human
caguacagugguucuac

SEQ ID NO: 2064506 - RNA, 12 nt, Human
caguaccacaug

SEQ ID NO: 2064507 - RNA, 14 nt, Human
caguaccaucugaa

SEQ ID NO: 2064508 - RNA, 12 nt, Human
caguacauuuaa

SEQ ID NO: 2064509 - RNA, 13 nt, Human
caguacccaccug

SEQ ID NO: 2064510 - RNA, 14 nt, Human
caguacccaccuga

SEQ ID NO: 2064511 - RNA, 15 nt, Human
caguacccaccugag

SEQ ID NO: 2064512 - RNA, 16 nt, Human
caguacccaccugagc

SEQ ID NO: 2064513 - RNA, 17 nt, Human
caguacccaccugagcu

SEQ ID NO: 2064514 - RNA, 19 nt, Human
caguacccaccugagcuuu

SEQ ID NO: 2064515 - RNA, 12 nt, Human
caguacaggcag

SEQ ID NO: 2064516 - RNA, 13 nt, Human
caguacaggcagc

SEQ ID NO: 2064517 - RNA, 14 nt, Human
caguacaggcagca

SEQ ID NO: 2064518 - RNA, 16 nt, Human
caguacaggcagcaca

SEQ ID NO: 2064519 - RNA, 19 nt, Human
caguacaggcagcacagag

SEQ ID NO: 2064520 - RNA, 20 nt, Human
caguacaggcagcacagaga

SEQ ID NO: 2064521 - RNA, 15 nt, Human
caguaagccacugcc

SEQ ID NO: 2064522 - RNA, 13 nt, Human
caguaauaaaaca

SEQ ID NO: 2064523 - RNA, 14 nt, Human
caguaauaaaacau

SEQ ID NO: 2064524 - RNA, 15 nt, Human
caguaauaaaacauc

SEQ ID NO: 2064525 - RNA, 17 nt, Human
caguaauaaaacaucuu

SEQ ID NO: 2064526 - RNA, 18 nt, Human
caguaauaaaacaucuuu

SEQ ID NO: 2064527 - RNA, 12 nt, Human
caguaauaacuc

SEQ ID NO: 2064528 - RNA, 13 nt, Human
caguaauaacucu

SEQ ID NO: 2064529 - RNA, 14 nt, Human
caggugucccugca

SEQ ID NO: 2064530 - RNA, 11 nt, Human
caggugucccu

SEQ ID NO: 2064531 - RNA, 20 nt, Human
caggugguuauggagagggu

SEQ ID NO: 2064532 - RNA, 14 nt, Human
cagguguccccagc

SEQ ID NO: 2064533 - RNA, 15 nt, Human
cagguguccccagcc

SEQ ID NO: 2064534 - RNA, 16 nt, Human
cagguguccccagccc

SEQ ID NO: 2064535 - RNA, 17 nt, Human
cagguguccccagccca

SEQ ID NO: 2064536 - RNA, 18 nt, Human
cagguguccccagcccac

SEQ ID NO: 2064537 - RNA, 19 nt, Human
cagguguccccagcccacu

SEQ ID NO: 2064538 - RNA, 20 nt, Human
cagguguccccagcccacug

SEQ ID NO: 2064539 - RNA, 21 nt, Human
cagguguccccagcccacugg

SEQ ID NO: 2064540 - RNA, 18 nt, Human
caggugguuauggagagg

SEQ ID NO: 2064541 - RNA, 15 nt, Human
cagguggggaggggg

SEQ ID NO: 2064542 - RNA, 23 nt, Human
cagguggggagucagggaccccu

SEQ ID NO: 2064543 - RNA, 12 nt, Human
cagguggggagg

SEQ ID NO: 2064544 - RNA, 17 nt, Human
cagguggggcagcuuga

SEQ ID NO: 2064545 - RNA, 16 nt, Human
cagguggggcagcuug

SEQ ID NO: 2064546 - RNA, 15 nt, Human
cagguggggcagcuu

SEQ ID NO: 2064547 - RNA, 14 nt, Human
cagguggggcagcu

SEQ ID NO: 2064548 - RNA, 13 nt, Human
cagguggggcagc

SEQ ID NO: 2064549 - RNA, 22 nt, Human
cagguggcugacccagucccug

SEQ ID NO: 2064550 - RNA, 17 nt, Human
caggaguggguugauuu

SEQ ID NO: 2064551 - RNA, 22 nt, Human
caggaguuagaggccagccugg

SEQ ID NO: 2064552 - RNA, 22 nt, Human
caggaguucaagaccagccugg

SEQ ID NO: 2064553 - RNA, 23 nt, Human
caggaguucaagaccagccuggc

SEQ ID NO: 2064554 - RNA, 21 nt, Human
caggaguucgagaccagccug

SEQ ID NO: 2064555 - RNA, 19 nt, Human
caggaguuaaaaagggcag

SEQ ID NO: 2064556 - RNA, 16 nt, Human
caggaguuagaggcca

SEQ ID NO: 2064557 - RNA, 17 nt, Human
caggaguuagaggccag

SEQ ID NO: 2064558 - RNA, 18 nt, Human
caggaguuagaggccagc

SEQ ID NO: 2064559 - RNA, 19 nt, Human
caggaguuagaggccagcc

SEQ ID NO: 2064560 - RNA, 20 nt, Human
caggaguuagaggccagccu

SEQ ID NO: 2064561 - RNA, 21 nt, Human
caggaguuagaggccagccug

SEQ ID NO: 2064562 - RNA, 16 nt, Human
caggaguuggaagugu

SEQ ID NO: 2064563 - RNA, 21 nt, Human
caggaguuuaagaccagccug

SEQ ID NO: 2064564 - RNA, 22 nt, Human
caggaguuuaagaccagccugg

SEQ ID NO: 2064565 - RNA, 19 nt, Human
caggaguucgaggcugcag

SEQ ID NO: 2064566 - RNA, 23 nt, Human
caggaguucgagaccagccuggc

SEQ ID NO: 2064567 - RNA, 18 nt, Human
caggaguucgaggcugca

SEQ ID NO: 2064568 - RNA, 21 nt, Human
caggaguuugagaccaaccug

SEQ ID NO: 2064569 - RNA, 17 nt, Human
caggauagauaacucuu

SEQ ID NO: 2064570 - RNA, 18 nt, Human
caggauagauaacucuuu

SEQ ID NO: 2064571 - RNA, 19 nt, Human
caggauagauaacucuuug

SEQ ID NO: 2064572 - RNA, 15 nt, Human
caggauaguugcucc

SEQ ID NO: 2064573 - RNA, 23 nt, Human
caggauacucugucagaugggaa

SEQ ID NO: 2064574 - RNA, 18 nt, Human
caggauacucugucagau

SEQ ID NO: 2064575 - RNA, 20 nt, Human
caggauacucugucagaugg

SEQ ID NO: 2064576 - RNA, 17 nt, Human
caggauacucugucaga

SEQ ID NO: 2064577 - RNA, 22 nt, Human
caggaguuugagaccaaccugg

SEQ ID NO: 2064578 - RNA, 23 nt, Human
caggaguuugagaccaaccuggg

SEQ ID NO: 2064579 - RNA, 18 nt, Human
caggaguuugaggcugca

SEQ ID NO: 2064580 - RNA, 20 nt, Human
caggaguuugaggcugcagc

SEQ ID NO: 2064581 - RNA, 21 nt, Human
caggaguuugaggcugcagcg

SEQ ID NO: 2064582 - RNA, 22 nt, Human
caggaguuugaggcugcagcga

SEQ ID NO: 2064583 - RNA, 15 nt, Human
caggagaggggcaga

SEQ ID NO: 2064584 - RNA, 17 nt, Human
caggagaggggcagaac

SEQ ID NO: 2064585 - RNA, 13 nt, Human
caggagagccagc

SEQ ID NO: 2064586 - RNA, 15 nt, Human
caggagagccagccc

SEQ ID NO: 2064587 - RNA, 16 nt, Human
caggagagccagcccu

SEQ ID NO: 2064588 - RNA, 17 nt, Human
caggagagccagcccuc

SEQ ID NO: 2064589 - RNA, 18 nt, Human
caggagagccagcccucc

SEQ ID NO: 2064590 - RNA, 19 nt, Human
caggagagccagcccuccc

SEQ ID NO: 2064591 - RNA, 21 nt, Human
caggagagccagcccucccug

SEQ ID NO: 2064592 - RNA, 23 nt, Human
caggagagccagcccucccuguc

SEQ ID NO: 2064593 - RNA, 12 nt, Human
caggagagggaa

SEQ ID NO: 2064594 - RNA, 20 nt, Human
caggagauggaaguugcagu

SEQ ID NO: 2064595 - RNA, 14 nt, Human
caggagagaaaggg

SEQ ID NO: 2064596 - RNA, 16 nt, Human
caggagacccacaggu

SEQ ID NO: 2064597 - RNA, 12 nt, Human
caggagacaucc

SEQ ID NO: 2064598 - RNA, 17 nt, Human
caggagaaccacuacau

SEQ ID NO: 2064599 - RNA, 23 nt, Human
caggacuuggucugauuucagga

SEQ ID NO: 2064600 - RNA, 20 nt, Human
caggacuuggucugauuuca

SEQ ID NO: 2064601 - RNA, 23 nt, Human
caggagaaaugcauccauuccuc

SEQ ID NO: 2064602 - RNA, 11 nt, Human
caggagaacca

SEQ ID NO: 2064603 - RNA, 16 nt, Human
caggacucugccuccu

SEQ ID NO: 2064604 - RNA, 15 nt, Human
caggacucugccucc

SEQ ID NO: 2064605 - RNA, 13 nt, Human
caggacucugccu

SEQ ID NO: 2064606 - RNA, 12 nt, Human
caggacucugcc

SEQ ID NO: 2064607 - RNA, 22 nt, Human
caggacucccuccucaccucug

SEQ ID NO: 2064608 - RNA, 23 nt, Human
caggacucccuccucaccucugg

SEQ ID NO: 2064609 - RNA, 20 nt, Human
caggacucugcccagaccac

SEQ ID NO: 2064610 - RNA, 18 nt, Human
caggacugaauugucccc

SEQ ID NO: 2064611 - RNA, 19 nt, Human
caggacugaauugucccca

SEQ ID NO: 2064612 - RNA, 20 nt, Human
caggacugaauuguccccag

SEQ ID NO: 2064613 - RNA, 21 nt, Human
caggacugaauuguccccagu

SEQ ID NO: 2064614 - RNA, 12 nt, Human
caggacuccagc

SEQ ID NO: 2064615 - RNA, 13 nt, Human
caggacuccagcc

SEQ ID NO: 2064616 - RNA, 16 nt, Human
caggacuccagcccau

SEQ ID NO: 2064617 - RNA, 17 nt, Human
caggacuccagcccauu

SEQ ID NO: 2064618 - RNA, 13 nt, Human
caggacucccucc

SEQ ID NO: 2064619 - RNA, 14 nt, Human
caggacucccuccu

SEQ ID NO: 2064620 - RNA, 15 nt, Human
caggacucccuccuc

SEQ ID NO: 2064621 - RNA, 16 nt, Human
caggacucccuccuca

SEQ ID NO: 2064622 - RNA, 17 nt, Human
caggacucccuccucac

SEQ ID NO: 2064623 - RNA, 19 nt, Human
caggacucccuccucaccu

SEQ ID NO: 2064624 - RNA, 20 nt, Human
caggacucccuccucaccuc

SEQ ID NO: 2064625 - RNA, 21 nt, Human
caggacucccuccucaccucu

SEQ ID NO: 2064626 - RNA, 15 nt, Human
caggagucccaagga

SEQ ID NO: 2064627 - RNA, 16 nt, Human
caggagucccaaggaa

SEQ ID NO: 2064628 - RNA, 17 nt, Human
caggagucccaaggaaa

SEQ ID NO: 2064629 - RNA, 18 nt, Human
caggagucccaaggaaag

SEQ ID NO: 2064630 - RNA, 12 nt, Human
caggagugagca

SEQ ID NO: 2064631 - RNA, 24 nt, Human
caggagucccaaggaaagccccag

SEQ ID NO: 2064632 - RNA, 13 nt, Human
caggagucccugg

SEQ ID NO: 2064633 - RNA, 14 nt, Human
caggagucccuggu

SEQ ID NO: 2064634 - RNA, 15 nt, Human
caggagucccuggua

SEQ ID NO: 2064635 - RNA, 19 nt, Human
caggagucccaaggaaagc

SEQ ID NO: 2064636 - RNA, 21 nt, Human
caggagucccaaggaaagccc

SEQ ID NO: 2064637 - RNA, 12 nt, Human
caggagcucaga

SEQ ID NO: 2064638 - RNA, 18 nt, Human
caggagccccgaggccuu

SEQ ID NO: 2064639 - RNA, 16 nt, Human
caggagccccgaggcc

SEQ ID NO: 2064640 - RNA, 15 nt, Human
caggagccccgaggc

SEQ ID NO: 2064641 - RNA, 22 nt, Human
caggagccccgaggccuucucu

SEQ ID NO: 2064642 - RNA, 20 nt, Human
caggagccccgaggccuucu

SEQ ID NO: 2064643 - RNA, 23 nt, Human
caggagccccgaggccuucucug

SEQ ID NO: 2064644 - RNA, 12 nt, Human
caggcccaccua

SEQ ID NO: 2064645 - RNA, 23 nt, Human
caggcccaccuaccuucaaagcu

SEQ ID NO: 2064646 - RNA, 18 nt, Human
caggcccaagagaugaag

SEQ ID NO: 2064647 - RNA, 19 nt, Human
caggcccaagagaugaaga

SEQ ID NO: 2064648 - RNA, 23 nt, Human
caggcccaaauuaucaagcuaau

SEQ ID NO: 2064649 - RNA, 17 nt, Human
caggccccaaaaccaca

SEQ ID NO: 2064650 - RNA, 19 nt, Human
caggccccaaaaccacagc

SEQ ID NO: 2064651 - RNA, 22 nt, Human
caggccccaaaaccacagcccu

SEQ ID NO: 2064652 - RNA, 23 nt, Human
caggccccaaaaccacagcccug

SEQ ID NO: 2064653 - RNA, 16 nt, Human
caggccccaggaagcc

SEQ ID NO: 2064654 - RNA, 17 nt, Human
caggccccaggaagccg

SEQ ID NO: 2064655 - RNA, 12 nt, Human
caggccccaagg

SEQ ID NO: 2064656 - RNA, 13 nt, Human
caggccccaggaa

SEQ ID NO: 2064657 - RNA, 14 nt, Human
caggccccaggaag

SEQ ID NO: 2064658 - RNA, 15 nt, Human
caggccccaggaagc

SEQ ID NO: 2064659 - RNA, 13 nt, Human
caggcccccaagc

SEQ ID NO: 2064660 - RNA, 13 nt, Human
caggccccugcca

SEQ ID NO: 2064661 - RNA, 17 nt, Human
caggccccgcuugucca

SEQ ID NO: 2064662 - RNA, 18 nt, Human
caggccccgcuuguccag

SEQ ID NO: 2064663 - RNA, 19 nt, Human
caggccccgcuuguccagc

SEQ ID NO: 2064664 - RNA, 22 nt, Human
caggccccgcuuguccagcgcc

SEQ ID NO: 2064665 - RNA, 23 nt, Human
caggccccgcuuguccagcgccu

SEQ ID NO: 2064666 - RNA, 18 nt, Human
caggcccccaagccugca

SEQ ID NO: 2064667 - RNA, 19 nt, Human
caggcccccaagccugcag

SEQ ID NO: 2064668 - RNA, 15 nt, Human
caggcccccaagccu

SEQ ID NO: 2064669 - RNA, 17 nt, Human
caggcccccaagccugc

SEQ ID NO: 2064670 - RNA, 15 nt, Human
caggcccccaccacu

SEQ ID NO: 2064671 - RNA, 18 nt, Human
caggccaagagcagaggc

SEQ ID NO: 2064672 - RNA, 19 nt, Human
caggccaagagcagaggca

SEQ ID NO: 2064673 - RNA, 21 nt, Human
caggccaagagcagaggcagc

SEQ ID NO: 2064674 - RNA, 23 nt, Human
caggccaagagcagaggcagcga

SEQ ID NO: 2064675 - RNA, 15 nt, Human
caggccaucagaggc

SEQ ID NO: 2064676 - RNA, 23 nt, Human
caggccaccauauucagugcugu

SEQ ID NO: 2064677 - RNA, 15 nt, Human
caggccaggugcagu

SEQ ID NO: 2064678 - RNA, 12 nt, Human
caggccaggcuc

SEQ ID NO: 2064679 - RNA, 18 nt, Human
caggccaggcuccuuccu

SEQ ID NO: 2064680 - RNA, 16 nt, Human
caggccaggugcagug

SEQ ID NO: 2064681 - RNA, 21 nt, Human
caggccaggcuccuuccuguc

SEQ ID NO: 2064682 - RNA, 13 nt, Human
caggccaacccca

SEQ ID NO: 2064683 - RNA, 20 nt, Human
caggccccugccacccuggg

SEQ ID NO: 2064684 - RNA, 19 nt, Human
caggccccugccacccugg

SEQ ID NO: 2064685 - RNA, 17 nt, Human
caggccccugccacccu

SEQ ID NO: 2064686 - RNA, 15 nt, Human
caggccccugccacc

SEQ ID NO: 2064687 - RNA, 15 nt, Human
caggcccggcuccag

SEQ ID NO: 2064688 - RNA, 14 nt, Human
caggcccggcucca

SEQ ID NO: 2064689 - RNA, 13 nt, Human
caggcccggcucc

SEQ ID NO: 2064690 - RNA, 15 nt, Human
caggcaugccugugu

SEQ ID NO: 2064691 - RNA, 16 nt, Human
caggcaugccugugug

SEQ ID NO: 2064692 - RNA, 24 nt, Human
caggcaugcuggcucccagggcca

SEQ ID NO: 2064693 - RNA, 17 nt, Human
caggcaugguggcccac

SEQ ID NO: 2064694 - RNA, 22 nt, Human
caggcaucauuccaccauggcu

SEQ ID NO: 2064695 - RNA, 14 nt, Human
caggcaugccugug

SEQ ID NO: 2064696 - RNA, 20 nt, Human
caggcagugaugcuggaugc

SEQ ID NO: 2064697 - RNA, 22 nt, Human
caggcagugaugcuggaugcuc

SEQ ID NO: 2064698 - RNA, 17 nt, Human
caggcaguuggccagag

SEQ ID NO: 2064699 - RNA, 14 nt, Human
caggcauaggccug

SEQ ID NO: 2064700 - RNA, 15 nt, Human
caggcauaggccugg

SEQ ID NO: 2064701 - RNA, 16 nt, Human
caggcauaggccuggg

SEQ ID NO: 2064702 - RNA, 17 nt, Human
caggcauaggccugggu

SEQ ID NO: 2064703 - RNA, 18 nt, Human
caggcauaggccugggug

SEQ ID NO: 2064704 - RNA, 19 nt, Human
caggcauaggccugggugc

SEQ ID NO: 2064705 - RNA, 23 nt, Human
caggcaggucuugaacuccuggc

SEQ ID NO: 2064706 - RNA, 15 nt, Human
caggcaggugggaug

SEQ ID NO: 2064707 - RNA, 22 nt, Human
caggcaggucuugaacuccugg

SEQ ID NO: 2064708 - RNA, 13 nt, Human
caggcaggucuug

SEQ ID NO: 2064709 - RNA, 12 nt, Human
caggcaggucuu

SEQ ID NO: 2064710 - RNA, 19 nt, Human
caggcagguccaggguuug

SEQ ID NO: 2064711 - RNA, 15 nt, Human
caggcagguccaggg

SEQ ID NO: 2064712 - RNA, 14 nt, Human
caggcagguccagg

SEQ ID NO: 2064713 - RNA, 20 nt, Human
caggcauguucucugaggac

SEQ ID NO: 2064714 - RNA, 19 nt, Human
caggcauguucucugagga

SEQ ID NO: 2064715 - RNA, 18 nt, Human
caggcauguucucugagg

SEQ ID NO: 2064716 - RNA, 15 nt, Human
caggcauguucucug

SEQ ID NO: 2064717 - RNA, 14 nt, Human
caggauucuccuuu

SEQ ID NO: 2064718 - RNA, 22 nt, Human
caggcaacgcacaaaacagaaa

SEQ ID NO: 2064719 - RNA, 15 nt, Human
caggcaacugaggca

SEQ ID NO: 2064720 - RNA, 16 nt, Human
caggcaacugaggcag

SEQ ID NO: 2064721 - RNA, 17 nt, Human
caggcaacugaggcaga

SEQ ID NO: 2064722 - RNA, 18 nt, Human
caggcaacugaggcagac

SEQ ID NO: 2064723 - RNA, 19 nt, Human
caggcaacugaggcagaca

SEQ ID NO: 2064724 - RNA, 20 nt, Human
caggauucuuccucccuccc

SEQ ID NO: 2064725 - RNA, 21 nt, Human
caggcaagcaccuccugccuc

SEQ ID NO: 2064726 - RNA, 16 nt, Human
caggcaagcaccuccu

SEQ ID NO: 2064727 - RNA, 15 nt, Human
caggcaagcaccucc

SEQ ID NO: 2064728 - RNA, 14 nt, Human
caggcaagcaccuc

SEQ ID NO: 2064729 - RNA, 20 nt, Human
caggcaacugaggcagacag

SEQ ID NO: 2064730 - RNA, 22 nt, Human
caggcaacugaggcagacagca

SEQ ID NO: 2064731 - RNA, 23 nt, Human
caggcagggcugacucuaggugc

SEQ ID NO: 2064732 - RNA, 17 nt, Human
caggcagggcugacucu

SEQ ID NO: 2064733 - RNA, 13 nt, Human
caggcagguccag

SEQ ID NO: 2064734 - RNA, 19 nt, Human
caggcaggcugugcgcuga

SEQ ID NO: 2064735 - RNA, 13 nt, Human
caggcaggcugug

SEQ ID NO: 2064736 - RNA, 12 nt, Human
caggcaggcugu

SEQ ID NO: 2064737 - RNA, 19 nt, Human
caggcaggaagggcaggaa

SEQ ID NO: 2064738 - RNA, 20 nt, Human
caggcaggaaggcugagagg

SEQ ID NO: 2064739 - RNA, 18 nt, Human
caggcaggaagggcagga

SEQ ID NO: 2064740 - RNA, 19 nt, Human
caggcagcuuuuucucucc

SEQ ID NO: 2064741 - RNA, 22 nt, Human
caggcagcuuuuucucucccac

SEQ ID NO: 2064742 - RNA, 14 nt, Human
caggaucagucuga

SEQ ID NO: 2064743 - RNA, 13 nt, Human
caggaucagucug

SEQ ID NO: 2064744 - RNA, 15 nt, Human
caggaugacccugcg

SEQ ID NO: 2064745 - RNA, 17 nt, Human
caggaugauuguacaga

SEQ ID NO: 2064746 - RNA, 13 nt, Human
caggaugcccagg

SEQ ID NO: 2064747 - RNA, 14 nt, Human
caggaugcccaggg

SEQ ID NO: 2064748 - RNA, 17 nt, Human
caggaugcccagggcca

SEQ ID NO: 2064749 - RNA, 23 nt, Human
caggauggccgggcgcgguggcu

SEQ ID NO: 2064750 - RNA, 24 nt, Human
caggaugcccagggccacucugcc

SEQ ID NO: 2064751 - RNA, 19 nt, Human
caggaugcccagggccacu

SEQ ID NO: 2064752 - RNA, 22 nt, Human
caggaugcccagggccacucug

SEQ ID NO: 2064753 - RNA, 15 nt, Human
caggauggaggggug

SEQ ID NO: 2064754 - RNA, 21 nt, Human
caggauggaggggugguccug

SEQ ID NO: 2064755 - RNA, 22 nt, Human
caggauggaggggugguccuga

SEQ ID NO: 2064756 - RNA, 23 nt, Human
caggauggaggggugguccugac

SEQ ID NO: 2064757 - RNA, 17 nt, Human
caggauucuuccucccu

SEQ ID NO: 2064758 - RNA, 18 nt, Human
caggauucuuccucccuc

SEQ ID NO: 2064759 - RNA, 21 nt, Human
caggauggcaaccagaccauu

SEQ ID NO: 2064760 - RNA, 23 nt, Human
caggcuggucucaaacuccugac

SEQ ID NO: 2064761 - RNA, 13 nt, Human
caggcuggucuca

SEQ ID NO: 2064762 - RNA, 12 nt, Human
caggcuggucuc

SEQ ID NO: 2064763 - RNA, 19 nt, Human
caggcuggucucaaacucu

SEQ ID NO: 2064764 - RNA, 21 nt, Human
caggcuguaucccaugagccu

SEQ ID NO: 2064765 - RNA, 20 nt, Human
caggcuguaucccaugagcc

SEQ ID NO: 2064766 - RNA, 14 nt, Human
caggcuguauccca

SEQ ID NO: 2064767 - RNA, 19 nt, Human
caggcugugcgcugacaac

SEQ ID NO: 2064768 - RNA, 22 nt, Human
caggcugugcgcugacaaccac

SEQ ID NO: 2064769 - RNA, 16 nt, Human
caggcugugggccuca

SEQ ID NO: 2064770 - RNA, 17 nt, Human
caggcugugggccucaa

SEQ ID NO: 2064771 - RNA, 18 nt, Human
caggcuguuuuugggugc

SEQ ID NO: 2064772 - RNA, 23 nt, Human
caggcuguaucccaugagccuca

SEQ ID NO: 2064773 - RNA, 22 nt, Human
caggcuguaucccaugagccuc

SEQ ID NO: 2064774 - RNA, 15 nt, Human
caggcuugccugcag

SEQ ID NO: 2064775 - RNA, 16 nt, Human
caggcuugccugcagg

SEQ ID NO: 2064776 - RNA, 17 nt, Human
caggcuugccugcaggc

SEQ ID NO: 2064777 - RNA, 18 nt, Human
caggcuugccugcaggca

SEQ ID NO: 2064778 - RNA, 14 nt, Human
caggcuuccuuggc

SEQ ID NO: 2064779 - RNA, 18 nt, Human
caggcugcucagggcugg

SEQ ID NO: 2064780 - RNA, 17 nt, Human
caggcugcucagggcug

SEQ ID NO: 2064781 - RNA, 12 nt, Human
caggcugcugga

SEQ ID NO: 2064782 - RNA, 14 nt, Human
caggcugcuggagg

SEQ ID NO: 2064783 - RNA, 15 nt, Human
caggcugcuggagga

SEQ ID NO: 2064784 - RNA, 16 nt, Human
caggcugcuggaggaa

SEQ ID NO: 2064785 - RNA, 14 nt, Human
caggcuggacgugg

SEQ ID NO: 2064786 - RNA, 12 nt, Human
caggcugcuugg

SEQ ID NO: 2064787 - RNA, 15 nt, Human
caggcugcuugggau

SEQ ID NO: 2064788 - RNA, 20 nt, Human
caggcuggcaccgccuucuc

SEQ ID NO: 2064789 - RNA, 21 nt, Human
caggcuggcaccgccuucucu

SEQ ID NO: 2064790 - RNA, 23 nt, Human
caggcugggcuucaguggcagcu

SEQ ID NO: 2064791 - RNA, 22 nt, Human
caggcugccaaggccagagugg

SEQ ID NO: 2064792 - RNA, 16 nt, Human
caggcugcauagaagg

SEQ ID NO: 2064793 - RNA, 17 nt, Human
caggcugcauagaagga

SEQ ID NO: 2064794 - RNA, 18 nt, Human
caggcugcauagaaggag

SEQ ID NO: 2064795 - RNA, 21 nt, Human
caggcugcauagaaggaggag

SEQ ID NO: 2064796 - RNA, 22 nt, Human
caggcugcauagaaggaggaga

SEQ ID NO: 2064797 - RNA, 21 nt, Human
caggcugccaaggccagagug

SEQ ID NO: 2064798 - RNA, 15 nt, Human
caggcugccugagca

SEQ ID NO: 2064799 - RNA, 20 nt, Human
caggcugccugagcaccucc

SEQ ID NO: 2064800 - RNA, 21 nt, Human
caggcugccugagcaccuccc

SEQ ID NO: 2064801 - RNA, 12 nt, Human
caggcucuucuc

SEQ ID NO: 2064802 - RNA, 15 nt, Human
caggcucuucuccuu

SEQ ID NO: 2064803 - RNA, 14 nt, Human
caggcucuucuccu

SEQ ID NO: 2064804 - RNA, 22 nt, Human
caggcucuucuccuuucacaac

SEQ ID NO: 2064805 - RNA, 18 nt, Human
caggcucuucuccuuuca

SEQ ID NO: 2064806 - RNA, 22 nt, Human
caggcucauagggaagaccugc

SEQ ID NO: 2064807 - RNA, 13 nt, Human
caggcuccucccu

SEQ ID NO: 2064808 - RNA, 14 nt, Human
caggcuccucccuc

SEQ ID NO: 2064809 - RNA, 21 nt, Human
caggcuccucccucccucugc

SEQ ID NO: 2064810 - RNA, 20 nt, Human
caggcuccuuuagcgcccag

SEQ ID NO: 2064811 - RNA, 19 nt, Human
caggcuccuuuagcgccca

SEQ ID NO: 2064812 - RNA, 12 nt, Human
caggcuccuucc

SEQ ID NO: 2064813 - RNA, 13 nt, Human
caggcuccuuccu

SEQ ID NO: 2064814 - RNA, 14 nt, Human
caggcuccuuccug

SEQ ID NO: 2064815 - RNA, 17 nt, Human
caggcuccuuccugucu

SEQ ID NO: 2064816 - RNA, 14 nt, Human
caggcuccuuuagc

SEQ ID NO: 2064817 - RNA, 23 nt, Human
caggccgccccagccucugagcc

SEQ ID NO: 2064818 - RNA, 21 nt, Human
caggcuccuuuagcgcccagu

SEQ ID NO: 2064819 - RNA, 21 nt, Human
caggcuccuuccugucuuccu

SEQ ID NO: 2064820 - RNA, 18 nt, Human
caggcuccuuccugucuu

SEQ ID NO: 2064821 - RNA, 20 nt, Human
caggcuccuuccugucuucc

SEQ ID NO: 2064822 - RNA, 14 nt, Human
caggcucugcccug

SEQ ID NO: 2064823 - RNA, 13 nt, Human
caggcucugcccu

SEQ ID NO: 2064824 - RNA, 15 nt, Human
caggcucugcccugc

SEQ ID NO: 2064825 - RNA, 21 nt, Human
caggcucugcccugcccuagc

SEQ ID NO: 2064826 - RNA, 22 nt, Human
caggcucugcccugcccuagcu

SEQ ID NO: 2064827 - RNA, 23 nt, Human
caggcucugcccugcccuagcuc

SEQ ID NO: 2064828 - RNA, 19 nt, Human
caggcccggcuccaggcuc

SEQ ID NO: 2064829 - RNA, 18 nt, Human
caggcccggcuccaggcu

SEQ ID NO: 2064830 - RNA, 16 nt, Human
caggcccggcuccagg

SEQ ID NO: 2064831 - RNA, 17 nt, Human
caggcccggcuccaggc

SEQ ID NO: 2064832 - RNA, 21 nt, Human
caggcccggcuccaggcuccu

SEQ ID NO: 2064833 - RNA, 20 nt, Human
caggcccggcuccaggcucc

SEQ ID NO: 2064834 - RNA, 18 nt, Human
caggcccggcgcgguggc

SEQ ID NO: 2064835 - RNA, 16 nt, Human
caggcccggggcuggc

SEQ ID NO: 2064836 - RNA, 22 nt, Human
caggcccggcuccaggcuccuu

SEQ ID NO: 2064837 - RNA, 15 nt, Human
caggcccggggcugg

SEQ ID NO: 2064838 - RNA, 19 nt, Human
caggcccggcgcgguggcu

SEQ ID NO: 2064839 - RNA, 14 nt, Human
caggcccggggcug

SEQ ID NO: 2064840 - RNA, 15 nt, Human
caggcccuuccucuc

SEQ ID NO: 2064841 - RNA, 17 nt, Human
caggcccuuccucucca

SEQ ID NO: 2064842 - RNA, 16 nt, Human
caggcccuuccucucc

SEQ ID NO: 2064843 - RNA, 23 nt, Human
caggcccuuccucuccacugccu

SEQ ID NO: 2064844 - RNA, 21 nt, Human
caggcccuuccucuccacugc

SEQ ID NO: 2064845 - RNA, 20 nt, Human
caggcccuuccucuccacug

SEQ ID NO: 2064846 - RNA, 19 nt, Human
caggcccuuccucuccacu

SEQ ID NO: 2064847 - RNA, 14 nt, Human
caggccgccccagc

SEQ ID NO: 2064848 - RNA, 16 nt, Human
caggccgccccagccu

SEQ ID NO: 2064849 - RNA, 18 nt, Human
caggccgccccagccucu

SEQ ID NO: 2064850 - RNA, 20 nt, Human
caggccgccccagccucuga

SEQ ID NO: 2064851 - RNA, 21 nt, Human
caggccgccccagccucugag

SEQ ID NO: 2064852 - RNA, 13 nt, Human
cagggcagcagau

SEQ ID NO: 2064853 - RNA, 15 nt, Human
cagggcagcagaucu

SEQ ID NO: 2064854 - RNA, 16 nt, Human
cagggcagagccggga

SEQ ID NO: 2064855 - RNA, 12 nt, Human
cagggcagagcc

SEQ ID NO: 2064856 - RNA, 15 nt, Human
cagggcagagccggg

SEQ ID NO: 2064857 - RNA, 16 nt, Human
cagggcaccaagccca

SEQ ID NO: 2064858 - RNA, 18 nt, Human
cagggcaccaagcccaca

SEQ ID NO: 2064859 - RNA, 19 nt, Human
cagggcaccaagcccacag

SEQ ID NO: 2064860 - RNA, 21 nt, Human
cagggcaccaagcccacaggu

SEQ ID NO: 2064861 - RNA, 11 nt, Human
cagggcacugc

SEQ ID NO: 2064862 - RNA, 15 nt, Human
cagggcacugcugcu

SEQ ID NO: 2064863 - RNA, 17 nt, Human
cagggcagccugccugg

SEQ ID NO: 2064864 - RNA, 19 nt, Human
cagggcagccugccuggag

SEQ ID NO: 2064865 - RNA, 21 nt, Human
cagggcacaccgggcacucag

SEQ ID NO: 2064866 - RNA, 19 nt, Human
cagggcacaccgggcacuc

SEQ ID NO: 2064867 - RNA, 17 nt, Human
cagggcacaccgggcac

SEQ ID NO: 2064868 - RNA, 15 nt, Human
cagggcacaccgggc

SEQ ID NO: 2064869 - RNA, 23 nt, Human
cagggcacaccgggcacucagaa

SEQ ID NO: 2064870 - RNA, 22 nt, Human
cagggcacaccgggcacucaga

SEQ ID NO: 2064871 - RNA, 14 nt, Human
cagggcacaccggg

SEQ ID NO: 2064872 - RNA, 15 nt, Human
cagggcaaggccauu

SEQ ID NO: 2064873 - RNA, 20 nt, Human
cagggauuuguccuugggga

SEQ ID NO: 2064874 - RNA, 14 nt, Human
cagggaccaaggac

SEQ ID NO: 2064875 - RNA, 15 nt, Human
cagggaccaaggacc

SEQ ID NO: 2064876 - RNA, 18 nt, Human
cagggaccaaggaccccu

SEQ ID NO: 2064877 - RNA, 14 nt, Human
cagggaccccugcc

SEQ ID NO: 2064878 - RNA, 15 nt, Human
cagggaccccugccc

SEQ ID NO: 2064879 - RNA, 16 nt, Human
cagggaccccugcccu

SEQ ID NO: 2064880 - RNA, 22 nt, Human
cagggacccacuucacacacag

SEQ ID NO: 2064881 - RNA, 19 nt, Human
cagggaccaaggaccccuc

SEQ ID NO: 2064882 - RNA, 15 nt, Human
cagggcccugcagag

SEQ ID NO: 2064883 - RNA, 18 nt, Human
cagggcccugcagagggg

SEQ ID NO: 2064884 - RNA, 15 nt, Human
cagggcccugagcuc

SEQ ID NO: 2064885 - RNA, 21 nt, Human
cagggcccugagcucggugga

SEQ ID NO: 2064886 - RNA, 13 nt, Human
cagggcccugcag

SEQ ID NO: 2064887 - RNA, 14 nt, Human
cagggcccugcaga

SEQ ID NO: 2064888 - RNA, 23 nt, Human
cagggccuccagcccucucacug

SEQ ID NO: 2064889 - RNA, 16 nt, Human
cagggccccagcacua

SEQ ID NO: 2064890 - RNA, 22 nt, Human
cagggccccagcacuaaagcag

SEQ ID NO: 2064891 - RNA, 13 nt, Human
cagggccccagaa

SEQ ID NO: 2064892 - RNA, 15 nt, Human
cagggccccagaagg

SEQ ID NO: 2064893 - RNA, 17 nt, Human
cagggccccagaaggca

SEQ ID NO: 2064894 - RNA, 14 nt, Human
cagggccccagcac

SEQ ID NO: 2064895 - RNA, 15 nt, Human
cagggccccagcacu

SEQ ID NO: 2064896 - RNA, 21 nt, Human
cagggccccagaaggcaggga

SEQ ID NO: 2064897 - RNA, 19 nt, Human
cagggcaugcauuuugcag

SEQ ID NO: 2064898 - RNA, 20 nt, Human
cagggcauggccagguggcc

SEQ ID NO: 2064899 - RNA, 15 nt, Human
cagggcagggcucug

SEQ ID NO: 2064900 - RNA, 16 nt, Human
cagggcagggcucuga

SEQ ID NO: 2064901 - RNA, 19 nt, Human
cagggcagggcucugauau

SEQ ID NO: 2064902 - RNA, 17 nt, Human
cagggcagggcucugau

SEQ ID NO: 2064903 - RNA, 15 nt, Human
cagggcaucuccugu

SEQ ID NO: 2064904 - RNA, 13 nt, Human
cagggcaucuccu

SEQ ID NO: 2064905 - RNA, 14 nt, Human
cagggcaucuccug

SEQ ID NO: 2064906 - RNA, 18 nt, Human
cagggccacucugccucu

SEQ ID NO: 2064907 - RNA, 20 nt, Human
cagggccacucugccucugc

SEQ ID NO: 2064908 - RNA, 18 nt, Human
cagggccacgugccaggc

SEQ ID NO: 2064909 - RNA, 20 nt, Human
cagggccacgugccaggccc

SEQ ID NO: 2064910 - RNA, 21 nt, Human
cagggccacgugccaggcccg

SEQ ID NO: 2064911 - RNA, 12 nt, Human
cagggccacucu

SEQ ID NO: 2064912 - RNA, 16 nt, Human
cagggccacucugccu

SEQ ID NO: 2064913 - RNA, 17 nt, Human
cagggccacucugccuc

SEQ ID NO: 2064914 - RNA, 15 nt, Human
cagggccacgugcca

SEQ ID NO: 2064915 - RNA, 16 nt, Human
cagggccacgugccag

SEQ ID NO: 2064916 - RNA, 17 nt, Human
cagggccacgugccagg

SEQ ID NO: 2064917 - RNA, 12 nt, Human
cagggccagggc

SEQ ID NO: 2064918 - RNA, 13 nt, Human
cagggccagggcc

SEQ ID NO: 2064919 - RNA, 15 nt, Human
cagggccagggcccu

SEQ ID NO: 2064920 - RNA, 16 nt, Human
cagggccagggcccug

SEQ ID NO: 2064921 - RNA, 18 nt, Human
cagggccagggcccugca

SEQ ID NO: 2064922 - RNA, 19 nt, Human
cagggccagggcccugcag

SEQ ID NO: 2064923 - RNA, 18 nt, Human
caggggcguguggcucac

SEQ ID NO: 2064924 - RNA, 15 nt, Human
caggggcuggugggc

SEQ ID NO: 2064925 - RNA, 20 nt, Human
cagggcgagacucugucuca

SEQ ID NO: 2064926 - RNA, 17 nt, Human
caggggcaaacaccugc

SEQ ID NO: 2064927 - RNA, 18 nt, Human
caggggcaaacaccugcu

SEQ ID NO: 2064928 - RNA, 18 nt, Human
caggggagucccgucagg

SEQ ID NO: 2064929 - RNA, 17 nt, Human
caggggagagggucugg

SEQ ID NO: 2064930 - RNA, 23 nt, Human
caggggacucagcccugagguga

SEQ ID NO: 2064931 - RNA, 20 nt, Human
caggggagagggucuggaga

SEQ ID NO: 2064932 - RNA, 21 nt, Human
caggggagagggucuggagaa

SEQ ID NO: 2064933 - RNA, 15 nt, Human
caggggaccacaccu

SEQ ID NO: 2064934 - RNA, 17 nt, Human
caggggaccacaccucc

SEQ ID NO: 2064935 - RNA, 15 nt, Human
caggggacucagccc

SEQ ID NO: 2064936 - RNA, 17 nt, Human
caggggacucagcccug

SEQ ID NO: 2064937 - RNA, 18 nt, Human
caggggacucagcccuga

SEQ ID NO: 2064938 - RNA, 20 nt, Human
caggggacucagcccugagg

SEQ ID NO: 2064939 - RNA, 21 nt, Human
caggggacucagcccugaggu

SEQ ID NO: 2064940 - RNA, 15 nt, Human
cagggccuugcccag

SEQ ID NO: 2064941 - RNA, 16 nt, Human
cagggccuugcccaga

SEQ ID NO: 2064942 - RNA, 17 nt, Human
cagggccuugcccagag

SEQ ID NO: 2064943 - RNA, 18 nt, Human
cagggccuugcccagaga

SEQ ID NO: 2064944 - RNA, 19 nt, Human
cagggccuugcccagagau

SEQ ID NO: 2064945 - RNA, 20 nt, Human
cagggccuugcccagagaug

SEQ ID NO: 2064946 - RNA, 24 nt, Human
cagggccuugcccagagaugccuc

SEQ ID NO: 2064947 - RNA, 15 nt, Human
cagggccuugcuaau

SEQ ID NO: 2064948 - RNA, 13 nt, Human
cagggccuugccc

SEQ ID NO: 2064949 - RNA, 22 nt, Human
cagggccagaugagcagaagcu

SEQ ID NO: 2064950 - RNA, 14 nt, Human
cagggccuugccca

SEQ ID NO: 2064951 - RNA, 13 nt, Human
cagggggccaggu

SEQ ID NO: 2064952 - RNA, 16 nt, Human
cagggggccaggugca

SEQ ID NO: 2064953 - RNA, 11 nt, Human
cagggggccag

SEQ ID NO: 2064954 - RNA, 19 nt, Human
cagggggccaggugcacag

SEQ ID NO: 2064955 - RNA, 19 nt, Human
cagggaaggggaggcagcc

SEQ ID NO: 2064956 - RNA, 14 nt, Human
cagggaagucccca

SEQ ID NO: 2064957 - RNA, 16 nt, Human
cagggaaguccccagg

SEQ ID NO: 2064958 - RNA, 17 nt, Human
cagggaaguccccaggc

SEQ ID NO: 2064959 - RNA, 18 nt, Human
cagggaaguccccaggcc

SEQ ID NO: 2064960 - RNA, 21 nt, Human
cagggaaguguaagaaacaca

SEQ ID NO: 2064961 - RNA, 23 nt, Human
cagggaaguccccaggccccagg

SEQ ID NO: 2064962 - RNA, 14 nt, Human
cagggaagcuggcc

SEQ ID NO: 2064963 - RNA, 17 nt, Human
cagggaagcuggccgag

SEQ ID NO: 2064964 - RNA, 13 nt, Human
cagggaagcuggc

SEQ ID NO: 2064965 - RNA, 23 nt, Human
cagggaauuucaggaacuagaga

SEQ ID NO: 2064966 - RNA, 14 nt, Human
cagggacagagaca

SEQ ID NO: 2064967 - RNA, 17 nt, Human
cagggacagagacaccu

SEQ ID NO: 2064968 - RNA, 18 nt, Human
cagggacagagacaccug

SEQ ID NO: 2064969 - RNA, 19 nt, Human
cagggacagagacaccugc

SEQ ID NO: 2064970 - RNA, 20 nt, Human
cagggacagagacaccugca

SEQ ID NO: 2064971 - RNA, 21 nt, Human
cagggacagagacaccugcac

SEQ ID NO: 2064972 - RNA, 22 nt, Human
cagggacagagacaccugcacc

SEQ ID NO: 2064973 - RNA, 23 nt, Human
cagggacagagacaccugcaccu

SEQ ID NO: 2064974 - RNA, 22 nt, Human
cagggaaacagcuaaugggaca

SEQ ID NO: 2064975 - RNA, 16 nt, Human
cagggaaacagcuaau

SEQ ID NO: 2064976 - RNA, 12 nt, Human
cagggaagccca

SEQ ID NO: 2064977 - RNA, 13 nt, Human
cagggaagcccag

SEQ ID NO: 2064978 - RNA, 14 nt, Human
cagggaagcccagc

SEQ ID NO: 2064979 - RNA, 15 nt, Human
cagggaagcccagcu

SEQ ID NO: 2064980 - RNA, 16 nt, Human
cagggaagcccagcuc

SEQ ID NO: 2064981 - RNA, 18 nt, Human
cagggaagcccagcucca

SEQ ID NO: 2064982 - RNA, 19 nt, Human
cagggaagcccagcuccag

SEQ ID NO: 2064983 - RNA, 21 nt, Human
cagggaagcccagcuccaggg

SEQ ID NO: 2064984 - RNA, 23 nt, Human
cagggaagcccagcuccagggcc

SEQ ID NO: 2064985 - RNA, 14 nt, Human
cagggaaaggcucu

SEQ ID NO: 2064986 - RNA, 23 nt, Human
cagggaaaggcucugaaagccag

SEQ ID NO: 2064987 - RNA, 14 nt, Human
cauguguuccaagg

SEQ ID NO: 2064988 - RNA, 17 nt, Human
caugugugagugugugc

SEQ ID NO: 2064989 - RNA, 15 nt, Human
caugugugagugugu

SEQ ID NO: 2064990 - RNA, 19 nt, Human
cauguguuugguucugggg

SEQ ID NO: 2064991 - RNA, 14 nt, Human
cauguguugaaaaa

SEQ ID NO: 2064992 - RNA, 10 nt, Human
cauguuucuu

SEQ ID NO: 2064993 - RNA, 22 nt, Human
caugugccuauagucccagcua

SEQ ID NO: 2064994 - RNA, 14 nt, Human
caugugcccaguua

SEQ ID NO: 2064995 - RNA, 15 nt, Human
caugugccugcacca

SEQ ID NO: 2064996 - RNA, 16 nt, Human
caugugccugcaccag

SEQ ID NO: 2064997 - RNA, 17 nt, Human
caugugccugcaccagg

SEQ ID NO: 2064998 - RNA, 18 nt, Human
caugugccugcaccagga

SEQ ID NO: 2064999 - RNA, 20 nt, Human
caugugccugcaccaggaga

SEQ ID NO: 2065000 - RNA, 21 nt, Human
caugugccugcaccaggagac

SEQ ID NO: 2065001 - RNA, 22 nt, Human
caugugccugcaccaggagaca

SEQ ID NO: 2065002 - RNA, 23 nt, Human
caugugccugcaccaggagacag

SEQ ID NO: 2065003 - RNA, 14 nt, Human
caugugcacaugca

SEQ ID NO: 2065004 - RNA, 22 nt, Human
caugugccagguuuuuggucug

SEQ ID NO: 2065005 - RNA, 17 nt, Human
cauguguccaucccagc

SEQ ID NO: 2065006 - RNA, 18 nt, Human
cauguguccaucccagcg

SEQ ID NO: 2065007 - RNA, 21 nt, Human
cauguguccaucccagcggcu

SEQ ID NO: 2065008 - RNA, 12 nt, Human
caugucuggcua

SEQ ID NO: 2065009 - RNA, 17 nt, Human
caugucucucagaauuc

SEQ ID NO: 2065010 - RNA, 22 nt, Human
cauguacuguaguuuuucuuca

SEQ ID NO: 2065011 - RNA, 14 nt, Human
cauguacuguaguu

SEQ ID NO: 2065012 - RNA, 13 nt, Human
cauguacuguagu

SEQ ID NO: 2065013 - RNA, 14 nt, Human
cauguaaaagaguc

SEQ ID NO: 2065014 - RNA, 16 nt, Human
cauguaaaagagucau

SEQ ID NO: 2065015 - RNA, 19 nt, Human
cauguacccuaaggucauu

SEQ ID NO: 2065016 - RNA, 14 nt, Human
cauguaaauaaaua

SEQ ID NO: 2065017 - RNA, 12 nt, Human
cauguaaaacaa

SEQ ID NO: 2065018 - RNA, 13 nt, Human
cauguaaaacaaa

SEQ ID NO: 2065019 - RNA, 14 nt, Human
cauguaaaacaaaa

SEQ ID NO: 2065020 - RNA, 15 nt, Human
cauguaaaacaaaaa

SEQ ID NO: 2065021 - RNA, 16 nt, Human
cauguaaaacaaaaaa

SEQ ID NO: 2065022 - RNA, 18 nt, Human
cauguaaaacaaaaaaca

SEQ ID NO: 2065023 - RNA, 19 nt, Human
cauguaaaacaaaaaacaa

SEQ ID NO: 2065024 - RNA, 22 nt, Human
cauguaaaacaaaaaacaauau

SEQ ID NO: 2065025 - RNA, 20 nt, Human
caugguggcgcaagccugua

SEQ ID NO: 2065026 - RNA, 12 nt, Human
caugguggcgca

SEQ ID NO: 2065027 - RNA, 17 nt, Human
caugguggcgcaagccu

SEQ ID NO: 2065028 - RNA, 18 nt, Human
caugguggcgcaagccug

SEQ ID NO: 2065029 - RNA, 19 nt, Human
caugguggguucaggggac

SEQ ID NO: 2065030 - RNA, 22 nt, Human
cauuaaaaaaaaaaaaaaaagu

SEQ ID NO: 2065031 - RNA, 19 nt, Human
cauguuuuucuucucccuc

SEQ ID NO: 2065032 - RNA, 20 nt, Human
cauguuuuucuucucccuca

SEQ ID NO: 2065033 - RNA, 13 nt, Human
cauguuucuucau

SEQ ID NO: 2065034 - RNA, 21 nt, Human
caugugugagugugugcaagu

SEQ ID NO: 2065035 - RNA, 12 nt, Human
cauuaaaacaau

SEQ ID NO: 2065036 - RNA, 21 nt, Human
cauuaaaacaauauuguuucu

SEQ ID NO: 2065037 - RNA, 22 nt, Human
cauuaaaacaauauuguuucua

SEQ ID NO: 2065038 - RNA, 16 nt, Human
caugcagcccaugccc

SEQ ID NO: 2065039 - RNA, 19 nt, Human
caugcagcccaugcccacc

SEQ ID NO: 2065040 - RNA, 20 nt, Human
caugcagcccaugcccaccu

SEQ ID NO: 2065041 - RNA, 12 nt, Human
caugcagcagcu

SEQ ID NO: 2065042 - RNA, 13 nt, Human
caugcagcagcuu

SEQ ID NO: 2065043 - RNA, 14 nt, Human
caugcagcagcuug

SEQ ID NO: 2065044 - RNA, 16 nt, Human
caugcagcagcuugcu

SEQ ID NO: 2065045 - RNA, 17 nt, Human
caugcagcagcuugcug

SEQ ID NO: 2065046 - RNA, 14 nt, Human
caugcagcaucuaa

SEQ ID NO: 2065047 - RNA, 22 nt, Human
caugcagcccaugcccaccugc

SEQ ID NO: 2065048 - RNA, 23 nt, Human
caugcagcccaugcccaccugcc

SEQ ID NO: 2065049 - RNA, 18 nt, Human
caugcagaaagggagcag

SEQ ID NO: 2065050 - RNA, 21 nt, Human
caugcgggcugggcagcuguu

SEQ ID NO: 2065051 - RNA, 16 nt, Human
caugcggcccaggaug

SEQ ID NO: 2065052 - RNA, 15 nt, Human
caugcgggcugggca

SEQ ID NO: 2065053 - RNA, 18 nt, Human
caugcgggcugggcagcu

SEQ ID NO: 2065054 - RNA, 19 nt, Human
caugcgggcugggcagcug

SEQ ID NO: 2065055 - RNA, 20 nt, Human
caugcgggcugggcagcugu

SEQ ID NO: 2065056 - RNA, 12 nt, Human
cauggacccgga

SEQ ID NO: 2065057 - RNA, 15 nt, Human
cauggaccuaacauu

SEQ ID NO: 2065058 - RNA, 16 nt, Human
cauggaccuaacauuc

SEQ ID NO: 2065059 - RNA, 19 nt, Human
cauggacguucggggcaug

SEQ ID NO: 2065060 - RNA, 15 nt, Human
cauggacccggagcu

SEQ ID NO: 2065061 - RNA, 21 nt, Human
cauggacucuacacugugaac

SEQ ID NO: 2065062 - RNA, 15 nt, Human
cauggacuuccacug

SEQ ID NO: 2065063 - RNA, 14 nt, Human
cauggaggagcuug

SEQ ID NO: 2065064 - RNA, 13 nt, Human
cauggaggcacac

SEQ ID NO: 2065065 - RNA, 14 nt, Human
caugcuugaugguu

SEQ ID NO: 2065066 - RNA, 17 nt, Human
caugcuugaugguuuau

SEQ ID NO: 2065067 - RNA, 13 nt, Human
cauggaaauauua

SEQ ID NO: 2065068 - RNA, 14 nt, Human
cauggaaauauuau

SEQ ID NO: 2065069 - RNA, 16 nt, Human
cauggaaauauuaugc

SEQ ID NO: 2065070 - RNA, 17 nt, Human
cauggaaauauuaugca

SEQ ID NO: 2065071 - RNA, 19 nt, Human
cauggaaauauuaugcaaa

SEQ ID NO: 2065072 - RNA, 22 nt, Human
cauggaaauauuaugcaaauuc

SEQ ID NO: 2065073 - RNA, 18 nt, Human
caugggccuccugugugu

SEQ ID NO: 2065074 - RNA, 22 nt, Human
cauggaggagcuugggggauga

SEQ ID NO: 2065075 - RNA, 16 nt, Human
cauggaggcacacagc

SEQ ID NO: 2065076 - RNA, 19 nt, Human
cauggaggcacacagcugc

SEQ ID NO: 2065077 - RNA, 20 nt, Human
cauggaggcacacagcugca

SEQ ID NO: 2065078 - RNA, 19 nt, Human
caugggugaagggagagcc

SEQ ID NO: 2065079 - RNA, 22 nt, Human
caugggugaagggagagccagc

SEQ ID NO: 2065080 - RNA, 23 nt, Human
caugggugaagggagagccagcu

SEQ ID NO: 2065081 - RNA, 15 nt, Human
cauggguuaugugua

SEQ ID NO: 2065082 - RNA, 23 nt, Human
cauggguuauguguaugugccau

SEQ ID NO: 2065083 - RNA, 16 nt, Human
cauggguuuuguaggu

SEQ ID NO: 2065084 - RNA, 21 nt, Human
cauggguuuuguagguacuuu

SEQ ID NO: 2065085 - RNA, 23 nt, Human
cauggguuuuguagguacuuuug

SEQ ID NO: 2065086 - RNA, 13 nt, Human
caugguaauuuau

SEQ ID NO: 2065087 - RNA, 23 nt, Human
caugguaauuuauaguuuauaca

SEQ ID NO: 2065088 - RNA, 14 nt, Human
caugguauuugaga

SEQ ID NO: 2065089 - RNA, 16 nt, Human
caugguauuugagaca

SEQ ID NO: 2065090 - RNA, 15 nt, Human
cauggguagcuucug

SEQ ID NO: 2065091 - RNA, 16 nt, Human
cauggguagcuucuga

SEQ ID NO: 2065092 - RNA, 19 nt, Human
cauggguagcuucugaccu

SEQ ID NO: 2065093 - RNA, 22 nt, Human
cauggguagcuucugaccucag

SEQ ID NO: 2065094 - RNA, 23 nt, Human
cauggguagcuucugaccucagc

SEQ ID NO: 2065095 - RNA, 20 nt, Human
caugggguuggcugggccca

SEQ ID NO: 2065096 - RNA, 22 nt, Human
caugggguuggcugggcccaga

SEQ ID NO: 2065097 - RNA, 19 nt, Human
caugggguuggcugggccc

SEQ ID NO: 2065098 - RNA, 22 nt, Human
cauuuacccuucuuuucugacu

SEQ ID NO: 2065099 - RNA, 12 nt, Human
cauuuacacuuu

SEQ ID NO: 2065100 - RNA, 19 nt, Human
cauuuacacuuuugagacu

SEQ ID NO: 2065101 - RNA, 14 nt, Human
cauuuaauugagaa

SEQ ID NO: 2065102 - RNA, 14 nt, Human
cauuucuugggccc

SEQ ID NO: 2065103 - RNA, 15 nt, Human
cauuucuugggcccu

SEQ ID NO: 2065104 - RNA, 16 nt, Human
cauuucuugggcccuc

SEQ ID NO: 2065105 - RNA, 15 nt, Human
cauuuaaaaaaaauc

SEQ ID NO: 2065106 - RNA, 21 nt, Human
cauuguaauguuacugaucau

SEQ ID NO: 2065107 - RNA, 17 nt, Human
cauuguaauguuacuga

SEQ ID NO: 2065108 - RNA, 18 nt, Human
cauuguaauguuacugau

SEQ ID NO: 2065109 - RNA, 15 nt, Human
cauuguaauguuacu

SEQ ID NO: 2065110 - RNA, 16 nt, Human
cauuguaauguuacug

SEQ ID NO: 2065111 - RNA, 19 nt, Human
cauugauggggaaggaggc

SEQ ID NO: 2065112 - RNA, 15 nt, Human
cauugauugcugugu

SEQ ID NO: 2065113 - RNA, 16 nt, Human
cauugauugcuguguc

SEQ ID NO: 2065114 - RNA, 23 nt, Human
cauugauugcuguguccaacucc

SEQ ID NO: 2065115 - RNA, 16 nt, Human
cauugauugucagcua

SEQ ID NO: 2065116 - RNA, 16 nt, Human
cauugauggggaagga

SEQ ID NO: 2065117 - RNA, 17 nt, Human
cauugauugucagcuac

SEQ ID NO: 2065118 - RNA, 18 nt, Human
cauugauugucagcuacu

SEQ ID NO: 2065119 - RNA, 17 nt, Human
cauugugguuauuuuua

SEQ ID NO: 2065120 - RNA, 18 nt, Human
cauugugguuauuuuuau

SEQ ID NO: 2065121 - RNA, 20 nt, Human
cauugugguuauuuuuauac

SEQ ID NO: 2065122 - RNA, 21 nt, Human
cauugugguuauuuuuauaca

SEQ ID NO: 2065123 - RNA, 22 nt, Human
cauugugguuauuuuuauacag

SEQ ID NO: 2065124 - RNA, 23 nt, Human
cauugugguuauuuuuauacagu

SEQ ID NO: 2065125 - RNA, 17 nt, Human
cauugauaugaaaaaua

SEQ ID NO: 2065126 - RNA, 18 nt, Human
cauugauaugaaaaauau

SEQ ID NO: 2065127 - RNA, 19 nt, Human
cauugauaugaaaaauaug

SEQ ID NO: 2065128 - RNA, 14 nt, Human
cauugauggggaag

SEQ ID NO: 2065129 - RNA, 22 nt, Human
cauugauaugaaaaauaugaua

SEQ ID NO: 2065130 - RNA, 18 nt, Human
cauugaaguaaugaauuu

SEQ ID NO: 2065131 - RNA, 19 nt, Human
cauugaaguaaugaauuuu

SEQ ID NO: 2065132 - RNA, 14 nt, Human
cauugaagagagag

SEQ ID NO: 2065133 - RNA, 15 nt, Human
cauugaagagagagc

SEQ ID NO: 2065134 - RNA, 16 nt, Human
cauugaagagagagcu

SEQ ID NO: 2065135 - RNA, 17 nt, Human
cauuuuacuuuuuccug

SEQ ID NO: 2065136 - RNA, 20 nt, Human
cauuuuacuuuuuccuggcu

SEQ ID NO: 2065137 - RNA, 22 nt, Human
cauuuuacuuuuuccuggcuca

SEQ ID NO: 2065138 - RNA, 16 nt, Human
cauuuuacuguacaga

SEQ ID NO: 2065139 - RNA, 22 nt, Human
cauuuuacuguacagauugcug

SEQ ID NO: 2065140 - RNA, 16 nt, Human
cauuuucaccccaccc

SEQ ID NO: 2065141 - RNA, 17 nt, Human
cauuucuugggcccucc

SEQ ID NO: 2065142 - RNA, 18 nt, Human
cauuucuugggcccuccu

SEQ ID NO: 2065143 - RNA, 14 nt, Human
cauuugaugcuaaa

SEQ ID NO: 2065144 - RNA, 15 nt, Human
cauuugaugcuaaau

SEQ ID NO: 2065145 - RNA, 16 nt, Human
cauuugaugcuaaaua

SEQ ID NO: 2065146 - RNA, 15 nt, Human
cauuugauucugugu

SEQ ID NO: 2065147 - RNA, 15 nt, Human
cauuugcacccuccg

SEQ ID NO: 2065148 - RNA, 17 nt, Human
cauuugcacccuccgcc

SEQ ID NO: 2065149 - RNA, 15 nt, Human
cauuuucugaaacua

SEQ ID NO: 2065150 - RNA, 17 nt, Human
cauuuucugaaacuaau

SEQ ID NO: 2065151 - RNA, 20 nt, Human
cauuuucugaaacuaaugaa

SEQ ID NO: 2065152 - RNA, 12 nt, Human
cauuuucccaga

SEQ ID NO: 2065153 - RNA, 14 nt, Human
cauuuuccccccac

SEQ ID NO: 2065154 - RNA, 15 nt, Human
cauuuuccccccacu

SEQ ID NO: 2065155 - RNA, 17 nt, Human
cauuuucaccccacccu

SEQ ID NO: 2065156 - RNA, 14 nt, Human
cauuuucagacugc

SEQ ID NO: 2065157 - RNA, 19 nt, Human
cauuuucagacugcuuuaa

SEQ ID NO: 2065158 - RNA, 17 nt, Human
cauuuuccccccacucu

SEQ ID NO: 2065159 - RNA, 20 nt, Human
cauuuuccccccacucuccc

SEQ ID NO: 2065160 - RNA, 21 nt, Human
cauuuuccccccacucucccc

SEQ ID NO: 2065161 - RNA, 22 nt, Human
cauuuuccccccacucucccca

SEQ ID NO: 2065162 - RNA, 17 nt, Human
cauuuuuaguagagaca

SEQ ID NO: 2065163 - RNA, 16 nt, Human
ccaaaauuauuucaga

SEQ ID NO: 2065164 - RNA, 16 nt, Human
ccaaacaaauaugcaa

SEQ ID NO: 2065165 - RNA, 13 nt, Human
cauucaucucauu

SEQ ID NO: 2065166 - RNA, 15 nt, Human
cauucauaacuuuca

SEQ ID NO: 2065167 - RNA, 13 nt, Human
cauucaggaaaac

SEQ ID NO: 2065168 - RNA, 20 nt, Human
cauucaggaaaacugacaga

SEQ ID NO: 2065169 - RNA, 23 nt, Human
cauucaggaaaacugacagagga

SEQ ID NO: 2065170 - RNA, 12 nt, Human
cauucaggaacc

SEQ ID NO: 2065171 - RNA, 15 nt, Human
cauucaggaaccugg

SEQ ID NO: 2065172 - RNA, 19 nt, Human
cauucaggaaccuggacca

SEQ ID NO: 2065173 - RNA, 20 nt, Human
cauucacccagacagcuccc

SEQ ID NO: 2065174 - RNA, 18 nt, Human
cauucacuugcauuucuu

SEQ ID NO: 2065175 - RNA, 13 nt, Human
cauucagaacacc

SEQ ID NO: 2065176 - RNA, 21 nt, Human
cauucagaacaccaagacuug

SEQ ID NO: 2065177 - RNA, 15 nt, Human
cauucacuugcauuu

SEQ ID NO: 2065178 - RNA, 15 nt, Human
cauuccaaaacgaag

SEQ ID NO: 2065179 - RNA, 17 nt, Human
cauuccaccuucccaug

SEQ ID NO: 2065180 - RNA, 22 nt, Human
cauuccaccuucccaugcccug

SEQ ID NO: 2065181 - RNA, 23 nt, Human
cauuccaacagcucaagucuucc

SEQ ID NO: 2065182 - RNA, 21 nt, Human
cauuccaugugcccaguuaau

SEQ ID NO: 2065183 - RNA, 12 nt, Human
cauuccaggcuc

SEQ ID NO: 2065184 - RNA, 13 nt, Human
cauuccaggcucc

SEQ ID NO: 2065185 - RNA, 17 nt, Human
cauuccaggcuccuccc

SEQ ID NO: 2065186 - RNA, 15 nt, Human
cauuccaugugccca

SEQ ID NO: 2065187 - RNA, 16 nt, Human
cauuccaugugcccag

SEQ ID NO: 2065188 - RNA, 17 nt, Human
cauuccaugugcccagu

SEQ ID NO: 2065189 - RNA, 18 nt, Human
cauuccaugugcccaguu

SEQ ID NO: 2065190 - RNA, 14 nt, Human
cauuccaagccuga

SEQ ID NO: 2065191 - RNA, 11 nt, Human
cauucccugag

SEQ ID NO: 2065192 - RNA, 17 nt, Human
cauucccugagucacca

SEQ ID NO: 2065193 - RNA, 22 nt, Human
cauuccgacaaccgaugcucca

SEQ ID NO: 2065194 - RNA, 18 nt, Human
cauucccugagucaccag

SEQ ID NO: 2065195 - RNA, 20 nt, Human
cauucccugagucaccagga

SEQ ID NO: 2065196 - RNA, 21 nt, Human
cauucccugagucaccaggaa

SEQ ID NO: 2065197 - RNA, 20 nt, Human
cauuccuaacacagcaugug

SEQ ID NO: 2065198 - RNA, 21 nt, Human
cauuccuaacacagcaugugu

SEQ ID NO: 2065199 - RNA, 13 nt, Human
cauuccuauuucu

SEQ ID NO: 2065200 - RNA, 23 nt, Human
cauuccuaacacagcauguguau

SEQ ID NO: 2065201 - RNA, 13 nt, Human
cauuccccauggg

SEQ ID NO: 2065202 - RNA, 15 nt, Human
cauuccccagccucu

SEQ ID NO: 2065203 - RNA, 13 nt, Human
cauuccccaggug

SEQ ID NO: 2065204 - RNA, 17 nt, Human
cauuccccagguggcug

SEQ ID NO: 2065205 - RNA, 23 nt, Human
cauuccccagguggcugacccag

SEQ ID NO: 2065206 - RNA, 18 nt, Human
cauuaccagacgguucac

SEQ ID NO: 2065207 - RNA, 14 nt, Human
cauuacucuuguaa

SEQ ID NO: 2065208 - RNA, 16 nt, Human
cauuacucuuguaaga

SEQ ID NO: 2065209 - RNA, 17 nt, Human
cauuacucuuguaagau

SEQ ID NO: 2065210 - RNA, 18 nt, Human
cauuacucuuguaagauu

SEQ ID NO: 2065211 - RNA, 19 nt, Human
cauuacucuuguaagauuu

SEQ ID NO: 2065212 - RNA, 20 nt, Human
cauuacucuuguaagauuuu

SEQ ID NO: 2065213 - RNA, 22 nt, Human
cauuacucuuguaagauuuuga

SEQ ID NO: 2065214 - RNA, 23 nt, Human
cauuacucuuguaagauuuugaa

SEQ ID NO: 2065215 - RNA, 17 nt, Human
cauuagaaauagacagu

SEQ ID NO: 2065216 - RNA, 18 nt, Human
cauuagaaauuagcugug

SEQ ID NO: 2065217 - RNA, 17 nt, Human
cauuauuggaauuaacc

SEQ ID NO: 2065218 - RNA, 18 nt, Human
cauuauuggaauuaaccu

SEQ ID NO: 2065219 - RNA, 20 nt, Human
cauuauuggaauuaaccugg

SEQ ID NO: 2065220 - RNA, 22 nt, Human
cauuauuggaauuaaccuggug

SEQ ID NO: 2065221 - RNA, 14 nt, Human
cauuauuggaauua

SEQ ID NO: 2065222 - RNA, 12 nt, Human
cauuauuggaau

SEQ ID NO: 2065223 - RNA, 16 nt, Human
cauucaaaaguugaaa

SEQ ID NO: 2065224 - RNA, 17 nt, Human
cauucaaaaguugaaau

SEQ ID NO: 2065225 - RNA, 23 nt, Human
cauuauuggaauuaaccuggugc

SEQ ID NO: 2065226 - RNA, 18 nt, Human
cauucaaaaguugaaauu

SEQ ID NO: 2065227 - RNA, 17 nt, Human
cauucaagucagcucuu

SEQ ID NO: 2065228 - RNA, 16 nt, Human
cauucaagucagcucu

SEQ ID NO: 2065229 - RNA, 21 nt, Human
cauucaauuuauucaagaaaa

SEQ ID NO: 2065230 - RNA, 13 nt, Human
cauucaauguuua

SEQ ID NO: 2065231 - RNA, 22 nt, Human
cauucaauaagcaucaaacucu

SEQ ID NO: 2065232 - RNA, 20 nt, Human
cauucaauuuauucaagaaa

SEQ ID NO: 2065233 - RNA, 13 nt, Human
cauucacccagac

SEQ ID NO: 2065234 - RNA, 14 nt, Human
cauucacccagaca

SEQ ID NO: 2065235 - RNA, 21 nt, Human
cauucaauaagcaucaaacuc

SEQ ID NO: 2065236 - RNA, 16 nt, Human
cauucaauacaagugu

SEQ ID NO: 2065237 - RNA, 21 nt, Human
cauuaacaguuuuccaugaaa

SEQ ID NO: 2065238 - RNA, 22 nt, Human
cauuaacaguuuuccaugaaaa

SEQ ID NO: 2065239 - RNA, 16 nt, Human
cauuaacuaaucuauu

SEQ ID NO: 2065240 - RNA, 18 nt, Human
cauuaacuaaucuauugg

SEQ ID NO: 2065241 - RNA, 23 nt, Human
cauuaacaguuuuccaugaaaac

SEQ ID NO: 2065242 - RNA, 16 nt, Human
cauuaagccuuccaca

SEQ ID NO: 2065243 - RNA, 13 nt, Human
cauuaagcaucac

SEQ ID NO: 2065244 - RNA, 15 nt, Human
cauuaagcaucacaa

SEQ ID NO: 2065245 - RNA, 19 nt, Human
cauuaagcaucacaaauga

SEQ ID NO: 2065246 - RNA, 17 nt, Human
cauuaacuuagcaugug

SEQ ID NO: 2065247 - RNA, 13 nt, Human
cauuacagagagg

SEQ ID NO: 2065248 - RNA, 15 nt, Human
cauuacagagaggag

SEQ ID NO: 2065249 - RNA, 18 nt, Human
cauuacagagaggagaaa

SEQ ID NO: 2065250 - RNA, 20 nt, Human
cauuacagagaggagaaaca

SEQ ID NO: 2065251 - RNA, 23 nt, Human
cauuaaaacuuaaccgcaucaga

SEQ ID NO: 2065252 - RNA, 22 nt, Human
cauuacagagaggagaaacaca

SEQ ID NO: 2065253 - RNA, 21 nt, Human
cauuacagagaggagaaacac

SEQ ID NO: 2065254 - RNA, 21 nt, Human
cauuacagugggugccccccu

SEQ ID NO: 2065255 - RNA, 20 nt, Human
cauuacauuccuugauaaug

SEQ ID NO: 2065256 - RNA, 21 nt, Human
cauuacauuccuugauaaugu

SEQ ID NO: 2065257 - RNA, 22 nt, Human
cauuacauuccuugauaauguu

SEQ ID NO: 2065258 - RNA, 16 nt, Human
cauucuggucucucua

SEQ ID NO: 2065259 - RNA, 18 nt, Human
cauucuggucucucuauu

SEQ ID NO: 2065260 - RNA, 12 nt, Human
cauucuggucuc

SEQ ID NO: 2065261 - RNA, 20 nt, Human
cauucugcuuucaucuuggu

SEQ ID NO: 2065262 - RNA, 15 nt, Human
cauucuuagccugug

SEQ ID NO: 2065263 - RNA, 21 nt, Human
cauucuuagccuguggcagua

SEQ ID NO: 2065264 - RNA, 22 nt, Human
cauucuuagccuguggcaguaa

SEQ ID NO: 2065265 - RNA, 20 nt, Human
cauucugccugcccaggccc

SEQ ID NO: 2065266 - RNA, 19 nt, Human
cauucugccugcccaggcc

SEQ ID NO: 2065267 - RNA, 18 nt, Human
cauucugccugcccaggc

SEQ ID NO: 2065268 - RNA, 17 nt, Human
cauucugccugcccagg

SEQ ID NO: 2065269 - RNA, 16 nt, Human
cauucugccugcccag

SEQ ID NO: 2065270 - RNA, 15 nt, Human
cauucugccugccca

SEQ ID NO: 2065271 - RNA, 13 nt, Human
cauucugccugcc

SEQ ID NO: 2065272 - RNA, 12 nt, Human
cauucugccugc

SEQ ID NO: 2065273 - RNA, 16 nt, Human
cauucugaccauuuca

SEQ ID NO: 2065274 - RNA, 17 nt, Human
cauucugaccauuucag

SEQ ID NO: 2065275 - RNA, 22 nt, Human
cauucugccaggcccccaagcc

SEQ ID NO: 2065276 - RNA, 13 nt, Human
cauuccugccugu

SEQ ID NO: 2065277 - RNA, 14 nt, Human
cauuccugccuguc

SEQ ID NO: 2065278 - RNA, 15 nt, Human
cauuccugccugucu

SEQ ID NO: 2065279 - RNA, 16 nt, Human
cauuccugccugucuc

SEQ ID NO: 2065280 - RNA, 15 nt, Human
cauuccuggagcccg

SEQ ID NO: 2065281 - RNA, 16 nt, Human
cauuccuggagcccga

SEQ ID NO: 2065282 - RNA, 17 nt, Human
cauuccuggagcccgag

SEQ ID NO: 2065283 - RNA, 18 nt, Human
cauuccuggagcccgagg

SEQ ID NO: 2065284 - RNA, 19 nt, Human
cauuccugaaagaaacagu

SEQ ID NO: 2065285 - RNA, 13 nt, Human
cauuccugaaaga

SEQ ID NO: 2065286 - RNA, 13 nt, Human
cauuccucaggga

SEQ ID NO: 2065287 - RNA, 16 nt, Human
cauuccucagggacag

SEQ ID NO: 2065288 - RNA, 23 nt, Human
cauuccucagggacagagacacc

SEQ ID NO: 2065289 - RNA, 23 nt, Human
cauucuucuguacgucugacagg

SEQ ID NO: 2065290 - RNA, 17 nt, Human
cauucuugaaagcugug

SEQ ID NO: 2065291 - RNA, 18 nt, Human
cauucuugucacaauaaa

SEQ ID NO: 2065292 - RNA, 19 nt, Human
cauucuugucacaauaaau

SEQ ID NO: 2065293 - RNA, 12 nt, Human
cauucuuugcuu

SEQ ID NO: 2065294 - RNA, 13 nt, Human
cauucuuugcuug

SEQ ID NO: 2065295 - RNA, 15 nt, Human
cauucuuugcuugaa

SEQ ID NO: 2065296 - RNA, 19 nt, Human
cauucuuugcuugaacaca

SEQ ID NO: 2065297 - RNA, 20 nt, Human
cauucuuugcuugaacacag

SEQ ID NO: 2065298 - RNA, 21 nt, Human
cauucuuugcuugaacacagu

SEQ ID NO: 2065299 - RNA, 18 nt, Human
caucugccccucccccaa

SEQ ID NO: 2065300 - RNA, 17 nt, Human
caucuugcucugcugac

SEQ ID NO: 2065301 - RNA, 16 nt, Human
caucuugcucugcuga

SEQ ID NO: 2065302 - RNA, 15 nt, Human
caucuugcucugcug

SEQ ID NO: 2065303 - RNA, 19 nt, Human
caucuugcucugcugacag

SEQ ID NO: 2065304 - RNA, 23 nt, Human
caucuuucuucuauuuuauuccc

SEQ ID NO: 2065305 - RNA, 20 nt, Human
caucucucccuccccugcca

SEQ ID NO: 2065306 - RNA, 23 nt, Human
caucucucccuccccugccauuu

SEQ ID NO: 2065307 - RNA, 21 nt, Human
caucucucuacuccuaccuca

SEQ ID NO: 2065308 - RNA, 22 nt, Human
caucucucuacuccuaccucag

SEQ ID NO: 2065309 - RNA, 22 nt, Human
caucucuacuaaaaauacaaac

SEQ ID NO: 2065310 - RNA, 12 nt, Human
caucucucccuc

SEQ ID NO: 2065311 - RNA, 15 nt, Human
caucucucccucccc

SEQ ID NO: 2065312 - RNA, 16 nt, Human
caucucucccuccccu

SEQ ID NO: 2065313 - RNA, 18 nt, Human
caucucugaacuucagcu

SEQ ID NO: 2065314 - RNA, 23 nt, Human
caucucucuacuccuaccucagc

SEQ ID NO: 2065315 - RNA, 14 nt, Human
caucucucuuuaau

SEQ ID NO: 2065316 - RNA, 14 nt, Human
caucugacacaaaa

SEQ ID NO: 2065317 - RNA, 15 nt, Human
caucugacacaaaaa

SEQ ID NO: 2065318 - RNA, 16 nt, Human
caucugacacaaaaaa

SEQ ID NO: 2065319 - RNA, 15 nt, Human
caucugaagagcaga

SEQ ID NO: 2065320 - RNA, 12 nt, Human
caucugaaagcc

SEQ ID NO: 2065321 - RNA, 13 nt, Human
caucugaaagcca

SEQ ID NO: 2065322 - RNA, 16 nt, Human
caucugaaagccacgu

SEQ ID NO: 2065323 - RNA, 14 nt, Human
caucugaaagccac

SEQ ID NO: 2065324 - RNA, 22 nt, Human
caucuccugaggaucagaaagu

SEQ ID NO: 2065325 - RNA, 23 nt, Human
caucugcacccucgaugaagccc

SEQ ID NO: 2065326 - RNA, 19 nt, Human
caucugcauuuucacccca

SEQ ID NO: 2065327 - RNA, 20 nt, Human
caucugcauuuucaccccac

SEQ ID NO: 2065328 - RNA, 11 nt, Human
caucugccccu

SEQ ID NO: 2065329 - RNA, 13 nt, Human
caucugccccucc

SEQ ID NO: 2065330 - RNA, 14 nt, Human
caucugccccuccc

SEQ ID NO: 2065331 - RNA, 15 nt, Human
caucugccccucccc

SEQ ID NO: 2065332 - RNA, 16 nt, Human
caucugccccuccccc

SEQ ID NO: 2065333 - RNA, 17 nt, Human
caucugccccuccccca

SEQ ID NO: 2065334 - RNA, 21 nt, Human
cauccuaccacaaugcagugc

SEQ ID NO: 2065335 - RNA, 23 nt, Human
cauccggaggagaagaaggaaau

SEQ ID NO: 2065336 - RNA, 15 nt, Human
cauccggcagccugg

SEQ ID NO: 2065337 - RNA, 16 nt, Human
cauccggcagccugga

SEQ ID NO: 2065338 - RNA, 20 nt, Human
caucuccuccauacucagga

SEQ ID NO: 2065339 - RNA, 22 nt, Human
caucucccucgaacccacacug

SEQ ID NO: 2065340 - RNA, 23 nt, Human
caucucccucgaacccacacugc

SEQ ID NO: 2065341 - RNA, 24 nt, Human
caucucccucgaacccacacugca

SEQ ID NO: 2065342 - RNA, 23 nt, Human
cauccuaccacaaugcagugccu

SEQ ID NO: 2065343 - RNA, 20 nt, Human
caucuccugugcauggguga

SEQ ID NO: 2065344 - RNA, 21 nt, Human
caucucgccaccccuccuucc

SEQ ID NO: 2065345 - RNA, 22 nt, Human
caucucgccaccccuccuuccu

SEQ ID NO: 2065346 - RNA, 13 nt, Human
caucuccugugca

SEQ ID NO: 2065347 - RNA, 15 nt, Human
caucuccugugcaug

SEQ ID NO: 2065348 - RNA, 19 nt, Human
caucuccugugcaugggug

SEQ ID NO: 2065349 - RNA, 16 nt, Human
caucucuacaaaaagc

SEQ ID NO: 2065350 - RNA, 14 nt, Human
caugauaugucagg

SEQ ID NO: 2065351 - RNA, 15 nt, Human
caugaguuugcccug

SEQ ID NO: 2065352 - RNA, 16 nt, Human
caugaguuugcccugg

SEQ ID NO: 2065353 - RNA, 22 nt, Human
caugaguuugcccugguuucac

SEQ ID NO: 2065354 - RNA, 19 nt, Human
caugaguuuuuucucuugg

SEQ ID NO: 2065355 - RNA, 22 nt, Human
caugaguuuuuucucuugggcu

SEQ ID NO: 2065356 - RNA, 21 nt, Human
caugaucuugugacauauuau

SEQ ID NO: 2065357 - RNA, 15 nt, Human
caugaugagcuccuc

SEQ ID NO: 2065358 - RNA, 18 nt, Human
caugaugagcuccucuuc

SEQ ID NO: 2065359 - RNA, 19 nt, Human
caugaugagcuccucuucc

SEQ ID NO: 2065360 - RNA, 15 nt, Human
caugaucucccugcc

SEQ ID NO: 2065361 - RNA, 13 nt, Human
caugauccugagu

SEQ ID NO: 2065362 - RNA, 13 nt, Human
caugaucucccug

SEQ ID NO: 2065363 - RNA, 16 nt, Human
caugaucucccugccg

SEQ ID NO: 2065364 - RNA, 17 nt, Human
caugaucucccugccgc

SEQ ID NO: 2065365 - RNA, 18 nt, Human
caugaucucccugccgcc

SEQ ID NO: 2065366 - RNA, 19 nt, Human
caugaucucccugccgccu

SEQ ID NO: 2065367 - RNA, 20 nt, Human
caugaucucccugccgccuc

SEQ ID NO: 2065368 - RNA, 21 nt, Human
caugaucucccugccgccuca

SEQ ID NO: 2065369 - RNA, 20 nt, Human
caugaggggcccgagcagaa

SEQ ID NO: 2065370 - RNA, 21 nt, Human
caugaggccucaguggacuuu

SEQ ID NO: 2065371 - RNA, 24 nt, Human
caugaggcaaugucaggaacagaa

SEQ ID NO: 2065372 - RNA, 16 nt, Human
caugaggaguugcugu

SEQ ID NO: 2065373 - RNA, 15 nt, Human
caugaggaguugcug

SEQ ID NO: 2065374 - RNA, 22 nt, Human
caugaggcaaugucaggaacag

SEQ ID NO: 2065375 - RNA, 23 nt, Human
caugaggcaaugucaggaacaga

SEQ ID NO: 2065376 - RNA, 17 nt, Human
caugagggaucacaggg

SEQ ID NO: 2065377 - RNA, 18 nt, Human
caugagggaucacagggc

SEQ ID NO: 2065378 - RNA, 16 nt, Human
caugaggggcccgagc

SEQ ID NO: 2065379 - RNA, 19 nt, Human
caugagggaucacagggcc

SEQ ID NO: 2065380 - RNA, 20 nt, Human
caugagggaucacagggccc

SEQ ID NO: 2065381 - RNA, 20 nt, Human
caugaggacaugauggagcg

SEQ ID NO: 2065382 - RNA, 21 nt, Human
caugaggacaugauggagcgc

SEQ ID NO: 2065383 - RNA, 22 nt, Human
caugaggacaugauggagcgca

SEQ ID NO: 2065384 - RNA, 14 nt, Human
caugaggaggcaga

SEQ ID NO: 2065385 - RNA, 23 nt, Human
caugagccucagcauccuggcac

SEQ ID NO: 2065386 - RNA, 22 nt, Human
caugagccucagcauccuggca

SEQ ID NO: 2065387 - RNA, 13 nt, Human
caugagcuccaga

SEQ ID NO: 2065388 - RNA, 14 nt, Human
caugagcuccagac

SEQ ID NO: 2065389 - RNA, 15 nt, Human
caugagcuccagacc

SEQ ID NO: 2065390 - RNA, 16 nt, Human
caugagcuccagaccc

SEQ ID NO: 2065391 - RNA, 17 nt, Human
caugagcuccagacccc

SEQ ID NO: 2065392 - RNA, 19 nt, Human
caugagcuccagaccccca

SEQ ID NO: 2065393 - RNA, 21 nt, Human
caugagcuccagacccccagc

SEQ ID NO: 2065394 - RNA, 23 nt, Human
caugagcuccagacccccagcaa

SEQ ID NO: 2065395 - RNA, 23 nt, Human
caugagagaauuguaucauuuga

SEQ ID NO: 2065396 - RNA, 20 nt, Human
caugagaucuaggugaggau

SEQ ID NO: 2065397 - RNA, 14 nt, Human
caugagacacaucu

SEQ ID NO: 2065398 - RNA, 19 nt, Human
caugagacacaucuccucc

SEQ ID NO: 2065399 - RNA, 12 nt, Human
caugagaacaga

SEQ ID NO: 2065400 - RNA, 15 nt, Human
caugagaacagacug

SEQ ID NO: 2065401 - RNA, 20 nt, Human
caugagaacagacuggccug

SEQ ID NO: 2065402 - RNA, 23 nt, Human
caugagaacagacuggccugagg

SEQ ID NO: 2065403 - RNA, 22 nt, Human
caugacuugagaaacaaauaau

SEQ ID NO: 2065404 - RNA, 20 nt, Human
caugacucguauaugucuca

SEQ ID NO: 2065405 - RNA, 19 nt, Human
caugacgacaaagcugcua

SEQ ID NO: 2065406 - RNA, 23 nt, Human
caugacgacaaagcugcuaaauc

SEQ ID NO: 2065407 - RNA, 13 nt, Human
caugacugcauuu

SEQ ID NO: 2065408 - RNA, 16 nt, Human
caugacugcauuuuac

SEQ ID NO: 2065409 - RNA, 23 nt, Human
caugacugcauuuuacuguacag

SEQ ID NO: 2065410 - RNA, 23 nt, Human
caugacucguauaugucucaggu

SEQ ID NO: 2065411 - RNA, 14 nt, Human
caugaccugugacc

SEQ ID NO: 2065412 - RNA, 16 nt, Human
caugaccugugaccag

SEQ ID NO: 2065413 - RNA, 17 nt, Human
caugaccugugaccagc

SEQ ID NO: 2065414 - RNA, 18 nt, Human
caugaccugugaccagca

SEQ ID NO: 2065415 - RNA, 17 nt, Human
caugaagccacagccca

SEQ ID NO: 2065416 - RNA, 21 nt, Human
caugaagccacagcccaggcc

SEQ ID NO: 2065417 - RNA, 22 nt, Human
caugaagccacagcccaggccu

SEQ ID NO: 2065418 - RNA, 24 nt, Human
caugaagccacagcccaggccucc

SEQ ID NO: 2065419 - RNA, 21 nt, Human
caugagccucagcauccuggc

SEQ ID NO: 2065420 - RNA, 20 nt, Human
caugagccucagcauccugg

SEQ ID NO: 2065421 - RNA, 19 nt, Human
caugagccucagcauccug

SEQ ID NO: 2065422 - RNA, 18 nt, Human
caugagccucagcauccu

SEQ ID NO: 2065423 - RNA, 17 nt, Human
caugagccucagcaucc

SEQ ID NO: 2065424 - RNA, 15 nt, Human
caugagccucagcau

SEQ ID NO: 2065425 - RNA, 12 nt, Human
caugagccucag

SEQ ID NO: 2065426 - RNA, 15 nt, Human
caugaaauaugcauc

SEQ ID NO: 2065427 - RNA, 14 nt, Human
caugaaauaugcau

SEQ ID NO: 2065428 - RNA, 13 nt, Human
caugaaauaugca

SEQ ID NO: 2065429 - RNA, 19 nt, Human
caugaacacaucagcuagc

SEQ ID NO: 2065430 - RNA, 24 nt, Human
caugaaauugucuagcagagcagg

SEQ ID NO: 2065431 - RNA, 14 nt, Human
caugaagacaggac

SEQ ID NO: 2065432 - RNA, 15 nt, Human
caugaagacaggaca

SEQ ID NO: 2065433 - RNA, 16 nt, Human
caugaagacaggacag

SEQ ID NO: 2065434 - RNA, 17 nt, Human
caugaagacaggacagu

SEQ ID NO: 2065435 - RNA, 21 nt, Human
caugaaaacguuuuauugugu

SEQ ID NO: 2065436 - RNA, 22 nt, Human
caugaaaacguuuuauuguguu

SEQ ID NO: 2065437 - RNA, 23 nt, Human
caugaaaaagcagcuaccaggug

SEQ ID NO: 2065438 - RNA, 16 nt, Human
caugaaaacguuuuau

SEQ ID NO: 2065439 - RNA, 17 nt, Human
caugaaaacguuuuauu

SEQ ID NO: 2065440 - RNA, 19 nt, Human
caugaaaacguuuuauugu

SEQ ID NO: 2065441 - RNA, 12 nt, Human
caugaaaaagca

SEQ ID NO: 2065442 - RNA, 13 nt, Human
caugaaaaagcag

SEQ ID NO: 2065443 - RNA, 15 nt, Human
caugaaaaagcagcu

SEQ ID NO: 2065444 - RNA, 18 nt, Human
caugaaaaagcagcuacc

SEQ ID NO: 2065445 - RNA, 19 nt, Human
caugaaaaagcagcuacca

SEQ ID NO: 2065446 - RNA, 21 nt, Human
caugaaaaccauuaccugacu

SEQ ID NO: 2065447 - RNA, 22 nt, Human
caugaaaaccauuaccugacuu

SEQ ID NO: 2065448 - RNA, 13 nt, Human
caugaaaacguuu

SEQ ID NO: 2065449 - RNA, 16 nt, Human
caugaaaauccuacca

SEQ ID NO: 2065450 - RNA, 21 nt, Human
caugaaaauccuaccaaccuc

SEQ ID NO: 2065451 - RNA, 22 nt, Human
caugaaaauccuaccaaccucu

SEQ ID NO: 2065452 - RNA, 13 nt, Human
caugaaaaugcaa

SEQ ID NO: 2065453 - RNA, 15 nt, Human
caugaaaaugcaaca

SEQ ID NO: 2065454 - RNA, 22 nt, Human
caugaaaaugcaacaacaugua

SEQ ID NO: 2065455 - RNA, 13 nt, Human
caugaaacaaagc

SEQ ID NO: 2065456 - RNA, 13 nt, Human
caucuuuuacauu

SEQ ID NO: 2065457 - RNA, 16 nt, Human
caucuuucuucuauuu

SEQ ID NO: 2065458 - RNA, 21 nt, Human
caucuuucuucuauuuuauuc

SEQ ID NO: 2065459 - RNA, 15 nt, Human
caucuuugccuuggg

SEQ ID NO: 2065460 - RNA, 17 nt, Human
caucuuugccuugggcu

SEQ ID NO: 2065461 - RNA, 22 nt, Human
caucuuugccuugggcugcucc

SEQ ID NO: 2065462 - RNA, 23 nt, Human
caucuuugccuugggcugcuccu

SEQ ID NO: 2065463 - RNA, 12 nt, Human
caucuuucacau

SEQ ID NO: 2065464 - RNA, 13 nt, Human
caucuuucacauu

SEQ ID NO: 2065465 - RNA, 14 nt, Human
caucuuucacacuu

SEQ ID NO: 2065466 - RNA, 18 nt, Human
cauaguauuccauugugu

SEQ ID NO: 2065467 - RNA, 17 nt, Human
cauaguauauuaaaaau

SEQ ID NO: 2065468 - RNA, 19 nt, Human
cauaguauauuaaaaaugg

SEQ ID NO: 2065469 - RNA, 23 nt, Human
cauaguauauuaaaaaugguaaa

SEQ ID NO: 2065470 - RNA, 21 nt, Human
cauaguauuccauugugugag

SEQ ID NO: 2065471 - RNA, 13 nt, Human
cauagucccagcu

SEQ ID NO: 2065472 - RNA, 17 nt, Human
cauaguaugguggcugg

SEQ ID NO: 2065473 - RNA, 16 nt, Human
cauaguaugguggcug

SEQ ID NO: 2065474 - RNA, 15 nt, Human
cauaguaugguggcu

SEQ ID NO: 2065475 - RNA, 21 nt, Human
cauaguacucuuuguagcaaa

SEQ ID NO: 2065476 - RNA, 23 nt, Human
cagugcugaccagacagccuccc

SEQ ID NO: 2065477 - RNA, 15 nt, Human
cagugcuguacuuga

SEQ ID NO: 2065478 - RNA, 12 nt, Human
cagugcuguggc

SEQ ID NO: 2065479 - RNA, 13 nt, Human
cagugcuguggcc

SEQ ID NO: 2065480 - RNA, 15 nt, Human
cagugcuguggccug

SEQ ID NO: 2065481 - RNA, 18 nt, Human
cagugcuguggccugggc

SEQ ID NO: 2065482 - RNA, 20 nt, Human
cagugcuguggccugggcaa

SEQ ID NO: 2065483 - RNA, 19 nt, Human
cagugcuugauugcgugga

SEQ ID NO: 2065484 - RNA, 20 nt, Human
cagugcuugaguuuggggaa

SEQ ID NO: 2065485 - RNA, 17 nt, Human
cagugcuucucuacaga

SEQ ID NO: 2065486 - RNA, 19 nt, Human
cagugcuguggccugggca

SEQ ID NO: 2065487 - RNA, 14 nt, Human
cagugcuucagccu

SEQ ID NO: 2065488 - RNA, 15 nt, Human
cagugcuucagccug

SEQ ID NO: 2065489 - RNA, 16 nt, Human
cagugcuucagccuga

SEQ ID NO: 2065490 - RNA, 17 nt, Human
cagugcuucagccugag

SEQ ID NO: 2065491 - RNA, 18 nt, Human
cagugcuucagccugagg

SEQ ID NO: 2065492 - RNA, 19 nt, Human
cagugcuucagccugaggc

SEQ ID NO: 2065493 - RNA, 20 nt, Human
cagugcuucagccugaggcu

SEQ ID NO: 2065494 - RNA, 20 nt, Human
cauagugagaccccugucuc

SEQ ID NO: 2065495 - RNA, 21 nt, Human
cauagugagaccccugucucc

SEQ ID NO: 2065496 - RNA, 22 nt, Human
cauagugaccggcugcuuuucc

SEQ ID NO: 2065497 - RNA, 18 nt, Human
cauagugaccggcugcuu

SEQ ID NO: 2065498 - RNA, 19 nt, Human
cauagugaugguuccccug

SEQ ID NO: 2065499 - RNA, 18 nt, Human
cauagugaugguuccccu

SEQ ID NO: 2065500 - RNA, 23 nt, Human
cauauaagauucauauuuacuuc

SEQ ID NO: 2065501 - RNA, 22 nt, Human
cauauauggggggccaacacca

SEQ ID NO: 2065502 - RNA, 21 nt, Human
cauauauggggggccaacacc

SEQ ID NO: 2065503 - RNA, 23 nt, Human
cauauauauguuuuaagaggcag

SEQ ID NO: 2065504 - RNA, 11 nt, Human
cauaucuaacc

SEQ ID NO: 2065505 - RNA, 18 nt, Human
cauaucuaaccagugauu

SEQ ID NO: 2065506 - RNA, 17 nt, Human
cauaugaaauuuaauau

SEQ ID NO: 2065507 - RNA, 22 nt, Human
cauauucuguuggccaguguga

SEQ ID NO: 2065508 - RNA, 18 nt, Human
cauaugaaaauacaacuu

SEQ ID NO: 2065509 - RNA, 13 nt, Human
cauaucuaucaga

SEQ ID NO: 2065510 - RNA, 17 nt, Human
cauaucuaucagaguau

SEQ ID NO: 2065511 - RNA, 14 nt, Human
cauauuuguuaaau

SEQ ID NO: 2065512 - RNA, 19 nt, Human
cauauuuguuaaauauuua

SEQ ID NO: 2065513 - RNA, 20 nt, Human
cauauuuguuaaauauuuac

SEQ ID NO: 2065514 - RNA, 14 nt, Human
cauauuguuauuau

SEQ ID NO: 2065515 - RNA, 19 nt, Human
cauauuugcauauguauga

SEQ ID NO: 2065516 - RNA, 15 nt, Human
cauauuugcauaugu

SEQ ID NO: 2065517 - RNA, 17 nt, Human
cauauuugcauauguau

SEQ ID NO: 2065518 - RNA, 21 nt, Human
cauauuuguuaaauauuuaca

SEQ ID NO: 2065519 - RNA, 14 nt, Human
caucaacaucuugg

SEQ ID NO: 2065520 - RNA, 23 nt, Human
cauccagucucccaacuuguauu

SEQ ID NO: 2065521 - RNA, 22 nt, Human
cauccacucuacccucccaccc

SEQ ID NO: 2065522 - RNA, 18 nt, Human
cauccacucuacccuccc

SEQ ID NO: 2065523 - RNA, 19 nt, Human
cauccacucuacccuccca

SEQ ID NO: 2065524 - RNA, 17 nt, Human
cauccagguucagcuug

SEQ ID NO: 2065525 - RNA, 23 nt, Human
cauccacugugccaugugccagg

SEQ ID NO: 2065526 - RNA, 17 nt, Human
cauccacugugccaugu

SEQ ID NO: 2065527 - RNA, 14 nt, Human
cauccacugugcca

SEQ ID NO: 2065528 - RNA, 17 nt, Human
cauccacucuacccucc

SEQ ID NO: 2065529 - RNA, 17 nt, Human
caucauuccuugagaaa

SEQ ID NO: 2065530 - RNA, 22 nt, Human
caucauuccuugagaaaaacaa

SEQ ID NO: 2065531 - RNA, 21 nt, Human
caucauuauuugcagagacag

SEQ ID NO: 2065532 - RNA, 17 nt, Human
caucauuauaaacguga

SEQ ID NO: 2065533 - RNA, 15 nt, Human
caucauuaaauuuuu

SEQ ID NO: 2065534 - RNA, 13 nt, Human
cauccgaggcagg

SEQ ID NO: 2065535 - RNA, 14 nt, Human
cauccgaggcaggg

SEQ ID NO: 2065536 - RNA, 15 nt, Human
cauccgaggcagggu

SEQ ID NO: 2065537 - RNA, 23 nt, Human
cauccgaggcagggucaggagag

SEQ ID NO: 2065538 - RNA, 16 nt, Human
cauccgaggcaggguc

SEQ ID NO: 2065539 - RNA, 22 nt, Human
cauccgaggcagggucaggaga

SEQ ID NO: 2065540 - RNA, 19 nt, Human
caucccugaggcuggacuc

SEQ ID NO: 2065541 - RNA, 22 nt, Human
caucccugaggcuggacuccag

SEQ ID NO: 2065542 - RNA, 19 nt, Human
caucccugauuccuguugu

SEQ ID NO: 2065543 - RNA, 15 nt, Human
caucccugccagcuc

SEQ ID NO: 2065544 - RNA, 21 nt, Human
caucccugccagcucuucugc

SEQ ID NO: 2065545 - RNA, 16 nt, Human
caucaguggcauggcu

SEQ ID NO: 2065546 - RNA, 18 nt, Human
caucaguggcauggcucc

SEQ ID NO: 2065547 - RNA, 22 nt, Human
caucaguggcauggcuccaguc

SEQ ID NO: 2065548 - RNA, 15 nt, Human
caucaguguuaaaaa

SEQ ID NO: 2065549 - RNA, 17 nt, Human
caucaguguuaaaaaau

SEQ ID NO: 2065550 - RNA, 18 nt, Human
caucaguguuaaaaaauu

SEQ ID NO: 2065551 - RNA, 22 nt, Human
caucaguguuaaaaaauuuuug

SEQ ID NO: 2065552 - RNA, 22 nt, Human
caucaguuacucugaagggcau

SEQ ID NO: 2065553 - RNA, 12 nt, Human
caucauaaaaua

SEQ ID NO: 2065554 - RNA, 16 nt, Human
caucaccuuaggcagg

SEQ ID NO: 2065555 - RNA, 17 nt, Human
caucaccuuaggcaggg

SEQ ID NO: 2065556 - RNA, 18 nt, Human
caucaccuuaggcaggga

SEQ ID NO: 2065557 - RNA, 19 nt, Human
caucaccuuaggcagggaa

SEQ ID NO: 2065558 - RNA, 20 nt, Human
caucaccuuaggcagggaag

SEQ ID NO: 2065559 - RNA, 22 nt, Human
caucaccuuaggcagggaagug

SEQ ID NO: 2065560 - RNA, 23 nt, Human
caucaccuuaggcagggaagugu

SEQ ID NO: 2065561 - RNA, 14 nt, Human
caucacgccugugc

SEQ ID NO: 2065562 - RNA, 15 nt, Human
caucacgccugugca

SEQ ID NO: 2065563 - RNA, 12 nt, Human
caucaccucagg

SEQ ID NO: 2065564 - RNA, 13 nt, Human
caucaccucaggc

SEQ ID NO: 2065565 - RNA, 15 nt, Human
caucaccucaggcca

SEQ ID NO: 2065566 - RNA, 18 nt, Human
caucaccucaggccaggu

SEQ ID NO: 2065567 - RNA, 15 nt, Human
caucaugucuggcua

SEQ ID NO: 2065568 - RNA, 14 nt, Human
caucaugucuggcu

SEQ ID NO: 2065569 - RNA, 20 nt, Human
caucauguaaauuaccagua

SEQ ID NO: 2065570 - RNA, 13 nt, Human
caucaugucuggc

SEQ ID NO: 2065571 - RNA, 16 nt, Human
caucaugcaucuuacu

SEQ ID NO: 2065572 - RNA, 22 nt, Human
caucauaaaauaaaguauauau

SEQ ID NO: 2065573 - RNA, 23 nt, Human
caucauaaaauaaaguauauaua

SEQ ID NO: 2065574 - RNA, 13 nt, Human
caucauaaaauaa

SEQ ID NO: 2065575 - RNA, 14 nt, Human
caucauaaaauaaa

SEQ ID NO: 2065576 - RNA, 18 nt, Human
caucauaaaauaaaguau

SEQ ID NO: 2065577 - RNA, 20 nt, Human
caucauaaaauaaaguauau

SEQ ID NO: 2065578 - RNA, 16 nt, Human
caucauccuaagcuau

SEQ ID NO: 2065579 - RNA, 13 nt, Human
caucaucuguaga

SEQ ID NO: 2065580 - RNA, 18 nt, Human
caucaucuguagauacua

SEQ ID NO: 2065581 - RNA, 23 nt, Human
caucaugacacucguauaagcau

SEQ ID NO: 2065582 - RNA, 20 nt, Human
cccaaagugguauagaaaug

SEQ ID NO: 2065583 - RNA, 16 nt, Human
cccaaagugcugggau

SEQ ID NO: 2065584 - RNA, 21 nt, Human
cccaaagugguauagaaaugc

SEQ ID NO: 2065585 - RNA, 10 nt, Human
cccaaagugg

SEQ ID NO: 2065586 - RNA, 13 nt, Human
cccaacccugccc

SEQ ID NO: 2065587 - RNA, 14 nt, Human
cccaacccugcccc

SEQ ID NO: 2065588 - RNA, 15 nt, Human
cccaacccugccccu

SEQ ID NO: 2065589 - RNA, 22 nt, Human
cccaaggaggaaaaacagacaa

SEQ ID NO: 2065590 - RNA, 21 nt, Human
cccaaggcaaggggugccugg

SEQ ID NO: 2065591 - RNA, 22 nt, Human
cccaaggcaaggggugccuggg

SEQ ID NO: 2065592 - RNA, 23 nt, Human
cccaaggcaaggggugccuggga

SEQ ID NO: 2065593 - RNA, 17 nt, Human
cccaaggcucugagcaa

SEQ ID NO: 2065594 - RNA, 16 nt, Human
cccaaccuccugaccu

SEQ ID NO: 2065595 - RNA, 14 nt, Human
cccaaggaggaaaa

SEQ ID NO: 2065596 - RNA, 15 nt, Human
cccaaggaggaaaaa

SEQ ID NO: 2065597 - RNA, 16 nt, Human
cccaacccugccccug

SEQ ID NO: 2065598 - RNA, 14 nt, Human
cccaaaucugccua

SEQ ID NO: 2065599 - RNA, 22 nt, Human
cccaaccggggagcccccgccc

SEQ ID NO: 2065600 - RNA, 12 nt, Human
cccaaccucagc

SEQ ID NO: 2065601 - RNA, 13 nt, Human
cccaaccucagca

SEQ ID NO: 2065602 - RNA, 12 nt, Human
ccauuuguaaua

SEQ ID NO: 2065603 - RNA, 13 nt, Human
ccauuuguaauaa

SEQ ID NO: 2065604 - RNA, 15 nt, Human
ccauuuguaauaaag

SEQ ID NO: 2065605 - RNA, 18 nt, Human
ccauuuguaauaaaguau

SEQ ID NO: 2065606 - RNA, 20 nt, Human
ccauuuguaauaaaguauau

SEQ ID NO: 2065607 - RNA, 14 nt, Human
ccauuugugugugu

SEQ ID NO: 2065608 - RNA, 15 nt, Human
cccaaagugcuggga

SEQ ID NO: 2065609 - RNA, 13 nt, Human
cccaaagugcugg

SEQ ID NO: 2065610 - RNA, 21 nt, Human
cccaaaggaagcuuucucugc

SEQ ID NO: 2065611 - RNA, 23 nt, Human
cccaaaggaagcuuucucugcuu

SEQ ID NO: 2065612 - RNA, 21 nt, Human
cccaaaaccacagcccuguca

SEQ ID NO: 2065613 - RNA, 14 nt, Human
cccaaaaccacagc

SEQ ID NO: 2065614 - RNA, 15 nt, Human
cccaaaaccacagcc

SEQ ID NO: 2065615 - RNA, 14 nt, Human
cccaaagccagaca

SEQ ID NO: 2065616 - RNA, 22 nt, Human
ccauucagcccauuucacaccu

SEQ ID NO: 2065617 - RNA, 12 nt, Human
ccauucaggaac

SEQ ID NO: 2065618 - RNA, 15 nt, Human
ccauucaggaaccug

SEQ ID NO: 2065619 - RNA, 17 nt, Human
ccauucaggaaccugga

SEQ ID NO: 2065620 - RNA, 21 nt, Human
ccauucaggaaccuggaccaa

SEQ ID NO: 2065621 - RNA, 11 nt, Human
ccauucaguca

SEQ ID NO: 2065622 - RNA, 14 nt, Human
ccauguuuaagauu

SEQ ID NO: 2065623 - RNA, 15 nt, Human
ccauguuuaagauuu

SEQ ID NO: 2065624 - RNA, 16 nt, Human
ccauguuuaagauuua

SEQ ID NO: 2065625 - RNA, 17 nt, Human
ccauguuuaagauuuaa

SEQ ID NO: 2065626 - RNA, 16 nt, Human
ccauguuugagcucag

SEQ ID NO: 2065627 - RNA, 17 nt, Human
ccauguuugagcucaga

SEQ ID NO: 2065628 - RNA, 21 nt, Human
ccauguuugagcucagacccc

SEQ ID NO: 2065629 - RNA, 13 nt, Human
ccauguuggcuag

SEQ ID NO: 2065630 - RNA, 16 nt, Human
ccauguuggccaggcu

SEQ ID NO: 2065631 - RNA, 17 nt, Human
ccauguuggccaggcug

SEQ ID NO: 2065632 - RNA, 14 nt, Human
ccaucuaccccugg

SEQ ID NO: 2065633 - RNA, 15 nt, Human
ccaucuaccccugga

SEQ ID NO: 2065634 - RNA, 18 nt, Human
ccaucuaccccuggauga

SEQ ID NO: 2065635 - RNA, 19 nt, Human
ccaucugcaccccccuggg

SEQ ID NO: 2065636 - RNA, 20 nt, Human
ccaucugcaccccccugggc

SEQ ID NO: 2065637 - RNA, 19 nt, Human
ccauggcgugucccucucg

SEQ ID NO: 2065638 - RNA, 21 nt, Human
ccauggcgugucccucucgga

SEQ ID NO: 2065639 - RNA, 21 nt, Human
ccaugggaaaugucaacaagu

SEQ ID NO: 2065640 - RNA, 20 nt, Human
ccauggcuaaggcaccagcc

SEQ ID NO: 2065641 - RNA, 16 nt, Human
ccaucgguccugucuc

SEQ ID NO: 2065642 - RNA, 18 nt, Human
ccaucgguccugucuccc

SEQ ID NO: 2065643 - RNA, 20 nt, Human
ccaucgguccugucuccccu

SEQ ID NO: 2065644 - RNA, 22 nt, Human
ccaucgguguccauuuauagaa

SEQ ID NO: 2065645 - RNA, 14 nt, Human
ccauccuccccuuc

SEQ ID NO: 2065646 - RNA, 13 nt, Human
ccauccuccccuu

SEQ ID NO: 2065647 - RNA, 19 nt, Human
ccauauucuguuggccagu

SEQ ID NO: 2065648 - RNA, 14 nt, Human
ccagggagaggcca

SEQ ID NO: 2065649 - RNA, 17 nt, Human
ccagggagaggccauga

SEQ ID NO: 2065650 - RNA, 21 nt, Human
ccaggcugugggccucaagga

SEQ ID NO: 2065651 - RNA, 22 nt, Human
ccaggcugugggccucaaggac

SEQ ID NO: 2065652 - RNA, 17 nt, Human
ccaggcugugggccuca

SEQ ID NO: 2065653 - RNA, 14 nt, Human
ccaggguuccccca

SEQ ID NO: 2065654 - RNA, 15 nt, Human
ccaggguucccccag

SEQ ID NO: 2065655 - RNA, 20 nt, Human
ccaggguucccccagcccug

SEQ ID NO: 2065656 - RNA, 21 nt, Human
ccaggguucccccagcccugu

SEQ ID NO: 2065657 - RNA, 22 nt, Human
ccaggguucccccagcccugug

SEQ ID NO: 2065658 - RNA, 18 nt, Human
ccagggccaugaacuuug

SEQ ID NO: 2065659 - RNA, 21 nt, Human
ccagggccacucugccucugc

SEQ ID NO: 2065660 - RNA, 14 nt, Human
ccagggccagggcc

SEQ ID NO: 2065661 - RNA, 16 nt, Human
ccagggccagggcccu

SEQ ID NO: 2065662 - RNA, 17 nt, Human
ccagggccagggcccug

SEQ ID NO: 2065663 - RNA, 20 nt, Human
ccagucuggaaugcaguggu

SEQ ID NO: 2065664 - RNA, 19 nt, Human
ccagucuggaaugcagugg

SEQ ID NO: 2065665 - RNA, 16 nt, Human
ccagucugcugcccuc

SEQ ID NO: 2065666 - RNA, 17 nt, Human
ccagucugcugcccucc

SEQ ID NO: 2065667 - RNA, 18 nt, Human
ccagucugcugcccucca

SEQ ID NO: 2065668 - RNA, 22 nt, Human
ccagucugcugcccuccauccc

SEQ ID NO: 2065669 - RNA, 23 nt, Human
ccagucugcugcccuccaucccg

SEQ ID NO: 2065670 - RNA, 18 nt, Human
ccagucuggaaugcagug

SEQ ID NO: 2065671 - RNA, 12 nt, Human
ccagucugaagu

SEQ ID NO: 2065672 - RNA, 14 nt, Human
ccagucugaaguuu

SEQ ID NO: 2065673 - RNA, 17 nt, Human
ccagucugaaguuucau

SEQ ID NO: 2065674 - RNA, 20 nt, Human
ccagucugaaguuucauuua

SEQ ID NO: 2065675 - RNA, 21 nt, Human
ccagucugaaguuucauuuau

SEQ ID NO: 2065676 - RNA, 12 nt, Human
ccagucucuucu

SEQ ID NO: 2065677 - RNA, 17 nt, Human
ccagguuuuuggucuga

SEQ ID NO: 2065678 - RNA, 16 nt, Human
ccagguugaaagaccu

SEQ ID NO: 2065679 - RNA, 15 nt, Human
ccagguucagcuugu

SEQ ID NO: 2065680 - RNA, 15 nt, Human
ccaggccccaggaag

SEQ ID NO: 2065681 - RNA, 21 nt, Human
ccagguucugguuagcucagc

SEQ ID NO: 2065682 - RNA, 22 nt, Human
ccagguucugguuagcucagcc

SEQ ID NO: 2065683 - RNA, 23 nt, Human
ccagguucugguuagcucagccc

SEQ ID NO: 2065684 - RNA, 13 nt, Human
ccagguugaaaga

SEQ ID NO: 2065685 - RNA, 24 nt, Human
ccaggcuguaucccaugagccuca

SEQ ID NO: 2065686 - RNA, 18 nt, Human
ccaggccguggcugccca

SEQ ID NO: 2065687 - RNA, 18 nt, Human
ccaggcgccccuuccccc

SEQ ID NO: 2065688 - RNA, 19 nt, Human
ccaggcgccccuucccccu

SEQ ID NO: 2065689 - RNA, 15 nt, Human
ccaggccgccccagc

SEQ ID NO: 2065690 - RNA, 16 nt, Human
ccaggccgccccagcc

SEQ ID NO: 2065691 - RNA, 18 nt, Human
ccaggccgccccagccuc

SEQ ID NO: 2065692 - RNA, 22 nt, Human
ccaggccggugugggcuguguc

SEQ ID NO: 2065693 - RNA, 14 nt, Human
ccaggccguggcug

SEQ ID NO: 2065694 - RNA, 16 nt, Human
ccaggccguggcugcc

SEQ ID NO: 2065695 - RNA, 20 nt, Human
ccaggccccaaaaccacagc

SEQ ID NO: 2065696 - RNA, 21 nt, Human
ccaggccccaaaaccacagcc

SEQ ID NO: 2065697 - RNA, 21 nt, Human
ccaggccgccccagccucuga

SEQ ID NO: 2065698 - RNA, 14 nt, Human
ccaggccaucagag

SEQ ID NO: 2065699 - RNA, 20 nt, Human
ccaggagccccgaggccuuc

SEQ ID NO: 2065700 - RNA, 23 nt, Human
ccaggagagccagcccucccugu

SEQ ID NO: 2065701 - RNA, 20 nt, Human
ccaggagagccagcccuccc

SEQ ID NO: 2065702 - RNA, 19 nt, Human
ccaggagccccgaggccuu

SEQ ID NO: 2065703 - RNA, 16 nt, Human
ccaggagccccgaggc

SEQ ID NO: 2065704 - RNA, 16 nt, Human
ccaggagacagacaga

SEQ ID NO: 2065705 - RNA, 13 nt, Human
ccaggagagccag

SEQ ID NO: 2065706 - RNA, 16 nt, Human
ccaggagagccagccc

SEQ ID NO: 2065707 - RNA, 17 nt, Human
ccaggagagccagcccu

SEQ ID NO: 2065708 - RNA, 18 nt, Human
ccaggagagccagcccuc

SEQ ID NO: 2065709 - RNA, 19 nt, Human
ccaggagagccagcccucc

SEQ ID NO: 2065710 - RNA, 21 nt, Human
ccaggagcugggcagaaggcc

SEQ ID NO: 2065711 - RNA, 16 nt, Human
ccaggagcugggcaga

SEQ ID NO: 2065712 - RNA, 13 nt, Human
ccaggagcucuuc

SEQ ID NO: 2065713 - RNA, 18 nt, Human
ccaggagcucuucaggcc

SEQ ID NO: 2065714 - RNA, 21 nt, Human
ccaggagcucuucaggccucc

SEQ ID NO: 2065715 - RNA, 23 nt, Human
ccaggagcucuucaggccucccu

SEQ ID NO: 2065716 - RNA, 23 nt, Human
ccaggagcugggcagaaggccaa

SEQ ID NO: 2065717 - RNA, 16 nt, Human
ccagccuccaugcugc

SEQ ID NO: 2065718 - RNA, 15 nt, Human
ccagccuccaugcug

SEQ ID NO: 2065719 - RNA, 19 nt, Human
ccagccuccguauuucaga

SEQ ID NO: 2065720 - RNA, 19 nt, Human
ccaguuaaucuugcuuucu

SEQ ID NO: 2065721 - RNA, 17 nt, Human
ccaguuaaucuugcuuu

SEQ ID NO: 2065722 - RNA, 17 nt, Human
ccaguguccuccccuca

SEQ ID NO: 2065723 - RNA, 22 nt, Human
ccaguuagccucugcaggaugu

SEQ ID NO: 2065724 - RNA, 17 nt, Human
ccaguuagccucugcag

SEQ ID NO: 2065725 - RNA, 15 nt, Human
ccauaguauauuaaa

SEQ ID NO: 2065726 - RNA, 17 nt, Human
ccauaguauauuaaaaa

SEQ ID NO: 2065727 - RNA, 20 nt, Human
ccauaguauauuaaaaaugg

SEQ ID NO: 2065728 - RNA, 22 nt, Human
ccauaguauauuaaaaauggua

SEQ ID NO: 2065729 - RNA, 23 nt, Human
ccauauucuguuggccaguguga

SEQ ID NO: 2065730 - RNA, 15 nt, Human
ccauagcuuccauga

SEQ ID NO: 2065731 - RNA, 23 nt, Human
ccaguguguggcuuucagagccu

SEQ ID NO: 2065732 - RNA, 22 nt, Human
ccaguguguggcuuucagagcc

SEQ ID NO: 2065733 - RNA, 21 nt, Human
ccaguguguggcuuucagagc

SEQ ID NO: 2065734 - RNA, 19 nt, Human
ccaguguuuuaggagcaug

SEQ ID NO: 2065735 - RNA, 15 nt, Human
ccaguguuguuugua

SEQ ID NO: 2065736 - RNA, 17 nt, Human
ccaguguuguuuguaaa

SEQ ID NO: 2065737 - RNA, 18 nt, Human
ccaguguuguuuguaaau

SEQ ID NO: 2065738 - RNA, 20 nt, Human
ccaguguuguuuguaaauaa

SEQ ID NO: 2065739 - RNA, 21 nt, Human
ccaguguuguuuguaaauaag

SEQ ID NO: 2065740 - RNA, 22 nt, Human
ccaguguuguuuguaaauaaga

SEQ ID NO: 2065741 - RNA, 23 nt, Human
ccaguguuguuuguaaauaagag

SEQ ID NO: 2065742 - RNA, 15 nt, Human
ccagugcccuggggc

SEQ ID NO: 2065743 - RNA, 22 nt, Human
ccagugcccuggggcugaucuc

SEQ ID NO: 2065744 - RNA, 14 nt, Human
ccaguguagccuug

SEQ ID NO: 2065745 - RNA, 15 nt, Human
ccaguguagccuugc

SEQ ID NO: 2065746 - RNA, 18 nt, Human
ccaguguguggcuuucag

SEQ ID NO: 2065747 - RNA, 16 nt, Human
ccaguguguggcuuuc

SEQ ID NO: 2065748 - RNA, 20 nt, Human
ccagugccgagaaggaagcc

SEQ ID NO: 2065749 - RNA, 13 nt, Human
ccaucuacccucc

SEQ ID NO: 2065750 - RNA, 19 nt, Human
ccagccucaucucuuuguu

SEQ ID NO: 2065751 - RNA, 21 nt, Human
ccagccuccaagcuccaucuc

SEQ ID NO: 2065752 - RNA, 14 nt, Human
ccagccgccaugcu

SEQ ID NO: 2065753 - RNA, 20 nt, Human
ccagcccuuugggaggcuga

SEQ ID NO: 2065754 - RNA, 18 nt, Human
ccagccgccaugcuccug

SEQ ID NO: 2065755 - RNA, 19 nt, Human
ccagccgccaugcuccugg

SEQ ID NO: 2065756 - RNA, 17 nt, Human
ccagccccacccaggag

SEQ ID NO: 2065757 - RNA, 18 nt, Human
ccagccccacccaggagg

SEQ ID NO: 2065758 - RNA, 15 nt, Human
ccagccccagugccc

SEQ ID NO: 2065759 - RNA, 13 nt, Human
ccagccccagugc

SEQ ID NO: 2065760 - RNA, 19 nt, Human
ccagccagugaccugagga

SEQ ID NO: 2065761 - RNA, 20 nt, Human
ccagccagugaccugaggaa

SEQ ID NO: 2065762 - RNA, 22 nt, Human
ccagccagugaccugaggaagc

SEQ ID NO: 2065763 - RNA, 23 nt, Human
ccagccagugaccugaggaagcg

SEQ ID NO: 2065764 - RNA, 14 nt, Human
ccagccccacccag

SEQ ID NO: 2065765 - RNA, 15 nt, Human
ccagccccacccagg

SEQ ID NO: 2065766 - RNA, 16 nt, Human
ccagccccacccagga

SEQ ID NO: 2065767 - RNA, 16 nt, Human
ccagcccuugaaguca

SEQ ID NO: 2065768 - RNA, 20 nt, Human
ccagcccuugagcuccccaa

SEQ ID NO: 2065769 - RNA, 13 nt, Human
ccagcccuguucu

SEQ ID NO: 2065770 - RNA, 15 nt, Human
ccagcccuguggaag

SEQ ID NO: 2065771 - RNA, 18 nt, Human
ccagcccuguggaaggga

SEQ ID NO: 2065772 - RNA, 17 nt, Human
ccagcccuuagcaggga

SEQ ID NO: 2065773 - RNA, 21 nt, Human
ccagcccucccuguccuccuc

SEQ ID NO: 2065774 - RNA, 22 nt, Human
ccagcccucccuguccuccucg

SEQ ID NO: 2065775 - RNA, 20 nt, Human
ccagcccucucacugugucc

SEQ ID NO: 2065776 - RNA, 14 nt, Human
ccagcccuguggaa

SEQ ID NO: 2065777 - RNA, 16 nt, Human
ccagcccuuagcaggg

SEQ ID NO: 2065778 - RNA, 16 nt, Human
ccagccccagugccca

SEQ ID NO: 2065779 - RNA, 13 nt, Human
ccagcccucccug

SEQ ID NO: 2065780 - RNA, 14 nt, Human
ccagcccucccugu

SEQ ID NO: 2065781 - RNA, 15 nt, Human
ccagcccucccuguc

SEQ ID NO: 2065782 - RNA, 16 nt, Human
ccagcccucccugucc

SEQ ID NO: 2065783 - RNA, 17 nt, Human
ccagcccucccuguccu

SEQ ID NO: 2065784 - RNA, 18 nt, Human
ccagcccucccuguccuc

SEQ ID NO: 2065785 - RNA, 19 nt, Human
ccagcccucccuguccucc

SEQ ID NO: 2065786 - RNA, 20 nt, Human
ccagcccucccuguccuccu

SEQ ID NO: 2065787 - RNA, 21 nt, Human
ccagccaccccgggcucucug

SEQ ID NO: 2065788 - RNA, 22 nt, Human
ccagccaccccgggcucucugc

SEQ ID NO: 2065789 - RNA, 13 nt, Human
ccagccagcagcc

SEQ ID NO: 2065790 - RNA, 15 nt, Human
ccagccagcagccag

SEQ ID NO: 2065791 - RNA, 16 nt, Human
ccagccagcagccagc

SEQ ID NO: 2065792 - RNA, 19 nt, Human
ccagccagcagccagcucu

SEQ ID NO: 2065793 - RNA, 23 nt, Human
ccagccagcagccagcucucagc

SEQ ID NO: 2065794 - RNA, 15 nt, Human
ccagccaaagccucc

SEQ ID NO: 2065795 - RNA, 18 nt, Human
ccagccaaagccuccucc

SEQ ID NO: 2065796 - RNA, 19 nt, Human
ccagccaaagccuccucca

SEQ ID NO: 2065797 - RNA, 13 nt, Human
ccagccaccccgg

SEQ ID NO: 2065798 - RNA, 19 nt, Human
ccagccaaccccuguggag

SEQ ID NO: 2065799 - RNA, 22 nt, Human
ccagccaacuuuugcauguuuu

SEQ ID NO: 2065800 - RNA, 17 nt, Human
ccagccaaacccugucu

SEQ ID NO: 2065801 - RNA, 18 nt, Human
ccagccaaacccugucug

SEQ ID NO: 2065802 - RNA, 19 nt, Human
ccagccaaacccugucuga

SEQ ID NO: 2065803 - RNA, 13 nt, Human
ccagccaaccccu

SEQ ID NO: 2065804 - RNA, 18 nt, Human
ccagccaaccccugugga

SEQ ID NO: 2065805 - RNA, 15 nt, Human
ccagcaguuugggag

SEQ ID NO: 2065806 - RNA, 21 nt, Human
ccagcauccuuuucugcagag

SEQ ID NO: 2065807 - RNA, 19 nt, Human
ccagcauccuuuucugcag

SEQ ID NO: 2065808 - RNA, 15 nt, Human
ccagcagguggggag

SEQ ID NO: 2065809 - RNA, 24 nt, Human
ccagcacuaaagcaguggacacca

SEQ ID NO: 2065810 - RNA, 12 nt, Human
ccagcacuaacg

SEQ ID NO: 2065811 - RNA, 15 nt, Human
ccagcacugucucag

SEQ ID NO: 2065812 - RNA, 15 nt, Human
ccagcaagugagagc

SEQ ID NO: 2065813 - RNA, 18 nt, Human
ccagcaacuugucuuuuu

SEQ ID NO: 2065814 - RNA, 16 nt, Human
ccagcaagguggagug

SEQ ID NO: 2065815 - RNA, 18 nt, Human
ccagcaagguggagugga

SEQ ID NO: 2065816 - RNA, 21 nt, Human
ccagcaacuugucuuuuucug

SEQ ID NO: 2065817 - RNA, 15 nt, Human
ccagcaacuccaacu

SEQ ID NO: 2065818 - RNA, 18 nt, Human
ccagcacuaaagcagugg

SEQ ID NO: 2065819 - RNA, 22 nt, Human
ccagcaagugagagcugggugu

SEQ ID NO: 2065820 - RNA, 21 nt, Human
ccagcaagugagagcugggug

SEQ ID NO: 2065821 - RNA, 20 nt, Human
ccagcaagugagagcugggu

SEQ ID NO: 2065822 - RNA, 16 nt, Human
ccagcaagugagagcu

SEQ ID NO: 2065823 - RNA, 17 nt, Human
ccagaggcagaacccug

SEQ ID NO: 2065824 - RNA, 18 nt, Human
ccagaggcagaacccugg

SEQ ID NO: 2065825 - RNA, 13 nt, Human
ccagaggcacagc

SEQ ID NO: 2065826 - RNA, 14 nt, Human
ccagaggcacagcc

SEQ ID NO: 2065827 - RNA, 15 nt, Human
ccagaggcacagccg

SEQ ID NO: 2065828 - RNA, 17 nt, Human
ccagaggcacagccggg

SEQ ID NO: 2065829 - RNA, 21 nt, Human
ccagaggcacagccggggccu

SEQ ID NO: 2065830 - RNA, 21 nt, Human
ccagagggagugacagaggca

SEQ ID NO: 2065831 - RNA, 20 nt, Human
ccagagggagugacagaggc

SEQ ID NO: 2065832 - RNA, 19 nt, Human
ccagagggagugacagagg

SEQ ID NO: 2065833 - RNA, 18 nt, Human
ccagagggagugacagag

SEQ ID NO: 2065834 - RNA, 17 nt, Human
ccagagggagugacaga

SEQ ID NO: 2065835 - RNA, 16 nt, Human
ccagagggagugacag

SEQ ID NO: 2065836 - RNA, 14 nt, Human
ccagagcuggguga

SEQ ID NO: 2065837 - RNA, 15 nt, Human
ccagagcugggugag

SEQ ID NO: 2065838 - RNA, 20 nt, Human
ccagagcugggugagugggg

SEQ ID NO: 2065839 - RNA, 21 nt, Human
ccagagcugggugagugggga

SEQ ID NO: 2065840 - RNA, 19 nt, Human
ccagagcuguuuauggccu

SEQ ID NO: 2065841 - RNA, 20 nt, Human
ccagagcuguuuauggccuc

SEQ ID NO: 2065842 - RNA, 21 nt, Human
ccagagcuguuuauggccuca

SEQ ID NO: 2065843 - RNA, 22 nt, Human
ccagagcuguuuauggccucag

SEQ ID NO: 2065844 - RNA, 23 nt, Human
ccagagcuguuuauggccucagc

SEQ ID NO: 2065845 - RNA, 24 nt, Human
ccagagcuguuuauggccucagcu

SEQ ID NO: 2065846 - RNA, 12 nt, Human
ccagagcuccuc

SEQ ID NO: 2065847 - RNA, 15 nt, Human
ccagagcuccuccuu

SEQ ID NO: 2065848 - RNA, 12 nt, Human
ccagagcucugg

SEQ ID NO: 2065849 - RNA, 13 nt, Human
ccagagcucugga

SEQ ID NO: 2065850 - RNA, 16 nt, Human
ccagagcucuggagcc

SEQ ID NO: 2065851 - RNA, 21 nt, Human
ccagagcucuggagccaccug

SEQ ID NO: 2065852 - RNA, 22 nt, Human
ccagagcucuggagccaccugu

SEQ ID NO: 2065853 - RNA, 22 nt, Human
ccagacccccagcaacccuccu

SEQ ID NO: 2065854 - RNA, 17 nt, Human
ccagaccccucuggcca

SEQ ID NO: 2065855 - RNA, 14 nt, Human
ccagagaugccucc

SEQ ID NO: 2065856 - RNA, 15 nt, Human
ccagagaugccucca

SEQ ID NO: 2065857 - RNA, 16 nt, Human
ccagagaugccuccac

SEQ ID NO: 2065858 - RNA, 17 nt, Human
ccagagaugccuccacc

SEQ ID NO: 2065859 - RNA, 18 nt, Human
ccagagaugccuccaccg

SEQ ID NO: 2065860 - RNA, 20 nt, Human
ccagagaugccuccaccgcu

SEQ ID NO: 2065861 - RNA, 23 nt, Human
ccagagaugccuccaccgcugcc

SEQ ID NO: 2065862 - RNA, 22 nt, Human
ccagagauggagguucucucgg

SEQ ID NO: 2065863 - RNA, 16 nt, Human
ccagagaugggacugg

SEQ ID NO: 2065864 - RNA, 21 nt, Human
ccagagaugggacugggaggg

SEQ ID NO: 2065865 - RNA, 22 nt, Human
ccagagaugggacugggagggc

SEQ ID NO: 2065866 - RNA, 11 nt, Human
ccagagcacug

SEQ ID NO: 2065867 - RNA, 23 nt, Human
ccagagaugggacugggagggcc

SEQ ID NO: 2065868 - RNA, 18 nt, Human
ccagagcaaagggccagg

SEQ ID NO: 2065869 - RNA, 16 nt, Human
ccagagcaagcuuuuu

SEQ ID NO: 2065870 - RNA, 20 nt, Human
ccagagcaagcuuuuuuauu

SEQ ID NO: 2065871 - RNA, 11 nt, Human
ccacuggggaa

SEQ ID NO: 2065872 - RNA, 22 nt, Human
ccacuggggaaauaacagcugu

SEQ ID NO: 2065873 - RNA, 19 nt, Human
ccagacaccuugacagggc

SEQ ID NO: 2065874 - RNA, 17 nt, Human
ccagacaccuugacagg

SEQ ID NO: 2065875 - RNA, 12 nt, Human
ccacuggggaaa

SEQ ID NO: 2065876 - RNA, 18 nt, Human
ccacuguaaaaugaaauu

SEQ ID NO: 2065877 - RNA, 14 nt, Human
ccagagaggguggu

SEQ ID NO: 2065878 - RNA, 18 nt, Human
ccagaccccucuggccag

SEQ ID NO: 2065879 - RNA, 23 nt, Human
ccagagaggguggugaccucugc

SEQ ID NO: 2065880 - RNA, 21 nt, Human
ccagagaggguggugaccucu

SEQ ID NO: 2065881 - RNA, 20 nt, Human
ccagacaccuugacagggca

SEQ ID NO: 2065882 - RNA, 18 nt, Human
ccagaccauugucucaga

SEQ ID NO: 2065883 - RNA, 12 nt, Human
ccagacccccac

SEQ ID NO: 2065884 - RNA, 21 nt, Human
ccagaccauugucucagagca

SEQ ID NO: 2065885 - RNA, 14 nt, Human
ccagacccccaccc

SEQ ID NO: 2065886 - RNA, 15 nt, Human
ccagacccccacccc

SEQ ID NO: 2065887 - RNA, 16 nt, Human
ccagacccccaccccu

SEQ ID NO: 2065888 - RNA, 19 nt, Human
ccagacccccaccccuucc

SEQ ID NO: 2065889 - RNA, 21 nt, Human
ccagacccccaccccuucccc

SEQ ID NO: 2065890 - RNA, 22 nt, Human
ccagacccccaccccuucccca

SEQ ID NO: 2065891 - RNA, 14 nt, Human
ccagacccccagca

SEQ ID NO: 2065892 - RNA, 19 nt, Human
ccagacccccagcaacccu

SEQ ID NO: 2065893 - RNA, 23 nt, Human
ccagagggagugacagaggcagc

SEQ ID NO: 2065894 - RNA, 22 nt, Human
ccagagggagugacagaggcag

SEQ ID NO: 2065895 - RNA, 13 nt, Human
ccagagggcccag

SEQ ID NO: 2065896 - RNA, 15 nt, Human
ccagagggcccaggc

SEQ ID NO: 2065897 - RNA, 17 nt, Human
ccagagggcccaggcag

SEQ ID NO: 2065898 - RNA, 23 nt, Human
ccagaugcaccagcccuuagcag

SEQ ID NO: 2065899 - RNA, 18 nt, Human
ccagagggcccaggcagg

SEQ ID NO: 2065900 - RNA, 18 nt, Human
ccagaugccuucuccaga

SEQ ID NO: 2065901 - RNA, 20 nt, Human
ccagauugcaacaggcuggg

SEQ ID NO: 2065902 - RNA, 19 nt, Human
ccagauugcaacaggcugg

SEQ ID NO: 2065903 - RNA, 21 nt, Human
ccagauugcaacaggcugggc

SEQ ID NO: 2065904 - RNA, 16 nt, Human
ccacaccucccugaac

SEQ ID NO: 2065905 - RNA, 17 nt, Human
ccacaccucccugaacc

SEQ ID NO: 2065906 - RNA, 22 nt, Human
ccacaccucaguucccuuggcc

SEQ ID NO: 2065907 - RNA, 14 nt, Human
ccacaccucccuga

SEQ ID NO: 2065908 - RNA, 14 nt, Human
ccacacccagccca

SEQ ID NO: 2065909 - RNA, 13 nt, Human
ccacacccagccc

SEQ ID NO: 2065910 - RNA, 14 nt, Human
ccacaccgcagaag

SEQ ID NO: 2065911 - RNA, 15 nt, Human
ccacaccgcagaagc

SEQ ID NO: 2065912 - RNA, 18 nt, Human
ccacaccucaguucccuu

SEQ ID NO: 2065913 - RNA, 19 nt, Human
ccacaccucaguucccuug

SEQ ID NO: 2065914 - RNA, 12 nt, Human
ccacacccagcc

SEQ ID NO: 2065915 - RNA, 13 nt, Human
ccacacaccccaa

SEQ ID NO: 2065916 - RNA, 12 nt, Human
ccacacacagag

SEQ ID NO: 2065917 - RNA, 16 nt, Human
ccacacacagaggaag

SEQ ID NO: 2065918 - RNA, 17 nt, Human
ccacacacagaggaaga

SEQ ID NO: 2065919 - RNA, 18 nt, Human
ccacacacagaggaagag

SEQ ID NO: 2065920 - RNA, 22 nt, Human
ccacacacagaggaagagcagg

SEQ ID NO: 2065921 - RNA, 12 nt, Human
ccacacacccca

SEQ ID NO: 2065922 - RNA, 14 nt, Human
ccaaacccugucug

SEQ ID NO: 2065923 - RNA, 15 nt, Human
ccaaaccccggggcu

SEQ ID NO: 2065924 - RNA, 16 nt, Human
ccaaacccaugaggca

SEQ ID NO: 2065925 - RNA, 23 nt, Human
ccacaucuugcucugcugacaga

SEQ ID NO: 2065926 - RNA, 22 nt, Human
ccacaucuugcucugcugacag

SEQ ID NO: 2065927 - RNA, 16 nt, Human
ccacaucuugcucugc

SEQ ID NO: 2065928 - RNA, 14 nt, Human
ccacaucuugcucu

SEQ ID NO: 2065929 - RNA, 23 nt, Human
ccacauagugaugguuccccugu

SEQ ID NO: 2065930 - RNA, 14 nt, Human
ccacacugcaacag

SEQ ID NO: 2065931 - RNA, 22 nt, Human
ccacauagugaugguuccccug

SEQ ID NO: 2065932 - RNA, 21 nt, Human
ccacauagugaugguuccccu

SEQ ID NO: 2065933 - RNA, 19 nt, Human
ccacauagugaugguuccc

SEQ ID NO: 2065934 - RNA, 23 nt, Human
ccacacugcuaggugggccagcc

SEQ ID NO: 2065935 - RNA, 13 nt, Human
ccacccaccucag

SEQ ID NO: 2065936 - RNA, 15 nt, Human
ccacccaccucagcc

SEQ ID NO: 2065937 - RNA, 14 nt, Human
ccacccaccucagc

SEQ ID NO: 2065938 - RNA, 16 nt, Human
ccacccaccucagccu

SEQ ID NO: 2065939 - RNA, 15 nt, Human
ccacccaccagggcg

SEQ ID NO: 2065940 - RNA, 16 nt, Human
ccaccacacccagccc

SEQ ID NO: 2065941 - RNA, 14 nt, Human
ccaccacacccagc

SEQ ID NO: 2065942 - RNA, 20 nt, Human
ccacggaaaaugccaaucuc

SEQ ID NO: 2065943 - RNA, 14 nt, Human
ccacgcugucucca

SEQ ID NO: 2065944 - RNA, 15 nt, Human
ccacgcugucuccag

SEQ ID NO: 2065945 - RNA, 18 nt, Human
ccacgcugucuccagacc

SEQ ID NO: 2065946 - RNA, 19 nt, Human
ccacgcugucuccagaccc

SEQ ID NO: 2065947 - RNA, 21 nt, Human
ccacgcugucuccagaccccc

SEQ ID NO: 2065948 - RNA, 20 nt, Human
ccacgcugucuccagacccc

SEQ ID NO: 2065949 - RNA, 23 nt, Human
ccaccugcccccuucucccacac

SEQ ID NO: 2065950 - RNA, 21 nt, Human
ccaccugcccccuucucccac

SEQ ID NO: 2065951 - RNA, 22 nt, Human
ccaccugcccccuucucccaca

SEQ ID NO: 2065952 - RNA, 17 nt, Human
ccacgucugucuucaca

SEQ ID NO: 2065953 - RNA, 15 nt, Human
ccacggccaggccag

SEQ ID NO: 2065954 - RNA, 20 nt, Human
ccacgucugcuaacuuggag

SEQ ID NO: 2065955 - RNA, 17 nt, Human
ccacgugacagugccug

SEQ ID NO: 2065956 - RNA, 14 nt, Human
ccacgugccaggcc

SEQ ID NO: 2065957 - RNA, 15 nt, Human
ccacgugccaggccc

SEQ ID NO: 2065958 - RNA, 16 nt, Human
ccacgugccaggcccg

SEQ ID NO: 2065959 - RNA, 23 nt, Human
ccacgugccaggcccggggcugg

SEQ ID NO: 2065960 - RNA, 14 nt, Human
ccacguucaccccu

SEQ ID NO: 2065961 - RNA, 15 nt, Human
ccacguucaccccuc

SEQ ID NO: 2065962 - RNA, 17 nt, Human
ccacguucaccccucca

SEQ ID NO: 2065963 - RNA, 14 nt, Human
ccacggccaggcca

SEQ ID NO: 2065964 - RNA, 13 nt, Human
ccacggccaggcc

SEQ ID NO: 2065965 - RNA, 12 nt, Human
ccacggccaggc

SEQ ID NO: 2065966 - RNA, 20 nt, Human
ccaccugcccaucacagggu

SEQ ID NO: 2065967 - RNA, 23 nt, Human
ccaccugcccaucacaggguugg

SEQ ID NO: 2065968 - RNA, 14 nt, Human
ccaccugccacuag

SEQ ID NO: 2065969 - RNA, 20 nt, Human
ccaccugccacuaggcuggg

SEQ ID NO: 2065970 - RNA, 23 nt, Human
ccaccugccacuaggcugggugc

SEQ ID NO: 2065971 - RNA, 12 nt, Human
ccaccugccccc

SEQ ID NO: 2065972 - RNA, 18 nt, Human
ccaccugcccccuucucc

SEQ ID NO: 2065973 - RNA, 20 nt, Human
ccaccugcccccuucuccca

SEQ ID NO: 2065974 - RNA, 14 nt, Human
ccaccugcccaacc

SEQ ID NO: 2065975 - RNA, 14 nt, Human
ccaccugcccauca

SEQ ID NO: 2065976 - RNA, 15 nt, Human
ccaccugcccaucac

SEQ ID NO: 2065977 - RNA, 16 nt, Human
ccaccugcccaucaca

SEQ ID NO: 2065978 - RNA, 12 nt, Human
ccaccugagcuu

SEQ ID NO: 2065979 - RNA, 20 nt, Human
ccaccugagcuuuggacaca

SEQ ID NO: 2065980 - RNA, 22 nt, Human
ccaccugagcuuuggacgcaca

SEQ ID NO: 2065981 - RNA, 19 nt, Human
ccaccuccccuauccaccc

SEQ ID NO: 2065982 - RNA, 22 nt, Human
ccaccuccccuauccacccagc

SEQ ID NO: 2065983 - RNA, 17 nt, Human
ccaccuccccuauccac

SEQ ID NO: 2065984 - RNA, 15 nt, Human
ccaccuccccagccu

SEQ ID NO: 2065985 - RNA, 13 nt, Human
ccaccuccccagg

SEQ ID NO: 2065986 - RNA, 16 nt, Human
ccaccuccccaggccg

SEQ ID NO: 2065987 - RNA, 23 nt, Human
ccaccuccccaggccguggcugc

SEQ ID NO: 2065988 - RNA, 17 nt, Human
ccaccucccacaaagga

SEQ ID NO: 2065989 - RNA, 16 nt, Human
ccaccucagccuugga

SEQ ID NO: 2065990 - RNA, 14 nt, Human
ccacccaggagccc

SEQ ID NO: 2065991 - RNA, 20 nt, Human
ccacccccuucucugcucca

SEQ ID NO: 2065992 - RNA, 23 nt, Human
ccacccccuucucugcuccacca

SEQ ID NO: 2065993 - RNA, 12 nt, Human
ccacccaggagc

SEQ ID NO: 2065994 - RNA, 11 nt, Human
ccacccagccc

SEQ ID NO: 2065995 - RNA, 12 nt, Human
ccacccagccca

SEQ ID NO: 2065996 - RNA, 13 nt, Human
ccacccagcccau

SEQ ID NO: 2065997 - RNA, 22 nt, Human
ccacccagcccauucucucucc

SEQ ID NO: 2065998 - RNA, 15 nt, Human
ccaccucagccuccc

SEQ ID NO: 2065999 - RNA, 16 nt, Human
ccaccucagccuccug

SEQ ID NO: 2066000 - RNA, 14 nt, Human
ccaccucagccuug

SEQ ID NO: 2066001 - RNA, 15 nt, Human
ccaccucagccuugg

SEQ ID NO: 2066002 - RNA, 14 nt, Human
ccaccucagccucc

SEQ ID NO: 2066003 - RNA, 13 nt, Human
ccaccucagccuc

SEQ ID NO: 2066004 - RNA, 12 nt, Human
ccaccucagccu

SEQ ID NO: 2066005 - RNA, 18 nt, Human
ccacccugaaagcccuga

SEQ ID NO: 2066006 - RNA, 16 nt, Human
ccacccugaaagcccu

SEQ ID NO: 2066007 - RNA, 17 nt, Human
ccacccugaaagcccug

SEQ ID NO: 2066008 - RNA, 15 nt, Human
ccacccguggagaug

SEQ ID NO: 2066009 - RNA, 19 nt, Human
ccaccccucaacaccucug

SEQ ID NO: 2066010 - RNA, 14 nt, Human
ccaccccgggcucu

SEQ ID NO: 2066011 - RNA, 17 nt, Human
ccaccccgggcucucug

SEQ ID NO: 2066012 - RNA, 18 nt, Human
ccaccccgggcucucugc

SEQ ID NO: 2066013 - RNA, 20 nt, Human
ccaccccgggcucucugcug

SEQ ID NO: 2066014 - RNA, 15 nt, Human
ccacccucccagcuc

SEQ ID NO: 2066015 - RNA, 11 nt, Human
ccacugccucu

SEQ ID NO: 2066016 - RNA, 16 nt, Human
ccacuggacuugagcu

SEQ ID NO: 2066017 - RNA, 20 nt, Human
ccacugcacuccagccuggc

SEQ ID NO: 2066018 - RNA, 22 nt, Human
ccacuggacuugagcuuggcag

SEQ ID NO: 2066019 - RNA, 20 nt, Human
ccacuggacuugagcuuggc

SEQ ID NO: 2066020 - RNA, 21 nt, Human
ccacuggacuugagcuuggca

SEQ ID NO: 2066021 - RNA, 11 nt, Human
ccacuggcugu

SEQ ID NO: 2066022 - RNA, 14 nt, Human
ccacuggcuguggg

SEQ ID NO: 2066023 - RNA, 15 nt, Human
ccacuggcugugggc

SEQ ID NO: 2066024 - RNA, 16 nt, Human
ccacuggcugugggcu

SEQ ID NO: 2066025 - RNA, 17 nt, Human
ccacuggcugugggcuc

SEQ ID NO: 2066026 - RNA, 18 nt, Human
ccacuggcugugggcucc

SEQ ID NO: 2066027 - RNA, 19 nt, Human
ccacuggcugugggcuccc

SEQ ID NO: 2066028 - RNA, 20 nt, Human
ccacuggcugugggcucccu

SEQ ID NO: 2066029 - RNA, 21 nt, Human
ccacuggcugugggcucccuu

SEQ ID NO: 2066030 - RNA, 22 nt, Human
ccacuggcugugggcucccuuc

SEQ ID NO: 2066031 - RNA, 17 nt, Human
ccacuggaucagaaaga

SEQ ID NO: 2066032 - RNA, 21 nt, Human
ccacugcacuccagccugggc

SEQ ID NO: 2066033 - RNA, 15 nt, Human
ccacugcccgagcug

SEQ ID NO: 2066034 - RNA, 16 nt, Human
ccacugcccgagcugg

SEQ ID NO: 2066035 - RNA, 17 nt, Human
ccacugcccgagcuggu

SEQ ID NO: 2066036 - RNA, 18 nt, Human
ccacugcccgagcuggug

SEQ ID NO: 2066037 - RNA, 20 nt, Human
ccacugcccgagcuggugca

SEQ ID NO: 2066038 - RNA, 22 nt, Human
ccacugcccgagcuggugcauu

SEQ ID NO: 2066039 - RNA, 23 nt, Human
ccacugcccgagcuggugcauua

SEQ ID NO: 2066040 - RNA, 13 nt, Human
ccacugcccucug

SEQ ID NO: 2066041 - RNA, 14 nt, Human
ccacugcccucugu

SEQ ID NO: 2066042 - RNA, 16 nt, Human
ccacugcccuucucau

SEQ ID NO: 2066043 - RNA, 17 nt, Human
ccacugcccuucucauu

SEQ ID NO: 2066044 - RNA, 18 nt, Human
ccacugcacuccagccug

SEQ ID NO: 2066045 - RNA, 19 nt, Human
ccacugcacuccagccugg

SEQ ID NO: 2066046 - RNA, 20 nt, Human
ccacugcacuccagccuggg

SEQ ID NO: 2066047 - RNA, 22 nt, Human
ccacuacggaauaguuggcuag

SEQ ID NO: 2066048 - RNA, 23 nt, Human
ccacuacggaauaguuggcuagg

SEQ ID NO: 2066049 - RNA, 12 nt, Human
ccacucaagcca

SEQ ID NO: 2066050 - RNA, 16 nt, Human
ccacucaagccaagca

SEQ ID NO: 2066051 - RNA, 17 nt, Human
ccacucaagccaagcag

SEQ ID NO: 2066052 - RNA, 20 nt, Human
ccacucacaacagcugccug

SEQ ID NO: 2066053 - RNA, 14 nt, Human
ccacucacaacagc

SEQ ID NO: 2066054 - RNA, 21 nt, Human
ccacuagaacucuccaucuua

SEQ ID NO: 2066055 - RNA, 18 nt, Human
ccacucaagccaagcagc

SEQ ID NO: 2066056 - RNA, 19 nt, Human
ccacuccagaccccuggcu

SEQ ID NO: 2066057 - RNA, 17 nt, Human
ccacuccagaccccugg

SEQ ID NO: 2066058 - RNA, 14 nt, Human
ccacguucucucug

SEQ ID NO: 2066059 - RNA, 23 nt, Human
ccacguucucucugccugugagc

SEQ ID NO: 2066060 - RNA, 22 nt, Human
ccacuaaaagaucgcaguuugc

SEQ ID NO: 2066061 - RNA, 15 nt, Human
ccacguuccuuacug

SEQ ID NO: 2066062 - RNA, 20 nt, Human
ccacguuccuuacugcagaa

SEQ ID NO: 2066063 - RNA, 21 nt, Human
ccacguuccuuacugcagaau

SEQ ID NO: 2066064 - RNA, 14 nt, Human
ccuuagaaguggaa

SEQ ID NO: 2066065 - RNA, 18 nt, Human
ccuuagaagucacacagu

SEQ ID NO: 2066066 - RNA, 12 nt, Human
ccuuacugcaga

SEQ ID NO: 2066067 - RNA, 20 nt, Human
ccuuacuuacagcauaaggg

SEQ ID NO: 2066068 - RNA, 14 nt, Human
ccuuacuuagcaug

SEQ ID NO: 2066069 - RNA, 17 nt, Human
ccuuagaagucacacag

SEQ ID NO: 2066070 - RNA, 18 nt, Human
ccuuacaccucguuaggg

SEQ ID NO: 2066071 - RNA, 22 nt, Human
ccuuacaccucguuagggaaga

SEQ ID NO: 2066072 - RNA, 14 nt, Human
ccuuacccaucugc

SEQ ID NO: 2066073 - RNA, 15 nt, Human
ccuuaccccuuagcc

SEQ ID NO: 2066074 - RNA, 16 nt, Human
ccuuaccccuuagccu

SEQ ID NO: 2066075 - RNA, 14 nt, Human
ccuuaaaagccauc

SEQ ID NO: 2066076 - RNA, 19 nt, Human
ccuuaaaagccaucaugua

SEQ ID NO: 2066077 - RNA, 23 nt, Human
ccuuaaaacuuuaaucccacuug

SEQ ID NO: 2066078 - RNA, 15 nt, Human
ccuuaaacugugugg

SEQ ID NO: 2066079 - RNA, 13 nt, Human
ccuuaaauuaaac

SEQ ID NO: 2066080 - RNA, 18 nt, Human
ccuuaaauuaaacaauuu

SEQ ID NO: 2066081 - RNA, 21 nt, Human
ccuuaaauuaaacaauuuauu

SEQ ID NO: 2066082 - RNA, 16 nt, Human
ccuguuuuuguuaacu

SEQ ID NO: 2066083 - RNA, 17 nt, Human
ccuguuuuuaagcuguu

SEQ ID NO: 2066084 - RNA, 18 nt, Human
ccuguuuuuaagcuguuu

SEQ ID NO: 2066085 - RNA, 19 nt, Human
ccuguuuuuaagcuguuuc

SEQ ID NO: 2066086 - RNA, 14 nt, Human
ccuuaacuggagcc

SEQ ID NO: 2066087 - RNA, 23 nt, Human
ccuuaacuggagccccaucagcu

SEQ ID NO: 2066088 - RNA, 17 nt, Human
ccuuaacuggagcccca

SEQ ID NO: 2066089 - RNA, 19 nt, Human
ccuuaagaacacaaagcgg

SEQ ID NO: 2066090 - RNA, 16 nt, Human
ccuuaaguaucagaaa

SEQ ID NO: 2066091 - RNA, 13 nt, Human
ccuguguuucuag

SEQ ID NO: 2066092 - RNA, 19 nt, Human
ccuguuuuauacuguacuu

SEQ ID NO: 2066093 - RNA, 12 nt, Human
ccuguuucuucc

SEQ ID NO: 2066094 - RNA, 21 nt, Human
ccugguauggguuucucccag

SEQ ID NO: 2066095 - RNA, 9 nt, Human
ccuggugcu

SEQ ID NO: 2066096 - RNA, 13 nt, Human
ccuguguagcugg

SEQ ID NO: 2066097 - RNA, 21 nt, Human
ccugugucuugcaauggcagc

SEQ ID NO: 2066098 - RNA, 19 nt, Human
ccugugucuugcaauggca

SEQ ID NO: 2066099 - RNA, 17 nt, Human
ccugugucuugcaaugg

SEQ ID NO: 2066100 - RNA, 22 nt, Human
ccugugucuugcaauggcagcc

SEQ ID NO: 2066101 - RNA, 21 nt, Human
ccugugugugcgccuacagga

SEQ ID NO: 2066102 - RNA, 20 nt, Human
ccugugugugcgccuacagg

SEQ ID NO: 2066103 - RNA, 19 nt, Human
ccugugugguuuaguguaa

SEQ ID NO: 2066104 - RNA, 20 nt, Human
ccugugugguuuaguguaaa

SEQ ID NO: 2066105 - RNA, 21 nt, Human
ccugugugguuuaguguaaaa

SEQ ID NO: 2066106 - RNA, 22 nt, Human
ccugugugguuuaguguaaaaa

SEQ ID NO: 2066107 - RNA, 21 nt, Human
ccuugaaagucaugaacacau

SEQ ID NO: 2066108 - RNA, 13 nt, Human
ccuugaacacugg

SEQ ID NO: 2066109 - RNA, 19 nt, Human
ccuucuuuccauuucucuc

SEQ ID NO: 2066110 - RNA, 17 nt, Human
ccuugaagaaccucuca

SEQ ID NO: 2066111 - RNA, 18 nt, Human
ccuugaagaaccucucac

SEQ ID NO: 2066112 - RNA, 20 nt, Human
ccuugaacacugggggaggg

SEQ ID NO: 2066113 - RNA, 14 nt, Human
ccuugaacuccugg

SEQ ID NO: 2066114 - RNA, 13 nt, Human
ccuugaagauauc

SEQ ID NO: 2066115 - RNA, 14 nt, Human
ccuugaagccacug

SEQ ID NO: 2066116 - RNA, 19 nt, Human
ccuugaagccacugaagcu

SEQ ID NO: 2066117 - RNA, 22 nt, Human
ccuugaagccacugaagcuggg

SEQ ID NO: 2066118 - RNA, 17 nt, Human
ccuugaagucacccggc

SEQ ID NO: 2066119 - RNA, 23 nt, Human
ccuugaagauaucuugaaaugaa

SEQ ID NO: 2066120 - RNA, 17 nt, Human
ccuugagggcaagagcc

SEQ ID NO: 2066121 - RNA, 20 nt, Human
ccuugacgucaagucuccuu

SEQ ID NO: 2066122 - RNA, 20 nt, Human
ccuugaguugauucagcucu

SEQ ID NO: 2066123 - RNA, 23 nt, Human
ccuugaggucuuuugacaugugg

SEQ ID NO: 2066124 - RNA, 13 nt, Human
ccuugaggucuuu

SEQ ID NO: 2066125 - RNA, 12 nt, Human
ccuugaggucuu

SEQ ID NO: 2066126 - RNA, 21 nt, Human
ccuugagggugcuuguucccu

SEQ ID NO: 2066127 - RNA, 15 nt, Human
ccuucuacacucucc

SEQ ID NO: 2066128 - RNA, 16 nt, Human
ccuucuacacucuccu

SEQ ID NO: 2066129 - RNA, 17 nt, Human
ccuucuacacucuccug

SEQ ID NO: 2066130 - RNA, 18 nt, Human
ccuucuacacucuccugg

SEQ ID NO: 2066131 - RNA, 19 nt, Human
ccuucuacacucuccuggg

SEQ ID NO: 2066132 - RNA, 20 nt, Human
ccuucuacacucuccugggc

SEQ ID NO: 2066133 - RNA, 21 nt, Human
ccuucuacacucuccugggcc

SEQ ID NO: 2066134 - RNA, 22 nt, Human
ccuucuacacucuccugggccc

SEQ ID NO: 2066135 - RNA, 20 nt, Human
ccuucggacaacucaguccc

SEQ ID NO: 2066136 - RNA, 14 nt, Human
ccuucuaggaagcu

SEQ ID NO: 2066137 - RNA, 15 nt, Human
ccuucuacugagccu

SEQ ID NO: 2066138 - RNA, 14 nt, Human
ccuucuacugagcc

SEQ ID NO: 2066139 - RNA, 14 nt, Human
ccuucuacugcuuc

SEQ ID NO: 2066140 - RNA, 22 nt, Human
ccuucuacuuacacaucuucca

SEQ ID NO: 2066141 - RNA, 23 nt, Human
ccuucuacuuacacaucuuccac

SEQ ID NO: 2066142 - RNA, 17 nt, Human
ccuucuuauucucacuc

SEQ ID NO: 2066143 - RNA, 18 nt, Human
ccuucuuauucucacucc

SEQ ID NO: 2066144 - RNA, 21 nt, Human
ccuucuguggcucacagaacc

SEQ ID NO: 2066145 - RNA, 19 nt, Human
ccuucuuauucucacucca

SEQ ID NO: 2066146 - RNA, 20 nt, Human
ccuucuuauucucacuccac

SEQ ID NO: 2066147 - RNA, 22 nt, Human
ccuucuuauucucacuccacca

SEQ ID NO: 2066148 - RNA, 21 nt, Human
ccuucuucggggaacuccugg

SEQ ID NO: 2066149 - RNA, 22 nt, Human
ccuucuucggggaacuccugga

SEQ ID NO: 2066150 - RNA, 14 nt, Human
ccuucuguggcuca

SEQ ID NO: 2066151 - RNA, 13 nt, Human
ccuucugugccca

SEQ ID NO: 2066152 - RNA, 14 nt, Human
ccuucugugcccag

SEQ ID NO: 2066153 - RNA, 15 nt, Human
ccuucugugcccagc

SEQ ID NO: 2066154 - RNA, 16 nt, Human
ccuucugugcccagcu

SEQ ID NO: 2066155 - RNA, 17 nt, Human
ccuucugugcccagcuc

SEQ ID NO: 2066156 - RNA, 18 nt, Human
ccuucugugcccagcuca

SEQ ID NO: 2066157 - RNA, 19 nt, Human
ccuucugugcccagcucag

SEQ ID NO: 2066158 - RNA, 20 nt, Human
ccuucugugcccagcucagu

SEQ ID NO: 2066159 - RNA, 21 nt, Human
ccuucugugcccagcucaguc

SEQ ID NO: 2066160 - RNA, 19 nt, Human
ccuucucucaccuccuaaa

SEQ ID NO: 2066161 - RNA, 17 nt, Human
ccuucucucaccuccua

SEQ ID NO: 2066162 - RNA, 18 nt, Human
ccuucucucaccuccuaa

SEQ ID NO: 2066163 - RNA, 17 nt, Human
ccuucuccuuccaacug

SEQ ID NO: 2066164 - RNA, 18 nt, Human
ccuucuccuuccaacugc

SEQ ID NO: 2066165 - RNA, 19 nt, Human
ccuucuccuuccaacugcu

SEQ ID NO: 2066166 - RNA, 19 nt, Human
ccuucuccuugauaacagc

SEQ ID NO: 2066167 - RNA, 20 nt, Human
ccuucuccuugauaacagcu

SEQ ID NO: 2066168 - RNA, 21 nt, Human
ccuucuccuugauaacagcua

SEQ ID NO: 2066169 - RNA, 16 nt, Human
ccuucucucaccuccu

SEQ ID NO: 2066170 - RNA, 17 nt, Human
ccuuucucccaggccag

SEQ ID NO: 2066171 - RNA, 19 nt, Human
ccuuucgcccacagucuga

SEQ ID NO: 2066172 - RNA, 14 nt, Human
ccuuucucccaggc

SEQ ID NO: 2066173 - RNA, 17 nt, Human
ccuugguucaucagugu

SEQ ID NO: 2066174 - RNA, 22 nt, Human
ccuuguuugauuuuagcugcag

SEQ ID NO: 2066175 - RNA, 19 nt, Human
ccuugggaggccccacugg

SEQ ID NO: 2066176 - RNA, 20 nt, Human
ccuugggaggccccacuggg

SEQ ID NO: 2066177 - RNA, 15 nt, Human
ccuugggaggcccca

SEQ ID NO: 2066178 - RNA, 18 nt, Human
ccuugcaacacacagaca

SEQ ID NO: 2066179 - RNA, 22 nt, Human
ccuugcaacacacagacacacg

SEQ ID NO: 2066180 - RNA, 16 nt, Human
ccuugcaacacacaga

SEQ ID NO: 2066181 - RNA, 17 nt, Human
ccuugcaacacacagac

SEQ ID NO: 2066182 - RNA, 21 nt, Human
ccuugauuuaucacacaaagc

SEQ ID NO: 2066183 - RNA, 14 nt, Human
ccuuggucuaacuu

SEQ ID NO: 2066184 - RNA, 23 nt, Human
ccuuggucuaacuuuugugugaa

SEQ ID NO: 2066185 - RNA, 14 nt, Human
ccuuggggcaggca

SEQ ID NO: 2066186 - RNA, 15 nt, Human
ccuuggggcaggcag

SEQ ID NO: 2066187 - RNA, 16 nt, Human
ccuuggggcaggcagu

SEQ ID NO: 2066188 - RNA, 15 nt, Human
ccuuccuucccuggc

SEQ ID NO: 2066189 - RNA, 16 nt, Human
ccuuccuucccuggcu

SEQ ID NO: 2066190 - RNA, 14 nt, Human
ccuuccuucuugcu

SEQ ID NO: 2066191 - RNA, 16 nt, Human
ccuuccuugaccagca

SEQ ID NO: 2066192 - RNA, 21 nt, Human
ccuuccucuccacugccuucg

SEQ ID NO: 2066193 - RNA, 22 nt, Human
ccuucauuuggcauuccccacu

SEQ ID NO: 2066194 - RNA, 12 nt, Human
ccuucagugccc

SEQ ID NO: 2066195 - RNA, 14 nt, Human
ccuucagugcccac

SEQ ID NO: 2066196 - RNA, 15 nt, Human
ccuucagugcccacc

SEQ ID NO: 2066197 - RNA, 16 nt, Human
ccuucagugcccacca

SEQ ID NO: 2066198 - RNA, 18 nt, Human
ccuucagugcccaccaac

SEQ ID NO: 2066199 - RNA, 16 nt, Human
ccuuccaacaggagcu

SEQ ID NO: 2066200 - RNA, 19 nt, Human
ccuuccaacaggagcuggg

SEQ ID NO: 2066201 - RNA, 16 nt, Human
ccuuccaacugcugcc

SEQ ID NO: 2066202 - RNA, 17 nt, Human
ccuuccaacugcugccc

SEQ ID NO: 2066203 - RNA, 19 nt, Human
ccuuccaacugcugcccca

SEQ ID NO: 2066204 - RNA, 23 nt, Human
ccuuccuugaccagcagauccca

SEQ ID NO: 2066205 - RNA, 20 nt, Human
ccuuccuugcuguccuaggc

SEQ ID NO: 2066206 - RNA, 23 nt, Human
ccuucacuccggugugccugcag

SEQ ID NO: 2066207 - RNA, 20 nt, Human
ccuucacuucugaccacacu

SEQ ID NO: 2066208 - RNA, 22 nt, Human
ccuucacuucugaccacacuuc

SEQ ID NO: 2066209 - RNA, 14 nt, Human
ccuucacuccggug

SEQ ID NO: 2066210 - RNA, 20 nt, Human
ccuucacuccggugugccug

SEQ ID NO: 2066211 - RNA, 12 nt, Human
ccuucacagugu

SEQ ID NO: 2066212 - RNA, 20 nt, Human
ccuucacauccuguguuucu

SEQ ID NO: 2066213 - RNA, 11 nt, Human
ccuucagugcc

SEQ ID NO: 2066214 - RNA, 19 nt, Human
ccuucauuuggcauucccc

SEQ ID NO: 2066215 - RNA, 21 nt, Human
ccuucagcauccucaguuccu

SEQ ID NO: 2066216 - RNA, 11 nt, Human
ccuucagaggc

SEQ ID NO: 2066217 - RNA, 18 nt, Human
ccuucagagguggcucug

SEQ ID NO: 2066218 - RNA, 13 nt, Human
ccuucagauccua

SEQ ID NO: 2066219 - RNA, 14 nt, Human
ccuucagauccuac

SEQ ID NO: 2066220 - RNA, 16 nt, Human
ccuucagauccuaccc

SEQ ID NO: 2066221 - RNA, 20 nt, Human
ccuucagauccuaccccuga

SEQ ID NO: 2066222 - RNA, 22 nt, Human
cgccaggggaaaaucagccugc

SEQ ID NO: 2066223 - RNA, 10 nt, Human
cgcagcccug

SEQ ID NO: 2066224 - RNA, 15 nt, Human
cgcacccccacccuu

SEQ ID NO: 2066225 - RNA, 19 nt, Human
cgcacccccacccuuuggg

SEQ ID NO: 2066226 - RNA, 16 nt, Human
cgagcccugguggcag

SEQ ID NO: 2066227 - RNA, 15 nt, Human
cgagcccugguggca

SEQ ID NO: 2066228 - RNA, 16 nt, Human
cgagcccuacuuccag

SEQ ID NO: 2066229 - RNA, 21 nt, Human
cgauucacccuguccaaacug

SEQ ID NO: 2066230 - RNA, 16 nt, Human
cgauucacccugucca

SEQ ID NO: 2066231 - RNA, 22 nt, Human
cgauguggcccuggccugcugg

SEQ ID NO: 2066232 - RNA, 17 nt, Human
cgauguggcccuggccu

SEQ ID NO: 2066233 - RNA, 18 nt, Human
cgauguggcccuggccug

SEQ ID NO: 2066234 - RNA, 11 nt, Human
cgauguggccc

SEQ ID NO: 2066235 - RNA, 13 nt, Human
cgauguggcccug

SEQ ID NO: 2066236 - RNA, 15 nt, Human
cgauguggcccuggc

SEQ ID NO: 2066237 - RNA, 16 nt, Human
cgauguggcccuggcc

SEQ ID NO: 2066238 - RNA, 14 nt, Human
cgcaccccagagug

SEQ ID NO: 2066239 - RNA, 13 nt, Human
cgcacccccaccc

SEQ ID NO: 2066240 - RNA, 14 nt, Human
cgcacccccacccu

SEQ ID NO: 2066241 - RNA, 20 nt, Human
cgcacacacacacacaggag

SEQ ID NO: 2066242 - RNA, 12 nt, Human
cgcacacagcuu

SEQ ID NO: 2066243 - RNA, 17 nt, Human
cgccaugcuccuggccc

SEQ ID NO: 2066244 - RNA, 19 nt, Human
cgaaagcugggcaacaugc

SEQ ID NO: 2066245 - RNA, 12 nt, Human
cgaacuccuggg

SEQ ID NO: 2066246 - RNA, 16 nt, Human
cgaacuccugggcuca

SEQ ID NO: 2066247 - RNA, 18 nt, Human
cgaagaaggguccuuccc

SEQ ID NO: 2066248 - RNA, 18 nt, Human
cgaagaaaaaaaauaaca

SEQ ID NO: 2066249 - RNA, 19 nt, Human
cgaagaaaaaaaauaacac

SEQ ID NO: 2066250 - RNA, 16 nt, Human
cgaacgacaauagcuu

SEQ ID NO: 2066251 - RNA, 23 nt, Human
cgaacccaccugcugagagaccc

SEQ ID NO: 2066252 - RNA, 16 nt, Human
cgaacccaccugcuga

SEQ ID NO: 2066253 - RNA, 13 nt, Human
cgaaccccaagga

SEQ ID NO: 2066254 - RNA, 14 nt, Human
cgaacuggcugcaa

SEQ ID NO: 2066255 - RNA, 12 nt, Human
cgaacuggcugc

SEQ ID NO: 2066256 - RNA, 19 nt, Human
cgaaagggacuuggaagcu

SEQ ID NO: 2066257 - RNA, 20 nt, Human
cgaaaggaugaaagugacca

SEQ ID NO: 2066258 - RNA, 22 nt, Human
cgaaagggacuuggaagcuccg

SEQ ID NO: 2066259 - RNA, 22 nt, Human
cgaaaggauguaaacagugccu

SEQ ID NO: 2066260 - RNA, 23 nt, Human
cgaaaggauguaaacagugccug

SEQ ID NO: 2066261 - RNA, 14 nt, Human
cgaaccaauauuug

SEQ ID NO: 2066262 - RNA, 18 nt, Human
cgaacccacacugcaaca

SEQ ID NO: 2066263 - RNA, 20 nt, Human
cgaacccacacugcaacagg

SEQ ID NO: 2066264 - RNA, 14 nt, Human
cgaacccaccugcu

SEQ ID NO: 2066265 - RNA, 17 nt, Human
ccuuuuacauacugcug

SEQ ID NO: 2066266 - RNA, 15 nt, Human
ccuuuucacuacacc

SEQ ID NO: 2066267 - RNA, 21 nt, Human
ccuuuuagccuaguucaucca

SEQ ID NO: 2066268 - RNA, 18 nt, Human
ccuuuuacauacugcugu

SEQ ID NO: 2066269 - RNA, 22 nt, Human
cgaaaaucauauaaucuuacaa

SEQ ID NO: 2066270 - RNA, 14 nt, Human
cgaaaccccaucuc

SEQ ID NO: 2066271 - RNA, 13 nt, Human
cgaaacagcgcug

SEQ ID NO: 2066272 - RNA, 13 nt, Human
cgaaacugcucua

SEQ ID NO: 2066273 - RNA, 13 nt, Human
cgaaacuggaagu

SEQ ID NO: 2066274 - RNA, 15 nt, Human
cgaaacuggaaguua

SEQ ID NO: 2066275 - RNA, 16 nt, Human
cgaaacuggaaguuau

SEQ ID NO: 2066276 - RNA, 18 nt, Human
cgaaacuggaaguuauuu

SEQ ID NO: 2066277 - RNA, 13 nt, Human
cgacuuuauuuuc

SEQ ID NO: 2066278 - RNA, 14 nt, Human
cgaauagcugggac

SEQ ID NO: 2066279 - RNA, 13 nt, Human
cgaauagcuggga

SEQ ID NO: 2066280 - RNA, 17 nt, Human
cgacugugaccuguggg

SEQ ID NO: 2066281 - RNA, 19 nt, Human
cgacugugaccugugggga

SEQ ID NO: 2066282 - RNA, 17 nt, Human
cgagaucacgccacugc

SEQ ID NO: 2066283 - RNA, 19 nt, Human
cgagaguagccgagagccu

SEQ ID NO: 2066284 - RNA, 20 nt, Human
cgagaguagccgagagccug

SEQ ID NO: 2066285 - RNA, 14 nt, Human
cgagagucugucuc

SEQ ID NO: 2066286 - RNA, 15 nt, Human
cgagagucugucuca

SEQ ID NO: 2066287 - RNA, 16 nt, Human
cgagaccagccuggcc

SEQ ID NO: 2066288 - RNA, 15 nt, Human
cgagaccagccuggc

SEQ ID NO: 2066289 - RNA, 14 nt, Human
cgagaccagccugg

SEQ ID NO: 2066290 - RNA, 13 nt, Human
cgagaccagccug

SEQ ID NO: 2066291 - RNA, 17 nt, Human
cgagaccaaccugacca

SEQ ID NO: 2066292 - RNA, 13 nt, Human
cgagaagcaagaa

SEQ ID NO: 2066293 - RNA, 15 nt, Human
cgagaagcaagaaag

SEQ ID NO: 2066294 - RNA, 17 nt, Human
cgagaccagccuggcca

SEQ ID NO: 2066295 - RNA, 20 nt, Human
cgagauugcaccacugcacu

SEQ ID NO: 2066296 - RNA, 20 nt, Human
cgagaucacgccacugcacu

SEQ ID NO: 2066297 - RNA, 18 nt, Human
cgagaucacgccacugca

SEQ ID NO: 2066298 - RNA, 16 nt, Human
cgagaucacgccacug

SEQ ID NO: 2066299 - RNA, 15 nt, Human
cgagcaguccugccu

SEQ ID NO: 2066300 - RNA, 17 nt, Human
cgagcaguccugccuca

SEQ ID NO: 2066301 - RNA, 21 nt, Human
cgagcaguccugccucagccu

SEQ ID NO: 2066302 - RNA, 23 nt, Human
cgagcaguccugccucagccucc

SEQ ID NO: 2066303 - RNA, 17 nt, Human
ccuggagagucucacuc

SEQ ID NO: 2066304 - RNA, 21 nt, Human
ccuggaagcuguguccuugca

SEQ ID NO: 2066305 - RNA, 22 nt, Human
ccuggaaggacauccauguucc

SEQ ID NO: 2066306 - RNA, 23 nt, Human
ccuggcacccggccccugcuggu

SEQ ID NO: 2066307 - RNA, 22 nt, Human
ccuggcacuauaauguaagcuc

SEQ ID NO: 2066308 - RNA, 18 nt, Human
ccuggcacgguggcucag

SEQ ID NO: 2066309 - RNA, 22 nt, Human
ccuggcacgguggcucaggccu

SEQ ID NO: 2066310 - RNA, 22 nt, Human
ccuggcacccggccccugcugg

SEQ ID NO: 2066311 - RNA, 17 nt, Human
ccuggcagaacugagcu

SEQ ID NO: 2066312 - RNA, 18 nt, Human
ccuggcagaacugagcuc

SEQ ID NO: 2066313 - RNA, 20 nt, Human
ccuggcagaacugagcuccu

SEQ ID NO: 2066314 - RNA, 23 nt, Human
ccuggcagaacugagcuccucug

SEQ ID NO: 2066315 - RNA, 22 nt, Human
ccuggcagccgugccuucagcu

SEQ ID NO: 2066316 - RNA, 21 nt, Human
ccuggcagccgugccuucagc

SEQ ID NO: 2066317 - RNA, 17 nt, Human
ccuggcaggaugacccu

SEQ ID NO: 2066318 - RNA, 15 nt, Human
ccuggccagaugcac

SEQ ID NO: 2066319 - RNA, 12 nt, Human
ccuggccagagg

SEQ ID NO: 2066320 - RNA, 13 nt, Human
ccuggccagaggc

SEQ ID NO: 2066321 - RNA, 14 nt, Human
ccuggccagaggcu

SEQ ID NO: 2066322 - RNA, 17 nt, Human
ccuggcucccacaggcc

SEQ ID NO: 2066323 - RNA, 23 nt, Human
ccuggcucccacaggcccuuccu

SEQ ID NO: 2066324 - RNA, 21 nt, Human
ccuggucacaggacucugccu

SEQ ID NO: 2066325 - RNA, 23 nt, Human
ccuggucacaggacucugccucc

SEQ ID NO: 2066326 - RNA, 22 nt, Human
ccuggucacaggacucugccuc

SEQ ID NO: 2066327 - RNA, 20 nt, Human
ccuggugaggaagcuccagu

SEQ ID NO: 2066328 - RNA, 21 nt, Human
ccuggugaggaagcuccaguc

SEQ ID NO: 2066329 - RNA, 23 nt, Human
ccuggugaggaagcuccaguccu

SEQ ID NO: 2066330 - RNA, 22 nt, Human
ccugguccagggaagcuggccg

SEQ ID NO: 2066331 - RNA, 14 nt, Human
ccugguccagggaa

SEQ ID NO: 2066332 - RNA, 21 nt, Human
ccugguccagggaagcuggcc

SEQ ID NO: 2066333 - RNA, 17 nt, Human
ccuggguucccuuuccu

SEQ ID NO: 2066334 - RNA, 16 nt, Human
ccugggugcuggcugc

SEQ ID NO: 2066335 - RNA, 15 nt, Human
ccuggguggggcugc

SEQ ID NO: 2066336 - RNA, 16 nt, Human
ccuggguggggcugcu

SEQ ID NO: 2066337 - RNA, 17 nt, Human
ccuggguggggcugcuc

SEQ ID NO: 2066338 - RNA, 23 nt, Human
ccuggggguucuuucuuccucug

SEQ ID NO: 2066339 - RNA, 22 nt, Human
ccuggggguucuuucuuccucu

SEQ ID NO: 2066340 - RNA, 21 nt, Human
ccuggggguucuuucuuccuc

SEQ ID NO: 2066341 - RNA, 18 nt, Human
ccugggucuaagggguug

SEQ ID NO: 2066342 - RNA, 14 nt, Human
ccugggucuguguc

SEQ ID NO: 2066343 - RNA, 15 nt, Human
ccugggucugugucu

SEQ ID NO: 2066344 - RNA, 16 nt, Human
ccugggucugugucuc

SEQ ID NO: 2066345 - RNA, 17 nt, Human
ccugggucugugucucu

SEQ ID NO: 2066346 - RNA, 21 nt, Human
ccugggucugugucucuuuuc

SEQ ID NO: 2066347 - RNA, 23 nt, Human
ccugggugcuggcugcccagacc

SEQ ID NO: 2066348 - RNA, 18 nt, Human
ccuggggguucuuucuuc

SEQ ID NO: 2066349 - RNA, 15 nt, Human
ccugggccccaccac

SEQ ID NO: 2066350 - RNA, 16 nt, Human
ccugggcauugcuuuc

SEQ ID NO: 2066351 - RNA, 17 nt, Human
ccugggcauugcuuucc

SEQ ID NO: 2066352 - RNA, 13 nt, Human
ccugggccccacc

SEQ ID NO: 2066353 - RNA, 14 nt, Human
ccugggccccacca

SEQ ID NO: 2066354 - RNA, 17 nt, Human
ccuggcuucuggagccc

SEQ ID NO: 2066355 - RNA, 13 nt, Human
ccuggacaaaccc

SEQ ID NO: 2066356 - RNA, 14 nt, Human
ccugggcauugcuu

SEQ ID NO: 2066357 - RNA, 15 nt, Human
ccugggcauugcuuu

SEQ ID NO: 2066358 - RNA, 24 nt, Human
ccuggcuuuucacugcuggcugcc

SEQ ID NO: 2066359 - RNA, 23 nt, Human
ccuggcuuuucacugcuggcugc

SEQ ID NO: 2066360 - RNA, 22 nt, Human
ccuggcuuuucacugcuggcug

SEQ ID NO: 2066361 - RNA, 21 nt, Human
ccuggcuuuucacugcuggcu

SEQ ID NO: 2066362 - RNA, 18 nt, Human
ccuggcuuuucacugcug

SEQ ID NO: 2066363 - RNA, 20 nt, Human
ccuggcuuuucacugcuggc

SEQ ID NO: 2066364 - RNA, 13 nt, Human
ccuggcuucugga

SEQ ID NO: 2066365 - RNA, 14 nt, Human
ccuggcuucuggag

SEQ ID NO: 2066366 - RNA, 15 nt, Human
ccuggcuucuggagc

SEQ ID NO: 2066367 - RNA, 16 nt, Human
ccuggcuucuggagcc

SEQ ID NO: 2066368 - RNA, 22 nt, Human
ccuggcugguaagggccaaguc

SEQ ID NO: 2066369 - RNA, 14 nt, Human
ccuggucccuggga

SEQ ID NO: 2066370 - RNA, 16 nt, Human
ccugcggccugcugga

SEQ ID NO: 2066371 - RNA, 17 nt, Human
ccugcggccugcuggag

SEQ ID NO: 2066372 - RNA, 12 nt, Human
ccugcgggcugc

SEQ ID NO: 2066373 - RNA, 22 nt, Human
ccugcgggcugccccgcuuugc

SEQ ID NO: 2066374 - RNA, 19 nt, Human
ccugcgggcuuuuccccgg

SEQ ID NO: 2066375 - RNA, 14 nt, Human
ccugcggucaaggc

SEQ ID NO: 2066376 - RNA, 16 nt, Human
ccugcggucaaggcca

SEQ ID NO: 2066377 - RNA, 17 nt, Human
ccugcggucaaggccag

SEQ ID NO: 2066378 - RNA, 18 nt, Human
ccugcggucaaggccagc

SEQ ID NO: 2066379 - RNA, 21 nt, Human
ccugcgggcuuuuccccgguc

SEQ ID NO: 2066380 - RNA, 22 nt, Human
ccugccuuggggaaggucuccc

SEQ ID NO: 2066381 - RNA, 22 nt, Human
ccugccuugaagccacugaagc

SEQ ID NO: 2066382 - RNA, 23 nt, Human
ccugccuugaagccacugaagcu

SEQ ID NO: 2066383 - RNA, 16 nt, Human
ccugccuugaagccac

SEQ ID NO: 2066384 - RNA, 17 nt, Human
ccugccuugaagccacu

SEQ ID NO: 2066385 - RNA, 19 nt, Human
ccugccuugaagccacuga

SEQ ID NO: 2066386 - RNA, 21 nt, Human
ccugccuugaagccacugaag

SEQ ID NO: 2066387 - RNA, 13 nt, Human
ccugccuugaagc

SEQ ID NO: 2066388 - RNA, 18 nt, Human
ccugccuucuucggggaa

SEQ ID NO: 2066389 - RNA, 14 nt, Human
ccugccuucguuaa

SEQ ID NO: 2066390 - RNA, 19 nt, Human
ccugcgaaggggcccuggu

SEQ ID NO: 2066391 - RNA, 20 nt, Human
ccugcgaaggggcccugguc

SEQ ID NO: 2066392 - RNA, 15 nt, Human
ccugcgaaggggccc

SEQ ID NO: 2066393 - RNA, 17 nt, Human
ccugcgaaggggcccug

SEQ ID NO: 2066394 - RNA, 14 nt, Human
ccugccccucccag

SEQ ID NO: 2066395 - RNA, 15 nt, Human
ccugccccucccaga

SEQ ID NO: 2066396 - RNA, 15 nt, Human
ccugccuagcacuca

SEQ ID NO: 2066397 - RNA, 20 nt, Human
ccugccuagcacucacaugc

SEQ ID NO: 2066398 - RNA, 21 nt, Human
ccugccuagcacucacaugcu

SEQ ID NO: 2066399 - RNA, 21 nt, Human
ccugccuaggaauucccagcc

SEQ ID NO: 2066400 - RNA, 17 nt, Human
ccugcccccuucuccca

SEQ ID NO: 2066401 - RNA, 18 nt, Human
ccugcccccuucucccac

SEQ ID NO: 2066402 - RNA, 19 nt, Human
ccugcccccuucucccaca

SEQ ID NO: 2066403 - RNA, 20 nt, Human
ccugcccccuucucccacac

SEQ ID NO: 2066404 - RNA, 21 nt, Human
ccugcccccuucucccacacu

SEQ ID NO: 2066405 - RNA, 22 nt, Human
ccugcccccuucucccacacug

SEQ ID NO: 2066406 - RNA, 23 nt, Human
ccugcccccuucucccacacugc

SEQ ID NO: 2066407 - RNA, 16 nt, Human
ccugccccgcccagcu

SEQ ID NO: 2066408 - RNA, 22 nt, Human
ccugccccgcccagcugcaccu

SEQ ID NO: 2066409 - RNA, 22 nt, Human
ccugccccgucaccaucucagg

SEQ ID NO: 2066410 - RNA, 23 nt, Human
ccugccccgucaccaucucaggc

SEQ ID NO: 2066411 - RNA, 11 nt, Human
ccugccucagc

SEQ ID NO: 2066412 - RNA, 11 nt, Human
ccugccuggcc

SEQ ID NO: 2066413 - RNA, 12 nt, Human
ccugccuggcca

SEQ ID NO: 2066414 - RNA, 13 nt, Human
ccugccuggccag

SEQ ID NO: 2066415 - RNA, 14 nt, Human
ccugccuggccagg

SEQ ID NO: 2066416 - RNA, 14 nt, Human
ccugccuggucucc

SEQ ID NO: 2066417 - RNA, 23 nt, Human
ccugccuggccaggcagaucugu

SEQ ID NO: 2066418 - RNA, 18 nt, Human
ccugccuggccaggcaga

SEQ ID NO: 2066419 - RNA, 22 nt, Human
ccugccuggccaggcagaucug

SEQ ID NO: 2066420 - RNA, 23 nt, Human
ccugcuuugggcugcccuggugc

SEQ ID NO: 2066421 - RNA, 22 nt, Human
ccugcuuugggcugcccuggug

SEQ ID NO: 2066422 - RNA, 21 nt, Human
ccugcuuugggcugcccuggu

SEQ ID NO: 2066423 - RNA, 19 nt, Human
ccugcuuugggcugcccug

SEQ ID NO: 2066424 - RNA, 20 nt, Human
ccugcuuugggcugcccugg

SEQ ID NO: 2066425 - RNA, 17 nt, Human
ccugcugagggaccagc

SEQ ID NO: 2066426 - RNA, 19 nt, Human
ccugcugagggaccagcca

SEQ ID NO: 2066427 - RNA, 21 nt, Human
ccugcugagggaccagccaag

SEQ ID NO: 2066428 - RNA, 14 nt, Human
ccugcuucaaauau

SEQ ID NO: 2066429 - RNA, 20 nt, Human
ccuggaagcccucucuggcu

SEQ ID NO: 2066430 - RNA, 13 nt, Human
ccuggaagcugug

SEQ ID NO: 2066431 - RNA, 20 nt, Human
ccuggaaggacauccauguu

SEQ ID NO: 2066432 - RNA, 23 nt, Human
ccuggaagcuguguccuugcacc

SEQ ID NO: 2066433 - RNA, 17 nt, Human
ccuggaagcuguguccu

SEQ ID NO: 2066434 - RNA, 18 nt, Human
ccuggaagcuguguccuu

SEQ ID NO: 2066435 - RNA, 20 nt, Human
ccuggaagcuguguccuugc

SEQ ID NO: 2066436 - RNA, 17 nt, Human
ccuggaagagcagcccu

SEQ ID NO: 2066437 - RNA, 16 nt, Human
ccuggaagagcagccc

SEQ ID NO: 2066438 - RNA, 22 nt, Human
ccuggaaauaucaguuacucag

SEQ ID NO: 2066439 - RNA, 23 nt, Human
ccugcugaaugauuuccaaagag

SEQ ID NO: 2066440 - RNA, 14 nt, Human
ccugcucucuaccc

SEQ ID NO: 2066441 - RNA, 15 nt, Human
ccugcucucuaccca

SEQ ID NO: 2066442 - RNA, 16 nt, Human
ccugcucucuacccag

SEQ ID NO: 2066443 - RNA, 17 nt, Human
ccugcucucuacccagc

SEQ ID NO: 2066444 - RNA, 19 nt, Human
ccugcucucuacccagccc

SEQ ID NO: 2066445 - RNA, 20 nt, Human
ccugcucucuacccagccca

SEQ ID NO: 2066446 - RNA, 21 nt, Human
ccugcucucuacccagcccau

SEQ ID NO: 2066447 - RNA, 22 nt, Human
ccugcucuccucuugccacugc

SEQ ID NO: 2066448 - RNA, 17 nt, Human
ccugcugagagacccaa

SEQ ID NO: 2066449 - RNA, 21 nt, Human
ccugcugagagacccaaggag

SEQ ID NO: 2066450 - RNA, 20 nt, Human
ccugcugagagacccaagga

SEQ ID NO: 2066451 - RNA, 21 nt, Human
ccugcucuccucuugccacug

SEQ ID NO: 2066452 - RNA, 19 nt, Human
ccugcucuccucuugccac

SEQ ID NO: 2066453 - RNA, 18 nt, Human
ccugcucuccucuugcca

SEQ ID NO: 2066454 - RNA, 16 nt, Human
ccugcucuccucuugc

SEQ ID NO: 2066455 - RNA, 22 nt, Human
ccugcucuccgaccagacaccu

SEQ ID NO: 2066456 - RNA, 21 nt, Human
ccugcucuccgaccagacacc

SEQ ID NO: 2066457 - RNA, 14 nt, Human
ccugcuauuuccca

SEQ ID NO: 2066458 - RNA, 18 nt, Human
ccugcuauuucccaagcu

SEQ ID NO: 2066459 - RNA, 20 nt, Human
ccugcuauuucccaagcugg

SEQ ID NO: 2066460 - RNA, 21 nt, Human
ccugcuauuucccaagcugga

SEQ ID NO: 2066461 - RNA, 22 nt, Human
ccuggcaggaugacccugcgaa

SEQ ID NO: 2066462 - RNA, 16 nt, Human
ccugacagaaggacuc

SEQ ID NO: 2066463 - RNA, 20 nt, Human
ccugaccaacaguuccuuca

SEQ ID NO: 2066464 - RNA, 16 nt, Human
ccugagcuuucugcua

SEQ ID NO: 2066465 - RNA, 17 nt, Human
ccugagcuuggccagaa

SEQ ID NO: 2066466 - RNA, 21 nt, Human
ccugagcuuggccagaagggg

SEQ ID NO: 2066467 - RNA, 15 nt, Human
ccugagcuuuggaca

SEQ ID NO: 2066468 - RNA, 16 nt, Human
ccugagcuuuggacac

SEQ ID NO: 2066469 - RNA, 17 nt, Human
ccugagcuuuggacaca

SEQ ID NO: 2066470 - RNA, 18 nt, Human
ccugagcuuuggacacac

SEQ ID NO: 2066471 - RNA, 22 nt, Human
ccugagcuuuggacacacacag

SEQ ID NO: 2066472 - RNA, 23 nt, Human
ccugagcuuuggacacacacagc

SEQ ID NO: 2066473 - RNA, 15 nt, Human
ccugagcuuuggacg

SEQ ID NO: 2066474 - RNA, 18 nt, Human
ccugagcuuuggacgcac

SEQ ID NO: 2066475 - RNA, 22 nt, Human
ccugagcuuuggacgcacacag

SEQ ID NO: 2066476 - RNA, 23 nt, Human
ccugagcuuuggacgcacacagc

SEQ ID NO: 2066477 - RNA, 18 nt, Human
ccugagcuuggccagaag

SEQ ID NO: 2066478 - RNA, 12 nt, Human
ccugaggaagcg

SEQ ID NO: 2066479 - RNA, 23 nt, Human
ccugaggaagcgugaaggccgag

SEQ ID NO: 2066480 - RNA, 14 nt, Human
ccugaggaucagaa

SEQ ID NO: 2066481 - RNA, 15 nt, Human
ccugaggaucagaaa

SEQ ID NO: 2066482 - RNA, 16 nt, Human
ccugaggaucagaaag

SEQ ID NO: 2066483 - RNA, 17 nt, Human
ccugaggaucagaaagu

SEQ ID NO: 2066484 - RNA, 18 nt, Human
ccugaggaucagaaagua

SEQ ID NO: 2066485 - RNA, 16 nt, Human
ccugagcaccucccag

SEQ ID NO: 2066486 - RNA, 17 nt, Human
ccugagcaccucccagc

SEQ ID NO: 2066487 - RNA, 18 nt, Human
ccugagcaccucccagcc

SEQ ID NO: 2066488 - RNA, 19 nt, Human
ccugagcaccucccagccc

SEQ ID NO: 2066489 - RNA, 21 nt, Human
ccugagcaccucccagccccu

SEQ ID NO: 2066490 - RNA, 22 nt, Human
ccugagcaccucccagccccug

SEQ ID NO: 2066491 - RNA, 23 nt, Human
ccugagcaccucccagccccugc

SEQ ID NO: 2066492 - RNA, 14 nt, Human
ccugagcuuucugc

SEQ ID NO: 2066493 - RNA, 16 nt, Human
ccugagcuuggccaga

SEQ ID NO: 2066494 - RNA, 20 nt, Human
ccugauuguguauauucaua

SEQ ID NO: 2066495 - RNA, 16 nt, Human
ccucuauauuugcucu

SEQ ID NO: 2066496 - RNA, 18 nt, Human
ccugcaaaaugagacccu

SEQ ID NO: 2066497 - RNA, 14 nt, Human
ccugcaaaauuuua

SEQ ID NO: 2066498 - RNA, 20 nt, Human
ccugcaguacuuuaccuccu

SEQ ID NO: 2066499 - RNA, 15 nt, Human
ccugcagucacagcu

SEQ ID NO: 2066500 - RNA, 15 nt, Human
ccugcagucaucuug

SEQ ID NO: 2066501 - RNA, 18 nt, Human
ccugcaguacuuuaccuc

SEQ ID NO: 2066502 - RNA, 15 nt, Human
ccugcagggccaagc

SEQ ID NO: 2066503 - RNA, 22 nt, Human
ccugcaggccaagagcagaggc

SEQ ID NO: 2066504 - RNA, 20 nt, Human
ccugcacugacccacagccu

SEQ ID NO: 2066505 - RNA, 16 nt, Human
ccugcaggccaagagc

SEQ ID NO: 2066506 - RNA, 21 nt, Human
ccugcaggccaagagcagagg

SEQ ID NO: 2066507 - RNA, 21 nt, Human
ccugcacuaauuugauguuua

SEQ ID NO: 2066508 - RNA, 22 nt, Human
ccugcaccuccccccacugcag

SEQ ID NO: 2066509 - RNA, 21 nt, Human
ccugcaccuccccccacugca

SEQ ID NO: 2066510 - RNA, 21 nt, Human
ccugccagccuggcuucugga

SEQ ID NO: 2066511 - RNA, 13 nt, Human
ccugccagccugg

SEQ ID NO: 2066512 - RNA, 19 nt, Human
ccugccagacggcacccac

SEQ ID NO: 2066513 - RNA, 13 nt, Human
ccugccagcaccc

SEQ ID NO: 2066514 - RNA, 14 nt, Human
ccugccagcacccc

SEQ ID NO: 2066515 - RNA, 14 nt, Human
ccugccagccuggc

SEQ ID NO: 2066516 - RNA, 15 nt, Human
ccugccagccuggcu

SEQ ID NO: 2066517 - RNA, 16 nt, Human
ccugccagccuggcuu

SEQ ID NO: 2066518 - RNA, 17 nt, Human
ccugccagccuggcuuc

SEQ ID NO: 2066519 - RNA, 15 nt, Human
ccugcauucacccag

SEQ ID NO: 2066520 - RNA, 16 nt, Human
ccugcauucacccaga

SEQ ID NO: 2066521 - RNA, 17 nt, Human
ccugcauucacccagac

SEQ ID NO: 2066522 - RNA, 19 nt, Human
ccugcauucacccagacag

SEQ ID NO: 2066523 - RNA, 22 nt, Human
ccugcauucugccgugugcccu

SEQ ID NO: 2066524 - RNA, 23 nt, Human
ccugccacuuugguacauggcca

SEQ ID NO: 2066525 - RNA, 19 nt, Human
ccugcauccguaguucccu

SEQ ID NO: 2066526 - RNA, 22 nt, Human
ccugcauccguaguucccugaa

SEQ ID NO: 2066527 - RNA, 12 nt, Human
ccugcaugcaga

SEQ ID NO: 2066528 - RNA, 22 nt, Human
ccugcccccagaccuuuuaucc

SEQ ID NO: 2066529 - RNA, 16 nt, Human
ccugccaggcauggug

SEQ ID NO: 2066530 - RNA, 17 nt, Human
cccgucgacguagaacc

SEQ ID NO: 2066531 - RNA, 19 nt, Human
cccgucaggacguugagga

SEQ ID NO: 2066532 - RNA, 18 nt, Human
cccgucauguuccucaaa

SEQ ID NO: 2066533 - RNA, 23 nt, Human
cccgucugggguucagccccucc

SEQ ID NO: 2066534 - RNA, 20 nt, Human
cccgucugggguucagcccc

SEQ ID NO: 2066535 - RNA, 21 nt, Human
cccgucugggguucagccccu

SEQ ID NO: 2066536 - RNA, 12 nt, Human
cccgucuucagc

SEQ ID NO: 2066537 - RNA, 18 nt, Human
cccggugcccaagaauag

SEQ ID NO: 2066538 - RNA, 22 nt, Human
cccggguuuggcgggccaagga

SEQ ID NO: 2066539 - RNA, 22 nt, Human
cccggucccuugagaccucagc

SEQ ID NO: 2066540 - RNA, 17 nt, Human
cccgucaccaucucagg

SEQ ID NO: 2066541 - RNA, 18 nt, Human
cccgucaccaucucaggc

SEQ ID NO: 2066542 - RNA, 21 nt, Human
cccggggcagcugccagagaa

SEQ ID NO: 2066543 - RNA, 20 nt, Human
cccggguuuggcgggccaag

SEQ ID NO: 2066544 - RNA, 16 nt, Human
cccgggcucucugcug

SEQ ID NO: 2066545 - RNA, 17 nt, Human
cccgggcucucugcugu

SEQ ID NO: 2066546 - RNA, 12 nt, Human
cccggggcagcu

SEQ ID NO: 2066547 - RNA, 14 nt, Human
cccggggcagcugc

SEQ ID NO: 2066548 - RNA, 19 nt, Human
cccggggcagcugccagag

SEQ ID NO: 2066549 - RNA, 20 nt, Human
cccggggcagcugccagaga

SEQ ID NO: 2066550 - RNA, 18 nt, Human
cccuaccgagucucuucu

SEQ ID NO: 2066551 - RNA, 14 nt, Human
cccuaccccaccac

SEQ ID NO: 2066552 - RNA, 21 nt, Human
cccuaccgagucucuucucca

SEQ ID NO: 2066553 - RNA, 10 nt, Human
cccuaccuca

SEQ ID NO: 2066554 - RNA, 15 nt, Human
cccuaccucaaccug

SEQ ID NO: 2066555 - RNA, 18 nt, Human
cccuaccucaaccuguaa

SEQ ID NO: 2066556 - RNA, 19 nt, Human
cccuaccucaaccuguaaa

SEQ ID NO: 2066557 - RNA, 20 nt, Human
cccuaccucaaccuguaaau

SEQ ID NO: 2066558 - RNA, 22 nt, Human
cccuaccucaaccuguaaauua

SEQ ID NO: 2066559 - RNA, 13 nt, Human
cccuaccucaggc

SEQ ID NO: 2066560 - RNA, 16 nt, Human
cccuaccucaggcagg

SEQ ID NO: 2066561 - RNA, 22 nt, Human
cccuaccugauuggugcaaccc

SEQ ID NO: 2066562 - RNA, 23 nt, Human
cccuaccugauuggugcaacccu

SEQ ID NO: 2066563 - RNA, 20 nt, Human
cccuagcuccacacccucuc

SEQ ID NO: 2066564 - RNA, 14 nt, Human
cccuaggagaccaa

SEQ ID NO: 2066565 - RNA, 13 nt, Human
cccuagggcuggg

SEQ ID NO: 2066566 - RNA, 15 nt, Human
cccuagggcugggug

SEQ ID NO: 2066567 - RNA, 16 nt, Human
cccuagggcugggugu

SEQ ID NO: 2066568 - RNA, 17 nt, Human
cccuagggcugggugua

SEQ ID NO: 2066569 - RNA, 21 nt, Human
cccuaggucagcuugcugccc

SEQ ID NO: 2066570 - RNA, 14 nt, Human
cccguguggccccu

SEQ ID NO: 2066571 - RNA, 17 nt, Human
cccguguggccccuuca

SEQ ID NO: 2066572 - RNA, 22 nt, Human
cccguguggccccuucacuucu

SEQ ID NO: 2066573 - RNA, 18 nt, Human
cccguguggccccuucac

SEQ ID NO: 2066574 - RNA, 12 nt, Human
cccuaaugccug

SEQ ID NO: 2066575 - RNA, 18 nt, Human
cccuacaccccuccccug

SEQ ID NO: 2066576 - RNA, 20 nt, Human
cccuacaguugaaaaacagc

SEQ ID NO: 2066577 - RNA, 19 nt, Human
cccuaauuuaacccagcuc

SEQ ID NO: 2066578 - RNA, 17 nt, Human
cccuaccaccuccccag

SEQ ID NO: 2066579 - RNA, 19 nt, Human
cccuaccaccuccccagcc

SEQ ID NO: 2066580 - RNA, 20 nt, Human
cccuaccaccuccccagccu

SEQ ID NO: 2066581 - RNA, 21 nt, Human
cccgggcaagacuuuucuuug

SEQ ID NO: 2066582 - RNA, 13 nt, Human
cccgcuggcuggg

SEQ ID NO: 2066583 - RNA, 22 nt, Human
cccgcuggcugggggccucacu

SEQ ID NO: 2066584 - RNA, 22 nt, Human
cccgaguagcugggacuacagg

SEQ ID NO: 2066585 - RNA, 17 nt, Human
cccgagguggcugccug

SEQ ID NO: 2066586 - RNA, 22 nt, Human
cccgagguggcugccuggagcc

SEQ ID NO: 2066587 - RNA, 15 nt, Human
cccgccccacauucc

SEQ ID NO: 2066588 - RNA, 19 nt, Human
cccgccccacauuccgaca

SEQ ID NO: 2066589 - RNA, 18 nt, Human
cccgccucccuccccugc

SEQ ID NO: 2066590 - RNA, 21 nt, Human
cccgaguagcugggacuacag

SEQ ID NO: 2066591 - RNA, 18 nt, Human
cccgaguagcugggacua

SEQ ID NO: 2066592 - RNA, 17 nt, Human
cccgaguagcugggacu

SEQ ID NO: 2066593 - RNA, 16 nt, Human
cccgaguagcugggac

SEQ ID NO: 2066594 - RNA, 15 nt, Human
cccgaguagcuggga

SEQ ID NO: 2066595 - RNA, 14 nt, Human
cccgaguagcuggg

SEQ ID NO: 2066596 - RNA, 13 nt, Human
cccgaguagcugg

SEQ ID NO: 2066597 - RNA, 14 nt, Human
cccgaggcugccca

SEQ ID NO: 2066598 - RNA, 19 nt, Human
cccgaggcugcccacuaug

SEQ ID NO: 2066599 - RNA, 22 nt, Human
cccagagggcccaggcaggcca

SEQ ID NO: 2066600 - RNA, 23 nt, Human
cccagagggcccaggcaggccac

SEQ ID NO: 2066601 - RNA, 20 nt, Human
cccagaacuggacucaggau

SEQ ID NO: 2066602 - RNA, 19 nt, Human
cccagaaccuguccuugca

SEQ ID NO: 2066603 - RNA, 15 nt, Human
cccagaaccuguccu

SEQ ID NO: 2066604 - RNA, 17 nt, Human
cccagaaccuguccuug

SEQ ID NO: 2066605 - RNA, 19 nt, Human
cccagaacuggacucagga

SEQ ID NO: 2066606 - RNA, 19 nt, Human
cccagaaggaccuccugag

SEQ ID NO: 2066607 - RNA, 13 nt, Human
cccagaaggcagg

SEQ ID NO: 2066608 - RNA, 23 nt, Human
cccagaaggcagggaaaggcucu

SEQ ID NO: 2066609 - RNA, 13 nt, Human
cccagagggccca

SEQ ID NO: 2066610 - RNA, 14 nt, Human
cccagaaaggagac

SEQ ID NO: 2066611 - RNA, 15 nt, Human
cccagaaaggagacu

SEQ ID NO: 2066612 - RNA, 17 nt, Human
cccagaaaggagacuag

SEQ ID NO: 2066613 - RNA, 14 nt, Human
cccagaacacacuc

SEQ ID NO: 2066614 - RNA, 18 nt, Human
cccagaacacacuccauc

SEQ ID NO: 2066615 - RNA, 22 nt, Human
cccagaacacacuccaucagcu

SEQ ID NO: 2066616 - RNA, 14 nt, Human
cccagaaccugucc

SEQ ID NO: 2066617 - RNA, 21 nt, Human
cccgaggccuucucugaagga

SEQ ID NO: 2066618 - RNA, 14 nt, Human
cccagagggcccag

SEQ ID NO: 2066619 - RNA, 15 nt, Human
cccagagggcccagg

SEQ ID NO: 2066620 - RNA, 16 nt, Human
cccagagggcccaggc

SEQ ID NO: 2066621 - RNA, 18 nt, Human
cccagagggcccaggcag

SEQ ID NO: 2066622 - RNA, 16 nt, Human
cccugagucaccagga

SEQ ID NO: 2066623 - RNA, 17 nt, Human
cccugagucaccaggaa

SEQ ID NO: 2066624 - RNA, 16 nt, Human
cccugaggcuggacuc

SEQ ID NO: 2066625 - RNA, 23 nt, Human
cccugaggcuggacuccagaucu

SEQ ID NO: 2066626 - RNA, 18 nt, Human
cccugaggugaaagggag

SEQ ID NO: 2066627 - RNA, 20 nt, Human
cccugaggugaaagggagcu

SEQ ID NO: 2066628 - RNA, 23 nt, Human
cccugcacaaagcccuuccaugu

SEQ ID NO: 2066629 - RNA, 15 nt, Human
cccugcaaaggacug

SEQ ID NO: 2066630 - RNA, 16 nt, Human
cccugcaaaggacugu

SEQ ID NO: 2066631 - RNA, 23 nt, Human
cccugcacuggaguccagucucu

SEQ ID NO: 2066632 - RNA, 13 nt, Human
cccugcacuggag

SEQ ID NO: 2066633 - RNA, 22 nt, Human
cccugcacuggaguccagucuc

SEQ ID NO: 2066634 - RNA, 12 nt, Human
cccugcacuugc

SEQ ID NO: 2066635 - RNA, 19 nt, Human
cccugcacuugcagacucu

SEQ ID NO: 2066636 - RNA, 16 nt, Human
cccucuggcccugccu

SEQ ID NO: 2066637 - RNA, 16 nt, Human
cccugaaaacccagag

SEQ ID NO: 2066638 - RNA, 17 nt, Human
cccugaaaacccagaga

SEQ ID NO: 2066639 - RNA, 18 nt, Human
cccugaaaacccagagag

SEQ ID NO: 2066640 - RNA, 15 nt, Human
cccugaaagcccuga

SEQ ID NO: 2066641 - RNA, 17 nt, Human
cccugaaaaccucacau

SEQ ID NO: 2066642 - RNA, 22 nt, Human
cccugaaaauguuuuucugcca

SEQ ID NO: 2066643 - RNA, 23 nt, Human
cccugaaaauguuuuucugccag

SEQ ID NO: 2066644 - RNA, 24 nt, Human
cccugaaaauguuuuucugccagg

SEQ ID NO: 2066645 - RNA, 16 nt, Human
cccugaaagcccugag

SEQ ID NO: 2066646 - RNA, 18 nt, Human
cccucuggccaggaugga

SEQ ID NO: 2066647 - RNA, 22 nt, Human
cccucuggccaggauggagggg

SEQ ID NO: 2066648 - RNA, 13 nt, Human
cccucuggcccug

SEQ ID NO: 2066649 - RNA, 14 nt, Human
cccucuggcccugc

SEQ ID NO: 2066650 - RNA, 14 nt, Human
cccucugcuggccg

SEQ ID NO: 2066651 - RNA, 23 nt, Human
cccucugcuggccgggcacagcu

SEQ ID NO: 2066652 - RNA, 12 nt, Human
cccucuggccag

SEQ ID NO: 2066653 - RNA, 13 nt, Human
cccucuggccagg

SEQ ID NO: 2066654 - RNA, 15 nt, Human
cccucugccuguccc

SEQ ID NO: 2066655 - RNA, 16 nt, Human
cccucugccugucccu

SEQ ID NO: 2066656 - RNA, 23 nt, Human
cccucugccugucccucucaggc

SEQ ID NO: 2066657 - RNA, 22 nt, Human
cccucucuggcuaaggacaggc

SEQ ID NO: 2066658 - RNA, 14 nt, Human
cccucugccugucc

SEQ ID NO: 2066659 - RNA, 18 nt, Human
cccucucucuucugcucc

SEQ ID NO: 2066660 - RNA, 19 nt, Human
cccucucucuucugcucca

SEQ ID NO: 2066661 - RNA, 22 nt, Human
cccucucucuucugcuccaccc

SEQ ID NO: 2066662 - RNA, 23 nt, Human
cccucucucuucugcuccacccu

SEQ ID NO: 2066663 - RNA, 13 nt, Human
cccucucuccucc

SEQ ID NO: 2066664 - RNA, 11 nt, Human
cccucucucug

SEQ ID NO: 2066665 - RNA, 13 nt, Human
cccucucucuucu

SEQ ID NO: 2066666 - RNA, 14 nt, Human
cccucucucuucug

SEQ ID NO: 2066667 - RNA, 15 nt, Human
cccucucucuucugc

SEQ ID NO: 2066668 - RNA, 17 nt, Human
cccucucucuucugcuc

SEQ ID NO: 2066669 - RNA, 17 nt, Human
cccucuccugccuacuc

SEQ ID NO: 2066670 - RNA, 12 nt, Human
cccucuccugcc

SEQ ID NO: 2066671 - RNA, 13 nt, Human
cccucuccugccu

SEQ ID NO: 2066672 - RNA, 22 nt, Human
cccucccagggccagggcccug

SEQ ID NO: 2066673 - RNA, 14 nt, Human
cccuccccagggga

SEQ ID NO: 2066674 - RNA, 16 nt, Human
cccucccccaaccccc

SEQ ID NO: 2066675 - RNA, 12 nt, Human
cccuccccaggg

SEQ ID NO: 2066676 - RNA, 13 nt, Human
cccuccccagggg

SEQ ID NO: 2066677 - RNA, 13 nt, Human
cccuccacugccc

SEQ ID NO: 2066678 - RNA, 14 nt, Human
cccuccacugcccu

SEQ ID NO: 2066679 - RNA, 15 nt, Human
cccuccacugcccuc

SEQ ID NO: 2066680 - RNA, 18 nt, Human
cccuccacguucaccccu

SEQ ID NO: 2066681 - RNA, 12 nt, Human
cccuccacuccu

SEQ ID NO: 2066682 - RNA, 17 nt, Human
cccuccacuccuuccug

SEQ ID NO: 2066683 - RNA, 23 nt, Human
cccuauauguaguauaaagaaaa

SEQ ID NO: 2066684 - RNA, 18 nt, Human
cccuauaaugcuggagcg

SEQ ID NO: 2066685 - RNA, 17 nt, Human
cccuagucccuuccccu

SEQ ID NO: 2066686 - RNA, 22 nt, Human
cccuagucccuuccccucccug

SEQ ID NO: 2066687 - RNA, 15 nt, Human
cccuaguaaaaauac

SEQ ID NO: 2066688 - RNA, 16 nt, Human
cccuagucccuucccc

SEQ ID NO: 2066689 - RNA, 22 nt, Human
cccuaggucagcuugcugcccu

SEQ ID NO: 2066690 - RNA, 14 nt, Human
cccuauccacccag

SEQ ID NO: 2066691 - RNA, 16 nt, Human
cccuauccacccagcc

SEQ ID NO: 2066692 - RNA, 18 nt, Human
cccuauccacccagccca

SEQ ID NO: 2066693 - RNA, 19 nt, Human
cccuauccacccagcccau

SEQ ID NO: 2066694 - RNA, 15 nt, Human
cccuccacaucccug

SEQ ID NO: 2066695 - RNA, 17 nt, Human
cccuggaccagaugcug

SEQ ID NO: 2066696 - RNA, 20 nt, Human
cccugcuuugggcugcccug

SEQ ID NO: 2066697 - RNA, 21 nt, Human
cccuggaaggacauccauguu

SEQ ID NO: 2066698 - RNA, 17 nt, Human
cccugcuuugggcugcc

SEQ ID NO: 2066699 - RNA, 19 nt, Human
cccugcuuugggcugcccu

SEQ ID NO: 2066700 - RNA, 18 nt, Human
cccugcuuugggcugccc

SEQ ID NO: 2066701 - RNA, 13 nt, Human
cccugccagcucu

SEQ ID NO: 2066702 - RNA, 14 nt, Human
cccugccagcaccc

SEQ ID NO: 2066703 - RNA, 17 nt, Human
cccugccagcaccccca

SEQ ID NO: 2066704 - RNA, 23 nt, Human
cccugccagcacccccacgcccu

SEQ ID NO: 2066705 - RNA, 12 nt, Human
cccugccagcuc

SEQ ID NO: 2066706 - RNA, 22 nt, Human
cccuggcuuuucacugcuggcu

SEQ ID NO: 2066707 - RNA, 19 nt, Human
cccuggcuuuucacugcug

SEQ ID NO: 2066708 - RNA, 17 nt, Human
cccuggcuuuucacugc

SEQ ID NO: 2066709 - RNA, 18 nt, Human
cccuggcuuuucacugcu

SEQ ID NO: 2066710 - RNA, 23 nt, Human
cccuggacugguggccccugccu

SEQ ID NO: 2066711 - RNA, 16 nt, Human
cccugggccccaccac

SEQ ID NO: 2066712 - RNA, 18 nt, Human
cccugggccccaccaccu

SEQ ID NO: 2066713 - RNA, 20 nt, Human
cccugggccccaccaccuag

SEQ ID NO: 2066714 - RNA, 22 nt, Human
cccugggccccaccaccuaggc

SEQ ID NO: 2066715 - RNA, 23 nt, Human
cccugguaauaaguacuguguac

SEQ ID NO: 2066716 - RNA, 16 nt, Human
cccugggcucugcccc

SEQ ID NO: 2066717 - RNA, 13 nt, Human
cccugggcucugc

SEQ ID NO: 2066718 - RNA, 15 nt, Human
cccugggcucugccc

SEQ ID NO: 2066719 - RNA, 16 nt, Human
cccugguccagggaag

SEQ ID NO: 2066720 - RNA, 18 nt, Human
cccugguccagggaagcu

SEQ ID NO: 2066721 - RNA, 13 nt, Human
cccugguccuucc

SEQ ID NO: 2066722 - RNA, 16 nt, Human
cccugguccuuccagg

SEQ ID NO: 2066723 - RNA, 17 nt, Human
cccugguccuuccaggc

SEQ ID NO: 2066724 - RNA, 21 nt, Human
cccaccaacaucccauugccc

SEQ ID NO: 2066725 - RNA, 14 nt, Human
cccacauuccgaca

SEQ ID NO: 2066726 - RNA, 13 nt, Human
cccacagcuuggg

SEQ ID NO: 2066727 - RNA, 17 nt, Human
cccacauguguccaucc

SEQ ID NO: 2066728 - RNA, 18 nt, Human
cccacauguguccauccc

SEQ ID NO: 2066729 - RNA, 14 nt, Human
cccacauuggaccc

SEQ ID NO: 2066730 - RNA, 19 nt, Human
cccacagcucccaccccac

SEQ ID NO: 2066731 - RNA, 20 nt, Human
cccacagcucccaccccacc

SEQ ID NO: 2066732 - RNA, 13 nt, Human
cccacacacccca

SEQ ID NO: 2066733 - RNA, 12 nt, Human
cccacagcuccc

SEQ ID NO: 2066734 - RNA, 14 nt, Human
cccacagcucccac

SEQ ID NO: 2066735 - RNA, 15 nt, Human
cccacagcucccacc

SEQ ID NO: 2066736 - RNA, 17 nt, Human
cccacagcucccacccc

SEQ ID NO: 2066737 - RNA, 21 nt, Human
cccaccugccacuaggcuggg

SEQ ID NO: 2066738 - RNA, 23 nt, Human
cccaccugccacuaggcugggug

SEQ ID NO: 2066739 - RNA, 13 nt, Human
cccaccugcccau

SEQ ID NO: 2066740 - RNA, 20 nt, Human
cccaccugcccaucacaggg

SEQ ID NO: 2066741 - RNA, 23 nt, Human
cccaccugcccaucacaggguug

SEQ ID NO: 2066742 - RNA, 20 nt, Human
cccacgacugcccggcaggg

SEQ ID NO: 2066743 - RNA, 21 nt, Human
cccacgacugcccggcagggu

SEQ ID NO: 2066744 - RNA, 21 nt, Human
cccaccuuuauuaaaaucuua

SEQ ID NO: 2066745 - RNA, 12 nt, Human
cccaccuuuggu

SEQ ID NO: 2066746 - RNA, 12 nt, Human
cccacuucugcc

SEQ ID NO: 2066747 - RNA, 23 nt, Human
cccacuugagaauuacccuuuug

SEQ ID NO: 2066748 - RNA, 21 nt, Human
cccacgcuggagugcagugag

SEQ ID NO: 2066749 - RNA, 20 nt, Human
cccacgcuggagugcaguga

SEQ ID NO: 2066750 - RNA, 19 nt, Human
cccacgcuggagugcagug

SEQ ID NO: 2066751 - RNA, 12 nt, Human
cccaccacagca

SEQ ID NO: 2066752 - RNA, 13 nt, Human
cccaccacagcag

SEQ ID NO: 2066753 - RNA, 15 nt, Human
cccaccaccccagcu

SEQ ID NO: 2066754 - RNA, 18 nt, Human
cccaccaccccagcugcu

SEQ ID NO: 2066755 - RNA, 13 nt, Human
cccaccaccuagg

SEQ ID NO: 2066756 - RNA, 16 nt, Human
cccaccaccuaggcca

SEQ ID NO: 2066757 - RNA, 19 nt, Human
cccaccaccuaggccacuc

SEQ ID NO: 2066758 - RNA, 20 nt, Human
cccaccaccuaggccacucc

SEQ ID NO: 2066759 - RNA, 21 nt, Human
cccaccaccuaggccacuccu

SEQ ID NO: 2066760 - RNA, 22 nt, Human
cccaccaccuaggccacuccuc

SEQ ID NO: 2066761 - RNA, 22 nt, Human
cccaccaggcugcucagggcug

SEQ ID NO: 2066762 - RNA, 17 nt, Human
cccaccaggcugcucag

SEQ ID NO: 2066763 - RNA, 16 nt, Human
cccaccaggcugcuca

SEQ ID NO: 2066764 - RNA, 13 nt, Human
cccaccaggcugc

SEQ ID NO: 2066765 - RNA, 19 nt, Human
cccaccacgauguggcccu

SEQ ID NO: 2066766 - RNA, 20 nt, Human
cccaccacgauguggcccug

SEQ ID NO: 2066767 - RNA, 24 nt, Human
cccaccacgauguggcccuggccu

SEQ ID NO: 2066768 - RNA, 23 nt, Human
cccaccacuaggacucugaggcu

SEQ ID NO: 2066769 - RNA, 23 nt, Human
cccaccgggcugggagcucugca

SEQ ID NO: 2066770 - RNA, 17 nt, Human
cccaccucagccucccg

SEQ ID NO: 2066771 - RNA, 17 nt, Human
cccaccucagccuccug

SEQ ID NO: 2066772 - RNA, 12 nt, Human
cccaccugagcu

SEQ ID NO: 2066773 - RNA, 13 nt, Human
cccaccugagcuu

SEQ ID NO: 2066774 - RNA, 15 nt, Human
cccaccugagcuuug

SEQ ID NO: 2066775 - RNA, 17 nt, Human
cccaccugagcuuugga

SEQ ID NO: 2066776 - RNA, 13 nt, Human
cccaccuccugca

SEQ ID NO: 2066777 - RNA, 19 nt, Human
ccucagucuggcccuuccu

SEQ ID NO: 2066778 - RNA, 20 nt, Human
ccuaugcugccuaggcugac

SEQ ID NO: 2066779 - RNA, 11 nt, Human
ccucagugcca

SEQ ID NO: 2066780 - RNA, 20 nt, Human
ccucagucuggcccuuccuu

SEQ ID NO: 2066781 - RNA, 22 nt, Human
ccucauaguaugguggcugggu

SEQ ID NO: 2066782 - RNA, 21 nt, Human
ccucauaguaugguggcuggg

SEQ ID NO: 2066783 - RNA, 20 nt, Human
ccucauaguaugguggcugg

SEQ ID NO: 2066784 - RNA, 14 nt, Human
ccucauccgaggca

SEQ ID NO: 2066785 - RNA, 15 nt, Human
ccucauccgaggcag

SEQ ID NO: 2066786 - RNA, 17 nt, Human
ccucauccgaggcaggg

SEQ ID NO: 2066787 - RNA, 20 nt, Human
ccucauccgaggcaggguca

SEQ ID NO: 2066788 - RNA, 16 nt, Human
ccucaguggacuuucc

SEQ ID NO: 2066789 - RNA, 18 nt, Human
ccucaguggacuuuccac

SEQ ID NO: 2066790 - RNA, 20 nt, Human
ccucaguggacuuuccaccc

SEQ ID NO: 2066791 - RNA, 23 nt, Human
ccuccaaucccaccaacccucag

SEQ ID NO: 2066792 - RNA, 14 nt, Human
ccucaucugucugg

SEQ ID NO: 2066793 - RNA, 15 nt, Human
ccuccacagccgcag

SEQ ID NO: 2066794 - RNA, 16 nt, Human
ccuccacagccgcagc

SEQ ID NO: 2066795 - RNA, 17 nt, Human
ccuccacagccgcagcc

SEQ ID NO: 2066796 - RNA, 11 nt, Human
ccuccacagcu

SEQ ID NO: 2066797 - RNA, 12 nt, Human
ccuccacagcuu

SEQ ID NO: 2066798 - RNA, 16 nt, Human
ccucccaaagugcugg

SEQ ID NO: 2066799 - RNA, 20 nt, Human
ccuccccauuagagucagcc

SEQ ID NO: 2066800 - RNA, 15 nt, Human
ccuccauucugacca

SEQ ID NO: 2066801 - RNA, 21 nt, Human
ccuccccauuagagucagccu

SEQ ID NO: 2066802 - RNA, 13 nt, Human
ccucccccaaccc

SEQ ID NO: 2066803 - RNA, 18 nt, Human
ccucccccaacccccacc

SEQ ID NO: 2066804 - RNA, 19 nt, Human
ccucccccaacccccaccc

SEQ ID NO: 2066805 - RNA, 22 nt, Human
ccucccccaacccccaccccac

SEQ ID NO: 2066806 - RNA, 15 nt, Human
ccuccaugcugccuc

SEQ ID NO: 2066807 - RNA, 20 nt, Human
ccuccauuccuggagcccga

SEQ ID NO: 2066808 - RNA, 15 nt, Human
ccucccaaagugcug

SEQ ID NO: 2066809 - RNA, 14 nt, Human
ccuccaugcugccu

SEQ ID NO: 2066810 - RNA, 23 nt, Human
ccuccaugugggcuaguugggcu

SEQ ID NO: 2066811 - RNA, 21 nt, Human
ccuccagggccacgugccagg

SEQ ID NO: 2066812 - RNA, 22 nt, Human
ccuccagggccacgugccaggc

SEQ ID NO: 2066813 - RNA, 22 nt, Human
ccuccagcccucucacuguguc

SEQ ID NO: 2066814 - RNA, 12 nt, Human
ccuccagggcca

SEQ ID NO: 2066815 - RNA, 14 nt, Human
ccuccagggccacg

SEQ ID NO: 2066816 - RNA, 16 nt, Human
ccuccagggccacgug

SEQ ID NO: 2066817 - RNA, 17 nt, Human
ccuccagggccacgugc

SEQ ID NO: 2066818 - RNA, 18 nt, Human
ccuccagggccacgugcc

SEQ ID NO: 2066819 - RNA, 19 nt, Human
ccuccagggccacgugcca

SEQ ID NO: 2066820 - RNA, 20 nt, Human
ccuccagggccacgugccag

SEQ ID NO: 2066821 - RNA, 11 nt, Human
ccuccacuccu

SEQ ID NO: 2066822 - RNA, 18 nt, Human
ccuccagaagccucuggc

SEQ ID NO: 2066823 - RNA, 15 nt, Human
ccuccacuccuuccu

SEQ ID NO: 2066824 - RNA, 19 nt, Human
ccuccagaagccucuggcu

SEQ ID NO: 2066825 - RNA, 20 nt, Human
ccuccagaagccucuggcua

SEQ ID NO: 2066826 - RNA, 21 nt, Human
ccuccagaagccucuggcuag

SEQ ID NO: 2066827 - RNA, 22 nt, Human
ccuccagaagccucuggcuaga

SEQ ID NO: 2066828 - RNA, 17 nt, Human
ccuccacguucaccccu

SEQ ID NO: 2066829 - RNA, 18 nt, Human
ccuccacguucaccccuc

SEQ ID NO: 2066830 - RNA, 13 nt, Human
ccuccaccgcugc

SEQ ID NO: 2066831 - RNA, 14 nt, Human
ccuccaccgcugcc

SEQ ID NO: 2066832 - RNA, 15 nt, Human
ccuccaccgcugccu

SEQ ID NO: 2066833 - RNA, 17 nt, Human
ccuccaccccccagaac

SEQ ID NO: 2066834 - RNA, 17 nt, Human
ccuccccuucccugcaa

SEQ ID NO: 2066835 - RNA, 13 nt, Human
ccuccccccacug

SEQ ID NO: 2066836 - RNA, 14 nt, Human
ccuccccccacugc

SEQ ID NO: 2066837 - RNA, 15 nt, Human
ccucccccagagggg

SEQ ID NO: 2066838 - RNA, 16 nt, Human
ccuccccccacugcag

SEQ ID NO: 2066839 - RNA, 15 nt, Human
ccuccccccacugca

SEQ ID NO: 2066840 - RNA, 21 nt, Human
ccucccgaguagcugggacua

SEQ ID NO: 2066841 - RNA, 20 nt, Human
ccucccgaguagcugggacu

SEQ ID NO: 2066842 - RNA, 11 nt, Human
ccucccucagc

SEQ ID NO: 2066843 - RNA, 12 nt, Human
ccucccucagcc

SEQ ID NO: 2066844 - RNA, 19 nt, Human
ccucccgaguagcugggac

SEQ ID NO: 2066845 - RNA, 24 nt, Human
ccucccugccccucccuucaacca

SEQ ID NO: 2066846 - RNA, 22 nt, Human
ccucccugccccucccuucaac

SEQ ID NO: 2066847 - RNA, 13 nt, Human
ccucccugccccu

SEQ ID NO: 2066848 - RNA, 21 nt, Human
ccucccugccccucccuucaa

SEQ ID NO: 2066849 - RNA, 18 nt, Human
ccucccugccccucccuu

SEQ ID NO: 2066850 - RNA, 14 nt, Human
ccucccucagcccc

SEQ ID NO: 2066851 - RNA, 15 nt, Human
ccucccucagccccu

SEQ ID NO: 2066852 - RNA, 16 nt, Human
ccucccucagccccuc

SEQ ID NO: 2066853 - RNA, 17 nt, Human
ccucccuccccugcccu

SEQ ID NO: 2066854 - RNA, 18 nt, Human
ccucccuccccugcccuc

SEQ ID NO: 2066855 - RNA, 10 nt, Human
ccucccuccc

SEQ ID NO: 2066856 - RNA, 20 nt, Human
ccucccucagccccucuugc

SEQ ID NO: 2066857 - RNA, 20 nt, Human
ccuccugaaacuuacacaca

SEQ ID NO: 2066858 - RNA, 21 nt, Human
ccuccugaaacuuacacacaa

SEQ ID NO: 2066859 - RNA, 18 nt, Human
ccuccucuguccagggcc

SEQ ID NO: 2066860 - RNA, 14 nt, Human
ccuccucugucccu

SEQ ID NO: 2066861 - RNA, 12 nt, Human
ccuccucugucc

SEQ ID NO: 2066862 - RNA, 15 nt, Human
ccuccucuguccagg

SEQ ID NO: 2066863 - RNA, 16 nt, Human
ccuccucuguccaggg

SEQ ID NO: 2066864 - RNA, 15 nt, Human
ccuccuccacaccag

SEQ ID NO: 2066865 - RNA, 14 nt, Human
ccuccugggcuaag

SEQ ID NO: 2066866 - RNA, 23 nt, Human
ccuccugccucgaacuggcugca

SEQ ID NO: 2066867 - RNA, 15 nt, Human
ccuccugaccuguca

SEQ ID NO: 2066868 - RNA, 15 nt, Human
ccuccugcuacucug

SEQ ID NO: 2066869 - RNA, 19 nt, Human
ccucuagaaauuuuucaga

SEQ ID NO: 2066870 - RNA, 14 nt, Human
ccucuagaggcaag

SEQ ID NO: 2066871 - RNA, 17 nt, Human
ccucuaacaggggcugg

SEQ ID NO: 2066872 - RNA, 18 nt, Human
ccucuaacaggggcuggu

SEQ ID NO: 2066873 - RNA, 21 nt, Human
ccucuaacaggggcugguggg

SEQ ID NO: 2066874 - RNA, 23 nt, Human
ccucuaacaggggcuggugggca

SEQ ID NO: 2066875 - RNA, 18 nt, Human
ccucgguguggagaagcg

SEQ ID NO: 2066876 - RNA, 18 nt, Human
ccucguggccuuccccag

SEQ ID NO: 2066877 - RNA, 19 nt, Human
ccucguggccuuccccagc

SEQ ID NO: 2066878 - RNA, 22 nt, Human
ccucguggccuuccccagccuc

SEQ ID NO: 2066879 - RNA, 23 nt, Human
ccucguggccuuccccagccucu

SEQ ID NO: 2066880 - RNA, 22 nt, Human
ccucguuagggaagagaaacag

SEQ ID NO: 2066881 - RNA, 23 nt, Human
ccucguuagggaagagaaacagg

SEQ ID NO: 2066882 - RNA, 16 nt, Human
ccucggugccuuccuc

SEQ ID NO: 2066883 - RNA, 14 nt, Human
ccucgguguggaga

SEQ ID NO: 2066884 - RNA, 14 nt, Human
ccuccuuccuugac

SEQ ID NO: 2066885 - RNA, 15 nt, Human
ccuccuuccuugacc

SEQ ID NO: 2066886 - RNA, 18 nt, Human
ccuccuuccuugaccagc

SEQ ID NO: 2066887 - RNA, 20 nt, Human
ccuccuuccuugaccagcag

SEQ ID NO: 2066888 - RNA, 20 nt, Human
ccuccuuccuugcuguccua

SEQ ID NO: 2066889 - RNA, 15 nt, Human
ccuccuucucccuuu

SEQ ID NO: 2066890 - RNA, 16 nt, Human
ccuccuucucccuuuu

SEQ ID NO: 2066891 - RNA, 17 nt, Human
ccuccuucucccuuuuu

SEQ ID NO: 2066892 - RNA, 22 nt, Human
ccucgggcgagucacugccucu

SEQ ID NO: 2066893 - RNA, 14 nt, Human
ccuccuucccagcu

SEQ ID NO: 2066894 - RNA, 16 nt, Human
ccuccuucccagcugc

SEQ ID NO: 2066895 - RNA, 18 nt, Human
ccuccuucccagcugccc

SEQ ID NO: 2066896 - RNA, 21 nt, Human
ccuccuucccagcugccccuc

SEQ ID NO: 2066897 - RNA, 13 nt, Human
ccucuagugcccu

SEQ ID NO: 2066898 - RNA, 14 nt, Human
ccucuagugcccuc

SEQ ID NO: 2066899 - RNA, 15 nt, Human
ccucuagugcccucc

SEQ ID NO: 2066900 - RNA, 16 nt, Human
ccucuauuuagcauga

SEQ ID NO: 2066901 - RNA, 17 nt, Human
ccucccgaauagcuggg

SEQ ID NO: 2066902 - RNA, 16 nt, Human
ccgcacccccacccuu

SEQ ID NO: 2066903 - RNA, 11 nt, Human
ccgcaccccag

SEQ ID NO: 2066904 - RNA, 13 nt, Human
ccgcaccccagag

SEQ ID NO: 2066905 - RNA, 17 nt, Human
ccgcaccccagagugug

SEQ ID NO: 2066906 - RNA, 15 nt, Human
ccgcacccccacccu

SEQ ID NO: 2066907 - RNA, 21 nt, Human
ccgcaaugugcccccagacgc

SEQ ID NO: 2066908 - RNA, 16 nt, Human
ccgcgccuccuuccuu

SEQ ID NO: 2066909 - RNA, 17 nt, Human
ccgcaaaacccacugac

SEQ ID NO: 2066910 - RNA, 23 nt, Human
ccgccuucacuccggugugccug

SEQ ID NO: 2066911 - RNA, 17 nt, Human
ccgcgucuggugacaac

SEQ ID NO: 2066912 - RNA, 13 nt, Human
ccgcucagcccuc

SEQ ID NO: 2066913 - RNA, 12 nt, Human
ccgcucagcccu

SEQ ID NO: 2066914 - RNA, 11 nt, Human
ccgcucagccc

SEQ ID NO: 2066915 - RNA, 17 nt, Human
ccgaguagcugggacua

SEQ ID NO: 2066916 - RNA, 20 nt, Human
ccgaguagcugggacuacag

SEQ ID NO: 2066917 - RNA, 16 nt, Human
ccgauuguaacucaaa

SEQ ID NO: 2066918 - RNA, 13 nt, Human
ccgauuguaacuc

SEQ ID NO: 2066919 - RNA, 13 nt, Human
ccgauucacccug

SEQ ID NO: 2066920 - RNA, 14 nt, Human
ccgaggccuucucu

SEQ ID NO: 2066921 - RNA, 19 nt, Human
ccgaggcaccaguguccuc

SEQ ID NO: 2066922 - RNA, 14 nt, Human
ccgaggcaggguca

SEQ ID NO: 2066923 - RNA, 20 nt, Human
ccgaggcagggucaggagag

SEQ ID NO: 2066924 - RNA, 15 nt, Human
cccugguuucacugg

SEQ ID NO: 2066925 - RNA, 20 nt, Human
cccugguuucacuggcccaa

SEQ ID NO: 2066926 - RNA, 20 nt, Human
ccgggcgcgguggcucacgc

SEQ ID NO: 2066927 - RNA, 22 nt, Human
ccgggcuccccuuucgcccaca

SEQ ID NO: 2066928 - RNA, 13 nt, Human
ccgggcucucugc

SEQ ID NO: 2066929 - RNA, 19 nt, Human
ccgggcugggagcucugca

SEQ ID NO: 2066930 - RNA, 18 nt, Human
ccgggcugggagcucugc

SEQ ID NO: 2066931 - RNA, 13 nt, Human
ccgggcugggagc

SEQ ID NO: 2066932 - RNA, 14 nt, Human
ccgggcucucugcu

SEQ ID NO: 2066933 - RNA, 16 nt, Human
ccgggcucucugcugu

SEQ ID NO: 2066934 - RNA, 21 nt, Human
ccggguuuggcgggccaagga

SEQ ID NO: 2066935 - RNA, 22 nt, Human
ccggguuuggcgggccaaggac

SEQ ID NO: 2066936 - RNA, 19 nt, Human
ccggguuuggcgggccaag

SEQ ID NO: 2066937 - RNA, 20 nt, Human
ccggguuuggcgggccaagg

SEQ ID NO: 2066938 - RNA, 20 nt, Human
ccgcucaggcugaccacuuu

SEQ ID NO: 2066939 - RNA, 22 nt, Human
ccgcucagcccucccugccccu

SEQ ID NO: 2066940 - RNA, 21 nt, Human
ccgcucagcccucccugcccc

SEQ ID NO: 2066941 - RNA, 19 nt, Human
ccgcucagcccucccugcc

SEQ ID NO: 2066942 - RNA, 15 nt, Human
ccgcucagcccuccc

SEQ ID NO: 2066943 - RNA, 12 nt, Human
ccgcuuucuacc

SEQ ID NO: 2066944 - RNA, 16 nt, Human
ccgcuuguccagcgcc

SEQ ID NO: 2066945 - RNA, 17 nt, Human
ccgcuuguccagcgccu

SEQ ID NO: 2066946 - RNA, 19 nt, Human
ccgcuuucuacccagcgag

SEQ ID NO: 2066947 - RNA, 18 nt, Human
ccgcuuguccagcgccua

SEQ ID NO: 2066948 - RNA, 19 nt, Human
ccgcuuguccagcgccuag

SEQ ID NO: 2066949 - RNA, 13 nt, Human
ccuaccaccuccc

SEQ ID NO: 2066950 - RNA, 18 nt, Human
ccuaccaccuccccagcc

SEQ ID NO: 2066951 - RNA, 13 nt, Human
ccuaccacagugu

SEQ ID NO: 2066952 - RNA, 14 nt, Human
ccuaccacaguguc

SEQ ID NO: 2066953 - RNA, 15 nt, Human
ccuaccacagugucu

SEQ ID NO: 2066954 - RNA, 16 nt, Human
ccuaccacagugucug

SEQ ID NO: 2066955 - RNA, 23 nt, Human
ccuaccgagucucuucuccacug

SEQ ID NO: 2066956 - RNA, 22 nt, Human
ccuaccgagucucuucuccacu

SEQ ID NO: 2066957 - RNA, 20 nt, Human
ccuaccggcaauuuccggcc

SEQ ID NO: 2066958 - RNA, 17 nt, Human
ccuaccucaaccuguaa

SEQ ID NO: 2066959 - RNA, 18 nt, Human
ccuaccucaaccuguaaa

SEQ ID NO: 2066960 - RNA, 20 nt, Human
ccuaccucaaccuguaaauu

SEQ ID NO: 2066961 - RNA, 22 nt, Human
ccuaccucaaccuguaaauuau

SEQ ID NO: 2066962 - RNA, 12 nt, Human
ccuaccucagcc

SEQ ID NO: 2066963 - RNA, 21 nt, Human
ccuaccggcaauuuccggcca

SEQ ID NO: 2066964 - RNA, 13 nt, Human
ccuaccucagccu

SEQ ID NO: 2066965 - RNA, 14 nt, Human
ccuaccucagccua

SEQ ID NO: 2066966 - RNA, 16 nt, Human
ccuaccucagccuaga

SEQ ID NO: 2066967 - RNA, 14 nt, Human
ccuacuuuuccuuc

SEQ ID NO: 2066968 - RNA, 16 nt, Human
ccuacuuuuccuuccc

SEQ ID NO: 2066969 - RNA, 17 nt, Human
ccuaggcugaccuugaa

SEQ ID NO: 2066970 - RNA, 20 nt, Human
ccuagggauguucuggcccu

SEQ ID NO: 2066971 - RNA, 14 nt, Human
ccuagggaaaaguu

SEQ ID NO: 2066972 - RNA, 14 nt, Human
ccuagggccugguc

SEQ ID NO: 2066973 - RNA, 16 nt, Human
ccuagggccuggucca

SEQ ID NO: 2066974 - RNA, 13 nt, Human
ccuagggcugggu

SEQ ID NO: 2066975 - RNA, 14 nt, Human
ccuagggcugggug

SEQ ID NO: 2066976 - RNA, 15 nt, Human
ccuagggcugggugu

SEQ ID NO: 2066977 - RNA, 15 nt, Human
ccuacuuccugugac

SEQ ID NO: 2066978 - RNA, 15 nt, Human
ccuaccucaggcagg

SEQ ID NO: 2066979 - RNA, 18 nt, Human
ccuaccucagccuagacc

SEQ ID NO: 2066980 - RNA, 21 nt, Human
ccuaccucagccuagacccuc

SEQ ID NO: 2066981 - RNA, 13 nt, Human
ccuacuuccugug

SEQ ID NO: 2066982 - RNA, 18 nt, Human
ccuauauuguuuucagug

SEQ ID NO: 2066983 - RNA, 16 nt, Human
ccuauauaguuuauug

SEQ ID NO: 2066984 - RNA, 14 nt, Human
ccuauauguaguau

SEQ ID NO: 2066985 - RNA, 22 nt, Human
ccuauauuguuuucaguguaca

SEQ ID NO: 2066986 - RNA, 13 nt, Human
ccuauaaugcugg

SEQ ID NO: 2066987 - RNA, 20 nt, Human
ccuauaccccuuacuuagca

SEQ ID NO: 2066988 - RNA, 23 nt, Human
ccuauaccccuuacuuagcaugc

SEQ ID NO: 2066989 - RNA, 13 nt, Human
ccuauagucccag

SEQ ID NO: 2066990 - RNA, 15 nt, Human
ccuauagucccagcu

SEQ ID NO: 2066991 - RNA, 18 nt, Human
ccuauagucccagcuacu

SEQ ID NO: 2066992 - RNA, 20 nt, Human
ccuauaaaacaggucaauac

SEQ ID NO: 2066993 - RNA, 23 nt, Human
ccuauaaaacaggucaauacagu

SEQ ID NO: 2066994 - RNA, 12 nt, Human
ccuauaaaacag

SEQ ID NO: 2066995 - RNA, 13 nt, Human
ccuaguucuucau

SEQ ID NO: 2066996 - RNA, 21 nt, Human
ccuaguucauccaauccucac

SEQ ID NO: 2066997 - RNA, 24 nt, Human
ccuaguggggucucccucuccugc

SEQ ID NO: 2066998 - RNA, 18 nt, Human
ccuaggggucagggacca

SEQ ID NO: 2066999 - RNA, 15 nt, Human
ccuaggggucaggga

SEQ ID NO: 2067000 - RNA, 23 nt, Human
ccuaguggggucucccucuccug

SEQ ID NO: 2067001 - RNA, 21 nt, Human
ccuacaccauuaucuuggaaa

SEQ ID NO: 2067002 - RNA, 19 nt, Human
ccuaaauaaacacauagau

SEQ ID NO: 2067003 - RNA, 23 nt, Human
ccuaaauaaacacauagauucac

SEQ ID NO: 2067004 - RNA, 19 nt, Human
ccuacaagagcagccugug

SEQ ID NO: 2067005 - RNA, 17 nt, Human
ccuacaagagcagccug

SEQ ID NO: 2067006 - RNA, 18 nt, Human
ccuacaagagcagccugu

SEQ ID NO: 2067007 - RNA, 21 nt, Human
ccuacaagagcagccuguggc

SEQ ID NO: 2067008 - RNA, 15 nt, Human
ccuaaaauucagugg

SEQ ID NO: 2067009 - RNA, 22 nt, Human
ccgugcuuguuugcucaccugg

SEQ ID NO: 2067010 - RNA, 20 nt, Human
ccgugcuuguuugcucaccu

SEQ ID NO: 2067011 - RNA, 23 nt, Human
ccgugcuuguuugcucaccuggg

SEQ ID NO: 2067012 - RNA, 13 nt, Human
ccgugugcccucg

SEQ ID NO: 2067013 - RNA, 16 nt, Human
ccguguggccccuuca

SEQ ID NO: 2067014 - RNA, 22 nt, Human
ccuaaaaggaaaucucacccca

SEQ ID NO: 2067015 - RNA, 16 nt, Human
ccgugugcccucgggc

SEQ ID NO: 2067016 - RNA, 13 nt, Human
ccguguggccccu

SEQ ID NO: 2067017 - RNA, 14 nt, Human
ccguguggccccuu

SEQ ID NO: 2067018 - RNA, 15 nt, Human
ccguguggccccuuc

SEQ ID NO: 2067019 - RNA, 23 nt, Human
ccuaaaaggaaaucucaccccau

SEQ ID NO: 2067020 - RNA, 22 nt, Human
ccuaaaaguucauaacagugcc

SEQ ID NO: 2067021 - RNA, 23 nt, Human
ccuaaaaguucauaacagugcca

SEQ ID NO: 2067022 - RNA, 14 nt, Human
ccuauagucccagc

SEQ ID NO: 2067023 - RNA, 16 nt, Human
cuuagaaguggaagua

SEQ ID NO: 2067024 - RNA, 16 nt, Human
cuuagaaauugcauuu

SEQ ID NO: 2067025 - RNA, 17 nt, Human
cuuagaaguggaccagg

SEQ ID NO: 2067026 - RNA, 18 nt, Human
cuuagaaguggaccagga

SEQ ID NO: 2067027 - RNA, 20 nt, Human
cuuagaaguggaccaggaca

SEQ ID NO: 2067028 - RNA, 21 nt, Human
cuuagaaguggaccaggacag

SEQ ID NO: 2067029 - RNA, 22 nt, Human
cuuagaaguggaccaggacagg

SEQ ID NO: 2067030 - RNA, 23 nt, Human
cuuagaaguggaccaggacagga

SEQ ID NO: 2067031 - RNA, 20 nt, Human
cuuagaagucacacaguauu

SEQ ID NO: 2067032 - RNA, 17 nt, Human
cuuagaagucacacagu

SEQ ID NO: 2067033 - RNA, 11 nt, Human
cuuacugcuug

SEQ ID NO: 2067034 - RNA, 20 nt, Human
cuuagaaaaaccaccaccau

SEQ ID NO: 2067035 - RNA, 13 nt, Human
cuuacugcagaau

SEQ ID NO: 2067036 - RNA, 22 nt, Human
cuuaccuucaauaaaguaucua

SEQ ID NO: 2067037 - RNA, 12 nt, Human
cuuacugaaggu

SEQ ID NO: 2067038 - RNA, 14 nt, Human
cuuaauuuucagua

SEQ ID NO: 2067039 - RNA, 18 nt, Human
cuuaauuuucaguauaau

SEQ ID NO: 2067040 - RNA, 15 nt, Human
cuuaccuucaauaaa

SEQ ID NO: 2067041 - RNA, 16 nt, Human
cuuaccuucaauaaag

SEQ ID NO: 2067042 - RNA, 17 nt, Human
cuuaccuucaauaaagu

SEQ ID NO: 2067043 - RNA, 18 nt, Human
cuuaccuucaauaaagua

SEQ ID NO: 2067044 - RNA, 21 nt, Human
cuuaccuucaauaaaguaucu

SEQ ID NO: 2067045 - RNA, 23 nt, Human
cuuagguuggcaaaaaggcagga

SEQ ID NO: 2067046 - RNA, 21 nt, Human
cuuagguuggcaaaaaggcag

SEQ ID NO: 2067047 - RNA, 17 nt, Human
cuuagacuugaaauacu

SEQ ID NO: 2067048 - RNA, 20 nt, Human
cuuagaccucagccugugcu

SEQ ID NO: 2067049 - RNA, 17 nt, Human
cuuagaccucagccugu

SEQ ID NO: 2067050 - RNA, 18 nt, Human
cuuagaccucagccugug

SEQ ID NO: 2067051 - RNA, 16 nt, Human
cuuagacuugaaauac

SEQ ID NO: 2067052 - RNA, 12 nt, Human
cuuagaccucag

SEQ ID NO: 2067053 - RNA, 13 nt, Human
cuuagaccucagc

SEQ ID NO: 2067054 - RNA, 14 nt, Human
cuuagaccucagcc

SEQ ID NO: 2067055 - RNA, 15 nt, Human
cuuagaccucagccu

SEQ ID NO: 2067056 - RNA, 16 nt, Human
cuuagaccucagccug

SEQ ID NO: 2067057 - RNA, 14 nt, Human
cuuaauauguuaac

SEQ ID NO: 2067058 - RNA, 13 nt, Human
cuuaauuaaguaa

SEQ ID NO: 2067059 - RNA, 15 nt, Human
cuuaauuaaguaaac

SEQ ID NO: 2067060 - RNA, 19 nt, Human
cuuaauuaaguaaacuaau

SEQ ID NO: 2067061 - RNA, 21 nt, Human
cuuaauuaaguaaacuaauga

SEQ ID NO: 2067062 - RNA, 18 nt, Human
cuuaagaauuuugagcag

SEQ ID NO: 2067063 - RNA, 14 nt, Human
cuuaacauucugua

SEQ ID NO: 2067064 - RNA, 17 nt, Human
cuuaacauucuguaaaa

SEQ ID NO: 2067065 - RNA, 20 nt, Human
cuuaacauuucuaacucuga

SEQ ID NO: 2067066 - RNA, 24 nt, Human
cuuaacauuucuaacucugaugua

SEQ ID NO: 2067067 - RNA, 20 nt, Human
cuuaaaaaucauugauuguc

SEQ ID NO: 2067068 - RNA, 19 nt, Human
cuuaacaaacccucguuuc

SEQ ID NO: 2067069 - RNA, 23 nt, Human
cuuaacaaacccucguuucugau

SEQ ID NO: 2067070 - RNA, 12 nt, Human
cuuaaaaaguua

SEQ ID NO: 2067071 - RNA, 18 nt, Human
cuuaaaaagucugcauua

SEQ ID NO: 2067072 - RNA, 22 nt, Human
cuuaaaaagucugcauuacauu

SEQ ID NO: 2067073 - RNA, 14 nt, Human
cuuaaaaaguuaua

SEQ ID NO: 2067074 - RNA, 18 nt, Human
cuuaaauuuuaauuuauu

SEQ ID NO: 2067075 - RNA, 12 nt, Human
cuuaagcuuccg

SEQ ID NO: 2067076 - RNA, 19 nt, Human
cuuaagaccaccucaaauu

SEQ ID NO: 2067077 - RNA, 20 nt, Human
cuuaagaccaccucaaauuu

SEQ ID NO: 2067078 - RNA, 21 nt, Human
cuuaagaccaccucaaauuua

SEQ ID NO: 2067079 - RNA, 23 nt, Human
cuuaagaccaccucaaauuuaaa

SEQ ID NO: 2067080 - RNA, 23 nt, Human
cuuaagcuaggauguugcucaga

SEQ ID NO: 2067081 - RNA, 20 nt, Human
cuuaaggauugugauauuuu

SEQ ID NO: 2067082 - RNA, 22 nt, Human
cuguuuuguuuuguuuuuuaaa

SEQ ID NO: 2067083 - RNA, 16 nt, Human
cuuaauaguauuuaug

SEQ ID NO: 2067084 - RNA, 17 nt, Human
cuuaauaguauuuauga

SEQ ID NO: 2067085 - RNA, 18 nt, Human
cuguucuuaagacgugau

SEQ ID NO: 2067086 - RNA, 17 nt, Human
cuguucuguuuugccug

SEQ ID NO: 2067087 - RNA, 16 nt, Human
cuguuaagugguuuca

SEQ ID NO: 2067088 - RNA, 16 nt, Human
cuguuaauaguucagg

SEQ ID NO: 2067089 - RNA, 14 nt, Human
cuguuaagagagga

SEQ ID NO: 2067090 - RNA, 16 nt, Human
cuguugcccaggcugg

SEQ ID NO: 2067091 - RNA, 15 nt, Human
cuguugcccaggcug

SEQ ID NO: 2067092 - RNA, 14 nt, Human
cuguugcccaggcu

SEQ ID NO: 2067093 - RNA, 13 nt, Human
cuguugcccaggc

SEQ ID NO: 2067094 - RNA, 12 nt, Human
cuguugcccagg

SEQ ID NO: 2067095 - RNA, 13 nt, Human
cuguugccacaac

SEQ ID NO: 2067096 - RNA, 22 nt, Human
cuguugaaaagccauguuuaag

SEQ ID NO: 2067097 - RNA, 20 nt, Human
cuguugacauccaagcuucc

SEQ ID NO: 2067098 - RNA, 17 nt, Human
cuguugaauuucccaca

SEQ ID NO: 2067099 - RNA, 15 nt, Human
cuguugauugcagga

SEQ ID NO: 2067100 - RNA, 15 nt, Human
cuguugagcuguuuu

SEQ ID NO: 2067101 - RNA, 20 nt, Human
cuguugagcuguuuucccug

SEQ ID NO: 2067102 - RNA, 23 nt, Human
cuguugacauccaagcuuccuuu

SEQ ID NO: 2067103 - RNA, 17 nt, Human
cuguuucaacacagacc

SEQ ID NO: 2067104 - RNA, 17 nt, Human
cuguugcccaggcuggc

SEQ ID NO: 2067105 - RNA, 18 nt, Human
cuguugcccaggcuggcg

SEQ ID NO: 2067106 - RNA, 13 nt, Human
cuguugccagaga

SEQ ID NO: 2067107 - RNA, 17 nt, Human
cuguugccagagaugga

SEQ ID NO: 2067108 - RNA, 11 nt, Human
cuguuugucau

SEQ ID NO: 2067109 - RNA, 14 nt, Human
cuguuuguuaaaac

SEQ ID NO: 2067110 - RNA, 12 nt, Human
cuguuuguuaug

SEQ ID NO: 2067111 - RNA, 22 nt, Human
cuguuuuacaaaaaagaaaaga

SEQ ID NO: 2067112 - RNA, 13 nt, Human
cuguuuucccuga

SEQ ID NO: 2067113 - RNA, 12 nt, Human
cuguuuuacugc

SEQ ID NO: 2067114 - RNA, 13 nt, Human
cuguuuuacugcu

SEQ ID NO: 2067115 - RNA, 15 nt, Human
cuguuuuacugcuuu

SEQ ID NO: 2067116 - RNA, 17 nt, Human
cuguuuuacugcuuuua

SEQ ID NO: 2067117 - RNA, 17 nt, Human
cuguuuuucagggaggu

SEQ ID NO: 2067118 - RNA, 16 nt, Human
cuuaaaaaguggaaaa

SEQ ID NO: 2067119 - RNA, 17 nt, Human
cuuaaaaaguggaaaaa

SEQ ID NO: 2067120 - RNA, 17 nt, Human
cuguuuuuaaaaaucau

SEQ ID NO: 2067121 - RNA, 15 nt, Human
cuguuuuuaagcugu

SEQ ID NO: 2067122 - RNA, 23 nt, Human
cuguuuuuaagcuguuuccauag

SEQ ID NO: 2067123 - RNA, 19 nt, Human
cuguuuuuaagcuguuucc

SEQ ID NO: 2067124 - RNA, 18 nt, Human
cuguuuuuaagcuguuuc

SEQ ID NO: 2067125 - RNA, 17 nt, Human
cuguuuuuaagcuguuu

SEQ ID NO: 2067126 - RNA, 16 nt, Human
cuguuuuuaagcuguu

SEQ ID NO: 2067127 - RNA, 10 nt, Human
cuucccuggc

SEQ ID NO: 2067128 - RNA, 11 nt, Human
cuucccuggcu

SEQ ID NO: 2067129 - RNA, 12 nt, Human
cuucccuggcuu

SEQ ID NO: 2067130 - RNA, 15 nt, Human
cuuccucacccugau

SEQ ID NO: 2067131 - RNA, 12 nt, Human
cuuccuauccca

SEQ ID NO: 2067132 - RNA, 14 nt, Human
cuuccuaucccauc

SEQ ID NO: 2067133 - RNA, 16 nt, Human
cuuccuaucccauccc

SEQ ID NO: 2067134 - RNA, 17 nt, Human
cuuccuaucccauccca

SEQ ID NO: 2067135 - RNA, 18 nt, Human
cuuccuaucccaucccau

SEQ ID NO: 2067136 - RNA, 15 nt, Human
cuuccugccuggucu

SEQ ID NO: 2067137 - RNA, 16 nt, Human
cuuccugccuggucuc

SEQ ID NO: 2067138 - RNA, 17 nt, Human
cuuccugccuggucucc

SEQ ID NO: 2067139 - RNA, 18 nt, Human
cuuccugccuggucuccu

SEQ ID NO: 2067140 - RNA, 13 nt, Human
cuuccugugacuu

SEQ ID NO: 2067141 - RNA, 14 nt, Human
cuuccuguccgccc

SEQ ID NO: 2067142 - RNA, 15 nt, Human
cuuccuguccgcccu

SEQ ID NO: 2067143 - RNA, 17 nt, Human
cuuccuguccgcccucu

SEQ ID NO: 2067144 - RNA, 22 nt, Human
cuuccuguccgcccucuucccc

SEQ ID NO: 2067145 - RNA, 20 nt, Human
cuuccugucuuccugcauuc

SEQ ID NO: 2067146 - RNA, 16 nt, Human
cuuccugugacuucag

SEQ ID NO: 2067147 - RNA, 11 nt, Human
cuuccccacug

SEQ ID NO: 2067148 - RNA, 14 nt, Human
cuuccccacugccu

SEQ ID NO: 2067149 - RNA, 16 nt, Human
cuuccccacugccugc

SEQ ID NO: 2067150 - RNA, 19 nt, Human
cuuccccacugccugccca

SEQ ID NO: 2067151 - RNA, 20 nt, Human
cuuccccacugccugcccac

SEQ ID NO: 2067152 - RNA, 22 nt, Human
cuuccccacugccugcccaccc

SEQ ID NO: 2067153 - RNA, 19 nt, Human
cuuccccagaaaggagacu

SEQ ID NO: 2067154 - RNA, 17 nt, Human
cuuccacugauggaaac

SEQ ID NO: 2067155 - RNA, 15 nt, Human
cuucccccuccaauc

SEQ ID NO: 2067156 - RNA, 16 nt, Human
cuucccccucccaggg

SEQ ID NO: 2067157 - RNA, 20 nt, Human
cuucccccgcaaugugcccc

SEQ ID NO: 2067158 - RNA, 13 nt, Human
cuucccuaccuca

SEQ ID NO: 2067159 - RNA, 15 nt, Human
cuucccuaccucagg

SEQ ID NO: 2067160 - RNA, 16 nt, Human
cuucccuaccucaggc

SEQ ID NO: 2067161 - RNA, 16 nt, Human
cuucccuagggcuggg

SEQ ID NO: 2067162 - RNA, 17 nt, Human
cuucccuagggcugggu

SEQ ID NO: 2067163 - RNA, 18 nt, Human
cuucccuagggcugggug

SEQ ID NO: 2067164 - RNA, 19 nt, Human
cuucccuagggcugggugu

SEQ ID NO: 2067165 - RNA, 17 nt, Human
cuucccuaccucaggca

SEQ ID NO: 2067166 - RNA, 20 nt, Human
cuucccuaccucaggcagga

SEQ ID NO: 2067167 - RNA, 20 nt, Human
cuucccuagaggguuccugu

SEQ ID NO: 2067168 - RNA, 23 nt, Human
cuucccuagaggguuccuguaga

SEQ ID NO: 2067169 - RNA, 12 nt, Human
cuucccccucca

SEQ ID NO: 2067170 - RNA, 18 nt, Human
cuucccccauagccaccc

SEQ ID NO: 2067171 - RNA, 14 nt, Human
cuucccccauagcc

SEQ ID NO: 2067172 - RNA, 15 nt, Human
cuucccccauagcca

SEQ ID NO: 2067173 - RNA, 16 nt, Human
cuucccccauagccac

SEQ ID NO: 2067174 - RNA, 13 nt, Human
cuuccccagccuc

SEQ ID NO: 2067175 - RNA, 14 nt, Human
cuuccccagccucu

SEQ ID NO: 2067176 - RNA, 23 nt, Human
cuuccccaacgaaaagcacaucc

SEQ ID NO: 2067177 - RNA, 16 nt, Human
cuucucacugccaugc

SEQ ID NO: 2067178 - RNA, 16 nt, Human
cuucucacucccuucu

SEQ ID NO: 2067179 - RNA, 20 nt, Human
cuucucacucccuucuccuu

SEQ ID NO: 2067180 - RNA, 17 nt, Human
cuucguuaacuguguau

SEQ ID NO: 2067181 - RNA, 20 nt, Human
cuucguuaacuguguaugua

SEQ ID NO: 2067182 - RNA, 21 nt, Human
cuucucacugccaugccagcu

SEQ ID NO: 2067183 - RNA, 15 nt, Human
cuucucauccugcag

SEQ ID NO: 2067184 - RNA, 16 nt, Human
cuucucauccugcagg

SEQ ID NO: 2067185 - RNA, 17 nt, Human
cuucucauccugcaggc

SEQ ID NO: 2067186 - RNA, 12 nt, Human
cuucucaucugu

SEQ ID NO: 2067187 - RNA, 19 nt, Human
cuucgggaggucgaggcag

SEQ ID NO: 2067188 - RNA, 21 nt, Human
cuucggcauugguucccuuug

SEQ ID NO: 2067189 - RNA, 19 nt, Human
cuucggggaacuccuggaa

SEQ ID NO: 2067190 - RNA, 18 nt, Human
cuucggggaacuccugga

SEQ ID NO: 2067191 - RNA, 22 nt, Human
cuuccuuuguuuuuuuuuccug

SEQ ID NO: 2067192 - RNA, 21 nt, Human
cuuccuuuuagccuaguucau

SEQ ID NO: 2067193 - RNA, 16 nt, Human
cuucgauacaccgggc

SEQ ID NO: 2067194 - RNA, 21 nt, Human
cuucgauacaccgggccugga

SEQ ID NO: 2067195 - RNA, 16 nt, Human
cuuccuuaccgugggc

SEQ ID NO: 2067196 - RNA, 19 nt, Human
cuucgcguauuucaggauu

SEQ ID NO: 2067197 - RNA, 17 nt, Human
cuucgcuccugugucuu

SEQ ID NO: 2067198 - RNA, 16 nt, Human
cuucgcuccugugucu

SEQ ID NO: 2067199 - RNA, 19 nt, Human
cuuccuuggcaucacaggg

SEQ ID NO: 2067200 - RNA, 15 nt, Human
cuucaguaagccgug

SEQ ID NO: 2067201 - RNA, 15 nt, Human
cuucagguucuuagu

SEQ ID NO: 2067202 - RNA, 19 nt, Human
cuucagguucuuaguguca

SEQ ID NO: 2067203 - RNA, 15 nt, Human
cuucagugcccacca

SEQ ID NO: 2067204 - RNA, 17 nt, Human
cuucagugcccaccaac

SEQ ID NO: 2067205 - RNA, 11 nt, Human
cuucagugccc

SEQ ID NO: 2067206 - RNA, 13 nt, Human
cuucagugcccac

SEQ ID NO: 2067207 - RNA, 19 nt, Human
cuucagugcaucugggaag

SEQ ID NO: 2067208 - RNA, 13 nt, Human
cuuccaaagcaca

SEQ ID NO: 2067209 - RNA, 12 nt, Human
cuucauuuuccc

SEQ ID NO: 2067210 - RNA, 13 nt, Human
cuucauuuuuccu

SEQ ID NO: 2067211 - RNA, 14 nt, Human
cuucauuuuuccua

SEQ ID NO: 2067212 - RNA, 16 nt, Human
cuucauuuuuccuaac

SEQ ID NO: 2067213 - RNA, 17 nt, Human
cuucauuuuuccuaaca

SEQ ID NO: 2067214 - RNA, 18 nt, Human
cuucagcauauuuauagc

SEQ ID NO: 2067215 - RNA, 15 nt, Human
cuucagcauccucag

SEQ ID NO: 2067216 - RNA, 14 nt, Human
cuucagccucccga

SEQ ID NO: 2067217 - RNA, 20 nt, Human
cuucagccuccccaccuucu

SEQ ID NO: 2067218 - RNA, 14 nt, Human
cuucagccugaggc

SEQ ID NO: 2067219 - RNA, 20 nt, Human
cuucagccucccgaguagcu

SEQ ID NO: 2067220 - RNA, 16 nt, Human
cuucagccucccgagu

SEQ ID NO: 2067221 - RNA, 14 nt, Human
cuucagcuugcuuc

SEQ ID NO: 2067222 - RNA, 10 nt, Human
cuucagaggc

SEQ ID NO: 2067223 - RNA, 19 nt, Human
cuucaggacacucacuaca

SEQ ID NO: 2067224 - RNA, 16 nt, Human
cuucaggacacucacu

SEQ ID NO: 2067225 - RNA, 14 nt, Human
cuucaguaagccgu

SEQ ID NO: 2067226 - RNA, 16 nt, Human
cuucagguggaaaaac

SEQ ID NO: 2067227 - RNA, 15 nt, Human
cuucagcugacuuuu

SEQ ID NO: 2067228 - RNA, 19 nt, Human
cuucagcugacuuuucugu

SEQ ID NO: 2067229 - RNA, 15 nt, Human
cuucagccugaggcu

SEQ ID NO: 2067230 - RNA, 16 nt, Human
cuucagccugaggcug

SEQ ID NO: 2067231 - RNA, 20 nt, Human
cuucagccugaggcugagac

SEQ ID NO: 2067232 - RNA, 22 nt, Human
cuucagccugaggcugagacug

SEQ ID NO: 2067233 - RNA, 11 nt, Human
cuucagagagc

SEQ ID NO: 2067234 - RNA, 21 nt, Human
cuucacauccuguguuucuag

SEQ ID NO: 2067235 - RNA, 14 nt, Human
cuucacaguguuuc

SEQ ID NO: 2067236 - RNA, 20 nt, Human
cuucacauccuguguuucua

SEQ ID NO: 2067237 - RNA, 14 nt, Human
cuucagagagcugg

SEQ ID NO: 2067238 - RNA, 15 nt, Human
cuucagagagcuggu

SEQ ID NO: 2067239 - RNA, 16 nt, Human
cuucagagagcuggua

SEQ ID NO: 2067240 - RNA, 22 nt, Human
cuucagagagcugguaguuagu

SEQ ID NO: 2067241 - RNA, 18 nt, Human
cuucagagauaggccugu

SEQ ID NO: 2067242 - RNA, 14 nt, Human
cuucagauccuacc

SEQ ID NO: 2067243 - RNA, 15 nt, Human
cuucagauccuaccc

SEQ ID NO: 2067244 - RNA, 16 nt, Human
cuucagauccuacccc

SEQ ID NO: 2067245 - RNA, 20 nt, Human
cuucagaucagugcuugagu

SEQ ID NO: 2067246 - RNA, 13 nt, Human
cuucagaggcuga

SEQ ID NO: 2067247 - RNA, 16 nt, Human
cuucagaggcugaggu

SEQ ID NO: 2067248 - RNA, 21 nt, Human
cuucagagguggcucuggaau

SEQ ID NO: 2067249 - RNA, 15 nt, Human
cuucagaucagugcu

SEQ ID NO: 2067250 - RNA, 17 nt, Human
cuucagaucagugcuug

SEQ ID NO: 2067251 - RNA, 18 nt, Human
cuucaauuuauugcacaa

SEQ ID NO: 2067252 - RNA, 19 nt, Human
cuucaauuuauugcacaaa

SEQ ID NO: 2067253 - RNA, 10 nt, Human
cuucaauuug

SEQ ID NO: 2067254 - RNA, 19 nt, Human
cuucaauuuguauaaaaug

SEQ ID NO: 2067255 - RNA, 12 nt, Human
cuucacaguguu

SEQ ID NO: 2067256 - RNA, 13 nt, Human
cuucacaguguuu

SEQ ID NO: 2067257 - RNA, 21 nt, Human
cuucacaauggugcucauuuc

SEQ ID NO: 2067258 - RNA, 16 nt, Human
cuucacacacaggcaa

SEQ ID NO: 2067259 - RNA, 17 nt, Human
cuucacacacaggcaac

SEQ ID NO: 2067260 - RNA, 15 nt, Human
cuucaaauauuuccc

SEQ ID NO: 2067261 - RNA, 24 nt, Human
cuucaacagacccccucuagaaau

SEQ ID NO: 2067262 - RNA, 18 nt, Human
cuucaagaacucugggcu

SEQ ID NO: 2067263 - RNA, 18 nt, Human
cuucaagcaccagggaag

SEQ ID NO: 2067264 - RNA, 23 nt, Human
cuucaacagacccccucuagaaa

SEQ ID NO: 2067265 - RNA, 17 nt, Human
cuucaacugaccagccu

SEQ ID NO: 2067266 - RNA, 23 nt, Human
cuucaacugaccagccuccaugc

SEQ ID NO: 2067267 - RNA, 20 nt, Human
cuucaacugaccagccucca

SEQ ID NO: 2067268 - RNA, 21 nt, Human
cuguacuccucccaggcgccc

SEQ ID NO: 2067269 - RNA, 19 nt, Human
cuguacuccucccaggcgc

SEQ ID NO: 2067270 - RNA, 16 nt, Human
cuguacuccucccagg

SEQ ID NO: 2067271 - RNA, 15 nt, Human
cuguacuccucccag

SEQ ID NO: 2067272 - RNA, 20 nt, Human
cuguacucaggaggcugagg

SEQ ID NO: 2067273 - RNA, 21 nt, Human
cuguaguuaggaaauaaaacc

SEQ ID NO: 2067274 - RNA, 22 nt, Human
cuguaguuaggaaauaaaaccu

SEQ ID NO: 2067275 - RNA, 20 nt, Human
cuguacgucugacaggcaau

SEQ ID NO: 2067276 - RNA, 19 nt, Human
cuguacgucugacaggcaa

SEQ ID NO: 2067277 - RNA, 14 nt, Human
cuguacuccuccca

SEQ ID NO: 2067278 - RNA, 22 nt, Human
cuguacuagucugugugggacu

SEQ ID NO: 2067279 - RNA, 13 nt, Human
cuguacucaggag

SEQ ID NO: 2067280 - RNA, 20 nt, Human
cuguacauauuugagacuag

SEQ ID NO: 2067281 - RNA, 18 nt, Human
cuguacgucugacaggca

SEQ ID NO: 2067282 - RNA, 16 nt, Human
cuguacgucugacagg

SEQ ID NO: 2067283 - RNA, 15 nt, Human
cuguacgucugacag

SEQ ID NO: 2067284 - RNA, 14 nt, Human
cuguacgucugaca

SEQ ID NO: 2067285 - RNA, 17 nt, Human
cuguauuuaugugugag

SEQ ID NO: 2067286 - RNA, 20 nt, Human
cuguauuuuguuuuugucuu

SEQ ID NO: 2067287 - RNA, 16 nt, Human
cuguauuuucuuuuua

SEQ ID NO: 2067288 - RNA, 21 nt, Human
cuguauuuuuaccuuuuuccu

SEQ ID NO: 2067289 - RNA, 14 nt, Human
cugucaaacaaagc

SEQ ID NO: 2067290 - RNA, 17 nt, Human
cugucaaacaaagccag

SEQ ID NO: 2067291 - RNA, 20 nt, Human
cuguaucccaugagccucag

SEQ ID NO: 2067292 - RNA, 19 nt, Human
cuguauuagucacagagau

SEQ ID NO: 2067293 - RNA, 17 nt, Human
cuguauuagucacagag

SEQ ID NO: 2067294 - RNA, 22 nt, Human
cuguaucccaugagccucagca

SEQ ID NO: 2067295 - RNA, 21 nt, Human
cuguaucccaugagccucagc

SEQ ID NO: 2067296 - RNA, 19 nt, Human
cuguaauccuagcacuuug

SEQ ID NO: 2067297 - RNA, 20 nt, Human
cuguaaucccagcacuuugg

SEQ ID NO: 2067298 - RNA, 16 nt, Human
cuguaaucccagcacu

SEQ ID NO: 2067299 - RNA, 14 nt, Human
cuguaaucccagcu

SEQ ID NO: 2067300 - RNA, 17 nt, Human
cuguaaucccagcacuu

SEQ ID NO: 2067301 - RNA, 13 nt, Human
cuguaaucccagc

SEQ ID NO: 2067302 - RNA, 14 nt, Human
cuguaaucccagca

SEQ ID NO: 2067303 - RNA, 14 nt, Human
cugguuagcucagc

SEQ ID NO: 2067304 - RNA, 15 nt, Human
cugguuagcucagcc

SEQ ID NO: 2067305 - RNA, 16 nt, Human
cugguuagcucagccc

SEQ ID NO: 2067306 - RNA, 20 nt, Human
cugguuagcucagccccagc

SEQ ID NO: 2067307 - RNA, 21 nt, Human
cugguuagcucagccccagcc

SEQ ID NO: 2067308 - RNA, 22 nt, Human
cugguuagcucagccccagccc

SEQ ID NO: 2067309 - RNA, 23 nt, Human
cugguuagcucagccccagccca

SEQ ID NO: 2067310 - RNA, 13 nt, Human
cugguuagcagag

SEQ ID NO: 2067311 - RNA, 22 nt, Human
cuguaaucccagcuacucggga

SEQ ID NO: 2067312 - RNA, 15 nt, Human
cuguaaucccagcag

SEQ ID NO: 2067313 - RNA, 19 nt, Human
cuguaaucccagcuacuca

SEQ ID NO: 2067314 - RNA, 19 nt, Human
cuguaaucccagcuacucg

SEQ ID NO: 2067315 - RNA, 18 nt, Human
cugguggcagugggagcu

SEQ ID NO: 2067316 - RNA, 14 nt, Human
cugguggcaguggg

SEQ ID NO: 2067317 - RNA, 15 nt, Human
cugguggcagcugcg

SEQ ID NO: 2067318 - RNA, 19 nt, Human
cugguauggguuucuccca

SEQ ID NO: 2067319 - RNA, 23 nt, Human
cugguauggguuucucccaguuc

SEQ ID NO: 2067320 - RNA, 14 nt, Human
cugguguccagcug

SEQ ID NO: 2067321 - RNA, 16 nt, Human
cugguguccagcugag

SEQ ID NO: 2067322 - RNA, 13 nt, Human
cugggcugagaga

SEQ ID NO: 2067323 - RNA, 15 nt, Human
cugggcucuccaccu

SEQ ID NO: 2067324 - RNA, 16 nt, Human
cugggcucuccaccuc

SEQ ID NO: 2067325 - RNA, 17 nt, Human
cugggcucuccaccuca

SEQ ID NO: 2067326 - RNA, 18 nt, Human
cugggcucuccaccucag

SEQ ID NO: 2067327 - RNA, 19 nt, Human
cugggcucuccaccucagc

SEQ ID NO: 2067328 - RNA, 20 nt, Human
cugggcucuccaccucagcc

SEQ ID NO: 2067329 - RNA, 21 nt, Human
cugggcucuccaccucagccu

SEQ ID NO: 2067330 - RNA, 13 nt, Human
cugggcucugccc

SEQ ID NO: 2067331 - RNA, 17 nt, Human
cugggcucugccccagc

SEQ ID NO: 2067332 - RNA, 18 nt, Human
cugggcucugccccagcu

SEQ ID NO: 2067333 - RNA, 23 nt, Human
cugggcucugccccagcucuggc

SEQ ID NO: 2067334 - RNA, 16 nt, Human
cugggccuccucuaac

SEQ ID NO: 2067335 - RNA, 23 nt, Human
cugggccuccucuaacaggggcu

SEQ ID NO: 2067336 - RNA, 24 nt, Human
cugggccuccucuaacaggggcug

SEQ ID NO: 2067337 - RNA, 12 nt, Human
cugggcucucca

SEQ ID NO: 2067338 - RNA, 13 nt, Human
cugggcucuccac

SEQ ID NO: 2067339 - RNA, 14 nt, Human
cugggcucuccacc

SEQ ID NO: 2067340 - RNA, 17 nt, Human
cugggccuguugcccuu

SEQ ID NO: 2067341 - RNA, 21 nt, Human
cugggauuacaagcgugagcc

SEQ ID NO: 2067342 - RNA, 19 nt, Human
cugggauguuucugucaca

SEQ ID NO: 2067343 - RNA, 14 nt, Human
cugggauguuucug

SEQ ID NO: 2067344 - RNA, 14 nt, Human
cugggauguccaca

SEQ ID NO: 2067345 - RNA, 21 nt, Human
cugggauguccacagaugccu

SEQ ID NO: 2067346 - RNA, 20 nt, Human
cugcuccacccuuggccugu

SEQ ID NO: 2067347 - RNA, 21 nt, Human
cugcuccacccuuggccuguc

SEQ ID NO: 2067348 - RNA, 11 nt, Human
cugcuccacca

SEQ ID NO: 2067349 - RNA, 13 nt, Human
cugcuccaccaca

SEQ ID NO: 2067350 - RNA, 16 nt, Human
cugcuccaccacaucc

SEQ ID NO: 2067351 - RNA, 11 nt, Human
cugcuccaccc

SEQ ID NO: 2067352 - RNA, 12 nt, Human
cugcuccacccu

SEQ ID NO: 2067353 - RNA, 13 nt, Human
cugcuccacccuu

SEQ ID NO: 2067354 - RNA, 14 nt, Human
cugcuccacccuug

SEQ ID NO: 2067355 - RNA, 15 nt, Human
cugcuccacccuugg

SEQ ID NO: 2067356 - RNA, 16 nt, Human
cugcuccacccuuggc

SEQ ID NO: 2067357 - RNA, 17 nt, Human
cugcuccacccuuggcc

SEQ ID NO: 2067358 - RNA, 18 nt, Human
cugcuccacccuuggccu

SEQ ID NO: 2067359 - RNA, 19 nt, Human
cugcuccacccuuggccug

SEQ ID NO: 2067360 - RNA, 15 nt, Human
cugggcaacagagca

SEQ ID NO: 2067361 - RNA, 18 nt, Human
cugggcaacagagcaaga

SEQ ID NO: 2067362 - RNA, 11 nt, Human
cugggauuagg

SEQ ID NO: 2067363 - RNA, 14 nt, Human
cugggauuccuccc

SEQ ID NO: 2067364 - RNA, 21 nt, Human
cuggguccaggggaugggagg

SEQ ID NO: 2067365 - RNA, 22 nt, Human
cuggguccaggggaugggaggu

SEQ ID NO: 2067366 - RNA, 17 nt, Human
cugggguucagccccuc

SEQ ID NO: 2067367 - RNA, 19 nt, Human
cugggguucagccccuccu

SEQ ID NO: 2067368 - RNA, 20 nt, Human
cugggguucagccccuccuc

SEQ ID NO: 2067369 - RNA, 21 nt, Human
cugggguucagccccuccucu

SEQ ID NO: 2067370 - RNA, 23 nt, Human
cugggguucagccccuccucugc

SEQ ID NO: 2067371 - RNA, 22 nt, Human
cugggguucagccccuccucug

SEQ ID NO: 2067372 - RNA, 23 nt, Human
cuggggguucuuucuuccucugc

SEQ ID NO: 2067373 - RNA, 20 nt, Human
cuggggguucuuucuuccuc

SEQ ID NO: 2067374 - RNA, 16 nt, Human
cuggggugugggaggc

SEQ ID NO: 2067375 - RNA, 19 nt, Human
cuggggugugggaggcccg

SEQ ID NO: 2067376 - RNA, 13 nt, Human
cugggguucagcc

SEQ ID NO: 2067377 - RNA, 15 nt, Human
cugggguucagcccc

SEQ ID NO: 2067378 - RNA, 15 nt, Human
cugguaagggccaag

SEQ ID NO: 2067379 - RNA, 15 nt, Human
cugggcuggccaguu

SEQ ID NO: 2067380 - RNA, 22 nt, Human
cugggcuggccaguuggaacca

SEQ ID NO: 2067381 - RNA, 17 nt, Human
cugggcugccaugugaa

SEQ ID NO: 2067382 - RNA, 20 nt, Human
cugggcugccaugugaagag

SEQ ID NO: 2067383 - RNA, 19 nt, Human
cugggcugcuacccagaaa

SEQ ID NO: 2067384 - RNA, 12 nt, Human
cugggcugugug

SEQ ID NO: 2067385 - RNA, 15 nt, Human
cugggcuucaguggc

SEQ ID NO: 2067386 - RNA, 18 nt, Human
cugggcuugucuguagau

SEQ ID NO: 2067387 - RNA, 16 nt, Human
cugggggucaggaggc

SEQ ID NO: 2067388 - RNA, 12 nt, Human
cugggggccuga

SEQ ID NO: 2067389 - RNA, 15 nt, Human
cugggggccugaccu

SEQ ID NO: 2067390 - RNA, 16 nt, Human
cugggggccugaccuc

SEQ ID NO: 2067391 - RNA, 22 nt, Human
cugggggccugaccucccccuc

SEQ ID NO: 2067392 - RNA, 20 nt, Human
cugggcuuugauuccaucuc

SEQ ID NO: 2067393 - RNA, 21 nt, Human
cugggcuuugauuccaucucc

SEQ ID NO: 2067394 - RNA, 20 nt, Human
cugggcuuggggcuuccuaa

SEQ ID NO: 2067395 - RNA, 19 nt, Human
cugggcuuggggcuuccua

SEQ ID NO: 2067396 - RNA, 11 nt, Human
cuguggccugg

SEQ ID NO: 2067397 - RNA, 22 nt, Human
cugugggcacgcugugggcagg

SEQ ID NO: 2067398 - RNA, 20 nt, Human
cugugggcaggugggagcuu

SEQ ID NO: 2067399 - RNA, 22 nt, Human
cugugggugaagacagagggaa

SEQ ID NO: 2067400 - RNA, 15 nt, Human
cugugggccagauug

SEQ ID NO: 2067401 - RNA, 23 nt, Human
cugugguaguacuccugcaaaau

SEQ ID NO: 2067402 - RNA, 15 nt, Human
cugugguuccugggg

SEQ ID NO: 2067403 - RNA, 21 nt, Human
cugugguuccuggggugcccu

SEQ ID NO: 2067404 - RNA, 19 nt, Human
cuguggugagguugggcag

SEQ ID NO: 2067405 - RNA, 13 nt, Human
cuguggaagggac

SEQ ID NO: 2067406 - RNA, 14 nt, Human
cuguggaagggacu

SEQ ID NO: 2067407 - RNA, 16 nt, Human
cuguggaagggacuag

SEQ ID NO: 2067408 - RNA, 17 nt, Human
cugugccucugccuguc

SEQ ID NO: 2067409 - RNA, 16 nt, Human
cugugccucugccugu

SEQ ID NO: 2067410 - RNA, 15 nt, Human
cugugccucugccug

SEQ ID NO: 2067411 - RNA, 14 nt, Human
cugugccucugccu

SEQ ID NO: 2067412 - RNA, 13 nt, Human
cugugccucugcc

SEQ ID NO: 2067413 - RNA, 12 nt, Human
cugugccucugc

SEQ ID NO: 2067414 - RNA, 15 nt, Human
cuguggagcccgcac

SEQ ID NO: 2067415 - RNA, 22 nt, Human
cuguggagcccgcacccccacc

SEQ ID NO: 2067416 - RNA, 23 nt, Human
cuguggagcccgcacccccaccc

SEQ ID NO: 2067417 - RNA, 22 nt, Human
cuguggagguacacucuuauag

SEQ ID NO: 2067418 - RNA, 22 nt, Human
cuguggccaugguccccaagac

SEQ ID NO: 2067419 - RNA, 23 nt, Human
cuguggccaugguccccaagacc

SEQ ID NO: 2067420 - RNA, 13 nt, Human
cuguguuccuggc

SEQ ID NO: 2067421 - RNA, 12 nt, Human
cuguguuccugg

SEQ ID NO: 2067422 - RNA, 22 nt, Human
cuguguucuugccacugcacuc

SEQ ID NO: 2067423 - RNA, 16 nt, Human
cuguguguuuucauaa

SEQ ID NO: 2067424 - RNA, 18 nt, Human
cuguguguuuucauaaua

SEQ ID NO: 2067425 - RNA, 19 nt, Human
cuguguguuuucauaauaa

SEQ ID NO: 2067426 - RNA, 14 nt, Human
cuguguugccaugu

SEQ ID NO: 2067427 - RNA, 18 nt, Human
cuguguugcgugucgugg

SEQ ID NO: 2067428 - RNA, 20 nt, Human
cuguguugcgugucgugggu

SEQ ID NO: 2067429 - RNA, 15 nt, Human
cuguguuuuugaaau

SEQ ID NO: 2067430 - RNA, 19 nt, Human
cugugguuuccaaggagcu

SEQ ID NO: 2067431 - RNA, 20 nt, Human
cugugguuuccaaggagcug

SEQ ID NO: 2067432 - RNA, 21 nt, Human
cugugguuuccaaggagcuga

SEQ ID NO: 2067433 - RNA, 22 nt, Human
cugugguuuucuuuugccauga

SEQ ID NO: 2067434 - RNA, 21 nt, Human
cugugguuuucuuuugccaug

SEQ ID NO: 2067435 - RNA, 20 nt, Human
cugugucuuuuuucacuaca

SEQ ID NO: 2067436 - RNA, 12 nt, Human
cugugugaaaua

SEQ ID NO: 2067437 - RNA, 19 nt, Human
cugugugaaauaccagugu

SEQ ID NO: 2067438 - RNA, 21 nt, Human
cugugugaaauaccagugugg

SEQ ID NO: 2067439 - RNA, 15 nt, Human
cuguguaacacuguu

SEQ ID NO: 2067440 - RNA, 18 nt, Human
cugugugcagucucucuu

SEQ ID NO: 2067441 - RNA, 18 nt, Human
cugugugcaagugugugc

SEQ ID NO: 2067442 - RNA, 19 nt, Human
cugugugacaucaguggca

SEQ ID NO: 2067443 - RNA, 17 nt, Human
cugugaugccacacaga

SEQ ID NO: 2067444 - RNA, 14 nt, Human
cugugaugccacac

SEQ ID NO: 2067445 - RNA, 16 nt, Human
cugugaugccacacag

SEQ ID NO: 2067446 - RNA, 16 nt, Human
cugugauugugccuac

SEQ ID NO: 2067447 - RNA, 13 nt, Human
cugugaggcaggg

SEQ ID NO: 2067448 - RNA, 14 nt, Human
cugugaggcagggg

SEQ ID NO: 2067449 - RNA, 18 nt, Human
cugugaggcaggggcgga

SEQ ID NO: 2067450 - RNA, 16 nt, Human
cugugaacgauuuaga

SEQ ID NO: 2067451 - RNA, 16 nt, Human
cugugaaaugcuggca

SEQ ID NO: 2067452 - RNA, 12 nt, Human
cugugaaauagu

SEQ ID NO: 2067453 - RNA, 15 nt, Human
cugugccaugugcca

SEQ ID NO: 2067454 - RNA, 11 nt, Human
cugugcccagc

SEQ ID NO: 2067455 - RNA, 12 nt, Human
cugugcccagcu

SEQ ID NO: 2067456 - RNA, 13 nt, Human
cugugcccagcuc

SEQ ID NO: 2067457 - RNA, 14 nt, Human
cugugcccagcuca

SEQ ID NO: 2067458 - RNA, 15 nt, Human
cugugcccagcucag

SEQ ID NO: 2067459 - RNA, 16 nt, Human
cugugcccagcucagu

SEQ ID NO: 2067460 - RNA, 19 nt, Human
cugugcccagcucagucuu

SEQ ID NO: 2067461 - RNA, 21 nt, Human
cugugccccaugccuguccag

SEQ ID NO: 2067462 - RNA, 17 nt, Human
cugugcccagagauggg

SEQ ID NO: 2067463 - RNA, 17 nt, Human
cugugccccaugccugu

SEQ ID NO: 2067464 - RNA, 14 nt, Human
cugugccaugugcc

SEQ ID NO: 2067465 - RNA, 15 nt, Human
cugugcagggaggag

SEQ ID NO: 2067466 - RNA, 22 nt, Human
cugugcagggaggagguggcag

SEQ ID NO: 2067467 - RNA, 13 nt, Human
cugugcagggagg

SEQ ID NO: 2067468 - RNA, 16 nt, Human
cugugcaaauccuuga

SEQ ID NO: 2067469 - RNA, 17 nt, Human
cugugcacggccagcug

SEQ ID NO: 2067470 - RNA, 21 nt, Human
cugugcacggccagcugcauc

SEQ ID NO: 2067471 - RNA, 14 nt, Human
cugucuuccugcau

SEQ ID NO: 2067472 - RNA, 16 nt, Human
cugucuuccugcauuc

SEQ ID NO: 2067473 - RNA, 17 nt, Human
cugucuucucaggcucu

SEQ ID NO: 2067474 - RNA, 18 nt, Human
cugucuuccugcauucac

SEQ ID NO: 2067475 - RNA, 17 nt, Human
cugucuucauccuuagc

SEQ ID NO: 2067476 - RNA, 22 nt, Human
cugucuucauagcagauuuuaa

SEQ ID NO: 2067477 - RNA, 19 nt, Human
cugucuucauagcagauuu

SEQ ID NO: 2067478 - RNA, 15 nt, Human
cugucuucaagggcu

SEQ ID NO: 2067479 - RNA, 23 nt, Human
cugucuucacagcucuguguugc

SEQ ID NO: 2067480 - RNA, 15 nt, Human
cugucuuaauuaagu

SEQ ID NO: 2067481 - RNA, 23 nt, Human
cugucuuaauuaaguaaacuaau

SEQ ID NO: 2067482 - RNA, 14 nt, Human
cugucuucaagggc

SEQ ID NO: 2067483 - RNA, 19 nt, Human
cugucuucacagcucugug

SEQ ID NO: 2067484 - RNA, 18 nt, Human
cugucuucaguaagccgu

SEQ ID NO: 2067485 - RNA, 16 nt, Human
cugucuuucagauaca

SEQ ID NO: 2067486 - RNA, 20 nt, Human
cugucuuucagauacauggu

SEQ ID NO: 2067487 - RNA, 15 nt, Human
cugucuuucagauac

SEQ ID NO: 2067488 - RNA, 16 nt, Human
cugucuuuaaggaaaa

SEQ ID NO: 2067489 - RNA, 22 nt, Human
cugucauuugagcagggcucag

SEQ ID NO: 2067490 - RNA, 21 nt, Human
cugucauuugagcagggcuca

SEQ ID NO: 2067491 - RNA, 14 nt, Human
cugucugccagcca

SEQ ID NO: 2067492 - RNA, 23 nt, Human
cugucauuugagcagggcucagc

SEQ ID NO: 2067493 - RNA, 21 nt, Human
cugucugccagccagcagcca

SEQ ID NO: 2067494 - RNA, 15 nt, Human
cugucugccagccag

SEQ ID NO: 2067495 - RNA, 16 nt, Human
cugucugccagccagc

SEQ ID NO: 2067496 - RNA, 17 nt, Human
cugucugccagccagca

SEQ ID NO: 2067497 - RNA, 20 nt, Human
cugucugccagccagcagcc

SEQ ID NO: 2067498 - RNA, 20 nt, Human
cugucuggcugaggauuuca

SEQ ID NO: 2067499 - RNA, 19 nt, Human
cugucuggaggggagcucu

SEQ ID NO: 2067500 - RNA, 20 nt, Human
cugucuggaggggagcucug

SEQ ID NO: 2067501 - RNA, 17 nt, Human
cuuuauuaaauguagaa

SEQ ID NO: 2067502 - RNA, 18 nt, Human
cuuuauuaaaaucuuaaa

SEQ ID NO: 2067503 - RNA, 13 nt, Human
cuuuauuaaaauc

SEQ ID NO: 2067504 - RNA, 13 nt, Human
cuuuaguuuuugu

SEQ ID NO: 2067505 - RNA, 15 nt, Human
cuuuaguuuuuguga

SEQ ID NO: 2067506 - RNA, 12 nt, Human
cuuuauaaacuu

SEQ ID NO: 2067507 - RNA, 13 nt, Human
cuuuauaaacuuu

SEQ ID NO: 2067508 - RNA, 16 nt, Human
cuuuauuuuauauaau

SEQ ID NO: 2067509 - RNA, 20 nt, Human
cuuuauuuuauauaauaaag

SEQ ID NO: 2067510 - RNA, 22 nt, Human
cuuuauuuuauauaauaaagua

SEQ ID NO: 2067511 - RNA, 23 nt, Human
cuuuauuuuauauaauaaaguau

SEQ ID NO: 2067512 - RNA, 11 nt, Human
cuuuauuuucu

SEQ ID NO: 2067513 - RNA, 13 nt, Human
cuuucagggccuc

SEQ ID NO: 2067514 - RNA, 15 nt, Human
cuuucagggccucca

SEQ ID NO: 2067515 - RNA, 12 nt, Human
cuuucagguacu

SEQ ID NO: 2067516 - RNA, 22 nt, Human
cuuuauuuacuucguuuugguu

SEQ ID NO: 2067517 - RNA, 18 nt, Human
cuuuauuccuucauuuca

SEQ ID NO: 2067518 - RNA, 15 nt, Human
cuuucagugaaagca

SEQ ID NO: 2067519 - RNA, 17 nt, Human
cuuucagugaaagcauc

SEQ ID NO: 2067520 - RNA, 18 nt, Human
cuuuccaaaugcccagcu

SEQ ID NO: 2067521 - RNA, 19 nt, Human
cuuuccaaaugcccagcuu

SEQ ID NO: 2067522 - RNA, 22 nt, Human
cuuuccaaaugcccagcuuaaa

SEQ ID NO: 2067523 - RNA, 17 nt, Human
cuuuccacccccucccu

SEQ ID NO: 2067524 - RNA, 20 nt, Human
cuuuccacccccucccuggc

SEQ ID NO: 2067525 - RNA, 14 nt, Human
cuuuccacccccuc

SEQ ID NO: 2067526 - RNA, 15 nt, Human
cuuuccacccccucc

SEQ ID NO: 2067527 - RNA, 16 nt, Human
cuuuccacccccuccc

SEQ ID NO: 2067528 - RNA, 21 nt, Human
cuuuccacccccucccuggcc

SEQ ID NO: 2067529 - RNA, 23 nt, Human
cuuguuggauuuuugucuugugu

SEQ ID NO: 2067530 - RNA, 14 nt, Human
cuuguuuucaguuu

SEQ ID NO: 2067531 - RNA, 21 nt, Human
cuuguguuucuuuaguuuuug

SEQ ID NO: 2067532 - RNA, 13 nt, Human
cuuguguuggcug

SEQ ID NO: 2067533 - RNA, 14 nt, Human
cuuguguuggcugu

SEQ ID NO: 2067534 - RNA, 21 nt, Human
cuuguuggauuuuugucuugu

SEQ ID NO: 2067535 - RNA, 17 nt, Human
cuuguguuggcuguggc

SEQ ID NO: 2067536 - RNA, 14 nt, Human
cuuguggccuggga

SEQ ID NO: 2067537 - RNA, 13 nt, Human
cuuguggcacauu

SEQ ID NO: 2067538 - RNA, 24 nt, Human
cuugggggaugacuagaggcaggg

SEQ ID NO: 2067539 - RNA, 21 nt, Human
cuuguuuuuuuuuuccacuua

SEQ ID NO: 2067540 - RNA, 20 nt, Human
cuuguuuuuuuuuuccacuu

SEQ ID NO: 2067541 - RNA, 19 nt, Human
cuuguuuuuuuuuuccacu

SEQ ID NO: 2067542 - RNA, 18 nt, Human
cuuguuuuuccacuacug

SEQ ID NO: 2067543 - RNA, 14 nt, Human
cuuguuuucuugcc

SEQ ID NO: 2067544 - RNA, 17 nt, Human
cuuguuuucuugccaau

SEQ ID NO: 2067545 - RNA, 18 nt, Human
cuuguuuucuugccaaug

SEQ ID NO: 2067546 - RNA, 14 nt, Human
cuuuacuuagcuua

SEQ ID NO: 2067547 - RNA, 15 nt, Human
cuuuacuuagcuuau

SEQ ID NO: 2067548 - RNA, 18 nt, Human
cuuuacuuagcuuaucaa

SEQ ID NO: 2067549 - RNA, 14 nt, Human
cuuuacuguuuguu

SEQ ID NO: 2067550 - RNA, 15 nt, Human
cuuuacuguuuguua

SEQ ID NO: 2067551 - RNA, 15 nt, Human
cuuuagaaauaaaug

SEQ ID NO: 2067552 - RNA, 16 nt, Human
cuuuagaaauaaaugu

SEQ ID NO: 2067553 - RNA, 13 nt, Human
cuuggaagcuccg

SEQ ID NO: 2067554 - RNA, 21 nt, Human
cuuggaaagaaacaaccguug

SEQ ID NO: 2067555 - RNA, 23 nt, Human
cuuggaaagcaucaccucaggcc

SEQ ID NO: 2067556 - RNA, 15 nt, Human
cuuggaaaggaccag

SEQ ID NO: 2067557 - RNA, 21 nt, Human
cuuggaaacuggaugagguca

SEQ ID NO: 2067558 - RNA, 20 nt, Human
cuuggaaagcaucaccucag

SEQ ID NO: 2067559 - RNA, 21 nt, Human
cuuggaaagcaucaccucagg

SEQ ID NO: 2067560 - RNA, 22 nt, Human
cuuggaaagcaucaccucaggc

SEQ ID NO: 2067561 - RNA, 17 nt, Human
cuugcuguccuaggcca

SEQ ID NO: 2067562 - RNA, 20 nt, Human
cuugcuguccuaggccacac

SEQ ID NO: 2067563 - RNA, 16 nt, Human
cuugcuguccuaggcc

SEQ ID NO: 2067564 - RNA, 17 nt, Human
cuugcucugcugacaga

SEQ ID NO: 2067565 - RNA, 16 nt, Human
cuugcucugcugacag

SEQ ID NO: 2067566 - RNA, 13 nt, Human
cuugcuguggucu

SEQ ID NO: 2067567 - RNA, 16 nt, Human
cuugcuguggucucuu

SEQ ID NO: 2067568 - RNA, 18 nt, Human
cuugcuguggucucuuug

SEQ ID NO: 2067569 - RNA, 20 nt, Human
cuuggaaaaauccagaaaga

SEQ ID NO: 2067570 - RNA, 22 nt, Human
cuuggaaaaauccagaaagaaa

SEQ ID NO: 2067571 - RNA, 23 nt, Human
cuuggaaaaguggcaagaccaaa

SEQ ID NO: 2067572 - RNA, 15 nt, Human
cuugccacugccucu

SEQ ID NO: 2067573 - RNA, 14 nt, Human
cuugccacugccuc

SEQ ID NO: 2067574 - RNA, 16 nt, Human
cuugccagacaugugg

SEQ ID NO: 2067575 - RNA, 13 nt, Human
cuugccacugccu

SEQ ID NO: 2067576 - RNA, 21 nt, Human
cuucuccacccugcucuccga

SEQ ID NO: 2067577 - RNA, 18 nt, Human
cuucuccacccugcucuc

SEQ ID NO: 2067578 - RNA, 17 nt, Human
cuucuccacccugcucu

SEQ ID NO: 2067579 - RNA, 13 nt, Human
cuugcccagagau

SEQ ID NO: 2067580 - RNA, 19 nt, Human
cuugcccagagaugccucc

SEQ ID NO: 2067581 - RNA, 21 nt, Human
cuugcccagagaugccuccac

SEQ ID NO: 2067582 - RNA, 19 nt, Human
cuugccccccaccccagcc

SEQ ID NO: 2067583 - RNA, 13 nt, Human
cuugccccccacc

SEQ ID NO: 2067584 - RNA, 14 nt, Human
cuugccccccaccc

SEQ ID NO: 2067585 - RNA, 15 nt, Human
cuugccccccacccc

SEQ ID NO: 2067586 - RNA, 16 nt, Human
cuugccccccacccca

SEQ ID NO: 2067587 - RNA, 23 nt, Human
cuugcccagagaugccuccaccg

SEQ ID NO: 2067588 - RNA, 22 nt, Human
cuugcccagagaugccuccacc

SEQ ID NO: 2067589 - RNA, 14 nt, Human
cuugcucugcugac

SEQ ID NO: 2067590 - RNA, 13 nt, Human
cuugcucugcuga

SEQ ID NO: 2067591 - RNA, 17 nt, Human
cuugcccgcucaggcug

SEQ ID NO: 2067592 - RNA, 17 nt, Human
cuugcccggauucuggg

SEQ ID NO: 2067593 - RNA, 18 nt, Human
cuugcccggauucuggga

SEQ ID NO: 2067594 - RNA, 20 nt, Human
cuugcccggauucugggagg

SEQ ID NO: 2067595 - RNA, 15 nt, Human
cuugcccuagaugag

SEQ ID NO: 2067596 - RNA, 16 nt, Human
cuuggggggcugaggu

SEQ ID NO: 2067597 - RNA, 22 nt, Human
cuuggggggcugaggugggagg

SEQ ID NO: 2067598 - RNA, 15 nt, Human
cuuggggggcugagg

SEQ ID NO: 2067599 - RNA, 14 nt, Human
cuugggccacugug

SEQ ID NO: 2067600 - RNA, 19 nt, Human
cuugggcuuccauuugugu

SEQ ID NO: 2067601 - RNA, 23 nt, Human
cuugggcuuccauuugugugugu

SEQ ID NO: 2067602 - RNA, 18 nt, Human
cuuggggaacaagggugg

SEQ ID NO: 2067603 - RNA, 20 nt, Human
cuugggacuaaaugcccugc

SEQ ID NO: 2067604 - RNA, 19 nt, Human
cuugggacuaaaugcccug

SEQ ID NO: 2067605 - RNA, 17 nt, Human
cuuggcugcagggaguc

SEQ ID NO: 2067606 - RNA, 14 nt, Human
cuuggcugcaggga

SEQ ID NO: 2067607 - RNA, 12 nt, Human
cuuggcuuuguu

SEQ ID NO: 2067608 - RNA, 13 nt, Human
cuuggcuuuguuu

SEQ ID NO: 2067609 - RNA, 16 nt, Human
cuuggcugcagggagu

SEQ ID NO: 2067610 - RNA, 15 nt, Human
cuuggaggcugucuu

SEQ ID NO: 2067611 - RNA, 15 nt, Human
cuuggagggauaagc

SEQ ID NO: 2067612 - RNA, 19 nt, Human
cuuggagggcccacuugua

SEQ ID NO: 2067613 - RNA, 20 nt, Human
cuuggagggcccacuuguau

SEQ ID NO: 2067614 - RNA, 17 nt, Human
cuuggaggagaugggga

SEQ ID NO: 2067615 - RNA, 15 nt, Human
cuuggaggccagcca

SEQ ID NO: 2067616 - RNA, 18 nt, Human
cuuuguucuaaagaugga

SEQ ID NO: 2067617 - RNA, 13 nt, Human
cuuugggaggcca

SEQ ID NO: 2067618 - RNA, 15 nt, Human
cuuugggaaaggaga

SEQ ID NO: 2067619 - RNA, 22 nt, Human
cuuugggaaaggagaaguuaag

SEQ ID NO: 2067620 - RNA, 15 nt, Human
cuuugucccggggcu

SEQ ID NO: 2067621 - RNA, 17 nt, Human
cuuuguccuuuuuguua

SEQ ID NO: 2067622 - RNA, 11 nt, Human
cuuugcucuga

SEQ ID NO: 2067623 - RNA, 14 nt, Human
cuuugcucuuucuu

SEQ ID NO: 2067624 - RNA, 19 nt, Human
cuuugcuccaccccacuca

SEQ ID NO: 2067625 - RNA, 19 nt, Human
cuuucccaacacuucagac

SEQ ID NO: 2067626 - RNA, 21 nt, Human
cuuucccaacacuucagacug

SEQ ID NO: 2067627 - RNA, 22 nt, Human
cuuucccaacacuucagacugc

SEQ ID NO: 2067628 - RNA, 16 nt, Human
cuuucccaucuuccaa

SEQ ID NO: 2067629 - RNA, 14 nt, Human
cuuugcugagagcu

SEQ ID NO: 2067630 - RNA, 11 nt, Human
cuuugcugcca

SEQ ID NO: 2067631 - RNA, 19 nt, Human
cuuugcuuaugaauauuua

SEQ ID NO: 2067632 - RNA, 20 nt, Human
cuuugcuuaugaauauuuau

SEQ ID NO: 2067633 - RNA, 17 nt, Human
cuuuggaaguuuguguu

SEQ ID NO: 2067634 - RNA, 17 nt, Human
cuuuggacacacacagc

SEQ ID NO: 2067635 - RNA, 18 nt, Human
cuuuggacacacacagcu

SEQ ID NO: 2067636 - RNA, 19 nt, Human
cuuuggacacacacagcuu

SEQ ID NO: 2067637 - RNA, 21 nt, Human
cuuuggacacacacagcuucu

SEQ ID NO: 2067638 - RNA, 18 nt, Human
cuuuucuguccgagcuuu

SEQ ID NO: 2067639 - RNA, 23 nt, Human
cuuuucuguccgagcuuugaaaa

SEQ ID NO: 2067640 - RNA, 17 nt, Human
cuuuucccccaaagugg

SEQ ID NO: 2067641 - RNA, 19 nt, Human
cuuuucccccaaagugguu

SEQ ID NO: 2067642 - RNA, 14 nt, Human
cuuuuccccggucc

SEQ ID NO: 2067643 - RNA, 14 nt, Human
cuuuucccaaccau

SEQ ID NO: 2067644 - RNA, 18 nt, Human
cuuuucuacagcaaauuu

SEQ ID NO: 2067645 - RNA, 19 nt, Human
cuuuucuacagcaaauuua

SEQ ID NO: 2067646 - RNA, 20 nt, Human
cuuuucuacagcaaauuuau

SEQ ID NO: 2067647 - RNA, 23 nt, Human
cuuuucuacagcaaauuuauaau

SEQ ID NO: 2067648 - RNA, 18 nt, Human
cuuuucuccuaucuucau

SEQ ID NO: 2067649 - RNA, 15 nt, Human
cuuuucuccaugagu

SEQ ID NO: 2067650 - RNA, 13 nt, Human
cuuuucucuuucu

SEQ ID NO: 2067651 - RNA, 14 nt, Human
cuuuucucuuucuc

SEQ ID NO: 2067652 - RNA, 20 nt, Human
cuuuucauaaccuagccuua

SEQ ID NO: 2067653 - RNA, 20 nt, Human
cuuuucacugcuggcugccu

SEQ ID NO: 2067654 - RNA, 18 nt, Human
cuuuucacugcuggcugc

SEQ ID NO: 2067655 - RNA, 17 nt, Human
cuuuucacugcuggcug

SEQ ID NO: 2067656 - RNA, 23 nt, Human
cuuuuacucaugaucuugugaca

SEQ ID NO: 2067657 - RNA, 22 nt, Human
cuuuucauaaccuagccuuaga

SEQ ID NO: 2067658 - RNA, 18 nt, Human
cuuuucaugcgugugugu

SEQ ID NO: 2067659 - RNA, 18 nt, Human
cuuuguuuguugucagcu

SEQ ID NO: 2067660 - RNA, 20 nt, Human
cuuuguuuguugucagcuga

SEQ ID NO: 2067661 - RNA, 15 nt, Human
cuuuguuuggcuggg

SEQ ID NO: 2067662 - RNA, 17 nt, Human
cuuuguuucaaccaagu

SEQ ID NO: 2067663 - RNA, 13 nt, Human
cuuuuacauacug

SEQ ID NO: 2067664 - RNA, 14 nt, Human
cuuuuacauacugc

SEQ ID NO: 2067665 - RNA, 17 nt, Human
cuuuuacauacugcugu

SEQ ID NO: 2067666 - RNA, 18 nt, Human
gaaacaccuagaucagaa

SEQ ID NO: 2067667 - RNA, 22 nt, Human
gaaacacugggcuucuagaacc

SEQ ID NO: 2067668 - RNA, 17 nt, Human
gaaacacugacuccugu

SEQ ID NO: 2067669 - RNA, 18 nt, Human
gaaacagcuaaugggaca

SEQ ID NO: 2067670 - RNA, 14 nt, Human
gaaacagauuuggu

SEQ ID NO: 2067671 - RNA, 21 nt, Human
gaaaauauuaucuuuguaauu

SEQ ID NO: 2067672 - RNA, 14 nt, Human
gaaacagagacagg

SEQ ID NO: 2067673 - RNA, 16 nt, Human
gaaacagagacaggcc

SEQ ID NO: 2067674 - RNA, 17 nt, Human
gaaacagagacaggccc

SEQ ID NO: 2067675 - RNA, 19 nt, Human
gaaacagagacaggcccaa

SEQ ID NO: 2067676 - RNA, 17 nt, Human
gaaaagcugcugacagu

SEQ ID NO: 2067677 - RNA, 13 nt, Human
gaaaagcugcuga

SEQ ID NO: 2067678 - RNA, 16 nt, Human
gaaaaucagccugcuc

SEQ ID NO: 2067679 - RNA, 18 nt, Human
gaaaaucagccugcucca

SEQ ID NO: 2067680 - RNA, 23 nt, Human
gaaaauauguccauaucuaacca

SEQ ID NO: 2067681 - RNA, 14 nt, Human
gaaaaucagccugc

SEQ ID NO: 2067682 - RNA, 12 nt, Human
gaaaauaugcau

SEQ ID NO: 2067683 - RNA, 15 nt, Human
gaaaauaugcaucua

SEQ ID NO: 2067684 - RNA, 19 nt, Human
gaaaaauaacuucaagcaa

SEQ ID NO: 2067685 - RNA, 19 nt, Human
gaaaaccaagccguggcuu

SEQ ID NO: 2067686 - RNA, 18 nt, Human
gaaaaccaagccguggcu

SEQ ID NO: 2067687 - RNA, 21 nt, Human
gaaaaccaagccguggcuucc

SEQ ID NO: 2067688 - RNA, 13 nt, Human
gaaaacccagaga

SEQ ID NO: 2067689 - RNA, 12 nt, Human
gaaaacccagag

SEQ ID NO: 2067690 - RNA, 15 nt, Human
cuuuuuucacuacau

SEQ ID NO: 2067691 - RNA, 18 nt, Human
cuuuugagaacuuuuggu

SEQ ID NO: 2067692 - RNA, 15 nt, Human
cuuuugagacuuuuu

SEQ ID NO: 2067693 - RNA, 18 nt, Human
cuuuugagacuuuuuggu

SEQ ID NO: 2067694 - RNA, 20 nt, Human
cuuuugagacuuuuuggugg

SEQ ID NO: 2067695 - RNA, 19 nt, Human
cuuuucuuguuuaucagca

SEQ ID NO: 2067696 - RNA, 21 nt, Human
cuuuucuuguuuaucagcagu

SEQ ID NO: 2067697 - RNA, 13 nt, Human
cuuuugacaugug

SEQ ID NO: 2067698 - RNA, 14 nt, Human
cuuuugacaugugg

SEQ ID NO: 2067699 - RNA, 23 nt, Human
cuuuugacggaaggaccuauguu

SEQ ID NO: 2067700 - RNA, 18 nt, Human
cuuuugacuuaaagcaga

SEQ ID NO: 2067701 - RNA, 19 nt, Human
gaaaaaguuaaacauugaa

SEQ ID NO: 2067702 - RNA, 18 nt, Human
gaaaaaguaucauggaaa

SEQ ID NO: 2067703 - RNA, 22 nt, Human
gaaaaaguaucauggaaauauu

SEQ ID NO: 2067704 - RNA, 16 nt, Human
cuuuuuucuuauuuaa

SEQ ID NO: 2067705 - RNA, 20 nt, Human
cuuuuuugaaauaauaaauc

SEQ ID NO: 2067706 - RNA, 18 nt, Human
gaaguuuaauugacuuau

SEQ ID NO: 2067707 - RNA, 13 nt, Human
gaaguuucauuua

SEQ ID NO: 2067708 - RNA, 14 nt, Human
gaaguuucauuuau

SEQ ID NO: 2067709 - RNA, 15 nt, Human
gaaguuucauuuaug

SEQ ID NO: 2067710 - RNA, 21 nt, Human
gaaguuucauuuaugauacaa

SEQ ID NO: 2067711 - RNA, 12 nt, Human
gaagguuguaag

SEQ ID NO: 2067712 - RNA, 15 nt, Human
gaagguugugaugaa

SEQ ID NO: 2067713 - RNA, 20 nt, Human
gaagguuuacucuguggcca

SEQ ID NO: 2067714 - RNA, 16 nt, Human
gaagguuuguauauug

SEQ ID NO: 2067715 - RNA, 15 nt, Human
gaagguuuguauauu

SEQ ID NO: 2067716 - RNA, 14 nt, Human
gaauaaagacaccu

SEQ ID NO: 2067717 - RNA, 17 nt, Human
gaauaaagccugcuuuu

SEQ ID NO: 2067718 - RNA, 13 nt, Human
gaauaaaguucug

SEQ ID NO: 2067719 - RNA, 14 nt, Human
gaauaaaguucuga

SEQ ID NO: 2067720 - RNA, 20 nt, Human
gaauaaaguucugaguguuu

SEQ ID NO: 2067721 - RNA, 22 nt, Human
gaauaaauaaauguaucuuauu

SEQ ID NO: 2067722 - RNA, 14 nt, Human
gaauaaaguugaag

SEQ ID NO: 2067723 - RNA, 16 nt, Human
gaauaaaguugaagcu

SEQ ID NO: 2067724 - RNA, 17 nt, Human
gaauaaugugggaagaa

SEQ ID NO: 2067725 - RNA, 20 nt, Human
gaauaaugugggaagaaaca

SEQ ID NO: 2067726 - RNA, 21 nt, Human
gaauaaugugggaagaaacaa

SEQ ID NO: 2067727 - RNA, 15 nt, Human
gaauaauucuuugau

SEQ ID NO: 2067728 - RNA, 16 nt, Human
gaauaauucuuugauu

SEQ ID NO: 2067729 - RNA, 22 nt, Human
gaauaaucuuuggguaacuuca

SEQ ID NO: 2067730 - RNA, 14 nt, Human
gaauaaugaaugga

SEQ ID NO: 2067731 - RNA, 15 nt, Human
gaauaaucuuugggu

SEQ ID NO: 2067732 - RNA, 15 nt, Human
gaauaaauugcuccu

SEQ ID NO: 2067733 - RNA, 12 nt, Human
gaauaaggccuu

SEQ ID NO: 2067734 - RNA, 14 nt, Human
gaauaacauguaau

SEQ ID NO: 2067735 - RNA, 16 nt, Human
gaaucucaaauaacua

SEQ ID NO: 2067736 - RNA, 19 nt, Human
gaauccgggcuccccuuuc

SEQ ID NO: 2067737 - RNA, 22 nt, Human
gaauccuguccucagcuucuua

SEQ ID NO: 2067738 - RNA, 19 nt, Human
gaaugaaagggcccagaga

SEQ ID NO: 2067739 - RNA, 13 nt, Human
gaaugccuccucc

SEQ ID NO: 2067740 - RNA, 23 nt, Human
gaaugcggcaagaaggaauugac

SEQ ID NO: 2067741 - RNA, 16 nt, Human
gaaugcuaacaguuca

SEQ ID NO: 2067742 - RNA, 21 nt, Human
gaaugcuaacaguucacuugc

SEQ ID NO: 2067743 - RNA, 14 nt, Human
gaaugaaagggccc

SEQ ID NO: 2067744 - RNA, 11 nt, Human
gaauagaagga

SEQ ID NO: 2067745 - RNA, 12 nt, Human
gaauagaaggaa

SEQ ID NO: 2067746 - RNA, 13 nt, Human
gaauagaaggaaa

SEQ ID NO: 2067747 - RNA, 14 nt, Human
gaauagaaggaaac

SEQ ID NO: 2067748 - RNA, 18 nt, Human
gaauagaaggaaacuagc

SEQ ID NO: 2067749 - RNA, 20 nt, Human
gaauagaaggaaacuagcuu

SEQ ID NO: 2067750 - RNA, 15 nt, Human
gaauagaugcugacu

SEQ ID NO: 2067751 - RNA, 15 nt, Human
gaauagcaugucacu

SEQ ID NO: 2067752 - RNA, 14 nt, Human
gaauagcugggacu

SEQ ID NO: 2067753 - RNA, 13 nt, Human
gaaucagaaacag

SEQ ID NO: 2067754 - RNA, 15 nt, Human
gaauagcugggacua

SEQ ID NO: 2067755 - RNA, 14 nt, Human
gaaucccuguucau

SEQ ID NO: 2067756 - RNA, 17 nt, Human
gaaucccuguucauugu

SEQ ID NO: 2067757 - RNA, 18 nt, Human
gaaucccuguucauugua

SEQ ID NO: 2067758 - RNA, 16 nt, Human
gaauccaagcgagguc

SEQ ID NO: 2067759 - RNA, 14 nt, Human
gaaucauugcuuau

SEQ ID NO: 2067760 - RNA, 20 nt, Human
gaaucauuguaaacauuagu

SEQ ID NO: 2067761 - RNA, 18 nt, Human
gaaucagccuacaggccu

SEQ ID NO: 2067762 - RNA, 19 nt, Human
gaaucagaucauuucaaaa

SEQ ID NO: 2067763 - RNA, 18 nt, Human
gaaucagacccuacccca

SEQ ID NO: 2067764 - RNA, 22 nt, Human
gaaucagacccuaccccaccac

SEQ ID NO: 2067765 - RNA, 23 nt, Human
gaaucagacccuaccccaccacg

SEQ ID NO: 2067766 - RNA, 19 nt, Human
gaaucagacuucacacugc

SEQ ID NO: 2067767 - RNA, 13 nt, Human
gaaggccaccugc

SEQ ID NO: 2067768 - RNA, 14 nt, Human
gaaggccaccugca

SEQ ID NO: 2067769 - RNA, 16 nt, Human
gaaggccaccugcagg

SEQ ID NO: 2067770 - RNA, 17 nt, Human
gaaggccaccugcaggu

SEQ ID NO: 2067771 - RNA, 13 nt, Human
gaaggcagggaaa

SEQ ID NO: 2067772 - RNA, 17 nt, Human
gaaggcagcagguggca

SEQ ID NO: 2067773 - RNA, 20 nt, Human
gaaggguuuuccacccugga

SEQ ID NO: 2067774 - RNA, 13 nt, Human
gaagguaaaauug

SEQ ID NO: 2067775 - RNA, 14 nt, Human
gaaggguccuuccc

SEQ ID NO: 2067776 - RNA, 21 nt, Human
gaaggguccuucccucucccc

SEQ ID NO: 2067777 - RNA, 15 nt, Human
gaaggguuuguggcu

SEQ ID NO: 2067778 - RNA, 21 nt, Human
gaaggguuuguggcugggggc

SEQ ID NO: 2067779 - RNA, 20 nt, Human
gaaggaaaaggcagggagcg

SEQ ID NO: 2067780 - RNA, 21 nt, Human
gaaggacccuucagagguggc

SEQ ID NO: 2067781 - RNA, 17 nt, Human
gaaggaccuauguuugc

SEQ ID NO: 2067782 - RNA, 15 nt, Human
gaaggaccuccugag

SEQ ID NO: 2067783 - RNA, 16 nt, Human
gaaggagaaggaagga

SEQ ID NO: 2067784 - RNA, 15 nt, Human
gaaggagacucaccu

SEQ ID NO: 2067785 - RNA, 17 nt, Human
gaaggagacucaccucu

SEQ ID NO: 2067786 - RNA, 20 nt, Human
gaaggagacucaccucugcc

SEQ ID NO: 2067787 - RNA, 22 nt, Human
gaaggagacucaccucugccuc

SEQ ID NO: 2067788 - RNA, 15 nt, Human
gaaggagacagagcu

SEQ ID NO: 2067789 - RNA, 18 nt, Human
gaaggagacagagcuggu

SEQ ID NO: 2067790 - RNA, 17 nt, Human
gaaggagaaggaaggag

SEQ ID NO: 2067791 - RNA, 23 nt, Human
gaaggacccggaggggccuggca

SEQ ID NO: 2067792 - RNA, 23 nt, Human
gaaggagacucaccucugccuca

SEQ ID NO: 2067793 - RNA, 15 nt, Human
gaaggagagaagggg

SEQ ID NO: 2067794 - RNA, 16 nt, Human
gaaggagagaagggga

SEQ ID NO: 2067795 - RNA, 18 nt, Human
gaaggagagaaggggagg

SEQ ID NO: 2067796 - RNA, 20 nt, Human
gaaggagagaaggggaggag

SEQ ID NO: 2067797 - RNA, 13 nt, Human
gaaggagagccug

SEQ ID NO: 2067798 - RNA, 15 nt, Human
gaaggagagccugcu

SEQ ID NO: 2067799 - RNA, 16 nt, Human
gaaggagagccugcug

SEQ ID NO: 2067800 - RNA, 21 nt, Human
gaagacucauucuucuguacg

SEQ ID NO: 2067801 - RNA, 19 nt, Human
gaagacucauucuucugua

SEQ ID NO: 2067802 - RNA, 15 nt, Human
gaagccacugaagcu

SEQ ID NO: 2067803 - RNA, 18 nt, Human
gaagccacugaagcuggg

SEQ ID NO: 2067804 - RNA, 15 nt, Human
gaagcccaagugaaa

SEQ ID NO: 2067805 - RNA, 16 nt, Human
gaagcccaagugaaau

SEQ ID NO: 2067806 - RNA, 14 nt, Human
gaagcccaauaaac

SEQ ID NO: 2067807 - RNA, 16 nt, Human
gaagcgagcacugacc

SEQ ID NO: 2067808 - RNA, 17 nt, Human
gaagccucuggcuagag

SEQ ID NO: 2067809 - RNA, 13 nt, Human
gaagccucuggcu

SEQ ID NO: 2067810 - RNA, 14 nt, Human
gaagccucuggcua

SEQ ID NO: 2067811 - RNA, 18 nt, Human
gaaggaaaaggcagggag

SEQ ID NO: 2067812 - RNA, 23 nt, Human
gaagcuucuuaaaugagaaggaa

SEQ ID NO: 2067813 - RNA, 22 nt, Human
gaagcgcgccacucgcuucccc

SEQ ID NO: 2067814 - RNA, 15 nt, Human
gaagcuuucucugcu

SEQ ID NO: 2067815 - RNA, 20 nt, Human
gaagcuuucucugcuucagc

SEQ ID NO: 2067816 - RNA, 21 nt, Human
gaagcuuucucugcuucagcu

SEQ ID NO: 2067817 - RNA, 12 nt, Human
gaagcccagcuc

SEQ ID NO: 2067818 - RNA, 13 nt, Human
gaagcccagcucc

SEQ ID NO: 2067819 - RNA, 14 nt, Human
gaagcccagcucca

SEQ ID NO: 2067820 - RNA, 16 nt, Human
gaagcccagcuccagg

SEQ ID NO: 2067821 - RNA, 17 nt, Human
gaagcccagcuccaggg

SEQ ID NO: 2067822 - RNA, 18 nt, Human
gaagcccaauaaaccucu

SEQ ID NO: 2067823 - RNA, 19 nt, Human
gaagcccaauaaaccucuu

SEQ ID NO: 2067824 - RNA, 16 nt, Human
gaagccgggaacagac

SEQ ID NO: 2067825 - RNA, 14 nt, Human
gaagccuauuguaa

SEQ ID NO: 2067826 - RNA, 16 nt, Human
gaagccuauuguaaau

SEQ ID NO: 2067827 - RNA, 16 nt, Human
gaagccgugcccugcc

SEQ ID NO: 2067828 - RNA, 17 nt, Human
gaagccgugcccugccc

SEQ ID NO: 2067829 - RNA, 19 nt, Human
gaagccgugcccugccccc

SEQ ID NO: 2067830 - RNA, 12 nt, Human
gaagccucuggc

SEQ ID NO: 2067831 - RNA, 23 nt, Human
gaaaugcugguuuuucaguuuuc

SEQ ID NO: 2067832 - RNA, 19 nt, Human
gaaauauuaaacccuggau

SEQ ID NO: 2067833 - RNA, 17 nt, Human
gaaauggcuugaagcca

SEQ ID NO: 2067834 - RNA, 18 nt, Human
gaaauggcuugaagccaa

SEQ ID NO: 2067835 - RNA, 15 nt, Human
gaaauguuuuaaggc

SEQ ID NO: 2067836 - RNA, 15 nt, Human
gaaauauaaugcaaa

SEQ ID NO: 2067837 - RNA, 15 nt, Human
gaaauuggcuggaug

SEQ ID NO: 2067838 - RNA, 16 nt, Human
gaaauuggaagagcac

SEQ ID NO: 2067839 - RNA, 14 nt, Human
gaaauuggcuggau

SEQ ID NO: 2067840 - RNA, 19 nt, Human
gaaauugcauuuccugaca

SEQ ID NO: 2067841 - RNA, 22 nt, Human
gaaauuguuuaaguguuguaaa

SEQ ID NO: 2067842 - RNA, 19 nt, Human
gaaauuuaaaagacacugu

SEQ ID NO: 2067843 - RNA, 20 nt, Human
gaaauugucuagcagagcag

SEQ ID NO: 2067844 - RNA, 21 nt, Human
gaaauugucuagcagagcagg

SEQ ID NO: 2067845 - RNA, 13 nt, Human
gaaauuuaaaaga

SEQ ID NO: 2067846 - RNA, 22 nt, Human
gaaauuuaauauagcuauuuuu

SEQ ID NO: 2067847 - RNA, 16 nt, Human
gaaauuuaauucaugu

SEQ ID NO: 2067848 - RNA, 20 nt, Human
gaaauuuaauucauguuucu

SEQ ID NO: 2067849 - RNA, 21 nt, Human
gaaauuuaauucauguuucuu

SEQ ID NO: 2067850 - RNA, 23 nt, Human
gaaauuuaauucauguuucuuaa

SEQ ID NO: 2067851 - RNA, 17 nt, Human
gaaauuuguuauaauga

SEQ ID NO: 2067852 - RNA, 15 nt, Human
gaaauuuuacaauag

SEQ ID NO: 2067853 - RNA, 12 nt, Human
gaaauuuuacca

SEQ ID NO: 2067854 - RNA, 13 nt, Human
gaaauuuuaccaa

SEQ ID NO: 2067855 - RNA, 14 nt, Human
gaaauuuuaccaag

SEQ ID NO: 2067856 - RNA, 16 nt, Human
gaaauuuuaccaaguu

SEQ ID NO: 2067857 - RNA, 21 nt, Human
gaaauuuuaccaaguuauaua

SEQ ID NO: 2067858 - RNA, 16 nt, Human
gaacacugggggaggg

SEQ ID NO: 2067859 - RNA, 17 nt, Human
gaacacugggggagggg

SEQ ID NO: 2067860 - RNA, 13 nt, Human
gaaauauuaugca

SEQ ID NO: 2067861 - RNA, 15 nt, Human
gaaauauuaugcaaa

SEQ ID NO: 2067862 - RNA, 16 nt, Human
gaaauauuaugcaaau

SEQ ID NO: 2067863 - RNA, 17 nt, Human
gaaauauuaugcaaauu

SEQ ID NO: 2067864 - RNA, 18 nt, Human
gaaauauuaugcaaauuc

SEQ ID NO: 2067865 - RNA, 19 nt, Human
gaaauauuaugcaaauucc

SEQ ID NO: 2067866 - RNA, 21 nt, Human
gaaauauuaugcaaauuccca

SEQ ID NO: 2067867 - RNA, 22 nt, Human
gaaauauuaugcaaauucccag

SEQ ID NO: 2067868 - RNA, 23 nt, Human
gaaauauuaugcaaauucccaga

SEQ ID NO: 2067869 - RNA, 13 nt, Human
gaaauaugcaucu

SEQ ID NO: 2067870 - RNA, 21 nt, Human
gaaauaucugaaaauguaugu

SEQ ID NO: 2067871 - RNA, 17 nt, Human
gaaauagucugugugaa

SEQ ID NO: 2067872 - RNA, 15 nt, Human
gaaauagucugugug

SEQ ID NO: 2067873 - RNA, 13 nt, Human
gaaauauaauuga

SEQ ID NO: 2067874 - RNA, 17 nt, Human
gaaauauacacacagca

SEQ ID NO: 2067875 - RNA, 18 nt, Human
gaaauaguucaaagccaa

SEQ ID NO: 2067876 - RNA, 15 nt, Human
gaaauauacacacag

SEQ ID NO: 2067877 - RNA, 16 nt, Human
gaaauacuacuuacca

SEQ ID NO: 2067878 - RNA, 21 nt, Human
gaaauacuacuuaccauaugu

SEQ ID NO: 2067879 - RNA, 19 nt, Human
gaaauacgccagaacugcu

SEQ ID NO: 2067880 - RNA, 20 nt, Human
gaaauacgccagaacugcuu

SEQ ID NO: 2067881 - RNA, 21 nt, Human
gaaauacaauucuacauuguc

SEQ ID NO: 2067882 - RNA, 18 nt, Human
gaaauagacaguauauuu

SEQ ID NO: 2067883 - RNA, 19 nt, Human
gaaauagacaguauauuua

SEQ ID NO: 2067884 - RNA, 14 nt, Human
gaaauaaauagcua

SEQ ID NO: 2067885 - RNA, 15 nt, Human
gaaauaaauagcuau

SEQ ID NO: 2067886 - RNA, 17 nt, Human
gaaauaaauagcuauau

SEQ ID NO: 2067887 - RNA, 21 nt, Human
gaaauaaauagcuauauccau

SEQ ID NO: 2067888 - RNA, 23 nt, Human
gaaauaaauagcuauauccaugu

SEQ ID NO: 2067889 - RNA, 15 nt, Human
gaaauaaaugcccca

SEQ ID NO: 2067890 - RNA, 12 nt, Human
gaaauaaaugua

SEQ ID NO: 2067891 - RNA, 20 nt, Human
gaaauaaauguaccugaugu

SEQ ID NO: 2067892 - RNA, 11 nt, Human
gaaauaauaaa

SEQ ID NO: 2067893 - RNA, 14 nt, Human
gaaauaauaugcau

SEQ ID NO: 2067894 - RNA, 13 nt, Human
gaaauaauaugca

SEQ ID NO: 2067895 - RNA, 13 nt, Human
gaaauaauaaauc

SEQ ID NO: 2067896 - RNA, 14 nt, Human
gaaauaauaaaucu

SEQ ID NO: 2067897 - RNA, 17 nt, Human
gaaauaauaaaucuggu

SEQ ID NO: 2067898 - RNA, 15 nt, Human
gaaauaauaugcauu

SEQ ID NO: 2067899 - RNA, 19 nt, Human
gaaauaauguacaucuggc

SEQ ID NO: 2067900 - RNA, 23 nt, Human
gaaacaucaguuacucugaaggg

SEQ ID NO: 2067901 - RNA, 19 nt, Human
gaaacaucaguuacucuga

SEQ ID NO: 2067902 - RNA, 20 nt, Human
gaaacaucaguuacucugaa

SEQ ID NO: 2067903 - RNA, 22 nt, Human
gaaacaggaccacaaaaaugaa

SEQ ID NO: 2067904 - RNA, 13 nt, Human
gaaacaggagaga

SEQ ID NO: 2067905 - RNA, 17 nt, Human
gaaacaggagagaaagg

SEQ ID NO: 2067906 - RNA, 20 nt, Human
gaaacaugacucguauaugu

SEQ ID NO: 2067907 - RNA, 18 nt, Human
gaaauaaaguuggugaca

SEQ ID NO: 2067908 - RNA, 17 nt, Human
gaaccaccacacccagc

SEQ ID NO: 2067909 - RNA, 16 nt, Human
gaaccaccacacccag

SEQ ID NO: 2067910 - RNA, 14 nt, Human
gaaccgcaggaagc

SEQ ID NO: 2067911 - RNA, 15 nt, Human
gaaccgcaggaagcu

SEQ ID NO: 2067912 - RNA, 16 nt, Human
gaaccgcaggaagcug

SEQ ID NO: 2067913 - RNA, 18 nt, Human
gaacagacaggagaaaug

SEQ ID NO: 2067914 - RNA, 17 nt, Human
gaacagacaggagaaau

SEQ ID NO: 2067915 - RNA, 13 nt, Human
gaaccgcaggaag

SEQ ID NO: 2067916 - RNA, 20 nt, Human
gaaccgcaggaagcugcucc

SEQ ID NO: 2067917 - RNA, 21 nt, Human
gaaccacaucuugcucugcug

SEQ ID NO: 2067918 - RNA, 16 nt, Human
gaacagacuggaagca

SEQ ID NO: 2067919 - RNA, 15 nt, Human
gaacagacuggaagc

SEQ ID NO: 2067920 - RNA, 16 nt, Human
gaacacuuauugcuuu

SEQ ID NO: 2067921 - RNA, 12 nt, Human
gaacagaaggau

SEQ ID NO: 2067922 - RNA, 18 nt, Human
gaacacugggggagggga

SEQ ID NO: 2067923 - RNA, 20 nt, Human
gaacacugggggaggggaca

SEQ ID NO: 2067924 - RNA, 11 nt, Human
gaacagaaaac

SEQ ID NO: 2067925 - RNA, 12 nt, Human
gaacagaaaaca

SEQ ID NO: 2067926 - RNA, 13 nt, Human
gaacagaaaacaa

SEQ ID NO: 2067927 - RNA, 14 nt, Human
gaacagaaaacaac

SEQ ID NO: 2067928 - RNA, 17 nt, Human
gaacagaaaacaacaaa

SEQ ID NO: 2067929 - RNA, 19 nt, Human
gaacagaaaacaacaaaaa

SEQ ID NO: 2067930 - RNA, 20 nt, Human
gaacagaaaacaacaaaaaa

SEQ ID NO: 2067931 - RNA, 23 nt, Human
gaacagaaaacaacaaaaaauaa

SEQ ID NO: 2067932 - RNA, 13 nt, Human
gaacagaaauacc

SEQ ID NO: 2067933 - RNA, 14 nt, Human
gaacagaaggauga

SEQ ID NO: 2067934 - RNA, 19 nt, Human
gaacagaaggaugaaugag

SEQ ID NO: 2067935 - RNA, 17 nt, Human
gaacagacaacagaagu

SEQ ID NO: 2067936 - RNA, 18 nt, Human
gaacagacaacagaaguc

SEQ ID NO: 2067937 - RNA, 19 nt, Human
gaacagacaacagaaguca

SEQ ID NO: 2067938 - RNA, 15 nt, Human
gaacagacaggagaa

SEQ ID NO: 2067939 - RNA, 16 nt, Human
gaacagacaggagaaa

SEQ ID NO: 2067940 - RNA, 19 nt, Human
gaacggaacguuggacuuu

SEQ ID NO: 2067941 - RNA, 23 nt, Human
gaacggacgagauaaugugaacu

SEQ ID NO: 2067942 - RNA, 14 nt, Human
gaacggggagaaaa

SEQ ID NO: 2067943 - RNA, 20 nt, Human
gaaccuguccuugcacacuc

SEQ ID NO: 2067944 - RNA, 12 nt, Human
gaaccuguccuu

SEQ ID NO: 2067945 - RNA, 12 nt, Human
gaaccuggacca

SEQ ID NO: 2067946 - RNA, 16 nt, Human
gaaccuggaccaaagc

SEQ ID NO: 2067947 - RNA, 17 nt, Human
gaaccuggaccaaagcu

SEQ ID NO: 2067948 - RNA, 18 nt, Human
gaaccuggaccaaagcug

SEQ ID NO: 2067949 - RNA, 22 nt, Human
gaacgugacugccccaacuccu

SEQ ID NO: 2067950 - RNA, 15 nt, Human
gaacgucuuaucuaa

SEQ ID NO: 2067951 - RNA, 14 nt, Human
gaacgugacugccc

SEQ ID NO: 2067952 - RNA, 23 nt, Human
gaacgugggaguucagcugcuuc

SEQ ID NO: 2067953 - RNA, 16 nt, Human
gaacgggguccuucaa

SEQ ID NO: 2067954 - RNA, 15 nt, Human
gaacgguaaauuucu

SEQ ID NO: 2067955 - RNA, 17 nt, Human
gaacgguaaauuucugu

SEQ ID NO: 2067956 - RNA, 15 nt, Human
gaacggggagaaaag

SEQ ID NO: 2067957 - RNA, 17 nt, Human
gaacuagugguggcucu

SEQ ID NO: 2067958 - RNA, 19 nt, Human
gaacuagugguggcucuga

SEQ ID NO: 2067959 - RNA, 15 nt, Human
gaacuauaaagaagu

SEQ ID NO: 2067960 - RNA, 13 nt, Human
gaacuagcuggaa

SEQ ID NO: 2067961 - RNA, 19 nt, Human
gaacuagcuggaauuuuuu

SEQ ID NO: 2067962 - RNA, 15 nt, Human
gaacuauuggagggu

SEQ ID NO: 2067963 - RNA, 22 nt, Human
gaacuauuggagggugggagag

SEQ ID NO: 2067964 - RNA, 13 nt, Human
gaacucauuccug

SEQ ID NO: 2067965 - RNA, 14 nt, Human
gaacucauuccugc

SEQ ID NO: 2067966 - RNA, 22 nt, Human
gaacucauuccugccugucucc

SEQ ID NO: 2067967 - RNA, 22 nt, Human
gaacuggguacuuguggacaca

SEQ ID NO: 2067968 - RNA, 14 nt, Human
gaacucccaagaac

SEQ ID NO: 2067969 - RNA, 20 nt, Human
gaacucccaagaacagcagg

SEQ ID NO: 2067970 - RNA, 21 nt, Human
gaacucccaagaacagcaggc

SEQ ID NO: 2067971 - RNA, 16 nt, Human
gaacucauuccugccu

SEQ ID NO: 2067972 - RNA, 22 nt, Human
gaacugugaggguaaaggcuau

SEQ ID NO: 2067973 - RNA, 20 nt, Human
gaacuuauccuaaaacaaau

SEQ ID NO: 2067974 - RNA, 20 nt, Human
gaagaaaagugggccagugu

SEQ ID NO: 2067975 - RNA, 13 nt, Human
gaagaagaaaaca

SEQ ID NO: 2067976 - RNA, 19 nt, Human
gaacuuggaaagaaaugcc

SEQ ID NO: 2067977 - RNA, 20 nt, Human
cucuguugcccaggcuggag

SEQ ID NO: 2067978 - RNA, 22 nt, Human
cucuguugcccaggcuggagug

SEQ ID NO: 2067979 - RNA, 22 nt, Human
cucuguuguguucguucuuguu

SEQ ID NO: 2067980 - RNA, 16 nt, Human
cucuuaaaaaauaaaa

SEQ ID NO: 2067981 - RNA, 17 nt, Human
cucuuaaaaaauaaaaa

SEQ ID NO: 2067982 - RNA, 18 nt, Human
cucuuaaaaaauaaaaac

SEQ ID NO: 2067983 - RNA, 19 nt, Human
cucuuaaaaaauaaaaacu

SEQ ID NO: 2067984 - RNA, 23 nt, Human
cucugugucagguggggcagcuu

SEQ ID NO: 2067985 - RNA, 22 nt, Human
cucugugucagguggggcagcu

SEQ ID NO: 2067986 - RNA, 21 nt, Human
cucugugucagguggggcagc

SEQ ID NO: 2067987 - RNA, 20 nt, Human
cucugugucagguggggcag

SEQ ID NO: 2067988 - RNA, 21 nt, Human
cucugugaacgauuuagaaag

SEQ ID NO: 2067989 - RNA, 18 nt, Human
cucugugaacgauuuaga

SEQ ID NO: 2067990 - RNA, 23 nt, Human
cucugugaacgauuuagaaagaa

SEQ ID NO: 2067991 - RNA, 15 nt, Human
cucugugaccugccc

SEQ ID NO: 2067992 - RNA, 23 nt, Human
cucugugaccugccccgcccagc

SEQ ID NO: 2067993 - RNA, 17 nt, Human
cucuucccccucuccca

SEQ ID NO: 2067994 - RNA, 18 nt, Human
cucuucccccucucccag

SEQ ID NO: 2067995 - RNA, 20 nt, Human
cucuucccccucucccaguu

SEQ ID NO: 2067996 - RNA, 19 nt, Human
cucuucccccucucccagu

SEQ ID NO: 2067997 - RNA, 24 nt, Human
cucuuccccucuaaugcucacgcu

SEQ ID NO: 2067998 - RNA, 15 nt, Human
cucuucccccucucc

SEQ ID NO: 2067999 - RNA, 16 nt, Human
cucuucccccucuccc

SEQ ID NO: 2068000 - RNA, 12 nt, Human
cucuuccccaga

SEQ ID NO: 2068001 - RNA, 21 nt, Human
cucuuccccagaaaggagacu

SEQ ID NO: 2068002 - RNA, 15 nt, Human
cucuuacccuucugu

SEQ ID NO: 2068003 - RNA, 16 nt, Human
cucuuacccuucugug

SEQ ID NO: 2068004 - RNA, 22 nt, Human
cucuuaagcuuccgccgucuca

SEQ ID NO: 2068005 - RNA, 13 nt, Human
cucuucuccaggc

SEQ ID NO: 2068006 - RNA, 15 nt, Human
cucuucuccaggcug

SEQ ID NO: 2068007 - RNA, 13 nt, Human
cucuucuccacug

SEQ ID NO: 2068008 - RNA, 12 nt, Human
cucuucuccacu

SEQ ID NO: 2068009 - RNA, 18 nt, Human
cucuuccuugcuguguca

SEQ ID NO: 2068010 - RNA, 15 nt, Human
cucuucuagagccgu

SEQ ID NO: 2068011 - RNA, 20 nt, Human
cucugccucugacacacagc

SEQ ID NO: 2068012 - RNA, 19 nt, Human
cucugccucugacacacag

SEQ ID NO: 2068013 - RNA, 16 nt, Human
cucugccucugacaca

SEQ ID NO: 2068014 - RNA, 10 nt, Human
cucugccuga

SEQ ID NO: 2068015 - RNA, 17 nt, Human
cucugccucugccugca

SEQ ID NO: 2068016 - RNA, 18 nt, Human
cucuggauugugggaauu

SEQ ID NO: 2068017 - RNA, 13 nt, Human
cucuggcccugcc

SEQ ID NO: 2068018 - RNA, 14 nt, Human
cucuggcccugccu

SEQ ID NO: 2068019 - RNA, 10 nt, Human
cucuggccag

SEQ ID NO: 2068020 - RNA, 15 nt, Human
cucuggccaggaugg

SEQ ID NO: 2068021 - RNA, 19 nt, Human
cucuggccaggauggaggg

SEQ ID NO: 2068022 - RNA, 22 nt, Human
cucuguccugggagugagcugg

SEQ ID NO: 2068023 - RNA, 15 nt, Human
cucuguccugggagu

SEQ ID NO: 2068024 - RNA, 13 nt, Human
cucuguccuggga

SEQ ID NO: 2068025 - RNA, 14 nt, Human
cucuguccugggag

SEQ ID NO: 2068026 - RNA, 15 nt, Human
cucugggcaggaccu

SEQ ID NO: 2068027 - RNA, 14 nt, Human
cucuggcguguggg

SEQ ID NO: 2068028 - RNA, 16 nt, Human
cucuggcuagaggcca

SEQ ID NO: 2068029 - RNA, 16 nt, Human
cucuggcgacaguuuu

SEQ ID NO: 2068030 - RNA, 14 nt, Human
cucuggcuagaggc

SEQ ID NO: 2068031 - RNA, 23 nt, Human
cucugggcaggaccucagagucc

SEQ ID NO: 2068032 - RNA, 23 nt, Human
cucugggccaagucaaagacauu

SEQ ID NO: 2068033 - RNA, 17 nt, Human
cucugggcugccaugug

SEQ ID NO: 2068034 - RNA, 10 nt, Human
cucugggcuu

SEQ ID NO: 2068035 - RNA, 22 nt, Human
cucugggcuuugauuccaucuc

SEQ ID NO: 2068036 - RNA, 23 nt, Human
cucugggcuuugauuccaucucc

SEQ ID NO: 2068037 - RNA, 13 nt, Human
cucugucgcccag

SEQ ID NO: 2068038 - RNA, 17 nt, Human
cucugucgcccagucug

SEQ ID NO: 2068039 - RNA, 15 nt, Human
cucugucuaccaucu

SEQ ID NO: 2068040 - RNA, 16 nt, Human
cucugucuaccaucuc

SEQ ID NO: 2068041 - RNA, 17 nt, Human
cucugucuaccaucucc

SEQ ID NO: 2068042 - RNA, 20 nt, Human
cucugucuaccaucucccuc

SEQ ID NO: 2068043 - RNA, 21 nt, Human
cucugucuaccaucucccucg

SEQ ID NO: 2068044 - RNA, 22 nt, Human
cucugucuaccaucucccucga

SEQ ID NO: 2068045 - RNA, 19 nt, Human
cucugucgcccagucugga

SEQ ID NO: 2068046 - RNA, 18 nt, Human
cucugucgcccagucugg

SEQ ID NO: 2068047 - RNA, 17 nt, Human
cucugaguaucuccucg

SEQ ID NO: 2068048 - RNA, 16 nt, Human
cucugaguuuaccauu

SEQ ID NO: 2068049 - RNA, 17 nt, Human
cucugaguuuaccauuu

SEQ ID NO: 2068050 - RNA, 18 nt, Human
cucugaguuuaccauuug

SEQ ID NO: 2068051 - RNA, 20 nt, Human
cucugaguuuaccauuugua

SEQ ID NO: 2068052 - RNA, 21 nt, Human
cucugaguuuaccauuuguaa

SEQ ID NO: 2068053 - RNA, 22 nt, Human
cucugaguuuaccauuuguaau

SEQ ID NO: 2068054 - RNA, 13 nt, Human
cucugcacaagcu

SEQ ID NO: 2068055 - RNA, 14 nt, Human
cucugcacaagcug

SEQ ID NO: 2068056 - RNA, 15 nt, Human
cucugcacaagcugc

SEQ ID NO: 2068057 - RNA, 19 nt, Human
cucugccaugaacuggagg

SEQ ID NO: 2068058 - RNA, 20 nt, Human
cucugccaugaacuggaggc

SEQ ID NO: 2068059 - RNA, 13 nt, Human
cucugccggcucu

SEQ ID NO: 2068060 - RNA, 17 nt, Human
cucugaagggcaucaug

SEQ ID NO: 2068061 - RNA, 19 nt, Human
cucugaagggcaucaugca

SEQ ID NO: 2068062 - RNA, 22 nt, Human
cucugaagggcaucaugcaucu

SEQ ID NO: 2068063 - RNA, 22 nt, Human
cucugaaggacauugcggacag

SEQ ID NO: 2068064 - RNA, 18 nt, Human
cucgcugcacaaauacuc

SEQ ID NO: 2068065 - RNA, 19 nt, Human
cucugaaggacccuucaga

SEQ ID NO: 2068066 - RNA, 12 nt, Human
cucugaauucca

SEQ ID NO: 2068067 - RNA, 18 nt, Human
cucugaauuccaaguaga

SEQ ID NO: 2068068 - RNA, 16 nt, Human
cucugaaguuggacag

SEQ ID NO: 2068069 - RNA, 17 nt, Human
cucugaaguuggacagc

SEQ ID NO: 2068070 - RNA, 18 nt, Human
cucugaaguuggacagca

SEQ ID NO: 2068071 - RNA, 23 nt, Human
cucugaagucacaucacaggaca

SEQ ID NO: 2068072 - RNA, 23 nt, Human
cucugaagggcaucaugcaucuu

SEQ ID NO: 2068073 - RNA, 13 nt, Human
cucugaagucaca

SEQ ID NO: 2068074 - RNA, 19 nt, Human
cucugacacacagcucugu

SEQ ID NO: 2068075 - RNA, 23 nt, Human
cucugacagaagaaccccagggu

SEQ ID NO: 2068076 - RNA, 18 nt, Human
cucugacacacagcucug

SEQ ID NO: 2068077 - RNA, 17 nt, Human
cucugacacacagcucu

SEQ ID NO: 2068078 - RNA, 16 nt, Human
cucugacacacagcuc

SEQ ID NO: 2068079 - RNA, 15 nt, Human
cucugacacacagcu

SEQ ID NO: 2068080 - RNA, 14 nt, Human
cucugacacacagc

SEQ ID NO: 2068081 - RNA, 17 nt, Human
cucugaccgaaacagcg

SEQ ID NO: 2068082 - RNA, 19 nt, Human
cucugaccgaaacagcgcu

SEQ ID NO: 2068083 - RNA, 22 nt, Human
cucugaccgaaacagcgcuggg

SEQ ID NO: 2068084 - RNA, 23 nt, Human
cucugaccgaaacagcgcugggu

SEQ ID NO: 2068085 - RNA, 13 nt, Human
cucugacucccaa

SEQ ID NO: 2068086 - RNA, 18 nt, Human
cucugacucccaaagagc

SEQ ID NO: 2068087 - RNA, 21 nt, Human
cucugacucccaaagagcugc

SEQ ID NO: 2068088 - RNA, 22 nt, Human
cucugacucccaaagagcugcc

SEQ ID NO: 2068089 - RNA, 23 nt, Human
cucugacucccaaagagcugccu

SEQ ID NO: 2068090 - RNA, 16 nt, Human
cucugaccugcaggcc

SEQ ID NO: 2068091 - RNA, 13 nt, Human
cucugaccugcag

SEQ ID NO: 2068092 - RNA, 14 nt, Human
cucugaccugcagg

SEQ ID NO: 2068093 - RNA, 15 nt, Human
cucugaccugcaggc

SEQ ID NO: 2068094 - RNA, 14 nt, Human
cucugaggacacua

SEQ ID NO: 2068095 - RNA, 12 nt, Human
cucugaggacac

SEQ ID NO: 2068096 - RNA, 16 nt, Human
cucugaguaucuccuc

SEQ ID NO: 2068097 - RNA, 16 nt, Human
cucugaggacacuaac

SEQ ID NO: 2068098 - RNA, 18 nt, Human
cucugacuggcacagucu

SEQ ID NO: 2068099 - RNA, 20 nt, Human
cucuuuguucuaaagaugga

SEQ ID NO: 2068100 - RNA, 21 nt, Human
cucuucugccggcccuggggc

SEQ ID NO: 2068101 - RNA, 15 nt, Human
cucuuuuagucauuu

SEQ ID NO: 2068102 - RNA, 20 nt, Human
cucuuuguggcagaaguguu

SEQ ID NO: 2068103 - RNA, 19 nt, Human
cucuuuuacccaauaagau

SEQ ID NO: 2068104 - RNA, 14 nt, Human
cucuuuucaaaaca

SEQ ID NO: 2068105 - RNA, 18 nt, Human
cugaaaguguuuccuuca

SEQ ID NO: 2068106 - RNA, 22 nt, Human
cugaaaguguuuccuucauuuc

SEQ ID NO: 2068107 - RNA, 16 nt, Human
cucuucuccaggcugu

SEQ ID NO: 2068108 - RNA, 20 nt, Human
cucuucugccggcccugggg

SEQ ID NO: 2068109 - RNA, 12 nt, Human
cucuucugcucc

SEQ ID NO: 2068110 - RNA, 13 nt, Human
cucuucugcucca

SEQ ID NO: 2068111 - RNA, 15 nt, Human
cugaacauuccagag

SEQ ID NO: 2068112 - RNA, 14 nt, Human
cugaaccaucccug

SEQ ID NO: 2068113 - RNA, 16 nt, Human
cugaaccaucccugau

SEQ ID NO: 2068114 - RNA, 13 nt, Human
cugaagaacagua

SEQ ID NO: 2068115 - RNA, 11 nt, Human
cugaacaaaaa

SEQ ID NO: 2068116 - RNA, 13 nt, Human
cugaacaaaaaaa

SEQ ID NO: 2068117 - RNA, 16 nt, Human
cugaacaaaaaauaaa

SEQ ID NO: 2068118 - RNA, 22 nt, Human
cugaauggaagguuuguauauu

SEQ ID NO: 2068119 - RNA, 17 nt, Human
cugaaugcucugugcga

SEQ ID NO: 2068120 - RNA, 12 nt, Human
cugaaugcucug

SEQ ID NO: 2068121 - RNA, 19 nt, Human
cugaaugguuuucaaaaua

SEQ ID NO: 2068122 - RNA, 20 nt, Human
cugaaugguuuucaaaauaa

SEQ ID NO: 2068123 - RNA, 11 nt, Human
cugaauguucu

SEQ ID NO: 2068124 - RNA, 12 nt, Human
cugaauguucug

SEQ ID NO: 2068125 - RNA, 13 nt, Human
cugaauguucuga

SEQ ID NO: 2068126 - RNA, 14 nt, Human
cugaauguucugac

SEQ ID NO: 2068127 - RNA, 16 nt, Human
cugaauguucugacau

SEQ ID NO: 2068128 - RNA, 13 nt, Human
cugaauguaauuu

SEQ ID NO: 2068129 - RNA, 14 nt, Human
cugaauguaauuug

SEQ ID NO: 2068130 - RNA, 15 nt, Human
cugaauguaauuugu

SEQ ID NO: 2068131 - RNA, 16 nt, Human
cugaauguaauuugug

SEQ ID NO: 2068132 - RNA, 17 nt, Human
cugaauguaauuugugu

SEQ ID NO: 2068133 - RNA, 18 nt, Human
cugaauguaauuugugua

SEQ ID NO: 2068134 - RNA, 22 nt, Human
cugaauguaauuuguguaauaa

SEQ ID NO: 2068135 - RNA, 11 nt, Human
cugaauguauu

SEQ ID NO: 2068136 - RNA, 22 nt, Human
cugaauguucugacauuaacag

SEQ ID NO: 2068137 - RNA, 23 nt, Human
cugaauguucugacauuaacagu

SEQ ID NO: 2068138 - RNA, 17 nt, Human
cugaauguucugacauu

SEQ ID NO: 2068139 - RNA, 18 nt, Human
cugaauguucugacauua

SEQ ID NO: 2068140 - RNA, 19 nt, Human
cugaauguucugacauuaa

SEQ ID NO: 2068141 - RNA, 20 nt, Human
cugaauguucugacauuaac

SEQ ID NO: 2068142 - RNA, 20 nt, Human
cugaauuaaugacagagcca

SEQ ID NO: 2068143 - RNA, 22 nt, Human
cugaauuaaugacagagccagu

SEQ ID NO: 2068144 - RNA, 21 nt, Human
cugaauuaaugacagagccag

SEQ ID NO: 2068145 - RNA, 17 nt, Human
cugaagucacacaguga

SEQ ID NO: 2068146 - RNA, 19 nt, Human
cugaagucacacagugagu

SEQ ID NO: 2068147 - RNA, 18 nt, Human
cugaagucacacagugag

SEQ ID NO: 2068148 - RNA, 15 nt, Human
cugaagucacugcac

SEQ ID NO: 2068149 - RNA, 14 nt, Human
cugaagucacugca

SEQ ID NO: 2068150 - RNA, 13 nt, Human
cugaagucacugc

SEQ ID NO: 2068151 - RNA, 21 nt, Human
cugaagucacaucacaggaca

SEQ ID NO: 2068152 - RNA, 22 nt, Human
cugaagucacaucacaggacac

SEQ ID NO: 2068153 - RNA, 21 nt, Human
cugaagucacacagugagucg

SEQ ID NO: 2068154 - RNA, 19 nt, Human
cugaagucacaucacagga

SEQ ID NO: 2068155 - RNA, 16 nt, Human
cugaaguuaacagaga

SEQ ID NO: 2068156 - RNA, 15 nt, Human
cugaaguuucauuua

SEQ ID NO: 2068157 - RNA, 17 nt, Human
cugaaguuucauuuaug

SEQ ID NO: 2068158 - RNA, 14 nt, Human
cugaaguuggacag

SEQ ID NO: 2068159 - RNA, 15 nt, Human
cugaaguuggacagc

SEQ ID NO: 2068160 - RNA, 22 nt, Human
cugaaguuggagugaguguggc

SEQ ID NO: 2068161 - RNA, 22 nt, Human
cugaagucccagauacuugggg

SEQ ID NO: 2068162 - RNA, 15 nt, Human
cugagccaaagagaa

SEQ ID NO: 2068163 - RNA, 13 nt, Human
cugagcagggaga

SEQ ID NO: 2068164 - RNA, 13 nt, Human
cugagcaccuccc

SEQ ID NO: 2068165 - RNA, 15 nt, Human
cugagcaccucccag

SEQ ID NO: 2068166 - RNA, 16 nt, Human
cugagcaccucccagc

SEQ ID NO: 2068167 - RNA, 17 nt, Human
cugagcaccucccagcc

SEQ ID NO: 2068168 - RNA, 18 nt, Human
cugagcaccucccagccc

SEQ ID NO: 2068169 - RNA, 21 nt, Human
cugagcaccucccagccccug

SEQ ID NO: 2068170 - RNA, 22 nt, Human
cugagcaccucccagccccugc

SEQ ID NO: 2068171 - RNA, 13 nt, Human
cugagcaccaggg

SEQ ID NO: 2068172 - RNA, 21 nt, Human
cugagcagacuggugagcaga

SEQ ID NO: 2068173 - RNA, 22 nt, Human
cugagcagacuggugagcagac

SEQ ID NO: 2068174 - RNA, 16 nt, Human
cugagcagacugguga

SEQ ID NO: 2068175 - RNA, 17 nt, Human
cugagcagacuggugag

SEQ ID NO: 2068176 - RNA, 19 nt, Human
cugagauuauuuuaaucua

SEQ ID NO: 2068177 - RNA, 21 nt, Human
cugagcaaauguggcuccugg

SEQ ID NO: 2068178 - RNA, 20 nt, Human
cugagcaaauguggcuccug

SEQ ID NO: 2068179 - RNA, 17 nt, Human
cugagcaaauguggcuc

SEQ ID NO: 2068180 - RNA, 15 nt, Human
cugagcaaauguggc

SEQ ID NO: 2068181 - RNA, 18 nt, Human
cugagcaagacccugucu

SEQ ID NO: 2068182 - RNA, 20 nt, Human
cugagcaagacccugucucu

SEQ ID NO: 2068183 - RNA, 12 nt, Human
cugagcaaagca

SEQ ID NO: 2068184 - RNA, 16 nt, Human
cugagcaacagaguga

SEQ ID NO: 2068185 - RNA, 23 nt, Human
cugagcaacagagugagacccug

SEQ ID NO: 2068186 - RNA, 24 nt, Human
cugagcaacagagugagacccugu

SEQ ID NO: 2068187 - RNA, 13 nt, Human
cugacuccuuaga

SEQ ID NO: 2068188 - RNA, 15 nt, Human
cugacuccuuagaga

SEQ ID NO: 2068189 - RNA, 19 nt, Human
cugacugauguugagggaa

SEQ ID NO: 2068190 - RNA, 18 nt, Human
cugacucccaaagagcug

SEQ ID NO: 2068191 - RNA, 19 nt, Human
cugacucccaaagagcugc

SEQ ID NO: 2068192 - RNA, 20 nt, Human
cugacucccaaagagcugcc

SEQ ID NO: 2068193 - RNA, 21 nt, Human
cugacucccaaagagcugccu

SEQ ID NO: 2068194 - RNA, 22 nt, Human
cugacucccaaagagcugccua

SEQ ID NO: 2068195 - RNA, 23 nt, Human
cugacucccaaagagcugccuaa

SEQ ID NO: 2068196 - RNA, 17 nt, Human
cugacuguacuccuccc

SEQ ID NO: 2068197 - RNA, 18 nt, Human
cugacuuugcucuuucuu

SEQ ID NO: 2068198 - RNA, 23 nt, Human
cugagaaaaugagugacuagacg

SEQ ID NO: 2068199 - RNA, 19 nt, Human
cugagaaaacgaaacugcu

SEQ ID NO: 2068200 - RNA, 21 nt, Human
cugagaaaacgaaacugcucu

SEQ ID NO: 2068201 - RNA, 22 nt, Human
cugagaaaacgaaacugcucua

SEQ ID NO: 2068202 - RNA, 18 nt, Human
cugacagacacaggcccg

SEQ ID NO: 2068203 - RNA, 17 nt, Human
cugacagacacaggccc

SEQ ID NO: 2068204 - RNA, 17 nt, Human
cugaccagccuccaugc

SEQ ID NO: 2068205 - RNA, 16 nt, Human
cugacagacacaggcc

SEQ ID NO: 2068206 - RNA, 21 nt, Human
cugaauuuggccugcacuaau

SEQ ID NO: 2068207 - RNA, 23 nt, Human
cugaccagccuccaugcugccuc

SEQ ID NO: 2068208 - RNA, 21 nt, Human
cugaccagccuccaugcugcc

SEQ ID NO: 2068209 - RNA, 23 nt, Human
cugaccuuugucaucuuucuucu

SEQ ID NO: 2068210 - RNA, 21 nt, Human
cugaccuuugucaucuuucuu

SEQ ID NO: 2068211 - RNA, 23 nt, Human
cugacgacuugagugcucaguag

SEQ ID NO: 2068212 - RNA, 13 nt, Human
cugacgaggcugg

SEQ ID NO: 2068213 - RNA, 14 nt, Human
cugacgaggcuggg

SEQ ID NO: 2068214 - RNA, 15 nt, Human
cugacgaggcugggc

SEQ ID NO: 2068215 - RNA, 16 nt, Human
cugacgaggcugggcc

SEQ ID NO: 2068216 - RNA, 17 nt, Human
cugacgaggcugggcca

SEQ ID NO: 2068217 - RNA, 19 nt, Human
cugacgaggcugggccaag

SEQ ID NO: 2068218 - RNA, 20 nt, Human
cugacgaggcugggccaagc

SEQ ID NO: 2068219 - RNA, 21 nt, Human
cugacgaggcugggccaagcc

SEQ ID NO: 2068220 - RNA, 14 nt, Human
cugacggcgccccc

SEQ ID NO: 2068221 - RNA, 19 nt, Human
cugacggcgcccccagugu

SEQ ID NO: 2068222 - RNA, 20 nt, Human
cugacggcgcccccagugug

SEQ ID NO: 2068223 - RNA, 22 nt, Human
cugacggcgcccccagugugca

SEQ ID NO: 2068224 - RNA, 14 nt, Human
cugaggcuggacuc

SEQ ID NO: 2068225 - RNA, 17 nt, Human
cugaggcuggacuccag

SEQ ID NO: 2068226 - RNA, 18 nt, Human
cugaggcuggacuccaga

SEQ ID NO: 2068227 - RNA, 24 nt, Human
cugaggcuggacuccagaucugca

SEQ ID NO: 2068228 - RNA, 15 nt, Human
cugaggcugagacug

SEQ ID NO: 2068229 - RNA, 18 nt, Human
cugaggcucuuucugggc

SEQ ID NO: 2068230 - RNA, 20 nt, Human
cugaggcucuuucugggcca

SEQ ID NO: 2068231 - RNA, 18 nt, Human
cugagggaccagccaaga

SEQ ID NO: 2068232 - RNA, 22 nt, Human
cugagucacccaugaagacagg

SEQ ID NO: 2068233 - RNA, 18 nt, Human
cugagucaugaucucccu

SEQ ID NO: 2068234 - RNA, 19 nt, Human
cugagucaugaucucccug

SEQ ID NO: 2068235 - RNA, 22 nt, Human
cugagccccugggacugcugcu

SEQ ID NO: 2068236 - RNA, 16 nt, Human
cugagccccugggacu

SEQ ID NO: 2068237 - RNA, 19 nt, Human
cugagccccugggacugcu

SEQ ID NO: 2068238 - RNA, 15 nt, Human
cugaggcucuuucug

SEQ ID NO: 2068239 - RNA, 16 nt, Human
cugaggcucuuucugg

SEQ ID NO: 2068240 - RNA, 18 nt, Human
cugaggcggguggaucac

SEQ ID NO: 2068241 - RNA, 13 nt, Human
cugaucagucuaa

SEQ ID NO: 2068242 - RNA, 20 nt, Human
cugaucacuaugcauuuuaa

SEQ ID NO: 2068243 - RNA, 19 nt, Human
cugauauuccaugaaugua

SEQ ID NO: 2068244 - RNA, 18 nt, Human
cugauauuccaugaaugu

SEQ ID NO: 2068245 - RNA, 17 nt, Human
cugaguucaagggcugu

SEQ ID NO: 2068246 - RNA, 18 nt, Human
cugaucaagucaccggag

SEQ ID NO: 2068247 - RNA, 22 nt, Human
cugaucaagucaccggagcuuu

SEQ ID NO: 2068248 - RNA, 22 nt, Human
cugauauauguguuuuucacau

SEQ ID NO: 2068249 - RNA, 12 nt, Human
cugauauagaau

SEQ ID NO: 2068250 - RNA, 15 nt, Human
cugauauagaauugc

SEQ ID NO: 2068251 - RNA, 22 nt, Human
cugauauagaucacauaacaga

SEQ ID NO: 2068252 - RNA, 15 nt, Human
cugauauauguguuu

SEQ ID NO: 2068253 - RNA, 21 nt, Human
cugauauauguguuuuucaca

SEQ ID NO: 2068254 - RNA, 20 nt, Human
cugagucaugaucucccugc

SEQ ID NO: 2068255 - RNA, 21 nt, Human
cugagucaugaucucccugcc

SEQ ID NO: 2068256 - RNA, 22 nt, Human
cugagucaugaucucccugccg

SEQ ID NO: 2068257 - RNA, 21 nt, Human
cugaguugguguugacaugug

SEQ ID NO: 2068258 - RNA, 15 nt, Human
cugaguuuaccauuu

SEQ ID NO: 2068259 - RNA, 17 nt, Human
cugaguuuaccauuugu

SEQ ID NO: 2068260 - RNA, 18 nt, Human
cugaguuuaccauuugua

SEQ ID NO: 2068261 - RNA, 19 nt, Human
cugaguuuaccauuuguaa

SEQ ID NO: 2068262 - RNA, 20 nt, Human
cugaguuuaccauuuguaau

SEQ ID NO: 2068263 - RNA, 21 nt, Human
cugaguuuaccauuuguaaua

SEQ ID NO: 2068264 - RNA, 22 nt, Human
cugaguuuaccauuuguaauaa

SEQ ID NO: 2068265 - RNA, 23 nt, Human
cugaguuuaccauuuguaauaaa

SEQ ID NO: 2068266 - RNA, 20 nt, Human
cugaguugacuugacagaac

SEQ ID NO: 2068267 - RNA, 22 nt, Human
cugcacagugcaucucagccca

SEQ ID NO: 2068268 - RNA, 23 nt, Human
cugcacagauggauuugccugug

SEQ ID NO: 2068269 - RNA, 20 nt, Human
cugcacagauggauuugccu

SEQ ID NO: 2068270 - RNA, 12 nt, Human
cugcacagaugg

SEQ ID NO: 2068271 - RNA, 13 nt, Human
cugcacagaugga

SEQ ID NO: 2068272 - RNA, 19 nt, Human
cugcaagugagcaaaccug

SEQ ID NO: 2068273 - RNA, 22 nt, Human
cugcaagugagcaaaccugccc

SEQ ID NO: 2068274 - RNA, 19 nt, Human
cugcaagugacaucucuuu

SEQ ID NO: 2068275 - RNA, 22 nt, Human
cugcacaagcugcacccucagg

SEQ ID NO: 2068276 - RNA, 12 nt, Human
cugcaauagaga

SEQ ID NO: 2068277 - RNA, 14 nt, Human
cugcaauagagacu

SEQ ID NO: 2068278 - RNA, 15 nt, Human
cugcaauagagacug

SEQ ID NO: 2068279 - RNA, 12 nt, Human
cugcaccgggcc

SEQ ID NO: 2068280 - RNA, 13 nt, Human
cugcacccucagg

SEQ ID NO: 2068281 - RNA, 14 nt, Human
cugcacccucaggc

SEQ ID NO: 2068282 - RNA, 16 nt, Human
cugcacccucaggcag

SEQ ID NO: 2068283 - RNA, 19 nt, Human
cugcacugacccacagccu

SEQ ID NO: 2068284 - RNA, 20 nt, Human
cugcacugacccacagccuc

SEQ ID NO: 2068285 - RNA, 19 nt, Human
cugcacucuuaagcuuccg

SEQ ID NO: 2068286 - RNA, 18 nt, Human
cugcacuugcagacucua

SEQ ID NO: 2068287 - RNA, 17 nt, Human
cugauuguuucauugcg

SEQ ID NO: 2068288 - RNA, 12 nt, Human
cugauuucagga

SEQ ID NO: 2068289 - RNA, 13 nt, Human
cugauuucuugcu

SEQ ID NO: 2068290 - RNA, 14 nt, Human
cugauuucuugcuu

SEQ ID NO: 2068291 - RNA, 17 nt, Human
cugauuggugcaacccu

SEQ ID NO: 2068292 - RNA, 15 nt, Human
cugauguaaaugaag

SEQ ID NO: 2068293 - RNA, 16 nt, Human
cugauguaaaugaagu

SEQ ID NO: 2068294 - RNA, 17 nt, Human
cugauguaaaugaagua

SEQ ID NO: 2068295 - RNA, 12 nt, Human
cugauuuuaaca

SEQ ID NO: 2068296 - RNA, 13 nt, Human
cugauuuuaacaa

SEQ ID NO: 2068297 - RNA, 14 nt, Human
cugauuuuaacaau

SEQ ID NO: 2068298 - RNA, 17 nt, Human
cugauuuuaacaauaac

SEQ ID NO: 2068299 - RNA, 22 nt, Human
cugauuuuaacaauaacuacug

SEQ ID NO: 2068300 - RNA, 11 nt, Human
cugccaggcau

SEQ ID NO: 2068301 - RNA, 13 nt, Human
cugccaggcaugg

SEQ ID NO: 2068302 - RNA, 19 nt, Human
cugccacuuugguacaugg

SEQ ID NO: 2068303 - RNA, 15 nt, Human
cugccacuaggcugg

SEQ ID NO: 2068304 - RNA, 16 nt, Human
cugccacuaggcuggg

SEQ ID NO: 2068305 - RNA, 18 nt, Human
cugccacuaggcugggug

SEQ ID NO: 2068306 - RNA, 19 nt, Human
cugccacuaggcugggugc

SEQ ID NO: 2068307 - RNA, 22 nt, Human
cugccacuaggcugggugccca

SEQ ID NO: 2068308 - RNA, 23 nt, Human
cugccacuaggcugggugcccac

SEQ ID NO: 2068309 - RNA, 14 nt, Human
cugccaugccagcu

SEQ ID NO: 2068310 - RNA, 23 nt, Human
cugccacuuugguacauggccag

SEQ ID NO: 2068311 - RNA, 15 nt, Human
cugccaugccagcuu

SEQ ID NO: 2068312 - RNA, 15 nt, Human
cugccaugaacugga

SEQ ID NO: 2068313 - RNA, 18 nt, Human
cugccaugaacuggaggc

SEQ ID NO: 2068314 - RNA, 23 nt, Human
cugccaugaacuggaggccagga

SEQ ID NO: 2068315 - RNA, 17 nt, Human
cugcccagccuccaagc

SEQ ID NO: 2068316 - RNA, 20 nt, Human
cugcccagaauucccagcug

SEQ ID NO: 2068317 - RNA, 21 nt, Human
cugcccagaauucccagcugu

SEQ ID NO: 2068318 - RNA, 22 nt, Human
cugcccagaauucccagcuguc

SEQ ID NO: 2068319 - RNA, 18 nt, Human
cugcccagaccccucugg

SEQ ID NO: 2068320 - RNA, 21 nt, Human
cugcccagaccccucuggcca

SEQ ID NO: 2068321 - RNA, 22 nt, Human
cugcccagaccccucuggccag

SEQ ID NO: 2068322 - RNA, 23 nt, Human
cugcccagaccccucuggccagg

SEQ ID NO: 2068323 - RNA, 13 nt, Human
cugcccagagcug

SEQ ID NO: 2068324 - RNA, 14 nt, Human
cugcccagagcugg

SEQ ID NO: 2068325 - RNA, 15 nt, Human
cugcccagagcuggg

SEQ ID NO: 2068326 - RNA, 17 nt, Human
cugcccagagcugggug

SEQ ID NO: 2068327 - RNA, 18 nt, Human
cugcccagagcuggguga

SEQ ID NO: 2068328 - RNA, 12 nt, Human
cugcccaccugu

SEQ ID NO: 2068329 - RNA, 11 nt, Human
cugcccagugu

SEQ ID NO: 2068330 - RNA, 12 nt, Human
cugcccaguguu

SEQ ID NO: 2068331 - RNA, 20 nt, Human
cugcccaguguuguuuguaa

SEQ ID NO: 2068332 - RNA, 21 nt, Human
cugcccaguguuguuuguaaa

SEQ ID NO: 2068333 - RNA, 22 nt, Human
cugcccaguguuguuuguaaau

SEQ ID NO: 2068334 - RNA, 23 nt, Human
cugcccaguguuguuuguaaaua

SEQ ID NO: 2068335 - RNA, 18 nt, Human
cugcccagaucccagaag

SEQ ID NO: 2068336 - RNA, 15 nt, Human
cugcccaucacaggg

SEQ ID NO: 2068337 - RNA, 18 nt, Human
cugcccaucacaggguug

SEQ ID NO: 2068338 - RNA, 22 nt, Human
cugcccaucacaggguugggcc

SEQ ID NO: 2068339 - RNA, 15 nt, Human
cugccccaaacaaau

SEQ ID NO: 2068340 - RNA, 15 nt, Human
cugcccauuccccag

SEQ ID NO: 2068341 - RNA, 16 nt, Human
cugcacuggaguccag

SEQ ID NO: 2068342 - RNA, 23 nt, Human
cugcacuugcagacucuacagag

SEQ ID NO: 2068343 - RNA, 16 nt, Human
cugcacucuagccgga

SEQ ID NO: 2068344 - RNA, 13 nt, Human
cugcaucaucugu

SEQ ID NO: 2068345 - RNA, 14 nt, Human
cugcaucaucugua

SEQ ID NO: 2068346 - RNA, 17 nt, Human
cugcaucaucuguagau

SEQ ID NO: 2068347 - RNA, 18 nt, Human
cugcaucaucuguagaua

SEQ ID NO: 2068348 - RNA, 22 nt, Human
cugcaucguuucaucuuccaac

SEQ ID NO: 2068349 - RNA, 14 nt, Human
cugcaucuacucag

SEQ ID NO: 2068350 - RNA, 17 nt, Human
cugcaucuacucaggcc

SEQ ID NO: 2068351 - RNA, 20 nt, Human
cugcauccguaguucccuga

SEQ ID NO: 2068352 - RNA, 21 nt, Human
cugcauccguaguucccugaa

SEQ ID NO: 2068353 - RNA, 19 nt, Human
cugcauccguaguucccug

SEQ ID NO: 2068354 - RNA, 16 nt, Human
cugcaucguuucaucu

SEQ ID NO: 2068355 - RNA, 12 nt, Human
cugcauggaccu

SEQ ID NO: 2068356 - RNA, 13 nt, Human
cugcauggaccua

SEQ ID NO: 2068357 - RNA, 16 nt, Human
cugcauggaccuaaca

SEQ ID NO: 2068358 - RNA, 17 nt, Human
cugcauggaccuaacau

SEQ ID NO: 2068359 - RNA, 18 nt, Human
cugcauggaccuaacauu

SEQ ID NO: 2068360 - RNA, 19 nt, Human
cugcauggaccuaacauuc

SEQ ID NO: 2068361 - RNA, 22 nt, Human
cugcauggaccuaacauucgau

SEQ ID NO: 2068362 - RNA, 11 nt, Human
cugcaugcaga

SEQ ID NO: 2068363 - RNA, 15 nt, Human
cugcaugcagaaagg

SEQ ID NO: 2068364 - RNA, 22 nt, Human
cugccacacgucugacccucuc

SEQ ID NO: 2068365 - RNA, 23 nt, Human
cugccacacgucugacccucucc

SEQ ID NO: 2068366 - RNA, 24 nt, Human
cugccacacgucugacccucucca

SEQ ID NO: 2068367 - RNA, 15 nt, Human
cugccaccugcugcu

SEQ ID NO: 2068368 - RNA, 14 nt, Human
cugccaccuggggc

SEQ ID NO: 2068369 - RNA, 15 nt, Human
cugccaccuggggca

SEQ ID NO: 2068370 - RNA, 16 nt, Human
cugccaccuggggcag

SEQ ID NO: 2068371 - RNA, 18 nt, Human
cugccaccuggggcaguc

SEQ ID NO: 2068372 - RNA, 15 nt, Human
cugcaugguaauuua

SEQ ID NO: 2068373 - RNA, 16 nt, Human
cugcaugguaauuuau

SEQ ID NO: 2068374 - RNA, 17 nt, Human
cugcaugguaauuuaua

SEQ ID NO: 2068375 - RNA, 19 nt, Human
cugcaugguaauuuauagu

SEQ ID NO: 2068376 - RNA, 20 nt, Human
cugcaugguaauuuauaguu

SEQ ID NO: 2068377 - RNA, 18 nt, Human
cugcgguccacccaggag

SEQ ID NO: 2068378 - RNA, 20 nt, Human
cugcgggaugguccuggggc

SEQ ID NO: 2068379 - RNA, 22 nt, Human
cugcgggaugguccuggggcuc

SEQ ID NO: 2068380 - RNA, 20 nt, Human
cugcgguccacccaggagcc

SEQ ID NO: 2068381 - RNA, 19 nt, Human
cugcgguccacccaggagc

SEQ ID NO: 2068382 - RNA, 13 nt, Human
cugcguggcugac

SEQ ID NO: 2068383 - RNA, 15 nt, Human
cugcguggcugaccc

SEQ ID NO: 2068384 - RNA, 16 nt, Human
cugcguggcugacccc

SEQ ID NO: 2068385 - RNA, 17 nt, Human
cugcguggcugaccccc

SEQ ID NO: 2068386 - RNA, 20 nt, Human
cugcguggcugaccccccuc

SEQ ID NO: 2068387 - RNA, 23 nt, Human
cugcguggcugaccccccucagg

SEQ ID NO: 2068388 - RNA, 13 nt, Human
cugcgucuguguu

SEQ ID NO: 2068389 - RNA, 17 nt, Human
cugcgaaggggcccugg

SEQ ID NO: 2068390 - RNA, 22 nt, Human
cugccuugaagccacugaagcu

SEQ ID NO: 2068391 - RNA, 18 nt, Human
cugccuuugcagaaacag

SEQ ID NO: 2068392 - RNA, 19 nt, Human
cugccuuugcagaaacaga

SEQ ID NO: 2068393 - RNA, 21 nt, Human
cugccuuugcagaaacagauu

SEQ ID NO: 2068394 - RNA, 18 nt, Human
cugcgaaggggcccuggu

SEQ ID NO: 2068395 - RNA, 19 nt, Human
cugcgaaggggcccugguc

SEQ ID NO: 2068396 - RNA, 15 nt, Human
cugcggccugcugga

SEQ ID NO: 2068397 - RNA, 21 nt, Human
cugcggcacccuugcgcuuuu

SEQ ID NO: 2068398 - RNA, 14 nt, Human
cugcggcaucagau

SEQ ID NO: 2068399 - RNA, 17 nt, Human
cugcgggaugguccugg

SEQ ID NO: 2068400 - RNA, 18 nt, Human
cugcgggaugguccuggg

SEQ ID NO: 2068401 - RNA, 19 nt, Human
cugcgggaugguccugggg

SEQ ID NO: 2068402 - RNA, 22 nt, Human
cugccugcccaggccccugcca

SEQ ID NO: 2068403 - RNA, 21 nt, Human
cugccugcccaggccccugcc

SEQ ID NO: 2068404 - RNA, 20 nt, Human
cugccuggaagagcagcccu

SEQ ID NO: 2068405 - RNA, 21 nt, Human
cugccucugacacacagcucu

SEQ ID NO: 2068406 - RNA, 18 nt, Human
cugccucugacacacagc

SEQ ID NO: 2068407 - RNA, 17 nt, Human
cugccucugacacacag

SEQ ID NO: 2068408 - RNA, 13 nt, Human
cugccuucguuaa

SEQ ID NO: 2068409 - RNA, 19 nt, Human
cugccuucguuaacugugu

SEQ ID NO: 2068410 - RNA, 20 nt, Human
cugccuucguuaacugugua

SEQ ID NO: 2068411 - RNA, 21 nt, Human
cugccuucguuaacuguguau

SEQ ID NO: 2068412 - RNA, 24 nt, Human
cugccuucuucggggaacuccugg

SEQ ID NO: 2068413 - RNA, 16 nt, Human
cugccuugaagccacu

SEQ ID NO: 2068414 - RNA, 20 nt, Human
cugccuugaagccacugaag

SEQ ID NO: 2068415 - RNA, 21 nt, Human
cugccuugaagccacugaagc

SEQ ID NO: 2068416 - RNA, 12 nt, Human
cugccuggagcc

SEQ ID NO: 2068417 - RNA, 13 nt, Human
cugccuggagccc

SEQ ID NO: 2068418 - RNA, 15 nt, Human
cugccuggagcccca

SEQ ID NO: 2068419 - RNA, 16 nt, Human
cugccuggagccccac

SEQ ID NO: 2068420 - RNA, 19 nt, Human
cugccuggagccccacugc

SEQ ID NO: 2068421 - RNA, 21 nt, Human
cugccuggagccccacugccc

SEQ ID NO: 2068422 - RNA, 13 nt, Human
cugccccugcccc

SEQ ID NO: 2068423 - RNA, 11 nt, Human
cugccccugcc

SEQ ID NO: 2068424 - RNA, 14 nt, Human
cugccccugccccg

SEQ ID NO: 2068425 - RNA, 10 nt, Human
cugccccugc

SEQ ID NO: 2068426 - RNA, 21 nt, Human
cugccccaaacaaauaugcaa

SEQ ID NO: 2068427 - RNA, 19 nt, Human
cugccccaaaggaagcuuu

SEQ ID NO: 2068428 - RNA, 15 nt, Human
cugccgcaccccaga

SEQ ID NO: 2068429 - RNA, 14 nt, Human
cugccgcaccccag

SEQ ID NO: 2068430 - RNA, 16 nt, Human
cugccccugccccguc

SEQ ID NO: 2068431 - RNA, 17 nt, Human
cugccccugccccguca

SEQ ID NO: 2068432 - RNA, 16 nt, Human
cugccgcaccccagag

SEQ ID NO: 2068433 - RNA, 17 nt, Human
cugccgcaccccagagu

SEQ ID NO: 2068434 - RNA, 14 nt, Human
cugccgccucccag

SEQ ID NO: 2068435 - RNA, 15 nt, Human
cugccgccucccagc

SEQ ID NO: 2068436 - RNA, 16 nt, Human
cugccgccucccagcc

SEQ ID NO: 2068437 - RNA, 18 nt, Human
cugccgccucccagccug

SEQ ID NO: 2068438 - RNA, 19 nt, Human
cugccgccucccagccugg

SEQ ID NO: 2068439 - RNA, 19 nt, Human
cugccuaggaauucccagc

SEQ ID NO: 2068440 - RNA, 17 nt, Human
cugccuagcacucacau

SEQ ID NO: 2068441 - RNA, 19 nt, Human
cugccuagcacucacaugc

SEQ ID NO: 2068442 - RNA, 20 nt, Human
cugccuagcacucacaugcu

SEQ ID NO: 2068443 - RNA, 22 nt, Human
cugccuagcacucacaugcugg

SEQ ID NO: 2068444 - RNA, 23 nt, Human
cugccuagcacucacaugcugga

SEQ ID NO: 2068445 - RNA, 19 nt, Human
cugccuaaguggcugcuga

SEQ ID NO: 2068446 - RNA, 15 nt, Human
cugccggcccugggg

SEQ ID NO: 2068447 - RNA, 16 nt, Human
cugccggcccuggggc

SEQ ID NO: 2068448 - RNA, 21 nt, Human
cugccggcccuggggcuaggc

SEQ ID NO: 2068449 - RNA, 20 nt, Human
cugccuaaguggcugcugac

SEQ ID NO: 2068450 - RNA, 13 nt, Human
cugccuacucacg

SEQ ID NO: 2068451 - RNA, 14 nt, Human
cugccuacucacga

SEQ ID NO: 2068452 - RNA, 19 nt, Human
cugccucagccucccaaag

SEQ ID NO: 2068453 - RNA, 15 nt, Human
cugccucagccuccc

SEQ ID NO: 2068454 - RNA, 16 nt, Human
cugccuaggcugaccu

SEQ ID NO: 2068455 - RNA, 22 nt, Human
cugccgcccgagguggcugccu

SEQ ID NO: 2068456 - RNA, 14 nt, Human
cugccuccagaaug

SEQ ID NO: 2068457 - RNA, 15 nt, Human
cugccuauugcagcu

SEQ ID NO: 2068458 - RNA, 21 nt, Human
cugccuauugcagcugggaga

SEQ ID NO: 2068459 - RNA, 22 nt, Human
cugccuauugcagcugggagaa

SEQ ID NO: 2068460 - RNA, 22 nt, Human
cugccuccagaauggucuuucu

SEQ ID NO: 2068461 - RNA, 21 nt, Human
cuccugccucagccuccugag

SEQ ID NO: 2068462 - RNA, 18 nt, Human
cuccugccucgaacuggc

SEQ ID NO: 2068463 - RNA, 21 nt, Human
cuccugccucgaacuggcugc

SEQ ID NO: 2068464 - RNA, 20 nt, Human
cuccugccucgaacuggcug

SEQ ID NO: 2068465 - RNA, 22 nt, Human
cuccugccucgaacuggcugca

SEQ ID NO: 2068466 - RNA, 15 nt, Human
cuccucuccccagca

SEQ ID NO: 2068467 - RNA, 13 nt, Human
cuccucuccccag

SEQ ID NO: 2068468 - RNA, 14 nt, Human
cuccugccuacuca

SEQ ID NO: 2068469 - RNA, 16 nt, Human
cuccugccuacucacg

SEQ ID NO: 2068470 - RNA, 13 nt, Human
cuccugccuacuc

SEQ ID NO: 2068471 - RNA, 11 nt, Human
cuccugccuca

SEQ ID NO: 2068472 - RNA, 12 nt, Human
cuccugccucag

SEQ ID NO: 2068473 - RNA, 16 nt, Human
cuccugccucagccuc

SEQ ID NO: 2068474 - RNA, 17 nt, Human
cuccugccucagccucc

SEQ ID NO: 2068475 - RNA, 13 nt, Human
cuccuuagaagug

SEQ ID NO: 2068476 - RNA, 17 nt, Human
cuccuuagaaguggaag

SEQ ID NO: 2068477 - RNA, 20 nt, Human
cuccuuagaaguggaaguag

SEQ ID NO: 2068478 - RNA, 16 nt, Human
cuccuuagucuucuca

SEQ ID NO: 2068479 - RNA, 14 nt, Human
cuccuuagcugcca

SEQ ID NO: 2068480 - RNA, 15 nt, Human
cuccuuagcugccaa

SEQ ID NO: 2068481 - RNA, 22 nt, Human
cuccuuagcugccaagccccau

SEQ ID NO: 2068482 - RNA, 20 nt, Human
cuccuuagagacaucaaaau

SEQ ID NO: 2068483 - RNA, 21 nt, Human
cuccuuagagacaucaaaauc

SEQ ID NO: 2068484 - RNA, 17 nt, Human
cuccuuagucuucucau

SEQ ID NO: 2068485 - RNA, 19 nt, Human
cuccuuagucuucucauag

SEQ ID NO: 2068486 - RNA, 13 nt, Human
cuccuucccagcu

SEQ ID NO: 2068487 - RNA, 14 nt, Human
cuccuucccagcug

SEQ ID NO: 2068488 - RNA, 15 nt, Human
cuccuucccagcugc

SEQ ID NO: 2068489 - RNA, 16 nt, Human
cuccuucccagcugcc

SEQ ID NO: 2068490 - RNA, 17 nt, Human
cuccuucccagcugccc

SEQ ID NO: 2068491 - RNA, 18 nt, Human
cuccuucccagcugcccc

SEQ ID NO: 2068492 - RNA, 19 nt, Human
cuccuucccagcugccccu

SEQ ID NO: 2068493 - RNA, 20 nt, Human
cuccuucccagcugccccuc

SEQ ID NO: 2068494 - RNA, 22 nt, Human
cuccuucccagcugccccuccc

SEQ ID NO: 2068495 - RNA, 24 nt, Human
cuccugugugugcgccuacaggag

SEQ ID NO: 2068496 - RNA, 23 nt, Human
cuccugugugugcgccuacagga

SEQ ID NO: 2068497 - RNA, 20 nt, Human
cuccuggaagcuguguccuu

SEQ ID NO: 2068498 - RNA, 23 nt, Human
cuccuggaagcuguguccuugca

SEQ ID NO: 2068499 - RNA, 21 nt, Human
cuccugugugugcgccuacag

SEQ ID NO: 2068500 - RNA, 14 nt, Human
cuccuggaaauauu

SEQ ID NO: 2068501 - RNA, 11 nt, Human
cuccuggaaau

SEQ ID NO: 2068502 - RNA, 15 nt, Human
cuccuggaagcugug

SEQ ID NO: 2068503 - RNA, 17 nt, Human
cuccuggaagcuguguc

SEQ ID NO: 2068504 - RNA, 17 nt, Human
cuccuggaaaggcucag

SEQ ID NO: 2068505 - RNA, 18 nt, Human
cuccuggaaaggcucagu

SEQ ID NO: 2068506 - RNA, 19 nt, Human
cuccuggaaaggcucaguc

SEQ ID NO: 2068507 - RNA, 20 nt, Human
cuccuggaaaggcucagucu

SEQ ID NO: 2068508 - RNA, 22 nt, Human
cuccuggaaaggcucagucuca

SEQ ID NO: 2068509 - RNA, 23 nt, Human
cuccuggaaaggcucagucucag

SEQ ID NO: 2068510 - RNA, 24 nt, Human
cuccuggaaaggcucagucucagg

SEQ ID NO: 2068511 - RNA, 17 nt, Human
cucgagcaguccugccu

SEQ ID NO: 2068512 - RNA, 14 nt, Human
cuccuuccuugacc

SEQ ID NO: 2068513 - RNA, 17 nt, Human
cuccuuccuugaccagc

SEQ ID NO: 2068514 - RNA, 18 nt, Human
cuccuuccuugaccagca

SEQ ID NO: 2068515 - RNA, 22 nt, Human
cuccuuccuugcuguccuaggc

SEQ ID NO: 2068516 - RNA, 21 nt, Human
cuccuuccugccaccugcugc

SEQ ID NO: 2068517 - RNA, 16 nt, Human
cuccuuccugccaccu

SEQ ID NO: 2068518 - RNA, 14 nt, Human
cuccuuccugucuu

SEQ ID NO: 2068519 - RNA, 15 nt, Human
cuccuuccugucuuc

SEQ ID NO: 2068520 - RNA, 16 nt, Human
cuccuuccugucuucc

SEQ ID NO: 2068521 - RNA, 17 nt, Human
cuccuuccugucuuccu

SEQ ID NO: 2068522 - RNA, 13 nt, Human
cuccuuccugucu

SEQ ID NO: 2068523 - RNA, 12 nt, Human
cuccuuccuguc

SEQ ID NO: 2068524 - RNA, 22 nt, Human
cucgacuggaggaccacacuca

SEQ ID NO: 2068525 - RNA, 16 nt, Human
cucgccgucugugaau

SEQ ID NO: 2068526 - RNA, 15 nt, Human
cucgccgucugugaa

SEQ ID NO: 2068527 - RNA, 12 nt, Human
cucgcccugggu

SEQ ID NO: 2068528 - RNA, 13 nt, Human
cucgcccuggguc

SEQ ID NO: 2068529 - RNA, 15 nt, Human
cucgcccugggucua

SEQ ID NO: 2068530 - RNA, 23 nt, Human
cucgagcaguccugccucagccu

SEQ ID NO: 2068531 - RNA, 13 nt, Human
cucgcaagcuggg

SEQ ID NO: 2068532 - RNA, 14 nt, Human
cucgcaagcugggu

SEQ ID NO: 2068533 - RNA, 21 nt, Human
cucccggugcccaagaauaga

SEQ ID NO: 2068534 - RNA, 15 nt, Human
cucccggugcccaag

SEQ ID NO: 2068535 - RNA, 20 nt, Human
cucccgaguagcugggacua

SEQ ID NO: 2068536 - RNA, 19 nt, Human
cucccgaguagcugggacu

SEQ ID NO: 2068537 - RNA, 14 nt, Human
cucccugccccucc

SEQ ID NO: 2068538 - RNA, 13 nt, Human
cucccugccccuc

SEQ ID NO: 2068539 - RNA, 16 nt, Human
cucccugccagcaccc

SEQ ID NO: 2068540 - RNA, 18 nt, Human
cucccugccagcaccccc

SEQ ID NO: 2068541 - RNA, 21 nt, Human
cucccugccccucccuucaac

SEQ ID NO: 2068542 - RNA, 20 nt, Human
cucccugccccucccuucaa

SEQ ID NO: 2068543 - RNA, 18 nt, Human
cucccugccccucccuuc

SEQ ID NO: 2068544 - RNA, 17 nt, Human
cucccugccccucccuu

SEQ ID NO: 2068545 - RNA, 18 nt, Human
cucccugccgccucaaug

SEQ ID NO: 2068546 - RNA, 19 nt, Human
cucccugccgccucaaugu

SEQ ID NO: 2068547 - RNA, 10 nt, Human
cucccugccg

SEQ ID NO: 2068548 - RNA, 15 nt, Human
cucccugccgccuca

SEQ ID NO: 2068549 - RNA, 16 nt, Human
cucccugccgccucaa

SEQ ID NO: 2068550 - RNA, 13 nt, Human
cucccuaccaccu

SEQ ID NO: 2068551 - RNA, 21 nt, Human
cuccccagcaagugagagcug

SEQ ID NO: 2068552 - RNA, 15 nt, Human
cuccccagcaggugg

SEQ ID NO: 2068553 - RNA, 16 nt, Human
cuccccagcagguggg

SEQ ID NO: 2068554 - RNA, 19 nt, Human
cuccccagcagguggggag

SEQ ID NO: 2068555 - RNA, 23 nt, Human
cuccccagcaagugagagcuggg

SEQ ID NO: 2068556 - RNA, 22 nt, Human
cuccccagcaagugagagcugg

SEQ ID NO: 2068557 - RNA, 11 nt, Human
cuccccuuccc

SEQ ID NO: 2068558 - RNA, 14 nt, Human
cuccccuugagcug

SEQ ID NO: 2068559 - RNA, 16 nt, Human
cuccccuugagcugag

SEQ ID NO: 2068560 - RNA, 15 nt, Human
cuccccuucccugca

SEQ ID NO: 2068561 - RNA, 16 nt, Human
cuccccuucccugcaa

SEQ ID NO: 2068562 - RNA, 23 nt, Human
cuccccuucgcguauuucaggau

SEQ ID NO: 2068563 - RNA, 14 nt, Human
cuccccugcccugc

SEQ ID NO: 2068564 - RNA, 12 nt, Human
cuccccugcccu

SEQ ID NO: 2068565 - RNA, 13 nt, Human
cuccccugcccuc

SEQ ID NO: 2068566 - RNA, 13 nt, Human
cuccccugcccug

SEQ ID NO: 2068567 - RNA, 14 nt, Human
cuccccugccauuu

SEQ ID NO: 2068568 - RNA, 15 nt, Human
cuccccuccuugccu

SEQ ID NO: 2068569 - RNA, 16 nt, Human
cuccccuccuugccuc

SEQ ID NO: 2068570 - RNA, 18 nt, Human
cucccuguccuccucgga

SEQ ID NO: 2068571 - RNA, 14 nt, Human
cucccuguccaccc

SEQ ID NO: 2068572 - RNA, 11 nt, Human
cucccuguccu

SEQ ID NO: 2068573 - RNA, 13 nt, Human
cucccuguccucc

SEQ ID NO: 2068574 - RNA, 14 nt, Human
cucccuguccuccu

SEQ ID NO: 2068575 - RNA, 15 nt, Human
cucccuguccuccuc

SEQ ID NO: 2068576 - RNA, 16 nt, Human
cucccuguccuccucg

SEQ ID NO: 2068577 - RNA, 22 nt, Human
cuccuaucagaaguuucucagc

SEQ ID NO: 2068578 - RNA, 15 nt, Human
cuccgcaguuccugu

SEQ ID NO: 2068579 - RNA, 14 nt, Human
cuccuaucuucaua

SEQ ID NO: 2068580 - RNA, 17 nt, Human
cuccuaucuucauaucu

SEQ ID NO: 2068581 - RNA, 14 nt, Human
cuccucaacucacc

SEQ ID NO: 2068582 - RNA, 16 nt, Human
cuccuauuuuuuuaaa

SEQ ID NO: 2068583 - RNA, 18 nt, Human
cuccuauuuuuuuaaaau

SEQ ID NO: 2068584 - RNA, 17 nt, Human
cuccucccaggcgcccc

SEQ ID NO: 2068585 - RNA, 23 nt, Human
cuccucccaggcgccccuucccc

SEQ ID NO: 2068586 - RNA, 22 nt, Human
cuccucccaggcgccccuuccc

SEQ ID NO: 2068587 - RNA, 14 nt, Human
cuccuccuccccca

SEQ ID NO: 2068588 - RNA, 15 nt, Human
cuccuccucccccag

SEQ ID NO: 2068589 - RNA, 15 nt, Human
cuccuccagccgcca

SEQ ID NO: 2068590 - RNA, 13 nt, Human
cucauuaaaaaaa

SEQ ID NO: 2068591 - RNA, 14 nt, Human
cucauuucuagcag

SEQ ID NO: 2068592 - RNA, 17 nt, Human
cucauuugucacacacu

SEQ ID NO: 2068593 - RNA, 16 nt, Human
cucauuacggcuccuc

SEQ ID NO: 2068594 - RNA, 17 nt, Human
cucauuacggcuccucu

SEQ ID NO: 2068595 - RNA, 18 nt, Human
cucauuacggcuccucuc

SEQ ID NO: 2068596 - RNA, 18 nt, Human
cucauuugucacacacuu

SEQ ID NO: 2068597 - RNA, 17 nt, Human
cucauuugggguagcua

SEQ ID NO: 2068598 - RNA, 20 nt, Human
cucauuugggguagcuagag

SEQ ID NO: 2068599 - RNA, 23 nt, Human
cuccaaguccacaguggaaccag

SEQ ID NO: 2068600 - RNA, 11 nt, Human
cuccaaagcuu

SEQ ID NO: 2068601 - RNA, 22 nt, Human
cuccaaaggaagucuaggagcu

SEQ ID NO: 2068602 - RNA, 22 nt, Human
cuccaaucccaccaacccucag

SEQ ID NO: 2068603 - RNA, 17 nt, Human
cuccacacccucuccca

SEQ ID NO: 2068604 - RNA, 13 nt, Human
cuccacccugcuc

SEQ ID NO: 2068605 - RNA, 12 nt, Human
cuccaccaaccc

SEQ ID NO: 2068606 - RNA, 20 nt, Human
cuccacacccucucccagga

SEQ ID NO: 2068607 - RNA, 15 nt, Human
cuccacccugcucuc

SEQ ID NO: 2068608 - RNA, 13 nt, Human
cuccaccaaccca

SEQ ID NO: 2068609 - RNA, 20 nt, Human
cuccaccaacccaucagaag

SEQ ID NO: 2068610 - RNA, 13 nt, Human
cuccaccacaucc

SEQ ID NO: 2068611 - RNA, 12 nt, Human
cuccacccuugg

SEQ ID NO: 2068612 - RNA, 13 nt, Human
cuccacccuuggc

SEQ ID NO: 2068613 - RNA, 15 nt, Human
cuccaucagcuguaa

SEQ ID NO: 2068614 - RNA, 15 nt, Human
cuccaggaaggggcu

SEQ ID NO: 2068615 - RNA, 16 nt, Human
cuccaggaaggggcug

SEQ ID NO: 2068616 - RNA, 18 nt, Human
cuccaggaaggggcugga

SEQ ID NO: 2068617 - RNA, 20 nt, Human
cuccaggaaggggcuggacu

SEQ ID NO: 2068618 - RNA, 21 nt, Human
cuccaggaaggggcuggacug

SEQ ID NO: 2068619 - RNA, 20 nt, Human
cuccaggaaugccuccuccc

SEQ ID NO: 2068620 - RNA, 14 nt, Human
cuccagcucaccag

SEQ ID NO: 2068621 - RNA, 12 nt, Human
cuccagccuggg

SEQ ID NO: 2068622 - RNA, 13 nt, Human
cuccagccugggc

SEQ ID NO: 2068623 - RNA, 14 nt, Human
cuccagccugggca

SEQ ID NO: 2068624 - RNA, 20 nt, Human
cuccagccugggcaacacag

SEQ ID NO: 2068625 - RNA, 20 nt, Human
cuccacguucaccccuccac

SEQ ID NO: 2068626 - RNA, 17 nt, Human
cuccaccuugcagcucu

SEQ ID NO: 2068627 - RNA, 16 nt, Human
cuccacguucaccccu

SEQ ID NO: 2068628 - RNA, 18 nt, Human
cuccacguucaccccucc

SEQ ID NO: 2068629 - RNA, 16 nt, Human
cucagggcugacacgu

SEQ ID NO: 2068630 - RNA, 16 nt, Human
cucaggugagaagcag

SEQ ID NO: 2068631 - RNA, 19 nt, Human
cucaggugagaagcagagg

SEQ ID NO: 2068632 - RNA, 20 nt, Human
cucaggugagaagcagagga

SEQ ID NO: 2068633 - RNA, 15 nt, Human
cucagggccuggucg

SEQ ID NO: 2068634 - RNA, 18 nt, Human
cucagcauccuggcaccc

SEQ ID NO: 2068635 - RNA, 21 nt, Human
cucagcccacauagugauggu

SEQ ID NO: 2068636 - RNA, 19 nt, Human
cucagcccacauagugaug

SEQ ID NO: 2068637 - RNA, 15 nt, Human
cucagccaugaggag

SEQ ID NO: 2068638 - RNA, 21 nt, Human
cucagccaugaggaguugcug

SEQ ID NO: 2068639 - RNA, 20 nt, Human
cucaggaggcugaggcagaa

SEQ ID NO: 2068640 - RNA, 20 nt, Human
cucaggaggcugaggcagga

SEQ ID NO: 2068641 - RNA, 22 nt, Human
cucaggaggcugaggcaggagg

SEQ ID NO: 2068642 - RNA, 18 nt, Human
cucaggaguuugagacca

SEQ ID NO: 2068643 - RNA, 23 nt, Human
cucaggaguuugagaccaaccug

SEQ ID NO: 2068644 - RNA, 21 nt, Human
cucagggacagagacaccugc

SEQ ID NO: 2068645 - RNA, 22 nt, Human
cucagggacagagacaccugca

SEQ ID NO: 2068646 - RNA, 23 nt, Human
cucagggacagagacaccugcac

SEQ ID NO: 2068647 - RNA, 15 nt, Human
cucaggaugcccagg

SEQ ID NO: 2068648 - RNA, 14 nt, Human
cucaggaugcccag

SEQ ID NO: 2068649 - RNA, 23 nt, Human
cucaggaggcugaggcagaagaa

SEQ ID NO: 2068650 - RNA, 23 nt, Human
cucaggaggcugaggcaggagga

SEQ ID NO: 2068651 - RNA, 16 nt, Human
cucaggaggcugaggg

SEQ ID NO: 2068652 - RNA, 16 nt, Human
cucaggaugcccaggg

SEQ ID NO: 2068653 - RNA, 19 nt, Human
cucaggaugcccagggcca

SEQ ID NO: 2068654 - RNA, 22 nt, Human
cucaggaugcccagggccacuc

SEQ ID NO: 2068655 - RNA, 17 nt, Human
cucauccgaggcagggu

SEQ ID NO: 2068656 - RNA, 14 nt, Human
cucauccgaggcag

SEQ ID NO: 2068657 - RNA, 15 nt, Human
cucauccgaggcagg

SEQ ID NO: 2068658 - RNA, 16 nt, Human
cucaucauaaaauaaa

SEQ ID NO: 2068659 - RNA, 23 nt, Human
cucauaguaugguggcuggguug

SEQ ID NO: 2068660 - RNA, 15 nt, Human
cucauaucaguuugc

SEQ ID NO: 2068661 - RNA, 19 nt, Human
cucauauauaucuaucuua

SEQ ID NO: 2068662 - RNA, 12 nt, Human
cucaucauaaaa

SEQ ID NO: 2068663 - RNA, 14 nt, Human
cucaucauaaaaua

SEQ ID NO: 2068664 - RNA, 15 nt, Human
cucaucauaaaauaa

SEQ ID NO: 2068665 - RNA, 19 nt, Human
cucaggugauccacccacc

SEQ ID NO: 2068666 - RNA, 18 nt, Human
cucaggugauccacccac

SEQ ID NO: 2068667 - RNA, 20 nt, Human
cucaggugauccacccaccu

SEQ ID NO: 2068668 - RNA, 12 nt, Human
cucauagcauua

SEQ ID NO: 2068669 - RNA, 14 nt, Human
cucauagcauuaac

SEQ ID NO: 2068670 - RNA, 16 nt, Human
cucauagcauuaacua

SEQ ID NO: 2068671 - RNA, 18 nt, Human
cucauagcauuaacuaau

SEQ ID NO: 2068672 - RNA, 20 nt, Human
cucauagccccggugugcgg

SEQ ID NO: 2068673 - RNA, 21 nt, Human
cucauaguaugguggcugggu

SEQ ID NO: 2068674 - RNA, 22 nt, Human
cucauacucaccucaccccacu

SEQ ID NO: 2068675 - RNA, 14 nt, Human
cucauacucaccuc

SEQ ID NO: 2068676 - RNA, 14 nt, Human
cucaagacuuccag

SEQ ID NO: 2068677 - RNA, 23 nt, Human
cucaagacccuuuuggguuucug

SEQ ID NO: 2068678 - RNA, 16 nt, Human
cucaagacuuccagag

SEQ ID NO: 2068679 - RNA, 21 nt, Human
cucaaguccucuuuucugaga

SEQ ID NO: 2068680 - RNA, 17 nt, Human
cucaagugauucuccug

SEQ ID NO: 2068681 - RNA, 16 nt, Human
cucaagucuucccuga

SEQ ID NO: 2068682 - RNA, 17 nt, Human
cucaagucuucccugau

SEQ ID NO: 2068683 - RNA, 18 nt, Human
cucaagucuucccugauc

SEQ ID NO: 2068684 - RNA, 23 nt, Human
cucacaccaggcuugccugcagg

SEQ ID NO: 2068685 - RNA, 19 nt, Human
cucacaccgcgucugguga

SEQ ID NO: 2068686 - RNA, 22 nt, Human
cucacauuuauucugcucacau

SEQ ID NO: 2068687 - RNA, 19 nt, Human
cucacauuuauucugcuca

SEQ ID NO: 2068688 - RNA, 15 nt, Human
cucacauuuauucug

SEQ ID NO: 2068689 - RNA, 15 nt, Human
cucaccagccccagu

SEQ ID NO: 2068690 - RNA, 14 nt, Human
cucaccagccccag

SEQ ID NO: 2068691 - RNA, 16 nt, Human
cucacagcuguaauaa

SEQ ID NO: 2068692 - RNA, 13 nt, Human
cucaccagcccca

SEQ ID NO: 2068693 - RNA, 18 nt, Human
cucaccagccccagugcc

SEQ ID NO: 2068694 - RNA, 17 nt, Human
cucaccagccccagugc

SEQ ID NO: 2068695 - RNA, 17 nt, Human
cucaaccuccugggcua

SEQ ID NO: 2068696 - RNA, 15 nt, Human
cucaaccuccugggc

SEQ ID NO: 2068697 - RNA, 13 nt, Human
cucaaccuccugg

SEQ ID NO: 2068698 - RNA, 21 nt, Human
cucaacaccucugcacaagcu

SEQ ID NO: 2068699 - RNA, 20 nt, Human
cucaacaaaagugcuuugga

SEQ ID NO: 2068700 - RNA, 22 nt, Human
cucaaaugcaguauuuuuguug

SEQ ID NO: 2068701 - RNA, 15 nt, Human
cuauuucccaagcug

SEQ ID NO: 2068702 - RNA, 17 nt, Human
cuauuucccaagcugga

SEQ ID NO: 2068703 - RNA, 13 nt, Human
cuauuuagcauga

SEQ ID NO: 2068704 - RNA, 18 nt, Human
cuauuuagcaugacaagc

SEQ ID NO: 2068705 - RNA, 17 nt, Human
cuauuuaguuuuuguaa

SEQ ID NO: 2068706 - RNA, 20 nt, Human
cuauuuaguuuuuguaauuu

SEQ ID NO: 2068707 - RNA, 22 nt, Human
cuauuuaguuuuuguaauuuau

SEQ ID NO: 2068708 - RNA, 23 nt, Human
cuauuuaguuuuuguaauuuauu

SEQ ID NO: 2068709 - RNA, 11 nt, Human
cuauuuaugaa

SEQ ID NO: 2068710 - RNA, 22 nt, Human
cuauuuaucuguguuuuugaaa

SEQ ID NO: 2068711 - RNA, 16 nt, Human
cuauuuaucuguguuu

SEQ ID NO: 2068712 - RNA, 19 nt, Human
cuauuuaucuguguuuuug

SEQ ID NO: 2068713 - RNA, 23 nt, Human
cuauuuagcaugacaagccccag

SEQ ID NO: 2068714 - RNA, 21 nt, Human
cuauuuaucuguaguaaacua

SEQ ID NO: 2068715 - RNA, 12 nt, Human
cuauuguaagau

SEQ ID NO: 2068716 - RNA, 15 nt, Human
cuauuguaagauaaa

SEQ ID NO: 2068717 - RNA, 16 nt, Human
cuauuguaagauaaaa

SEQ ID NO: 2068718 - RNA, 18 nt, Human
cuauuguaagauaaaaaa

SEQ ID NO: 2068719 - RNA, 20 nt, Human
cuauuguaagauaaaaaagc

SEQ ID NO: 2068720 - RNA, 22 nt, Human
cuauuguccccuagcaaggcau

SEQ ID NO: 2068721 - RNA, 12 nt, Human
cucacuccacca

SEQ ID NO: 2068722 - RNA, 14 nt, Human
cucacuccaccacc

SEQ ID NO: 2068723 - RNA, 16 nt, Human
cucacuccaccaccca

SEQ ID NO: 2068724 - RNA, 17 nt, Human
cucacuccaccacccaa

SEQ ID NO: 2068725 - RNA, 20 nt, Human
cucacuccaccacccaaaag

SEQ ID NO: 2068726 - RNA, 15 nt, Human
cucacuccuaccugg

SEQ ID NO: 2068727 - RNA, 13 nt, Human
cucacuccuaccu

SEQ ID NO: 2068728 - RNA, 15 nt, Human
cucacucccagucca

SEQ ID NO: 2068729 - RNA, 12 nt, Human
cucacuccccuc

SEQ ID NO: 2068730 - RNA, 20 nt, Human
cucacuccccuccuuuccca

SEQ ID NO: 2068731 - RNA, 22 nt, Human
cucacuccccuccuuucccaac

SEQ ID NO: 2068732 - RNA, 15 nt, Human
cucacucccuuccca

SEQ ID NO: 2068733 - RNA, 21 nt, Human
cucacucccuucccauaagcu

SEQ ID NO: 2068734 - RNA, 17 nt, Human
cucacucaaguucaagg

SEQ ID NO: 2068735 - RNA, 18 nt, Human
cucacucaaguucaagga

SEQ ID NO: 2068736 - RNA, 19 nt, Human
cucacucaaguucaaggac

SEQ ID NO: 2068737 - RNA, 21 nt, Human
cucacucaaguucaaggacca

SEQ ID NO: 2068738 - RNA, 23 nt, Human
cucacuauguugcccaggcaggu

SEQ ID NO: 2068739 - RNA, 22 nt, Human
cucacuauguugcccaggcagg

SEQ ID NO: 2068740 - RNA, 21 nt, Human
cucacuauguugcccaggcag

SEQ ID NO: 2068741 - RNA, 20 nt, Human
cucacuauguugcccaggca

SEQ ID NO: 2068742 - RNA, 19 nt, Human
cucacuauguugcccaggc

SEQ ID NO: 2068743 - RNA, 21 nt, Human
cucacccccaaggggcagucu

SEQ ID NO: 2068744 - RNA, 22 nt, Human
cucacccccaaggggcagucug

SEQ ID NO: 2068745 - RNA, 19 nt, Human
cucaccccaucccacaccc

SEQ ID NO: 2068746 - RNA, 21 nt, Human
cucaccccaucccacacccug

SEQ ID NO: 2068747 - RNA, 22 nt, Human
cucaccccaucccacacccugg

SEQ ID NO: 2068748 - RNA, 17 nt, Human
cucacccccaaggggca

SEQ ID NO: 2068749 - RNA, 14 nt, Human
cucaccauguaaaa

SEQ ID NO: 2068750 - RNA, 12 nt, Human
cucaccccaucc

SEQ ID NO: 2068751 - RNA, 13 nt, Human
cucaccccauccc

SEQ ID NO: 2068752 - RNA, 13 nt, Human
cucacugcagccu

SEQ ID NO: 2068753 - RNA, 12 nt, Human
cucacugcagcc

SEQ ID NO: 2068754 - RNA, 21 nt, Human
cucacucugucgcccagucug

SEQ ID NO: 2068755 - RNA, 13 nt, Human
cucacucugucgc

SEQ ID NO: 2068756 - RNA, 22 nt, Human
cucacucugucgcccagucugg

SEQ ID NO: 2068757 - RNA, 12 nt, Human
cucacucugucg

SEQ ID NO: 2068758 - RNA, 11 nt, Human
cucacucuguc

SEQ ID NO: 2068759 - RNA, 19 nt, Human
cucacuccuaccugguaau

SEQ ID NO: 2068760 - RNA, 21 nt, Human
cucacuccaggaaggggcugg

SEQ ID NO: 2068761 - RNA, 17 nt, Human
cucacucccuucuccuu

SEQ ID NO: 2068762 - RNA, 17 nt, Human
cucacuccuaccuggua

SEQ ID NO: 2068763 - RNA, 16 nt, Human
cucacuccuaccuggu

SEQ ID NO: 2068764 - RNA, 18 nt, Human
cucagcacccccuucucu

SEQ ID NO: 2068765 - RNA, 20 nt, Human
cucagcacccccuucucugc

SEQ ID NO: 2068766 - RNA, 12 nt, Human
cucagcacuugg

SEQ ID NO: 2068767 - RNA, 17 nt, Human
cucagcauccuggcacc

SEQ ID NO: 2068768 - RNA, 16 nt, Human
cucagcauccuggcac

SEQ ID NO: 2068769 - RNA, 12 nt, Human
cucagcagcccu

SEQ ID NO: 2068770 - RNA, 13 nt, Human
cucagcagcccuc

SEQ ID NO: 2068771 - RNA, 14 nt, Human
cucagcagcccucc

SEQ ID NO: 2068772 - RNA, 15 nt, Human
cucagcagcccuccu

SEQ ID NO: 2068773 - RNA, 16 nt, Human
cucagcagcccuccuc

SEQ ID NO: 2068774 - RNA, 17 nt, Human
cucagcagcccuccuca

SEQ ID NO: 2068775 - RNA, 18 nt, Human
cucagcagcccuccucac

SEQ ID NO: 2068776 - RNA, 21 nt, Human
cucagcagcccuccucacccc

SEQ ID NO: 2068777 - RNA, 19 nt, Human
cucagcagcccuccucacc

SEQ ID NO: 2068778 - RNA, 15 nt, Human
cucagcaaccuguaa

SEQ ID NO: 2068779 - RNA, 16 nt, Human
cucagcaaggggcucu

SEQ ID NO: 2068780 - RNA, 18 nt, Human
cucagcaaggggcucugc

SEQ ID NO: 2068781 - RNA, 20 nt, Human
cucagcaaggggcucugccc

SEQ ID NO: 2068782 - RNA, 20 nt, Human
cucacuguugcccaggcugg

SEQ ID NO: 2068783 - RNA, 19 nt, Human
cucacugccaugccagcuu

SEQ ID NO: 2068784 - RNA, 22 nt, Human
cucacugccaugccagcuuauc

SEQ ID NO: 2068785 - RNA, 21 nt, Human
cucacuuaucccaagagaaug

SEQ ID NO: 2068786 - RNA, 22 nt, Human
cucacuguugcccaggcuggcg

SEQ ID NO: 2068787 - RNA, 21 nt, Human
cucacuguugcccaggcuggc

SEQ ID NO: 2068788 - RNA, 15 nt, Human
cucagaguccaggcc

SEQ ID NO: 2068789 - RNA, 18 nt, Human
cucagaguccaggcccca

SEQ ID NO: 2068790 - RNA, 17 nt, Human
cucagagucggaacgga

SEQ ID NO: 2068791 - RNA, 14 nt, Human
cucagauauuuaua

SEQ ID NO: 2068792 - RNA, 18 nt, Human
cucagagucggaacggag

SEQ ID NO: 2068793 - RNA, 17 nt, Human
cucagauauuuauauuu

SEQ ID NO: 2068794 - RNA, 21 nt, Human
cuaugaucccagcacuuuggg

SEQ ID NO: 2068795 - RNA, 20 nt, Human
cuaugcauaucaguugagcu

SEQ ID NO: 2068796 - RNA, 20 nt, Human
cuaugauaugguaaaaguua

SEQ ID NO: 2068797 - RNA, 17 nt, Human
cuauggaagcauauugu

SEQ ID NO: 2068798 - RNA, 19 nt, Human
cuaugcugccuaggcugac

SEQ ID NO: 2068799 - RNA, 22 nt, Human
cuaugaucccagcacuuuggga

SEQ ID NO: 2068800 - RNA, 14 nt, Human
cuaugcugccuagg

SEQ ID NO: 2068801 - RNA, 14 nt, Human
cuauggauggcuuc

SEQ ID NO: 2068802 - RNA, 15 nt, Human
cuauggauggcuucu

SEQ ID NO: 2068803 - RNA, 16 nt, Human
cuauggauggcuucua

SEQ ID NO: 2068804 - RNA, 20 nt, Human
cuauggauuuucuaaggaag

SEQ ID NO: 2068805 - RNA, 12 nt, Human
cuauuagacuuu

SEQ ID NO: 2068806 - RNA, 18 nt, Human
cuauuagacuuuagaaau

SEQ ID NO: 2068807 - RNA, 20 nt, Human
cuauuagacuuuagaaauaa

SEQ ID NO: 2068808 - RNA, 21 nt, Human
cuauuagacuuuagaaauaaa

SEQ ID NO: 2068809 - RNA, 22 nt, Human
cuauuagacuuuagaaauaaau

SEQ ID NO: 2068810 - RNA, 16 nt, Human
cuauuagccacaaaau

SEQ ID NO: 2068811 - RNA, 16 nt, Human
cuauuaccacugaaga

SEQ ID NO: 2068812 - RNA, 20 nt, Human
cuauuaccacugaagauaga

SEQ ID NO: 2068813 - RNA, 21 nt, Human
cuauuaccacugaagauagaa

SEQ ID NO: 2068814 - RNA, 15 nt, Human
cuauuagagaagaga

SEQ ID NO: 2068815 - RNA, 11 nt, Human
cuauucacaac

SEQ ID NO: 2068816 - RNA, 12 nt, Human
cuaugguaaaga

SEQ ID NO: 2068817 - RNA, 13 nt, Human
cuaugguaaagau

SEQ ID NO: 2068818 - RNA, 16 nt, Human
cuaugguaaagauauu

SEQ ID NO: 2068819 - RNA, 21 nt, Human
cuaugguaaagauauuauuca

SEQ ID NO: 2068820 - RNA, 22 nt, Human
cuaugguaaagauauuauucac

SEQ ID NO: 2068821 - RNA, 12 nt, Human
cuauggucaucu

SEQ ID NO: 2068822 - RNA, 16 nt, Human
cuaugggagccccagg

SEQ ID NO: 2068823 - RNA, 19 nt, Human
cuaugggggcacugaggac

SEQ ID NO: 2068824 - RNA, 17 nt, Human
cuaugggagccccaggg

SEQ ID NO: 2068825 - RNA, 22 nt, Human
cuauggguaucaaacagcucag

SEQ ID NO: 2068826 - RNA, 23 nt, Human
cuauggguaucaaacagcucagg

SEQ ID NO: 2068827 - RNA, 23 nt, Human
cuaugggacucaaugcacugaca

SEQ ID NO: 2068828 - RNA, 13 nt, Human
cuaugggagcccc

SEQ ID NO: 2068829 - RNA, 14 nt, Human
cuaugggagcccca

SEQ ID NO: 2068830 - RNA, 15 nt, Human
cuaugggagccccag

SEQ ID NO: 2068831 - RNA, 22 nt, Human
cuaugggacucaaugcacugac

SEQ ID NO: 2068832 - RNA, 18 nt, Human
cuaugggacucaaugcac

SEQ ID NO: 2068833 - RNA, 17 nt, Human
cuauagccuaggugaca

SEQ ID NO: 2068834 - RNA, 13 nt, Human
cuauauuguacac

SEQ ID NO: 2068835 - RNA, 10 nt, Human
cuauauguau

SEQ ID NO: 2068836 - RNA, 21 nt, Human
cuauauguaguauaaagaaaa

SEQ ID NO: 2068837 - RNA, 16 nt, Human
cuauauggaauugcuu

SEQ ID NO: 2068838 - RNA, 22 nt, Human
cuauauuuagauuguuaaaaua

SEQ ID NO: 2068839 - RNA, 23 nt, Human
cuauauuuagauuguuaaaauaa

SEQ ID NO: 2068840 - RNA, 14 nt, Human
cuauauuguacaca

SEQ ID NO: 2068841 - RNA, 15 nt, Human
cuauauuguacacac

SEQ ID NO: 2068842 - RNA, 13 nt, Human
cuauauuuaagua

SEQ ID NO: 2068843 - RNA, 14 nt, Human
cuauauuuaaguau

SEQ ID NO: 2068844 - RNA, 16 nt, Human
cuauauuuaaguauuc

SEQ ID NO: 2068845 - RNA, 18 nt, Human
cuauauuuaaguauucaa

SEQ ID NO: 2068846 - RNA, 21 nt, Human
cuauauuuaaguauucaagaa

SEQ ID NO: 2068847 - RNA, 22 nt, Human
cuauauuuaaguauucaagaaa

SEQ ID NO: 2068848 - RNA, 13 nt, Human
cuauauuuagauu

SEQ ID NO: 2068849 - RNA, 15 nt, Human
cuagugauggucaga

SEQ ID NO: 2068850 - RNA, 17 nt, Human
cuagugauuucuggggc

SEQ ID NO: 2068851 - RNA, 23 nt, Human
cuagugauuucuggggccccacc

SEQ ID NO: 2068852 - RNA, 13 nt, Human
cuagugcagcuga

SEQ ID NO: 2068853 - RNA, 17 nt, Human
cuauaauaccagcuacu

SEQ ID NO: 2068854 - RNA, 17 nt, Human
cuaguggggucucccuc

SEQ ID NO: 2068855 - RNA, 18 nt, Human
cuaguggggucucccucu

SEQ ID NO: 2068856 - RNA, 19 nt, Human
cuaguggggucucccucuc

SEQ ID NO: 2068857 - RNA, 20 nt, Human
cuaguggggucucccucucc

SEQ ID NO: 2068858 - RNA, 21 nt, Human
cuaguggggucucccucuccu

SEQ ID NO: 2068859 - RNA, 22 nt, Human
cuaguggggucucccucuccug

SEQ ID NO: 2068860 - RNA, 23 nt, Human
cuaguggggucucccucuccugc

SEQ ID NO: 2068861 - RNA, 16 nt, Human
cuauaauguaagcucu

SEQ ID NO: 2068862 - RNA, 21 nt, Human
cuauaauguaagcucuacuga

SEQ ID NO: 2068863 - RNA, 19 nt, Human
cuauagacccgaggaaacu

SEQ ID NO: 2068864 - RNA, 12 nt, Human
cuauagacucua

SEQ ID NO: 2068865 - RNA, 15 nt, Human
cuauacaacuggaca

SEQ ID NO: 2068866 - RNA, 16 nt, Human
cuaguaaaaauacaaa

SEQ ID NO: 2068867 - RNA, 13 nt, Human
cuagucagagaga

SEQ ID NO: 2068868 - RNA, 16 nt, Human
cuagucagagagagug

SEQ ID NO: 2068869 - RNA, 15 nt, Human
cuagucccuuccccu

SEQ ID NO: 2068870 - RNA, 17 nt, Human
cuagucccuuccccucc

SEQ ID NO: 2068871 - RNA, 18 nt, Human
cuagucagagagaguguu

SEQ ID NO: 2068872 - RNA, 14 nt, Human
cuagucagccacau

SEQ ID NO: 2068873 - RNA, 16 nt, Human
cuagucagccacaugg

SEQ ID NO: 2068874 - RNA, 14 nt, Human
cuagucccuucccc

SEQ ID NO: 2068875 - RNA, 19 nt, Human
cgcccagugcccuggggcu

SEQ ID NO: 2068876 - RNA, 22 nt, Human
cgcccaguuggguggaugccug

SEQ ID NO: 2068877 - RNA, 15 nt, Human
cgccaugcuccuggc

SEQ ID NO: 2068878 - RNA, 23 nt, Human
cgcccaguuggguggaugccugg

SEQ ID NO: 2068879 - RNA, 13 nt, Human
cgcccauguguga

SEQ ID NO: 2068880 - RNA, 20 nt, Human
cuagguaauuuuuacagaau

SEQ ID NO: 2068881 - RNA, 12 nt, Human
cgccccagccuc

SEQ ID NO: 2068882 - RNA, 17 nt, Human
cuaggucaguacccacc

SEQ ID NO: 2068883 - RNA, 19 nt, Human
cuaggucaguacccaccug

SEQ ID NO: 2068884 - RNA, 20 nt, Human
cuaggucaguacccaccuga

SEQ ID NO: 2068885 - RNA, 21 nt, Human
cuaggucaguacccaccugag

SEQ ID NO: 2068886 - RNA, 22 nt, Human
cuaggucaguacccaccugagc

SEQ ID NO: 2068887 - RNA, 24 nt, Human
cuaggugacagagugagacucugu

SEQ ID NO: 2068888 - RNA, 22 nt, Human
cuaggugcccuuggaggccagc

SEQ ID NO: 2068889 - RNA, 18 nt, Human
cuaggugcccuuggaggc

SEQ ID NO: 2068890 - RNA, 13 nt, Human
cuaggugggccag

SEQ ID NO: 2068891 - RNA, 15 nt, Human
cuaggugggccagcc

SEQ ID NO: 2068892 - RNA, 17 nt, Human
cuaggugggccagcccc

SEQ ID NO: 2068893 - RNA, 18 nt, Human
cuaggugggccagccccu

SEQ ID NO: 2068894 - RNA, 19 nt, Human
cuaggugggccagccccuc

SEQ ID NO: 2068895 - RNA, 21 nt, Human
cuaggugggccagccccuccc

SEQ ID NO: 2068896 - RNA, 23 nt, Human
cuaggugggccagccccucccac

SEQ ID NO: 2068897 - RNA, 15 nt, Human
cuaggucaaggccug

SEQ ID NO: 2068898 - RNA, 16 nt, Human
cuaggucaaggccugu

SEQ ID NO: 2068899 - RNA, 19 nt, Human
cuaggucaaggccuguccc

SEQ ID NO: 2068900 - RNA, 20 nt, Human
cuaggucaaggccugucccu

SEQ ID NO: 2068901 - RNA, 22 nt, Human
cuaggucaaggccugucccugg

SEQ ID NO: 2068902 - RNA, 17 nt, Human
cuaggucagcuugcugc

SEQ ID NO: 2068903 - RNA, 18 nt, Human
cuaggugacagagugaga

SEQ ID NO: 2068904 - RNA, 14 nt, Human
cuaggugacagagu

SEQ ID NO: 2068905 - RNA, 20 nt, Human
gaggcggccccggccggggu

SEQ ID NO: 2068906 - RNA, 12 nt, Human
gaggcgggugga

SEQ ID NO: 2068907 - RNA, 19 nt, Human
gaggcggguggaucaccug

SEQ ID NO: 2068908 - RNA, 14 nt, Human
gaggccuucucuga

SEQ ID NO: 2068909 - RNA, 20 nt, Human
gaggcggagcuugcagugag

SEQ ID NO: 2068910 - RNA, 19 nt, Human
gaggcggguggaucacuug

SEQ ID NO: 2068911 - RNA, 15 nt, Human
gaggcuuaacaaugu

SEQ ID NO: 2068912 - RNA, 17 nt, Human
gaggcuguucccaccag

SEQ ID NO: 2068913 - RNA, 15 nt, Human
gaggcugggccaagc

SEQ ID NO: 2068914 - RNA, 17 nt, Human
gaggcugggccaagcca

SEQ ID NO: 2068915 - RNA, 21 nt, Human
gaggcugggccaagccaggga

SEQ ID NO: 2068916 - RNA, 23 nt, Human
gaggcugggccaagccagggaug

SEQ ID NO: 2068917 - RNA, 20 nt, Human
gaggcccgcaugcggcccag

SEQ ID NO: 2068918 - RNA, 19 nt, Human
gaggccgggugcucagggc

SEQ ID NO: 2068919 - RNA, 16 nt, Human
gagggaccagccaaga

SEQ ID NO: 2068920 - RNA, 12 nt, Human
gagggaccagcc

SEQ ID NO: 2068921 - RNA, 17 nt, Human
gagggaccaacugggcc

SEQ ID NO: 2068922 - RNA, 18 nt, Human
gagggaccaacugggccc

SEQ ID NO: 2068923 - RNA, 19 nt, Human
gagggaccaacugggccca

SEQ ID NO: 2068924 - RNA, 21 nt, Human
gagggacaaauuuaaaacaaa

SEQ ID NO: 2068925 - RNA, 15 nt, Human
gagggaacagacagg

SEQ ID NO: 2068926 - RNA, 18 nt, Human
gagggaacagacaggaga

SEQ ID NO: 2068927 - RNA, 19 nt, Human
gagggaacagacaggagaa

SEQ ID NO: 2068928 - RNA, 18 nt, Human
gagggaauugaggucugc

SEQ ID NO: 2068929 - RNA, 19 nt, Human
gaggcuugucagagcuggg

SEQ ID NO: 2068930 - RNA, 21 nt, Human
gaggcuugucagagcugggag

SEQ ID NO: 2068931 - RNA, 17 nt, Human
gaggcuugucagagcug

SEQ ID NO: 2068932 - RNA, 18 nt, Human
gaggcuugucagagcugg

SEQ ID NO: 2068933 - RNA, 15 nt, Human
gaggcuuggaaagca

SEQ ID NO: 2068934 - RNA, 16 nt, Human
gaggcuucuucagauc

SEQ ID NO: 2068935 - RNA, 22 nt, Human
gaggcuucuucagaucagugcu

SEQ ID NO: 2068936 - RNA, 16 nt, Human
gagggagugacagagg

SEQ ID NO: 2068937 - RNA, 14 nt, Human
gagggagugacaga

SEQ ID NO: 2068938 - RNA, 13 nt, Human
gagggagugacag

SEQ ID NO: 2068939 - RNA, 12 nt, Human
gagggcacuggu

SEQ ID NO: 2068940 - RNA, 20 nt, Human
gaggggccuggcagccgugc

SEQ ID NO: 2068941 - RNA, 18 nt, Human
gaggggccuggcagccgu

SEQ ID NO: 2068942 - RNA, 14 nt, Human
gaggggccuggcag

SEQ ID NO: 2068943 - RNA, 13 nt, Human
gaggggccuggca

SEQ ID NO: 2068944 - RNA, 16 nt, Human
gagggcagaggcugga

SEQ ID NO: 2068945 - RNA, 18 nt, Human
gagggcacugguggcccg

SEQ ID NO: 2068946 - RNA, 16 nt, Human
gagggcacugguggcc

SEQ ID NO: 2068947 - RNA, 15 nt, Human
gagggcagaggcugg

SEQ ID NO: 2068948 - RNA, 14 nt, Human
gagggcagaggcug

SEQ ID NO: 2068949 - RNA, 19 nt, Human
gaggagggaugcugccuga

SEQ ID NO: 2068950 - RNA, 20 nt, Human
gaggagggcgugacucaccc

SEQ ID NO: 2068951 - RNA, 18 nt, Human
gaggagcucaggacacua

SEQ ID NO: 2068952 - RNA, 11 nt, Human
gaggagcugcu

SEQ ID NO: 2068953 - RNA, 12 nt, Human
gaggagcugcug

SEQ ID NO: 2068954 - RNA, 13 nt, Human
gaggagcugcugg

SEQ ID NO: 2068955 - RNA, 15 nt, Human
gaggagcugcuggcu

SEQ ID NO: 2068956 - RNA, 15 nt, Human
gaggagcuuggggga

SEQ ID NO: 2068957 - RNA, 21 nt, Human
gaggagcuugggggaugacua

SEQ ID NO: 2068958 - RNA, 19 nt, Human
gaggaggaaggagagaagg

SEQ ID NO: 2068959 - RNA, 14 nt, Human
gaggaggaggaggu

SEQ ID NO: 2068960 - RNA, 18 nt, Human
gaggaggcaauugggaug

SEQ ID NO: 2068961 - RNA, 13 nt, Human
gaggaauuucuga

SEQ ID NO: 2068962 - RNA, 23 nt, Human
gaggacagggaggugaccccagg

SEQ ID NO: 2068963 - RNA, 22 nt, Human
gaggacagggaggugaccccag

SEQ ID NO: 2068964 - RNA, 13 nt, Human
gaggacagggagg

SEQ ID NO: 2068965 - RNA, 21 nt, Human
gaggaaggcaugccuggacaa

SEQ ID NO: 2068966 - RNA, 20 nt, Human
gaggacaccuguacuggaga

SEQ ID NO: 2068967 - RNA, 21 nt, Human
gaggacaccuguacuggagag

SEQ ID NO: 2068968 - RNA, 15 nt, Human
gaggaaugcuccccc

SEQ ID NO: 2068969 - RNA, 21 nt, Human
gaggaaugcucccccauccuc

SEQ ID NO: 2068970 - RNA, 17 nt, Human
gaggaaugaugaagcuu

SEQ ID NO: 2068971 - RNA, 13 nt, Human
gaggaaugcuccc

SEQ ID NO: 2068972 - RNA, 15 nt, Human
gaggaauccagaccc

SEQ ID NO: 2068973 - RNA, 20 nt, Human
gaggaaucgaggaaccagag

SEQ ID NO: 2068974 - RNA, 14 nt, Human
gaggaauccagacc

SEQ ID NO: 2068975 - RNA, 23 nt, Human
gaggaauaugacggaagaacaua

SEQ ID NO: 2068976 - RNA, 20 nt, Human
gaggaaucaacagggcagca

SEQ ID NO: 2068977 - RNA, 13 nt, Human
gaggaaggggggu

SEQ ID NO: 2068978 - RNA, 16 nt, Human
gaggaaggagagaagg

SEQ ID NO: 2068979 - RNA, 14 nt, Human
gaggaaggagagaa

SEQ ID NO: 2068980 - RNA, 22 nt, Human
gagcuucugggaagacaacuag

SEQ ID NO: 2068981 - RNA, 12 nt, Human
gaggccaggagu

SEQ ID NO: 2068982 - RNA, 22 nt, Human
gaggccaggaguuugagaccag

SEQ ID NO: 2068983 - RNA, 14 nt, Human
gaggcaggcuccag

SEQ ID NO: 2068984 - RNA, 23 nt, Human
gaggcaggaggauugcuugagcc

SEQ ID NO: 2068985 - RNA, 22 nt, Human
gaggcagccccauucugccugc

SEQ ID NO: 2068986 - RNA, 23 nt, Human
gaggcagccccauucugccugcc

SEQ ID NO: 2068987 - RNA, 13 nt, Human
gaggcagccccau

SEQ ID NO: 2068988 - RNA, 19 nt, Human
gaggcagacagcagcucag

SEQ ID NO: 2068989 - RNA, 12 nt, Human
gaggcagacagc

SEQ ID NO: 2068990 - RNA, 15 nt, Human
gaggcagacagcagc

SEQ ID NO: 2068991 - RNA, 16 nt, Human
gaggcagacagcagcu

SEQ ID NO: 2068992 - RNA, 14 nt, Human
gaggcagagugccc

SEQ ID NO: 2068993 - RNA, 16 nt, Human
gaggcagagugcccca

SEQ ID NO: 2068994 - RNA, 22 nt, Human
gaggcagagugccccaccugcc

SEQ ID NO: 2068995 - RNA, 17 nt, Human
gaggcacaugucagcaa

SEQ ID NO: 2068996 - RNA, 19 nt, Human
gaggcaccaguguccuccc

SEQ ID NO: 2068997 - RNA, 18 nt, Human
gaggcaccauucaggaac

SEQ ID NO: 2068998 - RNA, 21 nt, Human
gaggcaccauucaggaaccug

SEQ ID NO: 2068999 - RNA, 18 nt, Human
gaggcagaaagcagaggc

SEQ ID NO: 2069000 - RNA, 19 nt, Human
gaggcagaaagcagaggcu

SEQ ID NO: 2069001 - RNA, 20 nt, Human
gaggcagaaagcagaggcug

SEQ ID NO: 2069002 - RNA, 21 nt, Human
gaggcagaaagcagaggcugg

SEQ ID NO: 2069003 - RNA, 23 nt, Human
gaggcagaaagcagaggcuggcc

SEQ ID NO: 2069004 - RNA, 23 nt, Human
gaggcagaacccuggugaggaag

SEQ ID NO: 2069005 - RNA, 23 nt, Human
gaggcagaagaauugaacccagg

SEQ ID NO: 2069006 - RNA, 23 nt, Human
gaggcaaugucaggaacagaagg

SEQ ID NO: 2069007 - RNA, 20 nt, Human
gaggcacacagcugcagaga

SEQ ID NO: 2069008 - RNA, 24 nt, Human
gaggcacacagcugcagagacaga

SEQ ID NO: 2069009 - RNA, 18 nt, Human
gaggauugcuugagccca

SEQ ID NO: 2069010 - RNA, 19 nt, Human
gaggauugcuugagcccag

SEQ ID NO: 2069011 - RNA, 22 nt, Human
gaggauugcuugagcccaggag

SEQ ID NO: 2069012 - RNA, 21 nt, Human
gaggcaaugucaggaacagaa

SEQ ID NO: 2069013 - RNA, 12 nt, Human
gaggaguuuccu

SEQ ID NO: 2069014 - RNA, 18 nt, Human
gaggaguuuccuaaaagu

SEQ ID NO: 2069015 - RNA, 20 nt, Human
gaggaguuuccuaaaaguuc

SEQ ID NO: 2069016 - RNA, 15 nt, Human
gaggagguggcagcc

SEQ ID NO: 2069017 - RNA, 18 nt, Human
gaggagguggcagcccug

SEQ ID NO: 2069018 - RNA, 17 nt, Human
gaggagggcggggggca

SEQ ID NO: 2069019 - RNA, 20 nt, Human
gaggagguggcagcccugua

SEQ ID NO: 2069020 - RNA, 22 nt, Human
gaggagguggcagcccuguagg

SEQ ID NO: 2069021 - RNA, 17 nt, Human
gaggagguuuaggucaa

SEQ ID NO: 2069022 - RNA, 16 nt, Human
gaggauucuaugaggc

SEQ ID NO: 2069023 - RNA, 17 nt, Human
gaggauucuaugaggca

SEQ ID NO: 2069024 - RNA, 16 nt, Human
gaggauugcuugagcu

SEQ ID NO: 2069025 - RNA, 20 nt, Human
gaggauguucugggacacag

SEQ ID NO: 2069026 - RNA, 17 nt, Human
gaggauguucugggaca

SEQ ID NO: 2069027 - RNA, 20 nt, Human
gaggauggccucugcuaagc

SEQ ID NO: 2069028 - RNA, 15 nt, Human
gaggaugggaaggag

SEQ ID NO: 2069029 - RNA, 19 nt, Human
gaggaugggaaggagggag

SEQ ID NO: 2069030 - RNA, 17 nt, Human
gaggaucacuggagccc

SEQ ID NO: 2069031 - RNA, 19 nt, Human
gaggaucacuggagcccag

SEQ ID NO: 2069032 - RNA, 16 nt, Human
gaggaucacuggagcc

SEQ ID NO: 2069033 - RNA, 12 nt, Human
gaggauguucug

SEQ ID NO: 2069034 - RNA, 20 nt, Human
gaggaugucacucagaugga

SEQ ID NO: 2069035 - RNA, 18 nt, Human
gagccaccgcgcccagcc

SEQ ID NO: 2069036 - RNA, 14 nt, Human
gagccaccaugccc

SEQ ID NO: 2069037 - RNA, 13 nt, Human
gagccaccugucc

SEQ ID NO: 2069038 - RNA, 19 nt, Human
gagccaccugucccaccuc

SEQ ID NO: 2069039 - RNA, 20 nt, Human
gagccaccugucccaccuca

SEQ ID NO: 2069040 - RNA, 15 nt, Human
gagcaggcacaugga

SEQ ID NO: 2069041 - RNA, 19 nt, Human
gagcaggcacauggaggag

SEQ ID NO: 2069042 - RNA, 15 nt, Human
gagcacuguauaccc

SEQ ID NO: 2069043 - RNA, 16 nt, Human
gagcacuguauacccc

SEQ ID NO: 2069044 - RNA, 17 nt, Human
gagcacuggguugacuu

SEQ ID NO: 2069045 - RNA, 13 nt, Human
gagcacuggguug

SEQ ID NO: 2069046 - RNA, 22 nt, Human
gagccacugcaccgggccacag

SEQ ID NO: 2069047 - RNA, 19 nt, Human
gagccaccaugcccagcuc

SEQ ID NO: 2069048 - RNA, 12 nt, Human
gagccacucugu

SEQ ID NO: 2069049 - RNA, 22 nt, Human
gagccaucggugaaacuaacag

SEQ ID NO: 2069050 - RNA, 22 nt, Human
gagccauggaccacgcaggaag

SEQ ID NO: 2069051 - RNA, 12 nt, Human
gagcaccuccca

SEQ ID NO: 2069052 - RNA, 15 nt, Human
gagcaccucccagcc

SEQ ID NO: 2069053 - RNA, 16 nt, Human
gagcaccucccagccc

SEQ ID NO: 2069054 - RNA, 22 nt, Human
gagcaccgccugugaaauacca

SEQ ID NO: 2069055 - RNA, 13 nt, Human
gagcaccagggga

SEQ ID NO: 2069056 - RNA, 13 nt, Human
gagcacacuguag

SEQ ID NO: 2069057 - RNA, 15 nt, Human
gagcacacuguagca

SEQ ID NO: 2069058 - RNA, 22 nt, Human
gagcacaagaggagauccaggg

SEQ ID NO: 2069059 - RNA, 13 nt, Human
gagcaccaggcac

SEQ ID NO: 2069060 - RNA, 15 nt, Human
gagcaccaggcacga

SEQ ID NO: 2069061 - RNA, 23 nt, Human
gagcaccaggcacgaacccaccu

SEQ ID NO: 2069062 - RNA, 13 nt, Human
gagcaaaccugcc

SEQ ID NO: 2069063 - RNA, 14 nt, Human
gagcaaaccugccc

SEQ ID NO: 2069064 - RNA, 15 nt, Human
gagcaaaccugcccc

SEQ ID NO: 2069065 - RNA, 22 nt, Human
gagaucuccuugcccuagauga

SEQ ID NO: 2069066 - RNA, 21 nt, Human
gagaugaagagugagagggca

SEQ ID NO: 2069067 - RNA, 19 nt, Human
gagcaaaaucgaugcagug

SEQ ID NO: 2069068 - RNA, 20 nt, Human
gagaucaaccccuucgcucc

SEQ ID NO: 2069069 - RNA, 22 nt, Human
gagauauuuauggggggagaac

SEQ ID NO: 2069070 - RNA, 16 nt, Human
gagauauggcagcgaa

SEQ ID NO: 2069071 - RNA, 17 nt, Human
gagauauggcagcgaaa

SEQ ID NO: 2069072 - RNA, 22 nt, Human
gaaugcugguuuuccuaaaugc

SEQ ID NO: 2069073 - RNA, 21 nt, Human
gaaugcggccgcauucccuga

SEQ ID NO: 2069074 - RNA, 11 nt, Human
gaaugcucccc

SEQ ID NO: 2069075 - RNA, 13 nt, Human
gaaugcuccccca

SEQ ID NO: 2069076 - RNA, 19 nt, Human
gaaugcucccccauccucc

SEQ ID NO: 2069077 - RNA, 20 nt, Human
gaaugcucccccauccuccc

SEQ ID NO: 2069078 - RNA, 21 nt, Human
gaaugcucccccauccucccc

SEQ ID NO: 2069079 - RNA, 22 nt, Human
gaaugcucccccauccuccccu

SEQ ID NO: 2069080 - RNA, 23 nt, Human
gaaugcucccccauccuccccuu

SEQ ID NO: 2069081 - RNA, 17 nt, Human
gaaugcugguuuuccua

SEQ ID NO: 2069082 - RNA, 18 nt, Human
gaaugcugguuuuccuaa

SEQ ID NO: 2069083 - RNA, 21 nt, Human
gagaucgugccguuacucucc

SEQ ID NO: 2069084 - RNA, 22 nt, Human
gagaucgugccguuacucucca

SEQ ID NO: 2069085 - RNA, 19 nt, Human
gagaucuaagccuuuccau

SEQ ID NO: 2069086 - RNA, 20 nt, Human
gagaucuaagccuuuccaua

SEQ ID NO: 2069087 - RNA, 21 nt, Human
gagaucuaagccuuuccauaa

SEQ ID NO: 2069088 - RNA, 20 nt, Human
gagaucgcgccacugcacuc

SEQ ID NO: 2069089 - RNA, 16 nt, Human
gagaucggggccagag

SEQ ID NO: 2069090 - RNA, 18 nt, Human
gagaucggggccagaggc

SEQ ID NO: 2069091 - RNA, 15 nt, Human
gagauccuuaucgaa

SEQ ID NO: 2069092 - RNA, 13 nt, Human
gagaucagccugg

SEQ ID NO: 2069093 - RNA, 21 nt, Human
gagaucacgccacugcacucc

SEQ ID NO: 2069094 - RNA, 12 nt, Human
gagaucagaguc

SEQ ID NO: 2069095 - RNA, 14 nt, Human
gagaucagccuggg

SEQ ID NO: 2069096 - RNA, 16 nt, Human
gagaucagccugggca

SEQ ID NO: 2069097 - RNA, 13 nt, Human
gagccugggaggu

SEQ ID NO: 2069098 - RNA, 21 nt, Human
gagccugggaggucaaggcug

SEQ ID NO: 2069099 - RNA, 16 nt, Human
gagccuggugcugcug

SEQ ID NO: 2069100 - RNA, 17 nt, Human
gagccuggugcugcugc

SEQ ID NO: 2069101 - RNA, 15 nt, Human
gagccuggcaagaau

SEQ ID NO: 2069102 - RNA, 10 nt, Human
gagccuggca

SEQ ID NO: 2069103 - RNA, 16 nt, Human
gagcgugaaucuguau

SEQ ID NO: 2069104 - RNA, 17 nt, Human
gagccugcucccccacc

SEQ ID NO: 2069105 - RNA, 18 nt, Human
gagccugcucccccaccc

SEQ ID NO: 2069106 - RNA, 19 nt, Human
gagccugcucccccacccc

SEQ ID NO: 2069107 - RNA, 19 nt, Human
gagccugcggccugcugga

SEQ ID NO: 2069108 - RNA, 13 nt, Human
gagccugcucccc

SEQ ID NO: 2069109 - RNA, 17 nt, Human
gagcccugguggcagug

SEQ ID NO: 2069110 - RNA, 19 nt, Human
gagccucagcauccuggca

SEQ ID NO: 2069111 - RNA, 16 nt, Human
gagcccugguggcagu

SEQ ID NO: 2069112 - RNA, 15 nt, Human
gagcccugguggcag

SEQ ID NO: 2069113 - RNA, 21 nt, Human
gagccucagcauccuggcacc

SEQ ID NO: 2069114 - RNA, 20 nt, Human
gagccucagcauccuggcac

SEQ ID NO: 2069115 - RNA, 20 nt, Human
gagcuguuuauggccucagc

SEQ ID NO: 2069116 - RNA, 22 nt, Human
gagcuguuuauggccucagcug

SEQ ID NO: 2069117 - RNA, 13 nt, Human
gagcuuaccuccc

SEQ ID NO: 2069118 - RNA, 16 nt, Human
gagcuuaccucccacc

SEQ ID NO: 2069119 - RNA, 17 nt, Human
gagcuuagccaaugugg

SEQ ID NO: 2069120 - RNA, 18 nt, Human
gagcuuagugaaauuacu

SEQ ID NO: 2069121 - RNA, 20 nt, Human
gagcuucaagucugugccug

SEQ ID NO: 2069122 - RNA, 22 nt, Human
gagcuucaagucugugccugga

SEQ ID NO: 2069123 - RNA, 14 nt, Human
gagcuucuggcacu

SEQ ID NO: 2069124 - RNA, 16 nt, Human
gagcuucucugugaac

SEQ ID NO: 2069125 - RNA, 17 nt, Human
gagcuucucuuuaacuc

SEQ ID NO: 2069126 - RNA, 19 nt, Human
gagcuucucuuuaacucag

SEQ ID NO: 2069127 - RNA, 21 nt, Human
gagcuucucuuuaacucagga

SEQ ID NO: 2069128 - RNA, 22 nt, Human
gagcuucucuuuaacucaggac

SEQ ID NO: 2069129 - RNA, 23 nt, Human
gagcuucucuuuaacucaggacu

SEQ ID NO: 2069130 - RNA, 14 nt, Human
gagcuucucuguga

SEQ ID NO: 2069131 - RNA, 10 nt, Human
gagcuucucu

SEQ ID NO: 2069132 - RNA, 16 nt, Human
gagcucugcagagcag

SEQ ID NO: 2069133 - RNA, 13 nt, Human
gagcucuggagcc

SEQ ID NO: 2069134 - RNA, 17 nt, Human
gagcucuggagccaccu

SEQ ID NO: 2069135 - RNA, 19 nt, Human
gagcucuggagccaccugu

SEQ ID NO: 2069136 - RNA, 20 nt, Human
gagcucuggagccaccuguc

SEQ ID NO: 2069137 - RNA, 15 nt, Human
gagcucugucugucc

SEQ ID NO: 2069138 - RNA, 16 nt, Human
gagcucuucaggccuc

SEQ ID NO: 2069139 - RNA, 17 nt, Human
gagcucuucaggccucc

SEQ ID NO: 2069140 - RNA, 19 nt, Human
gagcucuucaggccucccu

SEQ ID NO: 2069141 - RNA, 22 nt, Human
gagcucuucaggccucccucuc

SEQ ID NO: 2069142 - RNA, 20 nt, Human
gagcugccauccagggaugc

SEQ ID NO: 2069143 - RNA, 20 nt, Human
gagcuccccaccaccccagc

SEQ ID NO: 2069144 - RNA, 22 nt, Human
gagcuccccaccaccccagcug

SEQ ID NO: 2069145 - RNA, 19 nt, Human
gagcuccccaccaccccag

SEQ ID NO: 2069146 - RNA, 21 nt, Human
gagcuccuccuugucuuggca

SEQ ID NO: 2069147 - RNA, 15 nt, Human
gagcucauguagcaa

SEQ ID NO: 2069148 - RNA, 13 nt, Human
gagcuccugggaa

SEQ ID NO: 2069149 - RNA, 22 nt, Human
gagcuccucugggcaggaccuc

SEQ ID NO: 2069150 - RNA, 14 nt, Human
gagcuccucugggc

SEQ ID NO: 2069151 - RNA, 15 nt, Human
gagcuccucugggca

SEQ ID NO: 2069152 - RNA, 16 nt, Human
gagcuccucugggcag

SEQ ID NO: 2069153 - RNA, 18 nt, Human
gagcuccucugggcagga

SEQ ID NO: 2069154 - RNA, 19 nt, Human
gagcuaacacuggccccua

SEQ ID NO: 2069155 - RNA, 14 nt, Human
gagcuaacacuggc

SEQ ID NO: 2069156 - RNA, 15 nt, Human
gagcuaacacuggcc

SEQ ID NO: 2069157 - RNA, 17 nt, Human
gagcucaggacacuaau

SEQ ID NO: 2069158 - RNA, 14 nt, Human
gagcucaggacacu

SEQ ID NO: 2069159 - RNA, 12 nt, Human
gaguagcuggau

SEQ ID NO: 2069160 - RNA, 19 nt, Human
gaguagccgagagccugcu

SEQ ID NO: 2069161 - RNA, 21 nt, Human
gaguagccgagagccugcucc

SEQ ID NO: 2069162 - RNA, 19 nt, Human
gagguuuuaaaaaaauccc

SEQ ID NO: 2069163 - RNA, 13 nt, Human
gagguuauagguc

SEQ ID NO: 2069164 - RNA, 22 nt, Human
gagguuaggaguucgagaccag

SEQ ID NO: 2069165 - RNA, 15 nt, Human
gagguuaaggcugag

SEQ ID NO: 2069166 - RNA, 19 nt, Human
gagguuaaggcugaggaaa

SEQ ID NO: 2069167 - RNA, 17 nt, Human
gagguucauuucaaaua

SEQ ID NO: 2069168 - RNA, 19 nt, Human
gagguuauaggucacuccu

SEQ ID NO: 2069169 - RNA, 22 nt, Human
gagguuauaggucacuccuggg

SEQ ID NO: 2069170 - RNA, 13 nt, Human
gaggucaggaguu

SEQ ID NO: 2069171 - RNA, 22 nt, Human
gaggucaggaguuagaggccag

SEQ ID NO: 2069172 - RNA, 14 nt, Human
gaggggcuccugga

SEQ ID NO: 2069173 - RNA, 15 nt, Human
gaggggcuccuggaa

SEQ ID NO: 2069174 - RNA, 21 nt, Human
gaggggcggcaggagggaggu

SEQ ID NO: 2069175 - RNA, 12 nt, Human
gaggggcuccug

SEQ ID NO: 2069176 - RNA, 13 nt, Human
gaggggcuccugg

SEQ ID NO: 2069177 - RNA, 13 nt, Human
gagguccuggggg

SEQ ID NO: 2069178 - RNA, 14 nt, Human
gagguccugggggc

SEQ ID NO: 2069179 - RNA, 16 nt, Human
gagguccugggggccu

SEQ ID NO: 2069180 - RNA, 18 nt, Human
gagguccugggggccuga

SEQ ID NO: 2069181 - RNA, 12 nt, Human
gaggucccaggc

SEQ ID NO: 2069182 - RNA, 14 nt, Human
gaggucccaggcag

SEQ ID NO: 2069183 - RNA, 14 nt, Human
gaguagcugggacu

SEQ ID NO: 2069184 - RNA, 12 nt, Human
gaguagcuggga

SEQ ID NO: 2069185 - RNA, 20 nt, Human
gaguauuuaggcagauugaa

SEQ ID NO: 2069186 - RNA, 14 nt, Human
gagucaaaacacuu

SEQ ID NO: 2069187 - RNA, 17 nt, Human
gagucaaaacacuugua

SEQ ID NO: 2069188 - RNA, 20 nt, Human
gagucaaaacacuuguaauu

SEQ ID NO: 2069189 - RNA, 17 nt, Human
gagucgaggacagggag

SEQ ID NO: 2069190 - RNA, 14 nt, Human
gagucccgucagga

SEQ ID NO: 2069191 - RNA, 21 nt, Human
gagucucacuguugcccaggc

SEQ ID NO: 2069192 - RNA, 20 nt, Human
gagucucacuguugcccagg

SEQ ID NO: 2069193 - RNA, 19 nt, Human
gagucucacuguugcccag

SEQ ID NO: 2069194 - RNA, 12 nt, Human
gagucucuucuc

SEQ ID NO: 2069195 - RNA, 23 nt, Human
gagucucacuguugcccaggcug

SEQ ID NO: 2069196 - RNA, 22 nt, Human
gagucucacuguugcccaggcu

SEQ ID NO: 2069197 - RNA, 17 nt, Human
gagucucuucuccacug

SEQ ID NO: 2069198 - RNA, 16 nt, Human
gagucucuucuccacu

SEQ ID NO: 2069199 - RNA, 15 nt, Human
gagucucuucuccac

SEQ ID NO: 2069200 - RNA, 14 nt, Human
gagucucuucucca

SEQ ID NO: 2069201 - RNA, 18 nt, Human
gagucucuucuccacugg

SEQ ID NO: 2069202 - RNA, 14 nt, Human
gagucugaagcaga

SEQ ID NO: 2069203 - RNA, 21 nt, Human
gaguucuuaaggauugugaua

SEQ ID NO: 2069204 - RNA, 21 nt, Human
gaguuccuugaucuguauaua

SEQ ID NO: 2069205 - RNA, 17 nt, Human
gaguucgagaccagccu

SEQ ID NO: 2069206 - RNA, 22 nt, Human
gaguugaaagaguuaagaaugu

SEQ ID NO: 2069207 - RNA, 14 nt, Human
gaguuuucuuccuu

SEQ ID NO: 2069208 - RNA, 17 nt, Human
gagugugccugaagucc

SEQ ID NO: 2069209 - RNA, 14 nt, Human
gaguuagaggccag

SEQ ID NO: 2069210 - RNA, 16 nt, Human
gaguuagaggccagcc

SEQ ID NO: 2069211 - RNA, 18 nt, Human
gaguuagaggccagccug

SEQ ID NO: 2069212 - RNA, 20 nt, Human
gaguuagaggccagccuggc

SEQ ID NO: 2069213 - RNA, 17 nt, Human
gaguuaggcuauucaca

SEQ ID NO: 2069214 - RNA, 18 nt, Human
gaguuaggcuauucacaa

SEQ ID NO: 2069215 - RNA, 19 nt, Human
gaguuagguuuaacauaaa

SEQ ID NO: 2069216 - RNA, 18 nt, Human
gaguuaguuucuuuggga

SEQ ID NO: 2069217 - RNA, 10 nt, Human
gaguggccug

SEQ ID NO: 2069218 - RNA, 12 nt, Human
gaguggccuggc

SEQ ID NO: 2069219 - RNA, 16 nt, Human
gagguuuuaugauauu

SEQ ID NO: 2069220 - RNA, 15 nt, Human
gagucugaagcagau

SEQ ID NO: 2069221 - RNA, 23 nt, Human
gagugggggaucacagccucuga

SEQ ID NO: 2069222 - RNA, 18 nt, Human
gagugggacagagucugg

SEQ ID NO: 2069223 - RNA, 20 nt, Human
gaguggggagacaccucaga

SEQ ID NO: 2069224 - RNA, 13 nt, Human
gaguggcuccucc

SEQ ID NO: 2069225 - RNA, 19 nt, Human
gaguggccuggccaggagc

SEQ ID NO: 2069226 - RNA, 20 nt, Human
gaguggccuggccaggagcu

SEQ ID NO: 2069227 - RNA, 13 nt, Human
gaguggccuggcc

SEQ ID NO: 2069228 - RNA, 14 nt, Human
gaguggccuggcca

SEQ ID NO: 2069229 - RNA, 15 nt, Human
gaguggccuggccag

SEQ ID NO: 2069230 - RNA, 18 nt, Human
gaguggccuggccaggag

SEQ ID NO: 2069231 - RNA, 15 nt, Human
gaguggcuccucccg

SEQ ID NO: 2069232 - RNA, 17 nt, Human
gagugggaaggacuugg

SEQ ID NO: 2069233 - RNA, 17 nt, Human
gagugggacagagucug

SEQ ID NO: 2069234 - RNA, 12 nt, Human
gauagagggggg

SEQ ID NO: 2069235 - RNA, 21 nt, Human
gauacacccaaaguaucagga

SEQ ID NO: 2069236 - RNA, 19 nt, Human
gauacacccaaaguaucag

SEQ ID NO: 2069237 - RNA, 20 nt, Human
gauacaacuucaagugcaug

SEQ ID NO: 2069238 - RNA, 18 nt, Human
gauaaucuuagcugccaa

SEQ ID NO: 2069239 - RNA, 21 nt, Human
gauaauguugugguuuguugc

SEQ ID NO: 2069240 - RNA, 15 nt, Human
gauaaugcuguugcc

SEQ ID NO: 2069241 - RNA, 19 nt, Human
gauaaugcuguugccucau

SEQ ID NO: 2069242 - RNA, 13 nt, Human
gaguuuuguuuua

SEQ ID NO: 2069243 - RNA, 19 nt, Human
gaguuuuguuuuaaaauua

SEQ ID NO: 2069244 - RNA, 18 nt, Human
gaguuuuuauggggcuga

SEQ ID NO: 2069245 - RNA, 19 nt, Human
gaguuuuuauggggcugaa

SEQ ID NO: 2069246 - RNA, 13 nt, Human
gauaaaaaauuuu

SEQ ID NO: 2069247 - RNA, 14 nt, Human
gauaaaaaauuuug

SEQ ID NO: 2069248 - RNA, 18 nt, Human
gauaaaaaauuuuguaau

SEQ ID NO: 2069249 - RNA, 19 nt, Human
gauaaaaaauuuuguaauu

SEQ ID NO: 2069250 - RNA, 23 nt, Human
gauaaaaaauuuuguaauuuucu

SEQ ID NO: 2069251 - RNA, 14 nt, Human
gauaaaaagauggc

SEQ ID NO: 2069252 - RNA, 16 nt, Human
gauaaaagauacauuu

SEQ ID NO: 2069253 - RNA, 23 nt, Human
gauaaaagauacauuuguauguu

SEQ ID NO: 2069254 - RNA, 13 nt, Human
gauaaucagccuc

SEQ ID NO: 2069255 - RNA, 14 nt, Human
gauaaucagccucu

SEQ ID NO: 2069256 - RNA, 15 nt, Human
gauaaucagccucuu

SEQ ID NO: 2069257 - RNA, 16 nt, Human
gauaaucagccucuua

SEQ ID NO: 2069258 - RNA, 22 nt, Human
gaucaaccccuucgcuccugug

SEQ ID NO: 2069259 - RNA, 21 nt, Human
gaucaaccccuucgcuccugu

SEQ ID NO: 2069260 - RNA, 22 nt, Human
gauauauguguuuuucacauuu

SEQ ID NO: 2069261 - RNA, 20 nt, Human
gauauauguguuuuucacau

SEQ ID NO: 2069262 - RNA, 23 nt, Human
gauauaugcucugcauguuacau

SEQ ID NO: 2069263 - RNA, 15 nt, Human
gauauagaauugcaa

SEQ ID NO: 2069264 - RNA, 18 nt, Human
gauauacuuuuuucuuau

SEQ ID NO: 2069265 - RNA, 18 nt, Human
gauauacacggaugacuu

SEQ ID NO: 2069266 - RNA, 14 nt, Human
gauagcaugucuuu

SEQ ID NO: 2069267 - RNA, 14 nt, Human
gauagauaacucuu

SEQ ID NO: 2069268 - RNA, 15 nt, Human
gauagauaacucuuu

SEQ ID NO: 2069269 - RNA, 17 nt, Human
gauagauaacucuuugg

SEQ ID NO: 2069270 - RNA, 18 nt, Human
gauagauaacucuuugga

SEQ ID NO: 2069271 - RNA, 21 nt, Human
gauggcacuuauaaccaaagc

SEQ ID NO: 2069272 - RNA, 18 nt, Human
gauggcaaccagaccauu

SEQ ID NO: 2069273 - RNA, 22 nt, Human
gaugggcaacccccagccugcu

SEQ ID NO: 2069274 - RNA, 14 nt, Human
gaugggacugggag

SEQ ID NO: 2069275 - RNA, 15 nt, Human
gaugggacugggagg

SEQ ID NO: 2069276 - RNA, 17 nt, Human
gaugggacugggagggc

SEQ ID NO: 2069277 - RNA, 18 nt, Human
gaugcuauggucagguua

SEQ ID NO: 2069278 - RNA, 21 nt, Human
gaugggaacgcagaugaucca

SEQ ID NO: 2069279 - RNA, 21 nt, Human
gauggcuuugaaugcggccca

SEQ ID NO: 2069280 - RNA, 18 nt, Human
gaugggaaggagggaggu

SEQ ID NO: 2069281 - RNA, 12 nt, Human
gaugccucagaa

SEQ ID NO: 2069282 - RNA, 23 nt, Human
gaugccucaugauaugucagggc

SEQ ID NO: 2069283 - RNA, 12 nt, Human
gaugccuccacc

SEQ ID NO: 2069284 - RNA, 13 nt, Human
gaugccuccaccg

SEQ ID NO: 2069285 - RNA, 16 nt, Human
gaugccuccaccgcug

SEQ ID NO: 2069286 - RNA, 17 nt, Human
gaugccuccaccgcugc

SEQ ID NO: 2069287 - RNA, 14 nt, Human
gaugccugaacuug

SEQ ID NO: 2069288 - RNA, 20 nt, Human
gaugccuccaccgcugccua

SEQ ID NO: 2069289 - RNA, 18 nt, Human
gaugccucccugacccug

SEQ ID NO: 2069290 - RNA, 19 nt, Human
gaugccucccugacccugc

SEQ ID NO: 2069291 - RNA, 22 nt, Human
gaugccucccugacccugcaga

SEQ ID NO: 2069292 - RNA, 12 nt, Human
gaugcccugcua

SEQ ID NO: 2069293 - RNA, 19 nt, Human
gaugcucagguacagagaa

SEQ ID NO: 2069294 - RNA, 20 nt, Human
gaugcucagguacagagaag

SEQ ID NO: 2069295 - RNA, 23 nt, Human
gaugcucagguacagagaaggaa

SEQ ID NO: 2069296 - RNA, 12 nt, Human
gaugcuccagcc

SEQ ID NO: 2069297 - RNA, 13 nt, Human
gaugcuccagcca

SEQ ID NO: 2069298 - RNA, 16 nt, Human
gaugcuccagccaacc

SEQ ID NO: 2069299 - RNA, 17 nt, Human
gaugcuccagccaaccc

SEQ ID NO: 2069300 - RNA, 22 nt, Human
gaugcuccagccaaccccugug

SEQ ID NO: 2069301 - RNA, 23 nt, Human
gaugcuccagccaaccccugugg

SEQ ID NO: 2069302 - RNA, 13 nt, Human
gaugcucccuccc

SEQ ID NO: 2069303 - RNA, 15 nt, Human
gaugcucccuccccu

SEQ ID NO: 2069304 - RNA, 20 nt, Human
gaugcucccuccccugcccu

SEQ ID NO: 2069305 - RNA, 21 nt, Human
gaugcucccuccccugcccug

SEQ ID NO: 2069306 - RNA, 23 nt, Human
gaugcucccuccccugcccuggu

SEQ ID NO: 2069307 - RNA, 22 nt, Human
gaugagaaagguugaagcacca

SEQ ID NO: 2069308 - RNA, 17 nt, Human
gaugacugaguccucgu

SEQ ID NO: 2069309 - RNA, 11 nt, Human
gaugagaaagg

SEQ ID NO: 2069310 - RNA, 12 nt, Human
gaugacugaguc

SEQ ID NO: 2069311 - RNA, 14 nt, Human
gaugacugaguccu

SEQ ID NO: 2069312 - RNA, 13 nt, Human
gaugacuggaauu

SEQ ID NO: 2069313 - RNA, 17 nt, Human
gaugacuggaauuuuua

SEQ ID NO: 2069314 - RNA, 22 nt, Human
gaugacuggaauuuuuauuaug

SEQ ID NO: 2069315 - RNA, 15 nt, Human
gaugacuagaggcag

SEQ ID NO: 2069316 - RNA, 21 nt, Human
gaugacgacgacaacgaugau

SEQ ID NO: 2069317 - RNA, 16 nt, Human
gaugacuagaggcagg

SEQ ID NO: 2069318 - RNA, 18 nt, Human
gaugcaaggaccaggacu

SEQ ID NO: 2069319 - RNA, 19 nt, Human
gaugcaaggaccaggacuc

SEQ ID NO: 2069320 - RNA, 18 nt, Human
gaugcaaugugcuacuga

SEQ ID NO: 2069321 - RNA, 14 nt, Human
gaugcaaagaaaau

SEQ ID NO: 2069322 - RNA, 21 nt, Human
gaugacuucccaacugcaagu

SEQ ID NO: 2069323 - RNA, 17 nt, Human
gaugcaaagaggcaaga

SEQ ID NO: 2069324 - RNA, 14 nt, Human
gaugcaaagaggca

SEQ ID NO: 2069325 - RNA, 15 nt, Human
gaugcaaagaggcaa

SEQ ID NO: 2069326 - RNA, 16 nt, Human
gaugcaaagaggcaag

SEQ ID NO: 2069327 - RNA, 14 nt, Human
gaugcaaggaccag

SEQ ID NO: 2069328 - RNA, 17 nt, Human
gaugcaaggaccaggac

SEQ ID NO: 2069329 - RNA, 16 nt, Human
gaucuuugcagacagg

SEQ ID NO: 2069330 - RNA, 19 nt, Human
gaucuuucacccacagaaa

SEQ ID NO: 2069331 - RNA, 20 nt, Human
gaucuuucacccacagaaag

SEQ ID NO: 2069332 - RNA, 21 nt, Human
gaucuuucacccacagaaaga

SEQ ID NO: 2069333 - RNA, 22 nt, Human
gaucuuucacccacagaaagag

SEQ ID NO: 2069334 - RNA, 23 nt, Human
gaucuuucacccacagaaagaga

SEQ ID NO: 2069335 - RNA, 11 nt, Human
gaucuuucagg

SEQ ID NO: 2069336 - RNA, 12 nt, Human
gaucuuucagga

SEQ ID NO: 2069337 - RNA, 15 nt, Human
gaucuuucaggaaag

SEQ ID NO: 2069338 - RNA, 14 nt, Human
gaugaaaaauagca

SEQ ID NO: 2069339 - RNA, 16 nt, Human
gaucuuuucaaguuaa

SEQ ID NO: 2069340 - RNA, 18 nt, Human
gauccucccaccucagcc

SEQ ID NO: 2069341 - RNA, 13 nt, Human
gaucgcaguuugc

SEQ ID NO: 2069342 - RNA, 18 nt, Human
gaucgcaguuugccuggu

SEQ ID NO: 2069343 - RNA, 19 nt, Human
gaucuguuuuuaaaaauca

SEQ ID NO: 2069344 - RNA, 21 nt, Human
gaucuguuuuuaaaaaucaua

SEQ ID NO: 2069345 - RNA, 23 nt, Human
gaucuguuuuuaaaaaucauaaa

SEQ ID NO: 2069346 - RNA, 21 nt, Human
gauccucccaccucagccucc

SEQ ID NO: 2069347 - RNA, 20 nt, Human
gauccucccaccucagccuc

SEQ ID NO: 2069348 - RNA, 19 nt, Human
gauccucccaccucagccu

SEQ ID NO: 2069349 - RNA, 14 nt, Human
gaucacgccacugc

SEQ ID NO: 2069350 - RNA, 13 nt, Human
gaucacgccacug

SEQ ID NO: 2069351 - RNA, 23 nt, Human
gaucaaccccuucgcuccugugu

SEQ ID NO: 2069352 - RNA, 14 nt, Human
gaucaagaaagugu

SEQ ID NO: 2069353 - RNA, 20 nt, Human
gaucaagcaauaauaauuuu

SEQ ID NO: 2069354 - RNA, 15 nt, Human
gaucacgccacugca

SEQ ID NO: 2069355 - RNA, 23 nt, Human
gauugugggaauuaaggaaguga

SEQ ID NO: 2069356 - RNA, 11 nt, Human
gauuguaacuc

SEQ ID NO: 2069357 - RNA, 21 nt, Human
gauuguacagaaucauugcuu

SEQ ID NO: 2069358 - RNA, 22 nt, Human
gauuguacagaaucauugcuua

SEQ ID NO: 2069359 - RNA, 22 nt, Human
gauuggauacgcaucagacaga

SEQ ID NO: 2069360 - RNA, 16 nt, Human
gauuggacggccugau

SEQ ID NO: 2069361 - RNA, 23 nt, Human
gauuggacggccugaugcucccu

SEQ ID NO: 2069362 - RNA, 18 nt, Human
gauugcuugagcucagga

SEQ ID NO: 2069363 - RNA, 15 nt, Human
gauugacaguaacuu

SEQ ID NO: 2069364 - RNA, 18 nt, Human
gauugacaguaacuuggu

SEQ ID NO: 2069365 - RNA, 19 nt, Human
gauugacaguaacuugguu

SEQ ID NO: 2069366 - RNA, 20 nt, Human
gauugacaguaacuugguua

SEQ ID NO: 2069367 - RNA, 14 nt, Human
gauucacaucugca

SEQ ID NO: 2069368 - RNA, 22 nt, Human
gauucccaagcucugcuccucu

SEQ ID NO: 2069369 - RNA, 21 nt, Human
gauucacccuguccaaacugc

SEQ ID NO: 2069370 - RNA, 13 nt, Human
gauucaccuguaa

SEQ ID NO: 2069371 - RNA, 14 nt, Human
gauucaccuguaaa

SEQ ID NO: 2069372 - RNA, 15 nt, Human
gauucaccuguaaaa

SEQ ID NO: 2069373 - RNA, 16 nt, Human
gauucaccuguaaaac

SEQ ID NO: 2069374 - RNA, 18 nt, Human
gauucaccuguaaaacuu

SEQ ID NO: 2069375 - RNA, 19 nt, Human
gauucaccuguaaaacuuu

SEQ ID NO: 2069376 - RNA, 20 nt, Human
gauucaccuguaaaacuuua

SEQ ID NO: 2069377 - RNA, 22 nt, Human
gauucaccuguaaaacuuuauu

SEQ ID NO: 2069378 - RNA, 21 nt, Human
gauuccccuaaccucauuccc

SEQ ID NO: 2069379 - RNA, 21 nt, Human
gauucccuccugcuacucugu

SEQ ID NO: 2069380 - RNA, 13 nt, Human
gauucccauugaa

SEQ ID NO: 2069381 - RNA, 14 nt, Human
gauucccauugaaa

SEQ ID NO: 2069382 - RNA, 16 nt, Human
gauucccauugaaaau

SEQ ID NO: 2069383 - RNA, 23 nt, Human
gauucccauugaaaauguaagua

SEQ ID NO: 2069384 - RNA, 19 nt, Human
gauucccagagacaggaaa

SEQ ID NO: 2069385 - RNA, 21 nt, Human
gauucccagagacaggaaaau

SEQ ID NO: 2069386 - RNA, 13 nt, Human
gauucccagagac

SEQ ID NO: 2069387 - RNA, 14 nt, Human
gauucccagagaca

SEQ ID NO: 2069388 - RNA, 15 nt, Human
gauuccugagccagu

SEQ ID NO: 2069389 - RNA, 19 nt, Human
gauucuaauuuuuaagcaa

SEQ ID NO: 2069390 - RNA, 23 nt, Human
gauucuaccacacagcagcaguu

SEQ ID NO: 2069391 - RNA, 16 nt, Human
gauguucugggacaca

SEQ ID NO: 2069392 - RNA, 14 nt, Human
gauguucugggaca

SEQ ID NO: 2069393 - RNA, 17 nt, Human
gaugugucuucaauuug

SEQ ID NO: 2069394 - RNA, 12 nt, Human
gauguggagcac

SEQ ID NO: 2069395 - RNA, 24 nt, Human
gauguggagcacaaaagccucuca

SEQ ID NO: 2069396 - RNA, 21 nt, Human
gaugugcuuugcauuccuaca

SEQ ID NO: 2069397 - RNA, 14 nt, Human
gauggggaaggagg

SEQ ID NO: 2069398 - RNA, 18 nt, Human
gaugggcuuguuuucuug

SEQ ID NO: 2069399 - RNA, 13 nt, Human
gauggggaaggag

SEQ ID NO: 2069400 - RNA, 16 nt, Human
gaugggcccaauucuu

SEQ ID NO: 2069401 - RNA, 22 nt, Human
gauuaagagauggguuugacaa

SEQ ID NO: 2069402 - RNA, 18 nt, Human
gauuaaccacuucagcug

SEQ ID NO: 2069403 - RNA, 19 nt, Human
gauuaaccacuucagcuga

SEQ ID NO: 2069404 - RNA, 21 nt, Human
gauuaaccacuucagcugacu

SEQ ID NO: 2069405 - RNA, 17 nt, Human
gccaccgcgcccagccu

SEQ ID NO: 2069406 - RNA, 17 nt, Human
gccacauccccgcuggc

SEQ ID NO: 2069407 - RNA, 18 nt, Human
gccacauccccgcuggcu

SEQ ID NO: 2069408 - RNA, 20 nt, Human
gccacauccccgcuggcugg

SEQ ID NO: 2069409 - RNA, 11 nt, Human
gccaccucccc

SEQ ID NO: 2069410 - RNA, 15 nt, Human
gccaccuccccaggc

SEQ ID NO: 2069411 - RNA, 17 nt, Human
gccaccuccccaggccg

SEQ ID NO: 2069412 - RNA, 12 nt, Human
gccaccuccccu

SEQ ID NO: 2069413 - RNA, 13 nt, Human
gccaccuccccua

SEQ ID NO: 2069414 - RNA, 15 nt, Human
gccaccuccccuauc

SEQ ID NO: 2069415 - RNA, 17 nt, Human
gccaccuccccuaucca

SEQ ID NO: 2069416 - RNA, 20 nt, Human
gccaccuccccuauccaccc

SEQ ID NO: 2069417 - RNA, 21 nt, Human
gccaccuccccuauccaccca

SEQ ID NO: 2069418 - RNA, 22 nt, Human
gccaccuccccuauccacccag

SEQ ID NO: 2069419 - RNA, 13 nt, Human
gccaccugccccc

SEQ ID NO: 2069420 - RNA, 12 nt, Human
gccaccugcagg

SEQ ID NO: 2069421 - RNA, 16 nt, Human
gccaccugcaggucac

SEQ ID NO: 2069422 - RNA, 14 nt, Human
gccaccugcccccu

SEQ ID NO: 2069423 - RNA, 16 nt, Human
gccaccugcccccuuc

SEQ ID NO: 2069424 - RNA, 17 nt, Human
gccaccugcccccuucu

SEQ ID NO: 2069425 - RNA, 19 nt, Human
gccacggccaggccagagg

SEQ ID NO: 2069426 - RNA, 13 nt, Human
gccacggcagccu

SEQ ID NO: 2069427 - RNA, 13 nt, Human
gccacgugccagg

SEQ ID NO: 2069428 - RNA, 14 nt, Human
gccacgugccaggc

SEQ ID NO: 2069429 - RNA, 17 nt, Human
gccacuacacuccagcc

SEQ ID NO: 2069430 - RNA, 18 nt, Human
gccacuacacuccagccu

SEQ ID NO: 2069431 - RNA, 19 nt, Human
gccacuacacuccagccug

SEQ ID NO: 2069432 - RNA, 21 nt, Human
gccacgcgguacaaaggaaaa

SEQ ID NO: 2069433 - RNA, 17 nt, Human
gccacggccaggccaga

SEQ ID NO: 2069434 - RNA, 18 nt, Human
gccacggccaggccagag

SEQ ID NO: 2069435 - RNA, 14 nt, Human
gccaccuggggcag

SEQ ID NO: 2069436 - RNA, 16 nt, Human
gccaccuggggcaguc

SEQ ID NO: 2069437 - RNA, 17 nt, Human
gccaccuggggcaguca

SEQ ID NO: 2069438 - RNA, 12 nt, Human
gccaccuggggc

SEQ ID NO: 2069439 - RNA, 13 nt, Human
gccaccuguccca

SEQ ID NO: 2069440 - RNA, 18 nt, Human
gccaccugucccaccuca

SEQ ID NO: 2069441 - RNA, 19 nt, Human
gccaccugucccaccucaa

SEQ ID NO: 2069442 - RNA, 21 nt, Human
gccaccugcccccuucuccca

SEQ ID NO: 2069443 - RNA, 18 nt, Human
gccaccugcccccuucuc

SEQ ID NO: 2069444 - RNA, 20 nt, Human
gccaccugcccccuucuccc

SEQ ID NO: 2069445 - RNA, 23 nt, Human
gccaccugcccccuucucccaca

SEQ ID NO: 2069446 - RNA, 22 nt, Human
gccacucugccucugccugcau

SEQ ID NO: 2069447 - RNA, 13 nt, Human
gccacuaggcugg

SEQ ID NO: 2069448 - RNA, 14 nt, Human
gccacuaggcuggg

SEQ ID NO: 2069449 - RNA, 15 nt, Human
gccacuaggcugggu

SEQ ID NO: 2069450 - RNA, 16 nt, Human
gccacuaggcugggug

SEQ ID NO: 2069451 - RNA, 17 nt, Human
gccacuaggcugggugc

SEQ ID NO: 2069452 - RNA, 20 nt, Human
gccacuaggcugggugccca

SEQ ID NO: 2069453 - RNA, 21 nt, Human
gccacuaggcugggugcccac

SEQ ID NO: 2069454 - RNA, 22 nt, Human
gccacuaggcugggugcccaca

SEQ ID NO: 2069455 - RNA, 20 nt, Human
gccacuacacuccagccuga

SEQ ID NO: 2069456 - RNA, 21 nt, Human
gccacuacacuccagccugag

SEQ ID NO: 2069457 - RNA, 22 nt, Human
gccacuacacuccagccugagc

SEQ ID NO: 2069458 - RNA, 23 nt, Human
gccacuacacuccagccugagca

SEQ ID NO: 2069459 - RNA, 14 nt, Human
gccacggcagccua

SEQ ID NO: 2069460 - RNA, 14 nt, Human
gccacucgcuuccc

SEQ ID NO: 2069461 - RNA, 18 nt, Human
gccacucgcuucccccau

SEQ ID NO: 2069462 - RNA, 12 nt, Human
gccacucugccu

SEQ ID NO: 2069463 - RNA, 13 nt, Human
gccacucugccuc

SEQ ID NO: 2069464 - RNA, 14 nt, Human
gccacucugccucu

SEQ ID NO: 2069465 - RNA, 15 nt, Human
gccacucugccucug

SEQ ID NO: 2069466 - RNA, 17 nt, Human
gccacucugccucugcc

SEQ ID NO: 2069467 - RNA, 13 nt, Human
gccacucuguucc

SEQ ID NO: 2069468 - RNA, 23 nt, Human
gccacucuguuccuggcucagcc

SEQ ID NO: 2069469 - RNA, 19 nt, Human
gccacucugccucugccug

SEQ ID NO: 2069470 - RNA, 21 nt, Human
gccacucugccucugccugca

SEQ ID NO: 2069471 - RNA, 14 nt, Human
gccacugaagcugg

SEQ ID NO: 2069472 - RNA, 15 nt, Human
gccacugaagcuggg

SEQ ID NO: 2069473 - RNA, 17 nt, Human
gccacugaagcugggau

SEQ ID NO: 2069474 - RNA, 18 nt, Human
gccagaugcaccagcccu

SEQ ID NO: 2069475 - RNA, 17 nt, Human
gccagaugcaccagccc

SEQ ID NO: 2069476 - RNA, 16 nt, Human
gccagaugcaccagcc

SEQ ID NO: 2069477 - RNA, 23 nt, Human
gccagaguggccuggccaggagc

SEQ ID NO: 2069478 - RNA, 24 nt, Human
gccagaguggccuggccaggagcu

SEQ ID NO: 2069479 - RNA, 23 nt, Human
gccagagggagugacagaggcag

SEQ ID NO: 2069480 - RNA, 13 nt, Human
gccagaguggccu

SEQ ID NO: 2069481 - RNA, 14 nt, Human
gccagaguggccug

SEQ ID NO: 2069482 - RNA, 15 nt, Human
gccagaguggccugg

SEQ ID NO: 2069483 - RNA, 17 nt, Human
gccagaguggccuggcc

SEQ ID NO: 2069484 - RNA, 18 nt, Human
gccagaguggccuggcca

SEQ ID NO: 2069485 - RNA, 19 nt, Human
gccagaguggccuggccag

SEQ ID NO: 2069486 - RNA, 22 nt, Human
gccagaguggccuggccaggag

SEQ ID NO: 2069487 - RNA, 22 nt, Human
gccagagggagugacagaggca

SEQ ID NO: 2069488 - RNA, 21 nt, Human
gccagagggagugacagaggc

SEQ ID NO: 2069489 - RNA, 12 nt, Human
gccaaguucuua

SEQ ID NO: 2069490 - RNA, 15 nt, Human
gccaaguuccucuag

SEQ ID NO: 2069491 - RNA, 21 nt, Human
gccaaguuccucuagugcccu

SEQ ID NO: 2069492 - RNA, 15 nt, Human
gccaagugcaggcug

SEQ ID NO: 2069493 - RNA, 16 nt, Human
gccaagugcaggcugg

SEQ ID NO: 2069494 - RNA, 23 nt, Human
gccaagucccaccgguugcuucu

SEQ ID NO: 2069495 - RNA, 20 nt, Human
gccaagugcaggcuggcacc

SEQ ID NO: 2069496 - RNA, 22 nt, Human
gccaagucagcuuugccuucca

SEQ ID NO: 2069497 - RNA, 15 nt, Human
gccaaguuuauauac

SEQ ID NO: 2069498 - RNA, 17 nt, Human
gccaaguuuauauacaa

SEQ ID NO: 2069499 - RNA, 21 nt, Human
gccaauggagacugucucaag

SEQ ID NO: 2069500 - RNA, 19 nt, Human
gccaauggagacugucuca

SEQ ID NO: 2069501 - RNA, 16 nt, Human
gccaauggagacuguc

SEQ ID NO: 2069502 - RNA, 12 nt, Human
gccaaugagguc

SEQ ID NO: 2069503 - RNA, 19 nt, Human
gccaaugaggucugaaaug

SEQ ID NO: 2069504 - RNA, 22 nt, Human
gccaaugaggucugaaauggag

SEQ ID NO: 2069505 - RNA, 18 nt, Human
gccaaugccccacuggca

SEQ ID NO: 2069506 - RNA, 20 nt, Human
gccaaguuuauauacaauua

SEQ ID NO: 2069507 - RNA, 14 nt, Human
gccaaggugggagg

SEQ ID NO: 2069508 - RNA, 15 nt, Human
gccaaggugggagga

SEQ ID NO: 2069509 - RNA, 23 nt, Human
gccaaggugggaggauugcuuga

SEQ ID NO: 2069510 - RNA, 16 nt, Human
gccaaggugggcugag

SEQ ID NO: 2069511 - RNA, 18 nt, Human
gccaaggugggcugagcc

SEQ ID NO: 2069512 - RNA, 19 nt, Human
gccaaggugggcugagccc

SEQ ID NO: 2069513 - RNA, 21 nt, Human
gccaaggugggcugagcccug

SEQ ID NO: 2069514 - RNA, 22 nt, Human
gccaaggugggcugagcccugg

SEQ ID NO: 2069515 - RNA, 23 nt, Human
gccaaggugggcugagcccuggc

SEQ ID NO: 2069516 - RNA, 16 nt, Human
gccaaguaagaaagug

SEQ ID NO: 2069517 - RNA, 12 nt, Human
gcauuugugaaa

SEQ ID NO: 2069518 - RNA, 21 nt, Human
gccaaggcugggggaagaagc

SEQ ID NO: 2069519 - RNA, 13 nt, Human
gcauuugucaaug

SEQ ID NO: 2069520 - RNA, 18 nt, Human
gcauuugucaaugacagu

SEQ ID NO: 2069521 - RNA, 23 nt, Human
gccacagagaaaguacuucucca

SEQ ID NO: 2069522 - RNA, 16 nt, Human
gccacagcccaggccu

SEQ ID NO: 2069523 - RNA, 22 nt, Human
gccacagcccaggccuccagcu

SEQ ID NO: 2069524 - RNA, 23 nt, Human
gccacagcccaggccuccagcuc

SEQ ID NO: 2069525 - RNA, 16 nt, Human
gccacagcagccucug

SEQ ID NO: 2069526 - RNA, 17 nt, Human
gccacagcagccucuga

SEQ ID NO: 2069527 - RNA, 20 nt, Human
gccacagcagccucugaagu

SEQ ID NO: 2069528 - RNA, 14 nt, Human
gccacagccagaac

SEQ ID NO: 2069529 - RNA, 16 nt, Human
gccacagccagaaccc

SEQ ID NO: 2069530 - RNA, 11 nt, Human
gccacagcucu

SEQ ID NO: 2069531 - RNA, 20 nt, Human
gccacagagaaaguacuucu

SEQ ID NO: 2069532 - RNA, 14 nt, Human
gccacagagaaagu

SEQ ID NO: 2069533 - RNA, 23 nt, Human
gccacacuucaggcucuucuccu

SEQ ID NO: 2069534 - RNA, 13 nt, Human
gccacagagaaag

SEQ ID NO: 2069535 - RNA, 22 nt, Human
gccacacuucaggcucuucucc

SEQ ID NO: 2069536 - RNA, 20 nt, Human
gccacacuucaggcucuucu

SEQ ID NO: 2069537 - RNA, 21 nt, Human
gccacacgucugacccucucc

SEQ ID NO: 2069538 - RNA, 21 nt, Human
gccacaacccuguuuuauacu

SEQ ID NO: 2069539 - RNA, 23 nt, Human
gccaaucucuucuaaaaaaaaac

SEQ ID NO: 2069540 - RNA, 19 nt, Human
gccaauugaauaggaucaa

SEQ ID NO: 2069541 - RNA, 19 nt, Human
gccacaccaucuccuuuca

SEQ ID NO: 2069542 - RNA, 14 nt, Human
gcccagaggcacag

SEQ ID NO: 2069543 - RNA, 19 nt, Human
gcccagaggcacagccggg

SEQ ID NO: 2069544 - RNA, 12 nt, Human
gcccagagcugg

SEQ ID NO: 2069545 - RNA, 13 nt, Human
gcccagagcuggg

SEQ ID NO: 2069546 - RNA, 15 nt, Human
gcccagagcugggug

SEQ ID NO: 2069547 - RNA, 16 nt, Human
gcccagagcuggguga

SEQ ID NO: 2069548 - RNA, 19 nt, Human
gcccagagcugggugagug

SEQ ID NO: 2069549 - RNA, 13 nt, Human
gcccagagggccc

SEQ ID NO: 2069550 - RNA, 15 nt, Human
gcccagagggcccag

SEQ ID NO: 2069551 - RNA, 16 nt, Human
gcccagagggcccagg

SEQ ID NO: 2069552 - RNA, 20 nt, Human
gcccagagggcccaggcagg

SEQ ID NO: 2069553 - RNA, 15 nt, Human
gcccagagaagccaa

SEQ ID NO: 2069554 - RNA, 13 nt, Human
gcccagagaagcc

SEQ ID NO: 2069555 - RNA, 18 nt, Human
gcccaauauuauaauuuu

SEQ ID NO: 2069556 - RNA, 12 nt, Human
gcccaauauuau

SEQ ID NO: 2069557 - RNA, 16 nt, Human
gcccagaccccucugg

SEQ ID NO: 2069558 - RNA, 19 nt, Human
gcccagaccccucuggcca

SEQ ID NO: 2069559 - RNA, 20 nt, Human
gcccagaccccucuggccag

SEQ ID NO: 2069560 - RNA, 21 nt, Human
gcccagaccccucuggccagg

SEQ ID NO: 2069561 - RNA, 22 nt, Human
gcccaauucuuacaaacaugug

SEQ ID NO: 2069562 - RNA, 20 nt, Human
gcccagccauuaccauggag

SEQ ID NO: 2069563 - RNA, 21 nt, Human
gcccagccauuaccauggaga

SEQ ID NO: 2069564 - RNA, 22 nt, Human
gcccagccauuaccauggagac

SEQ ID NO: 2069565 - RNA, 23 nt, Human
gcccagccauuaccauggagaca

SEQ ID NO: 2069566 - RNA, 20 nt, Human
gcccagccaaacccugucug

SEQ ID NO: 2069567 - RNA, 21 nt, Human
gcccagccaaacccugucuga

SEQ ID NO: 2069568 - RNA, 16 nt, Human
gcccagcccagcuggu

SEQ ID NO: 2069569 - RNA, 12 nt, Human
gcccagcccagc

SEQ ID NO: 2069570 - RNA, 13 nt, Human
gcccagcccagcu

SEQ ID NO: 2069571 - RNA, 14 nt, Human
gcccagcccagcug

SEQ ID NO: 2069572 - RNA, 16 nt, Human
gcccagcccagcugcu

SEQ ID NO: 2069573 - RNA, 15 nt, Human
gcccagcccagcugg

SEQ ID NO: 2069574 - RNA, 21 nt, Human
gcccagagggcccaggcaggc

SEQ ID NO: 2069575 - RNA, 17 nt, Human
gcccagccaaacccugu

SEQ ID NO: 2069576 - RNA, 15 nt, Human
gcccagaucccagaa

SEQ ID NO: 2069577 - RNA, 15 nt, Human
gcccaguugggugga

SEQ ID NO: 2069578 - RNA, 20 nt, Human
gcccagucuggaaugcagug

SEQ ID NO: 2069579 - RNA, 19 nt, Human
gcccagucuggaaugcagu

SEQ ID NO: 2069580 - RNA, 20 nt, Human
gcccaggcuggcgugcagug

SEQ ID NO: 2069581 - RNA, 19 nt, Human
gcccaggcuggcgugcagu

SEQ ID NO: 2069582 - RNA, 22 nt, Human
gcccaggcuggcgugcaguggu

SEQ ID NO: 2069583 - RNA, 17 nt, Human
gcccagcuggugggaag

SEQ ID NO: 2069584 - RNA, 16 nt, Human
gcccagcugcucugcc

SEQ ID NO: 2069585 - RNA, 18 nt, Human
gcccagcugcucugccca

SEQ ID NO: 2069586 - RNA, 19 nt, Human
gcccagcugcucugcccag

SEQ ID NO: 2069587 - RNA, 20 nt, Human
gcccagcugcucugcccaga

SEQ ID NO: 2069588 - RNA, 21 nt, Human
gcccagcugcucugcccagag

SEQ ID NO: 2069589 - RNA, 22 nt, Human
gcccagcugcucugcccagagc

SEQ ID NO: 2069590 - RNA, 23 nt, Human
gcccagcugcucugcccagagcu

SEQ ID NO: 2069591 - RNA, 15 nt, Human
gcccagcccuguucu

SEQ ID NO: 2069592 - RNA, 16 nt, Human
gcccagcccuguucug

SEQ ID NO: 2069593 - RNA, 16 nt, Human
gccaggggcuuuugcu

SEQ ID NO: 2069594 - RNA, 15 nt, Human
gccagggauggggcc

SEQ ID NO: 2069595 - RNA, 19 nt, Human
gccagggauggggccacag

SEQ ID NO: 2069596 - RNA, 20 nt, Human
gccagggauggggccacagc

SEQ ID NO: 2069597 - RNA, 21 nt, Human
gccagggauggggccacagcc

SEQ ID NO: 2069598 - RNA, 11 nt, Human
gccagggagcu

SEQ ID NO: 2069599 - RNA, 18 nt, Human
gccagguggccacuccag

SEQ ID NO: 2069600 - RNA, 17 nt, Human
gccagguuuuuggucug

SEQ ID NO: 2069601 - RNA, 22 nt, Human
gccagguuucugcccacauugg

SEQ ID NO: 2069602 - RNA, 14 nt, Human
gccaggcugccaag

SEQ ID NO: 2069603 - RNA, 19 nt, Human
gccagugccuuaccuccug

SEQ ID NO: 2069604 - RNA, 17 nt, Human
gccaucgguccugucuc

SEQ ID NO: 2069605 - RNA, 18 nt, Human
gccaucgguccugucucc

SEQ ID NO: 2069606 - RNA, 19 nt, Human
gccagugaugcuaaagguu

SEQ ID NO: 2069607 - RNA, 20 nt, Human
gccagugaugcuaaagguug

SEQ ID NO: 2069608 - RNA, 17 nt, Human
gccagugaccaaccuuu

SEQ ID NO: 2069609 - RNA, 17 nt, Human
gccagugaccugaggaa

SEQ ID NO: 2069610 - RNA, 18 nt, Human
gccagugaccugaggaag

SEQ ID NO: 2069611 - RNA, 20 nt, Human
gccagugaccugaggaagcg

SEQ ID NO: 2069612 - RNA, 10 nt, Human
gccagugccu

SEQ ID NO: 2069613 - RNA, 11 nt, Human
gccagugccuu

SEQ ID NO: 2069614 - RNA, 15 nt, Human
gccagugccuuaccu

SEQ ID NO: 2069615 - RNA, 17 nt, Human
gccagugccuuaccucc

SEQ ID NO: 2069616 - RNA, 14 nt, Human
gccaugccacccug

SEQ ID NO: 2069617 - RNA, 19 nt, Human
gccaugccagcuuaucuca

SEQ ID NO: 2069618 - RNA, 13 nt, Human
gccaugccagcuu

SEQ ID NO: 2069619 - RNA, 18 nt, Human
gccaugccagcuuaucuc

SEQ ID NO: 2069620 - RNA, 18 nt, Human
gccaugagcuccagaccc

SEQ ID NO: 2069621 - RNA, 19 nt, Human
gccaugagcuccagacccc

SEQ ID NO: 2069622 - RNA, 22 nt, Human
gccaugagcuccagacccccag

SEQ ID NO: 2069623 - RNA, 23 nt, Human
gccaugagcuccagacccccagc

SEQ ID NO: 2069624 - RNA, 14 nt, Human
gccaugagcuccag

SEQ ID NO: 2069625 - RNA, 15 nt, Human
gccaugagcuccaga

SEQ ID NO: 2069626 - RNA, 16 nt, Human
gccaugagcuccagac

SEQ ID NO: 2069627 - RNA, 17 nt, Human
gccaugagcuccagacc

SEQ ID NO: 2069628 - RNA, 21 nt, Human
gcccaaauuaucaagcuaaua

SEQ ID NO: 2069629 - RNA, 22 nt, Human
gcccaaauuaucaagcuaauaa

SEQ ID NO: 2069630 - RNA, 23 nt, Human
gcccaaauuaucaagcuaauaaa

SEQ ID NO: 2069631 - RNA, 14 nt, Human
gcccaaccuccuga

SEQ ID NO: 2069632 - RNA, 13 nt, Human
gcccaaccucagc

SEQ ID NO: 2069633 - RNA, 14 nt, Human
gcccaaccucagca

SEQ ID NO: 2069634 - RNA, 17 nt, Human
gcccaaccucagcaacc

SEQ ID NO: 2069635 - RNA, 13 nt, Human
gcccaaccuccug

SEQ ID NO: 2069636 - RNA, 14 nt, Human
gcccaaccugcucu

SEQ ID NO: 2069637 - RNA, 23 nt, Human
gcccaaccggggagcccccgccc

SEQ ID NO: 2069638 - RNA, 18 nt, Human
gccauggacagaagaagg

SEQ ID NO: 2069639 - RNA, 18 nt, Human
gccauggacucuacacug

SEQ ID NO: 2069640 - RNA, 20 nt, Human
gccauggacucuacacugug

SEQ ID NO: 2069641 - RNA, 22 nt, Human
gccauggacucuacacugugaa

SEQ ID NO: 2069642 - RNA, 23 nt, Human
gccauggacucuacacugugaac

SEQ ID NO: 2069643 - RNA, 15 nt, Human
gcaggaaggagagcc

SEQ ID NO: 2069644 - RNA, 12 nt, Human
gcaggaaggaga

SEQ ID NO: 2069645 - RNA, 13 nt, Human
gcaggaaggagag

SEQ ID NO: 2069646 - RNA, 16 nt, Human
gcaggaagcugugaga

SEQ ID NO: 2069647 - RNA, 14 nt, Human
gcaggaagcucaga

SEQ ID NO: 2069648 - RNA, 17 nt, Human
gcaggaagcucagacug

SEQ ID NO: 2069649 - RNA, 18 nt, Human
gcaggaagcucagacugg

SEQ ID NO: 2069650 - RNA, 13 nt, Human
gcaggaagcugcu

SEQ ID NO: 2069651 - RNA, 15 nt, Human
gcaggaagcugcucc

SEQ ID NO: 2069652 - RNA, 16 nt, Human
gcaggaagcugcuccg

SEQ ID NO: 2069653 - RNA, 18 nt, Human
gcaggaagcaacgaaggg

SEQ ID NO: 2069654 - RNA, 23 nt, Human
gcagccucccucugaccugcagg

SEQ ID NO: 2069655 - RNA, 18 nt, Human
gcagccucgaacuccugg

SEQ ID NO: 2069656 - RNA, 19 nt, Human
gcagccucgaacuccuggg

SEQ ID NO: 2069657 - RNA, 21 nt, Human
gcagccucgaacuccugggcu

SEQ ID NO: 2069658 - RNA, 14 nt, Human
gcagccucugaagu

SEQ ID NO: 2069659 - RNA, 22 nt, Human
gcagccucugaaguuggacagc

SEQ ID NO: 2069660 - RNA, 14 nt, Human
gcagccucccucug

SEQ ID NO: 2069661 - RNA, 16 nt, Human
gcagccucccucugac

SEQ ID NO: 2069662 - RNA, 22 nt, Human
gcagccucccucugaccugcag

SEQ ID NO: 2069663 - RNA, 24 nt, Human
gcagcccugcuuugggcugcccug

SEQ ID NO: 2069664 - RNA, 14 nt, Human
gcagcaggccuguu

SEQ ID NO: 2069665 - RNA, 20 nt, Human
gcagcaggccuguugcuuuu

SEQ ID NO: 2069666 - RNA, 14 nt, Human
gcagcccugcuuug

SEQ ID NO: 2069667 - RNA, 20 nt, Human
gcagcagggagggcuucugc

SEQ ID NO: 2069668 - RNA, 18 nt, Human
gcagcagggagggcuucu

SEQ ID NO: 2069669 - RNA, 19 nt, Human
gcagcagggagggcuucug

SEQ ID NO: 2069670 - RNA, 12 nt, Human
gcagcagcuugc

SEQ ID NO: 2069671 - RNA, 13 nt, Human
gcagcagcuugcu

SEQ ID NO: 2069672 - RNA, 23 nt, Human
gcagcagcuuuuaauacagggua

SEQ ID NO: 2069673 - RNA, 17 nt, Human
gcagacuggugagcaga

SEQ ID NO: 2069674 - RNA, 13 nt, Human
gcagacugguggg

SEQ ID NO: 2069675 - RNA, 12 nt, Human
gcagacuggagg

SEQ ID NO: 2069676 - RNA, 13 nt, Human
gcagacuggaggg

SEQ ID NO: 2069677 - RNA, 14 nt, Human
gcagacuggagggg

SEQ ID NO: 2069678 - RNA, 15 nt, Human
gcagacuggagggga

SEQ ID NO: 2069679 - RNA, 14 nt, Human
gcagagaagccuug

SEQ ID NO: 2069680 - RNA, 16 nt, Human
gcagagaagccuuggu

SEQ ID NO: 2069681 - RNA, 16 nt, Human
gcacuugcagacucua

SEQ ID NO: 2069682 - RNA, 14 nt, Human
gcacuugcagacuc

SEQ ID NO: 2069683 - RNA, 22 nt, Human
gcacuugcacgcccauguguga

SEQ ID NO: 2069684 - RNA, 21 nt, Human
gcacuugcacgcccaugugug

SEQ ID NO: 2069685 - RNA, 22 nt, Human
gcacuucgggaggucgaggcag

SEQ ID NO: 2069686 - RNA, 22 nt, Human
gcagacucuacagaggccaugg

SEQ ID NO: 2069687 - RNA, 19 nt, Human
gcagacucuacagaggcca

SEQ ID NO: 2069688 - RNA, 18 nt, Human
gcagacucuacagaggcc

SEQ ID NO: 2069689 - RNA, 17 nt, Human
gcagacucuacagaggc

SEQ ID NO: 2069690 - RNA, 16 nt, Human
gcagaugaccccuccc

SEQ ID NO: 2069691 - RNA, 15 nt, Human
gcagaugaccccucc

SEQ ID NO: 2069692 - RNA, 13 nt, Human
gcagaugauccau

SEQ ID NO: 2069693 - RNA, 14 nt, Human
gcagaugauccaug

SEQ ID NO: 2069694 - RNA, 15 nt, Human
gcagaugcaaagagg

SEQ ID NO: 2069695 - RNA, 16 nt, Human
gcagaugcaaagaggc

SEQ ID NO: 2069696 - RNA, 17 nt, Human
gcagaugcaaagaggca

SEQ ID NO: 2069697 - RNA, 18 nt, Human
gcagauguccuugaugcu

SEQ ID NO: 2069698 - RNA, 13 nt, Human
gcagcagagccug

SEQ ID NO: 2069699 - RNA, 18 nt, Human
gcagcagagccuggaaga

SEQ ID NO: 2069700 - RNA, 12 nt, Human
gcagaggggcuu

SEQ ID NO: 2069701 - RNA, 16 nt, Human
gcagaggggcuuucug

SEQ ID NO: 2069702 - RNA, 18 nt, Human
gcagaggggcuuucugga

SEQ ID NO: 2069703 - RNA, 19 nt, Human
gcagaggggcuuucuggag

SEQ ID NO: 2069704 - RNA, 20 nt, Human
gcagaggggcuuucuggaga

SEQ ID NO: 2069705 - RNA, 21 nt, Human
gcagaggggcuuucuggagag

SEQ ID NO: 2069706 - RNA, 21 nt, Human
gcagagguugcagugagcuga

SEQ ID NO: 2069707 - RNA, 15 nt, Human
gcagaucccagcuca

SEQ ID NO: 2069708 - RNA, 12 nt, Human
gcagaucccagc

SEQ ID NO: 2069709 - RNA, 14 nt, Human
gcagaucccagcuc

SEQ ID NO: 2069710 - RNA, 13 nt, Human
gcagaucugugcc

SEQ ID NO: 2069711 - RNA, 14 nt, Human
gcagaucugugccc

SEQ ID NO: 2069712 - RNA, 20 nt, Human
gcagaucugugccccaugcc

SEQ ID NO: 2069713 - RNA, 22 nt, Human
gcagaucugugccccaugccug

SEQ ID NO: 2069714 - RNA, 22 nt, Human
gcacuauaauguaagcucuacu

SEQ ID NO: 2069715 - RNA, 20 nt, Human
gcacuauaauguaagcucua

SEQ ID NO: 2069716 - RNA, 14 nt, Human
gcacuauaauguaa

SEQ ID NO: 2069717 - RNA, 15 nt, Human
gcacuauaauguaag

SEQ ID NO: 2069718 - RNA, 19 nt, Human
gcacuaauuugauguuuac

SEQ ID NO: 2069719 - RNA, 20 nt, Human
gcacuaaggugugcucugau

SEQ ID NO: 2069720 - RNA, 14 nt, Human
gcacgugugugcac

SEQ ID NO: 2069721 - RNA, 12 nt, Human
gcacgcuguggg

SEQ ID NO: 2069722 - RNA, 16 nt, Human
gcacgcugugggcagg

SEQ ID NO: 2069723 - RNA, 20 nt, Human
gcacgcugugggcagguggg

SEQ ID NO: 2069724 - RNA, 18 nt, Human
gcacgugguaaaacacuu

SEQ ID NO: 2069725 - RNA, 15 nt, Human
gcacguuuaaaguuc

SEQ ID NO: 2069726 - RNA, 17 nt, Human
gcacguuuaaaguucug

SEQ ID NO: 2069727 - RNA, 19 nt, Human
gcacguuuaaaguucugug

SEQ ID NO: 2069728 - RNA, 14 nt, Human
gcacuaaagcagug

SEQ ID NO: 2069729 - RNA, 20 nt, Human
gcacuaaagcaguggacacc

SEQ ID NO: 2069730 - RNA, 16 nt, Human
gcacccucaggcaggu

SEQ ID NO: 2069731 - RNA, 19 nt, Human
gcacccucaggcagguggg

SEQ ID NO: 2069732 - RNA, 22 nt, Human
gcacgcccaugugugagugugu

SEQ ID NO: 2069733 - RNA, 15 nt, Human
gcacgcccaugugug

SEQ ID NO: 2069734 - RNA, 17 nt, Human
gcacgcccaugugugag

SEQ ID NO: 2069735 - RNA, 18 nt, Human
gcacgcccaugugugagu

SEQ ID NO: 2069736 - RNA, 16 nt, Human
gcacgcacacugucug

SEQ ID NO: 2069737 - RNA, 15 nt, Human
gcacgcacacugucu

SEQ ID NO: 2069738 - RNA, 20 nt, Human
gcacccucauacacagaaac

SEQ ID NO: 2069739 - RNA, 17 nt, Human
gcacccucauacacaga

SEQ ID NO: 2069740 - RNA, 21 nt, Human
gcacagcuucauuuccugugu

SEQ ID NO: 2069741 - RNA, 23 nt, Human
gcacagcuucauuuccugugucu

SEQ ID NO: 2069742 - RNA, 16 nt, Human
gcacagggcaguggga

SEQ ID NO: 2069743 - RNA, 16 nt, Human
gcacagccggggccug

SEQ ID NO: 2069744 - RNA, 23 nt, Human
gcacagccggggccugccuagca

SEQ ID NO: 2069745 - RNA, 14 nt, Human
gauugaaaaggaag

SEQ ID NO: 2069746 - RNA, 16 nt, Human
gauuguuaaaauaacu

SEQ ID NO: 2069747 - RNA, 14 nt, Human
gauuguuaaaauaa

SEQ ID NO: 2069748 - RNA, 17 nt, Human
gcacagcccaaagaagg

SEQ ID NO: 2069749 - RNA, 14 nt, Human
gcaccagcagccug

SEQ ID NO: 2069750 - RNA, 17 nt, Human
gcaccaagagccaaugg

SEQ ID NO: 2069751 - RNA, 13 nt, Human
gcaccagcagccu

SEQ ID NO: 2069752 - RNA, 13 nt, Human
gcaccaagcccac

SEQ ID NO: 2069753 - RNA, 14 nt, Human
gcaccaagcccaca

SEQ ID NO: 2069754 - RNA, 16 nt, Human
gcaccaagcccacagg

SEQ ID NO: 2069755 - RNA, 17 nt, Human
gcaccaagcccacaggu

SEQ ID NO: 2069756 - RNA, 20 nt, Human
gcaggccaagagcagaggca

SEQ ID NO: 2069757 - RNA, 22 nt, Human
gcaggccaagagcagaggcagc

SEQ ID NO: 2069758 - RNA, 24 nt, Human
gcaggccaagagcagaggcagcga

SEQ ID NO: 2069759 - RNA, 22 nt, Human
gcaggccagcugugguuuucuu

SEQ ID NO: 2069760 - RNA, 22 nt, Human
gcaggcccaaauuaucaagcua

SEQ ID NO: 2069761 - RNA, 12 nt, Human
gcaggcccaccu

SEQ ID NO: 2069762 - RNA, 9 nt, Human
gcaggcagu

SEQ ID NO: 2069763 - RNA, 13 nt, Human
gcaggcagggcug

SEQ ID NO: 2069764 - RNA, 22 nt, Human
gcaggagaaucacuugcacucc

SEQ ID NO: 2069765 - RNA, 15 nt, Human
gcagggaggggacua

SEQ ID NO: 2069766 - RNA, 12 nt, Human
gcagggcucuga

SEQ ID NO: 2069767 - RNA, 22 nt, Human
gcaggcggccuuuguugcucag

SEQ ID NO: 2069768 - RNA, 14 nt, Human
gcagggucaggaga

SEQ ID NO: 2069769 - RNA, 15 nt, Human
gcagggucaggagag

SEQ ID NO: 2069770 - RNA, 16 nt, Human
gcagggucaggagagg

SEQ ID NO: 2069771 - RNA, 16 nt, Human
gcagggucucacucug

SEQ ID NO: 2069772 - RNA, 19 nt, Human
gcaggguccuagaaauucc

SEQ ID NO: 2069773 - RNA, 21 nt, Human
gcaguggugcgaucuggguuc

SEQ ID NO: 2069774 - RNA, 20 nt, Human
gcaguggugcgaucuggguu

SEQ ID NO: 2069775 - RNA, 22 nt, Human
gcaguggugcgaucuggguuca

SEQ ID NO: 2069776 - RNA, 17 nt, Human
gcaguucagcaccaccc

SEQ ID NO: 2069777 - RNA, 19 nt, Human
gcaguucagcaccacccua

SEQ ID NO: 2069778 - RNA, 19 nt, Human
gcaguggugcgaucugggu

SEQ ID NO: 2069779 - RNA, 18 nt, Human
gcaguggugcgaucuggg

SEQ ID NO: 2069780 - RNA, 15 nt, Human
gcaguggggcugggg

SEQ ID NO: 2069781 - RNA, 21 nt, Human
gcaguggugcgaucauggcuc

SEQ ID NO: 2069782 - RNA, 21 nt, Human
gcagugggacagggcauggcc

SEQ ID NO: 2069783 - RNA, 11 nt, Human
gcagugggagc

SEQ ID NO: 2069784 - RNA, 16 nt, Human
gcaguggcucacgccu

SEQ ID NO: 2069785 - RNA, 17 nt, Human
gcagggucaggagaggg

SEQ ID NO: 2069786 - RNA, 22 nt, Human
gcaucauuauuugcagagacag

SEQ ID NO: 2069787 - RNA, 14 nt, Human
gcaucaucuguaga

SEQ ID NO: 2069788 - RNA, 20 nt, Human
gcaucaucuguagauacuag

SEQ ID NO: 2069789 - RNA, 12 nt, Human
gcaucucagccc

SEQ ID NO: 2069790 - RNA, 18 nt, Human
gcaucauuccaccauggc

SEQ ID NO: 2069791 - RNA, 14 nt, Human
gcaucucagcccac

SEQ ID NO: 2069792 - RNA, 13 nt, Human
gcaucucagccca

SEQ ID NO: 2069793 - RNA, 12 nt, Human
gcauccaacuga

SEQ ID NO: 2069794 - RNA, 18 nt, Human
gcaucugcuaauaaaacc

SEQ ID NO: 2069795 - RNA, 18 nt, Human
gcaucugccccuccccca

SEQ ID NO: 2069796 - RNA, 11 nt, Human
gcaucuggccu

SEQ ID NO: 2069797 - RNA, 12 nt, Human
gcaucuggccuu

SEQ ID NO: 2069798 - RNA, 14 nt, Human
gcaucucuugaggc

SEQ ID NO: 2069799 - RNA, 14 nt, Human
gcaucugccccucc

SEQ ID NO: 2069800 - RNA, 15 nt, Human
gcaucugccccuccc

SEQ ID NO: 2069801 - RNA, 17 nt, Human
gcaucugccccuccccc

SEQ ID NO: 2069802 - RNA, 15 nt, Human
gcaucucagcccaca

SEQ ID NO: 2069803 - RNA, 16 nt, Human
gcaucuccugugcaug

SEQ ID NO: 2069804 - RNA, 14 nt, Human
gcaucuccugagga

SEQ ID NO: 2069805 - RNA, 22 nt, Human
gcaucuccugaggaucagaaag

SEQ ID NO: 2069806 - RNA, 23 nt, Human
gcaucuccugaggaucagaaagu

SEQ ID NO: 2069807 - RNA, 15 nt, Human
gcaucuccugugcau

SEQ ID NO: 2069808 - RNA, 16 nt, Human
gcaugaccugugacca

SEQ ID NO: 2069809 - RNA, 14 nt, Human
gcauguucucugag

SEQ ID NO: 2069810 - RNA, 18 nt, Human
gcauguuaccuccuauaa

SEQ ID NO: 2069811 - RNA, 13 nt, Human
gcauguuacauaa

SEQ ID NO: 2069812 - RNA, 14 nt, Human
gcaugccuggacaa

SEQ ID NO: 2069813 - RNA, 19 nt, Human
gcaugugugcgagugugug

SEQ ID NO: 2069814 - RNA, 11 nt, Human
gcaugugugug

SEQ ID NO: 2069815 - RNA, 16 nt, Human
gcaugugugugcucag

SEQ ID NO: 2069816 - RNA, 14 nt, Human
gcaugugugugcuc

SEQ ID NO: 2069817 - RNA, 19 nt, Human
gcauguguuugguucuggg

SEQ ID NO: 2069818 - RNA, 19 nt, Human
gcauuacagagaggagaaa

SEQ ID NO: 2069819 - RNA, 13 nt, Human
gcauuacauuccu

SEQ ID NO: 2069820 - RNA, 14 nt, Human
gcauuaacuaaucu

SEQ ID NO: 2069821 - RNA, 18 nt, Human
gcauuaacuaaucuauug

SEQ ID NO: 2069822 - RNA, 22 nt, Human
gcauuaacuaaucuauuggguu

SEQ ID NO: 2069823 - RNA, 14 nt, Human
gcauuacagagagg

SEQ ID NO: 2069824 - RNA, 19 nt, Human
gcauuaaauauaauaugca

SEQ ID NO: 2069825 - RNA, 20 nt, Human
gcauguguuugguucugggg

SEQ ID NO: 2069826 - RNA, 22 nt, Human
gcauguguuugguucuggggcc

SEQ ID NO: 2069827 - RNA, 22 nt, Human
gcauugagaacugcauauguuu

SEQ ID NO: 2069828 - RNA, 16 nt, Human
gcauugaauauauuau

SEQ ID NO: 2069829 - RNA, 12 nt, Human
gcauugagaacu

SEQ ID NO: 2069830 - RNA, 21 nt, Human
gcauugagaacugcauauguu

SEQ ID NO: 2069831 - RNA, 13 nt, Human
gcauucccugagu

SEQ ID NO: 2069832 - RNA, 14 nt, Human
gcauucccugaguc

SEQ ID NO: 2069833 - RNA, 21 nt, Human
gcauucccugagucaccagga

SEQ ID NO: 2069834 - RNA, 22 nt, Human
gcauucccugagucaccaggaa

SEQ ID NO: 2069835 - RNA, 16 nt, Human
gcauuccuacaaagau

SEQ ID NO: 2069836 - RNA, 19 nt, Human
gcauuccuacaaagauguu

SEQ ID NO: 2069837 - RNA, 14 nt, Human
gcuuguuggauuuu

SEQ ID NO: 2069838 - RNA, 18 nt, Human
gcuuguucccucucccug

SEQ ID NO: 2069839 - RNA, 15 nt, Human
gcuuguuauuuauaa

SEQ ID NO: 2069840 - RNA, 23 nt, Human
gcuuggaccucgugcuuuaagug

SEQ ID NO: 2069841 - RNA, 16 nt, Human
gcuugugaucugggaa

SEQ ID NO: 2069842 - RNA, 17 nt, Human
gcuugugaucugggaac

SEQ ID NO: 2069843 - RNA, 14 nt, Human
gcuucuguuucuag

SEQ ID NO: 2069844 - RNA, 15 nt, Human
gcuucuguuucuagu

SEQ ID NO: 2069845 - RNA, 15 nt, Human
gcuucuuaaagaguu

SEQ ID NO: 2069846 - RNA, 14 nt, Human
gcuucuuaaaugag

SEQ ID NO: 2069847 - RNA, 19 nt, Human
gcuucuuaauauaacugcc

SEQ ID NO: 2069848 - RNA, 16 nt, Human
gcuugccgaaacugga

SEQ ID NO: 2069849 - RNA, 17 nt, Human
gcuugccgaaacuggaa

SEQ ID NO: 2069850 - RNA, 18 nt, Human
gcuugccgaaacuggaag

SEQ ID NO: 2069851 - RNA, 19 nt, Human
gcuugccgaaacuggaagu

SEQ ID NO: 2069852 - RNA, 20 nt, Human
gcuugccgaaacuggaaguu

SEQ ID NO: 2069853 - RNA, 13 nt, Human
gcuugccuagggc

SEQ ID NO: 2069854 - RNA, 17 nt, Human
gcuugccuagggccugg

SEQ ID NO: 2069855 - RNA, 21 nt, Human
gcuugccuagggccuggucca

SEQ ID NO: 2069856 - RNA, 22 nt, Human
gcuugccuagggccugguccau

SEQ ID NO: 2069857 - RNA, 13 nt, Human
gcuugccugcagg

SEQ ID NO: 2069858 - RNA, 14 nt, Human
gcuugccugcaggc

SEQ ID NO: 2069859 - RNA, 18 nt, Human
gcuuggaaacuggaugag

SEQ ID NO: 2069860 - RNA, 12 nt, Human
gcuugcugcacc

SEQ ID NO: 2069861 - RNA, 21 nt, Human
gcuugcugcaccccaagucca

SEQ ID NO: 2069862 - RNA, 19 nt, Human
gcuuggaaagcaucaccuc

SEQ ID NO: 2069863 - RNA, 21 nt, Human
gcuuggaaagcaucaccucag

SEQ ID NO: 2069864 - RNA, 23 nt, Human
gcuugcucuucagugggagaaaa

SEQ ID NO: 2069865 - RNA, 16 nt, Human
gcuugcuagcuaugug

SEQ ID NO: 2069866 - RNA, 22 nt, Human
gcuugcuagcuaugugaccuug

SEQ ID NO: 2069867 - RNA, 22 nt, Human
gcuugcguuagaaugaggagga

SEQ ID NO: 2069868 - RNA, 19 nt, Human
gcuuugggcugcccuggug

SEQ ID NO: 2069869 - RNA, 18 nt, Human
gcuuugggcugcccuggu

SEQ ID NO: 2069870 - RNA, 16 nt, Human
gcuuugguuuaaaaga

SEQ ID NO: 2069871 - RNA, 14 nt, Human
gcuuuuaguaccca

SEQ ID NO: 2069872 - RNA, 19 nt, Human
gcuuuuaguacccaccuga

SEQ ID NO: 2069873 - RNA, 22 nt, Human
gcuuuuaguacccaccugagcu

SEQ ID NO: 2069874 - RNA, 23 nt, Human
gcuuuuaguacccaccugagcuu

SEQ ID NO: 2069875 - RNA, 17 nt, Human
gcuuuggucucuugcuu

SEQ ID NO: 2069876 - RNA, 21 nt, Human
gcuuguuugcucaccuggggu

SEQ ID NO: 2069877 - RNA, 23 nt, Human
gcuuguuuucuugccaaugaggu

SEQ ID NO: 2069878 - RNA, 19 nt, Human
gcuuguuugcucaccuggg

SEQ ID NO: 2069879 - RNA, 18 nt, Human
gcuuucaugauuagcaag

SEQ ID NO: 2069880 - RNA, 14 nt, Human
gcuuucagggccuc

SEQ ID NO: 2069881 - RNA, 18 nt, Human
gcuuucagggccuccagc

SEQ ID NO: 2069882 - RNA, 12 nt, Human
gcuuucaugauu

SEQ ID NO: 2069883 - RNA, 20 nt, Human
gcuucaguggcagcugcuuu

SEQ ID NO: 2069884 - RNA, 13 nt, Human
gcuuaucucaggg

SEQ ID NO: 2069885 - RNA, 19 nt, Human
gcuucaguggcagcugcuu

SEQ ID NO: 2069886 - RNA, 17 nt, Human
gcuuaucaauaaaccug

SEQ ID NO: 2069887 - RNA, 17 nt, Human
gcuuauccuuccacgga

SEQ ID NO: 2069888 - RNA, 13 nt, Human
gcuuaucaauuug

SEQ ID NO: 2069889 - RNA, 16 nt, Human
gcuuaucaauuuguca

SEQ ID NO: 2069890 - RNA, 20 nt, Human
gcuuaucaauuugucauuuu

SEQ ID NO: 2069891 - RNA, 22 nt, Human
gcuuaucaauuugucauuuuga

SEQ ID NO: 2069892 - RNA, 23 nt, Human
gcuuaucaauuugucauuuugaa

SEQ ID NO: 2069893 - RNA, 23 nt, Human
gcuuaucaugcugucuuuacaug

SEQ ID NO: 2069894 - RNA, 13 nt, Human
gcuucaugccuuu

SEQ ID NO: 2069895 - RNA, 15 nt, Human
gcuucaugccuuugu

SEQ ID NO: 2069896 - RNA, 16 nt, Human
gcuucaugccuuugua

SEQ ID NO: 2069897 - RNA, 17 nt, Human
gcuucaugccuuuguaa

SEQ ID NO: 2069898 - RNA, 18 nt, Human
gcuucaugaaaauccuac

SEQ ID NO: 2069899 - RNA, 20 nt, Human
gcuucaugaaaauccuacca

SEQ ID NO: 2069900 - RNA, 13 nt, Human
gcuuagaccucag

SEQ ID NO: 2069901 - RNA, 14 nt, Human
gcuuagaccucagc

SEQ ID NO: 2069902 - RNA, 15 nt, Human
gcuuagaccucagcc

SEQ ID NO: 2069903 - RNA, 16 nt, Human
gcuuagaccucagccu

SEQ ID NO: 2069904 - RNA, 17 nt, Human
gcuuagaccucagccug

SEQ ID NO: 2069905 - RNA, 18 nt, Human
gcuuagaccucagccugu

SEQ ID NO: 2069906 - RNA, 21 nt, Human
gcuuacuacaugugggagcuu

SEQ ID NO: 2069907 - RNA, 14 nt, Human
gcuuacucauuaaa

SEQ ID NO: 2069908 - RNA, 22 nt, Human
gcuucucacugccaugccagcu

SEQ ID NO: 2069909 - RNA, 16 nt, Human
gcuucucauccugcag

SEQ ID NO: 2069910 - RNA, 21 nt, Human
gcuuccacguacugcagccuc

SEQ ID NO: 2069911 - RNA, 19 nt, Human
gcuuccagaaaaccccagc

SEQ ID NO: 2069912 - RNA, 18 nt, Human
gcuucauuuccugugucu

SEQ ID NO: 2069913 - RNA, 22 nt, Human
gcuucauucaagucagcucuuc

SEQ ID NO: 2069914 - RNA, 13 nt, Human
gcuucuggagccc

SEQ ID NO: 2069915 - RNA, 14 nt, Human
gcuucuggagcccu

SEQ ID NO: 2069916 - RNA, 17 nt, Human
gcuucuggagcccuugg

SEQ ID NO: 2069917 - RNA, 18 nt, Human
gcuucuggagcccuuggg

SEQ ID NO: 2069918 - RNA, 17 nt, Human
gcuucucauccugcagg

SEQ ID NO: 2069919 - RNA, 18 nt, Human
gcuucucauccugcaggc

SEQ ID NO: 2069920 - RNA, 12 nt, Human
gcuucuggagcc

SEQ ID NO: 2069921 - RNA, 20 nt, Human
gcuggucucaaacuccugac

SEQ ID NO: 2069922 - RNA, 19 nt, Human
gcuggucucaaacuccuga

SEQ ID NO: 2069923 - RNA, 14 nt, Human
gcuggucccacuca

SEQ ID NO: 2069924 - RNA, 15 nt, Human
gcuggugcagggccu

SEQ ID NO: 2069925 - RNA, 13 nt, Human
gcuggugcauuac

SEQ ID NO: 2069926 - RNA, 17 nt, Human
gcuggugcauuacagag

SEQ ID NO: 2069927 - RNA, 18 nt, Human
gcuggugcauuacagaga

SEQ ID NO: 2069928 - RNA, 20 nt, Human
gcuggugcauuacagagagg

SEQ ID NO: 2069929 - RNA, 22 nt, Human
gcuggugcauuacagagaggag

SEQ ID NO: 2069930 - RNA, 13 nt, Human
gcuggugcccgga

SEQ ID NO: 2069931 - RNA, 14 nt, Human
gcugggggccucac

SEQ ID NO: 2069932 - RNA, 20 nt, Human
gcugggggccucacuccagg

SEQ ID NO: 2069933 - RNA, 17 nt, Human
gcuggggcaagucccug

SEQ ID NO: 2069934 - RNA, 18 nt, Human
gcugggggccucagugcc

SEQ ID NO: 2069935 - RNA, 13 nt, Human
gcuggucacugcc

SEQ ID NO: 2069936 - RNA, 15 nt, Human
gcuggucacugccau

SEQ ID NO: 2069937 - RNA, 18 nt, Human
gcuggucacugccaugga

SEQ ID NO: 2069938 - RNA, 15 nt, Human
gcugggggccucagu

SEQ ID NO: 2069939 - RNA, 14 nt, Human
gcugggggccucag

SEQ ID NO: 2069940 - RNA, 20 nt, Human
gcugggcuucaguggcagcu

SEQ ID NO: 2069941 - RNA, 18 nt, Human
gcugggauagagggguca

SEQ ID NO: 2069942 - RNA, 17 nt, Human
gcugggaucugacugca

SEQ ID NO: 2069943 - RNA, 18 nt, Human
gcugggaucugacugcac

SEQ ID NO: 2069944 - RNA, 20 nt, Human
gcugggaucugacugcacgu

SEQ ID NO: 2069945 - RNA, 22 nt, Human
gcugggaucugacugcacgugg

SEQ ID NO: 2069946 - RNA, 21 nt, Human
gcugggagggauagagggggg

SEQ ID NO: 2069947 - RNA, 13 nt, Human
gcugggcucucca

SEQ ID NO: 2069948 - RNA, 14 nt, Human
gcugggcucuccac

SEQ ID NO: 2069949 - RNA, 15 nt, Human
gcugggcucuccacc

SEQ ID NO: 2069950 - RNA, 19 nt, Human
gcugggcucuccaccucag

SEQ ID NO: 2069951 - RNA, 20 nt, Human
gcugggcucuccaccucagc

SEQ ID NO: 2069952 - RNA, 21 nt, Human
gcugggcucuccaccucagcc

SEQ ID NO: 2069953 - RNA, 22 nt, Human
gcugggcucuccaccucagccu

SEQ ID NO: 2069954 - RNA, 22 nt, Human
gcugggcuucaguggcagcugc

SEQ ID NO: 2069955 - RNA, 21 nt, Human
gcugggcuucaguggcagcug

SEQ ID NO: 2069956 - RNA, 14 nt, Human
gcugggcugggcgc

SEQ ID NO: 2069957 - RNA, 19 nt, Human
gcugggagggauagagggg

SEQ ID NO: 2069958 - RNA, 15 nt, Human
gcuggugucaccuga

SEQ ID NO: 2069959 - RNA, 14 nt, Human
gcuggugucaccug

SEQ ID NO: 2069960 - RNA, 14 nt, Human
gcuggugcccggag

SEQ ID NO: 2069961 - RNA, 18 nt, Human
gcugucauaagaaugaau

SEQ ID NO: 2069962 - RNA, 13 nt, Human
gcugucaucucag

SEQ ID NO: 2069963 - RNA, 13 nt, Human
gcugucccucacu

SEQ ID NO: 2069964 - RNA, 13 nt, Human
gcuguccuaggcc

SEQ ID NO: 2069965 - RNA, 14 nt, Human
gcuguccuaggcca

SEQ ID NO: 2069966 - RNA, 16 nt, Human
gcuguccuaggccaca

SEQ ID NO: 2069967 - RNA, 13 nt, Human
gcugugugcaguc

SEQ ID NO: 2069968 - RNA, 13 nt, Human
gcuguuagagucc

SEQ ID NO: 2069969 - RNA, 18 nt, Human
gcuguuauuucuauuuuu

SEQ ID NO: 2069970 - RNA, 18 nt, Human
gcuuacaugagaacagac

SEQ ID NO: 2069971 - RNA, 14 nt, Human
gcuuaccucccacc

SEQ ID NO: 2069972 - RNA, 15 nt, Human
gcuuaccucccaccu

SEQ ID NO: 2069973 - RNA, 13 nt, Human
gcugugggcaggu

SEQ ID NO: 2069974 - RNA, 14 nt, Human
gcugugggcaggug

SEQ ID NO: 2069975 - RNA, 17 nt, Human
gcugugggcagguggga

SEQ ID NO: 2069976 - RNA, 15 nt, Human
gcuguggccugggca

SEQ ID NO: 2069977 - RNA, 14 nt, Human
gcuguggccugggc

SEQ ID NO: 2069978 - RNA, 20 nt, Human
gcuggccgaggguccuggcu

SEQ ID NO: 2069979 - RNA, 24 nt, Human
gcuggccgaggguccuggcuccug

SEQ ID NO: 2069980 - RNA, 19 nt, Human
gcuggcccuggcucccaca

SEQ ID NO: 2069981 - RNA, 15 nt, Human
gcuggccgagggucc

SEQ ID NO: 2069982 - RNA, 19 nt, Human
gcuggccgaggguccuggc

SEQ ID NO: 2069983 - RNA, 14 nt, Human
gcuggcccagccaa

SEQ ID NO: 2069984 - RNA, 15 nt, Human
gcuggaccuugaacu

SEQ ID NO: 2069985 - RNA, 20 nt, Human
gcuggaccaguggugccuug

SEQ ID NO: 2069986 - RNA, 14 nt, Human
gcuggacaggucug

SEQ ID NO: 2069987 - RNA, 15 nt, Human
gcuggacaggucugg

SEQ ID NO: 2069988 - RNA, 16 nt, Human
gcuggcauuugcaccu

SEQ ID NO: 2069989 - RNA, 17 nt, Human
gcuggaccucaccaagc

SEQ ID NO: 2069990 - RNA, 18 nt, Human
gcuggcaccgccuucucu

SEQ ID NO: 2069991 - RNA, 17 nt, Human
gcuggcaccgccuucuc

SEQ ID NO: 2069992 - RNA, 13 nt, Human
gcuggcagcagag

SEQ ID NO: 2069993 - RNA, 15 nt, Human
gcuggcagcagagug

SEQ ID NO: 2069994 - RNA, 16 nt, Human
gcuggaauuuuuuauu

SEQ ID NO: 2069995 - RNA, 18 nt, Human
gcuggaauuuuuuauucu

SEQ ID NO: 2069996 - RNA, 20 nt, Human
gcuggaauuuuuuauucuug

SEQ ID NO: 2069997 - RNA, 13 nt, Human
gcuggaaggguca

SEQ ID NO: 2069998 - RNA, 12 nt, Human
gcugcuuuuccu

SEQ ID NO: 2069999 - RNA, 22 nt, Human
gcugcuuuuccuuggggcaggc

SEQ ID NO: 2070000 - RNA, 23 nt, Human
gcugcuuuuccuuggggcaggca

SEQ ID NO: 2070001 - RNA, 20 nt, Human
gcugcuaaucuucagggcac

SEQ ID NO: 2070002 - RNA, 15 nt, Human
gcugcuaaucuucag

SEQ ID NO: 2070003 - RNA, 18 nt, Human
gcugcuaaucuucagggc

SEQ ID NO: 2070004 - RNA, 18 nt, Human
gcugcuaaaucuccuauu

SEQ ID NO: 2070005 - RNA, 21 nt, Human
gcugcuaaaucuccuauuuuu

SEQ ID NO: 2070006 - RNA, 13 nt, Human
gcugcgucuccca

SEQ ID NO: 2070007 - RNA, 12 nt, Human
gcugcuacccag

SEQ ID NO: 2070008 - RNA, 14 nt, Human
gcugcuacccagaa

SEQ ID NO: 2070009 - RNA, 22 nt, Human
gcugcuuuucccuaagccaagg

SEQ ID NO: 2070010 - RNA, 22 nt, Human
gcugcuuuugucuaugggacuc

SEQ ID NO: 2070011 - RNA, 23 nt, Human
gcugcuuuaauugugaauugaua

SEQ ID NO: 2070012 - RNA, 21 nt, Human
gcugcgguccacccaggagcc

SEQ ID NO: 2070013 - RNA, 22 nt, Human
gcugcgguccacccaggagccc

SEQ ID NO: 2070014 - RNA, 14 nt, Human
gcugcggcacccuu

SEQ ID NO: 2070015 - RNA, 15 nt, Human
gcugcggcacccuug

SEQ ID NO: 2070016 - RNA, 15 nt, Human
gcugcgguccaccca

SEQ ID NO: 2070017 - RNA, 14 nt, Human
gcugcgguccaccc

SEQ ID NO: 2070018 - RNA, 15 nt, Human
gcugcccuggugcug

SEQ ID NO: 2070019 - RNA, 14 nt, Human
gcugcccuggugcu

SEQ ID NO: 2070020 - RNA, 13 nt, Human
gcugcccuggugc

SEQ ID NO: 2070021 - RNA, 12 nt, Human
gcugcccuggug

SEQ ID NO: 2070022 - RNA, 19 nt, Human
gcugccuguucagcuccag

SEQ ID NO: 2070023 - RNA, 18 nt, Human
gcugccuguucagcucca

SEQ ID NO: 2070024 - RNA, 15 nt, Human
gcugccuuagaaccu

SEQ ID NO: 2070025 - RNA, 17 nt, Human
gcugcccuggugcugcc

SEQ ID NO: 2070026 - RNA, 20 nt, Human
gcugccuuagaaccuuucuu

SEQ ID NO: 2070027 - RNA, 22 nt, Human
gcugccuguucagcuccagcuc

SEQ ID NO: 2070028 - RNA, 20 nt, Human
gcugccuguucagcuccagc

SEQ ID NO: 2070029 - RNA, 15 nt, Human
gcugcccugccacuu

SEQ ID NO: 2070030 - RNA, 21 nt, Human
gcugcccuggaggaaccgaaa

SEQ ID NO: 2070031 - RNA, 23 nt, Human
gcugcaaaggguaucaggugcug

SEQ ID NO: 2070032 - RNA, 22 nt, Human
gcugcaaaggguaucaggugcu

SEQ ID NO: 2070033 - RNA, 15 nt, Human
gcugauuuuaacaau

SEQ ID NO: 2070034 - RNA, 14 nt, Human
gcugauuuuaacaa

SEQ ID NO: 2070035 - RNA, 20 nt, Human
gcugauuuuaacaauaacua

SEQ ID NO: 2070036 - RNA, 12 nt, Human
gcugaucucagg

SEQ ID NO: 2070037 - RNA, 13 nt, Human
gcugaucucaggg

SEQ ID NO: 2070038 - RNA, 14 nt, Human
gcugaucucaggga

SEQ ID NO: 2070039 - RNA, 16 nt, Human
gcugaucucagggaag

SEQ ID NO: 2070040 - RNA, 17 nt, Human
gcugaucucagggaagc

SEQ ID NO: 2070041 - RNA, 21 nt, Human
gcugaucucagggaagcccag

SEQ ID NO: 2070042 - RNA, 22 nt, Human
gcugaucucagggaagcccagc

SEQ ID NO: 2070043 - RNA, 16 nt, Human
gcugaucgugcuaaau

SEQ ID NO: 2070044 - RNA, 14 nt, Human
gcugauuacuguca

SEQ ID NO: 2070045 - RNA, 20 nt, Human
gcugauuacugucaauaaac

SEQ ID NO: 2070046 - RNA, 21 nt, Human
gcugauuacugucaauaaaca

SEQ ID NO: 2070047 - RNA, 22 nt, Human
gcugauuacugucaauaaacag

SEQ ID NO: 2070048 - RNA, 14 nt, Human
gcugagacugcggg

SEQ ID NO: 2070049 - RNA, 19 nt, Human
gcugagacuggauacugcc

SEQ ID NO: 2070050 - RNA, 20 nt, Human
gcugagacuggauacugccc

SEQ ID NO: 2070051 - RNA, 14 nt, Human
gcugagagaaccuc

SEQ ID NO: 2070052 - RNA, 14 nt, Human
gcugagagacccaa

SEQ ID NO: 2070053 - RNA, 15 nt, Human
gcugagagacccaag

SEQ ID NO: 2070054 - RNA, 17 nt, Human
gcugagagacccaagga

SEQ ID NO: 2070055 - RNA, 18 nt, Human
gcugacuuugcucuuucu

SEQ ID NO: 2070056 - RNA, 13 nt, Human
gcugagaauagaa

SEQ ID NO: 2070057 - RNA, 15 nt, Human
gcugagaauagaagg

SEQ ID NO: 2070058 - RNA, 16 nt, Human
gcugagaauagaagga

SEQ ID NO: 2070059 - RNA, 17 nt, Human
gcugagaauagaaggaa

SEQ ID NO: 2070060 - RNA, 18 nt, Human
gcugagaauagaaggaaa

SEQ ID NO: 2070061 - RNA, 19 nt, Human
gcugagaauagaaggaaac

SEQ ID NO: 2070062 - RNA, 20 nt, Human
gcugagagacccaaggagga

SEQ ID NO: 2070063 - RNA, 22 nt, Human
gcugagagacccaaggaggaaa

SEQ ID NO: 2070064 - RNA, 17 nt, Human
gcugauauauguguuuu

SEQ ID NO: 2070065 - RNA, 18 nt, Human
gcugauauauguguuuuu

SEQ ID NO: 2070066 - RNA, 20 nt, Human
gcugauauauguguuuuuca

SEQ ID NO: 2070067 - RNA, 15 nt, Human
gcugccaaauuuugg

SEQ ID NO: 2070068 - RNA, 17 nt, Human
gcugccaaauuuuggcc

SEQ ID NO: 2070069 - RNA, 14 nt, Human
gcugccaagcccca

SEQ ID NO: 2070070 - RNA, 15 nt, Human
gcugccaagccccau

SEQ ID NO: 2070071 - RNA, 15 nt, Human
gcugccaaggccaga

SEQ ID NO: 2070072 - RNA, 17 nt, Human
gcugcaaaagugagggc

SEQ ID NO: 2070073 - RNA, 20 nt, Human
gcugcagugacgugcaccug

SEQ ID NO: 2070074 - RNA, 23 nt, Human
gcugccacacuucaggcucuucu

SEQ ID NO: 2070075 - RNA, 22 nt, Human
gcugccacacuucaggcucuuc

SEQ ID NO: 2070076 - RNA, 21 nt, Human
gcugccacacuucaggcucuu

SEQ ID NO: 2070077 - RNA, 18 nt, Human
gcugccacacuucaggcu

SEQ ID NO: 2070078 - RNA, 17 nt, Human
gcugccacacuucaggc

SEQ ID NO: 2070079 - RNA, 15 nt, Human
gcugccacacuucag

SEQ ID NO: 2070080 - RNA, 16 nt, Human
gcugccaaggccagag

SEQ ID NO: 2070081 - RNA, 17 nt, Human
gcugccaaggccagagu

SEQ ID NO: 2070082 - RNA, 18 nt, Human
gcugccaaggccagagug

SEQ ID NO: 2070083 - RNA, 19 nt, Human
gcugacagacacaggcccg

SEQ ID NO: 2070084 - RNA, 18 nt, Human
gcugacagacacaggccc

SEQ ID NO: 2070085 - RNA, 17 nt, Human
gcugacagacacaggcc

SEQ ID NO: 2070086 - RNA, 20 nt, Human
gcugacagacacaggcccgg

SEQ ID NO: 2070087 - RNA, 15 nt, Human
gcugaccaagagaga

SEQ ID NO: 2070088 - RNA, 16 nt, Human
gcugaccaagagagaa

SEQ ID NO: 2070089 - RNA, 20 nt, Human
gcugaccaagagagaaagaa

SEQ ID NO: 2070090 - RNA, 13 nt, Human
gcugaccaagaga

SEQ ID NO: 2070091 - RNA, 14 nt, Human
gcugaccaagagag

SEQ ID NO: 2070092 - RNA, 22 nt, Human
gcugacuguuuucucuugagag

SEQ ID NO: 2070093 - RNA, 14 nt, Human
gcugacgaggcugg

SEQ ID NO: 2070094 - RNA, 15 nt, Human
gcugacgaggcuggg

SEQ ID NO: 2070095 - RNA, 17 nt, Human
gcugacgaggcugggcc

SEQ ID NO: 2070096 - RNA, 18 nt, Human
gcugacgaggcugggcca

SEQ ID NO: 2070097 - RNA, 12 nt, Human
gcugaccagaca

SEQ ID NO: 2070098 - RNA, 21 nt, Human
gcugaccuugaacuccugggc

SEQ ID NO: 2070099 - RNA, 20 nt, Human
gcugaccuugaacuccuggg

SEQ ID NO: 2070100 - RNA, 23 nt, Human
gcugaccuugaacuccugggcuc

SEQ ID NO: 2070101 - RNA, 15 nt, Human
gcucuugcagagaag

SEQ ID NO: 2070102 - RNA, 18 nt, Human
gcucuugcagagaagccu

SEQ ID NO: 2070103 - RNA, 19 nt, Human
gcucuuggcagguacucag

SEQ ID NO: 2070104 - RNA, 21 nt, Human
gcucuucugccggcccugggg

SEQ ID NO: 2070105 - RNA, 23 nt, Human
gcucuuugaaauagucuguguga

SEQ ID NO: 2070106 - RNA, 13 nt, Human
gcucuuucugggc

SEQ ID NO: 2070107 - RNA, 14 nt, Human
gcucuuucugggcc

SEQ ID NO: 2070108 - RNA, 18 nt, Human
gcucuuucugggccaagu

SEQ ID NO: 2070109 - RNA, 17 nt, Human
gcucuuugaaacaacuu

SEQ ID NO: 2070110 - RNA, 21 nt, Human
gcucuuugaaauagucugugu

SEQ ID NO: 2070111 - RNA, 14 nt, Human
gcucuucugccggc

SEQ ID NO: 2070112 - RNA, 18 nt, Human
gcgcagugcuucucuaca

SEQ ID NO: 2070113 - RNA, 22 nt, Human
gcgcagugcuucucuacagacu

SEQ ID NO: 2070114 - RNA, 21 nt, Human
gcgccacuacacuccagccug

SEQ ID NO: 2070115 - RNA, 22 nt, Human
gcgccacuacacuccagccuga

SEQ ID NO: 2070116 - RNA, 24 nt, Human
gcgccacuacacuccagccugagc

SEQ ID NO: 2070117 - RNA, 16 nt, Human
gcgccacucgcuuccc

SEQ ID NO: 2070118 - RNA, 18 nt, Human
gcgccacucgcuuccccc

SEQ ID NO: 2070119 - RNA, 13 nt, Human
gcgccccuucccc

SEQ ID NO: 2070120 - RNA, 23 nt, Human
gcgcccaguuggguggaugccug

SEQ ID NO: 2070121 - RNA, 23 nt, Human
gcgccacucgcuucccccauagc

SEQ ID NO: 2070122 - RNA, 13 nt, Human
gcgcccccagugu

SEQ ID NO: 2070123 - RNA, 16 nt, Human
gcgccugccccuccca

SEQ ID NO: 2070124 - RNA, 17 nt, Human
gcgccugccccucccag

SEQ ID NO: 2070125 - RNA, 18 nt, Human
gcgccugccccucccaga

SEQ ID NO: 2070126 - RNA, 15 nt, Human
gcgccuccuuccuug

SEQ ID NO: 2070127 - RNA, 22 nt, Human
gcgccuccuuccuugcuguccu

SEQ ID NO: 2070128 - RNA, 14 nt, Human
gcgguccacccagg

SEQ ID NO: 2070129 - RNA, 13 nt, Human
gcgguccacccag

SEQ ID NO: 2070130 - RNA, 19 nt, Human
gcggugagaggggaacaga

SEQ ID NO: 2070131 - RNA, 17 nt, Human
gcggggacagcuccuuc

SEQ ID NO: 2070132 - RNA, 15 nt, Human
gcggggacagcuccu

SEQ ID NO: 2070133 - RNA, 14 nt, Human
gcggggacagcucc

SEQ ID NO: 2070134 - RNA, 19 nt, Human
gcggagacggagucccacc

SEQ ID NO: 2070135 - RNA, 14 nt, Human
gcggacgggcuguc

SEQ ID NO: 2070136 - RNA, 16 nt, Human
gcgcugccgcacccca

SEQ ID NO: 2070137 - RNA, 17 nt, Human
gcgcugccgcaccccag

SEQ ID NO: 2070138 - RNA, 19 nt, Human
gcgcugccgcaccccagag

SEQ ID NO: 2070139 - RNA, 21 nt, Human
gcgcugccgcaccccagagug

SEQ ID NO: 2070140 - RNA, 23 nt, Human
gcgcugcucuuaugccauuuguu

SEQ ID NO: 2070141 - RNA, 18 nt, Human
gccuuggucuaacuuuug

SEQ ID NO: 2070142 - RNA, 16 nt, Human
gccuugguguccaccu

SEQ ID NO: 2070143 - RNA, 22 nt, Human
gccuugguguccaccuggcccc

SEQ ID NO: 2070144 - RNA, 19 nt, Human
gccuugguucaucaguguu

SEQ ID NO: 2070145 - RNA, 18 nt, Human
gccuugguucccuugugu

SEQ ID NO: 2070146 - RNA, 17 nt, Human
gccuugguguccaccug

SEQ ID NO: 2070147 - RNA, 18 nt, Human
gccuugguguccaccugg

SEQ ID NO: 2070148 - RNA, 19 nt, Human
gccuugguguccaccuggc

SEQ ID NO: 2070149 - RNA, 21 nt, Human
gccuugguguccaccuggccc

SEQ ID NO: 2070150 - RNA, 17 nt, Human
gccuuaauuuucaguau

SEQ ID NO: 2070151 - RNA, 18 nt, Human
gccuuccccuugcccagg

SEQ ID NO: 2070152 - RNA, 16 nt, Human
gccuuaaaacuuuaau

SEQ ID NO: 2070153 - RNA, 19 nt, Human
gccuuaaaagccaucaugu

SEQ ID NO: 2070154 - RNA, 11 nt, Human
gcgaaugguag

SEQ ID NO: 2070155 - RNA, 20 nt, Human
gcgaaugguagucuaaccaa

SEQ ID NO: 2070156 - RNA, 22 nt, Human
gcgaaugguagucuaaccaaau

SEQ ID NO: 2070157 - RNA, 21 nt, Human
gccuuuccauaaggaauguag

SEQ ID NO: 2070158 - RNA, 22 nt, Human
gccuuuccauaaggaauguagc

SEQ ID NO: 2070159 - RNA, 13 nt, Human
gccuuuccuguuc

SEQ ID NO: 2070160 - RNA, 15 nt, Human
gccuuuccuguucag

SEQ ID NO: 2070161 - RNA, 16 nt, Human
gccuuuccuguucagc

SEQ ID NO: 2070162 - RNA, 18 nt, Human
gccuuuccuguucagcau

SEQ ID NO: 2070163 - RNA, 19 nt, Human
gccuuuccuguucagcauu

SEQ ID NO: 2070164 - RNA, 20 nt, Human
gccuuuccuguucagcauuc

SEQ ID NO: 2070165 - RNA, 22 nt, Human
gccuuucucccaggccaggcuc

SEQ ID NO: 2070166 - RNA, 18 nt, Human
gccuuucucccaggccag

SEQ ID NO: 2070167 - RNA, 23 nt, Human
gccuuucucccaggccaggcucc

SEQ ID NO: 2070168 - RNA, 17 nt, Human
gccuuucuucucuccag

SEQ ID NO: 2070169 - RNA, 14 nt, Human
gcgaaggggcccug

SEQ ID NO: 2070170 - RNA, 15 nt, Human
gcgaaggggcccugg

SEQ ID NO: 2070171 - RNA, 16 nt, Human
gcgaaggggcccuggu

SEQ ID NO: 2070172 - RNA, 20 nt, Human
gcgaaguauauaaauuggcu

SEQ ID NO: 2070173 - RNA, 21 nt, Human
gccuggcagccgugccuucag

SEQ ID NO: 2070174 - RNA, 20 nt, Human
gccuggcagccgugccuuca

SEQ ID NO: 2070175 - RNA, 12 nt, Human
gccuggcagccg

SEQ ID NO: 2070176 - RNA, 13 nt, Human
gccuggcagaacu

SEQ ID NO: 2070177 - RNA, 18 nt, Human
gccuggcagaacugagcu

SEQ ID NO: 2070178 - RNA, 19 nt, Human
gccuggcagaacugagcuc

SEQ ID NO: 2070179 - RNA, 19 nt, Human
gccuggcacagggcagugg

SEQ ID NO: 2070180 - RNA, 18 nt, Human
gccuggcacagggcagug

SEQ ID NO: 2070181 - RNA, 22 nt, Human
gccuggccagaugcaccagccc

SEQ ID NO: 2070182 - RNA, 21 nt, Human
gccuggccagaugcaccagcc

SEQ ID NO: 2070183 - RNA, 16 nt, Human
gccuggccagaugcac

SEQ ID NO: 2070184 - RNA, 22 nt, Human
gccuggcagccgugccuucagc

SEQ ID NO: 2070185 - RNA, 20 nt, Human
gccuggccagaugcaccagc

SEQ ID NO: 2070186 - RNA, 22 nt, Human
gccuggcagaacugagcuccuc

SEQ ID NO: 2070187 - RNA, 15 nt, Human
gccuggcccccagcu

SEQ ID NO: 2070188 - RNA, 18 nt, Human
gccuggcccccagcugug

SEQ ID NO: 2070189 - RNA, 13 nt, Human
gccugggcagcau

SEQ ID NO: 2070190 - RNA, 19 nt, Human
gccugggcagcauagcaag

SEQ ID NO: 2070191 - RNA, 17 nt, Human
gccugggcagccaggcu

SEQ ID NO: 2070192 - RNA, 18 nt, Human
gccugggcagccaggcug

SEQ ID NO: 2070193 - RNA, 20 nt, Human
gccugggcagccaggcugcc

SEQ ID NO: 2070194 - RNA, 23 nt, Human
gccugggcagccaggcugccaag

SEQ ID NO: 2070195 - RNA, 19 nt, Human
gccugucucauccccaggg

SEQ ID NO: 2070196 - RNA, 22 nt, Human
gccugucucauccccagggguc

SEQ ID NO: 2070197 - RNA, 13 nt, Human
gccugucuccuuu

SEQ ID NO: 2070198 - RNA, 21 nt, Human
gccugucuccuuugcaggcuc

SEQ ID NO: 2070199 - RNA, 22 nt, Human
gccugucuccuuugcaggcuca

SEQ ID NO: 2070200 - RNA, 17 nt, Human
gccuguaaucccagcua

SEQ ID NO: 2070201 - RNA, 18 nt, Human
gccuguaaucccagcuac

SEQ ID NO: 2070202 - RNA, 19 nt, Human
gccuguaaucccagcuacu

SEQ ID NO: 2070203 - RNA, 17 nt, Human
gccugucucauccccag

SEQ ID NO: 2070204 - RNA, 18 nt, Human
gccugucucauccccagg

SEQ ID NO: 2070205 - RNA, 20 nt, Human
gccuguaauccuagcacuuu

SEQ ID NO: 2070206 - RNA, 16 nt, Human
gccuggucccugggag

SEQ ID NO: 2070207 - RNA, 15 nt, Human
gccuggucccuggga

SEQ ID NO: 2070208 - RNA, 15 nt, Human
gccuguaauccuagc

SEQ ID NO: 2070209 - RNA, 14 nt, Human
gccuggucccuggg

SEQ ID NO: 2070210 - RNA, 22 nt, Human
gccugguccaugauggagucag

SEQ ID NO: 2070211 - RNA, 20 nt, Human
gccugggcgacagagcgaga

SEQ ID NO: 2070212 - RNA, 23 nt, Human
gccugggcucccuugugcguggg

SEQ ID NO: 2070213 - RNA, 24 nt, Human
gccuggguggggcugcuccuccag

SEQ ID NO: 2070214 - RNA, 23 nt, Human
gccuggguggggcugcuccucca

SEQ ID NO: 2070215 - RNA, 17 nt, Human
gccuggaagagcagccc

SEQ ID NO: 2070216 - RNA, 15 nt, Human
gccuggaagagcagc

SEQ ID NO: 2070217 - RNA, 10 nt, Human
gccugcugca

SEQ ID NO: 2070218 - RNA, 11 nt, Human
gccugcugcau

SEQ ID NO: 2070219 - RNA, 18 nt, Human
gccugcugcauggggugg

SEQ ID NO: 2070220 - RNA, 23 nt, Human
gccugcugaaugauuuccaaaga

SEQ ID NO: 2070221 - RNA, 11 nt, Human
gccugcucccc

SEQ ID NO: 2070222 - RNA, 13 nt, Human
gccugcuccccca

SEQ ID NO: 2070223 - RNA, 15 nt, Human
gccugcucccccacc

SEQ ID NO: 2070224 - RNA, 16 nt, Human
gccugcucccccaccc

SEQ ID NO: 2070225 - RNA, 17 nt, Human
gccugcucccccacccc

SEQ ID NO: 2070226 - RNA, 19 nt, Human
gccugcucccccacccccu

SEQ ID NO: 2070227 - RNA, 13 nt, Human
gccugcauucugc

SEQ ID NO: 2070228 - RNA, 14 nt, Human
gccuggcacagggc

SEQ ID NO: 2070229 - RNA, 13 nt, Human
gccuggcacaggg

SEQ ID NO: 2070230 - RNA, 14 nt, Human
gccuggacaaaccc

SEQ ID NO: 2070231 - RNA, 16 nt, Human
gccuggacaaacccuu

SEQ ID NO: 2070232 - RNA, 18 nt, Human
gccugaagucacacagug

SEQ ID NO: 2070233 - RNA, 17 nt, Human
gccugaagucacacagu

SEQ ID NO: 2070234 - RNA, 16 nt, Human
gccugaagucacacag

SEQ ID NO: 2070235 - RNA, 22 nt, Human
gcccaguuggguggaugccugg

SEQ ID NO: 2070236 - RNA, 21 nt, Human
gcccaguuggguggaugccug

SEQ ID NO: 2070237 - RNA, 19 nt, Human
gcccaguuggguggaugcc

SEQ ID NO: 2070238 - RNA, 13 nt, Human
gccugaggcugag

SEQ ID NO: 2070239 - RNA, 14 nt, Human
gccugaggcugaga

SEQ ID NO: 2070240 - RNA, 13 nt, Human
gccugaggagcag

SEQ ID NO: 2070241 - RNA, 16 nt, Human
gccugaggagcagcag

SEQ ID NO: 2070242 - RNA, 14 nt, Human
gccugaggcuggga

SEQ ID NO: 2070243 - RNA, 15 nt, Human
gccugaggcugagac

SEQ ID NO: 2070244 - RNA, 17 nt, Human
gccugaggcugagacug

SEQ ID NO: 2070245 - RNA, 18 nt, Human
gccugaggcugagacugc

SEQ ID NO: 2070246 - RNA, 13 nt, Human
gccugaggcuggg

SEQ ID NO: 2070247 - RNA, 16 nt, Human
gcgguacaaaggaaaa

SEQ ID NO: 2070248 - RNA, 21 nt, Human
gcuaguugggcuuccucauag

SEQ ID NO: 2070249 - RNA, 20 nt, Human
gcuagaguccucacucccag

SEQ ID NO: 2070250 - RNA, 22 nt, Human
gcuagaugagaauucagcugcc

SEQ ID NO: 2070251 - RNA, 23 nt, Human
gcuagaugagaauucagcugccc

SEQ ID NO: 2070252 - RNA, 20 nt, Human
gcuauaacuauguugauaaa

SEQ ID NO: 2070253 - RNA, 19 nt, Human
gcuauccagcuauuuuuau

SEQ ID NO: 2070254 - RNA, 15 nt, Human
gcuauauuuaaguau

SEQ ID NO: 2070255 - RNA, 21 nt, Human
gcuauauuuaaguauucaaga

SEQ ID NO: 2070256 - RNA, 22 nt, Human
gcuauauuuaaguauucaagaa

SEQ ID NO: 2070257 - RNA, 20 nt, Human
gcuauccugccaaaaucauu

SEQ ID NO: 2070258 - RNA, 20 nt, Human
gcuaucaaaauaaauugaaa

SEQ ID NO: 2070259 - RNA, 22 nt, Human
gcuaucaaaauaaauugaaaua

SEQ ID NO: 2070260 - RNA, 23 nt, Human
gcuaucaaaauaaauugaaauau

SEQ ID NO: 2070261 - RNA, 14 nt, Human
gcuauauccaugua

SEQ ID NO: 2070262 - RNA, 15 nt, Human
gcuauauccauguac

SEQ ID NO: 2070263 - RNA, 17 nt, Human
gcuauauccauguacug

SEQ ID NO: 2070264 - RNA, 18 nt, Human
gcuauauccauguacugu

SEQ ID NO: 2070265 - RNA, 19 nt, Human
gcuauauccauguacugua

SEQ ID NO: 2070266 - RNA, 21 nt, Human
gcuauauccauguacuguagu

SEQ ID NO: 2070267 - RNA, 23 nt, Human
gcuauauccauguacuguaguuu

SEQ ID NO: 2070268 - RNA, 22 nt, Human
gcucaaguccucuuuucugaga

SEQ ID NO: 2070269 - RNA, 19 nt, Human
gcucaaguccucuuuucug

SEQ ID NO: 2070270 - RNA, 16 nt, Human
gcucaaucaagaaaau

SEQ ID NO: 2070271 - RNA, 19 nt, Human
gcucaauauuccugaauga

SEQ ID NO: 2070272 - RNA, 21 nt, Human
gcucaauauuccugaaugaaa

SEQ ID NO: 2070273 - RNA, 20 nt, Human
gcucaagucuucccugauca

SEQ ID NO: 2070274 - RNA, 12 nt, Human
gcucaaguucau

SEQ ID NO: 2070275 - RNA, 17 nt, Human
gcucaaggcgugaggau

SEQ ID NO: 2070276 - RNA, 17 nt, Human
gcucaagucuucccuga

SEQ ID NO: 2070277 - RNA, 14 nt, Human
gcucacaccuguaa

SEQ ID NO: 2070278 - RNA, 14 nt, Human
gcucacacaugaga

SEQ ID NO: 2070279 - RNA, 15 nt, Human
gcucacacaugagau

SEQ ID NO: 2070280 - RNA, 22 nt, Human
gcucaauauuccugaaugaaau

SEQ ID NO: 2070281 - RNA, 14 nt, Human
gcucaauccucuaa

SEQ ID NO: 2070282 - RNA, 16 nt, Human
gcucaauccucuaagc

SEQ ID NO: 2070283 - RNA, 18 nt, Human
gcucaaguccucuuuucu

SEQ ID NO: 2070284 - RNA, 22 nt, Human
gcucaagcagucuacccaccuc

SEQ ID NO: 2070285 - RNA, 17 nt, Human
gcucaugcauaguccca

SEQ ID NO: 2070286 - RNA, 18 nt, Human
gcucaugcauagucccag

SEQ ID NO: 2070287 - RNA, 22 nt, Human
gcucauauuccugcagccugga

SEQ ID NO: 2070288 - RNA, 20 nt, Human
gcucauauuccugcagccug

SEQ ID NO: 2070289 - RNA, 21 nt, Human
gcucagcuuuuugucuuuucu

SEQ ID NO: 2070290 - RNA, 12 nt, Human
gcucagcucugg

SEQ ID NO: 2070291 - RNA, 13 nt, Human
gcucagcucuggc

SEQ ID NO: 2070292 - RNA, 14 nt, Human
gcucagcucuggcu

SEQ ID NO: 2070293 - RNA, 15 nt, Human
gcucagcucuggcuc

SEQ ID NO: 2070294 - RNA, 16 nt, Human
gcucagcucuggcuca

SEQ ID NO: 2070295 - RNA, 18 nt, Human
gcucagcucuggcucaca

SEQ ID NO: 2070296 - RNA, 20 nt, Human
gcucagcucuggcucacaga

SEQ ID NO: 2070297 - RNA, 21 nt, Human
gcucagcucuggcucacagac

SEQ ID NO: 2070298 - RNA, 23 nt, Human
gcucagcggggacagcuccuucu

SEQ ID NO: 2070299 - RNA, 19 nt, Human
gcucagcggggacagcucc

SEQ ID NO: 2070300 - RNA, 18 nt, Human
gcucagcggggacagcuc

SEQ ID NO: 2070301 - RNA, 17 nt, Human
gcucagcggggacagcu

SEQ ID NO: 2070302 - RNA, 21 nt, Human
gcucagcccucccugccccuc

SEQ ID NO: 2070303 - RNA, 19 nt, Human
gcucagcccucccugcccc

SEQ ID NO: 2070304 - RNA, 18 nt, Human
gcucagcccucccugccc

SEQ ID NO: 2070305 - RNA, 17 nt, Human
gcucagcccucccugcc

SEQ ID NO: 2070306 - RNA, 16 nt, Human
gcucagcggggacagc

SEQ ID NO: 2070307 - RNA, 15 nt, Human
gcucaccagccccag

SEQ ID NO: 2070308 - RNA, 16 nt, Human
gcucacaguuccucgc

SEQ ID NO: 2070309 - RNA, 17 nt, Human
gcucacaguuccucgcc

SEQ ID NO: 2070310 - RNA, 19 nt, Human
gcucacaguuccucgcccu

SEQ ID NO: 2070311 - RNA, 21 nt, Human
gcucacaguuccucgcccugg

SEQ ID NO: 2070312 - RNA, 14 nt, Human
gcucaccagcccca

SEQ ID NO: 2070313 - RNA, 13 nt, Human
gcucaccagcccc

SEQ ID NO: 2070314 - RNA, 12 nt, Human
gcucaccagccc

SEQ ID NO: 2070315 - RNA, 16 nt, Human
gcucacauaucuguca

SEQ ID NO: 2070316 - RNA, 22 nt, Human
gcucacagaacccuuggagcca

SEQ ID NO: 2070317 - RNA, 12 nt, Human
gcucacagacug

SEQ ID NO: 2070318 - RNA, 17 nt, Human
gcucacagacuggagac

SEQ ID NO: 2070319 - RNA, 13 nt, Human
gcucacaguuccu

SEQ ID NO: 2070320 - RNA, 15 nt, Human
gcucacaguuccucg

SEQ ID NO: 2070321 - RNA, 12 nt, Human
gcucagcccucc

SEQ ID NO: 2070322 - RNA, 12 nt, Human
gcucagccccag

SEQ ID NO: 2070323 - RNA, 16 nt, Human
gcucagccccagccca

SEQ ID NO: 2070324 - RNA, 17 nt, Human
gcucagccccagcccag

SEQ ID NO: 2070325 - RNA, 18 nt, Human
gcucagccccagcccagc

SEQ ID NO: 2070326 - RNA, 16 nt, Human
gcucagcccucccugc

SEQ ID NO: 2070327 - RNA, 15 nt, Human
gcucagcccucccug

SEQ ID NO: 2070328 - RNA, 22 nt, Human
gcucacaguuccucgcccuggg

SEQ ID NO: 2070329 - RNA, 23 nt, Human
gcucacaguuccucgcccugggu

SEQ ID NO: 2070330 - RNA, 11 nt, Human
gcucagcccac

SEQ ID NO: 2070331 - RNA, 11 nt, Human
gcucaccuggg

SEQ ID NO: 2070332 - RNA, 18 nt, Human
gcucagcccaccccccuc

SEQ ID NO: 2070333 - RNA, 14 nt, Human
gcucagcccacccc

SEQ ID NO: 2070334 - RNA, 15 nt, Human
gcucagcccaccccc

SEQ ID NO: 2070335 - RNA, 16 nt, Human
gcucagcccacccccc

SEQ ID NO: 2070336 - RNA, 17 nt, Human
gcucagcccaccccccu

SEQ ID NO: 2070337 - RNA, 18 nt, Human
gcuccagucugcugcccu

SEQ ID NO: 2070338 - RNA, 20 nt, Human
gcuccagucugcugcccucc

SEQ ID NO: 2070339 - RNA, 21 nt, Human
gcuccagucugcugcccucca

SEQ ID NO: 2070340 - RNA, 14 nt, Human
gcuccaguccugcu

SEQ ID NO: 2070341 - RNA, 17 nt, Human
gcuccaguccugcucuc

SEQ ID NO: 2070342 - RNA, 18 nt, Human
gcuccaguccugcucucu

SEQ ID NO: 2070343 - RNA, 21 nt, Human
gcuccaguccugcucucuacc

SEQ ID NO: 2070344 - RNA, 23 nt, Human
gcuccaguccugcucucuaccca

SEQ ID NO: 2070345 - RNA, 17 nt, Human
gcuccagucugcugccc

SEQ ID NO: 2070346 - RNA, 13 nt, Human
gcuccagggccag

SEQ ID NO: 2070347 - RNA, 15 nt, Human
gcuccagggccagau

SEQ ID NO: 2070348 - RNA, 15 nt, Human
gcucccacaggcccu

SEQ ID NO: 2070349 - RNA, 13 nt, Human
gcucccacagaac

SEQ ID NO: 2070350 - RNA, 12 nt, Human
gcuccaguggaa

SEQ ID NO: 2070351 - RNA, 21 nt, Human
gcuccaguggaagaagaaaac

SEQ ID NO: 2070352 - RNA, 23 nt, Human
gcucccaacacaaggugggcagg

SEQ ID NO: 2070353 - RNA, 23 nt, Human
gcuccgcuuucuacccagcgagc

SEQ ID NO: 2070354 - RNA, 22 nt, Human
gcuccgcuuucuacccagcgag

SEQ ID NO: 2070355 - RNA, 21 nt, Human
gcuccgcuuucuacccagcga

SEQ ID NO: 2070356 - RNA, 18 nt, Human
gcuccgcuuucuacccag

SEQ ID NO: 2070357 - RNA, 15 nt, Human
gcucccuugugcgug

SEQ ID NO: 2070358 - RNA, 13 nt, Human
gcuccgccucugc

SEQ ID NO: 2070359 - RNA, 14 nt, Human
gcuccgccucugcu

SEQ ID NO: 2070360 - RNA, 17 nt, Human
gcuccgccucugcuggc

SEQ ID NO: 2070361 - RNA, 19 nt, Human
gcucccacagaacacagca

SEQ ID NO: 2070362 - RNA, 12 nt, Human
gcuccaggcucc

SEQ ID NO: 2070363 - RNA, 21 nt, Human
gcuccagcuguucagcugguu

SEQ ID NO: 2070364 - RNA, 21 nt, Human
gcucauuauaaugucauuaaa

SEQ ID NO: 2070365 - RNA, 16 nt, Human
gcucaugggccccucu

SEQ ID NO: 2070366 - RNA, 20 nt, Human
gcucaugggccccucugacu

SEQ ID NO: 2070367 - RNA, 21 nt, Human
gcucaugggccccucugacuc

SEQ ID NO: 2070368 - RNA, 22 nt, Human
gcucaugggccccucugacucc

SEQ ID NO: 2070369 - RNA, 15 nt, Human
gcucaugguccccau

SEQ ID NO: 2070370 - RNA, 18 nt, Human
gcucaugguccccauggc

SEQ ID NO: 2070371 - RNA, 15 nt, Human
gcucauguagcaauc

SEQ ID NO: 2070372 - RNA, 17 nt, Human
gcuccuuuagcgcccag

SEQ ID NO: 2070373 - RNA, 13 nt, Human
gcuccuucugucc

SEQ ID NO: 2070374 - RNA, 13 nt, Human
gcuccuuccuguc

SEQ ID NO: 2070375 - RNA, 19 nt, Human
gcuccuuccugucuuccug

SEQ ID NO: 2070376 - RNA, 13 nt, Human
gcuccugugucuu

SEQ ID NO: 2070377 - RNA, 12 nt, Human
gcuccugugucu

SEQ ID NO: 2070378 - RNA, 13 nt, Human
gcuccuuagcugc

SEQ ID NO: 2070379 - RNA, 15 nt, Human
gcuccuuagcugcca

SEQ ID NO: 2070380 - RNA, 16 nt, Human
gcuccuuagcugccaa

SEQ ID NO: 2070381 - RNA, 18 nt, Human
gcuccuuagcugccaagc

SEQ ID NO: 2070382 - RNA, 19 nt, Human
gcuccuuagcugccaagcc

SEQ ID NO: 2070383 - RNA, 22 nt, Human
gcuccgugagugaaccaucauu

SEQ ID NO: 2070384 - RNA, 13 nt, Human
gcuccgcugugug

SEQ ID NO: 2070385 - RNA, 14 nt, Human
gcuccgcugugugg

SEQ ID NO: 2070386 - RNA, 24 nt, Human
gcuccgcuuucuacccagcgagcc

SEQ ID NO: 2070387 - RNA, 18 nt, Human
gcuccucaacucaccuaa

SEQ ID NO: 2070388 - RNA, 19 nt, Human
gcuccucaugguggguuca

SEQ ID NO: 2070389 - RNA, 14 nt, Human
gcuccuccagggcc

SEQ ID NO: 2070390 - RNA, 14 nt, Human
gcuccucccggugc

SEQ ID NO: 2070391 - RNA, 23 nt, Human
gcuccuggggguucuuucuuccu

SEQ ID NO: 2070392 - RNA, 19 nt, Human
gcuccuggucuugagaugu

SEQ ID NO: 2070393 - RNA, 14 nt, Human
gcucccuuccuccc

SEQ ID NO: 2070394 - RNA, 22 nt, Human
gcuccugguauggguuucuccc

SEQ ID NO: 2070395 - RNA, 15 nt, Human
gcuccuccagggcca

SEQ ID NO: 2070396 - RNA, 18 nt, Human
gcuccuccagggccacgu

SEQ ID NO: 2070397 - RNA, 22 nt, Human
gcuccuccagggccacgugcca

SEQ ID NO: 2070398 - RNA, 23 nt, Human
gcuccuccagggccacgugccag

SEQ ID NO: 2070399 - RNA, 14 nt, Human
gcuccugucugcca

SEQ ID NO: 2070400 - RNA, 16 nt, Human
gcuccugucugccagc

SEQ ID NO: 2070401 - RNA, 17 nt, Human
gcuccugucugccagcc

SEQ ID NO: 2070402 - RNA, 18 nt, Human
gcuccugucugccagcca

SEQ ID NO: 2070403 - RNA, 19 nt, Human
gcuccugucugccagccag

SEQ ID NO: 2070404 - RNA, 20 nt, Human
gcuccugucugccagccagc

SEQ ID NO: 2070405 - RNA, 21 nt, Human
gcuccugucugccagccagca

SEQ ID NO: 2070406 - RNA, 14 nt, Human
ggaccauccuauuu

SEQ ID NO: 2070407 - RNA, 18 nt, Human
ggaccuugaacuggguac

SEQ ID NO: 2070408 - RNA, 16 nt, Human
ggacugaagccugcag

SEQ ID NO: 2070409 - RNA, 17 nt, Human
ggacugaagccugcagg

SEQ ID NO: 2070410 - RNA, 19 nt, Human
ggacugaagccugcaggag

SEQ ID NO: 2070411 - RNA, 19 nt, Human
ggacugaauuguccccagu

SEQ ID NO: 2070412 - RNA, 14 nt, Human
ggacugaagccugc

SEQ ID NO: 2070413 - RNA, 16 nt, Human
ggagaauaauucuuug

SEQ ID NO: 2070414 - RNA, 17 nt, Human
ggagaauaauucuuuga

SEQ ID NO: 2070415 - RNA, 22 nt, Human
ggagaagucuuagacuugaaau

SEQ ID NO: 2070416 - RNA, 21 nt, Human
ggagaagggauggaggucaca

SEQ ID NO: 2070417 - RNA, 14 nt, Human
ggagaagggaugga

SEQ ID NO: 2070418 - RNA, 18 nt, Human
ggagaagcaugaaaaagc

SEQ ID NO: 2070419 - RNA, 17 nt, Human
ggagaaggaaggagacu

SEQ ID NO: 2070420 - RNA, 22 nt, Human
ggagaaggaaggagacucaccu

SEQ ID NO: 2070421 - RNA, 19 nt, Human
ggagaagcagugagccgca

SEQ ID NO: 2070422 - RNA, 13 nt, Human
ggagaagcaugaa

SEQ ID NO: 2070423 - RNA, 15 nt, Human
ggagaagcagugagc

SEQ ID NO: 2070424 - RNA, 16 nt, Human
ggagaagcagugagcc

SEQ ID NO: 2070425 - RNA, 21 nt, Human
ggagaacuccuaggguggcug

SEQ ID NO: 2070426 - RNA, 22 nt, Human
ggagaagaauuuucagacccca

SEQ ID NO: 2070427 - RNA, 12 nt, Human
ggaccagaugcu

SEQ ID NO: 2070428 - RNA, 14 nt, Human
ggaccagaugcuga

SEQ ID NO: 2070429 - RNA, 16 nt, Human
ggaccaaaaaaauaag

SEQ ID NO: 2070430 - RNA, 22 nt, Human
ggacagccuguggcggugccug

SEQ ID NO: 2070431 - RNA, 23 nt, Human
ggacagccuguggcggugccugg

SEQ ID NO: 2070432 - RNA, 21 nt, Human
ggacagccuguggcggugccu

SEQ ID NO: 2070433 - RNA, 17 nt, Human
ggacagcuccuucuguc

SEQ ID NO: 2070434 - RNA, 16 nt, Human
ggacagcuccuucugu

SEQ ID NO: 2070435 - RNA, 15 nt, Human
ggacagcuccuucug

SEQ ID NO: 2070436 - RNA, 11 nt, Human
ggacagcuccu

SEQ ID NO: 2070437 - RNA, 14 nt, Human
ggacagcccacuga

SEQ ID NO: 2070438 - RNA, 22 nt, Human
ggacagccacggccaggccaga

SEQ ID NO: 2070439 - RNA, 12 nt, Human
gcuuuucacugc

SEQ ID NO: 2070440 - RNA, 18 nt, Human
ggacacuuaacagaugca

SEQ ID NO: 2070441 - RNA, 14 nt, Human
ggacagaagaaggc

SEQ ID NO: 2070442 - RNA, 20 nt, Human
ggacagagacaccugcaccu

SEQ ID NO: 2070443 - RNA, 21 nt, Human
ggacagagacaccugcaccuc

SEQ ID NO: 2070444 - RNA, 14 nt, Human
ggacagagacaccu

SEQ ID NO: 2070445 - RNA, 17 nt, Human
ggacagagacaccugca

SEQ ID NO: 2070446 - RNA, 18 nt, Human
ggacagagacaccugcac

SEQ ID NO: 2070447 - RNA, 19 nt, Human
ggacagagacaccugcacc

SEQ ID NO: 2070448 - RNA, 22 nt, Human
ggagcuaucaggaacagcuaug

SEQ ID NO: 2070449 - RNA, 15 nt, Human
ggagcuaucaggaac

SEQ ID NO: 2070450 - RNA, 19 nt, Human
ggagcggccgccugcgggc

SEQ ID NO: 2070451 - RNA, 16 nt, Human
ggagcggaaagcagcu

SEQ ID NO: 2070452 - RNA, 19 nt, Human
ggagcgcaccugcccccug

SEQ ID NO: 2070453 - RNA, 21 nt, Human
ggagcgcaccugcccccuggu

SEQ ID NO: 2070454 - RNA, 23 nt, Human
ggagcgcaccugcccccuggugg

SEQ ID NO: 2070455 - RNA, 14 nt, Human
ggagcggaaagcag

SEQ ID NO: 2070456 - RNA, 15 nt, Human
ggagcggaaagcagc

SEQ ID NO: 2070457 - RNA, 16 nt, Human
ggagcuaacacuggcc

SEQ ID NO: 2070458 - RNA, 17 nt, Human
ggagcuaacacuggccc

SEQ ID NO: 2070459 - RNA, 18 nt, Human
ggagcuaacacuggcccc

SEQ ID NO: 2070460 - RNA, 19 nt, Human
ggagcuaacacuggccccu

SEQ ID NO: 2070461 - RNA, 15 nt, Human
ggagcgcaccugccc

SEQ ID NO: 2070462 - RNA, 17 nt, Human
ggagcaccaggcacgaa

SEQ ID NO: 2070463 - RNA, 13 nt, Human
ggagacagugauc

SEQ ID NO: 2070464 - RNA, 22 nt, Human
ggagacauaaccacugcuucca

SEQ ID NO: 2070465 - RNA, 18 nt, Human
ggagacagugaucuccau

SEQ ID NO: 2070466 - RNA, 17 nt, Human
ggagaccaaggcgggag

SEQ ID NO: 2070467 - RNA, 20 nt, Human
ggagccuccacugccucugg

SEQ ID NO: 2070468 - RNA, 21 nt, Human
ggagccucauccgaggcaggg

SEQ ID NO: 2070469 - RNA, 19 nt, Human
ggagccucauccgaggcag

SEQ ID NO: 2070470 - RNA, 20 nt, Human
ggagccucauccgaggcagg

SEQ ID NO: 2070471 - RNA, 18 nt, Human
ggagcccugucuccucuc

SEQ ID NO: 2070472 - RNA, 18 nt, Human
ggagcacaaaagccucuc

SEQ ID NO: 2070473 - RNA, 23 nt, Human
ggagcccugucuccucucucugu

SEQ ID NO: 2070474 - RNA, 21 nt, Human
ggaggauguucugggacacag

SEQ ID NO: 2070475 - RNA, 18 nt, Human
ggaggauguucugggaca

SEQ ID NO: 2070476 - RNA, 16 nt, Human
ggaggcacacagcugc

SEQ ID NO: 2070477 - RNA, 12 nt, Human
ggaggaccuuau

SEQ ID NO: 2070478 - RNA, 17 nt, Human
ggaggauucuaugaggc

SEQ ID NO: 2070479 - RNA, 20 nt, Human
ggaggauugcuugagcccag

SEQ ID NO: 2070480 - RNA, 22 nt, Human
ggaggauugcuugagcccagga

SEQ ID NO: 2070481 - RNA, 14 nt, Human
ggaggaccucuggg

SEQ ID NO: 2070482 - RNA, 15 nt, Human
ggaggaccucugggc

SEQ ID NO: 2070483 - RNA, 21 nt, Human
ggaggcagaaagcagaggcug

SEQ ID NO: 2070484 - RNA, 17 nt, Human
ggaggcacacagcugca

SEQ ID NO: 2070485 - RNA, 13 nt, Human
ggaggcagggccu

SEQ ID NO: 2070486 - RNA, 18 nt, Human
ggaggcagggccuugccc

SEQ ID NO: 2070487 - RNA, 19 nt, Human
ggaggcagggccuugccca

SEQ ID NO: 2070488 - RNA, 21 nt, Human
ggaggcagggccuugcccaga

SEQ ID NO: 2070489 - RNA, 21 nt, Human
ggagggaugcugccugaguca

SEQ ID NO: 2070490 - RNA, 16 nt, Human
ggagggcccuaccuga

SEQ ID NO: 2070491 - RNA, 20 nt, Human
ggagggauagaggggggcug

SEQ ID NO: 2070492 - RNA, 17 nt, Human
ggagggcgugacucacc

SEQ ID NO: 2070493 - RNA, 13 nt, Human
ggaggggccuggc

SEQ ID NO: 2070494 - RNA, 11 nt, Human
ggaggggagcu

SEQ ID NO: 2070495 - RNA, 12 nt, Human
ggaggggagcuc

SEQ ID NO: 2070496 - RNA, 14 nt, Human
ggaggggagcucug

SEQ ID NO: 2070497 - RNA, 20 nt, Human
ggaggggcauggccagcagc

SEQ ID NO: 2070498 - RNA, 13 nt, Human
ggaguaucuggga

SEQ ID NO: 2070499 - RNA, 17 nt, Human
ggaguaccauguggcaa

SEQ ID NO: 2070500 - RNA, 20 nt, Human
ggaguagaccccuggcuggu

SEQ ID NO: 2070501 - RNA, 22 nt, Human
ggaguagagauggggaaagaau

SEQ ID NO: 2070502 - RNA, 14 nt, Human
ggaguaucugggaa

SEQ ID NO: 2070503 - RNA, 15 nt, Human
ggaguaucugggaac

SEQ ID NO: 2070504 - RNA, 22 nt, Human
ggagucccaccuuggcugcagg

SEQ ID NO: 2070505 - RNA, 14 nt, Human
ggagucagagagaa

SEQ ID NO: 2070506 - RNA, 21 nt, Human
ggaggggccuggcagccgugc

SEQ ID NO: 2070507 - RNA, 18 nt, Human
ggaggggccuggcagccg

SEQ ID NO: 2070508 - RNA, 14 nt, Human
ggaggggccuggca

SEQ ID NO: 2070509 - RNA, 17 nt, Human
ggaggggcggcaggagg

SEQ ID NO: 2070510 - RNA, 20 nt, Human
ggagguuuaggucaagaaga

SEQ ID NO: 2070511 - RNA, 12 nt, Human
ggaguacaaggc

SEQ ID NO: 2070512 - RNA, 22 nt, Human
ggcaugguggcgcaagccugua

SEQ ID NO: 2070513 - RNA, 21 nt, Human
ggcaugguggcgcaagccugu

SEQ ID NO: 2070514 - RNA, 13 nt, Human
ggcaugugaaggg

SEQ ID NO: 2070515 - RNA, 15 nt, Human
ggcaugcacagcugu

SEQ ID NO: 2070516 - RNA, 14 nt, Human
ggcaugagggauca

SEQ ID NO: 2070517 - RNA, 19 nt, Human
ggcaugagggaucacaggg

SEQ ID NO: 2070518 - RNA, 19 nt, Human
ggcaugguggcgcaagccu

SEQ ID NO: 2070519 - RNA, 19 nt, Human
ggcaugguacggagauguu

SEQ ID NO: 2070520 - RNA, 15 nt, Human
ggcaugccuggacaa

SEQ ID NO: 2070521 - RNA, 19 nt, Human
ggcaugggggccucagggc

SEQ ID NO: 2070522 - RNA, 23 nt, Human
ggcaugggggccucagggcagcc

SEQ ID NO: 2070523 - RNA, 11 nt, Human
ggcaguggagg

SEQ ID NO: 2070524 - RNA, 19 nt, Human
ggcagucaccugcccagau

SEQ ID NO: 2070525 - RNA, 23 nt, Human
ggcaguagcuguggugagguggg

SEQ ID NO: 2070526 - RNA, 21 nt, Human
ggcagcugcgguccacccagg

SEQ ID NO: 2070527 - RNA, 11 nt, Human
ggcagcugcca

SEQ ID NO: 2070528 - RNA, 14 nt, Human
ggcagcugccagag

SEQ ID NO: 2070529 - RNA, 15 nt, Human
ggcagcugccagaga

SEQ ID NO: 2070530 - RNA, 16 nt, Human
ggcagcugccagagaa

SEQ ID NO: 2070531 - RNA, 17 nt, Human
ggcagcugccagagaag

SEQ ID NO: 2070532 - RNA, 24 nt, Human
ggcagcugcgguccacccaggagc

SEQ ID NO: 2070533 - RNA, 23 nt, Human
ggcagcugcgguccacccaggag

SEQ ID NO: 2070534 - RNA, 12 nt, Human
ggcaggguccua

SEQ ID NO: 2070535 - RNA, 18 nt, Human
ggcagggucucacucugu

SEQ ID NO: 2070536 - RNA, 17 nt, Human
ggcagggucucacucug

SEQ ID NO: 2070537 - RNA, 17 nt, Human
ggcagguuggugggggc

SEQ ID NO: 2070538 - RNA, 15 nt, Human
ggcaguaaagagaaa

SEQ ID NO: 2070539 - RNA, 16 nt, Human
ggcaguaaagagaaac

SEQ ID NO: 2070540 - RNA, 19 nt, Human
ggcaguaaagagaaacuuu

SEQ ID NO: 2070541 - RNA, 15 nt, Human
ggcagggucaggaga

SEQ ID NO: 2070542 - RNA, 17 nt, Human
ggcagggucaggagagg

SEQ ID NO: 2070543 - RNA, 20 nt, Human
ggcauguucucugaggacac

SEQ ID NO: 2070544 - RNA, 21 nt, Human
ggcaugugccuauagucccag

SEQ ID NO: 2070545 - RNA, 12 nt, Human
ggccacagccag

SEQ ID NO: 2070546 - RNA, 13 nt, Human
ggccacagccaga

SEQ ID NO: 2070547 - RNA, 17 nt, Human
ggccacagccagaaccc

SEQ ID NO: 2070548 - RNA, 20 nt, Human
ggccacugugaagagaacca

SEQ ID NO: 2070549 - RNA, 13 nt, Human
ggccaccugcccc

SEQ ID NO: 2070550 - RNA, 10 nt, Human
ggccaccugc

SEQ ID NO: 2070551 - RNA, 11 nt, Human
ggccaccugca

SEQ ID NO: 2070552 - RNA, 12 nt, Human
ggccaccugcag

SEQ ID NO: 2070553 - RNA, 13 nt, Human
ggccaccugcagg

SEQ ID NO: 2070554 - RNA, 14 nt, Human
ggccaccugcaggu

SEQ ID NO: 2070555 - RNA, 15 nt, Human
ggccacuuuugacua

SEQ ID NO: 2070556 - RNA, 23 nt, Human
ggccaggacagagcugacaaaau

SEQ ID NO: 2070557 - RNA, 15 nt, Human
ggccaggacaggccc

SEQ ID NO: 2070558 - RNA, 16 nt, Human
ggccaggacaggcccg

SEQ ID NO: 2070559 - RNA, 21 nt, Human
ggcccaccuaccuucaaagcu

SEQ ID NO: 2070560 - RNA, 22 nt, Human
ggcccaccuaccuucaaagcug

SEQ ID NO: 2070561 - RNA, 20 nt, Human
ggcccacagcucccacccca

SEQ ID NO: 2070562 - RNA, 15 nt, Human
ggcccacagcuccca

SEQ ID NO: 2070563 - RNA, 17 nt, Human
ggcccacagcucccacc

SEQ ID NO: 2070564 - RNA, 18 nt, Human
ggcccacagcucccaccc

SEQ ID NO: 2070565 - RNA, 19 nt, Human
ggcccacagcucccacccc

SEQ ID NO: 2070566 - RNA, 13 nt, Human
ggcccacagcucc

SEQ ID NO: 2070567 - RNA, 14 nt, Human
ggcccacagcuccc

SEQ ID NO: 2070568 - RNA, 19 nt, Human
ggcaccauucaggaaccug

SEQ ID NO: 2070569 - RNA, 16 nt, Human
ggcagagccgggaagc

SEQ ID NO: 2070570 - RNA, 21 nt, Human
ggcagagguugcagugagccg

SEQ ID NO: 2070571 - RNA, 16 nt, Human
ggcagagugccccacc

SEQ ID NO: 2070572 - RNA, 21 nt, Human
ggcagagugccccaccugcca

SEQ ID NO: 2070573 - RNA, 22 nt, Human
ggcagagugccccaccugccac

SEQ ID NO: 2070574 - RNA, 20 nt, Human
ggcagagguugcagugagcu

SEQ ID NO: 2070575 - RNA, 18 nt, Human
ggcagagguucauuucaa

SEQ ID NO: 2070576 - RNA, 21 nt, Human
ggcagaggcuggaggcagggc

SEQ ID NO: 2070577 - RNA, 19 nt, Human
ggcagagggcagaggcugg

SEQ ID NO: 2070578 - RNA, 20 nt, Human
ggcagagggcagaggcugga

SEQ ID NO: 2070579 - RNA, 22 nt, Human
ggcagaggcuggaggcagggcc

SEQ ID NO: 2070580 - RNA, 23 nt, Human
ggcagaggcuggaggcagggccu

SEQ ID NO: 2070581 - RNA, 14 nt, Human
ggcagagggcagag

SEQ ID NO: 2070582 - RNA, 16 nt, Human
ggcagagggcagaggc

SEQ ID NO: 2070583 - RNA, 20 nt, Human
ggcacucagaagacacugau

SEQ ID NO: 2070584 - RNA, 19 nt, Human
ggcacucagaagacacuga

SEQ ID NO: 2070585 - RNA, 18 nt, Human
ggcacucagaagacacug

SEQ ID NO: 2070586 - RNA, 16 nt, Human
ggcacccacaaauaaa

SEQ ID NO: 2070587 - RNA, 20 nt, Human
ggcacccacaagugccacug

SEQ ID NO: 2070588 - RNA, 20 nt, Human
ggcacccggccccugcuggu

SEQ ID NO: 2070589 - RNA, 19 nt, Human
ggcacccggccccugcugg

SEQ ID NO: 2070590 - RNA, 18 nt, Human
ggcacccggccccugcug

SEQ ID NO: 2070591 - RNA, 20 nt, Human
ggcacccaccaucaugucug

SEQ ID NO: 2070592 - RNA, 18 nt, Human
ggcaccagccggggaaga

SEQ ID NO: 2070593 - RNA, 21 nt, Human
ggcaccaguguccuccccuca

SEQ ID NO: 2070594 - RNA, 17 nt, Human
ggcaccagcagccugga

SEQ ID NO: 2070595 - RNA, 22 nt, Human
ggcaagcuuggcuguagaagga

SEQ ID NO: 2070596 - RNA, 19 nt, Human
ggcaagcaccuccugccuc

SEQ ID NO: 2070597 - RNA, 18 nt, Human
ggcaagcaccuccugccu

SEQ ID NO: 2070598 - RNA, 18 nt, Human
ggcaagaaggaauugacu

SEQ ID NO: 2070599 - RNA, 13 nt, Human
ggauugacaguaa

SEQ ID NO: 2070600 - RNA, 16 nt, Human
ggauugacaguaacuu

SEQ ID NO: 2070601 - RNA, 19 nt, Human
ggauugaaggaugcugucu

SEQ ID NO: 2070602 - RNA, 17 nt, Human
ggcaagcaccuccugcc

SEQ ID NO: 2070603 - RNA, 17 nt, Human
ggcaagacuuuucuuug

SEQ ID NO: 2070604 - RNA, 18 nt, Human
ggauucuuuccauuauga

SEQ ID NO: 2070605 - RNA, 21 nt, Human
ggauucuuccucccucccucu

SEQ ID NO: 2070606 - RNA, 19 nt, Human
ggauucugggaggaagcag

SEQ ID NO: 2070607 - RNA, 23 nt, Human
ggagucccaccuuggcugcaggg

SEQ ID NO: 2070608 - RNA, 15 nt, Human
ggagucccgucagga

SEQ ID NO: 2070609 - RNA, 13 nt, Human
ggaugagcauuua

SEQ ID NO: 2070610 - RNA, 16 nt, Human
ggaugaggugcuggga

SEQ ID NO: 2070611 - RNA, 18 nt, Human
ggaugaggugcugggagg

SEQ ID NO: 2070612 - RNA, 17 nt, Human
ggaugccugguggcagc

SEQ ID NO: 2070613 - RNA, 13 nt, Human
ggaugccuggugg

SEQ ID NO: 2070614 - RNA, 18 nt, Human
ggaugccaucugugggca

SEQ ID NO: 2070615 - RNA, 19 nt, Human
ggaugccaucugugggcac

SEQ ID NO: 2070616 - RNA, 22 nt, Human
ggaugcccagggccacucugcc

SEQ ID NO: 2070617 - RNA, 17 nt, Human
ggaugaggugcugggag

SEQ ID NO: 2070618 - RNA, 15 nt, Human
ggaugaugccucaug

SEQ ID NO: 2070619 - RNA, 21 nt, Human
ggaugccugguggcagcugcg

SEQ ID NO: 2070620 - RNA, 20 nt, Human
ggaugccugguggcagcugc

SEQ ID NO: 2070621 - RNA, 19 nt, Human
ggaugccugguggcagcug

SEQ ID NO: 2070622 - RNA, 18 nt, Human
ggaugccugguggcagcu

SEQ ID NO: 2070623 - RNA, 23 nt, Human
ggaugcccagggccacucugccu

SEQ ID NO: 2070624 - RNA, 18 nt, Human
ggauucuccuuuuuaccc

SEQ ID NO: 2070625 - RNA, 13 nt, Human
ggauucugggagg

SEQ ID NO: 2070626 - RNA, 13 nt, Human
ggauucaggcugc

SEQ ID NO: 2070627 - RNA, 14 nt, Human
ggauucaggcugcu

SEQ ID NO: 2070628 - RNA, 15 nt, Human
ggauucaggcugcuu

SEQ ID NO: 2070629 - RNA, 12 nt, Human
ggcccagaggca

SEQ ID NO: 2070630 - RNA, 14 nt, Human
ggcccagaggcaca

SEQ ID NO: 2070631 - RNA, 16 nt, Human
ggcccagaggcacagc

SEQ ID NO: 2070632 - RNA, 17 nt, Human
ggcccagaggcacagcc

SEQ ID NO: 2070633 - RNA, 22 nt, Human
ggcccagaucuggucccuugca

SEQ ID NO: 2070634 - RNA, 13 nt, Human
ggccguggcugcc

SEQ ID NO: 2070635 - RNA, 16 nt, Human
ggccguggcugcccac

SEQ ID NO: 2070636 - RNA, 14 nt, Human
ggccuaaacuucag

SEQ ID NO: 2070637 - RNA, 19 nt, Human
ggcaugguauuugagacau

SEQ ID NO: 2070638 - RNA, 12 nt, Human
ggccgggcacag

SEQ ID NO: 2070639 - RNA, 14 nt, Human
ggccgggcacagcu

SEQ ID NO: 2070640 - RNA, 15 nt, Human
ggccgggcacagcug

SEQ ID NO: 2070641 - RNA, 22 nt, Human
ggccucaagugauucuccugcc

SEQ ID NO: 2070642 - RNA, 14 nt, Human
ggccucaagugauu

SEQ ID NO: 2070643 - RNA, 22 nt, Human
ggccucaacccucccucagccc

SEQ ID NO: 2070644 - RNA, 23 nt, Human
ggccucaacccucccucagcccc

SEQ ID NO: 2070645 - RNA, 15 nt, Human
ggccucaaggacuug

SEQ ID NO: 2070646 - RNA, 15 nt, Human
ggccuccucuaacag

SEQ ID NO: 2070647 - RNA, 21 nt, Human
ggccuccucuaacaggggcug

SEQ ID NO: 2070648 - RNA, 23 nt, Human
ggccuccucuaacaggggcuggu

SEQ ID NO: 2070649 - RNA, 18 nt, Human
ggccuccucuguccaggg

SEQ ID NO: 2070650 - RNA, 17 nt, Human
ggccuagauccacacac

SEQ ID NO: 2070651 - RNA, 23 nt, Human
ggccuagauccacacacagagga

SEQ ID NO: 2070652 - RNA, 14 nt, Human
ggccuccugugugu

SEQ ID NO: 2070653 - RNA, 19 nt, Human
ggccuccucuguccagggc

SEQ ID NO: 2070654 - RNA, 19 nt, Human
ggccuguacaaaagggaca

SEQ ID NO: 2070655 - RNA, 14 nt, Human
ggccugggucugug

SEQ ID NO: 2070656 - RNA, 21 nt, Human
ggccugggugcuggcugccca

SEQ ID NO: 2070657 - RNA, 21 nt, Human
ggccugguccaugauggaguc

SEQ ID NO: 2070658 - RNA, 19 nt, Human
ggccugggucugugucucu

SEQ ID NO: 2070659 - RNA, 16 nt, Human
ggccugaccucccccu

SEQ ID NO: 2070660 - RNA, 19 nt, Human
ggccugaccucccccuccu

SEQ ID NO: 2070661 - RNA, 20 nt, Human
ggccugaccucccccuccuu

SEQ ID NO: 2070662 - RNA, 23 nt, Human
ggccucugccccgucucaugagg

SEQ ID NO: 2070663 - RNA, 19 nt, Human
ggcucccaugaccauacug

SEQ ID NO: 2070664 - RNA, 14 nt, Human
ggcuccaggcuccu

SEQ ID NO: 2070665 - RNA, 12 nt, Human
ggcuccccucua

SEQ ID NO: 2070666 - RNA, 11 nt, Human
ggcuccccucu

SEQ ID NO: 2070667 - RNA, 12 nt, Human
ggcucuccaccu

SEQ ID NO: 2070668 - RNA, 13 nt, Human
ggcucuccaccuc

SEQ ID NO: 2070669 - RNA, 14 nt, Human
ggcucuccaccuca

SEQ ID NO: 2070670 - RNA, 15 nt, Human
ggcucuccaccucag

SEQ ID NO: 2070671 - RNA, 16 nt, Human
ggcucuccaccucagc

SEQ ID NO: 2070672 - RNA, 17 nt, Human
ggcucuccaccucagcc

SEQ ID NO: 2070673 - RNA, 18 nt, Human
ggcucuccaccucagccu

SEQ ID NO: 2070674 - RNA, 19 nt, Human
ggcucuccaccucagccuu

SEQ ID NO: 2070675 - RNA, 20 nt, Human
ggcucuccaccucagccuug

SEQ ID NO: 2070676 - RNA, 21 nt, Human
ggcucuccaccucagccuugg

SEQ ID NO: 2070677 - RNA, 22 nt, Human
ggcucuccaccucagccuugga

SEQ ID NO: 2070678 - RNA, 14 nt, Human
ggcucugaaagcca

SEQ ID NO: 2070679 - RNA, 13 nt, Human
ggcucugagaagg

SEQ ID NO: 2070680 - RNA, 18 nt, Human
ggcucugagaaggggagg

SEQ ID NO: 2070681 - RNA, 14 nt, Human
ggcucugccccagc

SEQ ID NO: 2070682 - RNA, 20 nt, Human
ggcucugccccagcucuggc

SEQ ID NO: 2070683 - RNA, 21 nt, Human
ggcucugccccagcucuggcu

SEQ ID NO: 2070684 - RNA, 12 nt, Human
ggcucugcacag

SEQ ID NO: 2070685 - RNA, 12 nt, Human
ggcucugcccca

SEQ ID NO: 2070686 - RNA, 20 nt, Human
ggcucacgccuaugauccca

SEQ ID NO: 2070687 - RNA, 21 nt, Human
ggcucacgccuaugaucccag

SEQ ID NO: 2070688 - RNA, 23 nt, Human
ggcucacgccuaugaucccagca

SEQ ID NO: 2070689 - RNA, 14 nt, Human
ggcucacagacugg

SEQ ID NO: 2070690 - RNA, 13 nt, Human
ggcuccaggcucc

SEQ ID NO: 2070691 - RNA, 12 nt, Human
ggcuccaggcuc

SEQ ID NO: 2070692 - RNA, 22 nt, Human
ggcucacgccuguaaucccagc

SEQ ID NO: 2070693 - RNA, 24 nt, Human
ggcucacgccuguaaucccagcag

SEQ ID NO: 2070694 - RNA, 13 nt, Human
ggcucacgugugu

SEQ ID NO: 2070695 - RNA, 16 nt, Human
ggcgggagcaucucuu

SEQ ID NO: 2070696 - RNA, 15 nt, Human
ggcgcgguggcucac

SEQ ID NO: 2070697 - RNA, 19 nt, Human
ggcgcgguggcucacgccu

SEQ ID NO: 2070698 - RNA, 14 nt, Human
ggcgcccccagugu

SEQ ID NO: 2070699 - RNA, 15 nt, Human
ggcgcccccagugug

SEQ ID NO: 2070700 - RNA, 22 nt, Human
ggcgggcaccuauagucccagc

SEQ ID NO: 2070701 - RNA, 17 nt, Human
ggcgggccaaggacugc

SEQ ID NO: 2070702 - RNA, 20 nt, Human
ggcgggcgaaucacgagguc

SEQ ID NO: 2070703 - RNA, 13 nt, Human
ggcuagucagaga

SEQ ID NO: 2070704 - RNA, 18 nt, Human
ggcuagucagagagagug

SEQ ID NO: 2070705 - RNA, 14 nt, Human
ggcuagucagagag

SEQ ID NO: 2070706 - RNA, 15 nt, Human
ggcuagucagagaga

SEQ ID NO: 2070707 - RNA, 16 nt, Human
gggagcccccgccccg

SEQ ID NO: 2070708 - RNA, 22 nt, Human
gggagcccccgccccgccccac

SEQ ID NO: 2070709 - RNA, 12 nt, Human
gggagcccccgc

SEQ ID NO: 2070710 - RNA, 12 nt, Human
gggagcucugca

SEQ ID NO: 2070711 - RNA, 16 nt, Human
gggagcguagaaucug

SEQ ID NO: 2070712 - RNA, 16 nt, Human
gggaggaaaagaaaag

SEQ ID NO: 2070713 - RNA, 24 nt, Human
gggaggaaauuugaauggguccau

SEQ ID NO: 2070714 - RNA, 23 nt, Human
gggaggaagcagguugaggggcu

SEQ ID NO: 2070715 - RNA, 19 nt, Human
gggaggaaucgaggaacca

SEQ ID NO: 2070716 - RNA, 15 nt, Human
gggaggaccucuggg

SEQ ID NO: 2070717 - RNA, 22 nt, Human
gggagcugccuguucagcucca

SEQ ID NO: 2070718 - RNA, 21 nt, Human
gggagcugccuguucagcucc

SEQ ID NO: 2070719 - RNA, 13 nt, Human
gggagcugccugu

SEQ ID NO: 2070720 - RNA, 14 nt, Human
gggagcucugucug

SEQ ID NO: 2070721 - RNA, 22 nt, Human
gggaggauguucugggacacag

SEQ ID NO: 2070722 - RNA, 21 nt, Human
gggaggauugcuugagcucag

SEQ ID NO: 2070723 - RNA, 23 nt, Human
gggaggaucucuugagccuggga

SEQ ID NO: 2070724 - RNA, 20 nt, Human
gggaggagguggcagcccug

SEQ ID NO: 2070725 - RNA, 17 nt, Human
gggaggaucacuggagc

SEQ ID NO: 2070726 - RNA, 17 nt, Human
gggagugacagaggcag

SEQ ID NO: 2070727 - RNA, 21 nt, Human
gggagucaucucaaccauccc

SEQ ID NO: 2070728 - RNA, 15 nt, Human
gggagucccgucagg

SEQ ID NO: 2070729 - RNA, 17 nt, Human
gggagucugaagcagau

SEQ ID NO: 2070730 - RNA, 23 nt, Human
gggagucugaagcagaugcaaag

SEQ ID NO: 2070731 - RNA, 23 nt, Human
gggaggauugcuugagcucagga

SEQ ID NO: 2070732 - RNA, 19 nt, Human
gggaggaucacuggagccc

SEQ ID NO: 2070733 - RNA, 22 nt, Human
gggaggaucacuggagcccagg

SEQ ID NO: 2070734 - RNA, 23 nt, Human
gggaggaucacuggagcccagga

SEQ ID NO: 2070735 - RNA, 21 nt, Human
gggaagugacaaggccccaga

SEQ ID NO: 2070736 - RNA, 14 nt, Human
gggaauauuuuauu

SEQ ID NO: 2070737 - RNA, 15 nt, Human
ggcuuugucccacag

SEQ ID NO: 2070738 - RNA, 16 nt, Human
ggcuuugucccacagc

SEQ ID NO: 2070739 - RNA, 18 nt, Human
ggcuuugucccacagcuu

SEQ ID NO: 2070740 - RNA, 18 nt, Human
ggcuuugauuccaucucc

SEQ ID NO: 2070741 - RNA, 24 nt, Human
ggcuuugauuccaucuccuugucu

SEQ ID NO: 2070742 - RNA, 19 nt, Human
ggcuuugcccaaccucagc

SEQ ID NO: 2070743 - RNA, 20 nt, Human
ggcuuugcccaaccucagca

SEQ ID NO: 2070744 - RNA, 21 nt, Human
gggaauguuugccucugccuc

SEQ ID NO: 2070745 - RNA, 19 nt, Human
gggaauguuugccucugcc

SEQ ID NO: 2070746 - RNA, 12 nt, Human
gggaauucucuu

SEQ ID NO: 2070747 - RNA, 14 nt, Human
gggaauucucuugg

SEQ ID NO: 2070748 - RNA, 23 nt, Human
gggacucaaugcacugacauugu

SEQ ID NO: 2070749 - RNA, 23 nt, Human
gggacugccagucccccugcccc

SEQ ID NO: 2070750 - RNA, 12 nt, Human
gggagccccagg

SEQ ID NO: 2070751 - RNA, 13 nt, Human
gggagccccaggg

SEQ ID NO: 2070752 - RNA, 21 nt, Human
gggagccccagggucuucccu

SEQ ID NO: 2070753 - RNA, 14 nt, Human
gggagccccagggu

SEQ ID NO: 2070754 - RNA, 16 nt, Human
gggagccccagggucu

SEQ ID NO: 2070755 - RNA, 19 nt, Human
gggacucaaugcacugaca

SEQ ID NO: 2070756 - RNA, 17 nt, Human
gggacucaaugcacuga

SEQ ID NO: 2070757 - RNA, 23 nt, Human
gggacguccugccaccuggggca

SEQ ID NO: 2070758 - RNA, 21 nt, Human
ggcugugggccucaaggacuu

SEQ ID NO: 2070759 - RNA, 14 nt, Human
ggcugugggcuccc

SEQ ID NO: 2070760 - RNA, 15 nt, Human
ggcugugggcucccu

SEQ ID NO: 2070761 - RNA, 16 nt, Human
ggcugugggcucccuu

SEQ ID NO: 2070762 - RNA, 18 nt, Human
ggcugugggcucccuucc

SEQ ID NO: 2070763 - RNA, 22 nt, Human
ggcugugggcucccuuccuccc

SEQ ID NO: 2070764 - RNA, 11 nt, Human
ggcugugagug

SEQ ID NO: 2070765 - RNA, 19 nt, Human
ggcugugcgcugacaacca

SEQ ID NO: 2070766 - RNA, 18 nt, Human
ggcugucuucucaggcuc

SEQ ID NO: 2070767 - RNA, 19 nt, Human
ggcugucuucucaggcucu

SEQ ID NO: 2070768 - RNA, 22 nt, Human
ggcugucuucucaggcucugcc

SEQ ID NO: 2070769 - RNA, 23 nt, Human
ggcugucuucucaggcucugccc

SEQ ID NO: 2070770 - RNA, 16 nt, Human
ggcugugccucugccu

SEQ ID NO: 2070771 - RNA, 13 nt, Human
ggcugugccucug

SEQ ID NO: 2070772 - RNA, 13 nt, Human
ggcuguccuuucc

SEQ ID NO: 2070773 - RNA, 19 nt, Human
ggcuguccuuuccaguggc

SEQ ID NO: 2070774 - RNA, 22 nt, Human
ggcuguccuuuccaguggccug

SEQ ID NO: 2070775 - RNA, 18 nt, Human
ggcugggggcaggagggc

SEQ ID NO: 2070776 - RNA, 16 nt, Human
ggcugggggcaggagg

SEQ ID NO: 2070777 - RNA, 17 nt, Human
ggcugggggcaggaggg

SEQ ID NO: 2070778 - RNA, 15 nt, Human
ggcuuaaaacaacac

SEQ ID NO: 2070779 - RNA, 20 nt, Human
ggcuguuggcugggggccuc

SEQ ID NO: 2070780 - RNA, 16 nt, Human
ggcuguuggcuggggg

SEQ ID NO: 2070781 - RNA, 15 nt, Human
ggcuguuggcugggg

SEQ ID NO: 2070782 - RNA, 14 nt, Human
ggcuguuggcuggg

SEQ ID NO: 2070783 - RNA, 22 nt, Human
ggcugugggccucaaggacuug

SEQ ID NO: 2070784 - RNA, 11 nt, Human
ggcuugcugcc

SEQ ID NO: 2070785 - RNA, 14 nt, Human
ggcuugccugcagg

SEQ ID NO: 2070786 - RNA, 15 nt, Human
ggcuugccugcaggc

SEQ ID NO: 2070787 - RNA, 23 nt, Human
ggcuugggcuuccauuugugugu

SEQ ID NO: 2070788 - RNA, 13 nt, Human
ggcuuucuggaga

SEQ ID NO: 2070789 - RNA, 14 nt, Human
ggcuuucuggagag

SEQ ID NO: 2070790 - RNA, 16 nt, Human
ggcuguuuuugggugc

SEQ ID NO: 2070791 - RNA, 22 nt, Human
ggcuguuuuugggugcaagagg

SEQ ID NO: 2070792 - RNA, 20 nt, Human
ggcuucacggaagagccuug

SEQ ID NO: 2070793 - RNA, 21 nt, Human
ggcuucacggaagagccuugc

SEQ ID NO: 2070794 - RNA, 12 nt, Human
ggcuucacagau

SEQ ID NO: 2070795 - RNA, 17 nt, Human
ggcuucagcauauuuau

SEQ ID NO: 2070796 - RNA, 13 nt, Human
ggcuugccugcag

SEQ ID NO: 2070797 - RNA, 16 nt, Human
ggcuugccacagcucu

SEQ ID NO: 2070798 - RNA, 15 nt, Human
ggcuggacuccagau

SEQ ID NO: 2070799 - RNA, 19 nt, Human
ggcuggacuccagaucugc

SEQ ID NO: 2070800 - RNA, 20 nt, Human
ggcuggacuccagaucugca

SEQ ID NO: 2070801 - RNA, 23 nt, Human
ggcuggacuccagaucugcaccg

SEQ ID NO: 2070802 - RNA, 13 nt, Human
ggcuggagcuggc

SEQ ID NO: 2070803 - RNA, 14 nt, Human
ggcuggacuggcug

SEQ ID NO: 2070804 - RNA, 23 nt, Human
ggcuggagcccagggagcggaaa

SEQ ID NO: 2070805 - RNA, 13 nt, Human
ggcuggaggcagg

SEQ ID NO: 2070806 - RNA, 15 nt, Human
ggcuggaggcagggc

SEQ ID NO: 2070807 - RNA, 23 nt, Human
ggcuggaggcagggccuugccca

SEQ ID NO: 2070808 - RNA, 17 nt, Human
ggcuggaggcagggccu

SEQ ID NO: 2070809 - RNA, 19 nt, Human
ggcuggaggcagggccuug

SEQ ID NO: 2070810 - RNA, 23 nt, Human
ggcucugggauagcugacccagc

SEQ ID NO: 2070811 - RNA, 23 nt, Human
ggcucugccccagcucuggcuuc

SEQ ID NO: 2070812 - RNA, 21 nt, Human
ggcucugcccucccuccuucc

SEQ ID NO: 2070813 - RNA, 13 nt, Human
ggcucugcccugc

SEQ ID NO: 2070814 - RNA, 17 nt, Human
ggcugaggaaaggccag

SEQ ID NO: 2070815 - RNA, 22 nt, Human
ggcugaggaaaggccagcuggc

SEQ ID NO: 2070816 - RNA, 17 nt, Human
ggcucuggcucucccca

SEQ ID NO: 2070817 - RNA, 21 nt, Human
ggcugaggauuucaagccugc

SEQ ID NO: 2070818 - RNA, 13 nt, Human
ggcugaggcagaa

SEQ ID NO: 2070819 - RNA, 14 nt, Human
ggcugaggcagaag

SEQ ID NO: 2070820 - RNA, 18 nt, Human
ggcugaggcaggagaauc

SEQ ID NO: 2070821 - RNA, 14 nt, Human
ggcugaggcaggag

SEQ ID NO: 2070822 - RNA, 17 nt, Human
ggcugaggcagaagaau

SEQ ID NO: 2070823 - RNA, 14 nt, Human
ggcugggggcagga

SEQ ID NO: 2070824 - RNA, 14 nt, Human
ggcugggggccuca

SEQ ID NO: 2070825 - RNA, 16 nt, Human
ggcuggggcaggaggg

SEQ ID NO: 2070826 - RNA, 16 nt, Human
ggcugggggaagaagc

SEQ ID NO: 2070827 - RNA, 18 nt, Human
ggcugggcuucaguggca

SEQ ID NO: 2070828 - RNA, 22 nt, Human
ggcugggcuucaguggcagcug

SEQ ID NO: 2070829 - RNA, 21 nt, Human
ggcugggcuucaguggcagcu

SEQ ID NO: 2070830 - RNA, 11 nt, Human
ggcugggcuuc

SEQ ID NO: 2070831 - RNA, 15 nt, Human
ggcugggagcucugc

SEQ ID NO: 2070832 - RNA, 19 nt, Human
ggcuggaguggaguggcgu

SEQ ID NO: 2070833 - RNA, 21 nt, Human
ucagggagugggcuaagcacg

SEQ ID NO: 2070834 - RNA, 22 nt, Human
ucagggcacugcugcugccuuu

SEQ ID NO: 2070835 - RNA, 20 nt, Human
ucagggauuuuuuuuuuaaa

SEQ ID NO: 2070836 - RNA, 23 nt, Human
ucagggauagcacugagcaaagc

SEQ ID NO: 2070837 - RNA, 15 nt, Human
ucagggcagccugcc

SEQ ID NO: 2070838 - RNA, 18 nt, Human
ucagggcagccugccugg

SEQ ID NO: 2070839 - RNA, 16 nt, Human
ucagggcagggcucug

SEQ ID NO: 2070840 - RNA, 15 nt, Human
ucaggugagaagcag

SEQ ID NO: 2070841 - RNA, 16 nt, Human
ucaggugagaagcaga

SEQ ID NO: 2070842 - RNA, 14 nt, Human
ucagggccccagca

SEQ ID NO: 2070843 - RNA, 16 nt, Human
ucagggccccagcacu

SEQ ID NO: 2070844 - RNA, 23 nt, Human
ucagggccccagcacuaaagcag

SEQ ID NO: 2070845 - RNA, 13 nt, Human
ucaggcucugccc

SEQ ID NO: 2070846 - RNA, 14 nt, Human
ucaggcucugcccu

SEQ ID NO: 2070847 - RNA, 19 nt, Human
ucaggcucugcccugcccu

SEQ ID NO: 2070848 - RNA, 15 nt, Human
ucaggcugcuuggga

SEQ ID NO: 2070849 - RNA, 14 nt, Human
ucaggcuuccuugg

SEQ ID NO: 2070850 - RNA, 15 nt, Human
ucaggcuuccuuggc

SEQ ID NO: 2070851 - RNA, 23 nt, Human
ucaggcuuccuuggcaucacagg

SEQ ID NO: 2070852 - RNA, 12 nt, Human
ucagcugccccc

SEQ ID NO: 2070853 - RNA, 22 nt, Human
ucaggaugcccagggccacucu

SEQ ID NO: 2070854 - RNA, 23 nt, Human
ucaggauucuccuuuuuaccccu

SEQ ID NO: 2070855 - RNA, 13 nt, Human
ucaggaugcccag

SEQ ID NO: 2070856 - RNA, 14 nt, Human
ucaggaugcccagg

SEQ ID NO: 2070857 - RNA, 15 nt, Human
ucaggaugcccaggg

SEQ ID NO: 2070858 - RNA, 16 nt, Human
ucaggaugcccagggc

SEQ ID NO: 2070859 - RNA, 20 nt, Human
ucagccuccugaguagcugg

SEQ ID NO: 2070860 - RNA, 20 nt, Human
ucagccuccggaguagcugg

SEQ ID NO: 2070861 - RNA, 22 nt, Human
ucagccucccgaguagcuggga

SEQ ID NO: 2070862 - RNA, 21 nt, Human
ucagccucccgaguagcuggg

SEQ ID NO: 2070863 - RNA, 13 nt, Human
ucagccuccugag

SEQ ID NO: 2070864 - RNA, 21 nt, Human
ucagccuccugaguagcugga

SEQ ID NO: 2070865 - RNA, 13 nt, Human
ucagccuccugug

SEQ ID NO: 2070866 - RNA, 14 nt, Human
ucagccuccugugu

SEQ ID NO: 2070867 - RNA, 16 nt, Human
ucagccuccuguguag

SEQ ID NO: 2070868 - RNA, 18 nt, Human
ucagccugcuccagcugu

SEQ ID NO: 2070869 - RNA, 19 nt, Human
ucagccugcuccagcuguu

SEQ ID NO: 2070870 - RNA, 15 nt, Human
ucagcugaaccuggg

SEQ ID NO: 2070871 - RNA, 16 nt, Human
ucagcugaaccugggu

SEQ ID NO: 2070872 - RNA, 20 nt, Human
ucagccuccuguguagcugg

SEQ ID NO: 2070873 - RNA, 18 nt, Human
ucagauauaaaagacuga

SEQ ID NO: 2070874 - RNA, 20 nt, Human
ucagauauaaaagacugacc

SEQ ID NO: 2070875 - RNA, 18 nt, Human
ucagauauauuuuucaca

SEQ ID NO: 2070876 - RNA, 23 nt, Human
ucagauauauuuuucacaguuuu

SEQ ID NO: 2070877 - RNA, 15 nt, Human
ucagacugcuuuaaa

SEQ ID NO: 2070878 - RNA, 16 nt, Human
ucagauauauuuuuca

SEQ ID NO: 2070879 - RNA, 14 nt, Human
ucagauauaaaaga

SEQ ID NO: 2070880 - RNA, 17 nt, Human
ucagauauaaaagacug

SEQ ID NO: 2070881 - RNA, 18 nt, Human
ucagagguagggcugcca

SEQ ID NO: 2070882 - RNA, 17 nt, Human
ucagagguggcucugga

SEQ ID NO: 2070883 - RNA, 18 nt, Human
ucagaguaagcugcuuuu

SEQ ID NO: 2070884 - RNA, 19 nt, Human
ucagaguaagcugcuuuug

SEQ ID NO: 2070885 - RNA, 20 nt, Human
ucagcauucucacuccuacc

SEQ ID NO: 2070886 - RNA, 17 nt, Human
ucagcauucucacuccu

SEQ ID NO: 2070887 - RNA, 13 nt, Human
ucagaguccaggc

SEQ ID NO: 2070888 - RNA, 21 nt, Human
ucagccucccaaagugcuggg

SEQ ID NO: 2070889 - RNA, 19 nt, Human
ucagccucccaaagugcug

SEQ ID NO: 2070890 - RNA, 23 nt, Human
ucagcauucucacuccuaccugg

SEQ ID NO: 2070891 - RNA, 14 nt, Human
ucagccucccaaag

SEQ ID NO: 2070892 - RNA, 22 nt, Human
ucagccucccgaauagcuggga

SEQ ID NO: 2070893 - RNA, 21 nt, Human
ucagccucccgaauagcuggg

SEQ ID NO: 2070894 - RNA, 18 nt, Human
ucagccucccgaguagcu

SEQ ID NO: 2070895 - RNA, 20 nt, Human
ucagccucccgaguagcugg

SEQ ID NO: 2070896 - RNA, 18 nt, Human
ucacugccaugccagcuu

SEQ ID NO: 2070897 - RNA, 11 nt, Human
ucacugccucu

SEQ ID NO: 2070898 - RNA, 12 nt, Human
ucacugccucuc

SEQ ID NO: 2070899 - RNA, 19 nt, Human
ucacugccucucccuggcc

SEQ ID NO: 2070900 - RNA, 21 nt, Human
ucacugccucucccuggcccu

SEQ ID NO: 2070901 - RNA, 20 nt, Human
ucacucuuauugcccacgcu

SEQ ID NO: 2070902 - RNA, 16 nt, Human
ucaccagccccagugc

SEQ ID NO: 2070903 - RNA, 13 nt, Human
ucaccagccccag

SEQ ID NO: 2070904 - RNA, 12 nt, Human
ucaccccuccac

SEQ ID NO: 2070905 - RNA, 17 nt, Human
ucaccccuccacccuug

SEQ ID NO: 2070906 - RNA, 14 nt, Human
ucaccccgucuggg

SEQ ID NO: 2070907 - RNA, 17 nt, Human
ucacucuuauugcccac

SEQ ID NO: 2070908 - RNA, 13 nt, Human
ucaccccugcccu

SEQ ID NO: 2070909 - RNA, 14 nt, Human
ucaccccugcccug

SEQ ID NO: 2070910 - RNA, 16 nt, Human
ucaccccugcccuggg

SEQ ID NO: 2070911 - RNA, 17 nt, Human
ucaccccugcccuggga

SEQ ID NO: 2070912 - RNA, 12 nt, Human
ucacugcuggcu

SEQ ID NO: 2070913 - RNA, 14 nt, Human
ucacugcucacacu

SEQ ID NO: 2070914 - RNA, 16 nt, Human
ucacugcuggcugccu

SEQ ID NO: 2070915 - RNA, 15 nt, Human
ucacugcuggcugcc

SEQ ID NO: 2070916 - RNA, 14 nt, Human
ucacugcuggcugc

SEQ ID NO: 2070917 - RNA, 13 nt, Human
ucacugcuggcug

SEQ ID NO: 2070918 - RNA, 22 nt, Human
ucacugcuggcugccuuagaac

SEQ ID NO: 2070919 - RNA, 18 nt, Human
ucacugcuggcugccuua

SEQ ID NO: 2070920 - RNA, 17 nt, Human
ucacugcuggcugccuu

SEQ ID NO: 2070921 - RNA, 17 nt, Human
ucacuggagcaccaggc

SEQ ID NO: 2070922 - RNA, 17 nt, Human
ucacuggagcccaggag

SEQ ID NO: 2070923 - RNA, 14 nt, Human
ucacuggagcccag

SEQ ID NO: 2070924 - RNA, 15 nt, Human
ucacuggagcccagg

SEQ ID NO: 2070925 - RNA, 18 nt, Human
ucacuggagcaccaggca

SEQ ID NO: 2070926 - RNA, 22 nt, Human
ucacuggagcaccaggcacgaa

SEQ ID NO: 2070927 - RNA, 11 nt, Human
ucacuggagcc

SEQ ID NO: 2070928 - RNA, 12 nt, Human
ucacuggagccc

SEQ ID NO: 2070929 - RNA, 13 nt, Human
ucacuggagccca

SEQ ID NO: 2070930 - RNA, 18 nt, Human
ucacuggguggggugagg

SEQ ID NO: 2070931 - RNA, 16 nt, Human
ucacugggguccuggg

SEQ ID NO: 2070932 - RNA, 17 nt, Human
ucacugggguccugggg

SEQ ID NO: 2070933 - RNA, 19 nt, Human
ucacugggguccuggggcc

SEQ ID NO: 2070934 - RNA, 20 nt, Human
ucacugggguccuggggccu

SEQ ID NO: 2070935 - RNA, 21 nt, Human
ucacugggguccuggggccuc

SEQ ID NO: 2070936 - RNA, 11 nt, Human
ucacugggugg

SEQ ID NO: 2070937 - RNA, 20 nt, Human
ucacuggguggggugaggac

SEQ ID NO: 2070938 - RNA, 22 nt, Human
ucagaaaccaguuaugugaaug

SEQ ID NO: 2070939 - RNA, 13 nt, Human
ucagaaaccaguu

SEQ ID NO: 2070940 - RNA, 18 nt, Human
ucagaaacaucaguuacu

SEQ ID NO: 2070941 - RNA, 22 nt, Human
ucagaaacaucaguuacucuga

SEQ ID NO: 2070942 - RNA, 15 nt, Human
ucagaaacuugugaa

SEQ ID NO: 2070943 - RNA, 16 nt, Human
ucagaaacuugugaag

SEQ ID NO: 2070944 - RNA, 17 nt, Human
ucagaaacuugugaagu

SEQ ID NO: 2070945 - RNA, 18 nt, Human
ucagaaacuugugaagug

SEQ ID NO: 2070946 - RNA, 17 nt, Human
ucacuuucacauagaug

SEQ ID NO: 2070947 - RNA, 18 nt, Human
ucacuuucacauagaugu

SEQ ID NO: 2070948 - RNA, 19 nt, Human
ucacuuucacauagauguc

SEQ ID NO: 2070949 - RNA, 21 nt, Human
ucagaauugaucauuuucccc

SEQ ID NO: 2070950 - RNA, 13 nt, Human
ucagacacaaaca

SEQ ID NO: 2070951 - RNA, 19 nt, Human
ucagacacaaacaaacaag

SEQ ID NO: 2070952 - RNA, 14 nt, Human
ucagaaauuuaauu

SEQ ID NO: 2070953 - RNA, 21 nt, Human
ucagaaauuuaauucauguuu

SEQ ID NO: 2070954 - RNA, 23 nt, Human
ucagaaauuuaauucauguuucu

SEQ ID NO: 2070955 - RNA, 18 nt, Human
ucagaaauguacaacuuu

SEQ ID NO: 2070956 - RNA, 15 nt, Human
ucagaaaugucugga

SEQ ID NO: 2070957 - RNA, 21 nt, Human
ucagaaaugucuggagaauaa

SEQ ID NO: 2070958 - RNA, 12 nt, Human
ucagaccccagc

SEQ ID NO: 2070959 - RNA, 13 nt, Human
ucagaccccagcg

SEQ ID NO: 2070960 - RNA, 17 nt, Human
ucagaccccagcggcug

SEQ ID NO: 2070961 - RNA, 12 nt, Human
ucagacccccac

SEQ ID NO: 2070962 - RNA, 14 nt, Human
ucagacccccacuc

SEQ ID NO: 2070963 - RNA, 18 nt, Human
ucagacccccacucucau

SEQ ID NO: 2070964 - RNA, 22 nt, Human
ucagacccccacucucauuccc

SEQ ID NO: 2070965 - RNA, 14 nt, Human
ucagacacuuugga

SEQ ID NO: 2070966 - RNA, 13 nt, Human
ucagacccuaccc

SEQ ID NO: 2070967 - RNA, 14 nt, Human
ucagacccuacccc

SEQ ID NO: 2070968 - RNA, 16 nt, Human
ucagacccuaccccac

SEQ ID NO: 2070969 - RNA, 18 nt, Human
ucagacccuaccccacca

SEQ ID NO: 2070970 - RNA, 23 nt, Human
ucagacugcugggacuggccagg

SEQ ID NO: 2070971 - RNA, 13 nt, Human
ucagacuggcugg

SEQ ID NO: 2070972 - RNA, 14 nt, Human
ucagacuggcuggc

SEQ ID NO: 2070973 - RNA, 20 nt, Human
ucagacuggcuggcugcagu

SEQ ID NO: 2070974 - RNA, 21 nt, Human
ucagacuggcuggcugcagug

SEQ ID NO: 2070975 - RNA, 16 nt, Human
ucagacuuuaaagaau

SEQ ID NO: 2070976 - RNA, 17 nt, Human
ucagacuuuaaagaaua

SEQ ID NO: 2070977 - RNA, 23 nt, Human
ucagacuuuaaagaauaauaugc

SEQ ID NO: 2070978 - RNA, 13 nt, Human
ucauuauaaacgu

SEQ ID NO: 2070979 - RNA, 15 nt, Human
ucauuauaaacguga

SEQ ID NO: 2070980 - RNA, 23 nt, Human
ucauuauaaacgugaugaucagc

SEQ ID NO: 2070981 - RNA, 22 nt, Human
ucauuauaaugucauuaaacau

SEQ ID NO: 2070982 - RNA, 23 nt, Human
ucauuccaccuucccaugcccug

SEQ ID NO: 2070983 - RNA, 16 nt, Human
ucauucaauacaagug

SEQ ID NO: 2070984 - RNA, 11 nt, Human
ucauuauuuau

SEQ ID NO: 2070985 - RNA, 16 nt, Human
ucauuccaugugccca

SEQ ID NO: 2070986 - RNA, 21 nt, Human
ucauuccaacuucccaguuca

SEQ ID NO: 2070987 - RNA, 17 nt, Human
ucauuccaugugcccag

SEQ ID NO: 2070988 - RNA, 18 nt, Human
ucauuccaugugcccagu

SEQ ID NO: 2070989 - RNA, 19 nt, Human
ucauuccaugugcccaguu

SEQ ID NO: 2070990 - RNA, 20 nt, Human
ucauuccaugugcccaguua

SEQ ID NO: 2070991 - RNA, 21 nt, Human
ucauucaacccaccugcgucu

SEQ ID NO: 2070992 - RNA, 22 nt, Human
ucauucaaaaguugaaauuaac

SEQ ID NO: 2070993 - RNA, 16 nt, Human
ucauucaaaaguugaa

SEQ ID NO: 2070994 - RNA, 18 nt, Human
ucauucaaaaguugaaau

SEQ ID NO: 2070995 - RNA, 19 nt, Human
ucauuauuggaauuaaccu

SEQ ID NO: 2070996 - RNA, 21 nt, Human
ucauuauuggaauuaaccugg

SEQ ID NO: 2070997 - RNA, 14 nt, Human
ucauuauuggaauu

SEQ ID NO: 2070998 - RNA, 17 nt, Human
ucauuauuggaauuaac

SEQ ID NO: 2070999 - RNA, 18 nt, Human
ucauuauuggaauuaacc

SEQ ID NO: 2071000 - RNA, 16 nt, Human
ucauuucauuccuaac

SEQ ID NO: 2071001 - RNA, 16 nt, Human
ucauuuccugugucuu

SEQ ID NO: 2071002 - RNA, 13 nt, Human
ucauuuccugugu

SEQ ID NO: 2071003 - RNA, 22 nt, Human
ucauuuccuauguaacugcauu

SEQ ID NO: 2071004 - RNA, 13 nt, Human
ucauugugguuau

SEQ ID NO: 2071005 - RNA, 22 nt, Human
ucauugugguuauuuuuauaca

SEQ ID NO: 2071006 - RNA, 23 nt, Human
ucauugugguuauuuuuauacag

SEQ ID NO: 2071007 - RNA, 12 nt, Human
ucauuucaucua

SEQ ID NO: 2071008 - RNA, 23 nt, Human
ucaucuuagguuggcaaaaaggc

SEQ ID NO: 2071009 - RNA, 13 nt, Human
ucaucuucucugg

SEQ ID NO: 2071010 - RNA, 19 nt, Human
ucauagggaagaccugcug

SEQ ID NO: 2071011 - RNA, 15 nt, Human
ucaggugcugccauc

SEQ ID NO: 2071012 - RNA, 14 nt, Human
ucaggugcugccau

SEQ ID NO: 2071013 - RNA, 13 nt, Human
ucaggugcugcca

SEQ ID NO: 2071014 - RNA, 21 nt, Human
ucaggugagaagcagaggaag

SEQ ID NO: 2071015 - RNA, 19 nt, Human
ucauagcauuaacuaaucu

SEQ ID NO: 2071016 - RNA, 15 nt, Human
ucauacucaccucac

SEQ ID NO: 2071017 - RNA, 14 nt, Human
ucauagcauuaacu

SEQ ID NO: 2071018 - RNA, 21 nt, Human
ucauagcauuaacuaaucuau

SEQ ID NO: 2071019 - RNA, 21 nt, Human
ucauagcugguuccugcuaga

SEQ ID NO: 2071020 - RNA, 12 nt, Human
ucauagcugaga

SEQ ID NO: 2071021 - RNA, 17 nt, Human
ucauagcugagauuccu

SEQ ID NO: 2071022 - RNA, 22 nt, Human
uccaauuuguaaaaacagcauu

SEQ ID NO: 2071023 - RNA, 17 nt, Human
uccaauuuacauacucu

SEQ ID NO: 2071024 - RNA, 18 nt, Human
uccaauuuacauacucug

SEQ ID NO: 2071025 - RNA, 17 nt, Human
uccacaaguuaaauaaa

SEQ ID NO: 2071026 - RNA, 18 nt, Human
uccacaaguuaaauaaau

SEQ ID NO: 2071027 - RNA, 12 nt, Human
uccacacacaga

SEQ ID NO: 2071028 - RNA, 13 nt, Human
uccacacacagag

SEQ ID NO: 2071029 - RNA, 23 nt, Human
uccacacacagaggaagagcagg

SEQ ID NO: 2071030 - RNA, 14 nt, Human
uccacacacagagg

SEQ ID NO: 2071031 - RNA, 15 nt, Human
uccacacacagagga

SEQ ID NO: 2071032 - RNA, 19 nt, Human
uccacacacagaggaagag

SEQ ID NO: 2071033 - RNA, 22 nt, Human
uccacacacagaggaagagcag

SEQ ID NO: 2071034 - RNA, 12 nt, Human
uccacccugcuc

SEQ ID NO: 2071035 - RNA, 21 nt, Human
uccacccccucccuggccugu

SEQ ID NO: 2071036 - RNA, 19 nt, Human
uccacccccucccuggccu

SEQ ID NO: 2071037 - RNA, 20 nt, Human
uccacccccucccuggccug

SEQ ID NO: 2071038 - RNA, 23 nt, Human
uccaccccccagaaccuguccuu

SEQ ID NO: 2071039 - RNA, 13 nt, Human
uccacccccuccc

SEQ ID NO: 2071040 - RNA, 15 nt, Human
uccacccccucccug

SEQ ID NO: 2071041 - RNA, 18 nt, Human
uccacccccucccuggcc

SEQ ID NO: 2071042 - RNA, 17 nt, Human
uccacagaugccuccac

SEQ ID NO: 2071043 - RNA, 22 nt, Human
uccaccccccagaaccuguccu

SEQ ID NO: 2071044 - RNA, 18 nt, Human
uccacccccgccucccuc

SEQ ID NO: 2071045 - RNA, 23 nt, Human
uccacccccgccucccuccccug

SEQ ID NO: 2071046 - RNA, 12 nt, Human
uccacccccucc

SEQ ID NO: 2071047 - RNA, 17 nt, Human
uccaccuggccccaugu

SEQ ID NO: 2071048 - RNA, 13 nt, Human
uccaccuggaagc

SEQ ID NO: 2071049 - RNA, 13 nt, Human
uccaccuggcccc

SEQ ID NO: 2071050 - RNA, 15 nt, Human
uccaccuucccaugc

SEQ ID NO: 2071051 - RNA, 13 nt, Human
uccaccugucuca

SEQ ID NO: 2071052 - RNA, 16 nt, Human
uccaccugucucagcc

SEQ ID NO: 2071053 - RNA, 17 nt, Human
uccaccugucucagccu

SEQ ID NO: 2071054 - RNA, 20 nt, Human
uccaccugucucagccuccc

SEQ ID NO: 2071055 - RNA, 23 nt, Human
uccagccaaccccuguggagccc

SEQ ID NO: 2071056 - RNA, 14 nt, Human
uccaccuuaaauua

SEQ ID NO: 2071057 - RNA, 17 nt, Human
uccaccuuaaauuaaac

SEQ ID NO: 2071058 - RNA, 18 nt, Human
uccaccuuaaauuaaaca

SEQ ID NO: 2071059 - RNA, 22 nt, Human
uccaccuuaaauuaaacaauuu

SEQ ID NO: 2071060 - RNA, 13 nt, Human
uccagccaacccc

SEQ ID NO: 2071061 - RNA, 14 nt, Human
uccagccaaccccu

SEQ ID NO: 2071062 - RNA, 16 nt, Human
uccagccaaccccugu

SEQ ID NO: 2071063 - RNA, 20 nt, Human
uccagccaaccccuguggag

SEQ ID NO: 2071064 - RNA, 17 nt, Human
uccagcuguucagcugg

SEQ ID NO: 2071065 - RNA, 20 nt, Human
uccagcuguugagccccucc

SEQ ID NO: 2071066 - RNA, 15 nt, Human
uccagcuugcucuuc

SEQ ID NO: 2071067 - RNA, 16 nt, Human
uccagcuugcucuuca

SEQ ID NO: 2071068 - RNA, 17 nt, Human
uccagcuugcucuucag

SEQ ID NO: 2071069 - RNA, 19 nt, Human
uccagcuugcucuucagug

SEQ ID NO: 2071070 - RNA, 17 nt, Human
uccagcucaccagcccc

SEQ ID NO: 2071071 - RNA, 16 nt, Human
uccagcucaccagccc

SEQ ID NO: 2071072 - RNA, 18 nt, Human
uccagcucaccagcccca

SEQ ID NO: 2071073 - RNA, 12 nt, Human
uccagcccauug

SEQ ID NO: 2071074 - RNA, 16 nt, Human
uccagguucagcuugu

SEQ ID NO: 2071075 - RNA, 15 nt, Human
uccagguucagcuug

SEQ ID NO: 2071076 - RNA, 19 nt, Human
uauugcuuguuggauuuuu

SEQ ID NO: 2071077 - RNA, 21 nt, Human
uauugcuugcacaaaccaauu

SEQ ID NO: 2071078 - RNA, 22 nt, Human
uauuggaaauuuguuauaauga

SEQ ID NO: 2071079 - RNA, 14 nt, Human
uauuggcaaagaug

SEQ ID NO: 2071080 - RNA, 23 nt, Human
uauuggaggaccaaaaaaauaag

SEQ ID NO: 2071081 - RNA, 21 nt, Human
uauuggaauuaaccuggugcu

SEQ ID NO: 2071082 - RNA, 23 nt, Human
uauuggaauuaaccuggugcugg

SEQ ID NO: 2071083 - RNA, 15 nt, Human
uauuggaauuaaccu

SEQ ID NO: 2071084 - RNA, 16 nt, Human
uauuggaauuaaccug

SEQ ID NO: 2071085 - RNA, 14 nt, Human
uauugaugugcaaa

SEQ ID NO: 2071086 - RNA, 19 nt, Human
uauugaugugcaaaaauuu

SEQ ID NO: 2071087 - RNA, 20 nt, Human
uauugaugugcaaaaauuuu

SEQ ID NO: 2071088 - RNA, 14 nt, Human
uauugcgucuuagc

SEQ ID NO: 2071089 - RNA, 13 nt, Human
uauugcuacuucc

SEQ ID NO: 2071090 - RNA, 18 nt, Human
uauugcuacuuccugccu

SEQ ID NO: 2071091 - RNA, 16 nt, Human
uauucucacuccacca

SEQ ID NO: 2071092 - RNA, 19 nt, Human
uauucucacuccaccaccc

SEQ ID NO: 2071093 - RNA, 16 nt, Human
uauucucuccucagac

SEQ ID NO: 2071094 - RNA, 17 nt, Human
uauucucuccucagacu

SEQ ID NO: 2071095 - RNA, 21 nt, Human
uauugauaugcuuauacacuu

SEQ ID NO: 2071096 - RNA, 19 nt, Human
uauuuaaaauuuauugcuu

SEQ ID NO: 2071097 - RNA, 23 nt, Human
uauuuaaaagaaagccucagaga

SEQ ID NO: 2071098 - RNA, 22 nt, Human
uauuguuuucaguguacaugga

SEQ ID NO: 2071099 - RNA, 22 nt, Human
uauuguuuuuccuuguauuuaa

SEQ ID NO: 2071100 - RNA, 18 nt, Human
uauuguuuucaguguaca

SEQ ID NO: 2071101 - RNA, 20 nt, Human
uauuguuuucaguguacaug

SEQ ID NO: 2071102 - RNA, 12 nt, Human
uauuguuuucag

SEQ ID NO: 2071103 - RNA, 13 nt, Human
uauuguuccaaga

SEQ ID NO: 2071104 - RNA, 17 nt, Human
uauuguuccaagacauu

SEQ ID NO: 2071105 - RNA, 18 nt, Human
uauuguuccaagacauug

SEQ ID NO: 2071106 - RNA, 19 nt, Human
uauuguuccaagacauugu

SEQ ID NO: 2071107 - RNA, 20 nt, Human
uauuguuccaagacauuguc

SEQ ID NO: 2071108 - RNA, 21 nt, Human
uauuguuccaagacauuguca

SEQ ID NO: 2071109 - RNA, 23 nt, Human
uauuguuccaagacauugucaau

SEQ ID NO: 2071110 - RNA, 18 nt, Human
uauuauucaccauguaaa

SEQ ID NO: 2071111 - RNA, 19 nt, Human
uauuauucaccauguaaaa

SEQ ID NO: 2071112 - RNA, 22 nt, Human
uauuauucaccauguaaaacaa

SEQ ID NO: 2071113 - RNA, 15 nt, Human
uauuaaugcuaaggg

SEQ ID NO: 2071114 - RNA, 21 nt, Human
uauuacacaaauacuuauuca

SEQ ID NO: 2071115 - RNA, 23 nt, Human
uauuacacaaauacuuauucauu

SEQ ID NO: 2071116 - RNA, 21 nt, Human
uauuccaguuuguuuauuacu

SEQ ID NO: 2071117 - RNA, 16 nt, Human
uauuccauaguauauu

SEQ ID NO: 2071118 - RNA, 18 nt, Human
uauuccauaguauauuaa

SEQ ID NO: 2071119 - RNA, 19 nt, Human
uauuccauaguauauuaaa

SEQ ID NO: 2071120 - RNA, 23 nt, Human
uauuccauaguauauuaaaaaug

SEQ ID NO: 2071121 - RNA, 14 nt, Human
uauuccauauauua

SEQ ID NO: 2071122 - RNA, 14 nt, Human
uauuccaccuuaaa

SEQ ID NO: 2071123 - RNA, 15 nt, Human
uauuccaccuuaaau

SEQ ID NO: 2071124 - RNA, 18 nt, Human
uauuccaccuuaaauuaa

SEQ ID NO: 2071125 - RNA, 19 nt, Human
uauuccaccuuaaauuaaa

SEQ ID NO: 2071126 - RNA, 20 nt, Human
uauuccaccuuaaauuaaac

SEQ ID NO: 2071127 - RNA, 22 nt, Human
uauuccaccuuaaauuaaacaa

SEQ ID NO: 2071128 - RNA, 13 nt, Human
uauuauucugcag

SEQ ID NO: 2071129 - RNA, 15 nt, Human
uauuauucugcagca

SEQ ID NO: 2071130 - RNA, 18 nt, Human
uauuccauauauuagcau

SEQ ID NO: 2071131 - RNA, 23 nt, Human
uauuccaugaauguaucaggaaa

SEQ ID NO: 2071132 - RNA, 16 nt, Human
uauuccaugaauguau

SEQ ID NO: 2071133 - RNA, 17 nt, Human
uauuccaugaauguauc

SEQ ID NO: 2071134 - RNA, 22 nt, Human
uauuccaugaauguaucaggaa

SEQ ID NO: 2071135 - RNA, 20 nt, Human
uauuccccuaucucuagaau

SEQ ID NO: 2071136 - RNA, 22 nt, Human
uauuccccuaucucuagaauuu

SEQ ID NO: 2071137 - RNA, 14 nt, Human
uauucucaaagcag

SEQ ID NO: 2071138 - RNA, 16 nt, Human
uauucucaaagcagga

SEQ ID NO: 2071139 - RNA, 13 nt, Human
uauucucacucca

SEQ ID NO: 2071140 - RNA, 14 nt, Human
uauucucacuccac

SEQ ID NO: 2071141 - RNA, 15 nt, Human
uauucucacuccacc

SEQ ID NO: 2071142 - RNA, 22 nt, Human
uauucucacuccaccacccaaa

SEQ ID NO: 2071143 - RNA, 14 nt, Human
uauucuacauuuca

SEQ ID NO: 2071144 - RNA, 15 nt, Human
uauucuacauuucac

SEQ ID NO: 2071145 - RNA, 22 nt, Human
uauuccuauauaguuuauugac

SEQ ID NO: 2071146 - RNA, 21 nt, Human
uauucccuguacaauauuuaa

SEQ ID NO: 2071147 - RNA, 20 nt, Human
uauuccuauauaguuuauug

SEQ ID NO: 2071148 - RNA, 21 nt, Human
uauuccuauauaguuuauuga

SEQ ID NO: 2071149 - RNA, 21 nt, Human
uauuccugcauuugugaaaug

SEQ ID NO: 2071150 - RNA, 20 nt, Human
uauuccugcauuugugaaau

SEQ ID NO: 2071151 - RNA, 19 nt, Human
uauuccugcauuugugaaa

SEQ ID NO: 2071152 - RNA, 17 nt, Human
uauuccugcauuuguga

SEQ ID NO: 2071153 - RNA, 14 nt, Human
uauuccugaaugaa

SEQ ID NO: 2071154 - RNA, 20 nt, Human
uauuccugaaugaaauauca

SEQ ID NO: 2071155 - RNA, 20 nt, Human
uauuccuuuuguguacagug

SEQ ID NO: 2071156 - RNA, 19 nt, Human
uauuccuuuuguguacagu

SEQ ID NO: 2071157 - RNA, 21 nt, Human
uauuccuuuuguguacagugu

SEQ ID NO: 2071158 - RNA, 12 nt, Human
uauuaaugcuaa

SEQ ID NO: 2071159 - RNA, 13 nt, Human
uauuaaugcuaag

SEQ ID NO: 2071160 - RNA, 14 nt, Human
uauuaaugcuaagg

SEQ ID NO: 2071161 - RNA, 15 nt, Human
uauuaauauuuuaau

SEQ ID NO: 2071162 - RNA, 17 nt, Human
uauuaauauucauugua

SEQ ID NO: 2071163 - RNA, 20 nt, Human
uauuaauauucauuguauaa

SEQ ID NO: 2071164 - RNA, 21 nt, Human
uauuaagauggauucucagau

SEQ ID NO: 2071165 - RNA, 16 nt, Human
uauuaagauggauucu

SEQ ID NO: 2071166 - RNA, 18 nt, Human
uauuaagauggauucuca

SEQ ID NO: 2071167 - RNA, 19 nt, Human
uauuaagauggauucucag

SEQ ID NO: 2071168 - RNA, 20 nt, Human
uauuaagauggauucucaga

SEQ ID NO: 2071169 - RNA, 24 nt, Human
uauuaagaaagacuaucuaaaugu

SEQ ID NO: 2071170 - RNA, 13 nt, Human
uauuaagauggau

SEQ ID NO: 2071171 - RNA, 15 nt, Human
uauuaagauggauuc

SEQ ID NO: 2071172 - RNA, 20 nt, Human
uauuaaauuuuuuaaaaagc

SEQ ID NO: 2071173 - RNA, 22 nt, Human
uauuaaauuuuuuaaaaagcaa

SEQ ID NO: 2071174 - RNA, 12 nt, Human
uauuaaauuaug

SEQ ID NO: 2071175 - RNA, 23 nt, Human
uauguuugcucagaacacauucu

SEQ ID NO: 2071176 - RNA, 14 nt, Human
uauguuugcacacu

SEQ ID NO: 2071177 - RNA, 19 nt, Human
uauguuugcacacuugugu

SEQ ID NO: 2071178 - RNA, 18 nt, Human
uauguauguuuacacugu

SEQ ID NO: 2071179 - RNA, 22 nt, Human
uauguauguuuacacugucaaa

SEQ ID NO: 2071180 - RNA, 19 nt, Human
uauguauuaauauucauug

SEQ ID NO: 2071181 - RNA, 17 nt, Human
uaugucaacuuuaugca

SEQ ID NO: 2071182 - RNA, 14 nt, Human
uauguauuuuaugu

SEQ ID NO: 2071183 - RNA, 16 nt, Human
uauguauuuuauguau

SEQ ID NO: 2071184 - RNA, 19 nt, Human
uauguauuuuauguauguu

SEQ ID NO: 2071185 - RNA, 14 nt, Human
uauguugauaaaag

SEQ ID NO: 2071186 - RNA, 18 nt, Human
uauguugaccuaagauuu

SEQ ID NO: 2071187 - RNA, 20 nt, Human
uauguugcccaggcaggucu

SEQ ID NO: 2071188 - RNA, 15 nt, Human
uauguugaugaaaaa

SEQ ID NO: 2071189 - RNA, 13 nt, Human
uauguuuacacug

SEQ ID NO: 2071190 - RNA, 15 nt, Human
uauguuuacacuguc

SEQ ID NO: 2071191 - RNA, 16 nt, Human
uauguuuacacuguca

SEQ ID NO: 2071192 - RNA, 18 nt, Human
uauguuuacacugucaaa

SEQ ID NO: 2071193 - RNA, 19 nt, Human
uauguugcccaggcagguc

SEQ ID NO: 2071194 - RNA, 16 nt, Human
uauguugcccaggcag

SEQ ID NO: 2071195 - RNA, 13 nt, Human
uauguugcccagg

SEQ ID NO: 2071196 - RNA, 18 nt, Human
uauguacaauauuuuaag

SEQ ID NO: 2071197 - RNA, 20 nt, Human
uauguacaauauuuuaagca

SEQ ID NO: 2071198 - RNA, 21 nt, Human
uauguacaauauuuuaagcau

SEQ ID NO: 2071199 - RNA, 23 nt, Human
uauguacaauauuuuaagcauua

SEQ ID NO: 2071200 - RNA, 14 nt, Human
uauguacauauaua

SEQ ID NO: 2071201 - RNA, 14 nt, Human
uauguaacugcauu

SEQ ID NO: 2071202 - RNA, 24 nt, Human
uauguaacugcauugagaacugca

SEQ ID NO: 2071203 - RNA, 15 nt, Human
uauguaauaauguga

SEQ ID NO: 2071204 - RNA, 16 nt, Human
uauguaauaaugugaa

SEQ ID NO: 2071205 - RNA, 14 nt, Human
uauguaccucuuuu

SEQ ID NO: 2071206 - RNA, 16 nt, Human
uauguaccucuuuuag

SEQ ID NO: 2071207 - RNA, 20 nt, Human
uauguacuccucuuuacacu

SEQ ID NO: 2071208 - RNA, 21 nt, Human
uauguacuccucuuuacacug

SEQ ID NO: 2071209 - RNA, 17 nt, Human
uauguagaugugcauuu

SEQ ID NO: 2071210 - RNA, 12 nt, Human
uauguagaugug

SEQ ID NO: 2071211 - RNA, 16 nt, Human
uauguagaugugcauu

SEQ ID NO: 2071212 - RNA, 13 nt, Human
uauguaugugugu

SEQ ID NO: 2071213 - RNA, 14 nt, Human
uauguaugugugua

SEQ ID NO: 2071214 - RNA, 17 nt, Human
uauguauguguguaugg

SEQ ID NO: 2071215 - RNA, 14 nt, Human
uauguauguaaaaa

SEQ ID NO: 2071216 - RNA, 16 nt, Human
uauguauguaaaaaug

SEQ ID NO: 2071217 - RNA, 16 nt, Human
uauguaugugaaaguu

SEQ ID NO: 2071218 - RNA, 20 nt, Human
uauguauggaauacaguguu

SEQ ID NO: 2071219 - RNA, 19 nt, Human
uauguauauuuaaaagaaa

SEQ ID NO: 2071220 - RNA, 18 nt, Human
uauguaaacauaauucuu

SEQ ID NO: 2071221 - RNA, 19 nt, Human
uauguaaacugcauuagaa

SEQ ID NO: 2071222 - RNA, 23 nt, Human
uauguaaacugcauuagaaauua

SEQ ID NO: 2071223 - RNA, 14 nt, Human
uauguaaacauaau

SEQ ID NO: 2071224 - RNA, 12 nt, Human
uauguaaaauaa

SEQ ID NO: 2071225 - RNA, 19 nt, Human
uauguaaaauaaaauuaug

SEQ ID NO: 2071226 - RNA, 14 nt, Human
uauguaaaauuuug

SEQ ID NO: 2071227 - RNA, 19 nt, Human
gggagugaggcaggugaca

SEQ ID NO: 2071228 - RNA, 10 nt, Human
uauguaaaaa

SEQ ID NO: 2071229 - RNA, 15 nt, Human
uauggauuuucuaag

SEQ ID NO: 2071230 - RNA, 19 nt, Human
uauggauuuucuaaggaag

SEQ ID NO: 2071231 - RNA, 20 nt, Human
gggagugggacagagucugg

SEQ ID NO: 2071232 - RNA, 18 nt, Human
gggagugggacagagucu

SEQ ID NO: 2071233 - RNA, 19 nt, Human
ucaagugauucuccugccu

SEQ ID NO: 2071234 - RNA, 21 nt, Human
ucaagugauucuccugccuca

SEQ ID NO: 2071235 - RNA, 18 nt, Human
ucaagugauucuccugcc

SEQ ID NO: 2071236 - RNA, 20 nt, Human
ucaagugauucuccugccuc

SEQ ID NO: 2071237 - RNA, 18 nt, Human
ucaacgcagcccugcuuu

SEQ ID NO: 2071238 - RNA, 15 nt, Human
ucaacgcagcccugc

SEQ ID NO: 2071239 - RNA, 14 nt, Human
ucaacgcagcccug

SEQ ID NO: 2071240 - RNA, 12 nt, Human
ucaaccuguaaa

SEQ ID NO: 2071241 - RNA, 13 nt, Human
ucaaccuguaaau

SEQ ID NO: 2071242 - RNA, 15 nt, Human
ucaaccuguaaauua

SEQ ID NO: 2071243 - RNA, 16 nt, Human
ucaaccuguaaauuau

SEQ ID NO: 2071244 - RNA, 17 nt, Human
ucaaccuguaaauuauu

SEQ ID NO: 2071245 - RNA, 18 nt, Human
ucaaccuguaaauuauuu

SEQ ID NO: 2071246 - RNA, 19 nt, Human
ucaaccuguaaauuauuuu

SEQ ID NO: 2071247 - RNA, 15 nt, Human
ucaaccugugaugag

SEQ ID NO: 2071248 - RNA, 20 nt, Human
ucaaccugugaugaggggag

SEQ ID NO: 2071249 - RNA, 13 nt, Human
ucaaguucaagga

SEQ ID NO: 2071250 - RNA, 16 nt, Human
ucaaguucaaggacca

SEQ ID NO: 2071251 - RNA, 16 nt, Human
ucaaguugcacacuca

SEQ ID NO: 2071252 - RNA, 20 nt, Human
ucaaguugcacacucacugg

SEQ ID NO: 2071253 - RNA, 21 nt, Human
ucaaguugggagccugaaaua

SEQ ID NO: 2071254 - RNA, 18 nt, Human
ucaaguuuccaagcaaau

SEQ ID NO: 2071255 - RNA, 19 nt, Human
ucaaguuuccaagcaaaug

SEQ ID NO: 2071256 - RNA, 23 nt, Human
ucaaguuuccaagcaaauguuac

SEQ ID NO: 2071257 - RNA, 13 nt, Human
ucaauaaaaugug

SEQ ID NO: 2071258 - RNA, 23 nt, Human
ucaauaaaaugugauuuuucuga

SEQ ID NO: 2071259 - RNA, 19 nt, Human
ucaauaaaaugugauuuuu

SEQ ID NO: 2071260 - RNA, 22 nt, Human
ucaauaaaaugugauuuuucug

SEQ ID NO: 2071261 - RNA, 14 nt, Human
ucaauaaaauguga

SEQ ID NO: 2071262 - RNA, 15 nt, Human
ucaauaaaaugugau

SEQ ID NO: 2071263 - RNA, 16 nt, Human
ucaauaaaaugugauu

SEQ ID NO: 2071264 - RNA, 18 nt, Human
ucaauaaaaugugauuuu

SEQ ID NO: 2071265 - RNA, 14 nt, Human
ucaauaaacagcuu

SEQ ID NO: 2071266 - RNA, 21 nt, Human
ucaauaaacagcuucaugccu

SEQ ID NO: 2071267 - RNA, 23 nt, Human
ucaauaaacagcuucaugccuuu

SEQ ID NO: 2071268 - RNA, 12 nt, Human
ucaauaaacagc

SEQ ID NO: 2071269 - RNA, 17 nt, Human
ucaauaaaguaucuaca

SEQ ID NO: 2071270 - RNA, 12 nt, Human
ucaauaaaguau

SEQ ID NO: 2071271 - RNA, 13 nt, Human
ucaauaaaguauc

SEQ ID NO: 2071272 - RNA, 22 nt, Human
ucaauaagccucagcuuucuaa

SEQ ID NO: 2071273 - RNA, 14 nt, Human
ucaauaacgaaguu

SEQ ID NO: 2071274 - RNA, 22 nt, Human
ucaauaacgaaguugggcaaua

SEQ ID NO: 2071275 - RNA, 20 nt, Human
ucaauaagcaucaaacucuu

SEQ ID NO: 2071276 - RNA, 11 nt, Human
ucaauguucau

SEQ ID NO: 2071277 - RNA, 12 nt, Human
ucaauguucauu

SEQ ID NO: 2071278 - RNA, 13 nt, Human
ucaauguucauug

SEQ ID NO: 2071279 - RNA, 14 nt, Human
ucaauguucauugu

SEQ ID NO: 2071280 - RNA, 16 nt, Human
ucaauguucauuguaa

SEQ ID NO: 2071281 - RNA, 15 nt, Human
ucaaugugaaucaga

SEQ ID NO: 2071282 - RNA, 11 nt, Human
ucaaugucacu

SEQ ID NO: 2071283 - RNA, 18 nt, Human
ucaaugguuugcaaggaa

SEQ ID NO: 2071284 - RNA, 19 nt, Human
ucaaugguuugcaaggaag

SEQ ID NO: 2071285 - RNA, 19 nt, Human
ucacaggcagguccagggu

SEQ ID NO: 2071286 - RNA, 18 nt, Human
ucacaccauaacuaggua

SEQ ID NO: 2071287 - RNA, 21 nt, Human
ucacaccugaaaauguuagug

SEQ ID NO: 2071288 - RNA, 18 nt, Human
ucacaggcagguccaggg

SEQ ID NO: 2071289 - RNA, 17 nt, Human
ucacaggcagguccagg

SEQ ID NO: 2071290 - RNA, 16 nt, Human
ucacaggcagguccag

SEQ ID NO: 2071291 - RNA, 13 nt, Human
ucaauuaccacac

SEQ ID NO: 2071292 - RNA, 13 nt, Human
ucacaguguguuu

SEQ ID NO: 2071293 - RNA, 19 nt, Human
ucaccaaaucagcugcuac

SEQ ID NO: 2071294 - RNA, 20 nt, Human
ucaccaaaucagcugcuacu

SEQ ID NO: 2071295 - RNA, 12 nt, Human
ucaccaagcuca

SEQ ID NO: 2071296 - RNA, 16 nt, Human
ucaccaagcucacagu

SEQ ID NO: 2071297 - RNA, 20 nt, Human
ucaccaagcucacaguuccu

SEQ ID NO: 2071298 - RNA, 21 nt, Human
ucaccaagcucacaguuccuc

SEQ ID NO: 2071299 - RNA, 22 nt, Human
ucaccaagcucacaguuccucg

SEQ ID NO: 2071300 - RNA, 17 nt, Human
ucacauuuauucugcuc

SEQ ID NO: 2071301 - RNA, 18 nt, Human
ucacagucucuuuaaucu

SEQ ID NO: 2071302 - RNA, 19 nt, Human
ucacagucucuuuaaucuu

SEQ ID NO: 2071303 - RNA, 21 nt, Human
ucacagucucuuuaaucuuca

SEQ ID NO: 2071304 - RNA, 23 nt, Human
ucacagucucuuuaaucuucagu

SEQ ID NO: 2071305 - RNA, 18 nt, Human
ucacagugggagccaggg

SEQ ID NO: 2071306 - RNA, 17 nt, Human
ucacagugggagccagg

SEQ ID NO: 2071307 - RNA, 19 nt, Human
ucacauuuauucugcucac

SEQ ID NO: 2071308 - RNA, 18 nt, Human
ucacauuuauucugcuca

SEQ ID NO: 2071309 - RNA, 13 nt, Human
uauuuauauaaau

SEQ ID NO: 2071310 - RNA, 17 nt, Human
uauuuauaauacauuuc

SEQ ID NO: 2071311 - RNA, 18 nt, Human
uauuuauagcaauccaug

SEQ ID NO: 2071312 - RNA, 14 nt, Human
uauuuauaagcaga

SEQ ID NO: 2071313 - RNA, 17 nt, Human
uauuuauaagcagauuu

SEQ ID NO: 2071314 - RNA, 23 nt, Human
uauuuauaacucaucauaaaaua

SEQ ID NO: 2071315 - RNA, 21 nt, Human
uauuuauaacucaucauaaaa

SEQ ID NO: 2071316 - RNA, 22 nt, Human
uauuuauaacucaucauaaaau

SEQ ID NO: 2071317 - RNA, 20 nt, Human
uauuuauaacaaccuaaauu

SEQ ID NO: 2071318 - RNA, 19 nt, Human
uauuuauaacaaccuaaau

SEQ ID NO: 2071319 - RNA, 14 nt, Human
uauuuauaacagca

SEQ ID NO: 2071320 - RNA, 18 nt, Human
uauuuauaacagcauucu

SEQ ID NO: 2071321 - RNA, 13 nt, Human
uauuuauaacuca

SEQ ID NO: 2071322 - RNA, 20 nt, Human
uauuuauaacucaucauaaa

SEQ ID NO: 2071323 - RNA, 13 nt, Human
uauuuauauaauu

SEQ ID NO: 2071324 - RNA, 17 nt, Human
uauuuauauaauuaugu

SEQ ID NO: 2071325 - RNA, 18 nt, Human
uauuuauauaauuauguu

SEQ ID NO: 2071326 - RNA, 23 nt, Human
uauuuauauaauuauguuauuga

SEQ ID NO: 2071327 - RNA, 13 nt, Human
uauuuauauauuu

SEQ ID NO: 2071328 - RNA, 21 nt, Human
uauuuuauuacaucuuucaca

SEQ ID NO: 2071329 - RNA, 19 nt, Human
uauuuucaacgcagcccug

SEQ ID NO: 2071330 - RNA, 17 nt, Human
uauuuuauuuuuuucua

SEQ ID NO: 2071331 - RNA, 22 nt, Human
uauuuucaaauuguaucuagug

SEQ ID NO: 2071332 - RNA, 20 nt, Human
uauuuuccaugaaaaugcaa

SEQ ID NO: 2071333 - RNA, 18 nt, Human
uauuuucccaauagcacu

SEQ ID NO: 2071334 - RNA, 23 nt, Human
uauuuucccaauagcacuuucau

SEQ ID NO: 2071335 - RNA, 16 nt, Human
uauuuuccaugaaaau

SEQ ID NO: 2071336 - RNA, 11 nt, Human
uauuuuauuca

SEQ ID NO: 2071337 - RNA, 15 nt, Human
uauuuuauucaaggu

SEQ ID NO: 2071338 - RNA, 16 nt, Human
uauuuuauucaaggua

SEQ ID NO: 2071339 - RNA, 13 nt, Human
uauuuuauucccu

SEQ ID NO: 2071340 - RNA, 19 nt, Human
uauuuuauucccuuucaca

SEQ ID NO: 2071341 - RNA, 22 nt, Human
uauuuucugguagauagaaaua

SEQ ID NO: 2071342 - RNA, 17 nt, Human
uauuuuuuuaaaaucac

SEQ ID NO: 2071343 - RNA, 18 nt, Human
uauuuuuuuaaaaucacu

SEQ ID NO: 2071344 - RNA, 19 nt, Human
uauuuuuuuaaaaucacua

SEQ ID NO: 2071345 - RNA, 23 nt, Human
uauuuuuuuaaaaucacuaacau

SEQ ID NO: 2071346 - RNA, 20 nt, Human
uauuuucugguagauagaaa

SEQ ID NO: 2071347 - RNA, 15 nt, Human
uauuuuccuccccag

SEQ ID NO: 2071348 - RNA, 16 nt, Human
uauuuuccuccccagc

SEQ ID NO: 2071349 - RNA, 12 nt, Human
uauuuuccuccc

SEQ ID NO: 2071350 - RNA, 22 nt, Human
uauuuucccuauuagagaagag

SEQ ID NO: 2071351 - RNA, 14 nt, Human
ucaaaaaaagaaaa

SEQ ID NO: 2071352 - RNA, 15 nt, Human
ucaaaaaaagaaaaa

SEQ ID NO: 2071353 - RNA, 15 nt, Human
ucaaaugagaaaaug

SEQ ID NO: 2071354 - RNA, 18 nt, Human
ucaaaugggcugcugcuu

SEQ ID NO: 2071355 - RNA, 16 nt, Human
ucaaauugagagaaug

SEQ ID NO: 2071356 - RNA, 12 nt, Human
ucaaauuguauc

SEQ ID NO: 2071357 - RNA, 14 nt, Human
ucaaauuguaucua

SEQ ID NO: 2071358 - RNA, 23 nt, Human
ucaaccccuucgcuccugugucu

SEQ ID NO: 2071359 - RNA, 23 nt, Human
ucaacccuaaaaagcagagcuuu

SEQ ID NO: 2071360 - RNA, 22 nt, Human
ucaacccuaaaaagcagagcuu

SEQ ID NO: 2071361 - RNA, 18 nt, Human
ucaacccuaaaaagcaga

SEQ ID NO: 2071362 - RNA, 13 nt, Human
ucaaauuguaucu

SEQ ID NO: 2071363 - RNA, 14 nt, Human
ucaacccucccuca

SEQ ID NO: 2071364 - RNA, 15 nt, Human
ucaacccucccucag

SEQ ID NO: 2071365 - RNA, 17 nt, Human
ucaacccucccucagcc

SEQ ID NO: 2071366 - RNA, 18 nt, Human
ucaacccucccucagccc

SEQ ID NO: 2071367 - RNA, 19 nt, Human
ucaacccucccucagcccc

SEQ ID NO: 2071368 - RNA, 20 nt, Human
ucaacccucccucagccccu

SEQ ID NO: 2071369 - RNA, 21 nt, Human
ucaacccucccucagccccuc

SEQ ID NO: 2071370 - RNA, 23 nt, Human
ucaacccucccucagccccucuu

SEQ ID NO: 2071371 - RNA, 12 nt, Human
ucaaagaaauuu

SEQ ID NO: 2071372 - RNA, 13 nt, Human
ucaaagaaauuuc

SEQ ID NO: 2071373 - RNA, 19 nt, Human
ucaaagaaauuuccacuca

SEQ ID NO: 2071374 - RNA, 20 nt, Human
ucaaagaaauuuccacucag

SEQ ID NO: 2071375 - RNA, 14 nt, Human
ucaaaacacuugua

SEQ ID NO: 2071376 - RNA, 17 nt, Human
ucaaaacacuuguaauu

SEQ ID NO: 2071377 - RNA, 24 nt, Human
ucaaaacacuuguaauuuuguauc

SEQ ID NO: 2071378 - RNA, 15 nt, Human
ucaaaacagagaugu

SEQ ID NO: 2071379 - RNA, 23 nt, Human
ucaaaaauguacaaaauaaaguu

SEQ ID NO: 2071380 - RNA, 17 nt, Human
ucaaagacauucugaca

SEQ ID NO: 2071381 - RNA, 12 nt, Human
ucaaagaaggaa

SEQ ID NO: 2071382 - RNA, 19 nt, Human
ucuucuuuuugcuucaaaa

SEQ ID NO: 2071383 - RNA, 16 nt, Human
ucuucuuuuuuuguga

SEQ ID NO: 2071384 - RNA, 18 nt, Human
ucuucuuuuuuugugaug

SEQ ID NO: 2071385 - RNA, 17 nt, Human
ucuucuuuuuuugugau

SEQ ID NO: 2071386 - RNA, 13 nt, Human
ucuucuccuuuca

SEQ ID NO: 2071387 - RNA, 14 nt, Human
ucuucuccuuucac

SEQ ID NO: 2071388 - RNA, 12 nt, Human
ucuugaacuccu

SEQ ID NO: 2071389 - RNA, 19 nt, Human
ucuucuccauccuaccaca

SEQ ID NO: 2071390 - RNA, 12 nt, Human
ucuucuccaucu

SEQ ID NO: 2071391 - RNA, 14 nt, Human
ucuucuccaucugg

SEQ ID NO: 2071392 - RNA, 16 nt, Human
ucuucucccaauucau

SEQ ID NO: 2071393 - RNA, 12 nt, Human
ucuucuccacug

SEQ ID NO: 2071394 - RNA, 17 nt, Human
ucuucucauagcauuaa

SEQ ID NO: 2071395 - RNA, 18 nt, Human
ucuucucauagcauuaac

SEQ ID NO: 2071396 - RNA, 19 nt, Human
ucuucucauagcauuaacu

SEQ ID NO: 2071397 - RNA, 20 nt, Human
ucuucucauagcauuaacua

SEQ ID NO: 2071398 - RNA, 15 nt, Human
ucuuccuuaaacucc

SEQ ID NO: 2071399 - RNA, 14 nt, Human
ucuucucaggcucu

SEQ ID NO: 2071400 - RNA, 20 nt, Human
ucuucucaggcucugcccug

SEQ ID NO: 2071401 - RNA, 21 nt, Human
ucuucucaggcucugcccugc

SEQ ID NO: 2071402 - RNA, 16 nt, Human
ucuucucauagcauua

SEQ ID NO: 2071403 - RNA, 17 nt, Human
ucuucaugcaaugacau

SEQ ID NO: 2071404 - RNA, 14 nt, Human
ucuucaugcaauga

SEQ ID NO: 2071405 - RNA, 20 nt, Human
ucuucauccggcagccugga

SEQ ID NO: 2071406 - RNA, 15 nt, Human
ucuucauccuuagca

SEQ ID NO: 2071407 - RNA, 16 nt, Human
ucuucauccuuagcaa

SEQ ID NO: 2071408 - RNA, 21 nt, Human
ucuucauccuuagcaacagcc

SEQ ID NO: 2071409 - RNA, 23 nt, Human
ucuucagccuagccgaccucagc

SEQ ID NO: 2071410 - RNA, 21 nt, Human
ucuucagccuagccgaccuca

SEQ ID NO: 2071411 - RNA, 22 nt, Human
ucuucagccuagccgaccucag

SEQ ID NO: 2071412 - RNA, 13 nt, Human
ucuucaggccucc

SEQ ID NO: 2071413 - RNA, 14 nt, Human
ucuucaggccuccc

SEQ ID NO: 2071414 - RNA, 15 nt, Human
ucuucaggccucccu

SEQ ID NO: 2071415 - RNA, 18 nt, Human
ucuucaggccucccucuc

SEQ ID NO: 2071416 - RNA, 15 nt, Human
ucuucaucccacucc

SEQ ID NO: 2071417 - RNA, 18 nt, Human
ucuucauccggcagccug

SEQ ID NO: 2071418 - RNA, 19 nt, Human
ucuucauccggcagccugg

SEQ ID NO: 2071419 - RNA, 17 nt, Human
ucuuaggggagagcuuu

SEQ ID NO: 2071420 - RNA, 19 nt, Human
ucuuaggggagagcuuucu

SEQ ID NO: 2071421 - RNA, 16 nt, Human
ucuuaggcaaucacau

SEQ ID NO: 2071422 - RNA, 19 nt, Human
ucuuaggcaaucacauagu

SEQ ID NO: 2071423 - RNA, 14 nt, Human
ucuuagcugccaag

SEQ ID NO: 2071424 - RNA, 16 nt, Human
ucuucagccaccucuc

SEQ ID NO: 2071425 - RNA, 19 nt, Human
ucuucagccaccucucuuu

SEQ ID NO: 2071426 - RNA, 11 nt, Human
ucuucagccua

SEQ ID NO: 2071427 - RNA, 12 nt, Human
ucuucagccuag

SEQ ID NO: 2071428 - RNA, 19 nt, Human
ucuuaggaagagaaaccag

SEQ ID NO: 2071429 - RNA, 15 nt, Human
ucuuaggaagagaaa

SEQ ID NO: 2071430 - RNA, 13 nt, Human
ucuuaaaaagugg

SEQ ID NO: 2071431 - RNA, 17 nt, Human
ucuuaaacaaauguaug

SEQ ID NO: 2071432 - RNA, 16 nt, Human
ucuguuuuuaaaaauc

SEQ ID NO: 2071433 - RNA, 18 nt, Human
ucuuaaaaaauaaaaacu

SEQ ID NO: 2071434 - RNA, 23 nt, Human
ucuuaaagcugccuguaguuagg

SEQ ID NO: 2071435 - RNA, 20 nt, Human
ucuuaaagcugccuguaguu

SEQ ID NO: 2071436 - RNA, 21 nt, Human
ucuuaaagcugccuguaguua

SEQ ID NO: 2071437 - RNA, 16 nt, Human
ucuuaaagcugccugu

SEQ ID NO: 2071438 - RNA, 19 nt, Human
ucuuaaagcugccuguagu

SEQ ID NO: 2071439 - RNA, 17 nt, Human
ucugucuucaagggcuu

SEQ ID NO: 2071440 - RNA, 16 nt, Human
ucuguuuugccugaag

SEQ ID NO: 2071441 - RNA, 12 nt, Human
ucugucuucaca

SEQ ID NO: 2071442 - RNA, 14 nt, Human
ucugucuucacagc

SEQ ID NO: 2071443 - RNA, 15 nt, Human
ucugucuucacagcu

SEQ ID NO: 2071444 - RNA, 22 nt, Human
ucugucuucacagcucuguguu

SEQ ID NO: 2071445 - RNA, 12 nt, Human
ucuuaacucuuu

SEQ ID NO: 2071446 - RNA, 12 nt, Human
ucuuaagcuucc

SEQ ID NO: 2071447 - RNA, 22 nt, Human
ucuuaagaccaccucaaauuua

SEQ ID NO: 2071448 - RNA, 23 nt, Human
ucuuaagaccaccucaaauuuaa

SEQ ID NO: 2071449 - RNA, 23 nt, Human
ucuggcugauaaaagauacauuu

SEQ ID NO: 2071450 - RNA, 15 nt, Human
ucuuaaauaaaccuu

SEQ ID NO: 2071451 - RNA, 13 nt, Human
ucuuaaauaaaag

SEQ ID NO: 2071452 - RNA, 15 nt, Human
ucuuaaauaaaagaa

SEQ ID NO: 2071453 - RNA, 19 nt, Human
ucuuaaauaaaagaaaugc

SEQ ID NO: 2071454 - RNA, 22 nt, Human
ucuuaaauaaaagaaaugcaca

SEQ ID NO: 2071455 - RNA, 14 nt, Human
ucuguccuacucug

SEQ ID NO: 2071456 - RNA, 16 nt, Human
ucugguggucucugcu

SEQ ID NO: 2071457 - RNA, 15 nt, Human
ucugguuagcucagc

SEQ ID NO: 2071458 - RNA, 16 nt, Human
ucugguuagcucagcc

SEQ ID NO: 2071459 - RNA, 17 nt, Human
ucugguuagcucagccc

SEQ ID NO: 2071460 - RNA, 18 nt, Human
ucugguuagcucagcccc

SEQ ID NO: 2071461 - RNA, 22 nt, Human
ucugguuagcucagccccagcc

SEQ ID NO: 2071462 - RNA, 19 nt, Human
ucuguccuacucuguguca

SEQ ID NO: 2071463 - RNA, 15 nt, Human
ucuguccuacucugu

SEQ ID NO: 2071464 - RNA, 20 nt, Human
ucuguccuacucugugucag

SEQ ID NO: 2071465 - RNA, 21 nt, Human
ucuguccugggagugagcugg

SEQ ID NO: 2071466 - RNA, 14 nt, Human
ucugucgcccaguc

SEQ ID NO: 2071467 - RNA, 16 nt, Human
ucugucgcccagucug

SEQ ID NO: 2071468 - RNA, 19 nt, Human
ucuguccuuuuggcacuga

SEQ ID NO: 2071469 - RNA, 21 nt, Human
ucuguccuuuuggcacugaga

SEQ ID NO: 2071470 - RNA, 19 nt, Human
ucugggacccuuuccuucc

SEQ ID NO: 2071471 - RNA, 14 nt, Human
ucugggacacaguu

SEQ ID NO: 2071472 - RNA, 15 nt, Human
ucugggacccuuucc

SEQ ID NO: 2071473 - RNA, 16 nt, Human
ucugggacccuuuccu

SEQ ID NO: 2071474 - RNA, 18 nt, Human
ucuggcugaacacuggca

SEQ ID NO: 2071475 - RNA, 21 nt, Human
ucugcuggccgggcacagcug

SEQ ID NO: 2071476 - RNA, 23 nt, Human
ucugcuggccgggcacagcugug

SEQ ID NO: 2071477 - RNA, 20 nt, Human
ucugcuggcccagccaaacc

SEQ ID NO: 2071478 - RNA, 16 nt, Human
ucugcuggauaaaaug

SEQ ID NO: 2071479 - RNA, 18 nt, Human
ucugcuggauaaaaugag

SEQ ID NO: 2071480 - RNA, 22 nt, Human
ucugcuggauaaaaugagguuc

SEQ ID NO: 2071481 - RNA, 12 nt, Human
ucugcuggccca

SEQ ID NO: 2071482 - RNA, 14 nt, Human
ucugcuggcccagc

SEQ ID NO: 2071483 - RNA, 22 nt, Human
ucugcugacagacacaggcccg

SEQ ID NO: 2071484 - RNA, 21 nt, Human
ucugcugacagacacaggccc

SEQ ID NO: 2071485 - RNA, 20 nt, Human
ucugcugacagacacaggcc

SEQ ID NO: 2071486 - RNA, 19 nt, Human
ucugcugacagacacaggc

SEQ ID NO: 2071487 - RNA, 15 nt, Human
ucugcuggucuucaa

SEQ ID NO: 2071488 - RNA, 17 nt, Human
ucugcuggucuucaauu

SEQ ID NO: 2071489 - RNA, 15 nt, Human
ucuggaaugcagugg

SEQ ID NO: 2071490 - RNA, 14 nt, Human
ucuggacaggcaug

SEQ ID NO: 2071491 - RNA, 16 nt, Human
ucuggaaugcaguggu

SEQ ID NO: 2071492 - RNA, 21 nt, Human
ucuggacaggcauguucucug

SEQ ID NO: 2071493 - RNA, 17 nt, Human
ucugcugacagacacag

SEQ ID NO: 2071494 - RNA, 18 nt, Human
ucugcugacagacacagg

SEQ ID NO: 2071495 - RNA, 21 nt, Human
ucugcuccucuccccagcaag

SEQ ID NO: 2071496 - RNA, 18 nt, Human
ucugcuccucuccccagc

SEQ ID NO: 2071497 - RNA, 16 nt, Human
ucugccugcccaggcc

SEQ ID NO: 2071498 - RNA, 15 nt, Human
ucugccugcccaggc

SEQ ID NO: 2071499 - RNA, 13 nt, Human
ucugccagccaca

SEQ ID NO: 2071500 - RNA, 13 nt, Human
ucugccagccagc

SEQ ID NO: 2071501 - RNA, 15 nt, Human
ucugccagccagcag

SEQ ID NO: 2071502 - RNA, 16 nt, Human
ucugccagccagcagc

SEQ ID NO: 2071503 - RNA, 17 nt, Human
ucugccagccagcagcc

SEQ ID NO: 2071504 - RNA, 14 nt, Human
ucugccaggccccc

SEQ ID NO: 2071505 - RNA, 19 nt, Human
ucugccagccagcagccag

SEQ ID NO: 2071506 - RNA, 23 nt, Human
ucugccaggcccccaagccugca

SEQ ID NO: 2071507 - RNA, 12 nt, Human
ucugccagggag

SEQ ID NO: 2071508 - RNA, 13 nt, Human
ucugccagggagc

SEQ ID NO: 2071509 - RNA, 14 nt, Human
ucugccagggagcu

SEQ ID NO: 2071510 - RNA, 19 nt, Human
ucugccagggagcuugaaa

SEQ ID NO: 2071511 - RNA, 13 nt, Human
ucugccugcccag

SEQ ID NO: 2071512 - RNA, 14 nt, Human
ucugccugcccagg

SEQ ID NO: 2071513 - RNA, 21 nt, Human
ucucgugguaggacuguagaa

SEQ ID NO: 2071514 - RNA, 19 nt, Human
ucucgugguaggacuguag

SEQ ID NO: 2071515 - RNA, 14 nt, Human
ucucuaaccuccuu

SEQ ID NO: 2071516 - RNA, 15 nt, Human
ucucuaaccuccuuu

SEQ ID NO: 2071517 - RNA, 18 nt, Human
ucucuaacucagaaacau

SEQ ID NO: 2071518 - RNA, 20 nt, Human
ucucuaacucagaaacauca

SEQ ID NO: 2071519 - RNA, 21 nt, Human
ucucuaacucagaaacaucag

SEQ ID NO: 2071520 - RNA, 23 nt, Human
ucucuaaaugaggggccucaggu

SEQ ID NO: 2071521 - RNA, 22 nt, Human
ucucuaacucagaaacaucagu

SEQ ID NO: 2071522 - RNA, 22 nt, Human
ucucuaacuucaaggcccauau

SEQ ID NO: 2071523 - RNA, 18 nt, Human
ucucaagagggcacuggu

SEQ ID NO: 2071524 - RNA, 17 nt, Human
ucucaagagggcacugg

SEQ ID NO: 2071525 - RNA, 19 nt, Human
ucucaagagggcacuggug

SEQ ID NO: 2071526 - RNA, 20 nt, Human
ucucaagccgcaucccagac

SEQ ID NO: 2071527 - RNA, 21 nt, Human
ucucaagccgcaucccagacu

SEQ ID NO: 2071528 - RNA, 22 nt, Human
ucucaagccgcaucccagacuu

SEQ ID NO: 2071529 - RNA, 13 nt, Human
ucucaagcccugc

SEQ ID NO: 2071530 - RNA, 20 nt, Human
ucucaaggugggccuugcua

SEQ ID NO: 2071531 - RNA, 15 nt, Human
ucuccugccucagcc

SEQ ID NO: 2071532 - RNA, 17 nt, Human
ucuccugccucagccuc

SEQ ID NO: 2071533 - RNA, 19 nt, Human
ucuccugccucagccuccc

SEQ ID NO: 2071534 - RNA, 18 nt, Human
ucucaaaggguacuucca

SEQ ID NO: 2071535 - RNA, 21 nt, Human
ucuccuggaaauauuaagaaa

SEQ ID NO: 2071536 - RNA, 21 nt, Human
ucucugggcuuggggcuuccu

SEQ ID NO: 2071537 - RNA, 16 nt, Human
ucucuggcgacaguuu

SEQ ID NO: 2071538 - RNA, 17 nt, Human
ucucuggcgacaguuuu

SEQ ID NO: 2071539 - RNA, 22 nt, Human
ucucuggcgacaguuuuccuuc

SEQ ID NO: 2071540 - RNA, 17 nt, Human
ucucuggcuaaggacag

SEQ ID NO: 2071541 - RNA, 22 nt, Human
ucucuguaauaaacucauuucu

SEQ ID NO: 2071542 - RNA, 18 nt, Human
ucucuguaauaaacucau

SEQ ID NO: 2071543 - RNA, 15 nt, Human
ucucugucuaccauc

SEQ ID NO: 2071544 - RNA, 17 nt, Human
ucucugucuaccaucuc

SEQ ID NO: 2071545 - RNA, 18 nt, Human
ucucugucuaccaucucc

SEQ ID NO: 2071546 - RNA, 23 nt, Human
ucucugugaacgauuuagaaaga

SEQ ID NO: 2071547 - RNA, 22 nt, Human
ucucugugaacgauuuagaaag

SEQ ID NO: 2071548 - RNA, 18 nt, Human
ucucugugaccugccccg

SEQ ID NO: 2071549 - RNA, 16 nt, Human
ucucugugaacgauuu

SEQ ID NO: 2071550 - RNA, 14 nt, Human
ucucugaggacacu

SEQ ID NO: 2071551 - RNA, 14 nt, Human
ucucugaauccuaa

SEQ ID NO: 2071552 - RNA, 17 nt, Human
ucucugaggacacuaac

SEQ ID NO: 2071553 - RNA, 16 nt, Human
ucucuagggaaggcca

SEQ ID NO: 2071554 - RNA, 19 nt, Human
ucucuagggaaggccaccu

SEQ ID NO: 2071555 - RNA, 20 nt, Human
ucucuagggaaggccaccug

SEQ ID NO: 2071556 - RNA, 21 nt, Human
ucucuagggaaggccaccugc

SEQ ID NO: 2071557 - RNA, 22 nt, Human
ucucuagggaaggccaccugca

SEQ ID NO: 2071558 - RNA, 14 nt, Human
ucucucuccagucu

SEQ ID NO: 2071559 - RNA, 11 nt, Human
ucucucuccug

SEQ ID NO: 2071560 - RNA, 22 nt, Human
ucucucuccuguacuuuuucca

SEQ ID NO: 2071561 - RNA, 15 nt, Human
ucucugaacuucagc

SEQ ID NO: 2071562 - RNA, 16 nt, Human
ucucugaacuucagcu

SEQ ID NO: 2071563 - RNA, 22 nt, Human
ucucugaagaguggguuucaca

SEQ ID NO: 2071564 - RNA, 23 nt, Human
ucucugaagaguggguuucacaa

SEQ ID NO: 2071565 - RNA, 13 nt, Human
ucucucugccugu

SEQ ID NO: 2071566 - RNA, 15 nt, Human
ucucucugccuguga

SEQ ID NO: 2071567 - RNA, 17 nt, Human
ucucucugccugugagc

SEQ ID NO: 2071568 - RNA, 12 nt, Human
ucucucuggaaa

SEQ ID NO: 2071569 - RNA, 14 nt, Human
ucucucucuguugu

SEQ ID NO: 2071570 - RNA, 12 nt, Human
ucucucuccugu

SEQ ID NO: 2071571 - RNA, 13 nt, Human
ucucucuccuguc

SEQ ID NO: 2071572 - RNA, 13 nt, Human
ucugaaaauguau

SEQ ID NO: 2071573 - RNA, 13 nt, Human
ucugaaacuaaug

SEQ ID NO: 2071574 - RNA, 15 nt, Human
ucugaaacuaaugaa

SEQ ID NO: 2071575 - RNA, 17 nt, Human
ucugaaacuaaugaaag

SEQ ID NO: 2071576 - RNA, 23 nt, Human
ucugaaaauuccagaaaggauau

SEQ ID NO: 2071577 - RNA, 18 nt, Human
ucucuuaauuuaaucuuu

SEQ ID NO: 2071578 - RNA, 15 nt, Human
ucucuuacccuucug

SEQ ID NO: 2071579 - RNA, 18 nt, Human
ucucuuacccuucugugc

SEQ ID NO: 2071580 - RNA, 21 nt, Human
ucucuuacccuucugugccca

SEQ ID NO: 2071581 - RNA, 23 nt, Human
ucucuuacccuucugugcccagc

SEQ ID NO: 2071582 - RNA, 15 nt, Human
ucucuuauagaauau

SEQ ID NO: 2071583 - RNA, 21 nt, Human
ucucuuauagaauauuuauua

SEQ ID NO: 2071584 - RNA, 20 nt, Human
ucucuuauagaauauuuauu

SEQ ID NO: 2071585 - RNA, 18 nt, Human
ucucuuauagaauauuua

SEQ ID NO: 2071586 - RNA, 17 nt, Human
ucucuuauagaauauuu

SEQ ID NO: 2071587 - RNA, 13 nt, Human
ucugacccacugc

SEQ ID NO: 2071588 - RNA, 22 nt, Human
ucugacaggcaaugcuggcugu

SEQ ID NO: 2071589 - RNA, 21 nt, Human
ucugacaggcaaugcuggcug

SEQ ID NO: 2071590 - RNA, 12 nt, Human
ucugacaggcaa

SEQ ID NO: 2071591 - RNA, 13 nt, Human
ucugacaccuauu

SEQ ID NO: 2071592 - RNA, 20 nt, Human
ucugacaccuauuuuagaca

SEQ ID NO: 2071593 - RNA, 21 nt, Human
ucugacaccuauuuuagacaa

SEQ ID NO: 2071594 - RNA, 19 nt, Human
ucugacacacagcucuguc

SEQ ID NO: 2071595 - RNA, 18 nt, Human
ucugacacacagcucugu

SEQ ID NO: 2071596 - RNA, 17 nt, Human
ucugacacacagcucug

SEQ ID NO: 2071597 - RNA, 16 nt, Human
ucugacacacagcucu

SEQ ID NO: 2071598 - RNA, 12 nt, Human
ucugaaagccac

SEQ ID NO: 2071599 - RNA, 15 nt, Human
ucugaacacgaagcu

SEQ ID NO: 2071600 - RNA, 10 nt, Human
ucugcacaga

SEQ ID NO: 2071601 - RNA, 13 nt, Human
ucugcacagaugg

SEQ ID NO: 2071602 - RNA, 15 nt, Human
ucugcacagauggau

SEQ ID NO: 2071603 - RNA, 20 nt, Human
ucugcaagaauugaagcagg

SEQ ID NO: 2071604 - RNA, 21 nt, Human
ucugcaagaauugaagcagga

SEQ ID NO: 2071605 - RNA, 19 nt, Human
ucugaggcucuuucugggc

SEQ ID NO: 2071606 - RNA, 23 nt, Human
ucugaggccuccucucucaguuu

SEQ ID NO: 2071607 - RNA, 21 nt, Human
ucugcaaauagaaaacaggaa

SEQ ID NO: 2071608 - RNA, 21 nt, Human
ucugaggcucuuucugggcca

SEQ ID NO: 2071609 - RNA, 22 nt, Human
ucugaggagaaacaaauaagac

SEQ ID NO: 2071610 - RNA, 18 nt, Human
ucugaccauuucaggggu

SEQ ID NO: 2071611 - RNA, 14 nt, Human
ucugaccauuucag

SEQ ID NO: 2071612 - RNA, 23 nt, Human
ucugaggaauccagacccggcug

SEQ ID NO: 2071613 - RNA, 15 nt, Human
ucugacccacugcuu

SEQ ID NO: 2071614 - RNA, 14 nt, Human
ucugacccacugcu

SEQ ID NO: 2071615 - RNA, 16 nt, Human
ucugcaucaucuguag

SEQ ID NO: 2071616 - RNA, 18 nt, Human
ucugcaucaucuguagau

SEQ ID NO: 2071617 - RNA, 19 nt, Human
ucugcaucaucuguagaua

SEQ ID NO: 2071618 - RNA, 21 nt, Human
ucugcaucaucuguagauacu

SEQ ID NO: 2071619 - RNA, 14 nt, Human
ucugccaccucccc

SEQ ID NO: 2071620 - RNA, 15 nt, Human
ucugccaccuccccu

SEQ ID NO: 2071621 - RNA, 20 nt, Human
ucugccaccuccccuaucca

SEQ ID NO: 2071622 - RNA, 23 nt, Human
ucugccaccuccccuauccaccc

SEQ ID NO: 2071623 - RNA, 17 nt, Human
ucugcauucaggaucaa

SEQ ID NO: 2071624 - RNA, 10 nt, Human
ucugcauuua

SEQ ID NO: 2071625 - RNA, 13 nt, Human
ucugcauuuagca

SEQ ID NO: 2071626 - RNA, 14 nt, Human
ucugcauuuagcac

SEQ ID NO: 2071627 - RNA, 15 nt, Human
ucugcauuuagcaca

SEQ ID NO: 2071628 - RNA, 17 nt, Human
ucugcauuuucacccca

SEQ ID NO: 2071629 - RNA, 21 nt, Human
ucugcauuuucaccccacccu

SEQ ID NO: 2071630 - RNA, 19 nt, Human
ucugcauuuucugaaacua

SEQ ID NO: 2071631 - RNA, 20 nt, Human
ucugcauuuucugaaacuaa

SEQ ID NO: 2071632 - RNA, 21 nt, Human
ucugcauuuucugaaacuaau

SEQ ID NO: 2071633 - RNA, 16 nt, Human
ucugcauuuucugggu

SEQ ID NO: 2071634 - RNA, 16 nt, Human
ucgagguuucucaaag

SEQ ID NO: 2071635 - RNA, 22 nt, Human
ucgagguuucucaaagaaauuu

SEQ ID NO: 2071636 - RNA, 23 nt, Human
ucgagguagguggaucaccugag

SEQ ID NO: 2071637 - RNA, 16 nt, Human
ucgaacuccugggcuc

SEQ ID NO: 2071638 - RNA, 19 nt, Human
ucgugcagcauaugaggau

SEQ ID NO: 2071639 - RNA, 20 nt, Human
ucgugccguuacucuccaac

SEQ ID NO: 2071640 - RNA, 18 nt, Human
ucgugcuaaauuuucagu

SEQ ID NO: 2071641 - RNA, 23 nt, Human
ucgugccguuacucuccaaccug

SEQ ID NO: 2071642 - RNA, 22 nt, Human
ucguggcagauaaucagccucu

SEQ ID NO: 2071643 - RNA, 23 nt, Human
ucguggcagauaaucagccucuu

SEQ ID NO: 2071644 - RNA, 14 nt, Human
ucgugcuuuaagug

SEQ ID NO: 2071645 - RNA, 23 nt, Human
ucguggaaagggugcugcuuccc

SEQ ID NO: 2071646 - RNA, 24 nt, Human
ucguggaaagggugcugcuucccu

SEQ ID NO: 2071647 - RNA, 20 nt, Human
ucguggccuuccccagccuc

SEQ ID NO: 2071648 - RNA, 13 nt, Human
ucuaauagugcuu

SEQ ID NO: 2071649 - RNA, 18 nt, Human
ucuaaccagagcaagcuu

SEQ ID NO: 2071650 - RNA, 19 nt, Human
ucuaaccagagcaagcuuu

SEQ ID NO: 2071651 - RNA, 16 nt, Human
ucuaaccacacagccu

SEQ ID NO: 2071652 - RNA, 18 nt, Human
ucuaaccacacagccuac

SEQ ID NO: 2071653 - RNA, 22 nt, Human
ucuaauagaacucaguuuuaac

SEQ ID NO: 2071654 - RNA, 20 nt, Human
ucuaauagcgaggcucuaac

SEQ ID NO: 2071655 - RNA, 22 nt, Human
ucuaauagcgaggcucuaacca

SEQ ID NO: 2071656 - RNA, 16 nt, Human
ucuaacaggggcuggu

SEQ ID NO: 2071657 - RNA, 18 nt, Human
ucuaacaggggcuggugg

SEQ ID NO: 2071658 - RNA, 24 nt, Human
ucuaacaggggcuggugggcacca

SEQ ID NO: 2071659 - RNA, 23 nt, Human
ucuaacauuugagucccuuccag

SEQ ID NO: 2071660 - RNA, 14 nt, Human
ucuaaccaaaugca

SEQ ID NO: 2071661 - RNA, 15 nt, Human
ucuaaccaaaugcau

SEQ ID NO: 2071662 - RNA, 16 nt, Human
ucuaaccaaaugcauc

SEQ ID NO: 2071663 - RNA, 20 nt, Human
ucuaacacuagucugugugc

SEQ ID NO: 2071664 - RNA, 13 nt, Human
ucuaaauauuucc

SEQ ID NO: 2071665 - RNA, 12 nt, Human
ucguuaacauug

SEQ ID NO: 2071666 - RNA, 14 nt, Human
ucguuaacauugac

SEQ ID NO: 2071667 - RNA, 17 nt, Human
ucguuaacauugaccaa

SEQ ID NO: 2071668 - RNA, 14 nt, Human
ucguuaacugugua

SEQ ID NO: 2071669 - RNA, 15 nt, Human
ucguuaacuguguau

SEQ ID NO: 2071670 - RNA, 21 nt, Human
ucguuaacuguguauguacau

SEQ ID NO: 2071671 - RNA, 22 nt, Human
ucguuaacuguguauguacaua

SEQ ID NO: 2071672 - RNA, 15 nt, Human
ucuaaauaaaauaua

SEQ ID NO: 2071673 - RNA, 17 nt, Human
ucuaaauaaaauauaau

SEQ ID NO: 2071674 - RNA, 17 nt, Human
ucguuagggaagagaaa

SEQ ID NO: 2071675 - RNA, 20 nt, Human
ucguuagggaagagaaacag

SEQ ID NO: 2071676 - RNA, 21 nt, Human
ucguuagggaagagaaacagg

SEQ ID NO: 2071677 - RNA, 23 nt, Human
ucuaaauauuuccuuaaacugug

SEQ ID NO: 2071678 - RNA, 17 nt, Human
ucgugugcaacagacaa

SEQ ID NO: 2071679 - RNA, 19 nt, Human
ucgugugcaacagacaagu

SEQ ID NO: 2071680 - RNA, 19 nt, Human
ucguggccuuccccagccu

SEQ ID NO: 2071681 - RNA, 19 nt, Human
ucucaaagaaauuuccacu

SEQ ID NO: 2071682 - RNA, 21 nt, Human
ucucaaagaaauuuccacuca

SEQ ID NO: 2071683 - RNA, 22 nt, Human
ucucaaagaaauuuccacucag

SEQ ID NO: 2071684 - RNA, 17 nt, Human
ucucaaauaacuaaaag

SEQ ID NO: 2071685 - RNA, 15 nt, Human
ucuaugcucauaacu

SEQ ID NO: 2071686 - RNA, 18 nt, Human
ucuaugcucauaacugug

SEQ ID NO: 2071687 - RNA, 14 nt, Human
ucuaugccagcuca

SEQ ID NO: 2071688 - RNA, 19 nt, Human
ucuagugcagcugauuuua

SEQ ID NO: 2071689 - RNA, 16 nt, Human
ucuagugcagcugauu

SEQ ID NO: 2071690 - RNA, 14 nt, Human
ucuaaugugugaau

SEQ ID NO: 2071691 - RNA, 14 nt, Human
ucuaauauguaaca

SEQ ID NO: 2071692 - RNA, 22 nt, Human
ucuacuuuagaaugagagugug

SEQ ID NO: 2071693 - RNA, 11 nt, Human
ucuaauucuaa

SEQ ID NO: 2071694 - RNA, 12 nt, Human
ucuaauucuaac

SEQ ID NO: 2071695 - RNA, 13 nt, Human
ucuaauucuaacc

SEQ ID NO: 2071696 - RNA, 21 nt, Human
ucuaauucuaaccagagcaag

SEQ ID NO: 2071697 - RNA, 20 nt, Human
ucuaauucuaaggaauauga

SEQ ID NO: 2071698 - RNA, 18 nt, Human
ucuaauucccauuuugca

SEQ ID NO: 2071699 - RNA, 19 nt, Human
ucuaauucccauuuugcaa

SEQ ID NO: 2071700 - RNA, 21 nt, Human
ucuaauucccauuuugcaaaa

SEQ ID NO: 2071701 - RNA, 22 nt, Human
ucuaauucccauuuugcaaaau

SEQ ID NO: 2071702 - RNA, 14 nt, Human
ucuagugcagcuga

SEQ ID NO: 2071703 - RNA, 17 nt, Human
ucuaggagcugggagga

SEQ ID NO: 2071704 - RNA, 18 nt, Human
ucuaggagcugggaggaa

SEQ ID NO: 2071705 - RNA, 20 nt, Human
ucuaggagcugggaggaaaa

SEQ ID NO: 2071706 - RNA, 21 nt, Human
ucuaggagcugggaggaaaag

SEQ ID NO: 2071707 - RNA, 16 nt, Human
ucuaggagcugggagg

SEQ ID NO: 2071708 - RNA, 14 nt, Human
uccugccucagccu

SEQ ID NO: 2071709 - RNA, 19 nt, Human
uccuggcacccggccccug

SEQ ID NO: 2071710 - RNA, 16 nt, Human
uccuggcacccggccc

SEQ ID NO: 2071711 - RNA, 14 nt, Human
uccuggcacccggc

SEQ ID NO: 2071712 - RNA, 15 nt, Human
uccugccucagccuc

SEQ ID NO: 2071713 - RNA, 13 nt, Human
uccugccucagcc

SEQ ID NO: 2071714 - RNA, 16 nt, Human
uccugccucagccucc

SEQ ID NO: 2071715 - RNA, 17 nt, Human
uccugccucagccuccc

SEQ ID NO: 2071716 - RNA, 22 nt, Human
uccuggcacccggccccugcug

SEQ ID NO: 2071717 - RNA, 21 nt, Human
uccuggcacccggccccugcu

SEQ ID NO: 2071718 - RNA, 20 nt, Human
uccuggcacccggccccugc

SEQ ID NO: 2071719 - RNA, 23 nt, Human
uccuggcaauaguguguucugau

SEQ ID NO: 2071720 - RNA, 21 nt, Human
uccuggcaauaguguguucug

SEQ ID NO: 2071721 - RNA, 22 nt, Human
uccuggcaauaguguguucuga

SEQ ID NO: 2071722 - RNA, 11 nt, Human
uccugccuacu

SEQ ID NO: 2071723 - RNA, 20 nt, Human
uccuggcaauaguguguucu

SEQ ID NO: 2071724 - RNA, 13 nt, Human
uccuguccgcccu

SEQ ID NO: 2071725 - RNA, 15 nt, Human
uccuguccgcccucu

SEQ ID NO: 2071726 - RNA, 19 nt, Human
uccuguccgcccucuuccc

SEQ ID NO: 2071727 - RNA, 22 nt, Human
uccuguccgcccucuuccccuc

SEQ ID NO: 2071728 - RNA, 16 nt, Human
uccuguacacugaaua

SEQ ID NO: 2071729 - RNA, 17 nt, Human
uccuguacacugaauau

SEQ ID NO: 2071730 - RNA, 16 nt, Human
uccuguccucagcuuc

SEQ ID NO: 2071731 - RNA, 21 nt, Human
uccuguacacugaauauuuau

SEQ ID NO: 2071732 - RNA, 22 nt, Human
uccuguccuucucucaccuccu

SEQ ID NO: 2071733 - RNA, 19 nt, Human
uccugucggagcccugucu

SEQ ID NO: 2071734 - RNA, 22 nt, Human
uccugucggagcccugucuccu

SEQ ID NO: 2071735 - RNA, 13 nt, Human
uccuugauaacag

SEQ ID NO: 2071736 - RNA, 14 nt, Human
uccuugauaacagc

SEQ ID NO: 2071737 - RNA, 15 nt, Human
uccuugauaacagcu

SEQ ID NO: 2071738 - RNA, 12 nt, Human
uccuugauaaug

SEQ ID NO: 2071739 - RNA, 22 nt, Human
uccuugauaauguugugguuug

SEQ ID NO: 2071740 - RNA, 13 nt, Human
uccuugaccagca

SEQ ID NO: 2071741 - RNA, 21 nt, Human
uccuugaccagcagaucccag

SEQ ID NO: 2071742 - RNA, 14 nt, Human
uccuucacauccug

SEQ ID NO: 2071743 - RNA, 20 nt, Human
uccuucacauccuguguuuc

SEQ ID NO: 2071744 - RNA, 20 nt, Human
uccuuggcaucacagggcag

SEQ ID NO: 2071745 - RNA, 15 nt, Human
uccuuggcaugccuu

SEQ ID NO: 2071746 - RNA, 17 nt, Human
uccuuggcaugccuucc

SEQ ID NO: 2071747 - RNA, 18 nt, Human
uccuuggcaugccuucca

SEQ ID NO: 2071748 - RNA, 20 nt, Human
uccuuggcaugccuuccagc

SEQ ID NO: 2071749 - RNA, 19 nt, Human
uccuuuuaaaacacuucca

SEQ ID NO: 2071750 - RNA, 19 nt, Human
uccuuuguuuuuuuuuccu

SEQ ID NO: 2071751 - RNA, 23 nt, Human
uccuuuguuuuuuuuuccugucc

SEQ ID NO: 2071752 - RNA, 15 nt, Human
uccuuuguuuuuaug

SEQ ID NO: 2071753 - RNA, 13 nt, Human
uccuuuuagccua

SEQ ID NO: 2071754 - RNA, 16 nt, Human
ucgaggcugcagucag

SEQ ID NO: 2071755 - RNA, 20 nt, Human
ucgaggcugcagucagucau

SEQ ID NO: 2071756 - RNA, 13 nt, Human
ucgaacccacacu

SEQ ID NO: 2071757 - RNA, 17 nt, Human
ucgaacccacacugcaa

SEQ ID NO: 2071758 - RNA, 19 nt, Human
ucgaacccacacugcaaca

SEQ ID NO: 2071759 - RNA, 18 nt, Human
uccuuuucgcaggauucu

SEQ ID NO: 2071760 - RNA, 15 nt, Human
uccuuuuagccuagu

SEQ ID NO: 2071761 - RNA, 14 nt, Human
uccuuuuagccuag

SEQ ID NO: 2071762 - RNA, 16 nt, Human
ucccguggaacguuuu

SEQ ID NO: 2071763 - RNA, 22 nt, Human
ucccguggaacguuuuuccugu

SEQ ID NO: 2071764 - RNA, 23 nt, Human
ucccguggaacguuuuuccuguu

SEQ ID NO: 2071765 - RNA, 22 nt, Human
ucccgugcaaaacaugcuaccu

SEQ ID NO: 2071766 - RNA, 14 nt, Human
ucccggggcuccac

SEQ ID NO: 2071767 - RNA, 13 nt, Human
uccccuucacucc

SEQ ID NO: 2071768 - RNA, 21 nt, Human
ucccgggacucacuggcagcc

SEQ ID NO: 2071769 - RNA, 22 nt, Human
ucccgggacucacuggcagccc

SEQ ID NO: 2071770 - RNA, 17 nt, Human
uccagguuuaagcuguu

SEQ ID NO: 2071771 - RNA, 18 nt, Human
uccagguuuaagcuguua

SEQ ID NO: 2071772 - RNA, 15 nt, Human
ucccuccucuguccc

SEQ ID NO: 2071773 - RNA, 14 nt, Human
ucccuccugcuacu

SEQ ID NO: 2071774 - RNA, 16 nt, Human
ucccucuaauuuaucu

SEQ ID NO: 2071775 - RNA, 14 nt, Human
ucccucuaauuuau

SEQ ID NO: 2071776 - RNA, 22 nt, Human
ucccucgcugcacaaauacucc

SEQ ID NO: 2071777 - RNA, 19 nt, Human
ucccucgcugcacaaauac

SEQ ID NO: 2071778 - RNA, 17 nt, Human
ucccucgaacccacacu

SEQ ID NO: 2071779 - RNA, 20 nt, Human
ucccucgaacccacacugca

SEQ ID NO: 2071780 - RNA, 16 nt, Human
ucccuauuagagaaga

SEQ ID NO: 2071781 - RNA, 14 nt, Human
ucccuccucaccuc

SEQ ID NO: 2071782 - RNA, 16 nt, Human
ucccuccucaccucug

SEQ ID NO: 2071783 - RNA, 17 nt, Human
ucccuccucaccucugg

SEQ ID NO: 2071784 - RNA, 18 nt, Human
ucccuccucaccucugga

SEQ ID NO: 2071785 - RNA, 18 nt, Human
ucccuagucuucaagcag

SEQ ID NO: 2071786 - RNA, 20 nt, Human
ucccuaucacugaagcuuuu

SEQ ID NO: 2071787 - RNA, 21 nt, Human
ucccuaucacugaagcuuuuu

SEQ ID NO: 2071788 - RNA, 18 nt, Human
ucccuaaaaacacagaca

SEQ ID NO: 2071789 - RNA, 16 nt, Human
ucccuaguaaaaauac

SEQ ID NO: 2071790 - RNA, 14 nt, Human
ucccuagggcuggg

SEQ ID NO: 2071791 - RNA, 15 nt, Human
ucccuagggcugggu

SEQ ID NO: 2071792 - RNA, 13 nt, Human
ucccuaccaccuc

SEQ ID NO: 2071793 - RNA, 15 nt, Human
ucccuaggagaccaa

SEQ ID NO: 2071794 - RNA, 20 nt, Human
ucccuaauuuaacccagcuc

SEQ ID NO: 2071795 - RNA, 13 nt, Human
ucccugcacuugc

SEQ ID NO: 2071796 - RNA, 19 nt, Human
ucccugccccucccuucaa

SEQ ID NO: 2071797 - RNA, 14 nt, Human
ucccugcacuugca

SEQ ID NO: 2071798 - RNA, 12 nt, Human
ucccucucucug

SEQ ID NO: 2071799 - RNA, 22 nt, Human
ucccucucggaaggcuggcugg

SEQ ID NO: 2071800 - RNA, 23 nt, Human
ucccucucggaaggcuggcuggg

SEQ ID NO: 2071801 - RNA, 12 nt, Human
ucccucucccug

SEQ ID NO: 2071802 - RNA, 16 nt, Human
ucccuauaaugcugga

SEQ ID NO: 2071803 - RNA, 13 nt, Human
ucccucuccugcc

SEQ ID NO: 2071804 - RNA, 14 nt, Human
ucccucuccugccu

SEQ ID NO: 2071805 - RNA, 15 nt, Human
ucccucuccugccua

SEQ ID NO: 2071806 - RNA, 12 nt, Human
ucccucucggaa

SEQ ID NO: 2071807 - RNA, 16 nt, Human
ucccucuccugccuac

SEQ ID NO: 2071808 - RNA, 14 nt, Human
ucccucucucugga

SEQ ID NO: 2071809 - RNA, 16 nt, Human
ucccucucucuggaaa

SEQ ID NO: 2071810 - RNA, 12 nt, Human
ucccucucucuu

SEQ ID NO: 2071811 - RNA, 16 nt, Human
ucccucucucuucugc

SEQ ID NO: 2071812 - RNA, 18 nt, Human
ucccucucucuucugcuc

SEQ ID NO: 2071813 - RNA, 19 nt, Human
ucccucucucuucugcucc

SEQ ID NO: 2071814 - RNA, 20 nt, Human
ucccucucucuucugcucca

SEQ ID NO: 2071815 - RNA, 18 nt, Human
ucccuggaaggacaucca

SEQ ID NO: 2071816 - RNA, 11 nt, Human
ucccuggacca

SEQ ID NO: 2071817 - RNA, 17 nt, Human
ucccuggaccagaugcu

SEQ ID NO: 2071818 - RNA, 18 nt, Human
ucccuggaccagaugcug

SEQ ID NO: 2071819 - RNA, 19 nt, Human
ucccuggaccagaugcuga

SEQ ID NO: 2071820 - RNA, 20 nt, Human
ucccugccccucccuucaac

SEQ ID NO: 2071821 - RNA, 14 nt, Human
ucccugccgccuca

SEQ ID NO: 2071822 - RNA, 14 nt, Human
ucccuggccuguuc

SEQ ID NO: 2071823 - RNA, 18 nt, Human
ucccuggccuguucuguu

SEQ ID NO: 2071824 - RNA, 13 nt, Human
ucccuggccuguu

SEQ ID NO: 2071825 - RNA, 14 nt, Human
ucccuggccaucuc

SEQ ID NO: 2071826 - RNA, 15 nt, Human
ucccuggccaucucu

SEQ ID NO: 2071827 - RNA, 16 nt, Human
ucccuggccaucucug

SEQ ID NO: 2071828 - RNA, 21 nt, Human
ucccuggagccuccacugccu

SEQ ID NO: 2071829 - RNA, 20 nt, Human
uccgaccacuaauugccaag

SEQ ID NO: 2071830 - RNA, 21 nt, Human
uccgacaaccgaugcuccagc

SEQ ID NO: 2071831 - RNA, 22 nt, Human
uccgacaaccgaugcuccagcc

SEQ ID NO: 2071832 - RNA, 23 nt, Human
uccgacaaccgaugcuccagcca

SEQ ID NO: 2071833 - RNA, 20 nt, Human
uccgacaaccgaugcuccag

SEQ ID NO: 2071834 - RNA, 21 nt, Human
uccgaaguaugagggaaaaug

SEQ ID NO: 2071835 - RNA, 19 nt, Human
ucccuugagaccucagcca

SEQ ID NO: 2071836 - RNA, 14 nt, Human
ucccuugagcccuc

SEQ ID NO: 2071837 - RNA, 16 nt, Human
ucccuucuacugcuuc

SEQ ID NO: 2071838 - RNA, 17 nt, Human
ucccuucuacugcuucu

SEQ ID NO: 2071839 - RNA, 19 nt, Human
ucccuucuacugcuucuac

SEQ ID NO: 2071840 - RNA, 13 nt, Human
ucccuucuccuuc

SEQ ID NO: 2071841 - RNA, 20 nt, Human
ucccuucuccuugauaacag

SEQ ID NO: 2071842 - RNA, 21 nt, Human
ucccuucuccuugauaacagc

SEQ ID NO: 2071843 - RNA, 23 nt, Human
ucccugccucaccucugccauuu

SEQ ID NO: 2071844 - RNA, 18 nt, Human
ucccuugagaccucagcc

SEQ ID NO: 2071845 - RNA, 21 nt, Human
uccuauauuguuuucagugua

SEQ ID NO: 2071846 - RNA, 18 nt, Human
uccuauauaguuuauuga

SEQ ID NO: 2071847 - RNA, 17 nt, Human
uccucauuagcauuuug

SEQ ID NO: 2071848 - RNA, 20 nt, Human
uccuauaauucccuaucuuu

SEQ ID NO: 2071849 - RNA, 20 nt, Human
uccuauaauauaauaaauau

SEQ ID NO: 2071850 - RNA, 15 nt, Human
uccuauauaguuuau

SEQ ID NO: 2071851 - RNA, 18 nt, Human
uccuauauuguuuucagu

SEQ ID NO: 2071852 - RNA, 16 nt, Human
uccuaguucuucaucc

SEQ ID NO: 2071853 - RNA, 14 nt, Human
uccuaaucauccaa

SEQ ID NO: 2071854 - RNA, 15 nt, Human
uccuaaucauccaau

SEQ ID NO: 2071855 - RNA, 22 nt, Human
uccuaaugaaugcauaaaaugu

SEQ ID NO: 2071856 - RNA, 15 nt, Human
uccuacaaagauguu

SEQ ID NO: 2071857 - RNA, 14 nt, Human
uccuaccaaccucu

SEQ ID NO: 2071858 - RNA, 14 nt, Human
uccuacaaagaugu

SEQ ID NO: 2071859 - RNA, 18 nt, Human
uccuacaagagcagccug

SEQ ID NO: 2071860 - RNA, 18 nt, Human
uccuacccacccuccuuu

SEQ ID NO: 2071861 - RNA, 17 nt, Human
uccgaccagacaccuug

SEQ ID NO: 2071862 - RNA, 13 nt, Human
uccgaccagacac

SEQ ID NO: 2071863 - RNA, 20 nt, Human
uccuaaguucuuagauaucu

SEQ ID NO: 2071864 - RNA, 22 nt, Human
uccuaaguucuuagauaucuuu

SEQ ID NO: 2071865 - RNA, 14 nt, Human
uccuccagaagccu

SEQ ID NO: 2071866 - RNA, 16 nt, Human
uccuccagaagccucu

SEQ ID NO: 2071867 - RNA, 18 nt, Human
uccuccagaagccucugg

SEQ ID NO: 2071868 - RNA, 19 nt, Human
uccuccagaagccucuggc

SEQ ID NO: 2071869 - RNA, 20 nt, Human
uccuccagaagccucuggcu

SEQ ID NO: 2071870 - RNA, 21 nt, Human
uccuccagaagccucuggcua

SEQ ID NO: 2071871 - RNA, 22 nt, Human
uccuccagaagccucuggcuag

SEQ ID NO: 2071872 - RNA, 18 nt, Human
uccucuacuuaaugagau

SEQ ID NO: 2071873 - RNA, 19 nt, Human
uccucuacuuaaugagaua

SEQ ID NO: 2071874 - RNA, 21 nt, Human
uccucuaacaggggcuggugg

SEQ ID NO: 2071875 - RNA, 22 nt, Human
uccucuaacaggggcugguggg

SEQ ID NO: 2071876 - RNA, 16 nt, Human
uccucggaucaccgag

SEQ ID NO: 2071877 - RNA, 19 nt, Human
uccucggaucaccgagagu

SEQ ID NO: 2071878 - RNA, 19 nt, Human
uccuccuugucuuggcagc

SEQ ID NO: 2071879 - RNA, 13 nt, Human
uccucgcccuggg

SEQ ID NO: 2071880 - RNA, 14 nt, Human
uccucgcccugggu

SEQ ID NO: 2071881 - RNA, 16 nt, Human
ugguuuuucaguuuuc

SEQ ID NO: 2071882 - RNA, 23 nt, Human
ugguuuuuaaaaaacugcugacu

SEQ ID NO: 2071883 - RNA, 23 nt, Human
ugguugucauuuuugcaguagag

SEQ ID NO: 2071884 - RNA, 21 nt, Human
ugguuuuuaaaaaacugcuga

SEQ ID NO: 2071885 - RNA, 18 nt, Human
ugguuuucuuuugccaug

SEQ ID NO: 2071886 - RNA, 19 nt, Human
ugguuuucuuuugccauga

SEQ ID NO: 2071887 - RNA, 22 nt, Human
ugguugaguucagguagcugcc

SEQ ID NO: 2071888 - RNA, 15 nt, Human
ugguuggguccucac

SEQ ID NO: 2071889 - RNA, 14 nt, Human
uguaaaaugaaauu

SEQ ID NO: 2071890 - RNA, 15 nt, Human
uguaaaaugaaauua

SEQ ID NO: 2071891 - RNA, 22 nt, Human
uguaaaaucuuggcacagaaac

SEQ ID NO: 2071892 - RNA, 21 nt, Human
uguaaaaucuuggcacagaaa

SEQ ID NO: 2071893 - RNA, 18 nt, Human
uguaaacugcauuagaaa

SEQ ID NO: 2071894 - RNA, 14 nt, Human
uguaaaauaaaauu

SEQ ID NO: 2071895 - RNA, 15 nt, Human
uguaaaacugaggca

SEQ ID NO: 2071896 - RNA, 16 nt, Human
uguaaaacugaggcac

SEQ ID NO: 2071897 - RNA, 11 nt, Human
uguaaaaauga

SEQ ID NO: 2071898 - RNA, 14 nt, Human
uguaaaaaugagaa

SEQ ID NO: 2071899 - RNA, 17 nt, Human
uguaaaaaugagaacau

SEQ ID NO: 2071900 - RNA, 11 nt, Human
uguaaaacaaa

SEQ ID NO: 2071901 - RNA, 13 nt, Human
uguaaaacaaaaa

SEQ ID NO: 2071902 - RNA, 15 nt, Human
uguaaaacaaaaaac

SEQ ID NO: 2071903 - RNA, 16 nt, Human
uguaaaacaaaaaaca

SEQ ID NO: 2071904 - RNA, 19 nt, Human
uguaaaaacagcauugcuu

SEQ ID NO: 2071905 - RNA, 20 nt, Human
uguaaaaacagcauugcuuu

SEQ ID NO: 2071906 - RNA, 22 nt, Human
uguaaaaacagcauugcuuucu

SEQ ID NO: 2071907 - RNA, 23 nt, Human
uguaaaaacagcauugcuuucug

SEQ ID NO: 2071908 - RNA, 24 nt, Human
uguaaaaacagcauugcuuucuga

SEQ ID NO: 2071909 - RNA, 14 nt, Human
uguaaaaacugugg

SEQ ID NO: 2071910 - RNA, 12 nt, Human
uguaaaacuuua

SEQ ID NO: 2071911 - RNA, 13 nt, Human
uguaaaacuuuau

SEQ ID NO: 2071912 - RNA, 14 nt, Human
uguaaaacuuuauu

SEQ ID NO: 2071913 - RNA, 16 nt, Human
uguaaaacuuuauuuu

SEQ ID NO: 2071914 - RNA, 18 nt, Human
uguaaaacuuuauuuuau

SEQ ID NO: 2071915 - RNA, 23 nt, Human
uguaaaacuuuauuuuauauaau

SEQ ID NO: 2071916 - RNA, 17 nt, Human
uguacagaaucauugcu

SEQ ID NO: 2071917 - RNA, 18 nt, Human
uguacagaauucugcuac

SEQ ID NO: 2071918 - RNA, 21 nt, Human
uguacagaauucugcuaccuc

SEQ ID NO: 2071919 - RNA, 17 nt, Human
uguacagacguaugcuu

SEQ ID NO: 2071920 - RNA, 18 nt, Human
uguacagacguaugcuua

SEQ ID NO: 2071921 - RNA, 19 nt, Human
uguacagacguaugcuuau

SEQ ID NO: 2071922 - RNA, 20 nt, Human
uguacagacguaugcuuauu

SEQ ID NO: 2071923 - RNA, 22 nt, Human
uguacacaugggaguuuagugu

SEQ ID NO: 2071924 - RNA, 17 nt, Human
uguacaaccugugauca

SEQ ID NO: 2071925 - RNA, 12 nt, Human
uguacacugaau

SEQ ID NO: 2071926 - RNA, 14 nt, Human
uguacacugaauau

SEQ ID NO: 2071927 - RNA, 15 nt, Human
uguacacugaauauu

SEQ ID NO: 2071928 - RNA, 16 nt, Human
uguacacugaauauuu

SEQ ID NO: 2071929 - RNA, 17 nt, Human
uguacacugaauauuua

SEQ ID NO: 2071930 - RNA, 19 nt, Human
uguacacugaauauuuaua

SEQ ID NO: 2071931 - RNA, 21 nt, Human
uguacacugaauauuuauauu

SEQ ID NO: 2071932 - RNA, 20 nt, Human
uguacacugaauauuuauau

SEQ ID NO: 2071933 - RNA, 20 nt, Human
uguaacauccaauaggaaug

SEQ ID NO: 2071934 - RNA, 13 nt, Human
uguaauaauguga

SEQ ID NO: 2071935 - RNA, 14 nt, Human
uguaacauaugcaa

SEQ ID NO: 2071936 - RNA, 15 nt, Human
uguaacauaugcaaa

SEQ ID NO: 2071937 - RNA, 16 nt, Human
uguaacauaugcaaac

SEQ ID NO: 2071938 - RNA, 22 nt, Human
uguaacaggucuccucuuaaaa

SEQ ID NO: 2071939 - RNA, 11 nt, Human
uguaacagcug

SEQ ID NO: 2071940 - RNA, 14 nt, Human
uguaacagcugagg

SEQ ID NO: 2071941 - RNA, 15 nt, Human
uguaacagcugaggu

SEQ ID NO: 2071942 - RNA, 18 nt, Human
uguaacaggucuccucuu

SEQ ID NO: 2071943 - RNA, 20 nt, Human
uguaacaggucuccucuuaa

SEQ ID NO: 2071944 - RNA, 21 nt, Human
uguaacaggucuccucuuaaa

SEQ ID NO: 2071945 - RNA, 11 nt, Human
uguaacacugu

SEQ ID NO: 2071946 - RNA, 13 nt, Human
uguaacaagaaag

SEQ ID NO: 2071947 - RNA, 14 nt, Human
uguaacaagaaagg

SEQ ID NO: 2071948 - RNA, 15 nt, Human
uguaacaagaaagga

SEQ ID NO: 2071949 - RNA, 17 nt, Human
uguaacaagaaaggaga

SEQ ID NO: 2071950 - RNA, 18 nt, Human
uguaacaagaaaggagag

SEQ ID NO: 2071951 - RNA, 17 nt, Human
uguaacaagccacccca

SEQ ID NO: 2071952 - RNA, 11 nt, Human
uguaacacaag

SEQ ID NO: 2071953 - RNA, 15 nt, Human
uguaacaagaaaaca

SEQ ID NO: 2071954 - RNA, 14 nt, Human
uguaacaagccacc

SEQ ID NO: 2071955 - RNA, 18 nt, Human
uguaaacuguacuagucu

SEQ ID NO: 2071956 - RNA, 19 nt, Human
uguaaacuguacuagucug

SEQ ID NO: 2071957 - RNA, 21 nt, Human
uguaaacuguacuagucugug

SEQ ID NO: 2071958 - RNA, 22 nt, Human
uguaaacuguacuagucugugu

SEQ ID NO: 2071959 - RNA, 23 nt, Human
uguaaacuguacuagucugugug

SEQ ID NO: 2071960 - RNA, 20 nt, Human
ugguggggcugccaggggag

SEQ ID NO: 2071961 - RNA, 15 nt, Human
uggugggugaaagaa

SEQ ID NO: 2071962 - RNA, 21 nt, Human
uggugggugaaagaaaucaug

SEQ ID NO: 2071963 - RNA, 19 nt, Human
ugguggguucaggggacuc

SEQ ID NO: 2071964 - RNA, 21 nt, Human
ugguggguucaggggacucag

SEQ ID NO: 2071965 - RNA, 15 nt, Human
uggugguaucugagu

SEQ ID NO: 2071966 - RNA, 17 nt, Human
uggugggcaccaagagc

SEQ ID NO: 2071967 - RNA, 23 nt, Human
ugguguaaccugagauggcccuc

SEQ ID NO: 2071968 - RNA, 21 nt, Human
ugguggcccgacagccuggca

SEQ ID NO: 2071969 - RNA, 21 nt, Human
ugguggccucugccccgucuc

SEQ ID NO: 2071970 - RNA, 16 nt, Human
ugguggcgcaagccug

SEQ ID NO: 2071971 - RNA, 13 nt, Human
ugguggcuggguu

SEQ ID NO: 2071972 - RNA, 17 nt, Human
ugguggcgcaagccugu

SEQ ID NO: 2071973 - RNA, 21 nt, Human
uggugggaagcgucuguccgu

SEQ ID NO: 2071974 - RNA, 16 nt, Human
uggugggggccucggu

SEQ ID NO: 2071975 - RNA, 18 nt, Human
uggugggggccucggugu

SEQ ID NO: 2071976 - RNA, 23 nt, Human
uggguacuuguggacacagcucu

SEQ ID NO: 2071977 - RNA, 20 nt, Human
uggguacuuguggacacagc

SEQ ID NO: 2071978 - RNA, 21 nt, Human
uggguagaaagagauacagag

SEQ ID NO: 2071979 - RNA, 19 nt, Human
ugggguugcaucagaaaug

SEQ ID NO: 2071980 - RNA, 18 nt, Human
ugggguuggcugggccca

SEQ ID NO: 2071981 - RNA, 21 nt, Human
ugggguuggcugggcccagaa

SEQ ID NO: 2071982 - RNA, 22 nt, Human
uggugagaacuacucagggaau

SEQ ID NO: 2071983 - RNA, 23 nt, Human
uggugagaacuacucagggaaug

SEQ ID NO: 2071984 - RNA, 18 nt, Human
ugguggcagugggagcug

SEQ ID NO: 2071985 - RNA, 13 nt, Human
ugguggcaguggg

SEQ ID NO: 2071986 - RNA, 19 nt, Human
ugguggcccgacagccugg

SEQ ID NO: 2071987 - RNA, 20 nt, Human
ugguggcagugggagcugcc

SEQ ID NO: 2071988 - RNA, 14 nt, Human
uggugcaaauccua

SEQ ID NO: 2071989 - RNA, 19 nt, Human
ugguucuuguguuggcugu

SEQ ID NO: 2071990 - RNA, 22 nt, Human
ugguugagguggaagcccuccu

SEQ ID NO: 2071991 - RNA, 17 nt, Human
ugguugagaaaugaaua

SEQ ID NO: 2071992 - RNA, 15 nt, Human
ugguugagguggaag

SEQ ID NO: 2071993 - RNA, 15 nt, Human
ugguugacuggguuu

SEQ ID NO: 2071994 - RNA, 18 nt, Human
ugguugaugaucuuugca

SEQ ID NO: 2071995 - RNA, 12 nt, Human
ugguucuggggc

SEQ ID NO: 2071996 - RNA, 15 nt, Human
ugguucuucauuuau

SEQ ID NO: 2071997 - RNA, 23 nt, Human
ugguuccccuguucacucuacuu

SEQ ID NO: 2071998 - RNA, 21 nt, Human
ugguucccuuugcuccacccc

SEQ ID NO: 2071999 - RNA, 23 nt, Human
ugguucccuuugcuccaccccac

SEQ ID NO: 2072000 - RNA, 20 nt, Human
ugguuccggaauccuguccu

SEQ ID NO: 2072001 - RNA, 23 nt, Human
ugguuccuggggugcccuccacu

SEQ ID NO: 2072002 - RNA, 17 nt, Human
ugguuccuuucucagcc

SEQ ID NO: 2072003 - RNA, 19 nt, Human
ugguuccugcuagaaaugg

SEQ ID NO: 2072004 - RNA, 12 nt, Human
ugguuccugggg

SEQ ID NO: 2072005 - RNA, 15 nt, Human
ugguucuaauagaac

SEQ ID NO: 2072006 - RNA, 14 nt, Human
ugguucuacaaucu

SEQ ID NO: 2072007 - RNA, 16 nt, Human
uggugucaccugaaga

SEQ ID NO: 2072008 - RNA, 14 nt, Human
ugguguacaaaaug

SEQ ID NO: 2072009 - RNA, 18 nt, Human
ugguguccaccuggcccc

SEQ ID NO: 2072010 - RNA, 13 nt, Human
ugguguccagcug

SEQ ID NO: 2072011 - RNA, 17 nt, Human
ugguguccagcugaguu

SEQ ID NO: 2072012 - RNA, 13 nt, Human
ugguguccaccug

SEQ ID NO: 2072013 - RNA, 14 nt, Human
ugguguccaccugg

SEQ ID NO: 2072014 - RNA, 15 nt, Human
ugguguccaccuggc

SEQ ID NO: 2072015 - RNA, 17 nt, Human
ugguguccaccuggccc

SEQ ID NO: 2072016 - RNA, 19 nt, Human
ugguguccuuucccuccac

SEQ ID NO: 2072017 - RNA, 20 nt, Human
ugguuccccuguucacucua

SEQ ID NO: 2072018 - RNA, 19 nt, Human
ugguuccccuguucacucu

SEQ ID NO: 2072019 - RNA, 18 nt, Human
ugguuccccuguucacuc

SEQ ID NO: 2072020 - RNA, 11 nt, Human
ugguuccccug

SEQ ID NO: 2072021 - RNA, 16 nt, Human
ugguucaucaguguua

SEQ ID NO: 2072022 - RNA, 18 nt, Human
ugguucaucaguguuaaa

SEQ ID NO: 2072023 - RNA, 23 nt, Human
ugguucaucaguguuaaaaaauu

SEQ ID NO: 2072024 - RNA, 17 nt, Human
ugucuaggcaggaccug

SEQ ID NO: 2072025 - RNA, 19 nt, Human
ugucuaggcaggaccugug

SEQ ID NO: 2072026 - RNA, 14 nt, Human
ugucuaccaucucc

SEQ ID NO: 2072027 - RNA, 16 nt, Human
ugucuaccaucucccu

SEQ ID NO: 2072028 - RNA, 16 nt, Human
ugucuaugggacucaa

SEQ ID NO: 2072029 - RNA, 15 nt, Human
ugucuaugggacuca

SEQ ID NO: 2072030 - RNA, 14 nt, Human
ugucuaugggacuc

SEQ ID NO: 2072031 - RNA, 18 nt, Human
ugucuaggucaguaccca

SEQ ID NO: 2072032 - RNA, 21 nt, Human
ugucuaggucaguacccaccu

SEQ ID NO: 2072033 - RNA, 18 nt, Human
ugucucaagagggcacug

SEQ ID NO: 2072034 - RNA, 17 nt, Human
ugucucaagagggcacu

SEQ ID NO: 2072035 - RNA, 21 nt, Human
ugucucaaaaaaagaaaaaga

SEQ ID NO: 2072036 - RNA, 12 nt, Human
ugucucaaaaaa

SEQ ID NO: 2072037 - RNA, 13 nt, Human
ugucucagccucc

SEQ ID NO: 2072038 - RNA, 14 nt, Human
ugucucagccuccc

SEQ ID NO: 2072039 - RNA, 15 nt, Human
ugucucagccuccca

SEQ ID NO: 2072040 - RNA, 21 nt, Human
ugucugugugcaagugugugc

SEQ ID NO: 2072041 - RNA, 15 nt, Human
ugucugugucagccu

SEQ ID NO: 2072042 - RNA, 12 nt, Human
ugucugugugca

SEQ ID NO: 2072043 - RNA, 20 nt, Human
ugucugaagucacugcacag

SEQ ID NO: 2072044 - RNA, 14 nt, Human
ugucuuaaauaaaa

SEQ ID NO: 2072045 - RNA, 19 nt, Human
ugucuuaaauaaaagaaau

SEQ ID NO: 2072046 - RNA, 20 nt, Human
ugucuuaaauaaaagaaaug

SEQ ID NO: 2072047 - RNA, 19 nt, Human
ugucuuuguuggaaaagaa

SEQ ID NO: 2072048 - RNA, 10 nt, Human
ugucuuuggu

SEQ ID NO: 2072049 - RNA, 15 nt, Human
ugucuuugguccucu

SEQ ID NO: 2072050 - RNA, 20 nt, Human
ugucuuugguccucuugcca

SEQ ID NO: 2072051 - RNA, 16 nt, Human
uguccuccagaagccu

SEQ ID NO: 2072052 - RNA, 17 nt, Human
uguccuccagaagccuc

SEQ ID NO: 2072053 - RNA, 18 nt, Human
uguccuccagaagccucu

SEQ ID NO: 2072054 - RNA, 19 nt, Human
uguccuccagaagccucug

SEQ ID NO: 2072055 - RNA, 20 nt, Human
uguccuccagaagccucugg

SEQ ID NO: 2072056 - RNA, 21 nt, Human
uguccuccagaagccucuggc

SEQ ID NO: 2072057 - RNA, 22 nt, Human
uguccuccagaagccucuggcu

SEQ ID NO: 2072058 - RNA, 23 nt, Human
uguccuccagaagccucuggcua

SEQ ID NO: 2072059 - RNA, 17 nt, Human
uguccuccccucaagga

SEQ ID NO: 2072060 - RNA, 18 nt, Human
uguccuccccucaaggac

SEQ ID NO: 2072061 - RNA, 17 nt, Human
uguccugaccugucuca

SEQ ID NO: 2072062 - RNA, 20 nt, Human
uguccuaggaguauccucau

SEQ ID NO: 2072063 - RNA, 16 nt, Human
ugucaucccauugucu

SEQ ID NO: 2072064 - RNA, 17 nt, Human
ugucaucccauugucuu

SEQ ID NO: 2072065 - RNA, 20 nt, Human
ugucaucuaccuuuucucuu

SEQ ID NO: 2072066 - RNA, 15 nt, Human
ugucaucucagugcu

SEQ ID NO: 2072067 - RNA, 23 nt, Human
uguccccuauggggaugguccac

SEQ ID NO: 2072068 - RNA, 13 nt, Human
ugucaucucagcu

SEQ ID NO: 2072069 - RNA, 20 nt, Human
uguccugggagugagcuggu

SEQ ID NO: 2072070 - RNA, 19 nt, Human
uguccugggagugagcugg

SEQ ID NO: 2072071 - RNA, 12 nt, Human
uguccugggagu

SEQ ID NO: 2072072 - RNA, 23 nt, Human
ugucuacacagauguucacccaa

SEQ ID NO: 2072073 - RNA, 20 nt, Human
uguacagauugcugcuucug

SEQ ID NO: 2072074 - RNA, 13 nt, Human
uguauaaagaaca

SEQ ID NO: 2072075 - RNA, 23 nt, Human
uguauaaaugaaguuuauacagu

SEQ ID NO: 2072076 - RNA, 15 nt, Human
uguauaguacuggca

SEQ ID NO: 2072077 - RNA, 23 nt, Human
uguauaguaaagugauaauuucu

SEQ ID NO: 2072078 - RNA, 22 nt, Human
uguauagauuagauuauauuga

SEQ ID NO: 2072079 - RNA, 23 nt, Human
uguauagauuagauuauauugag

SEQ ID NO: 2072080 - RNA, 14 nt, Human
uguaugacuaaaga

SEQ ID NO: 2072081 - RNA, 15 nt, Human
uguaugacuaaagag

SEQ ID NO: 2072082 - RNA, 16 nt, Human
uguaugacuaaagaga

SEQ ID NO: 2072083 - RNA, 20 nt, Human
uguaugacuaaagagagaau

SEQ ID NO: 2072084 - RNA, 21 nt, Human
uguaugacuaaagagagaaug

SEQ ID NO: 2072085 - RNA, 16 nt, Human
uguaugauauuccaua

SEQ ID NO: 2072086 - RNA, 21 nt, Human
uguaugauauuccauaguaua

SEQ ID NO: 2072087 - RNA, 22 nt, Human
uguaugauauuccauaguauau

SEQ ID NO: 2072088 - RNA, 22 nt, Human
uguaugaaagauggcugugccu

SEQ ID NO: 2072089 - RNA, 11 nt, Human
uguaucugugu

SEQ ID NO: 2072090 - RNA, 12 nt, Human
uguaucugugua

SEQ ID NO: 2072091 - RNA, 16 nt, Human
uguaucuguguagacu

SEQ ID NO: 2072092 - RNA, 13 nt, Human
uguaucuguguag

SEQ ID NO: 2072093 - RNA, 13 nt, Human
uguaucugagcag

SEQ ID NO: 2072094 - RNA, 21 nt, Human
uguauaguacuggcaugguac

SEQ ID NO: 2072095 - RNA, 13 nt, Human
uguauguacauau

SEQ ID NO: 2072096 - RNA, 14 nt, Human
ugucacaggcaggu

SEQ ID NO: 2072097 - RNA, 13 nt, Human
ugucacacacuuu

SEQ ID NO: 2072098 - RNA, 13 nt, Human
ugucacaauaaau

SEQ ID NO: 2072099 - RNA, 16 nt, Human
ugucacaauaaaugua

SEQ ID NO: 2072100 - RNA, 14 nt, Human
ugucacaauccuaa

SEQ ID NO: 2072101 - RNA, 19 nt, Human
ugucacaauccuaacacau

SEQ ID NO: 2072102 - RNA, 21 nt, Human
ugucacaauccuaacacauua

SEQ ID NO: 2072103 - RNA, 16 nt, Human
uguaugccaagugaga

SEQ ID NO: 2072104 - RNA, 18 nt, Human
uguaugccaagugagaag

SEQ ID NO: 2072105 - RNA, 20 nt, Human
uguaugccaagugagaagau

SEQ ID NO: 2072106 - RNA, 23 nt, Human
uguauggguguguguuuguguga

SEQ ID NO: 2072107 - RNA, 12 nt, Human
uguauguaaaaa

SEQ ID NO: 2072108 - RNA, 18 nt, Human
uguauggaauacaguguu

SEQ ID NO: 2072109 - RNA, 19 nt, Human
uguauggaauacaguguua

SEQ ID NO: 2072110 - RNA, 16 nt, Human
uguauggaauacagug

SEQ ID NO: 2072111 - RNA, 17 nt, Human
uguauggaauacagugu

SEQ ID NO: 2072112 - RNA, 12 nt, Human
uguaugcuggac

SEQ ID NO: 2072113 - RNA, 21 nt, Human
ugucacaggcagguccagggu

SEQ ID NO: 2072114 - RNA, 17 nt, Human
ugucacaggcaggucca

SEQ ID NO: 2072115 - RNA, 16 nt, Human
ugucacaggcaggucc

SEQ ID NO: 2072116 - RNA, 15 nt, Human
ugucacaggcagguc

SEQ ID NO: 2072117 - RNA, 13 nt, Human
ugucacaggcagg

SEQ ID NO: 2072118 - RNA, 13 nt, Human
ugucacuguuucu

SEQ ID NO: 2072119 - RNA, 17 nt, Human
ugucacuguuucucugc

SEQ ID NO: 2072120 - RNA, 18 nt, Human
ugucacuguuucucugcu

SEQ ID NO: 2072121 - RNA, 13 nt, Human
uggccuccaaguc

SEQ ID NO: 2072122 - RNA, 23 nt, Human
uggccuccaaguccacaguggaa

SEQ ID NO: 2072123 - RNA, 23 nt, Human
uggccucaacccucccucagccc

SEQ ID NO: 2072124 - RNA, 17 nt, Human
uggccucagaauucaca

SEQ ID NO: 2072125 - RNA, 21 nt, Human
uggccucaacccucccucagc

SEQ ID NO: 2072126 - RNA, 22 nt, Human
uggccucaacccucccucagcc

SEQ ID NO: 2072127 - RNA, 23 nt, Human
uggccucaagugauucuccugcc

SEQ ID NO: 2072128 - RNA, 18 nt, Human
uggccucaagugauucuc

SEQ ID NO: 2072129 - RNA, 19 nt, Human
uggcagcugcgguccaccc

SEQ ID NO: 2072130 - RNA, 17 nt, Human
uggcagcugcgguccac

SEQ ID NO: 2072131 - RNA, 23 nt, Human
uggccccaugucucucagaauuc

SEQ ID NO: 2072132 - RNA, 19 nt, Human
uggccccaugucucucaga

SEQ ID NO: 2072133 - RNA, 21 nt, Human
uggccccaugucucucagaau

SEQ ID NO: 2072134 - RNA, 16 nt, Human
uggccccucaccuggg

SEQ ID NO: 2072135 - RNA, 21 nt, Human
uggccccucaccugggcaccu

SEQ ID NO: 2072136 - RNA, 21 nt, Human
uggcuccccucuauuuagcau

SEQ ID NO: 2072137 - RNA, 19 nt, Human
uggcuccgaacacccucga

SEQ ID NO: 2072138 - RNA, 16 nt, Human
uggcuccgcugugugg

SEQ ID NO: 2072139 - RNA, 13 nt, Human
uggcuccccucua

SEQ ID NO: 2072140 - RNA, 14 nt, Human
uggcuccccucuau

SEQ ID NO: 2072141 - RNA, 23 nt, Human
uggcucccaugaccauacugagg

SEQ ID NO: 2072142 - RNA, 23 nt, Human
uggcuccccucuauuuagcauga

SEQ ID NO: 2072143 - RNA, 19 nt, Human
uggcuccagucugcugccc

SEQ ID NO: 2072144 - RNA, 20 nt, Human
uggcuccagucugcugcccu

SEQ ID NO: 2072145 - RNA, 23 nt, Human
uggcuccagucugcugcccucca

SEQ ID NO: 2072146 - RNA, 15 nt, Human
uggcuccagucugcu

SEQ ID NO: 2072147 - RNA, 18 nt, Human
uggccuugaaaccaccuu

SEQ ID NO: 2072148 - RNA, 21 nt, Human
uggcuucccgcucagcccucc

SEQ ID NO: 2072149 - RNA, 20 nt, Human
uggcuucccgcucagcccuc

SEQ ID NO: 2072150 - RNA, 19 nt, Human
uggcuucccgcucagcccu

SEQ ID NO: 2072151 - RNA, 18 nt, Human
uggcuucccgcucagccc

SEQ ID NO: 2072152 - RNA, 15 nt, Human
uggcugggcccagaa

SEQ ID NO: 2072153 - RNA, 17 nt, Human
uggcuugccacagcucu

SEQ ID NO: 2072154 - RNA, 22 nt, Human
uggcuucccgcucagcccuccc

SEQ ID NO: 2072155 - RNA, 22 nt, Human
uggcuuccuaaaauucagugga

SEQ ID NO: 2072156 - RNA, 12 nt, Human
uggcugggccca

SEQ ID NO: 2072157 - RNA, 12 nt, Human
uggcugggcaug

SEQ ID NO: 2072158 - RNA, 22 nt, Human
uggcuggcuaacuggaagcaug

SEQ ID NO: 2072159 - RNA, 17 nt, Human
uggcuggcccgucaugu

SEQ ID NO: 2072160 - RNA, 13 nt, Human
uggcuggcugcag

SEQ ID NO: 2072161 - RNA, 14 nt, Human
uggcuggcugcagu

SEQ ID NO: 2072162 - RNA, 18 nt, Human
uggcuugggacuaaaugc

SEQ ID NO: 2072163 - RNA, 23 nt, Human
uggcuugggacuaaaugcccugc

SEQ ID NO: 2072164 - RNA, 17 nt, Human
uggcuuguaacuccacc

SEQ ID NO: 2072165 - RNA, 16 nt, Human
uggcuuuucacugcug

SEQ ID NO: 2072166 - RNA, 18 nt, Human
uggcuugugaucugggaa

SEQ ID NO: 2072167 - RNA, 22 nt, Human
uggcuuuucacugcuggcugcc

SEQ ID NO: 2072168 - RNA, 21 nt, Human
uggcuuuucacugcuggcugc

SEQ ID NO: 2072169 - RNA, 19 nt, Human
uggcuuuucacugcuggcu

SEQ ID NO: 2072170 - RNA, 18 nt, Human
uggcuuuucacugcuggc

SEQ ID NO: 2072171 - RNA, 21 nt, Human
uggcuuuucaugcgugugugu

SEQ ID NO: 2072172 - RNA, 20 nt, Human
ugggauaaaggcccagacuc

SEQ ID NO: 2072173 - RNA, 14 nt, Human
ugggaugcuugccu

SEQ ID NO: 2072174 - RNA, 19 nt, Human
ugggaugcuugccuagggc

SEQ ID NO: 2072175 - RNA, 17 nt, Human
ugggaguucagcugcuu

SEQ ID NO: 2072176 - RNA, 19 nt, Human
ugggaguucagcugcuucu

SEQ ID NO: 2072177 - RNA, 23 nt, Human
ugggauaaagaugcaaggaccag

SEQ ID NO: 2072178 - RNA, 16 nt, Human
ugggaggaucucuuga

SEQ ID NO: 2072179 - RNA, 20 nt, Human
ugggaugcuugccuagggcc

SEQ ID NO: 2072180 - RNA, 13 nt, Human
ugggauggaggag

SEQ ID NO: 2072181 - RNA, 16 nt, Human
ugggauggaggagaag

SEQ ID NO: 2072182 - RNA, 14 nt, Human
ugggauggaggaga

SEQ ID NO: 2072183 - RNA, 16 nt, Human
ugggcagcauagcaag

SEQ ID NO: 2072184 - RNA, 18 nt, Human
ugggcagcauagcaagac

SEQ ID NO: 2072185 - RNA, 14 nt, Human
ugggcagccaggcu

SEQ ID NO: 2072186 - RNA, 15 nt, Human
ugggcagccaggcug

SEQ ID NO: 2072187 - RNA, 16 nt, Human
ugggcagccaggcugc

SEQ ID NO: 2072188 - RNA, 16 nt, Human
ugggccucaaggacuu

SEQ ID NO: 2072189 - RNA, 17 nt, Human
ugggcagcugaacagug

SEQ ID NO: 2072190 - RNA, 23 nt, Human
ugggcaggaagugaagagauccu

SEQ ID NO: 2072191 - RNA, 13 nt, Human
ugggcaggaccuc

SEQ ID NO: 2072192 - RNA, 16 nt, Human
ugggcaggaccucaga

SEQ ID NO: 2072193 - RNA, 21 nt, Human
uggggggccaacaccagggau

SEQ ID NO: 2072194 - RNA, 15 nt, Human
uggggugugggaggc

SEQ ID NO: 2072195 - RNA, 14 nt, Human
ugggguucagcccc

SEQ ID NO: 2072196 - RNA, 15 nt, Human
ugggguucagccccu

SEQ ID NO: 2072197 - RNA, 17 nt, Human
ugggguucagccccucc

SEQ ID NO: 2072198 - RNA, 19 nt, Human
ugggguucagccccuccuc

SEQ ID NO: 2072199 - RNA, 21 nt, Human
ugggguucagccccuccucug

SEQ ID NO: 2072200 - RNA, 22 nt, Human
ugggguucagccccuccucugc

SEQ ID NO: 2072201 - RNA, 14 nt, Human
ugggguucguggaa

SEQ ID NO: 2072202 - RNA, 20 nt, Human
ugggguucguggaaagggug

SEQ ID NO: 2072203 - RNA, 19 nt, Human
uggggggcugaggugggag

SEQ ID NO: 2072204 - RNA, 19 nt, Human
ugggggccugaccuccccc

SEQ ID NO: 2072205 - RNA, 15 nt, Human
uggggggccaacacc

SEQ ID NO: 2072206 - RNA, 17 nt, Human
uggggggccaacaccag

SEQ ID NO: 2072207 - RNA, 21 nt, Human
ugggggccucacuccaggaag

SEQ ID NO: 2072208 - RNA, 16 nt, Human
ugggggccucagugcc

SEQ ID NO: 2072209 - RNA, 13 nt, Human
ugggggccaugag

SEQ ID NO: 2072210 - RNA, 16 nt, Human
ugggggccaugagcuc

SEQ ID NO: 2072211 - RNA, 18 nt, Human
ugggggcagagggcagag

SEQ ID NO: 2072212 - RNA, 17 nt, Human
ugggggcagggcaugac

SEQ ID NO: 2072213 - RNA, 17 nt, Human
ugggggcagccugcgug

SEQ ID NO: 2072214 - RNA, 19 nt, Human
ugggggcagccugcguggc

SEQ ID NO: 2072215 - RNA, 22 nt, Human
ugggggcagccugcguggcuga

SEQ ID NO: 2072216 - RNA, 22 nt, Human
ugggggcaggagggcccuaccu

SEQ ID NO: 2072217 - RNA, 12 nt, Human
uggggccacagc

SEQ ID NO: 2072218 - RNA, 13 nt, Human
uggggccacagcc

SEQ ID NO: 2072219 - RNA, 14 nt, Human
uggggccacagcca

SEQ ID NO: 2072220 - RNA, 15 nt, Human
uggggccacagccag

SEQ ID NO: 2072221 - RNA, 16 nt, Human
uggggccacagccaga

SEQ ID NO: 2072222 - RNA, 13 nt, Human
uggggcagcacag

SEQ ID NO: 2072223 - RNA, 14 nt, Human
uggggcagcacaga

SEQ ID NO: 2072224 - RNA, 19 nt, Human
uggggcaagucccugacuc

SEQ ID NO: 2072225 - RNA, 13 nt, Human
uggggcagcuuga

SEQ ID NO: 2072226 - RNA, 22 nt, Human
uggggcagcacagagagggggc

SEQ ID NO: 2072227 - RNA, 16 nt, Human
uggggcagcacagaga

SEQ ID NO: 2072228 - RNA, 18 nt, Human
uggggcagcacagagagg

SEQ ID NO: 2072229 - RNA, 17 nt, Human
ugggcuugucuguagau

SEQ ID NO: 2072230 - RNA, 21 nt, Human
ugggcuugucuguagauuuua

SEQ ID NO: 2072231 - RNA, 17 nt, Human
uggggauuucucccagc

SEQ ID NO: 2072232 - RNA, 21 nt, Human
ugggcuucaguggcagcugcu

SEQ ID NO: 2072233 - RNA, 22 nt, Human
ugggcuucaguggcagcugcuu

SEQ ID NO: 2072234 - RNA, 23 nt, Human
ugggccucaaggacuugaaagca

SEQ ID NO: 2072235 - RNA, 19 nt, Human
uggcacugacugggcauag

SEQ ID NO: 2072236 - RNA, 22 nt, Human
uggcacugagauauuuauuguu

SEQ ID NO: 2072237 - RNA, 22 nt, Human
uggcacuauaauguaagcucua

SEQ ID NO: 2072238 - RNA, 13 nt, Human
uggcacuggaugc

SEQ ID NO: 2072239 - RNA, 15 nt, Human
uggcacuggaugcag

SEQ ID NO: 2072240 - RNA, 18 nt, Human
uggcacuggaugcagaaa

SEQ ID NO: 2072241 - RNA, 16 nt, Human
uggcaaccagaccauu

SEQ ID NO: 2072242 - RNA, 21 nt, Human
uggcacuauaauguaagcucu

SEQ ID NO: 2072243 - RNA, 22 nt, Human
uggcaaccuugucucuaugcca

SEQ ID NO: 2072244 - RNA, 17 nt, Human
uggaugauguuucguga

SEQ ID NO: 2072245 - RNA, 15 nt, Human
uggauauuagucaua

SEQ ID NO: 2072246 - RNA, 13 nt, Human
uggauauuuucaa

SEQ ID NO: 2072247 - RNA, 23 nt, Human
uggaucacagaggcuucuucaga

SEQ ID NO: 2072248 - RNA, 18 nt, Human
uggauauuuucaaauugu

SEQ ID NO: 2072249 - RNA, 22 nt, Human
uggauauuuucaaauuguaucu

SEQ ID NO: 2072250 - RNA, 23 nt, Human
uggauauuuucaaauuguaucua

SEQ ID NO: 2072251 - RNA, 22 nt, Human
uggaucaaaaucuguagagcag

SEQ ID NO: 2072252 - RNA, 23 nt, Human
uggaucaaaaucuguagagcagg

SEQ ID NO: 2072253 - RNA, 24 nt, Human
uggaucaaaaucuguagagcaggg

SEQ ID NO: 2072254 - RNA, 20 nt, Human
uggaggggcauggccagcag

SEQ ID NO: 2072255 - RNA, 15 nt, Human
uggaggggagcucug

SEQ ID NO: 2072256 - RNA, 21 nt, Human
uggagaggagggaugcugccu

SEQ ID NO: 2072257 - RNA, 19 nt, Human
uggagauauuuaugggggg

SEQ ID NO: 2072258 - RNA, 23 nt, Human
uggagauauuuauggggggagaa

SEQ ID NO: 2072259 - RNA, 20 nt, Human
uggagauaaagauuucuuga

SEQ ID NO: 2072260 - RNA, 23 nt, Human
uggagaucaccaguguguggcuu

SEQ ID NO: 2072261 - RNA, 14 nt, Human
uggagagcuggugc

SEQ ID NO: 2072262 - RNA, 16 nt, Human
uggagagcuggugccc

SEQ ID NO: 2072263 - RNA, 19 nt, Human
uggagagcuggugcccgga

SEQ ID NO: 2072264 - RNA, 11 nt, Human
uggagagcugg

SEQ ID NO: 2072265 - RNA, 15 nt, Human
uggacugaagccugc

SEQ ID NO: 2072266 - RNA, 15 nt, Human
uggacugugaugcca

SEQ ID NO: 2072267 - RNA, 21 nt, Human
uggacuggguugcguccugac

SEQ ID NO: 2072268 - RNA, 16 nt, Human
uggacugguggccccu

SEQ ID NO: 2072269 - RNA, 17 nt, Human
uggacugguggccccug

SEQ ID NO: 2072270 - RNA, 21 nt, Human
uggacugugaugccacacaga

SEQ ID NO: 2072271 - RNA, 20 nt, Human
uggacugugaugccacacag

SEQ ID NO: 2072272 - RNA, 13 nt, Human
uggacuggcuaga

SEQ ID NO: 2072273 - RNA, 19 nt, Human
uggacuggcuagaguccuc

SEQ ID NO: 2072274 - RNA, 20 nt, Human
uggacuggcuagaguccuca

SEQ ID NO: 2072275 - RNA, 22 nt, Human
uggacuggcuagaguccucacu

SEQ ID NO: 2072276 - RNA, 23 nt, Human
uggacuggcuguccuuuccagug

SEQ ID NO: 2072277 - RNA, 23 nt, Human
uggacaggcauguucucugagga

SEQ ID NO: 2072278 - RNA, 17 nt, Human
uggacaggcauguucuc

SEQ ID NO: 2072279 - RNA, 20 nt, Human
uggacauuaagcaucacaaa

SEQ ID NO: 2072280 - RNA, 23 nt, Human
uggacauuaagcaucacaaauga

SEQ ID NO: 2072281 - RNA, 15 nt, Human
uggacauucagaaca

SEQ ID NO: 2072282 - RNA, 15 nt, Human
uggacauugucugcg

SEQ ID NO: 2072283 - RNA, 22 nt, Human
uggacaggcauguucucugagg

SEQ ID NO: 2072284 - RNA, 18 nt, Human
uggacaggcauguucucu

SEQ ID NO: 2072285 - RNA, 17 nt, Human
uggacguucggggcaug

SEQ ID NO: 2072286 - RNA, 21 nt, Human
ugcuucccucugccugucccu

SEQ ID NO: 2072287 - RNA, 19 nt, Human
ugcuucucauagccccggu

SEQ ID NO: 2072288 - RNA, 17 nt, Human
ugcuucuccaugagaca

SEQ ID NO: 2072289 - RNA, 14 nt, Human
ugcuucucuacaga

SEQ ID NO: 2072290 - RNA, 16 nt, Human
ugcuucucuacagacu

SEQ ID NO: 2072291 - RNA, 13 nt, Human
ugcuucccucugc

SEQ ID NO: 2072292 - RNA, 15 nt, Human
ugcuucccucugccu

SEQ ID NO: 2072293 - RNA, 20 nt, Human
ugcuucccucugccuguccc

SEQ ID NO: 2072294 - RNA, 14 nt, Human
ugcuuaaugaaaag

SEQ ID NO: 2072295 - RNA, 12 nt, Human
ugcuuaaugaaa

SEQ ID NO: 2072296 - RNA, 18 nt, Human
ugcuuaaaaaucauugau

SEQ ID NO: 2072297 - RNA, 17 nt, Human
ugcuuaaaaaucauuga

SEQ ID NO: 2072298 - RNA, 19 nt, Human
ugcuuaaaaaucauugauu

SEQ ID NO: 2072299 - RNA, 19 nt, Human
ugcuguuuguuugacaaag

SEQ ID NO: 2072300 - RNA, 14 nt, Human
ugccugucccucuc

SEQ ID NO: 2072301 - RNA, 11 nt, Human
ugccugucccu

SEQ ID NO: 2072302 - RNA, 11 nt, Human
ugccugucucc

SEQ ID NO: 2072303 - RNA, 19 nt, Human
ugccuguccagccugggca

SEQ ID NO: 2072304 - RNA, 20 nt, Human
ugccuguccagccugggcag

SEQ ID NO: 2072305 - RNA, 23 nt, Human
ugccuguaguuaggaaauaaaac

SEQ ID NO: 2072306 - RNA, 15 nt, Human
ugccuguccagccug

SEQ ID NO: 2072307 - RNA, 16 nt, Human
ugccuguccagccugg

SEQ ID NO: 2072308 - RNA, 18 nt, Human
ugccuguccagccugggc

SEQ ID NO: 2072309 - RNA, 13 nt, Human
ugcuuuggaaauc

SEQ ID NO: 2072310 - RNA, 14 nt, Human
uggaaaagaauaca

SEQ ID NO: 2072311 - RNA, 19 nt, Human
uggaaaagaauacagaaag

SEQ ID NO: 2072312 - RNA, 20 nt, Human
ugcuuugacugagcagacug

SEQ ID NO: 2072313 - RNA, 22 nt, Human
ugcuuugacugagcagacuggu

SEQ ID NO: 2072314 - RNA, 15 nt, Human
ugcuuugccccugag

SEQ ID NO: 2072315 - RNA, 12 nt, Human
ugcuuucugaaa

SEQ ID NO: 2072316 - RNA, 13 nt, Human
ugcuuucugaaau

SEQ ID NO: 2072317 - RNA, 14 nt, Human
ugcuuucugaacuc

SEQ ID NO: 2072318 - RNA, 20 nt, Human
ugcuuucugaacucgcuucu

SEQ ID NO: 2072319 - RNA, 20 nt, Human
ugcuuuccguggcacugcau

SEQ ID NO: 2072320 - RNA, 21 nt, Human
ugcuuuccguggcacugcaua

SEQ ID NO: 2072321 - RNA, 17 nt, Human
ugcuuuccguggcacug

SEQ ID NO: 2072322 - RNA, 19 nt, Human
ugcuucuuaaccccaguaa

SEQ ID NO: 2072323 - RNA, 17 nt, Human
ugcuucuuaaccccagu

SEQ ID NO: 2072324 - RNA, 20 nt, Human
uggaaaaggaagacuagagg

SEQ ID NO: 2072325 - RNA, 22 nt, Human
uggaaaaggaagacuagaggcu

SEQ ID NO: 2072326 - RNA, 15 nt, Human
uggaaaaggaagacu

SEQ ID NO: 2072327 - RNA, 16 nt, Human
uggaaaaggaagacua

SEQ ID NO: 2072328 - RNA, 18 nt, Human
uggaaaaggaagacuaga

SEQ ID NO: 2072329 - RNA, 15 nt, Human
uggaaacuaaaacuu

SEQ ID NO: 2072330 - RNA, 21 nt, Human
uggaaacuggaugaggucaua

SEQ ID NO: 2072331 - RNA, 19 nt, Human
ugauaugcaguuuuccuua

SEQ ID NO: 2072332 - RNA, 16 nt, Human
ugauaugcauuuccug

SEQ ID NO: 2072333 - RNA, 19 nt, Human
ugauaugcauuuccugcug

SEQ ID NO: 2072334 - RNA, 19 nt, Human
ugauaugaaaaauaugaua

SEQ ID NO: 2072335 - RNA, 12 nt, Human
ugauaugaaaaa

SEQ ID NO: 2072336 - RNA, 15 nt, Human
ugauaugaaaaauau

SEQ ID NO: 2072337 - RNA, 11 nt, Human
ugauaugaaaa

SEQ ID NO: 2072338 - RNA, 21 nt, Human
ugauaucaugccccuguacuc

SEQ ID NO: 2072339 - RNA, 18 nt, Human
ugaucacuggcaaugaaa

SEQ ID NO: 2072340 - RNA, 22 nt, Human
ugaucacggcucacugcagccu

SEQ ID NO: 2072341 - RNA, 14 nt, Human
ugauauaaauaaaa

SEQ ID NO: 2072342 - RNA, 13 nt, Human
ugauauauguguu

SEQ ID NO: 2072343 - RNA, 21 nt, Human
ugauauauguguuuuucacau

SEQ ID NO: 2072344 - RNA, 18 nt, Human
ugauauaauuuccauagu

SEQ ID NO: 2072345 - RNA, 22 nt, Human
ugauauacuuuuuucuuauuua

SEQ ID NO: 2072346 - RNA, 20 nt, Human
ugauccacccaccucagccu

SEQ ID NO: 2072347 - RNA, 16 nt, Human
ugauccacccaccuca

SEQ ID NO: 2072348 - RNA, 15 nt, Human
ugauccacccaccuc

SEQ ID NO: 2072349 - RNA, 21 nt, Human
ugauccaagcuggucccacuc

SEQ ID NO: 2072350 - RNA, 17 nt, Human
ugauccaagcugguccc

SEQ ID NO: 2072351 - RNA, 24 nt, Human
ugaucauccacugugccaugugcc

SEQ ID NO: 2072352 - RNA, 13 nt, Human
ugaucauccacug

SEQ ID NO: 2072353 - RNA, 22 nt, Human
ugauccacccaccucagccucc

SEQ ID NO: 2072354 - RNA, 21 nt, Human
ugauccacccaccucagccuc

SEQ ID NO: 2072355 - RNA, 20 nt, Human
ugaucugaugcaagcaagaa

SEQ ID NO: 2072356 - RNA, 13 nt, Human
ugaugcucauggu

SEQ ID NO: 2072357 - RNA, 14 nt, Human
ugaugcucccuccc

SEQ ID NO: 2072358 - RNA, 15 nt, Human
ugaugcucccucccc

SEQ ID NO: 2072359 - RNA, 16 nt, Human
ugaugcucccuccccu

SEQ ID NO: 2072360 - RNA, 23 nt, Human
ugaugcucccuccccugcccugg

SEQ ID NO: 2072361 - RNA, 17 nt, Human
ugaugcucccuccccug

SEQ ID NO: 2072362 - RNA, 20 nt, Human
ugaugcucccuccccugccc

SEQ ID NO: 2072363 - RNA, 21 nt, Human
ugaugcucccuccccugcccu

SEQ ID NO: 2072364 - RNA, 22 nt, Human
ugaugcucccuccccugcccug

SEQ ID NO: 2072365 - RNA, 20 nt, Human
ugaugcuggaugcuccuucc

SEQ ID NO: 2072366 - RNA, 20 nt, Human
ugauguaggguaaggugccu

SEQ ID NO: 2072367 - RNA, 15 nt, Human
ugauguacaguuggg

SEQ ID NO: 2072368 - RNA, 15 nt, Human
ugauguaccugaugc

SEQ ID NO: 2072369 - RNA, 20 nt, Human
ugauguaccaugaaacaaag

SEQ ID NO: 2072370 - RNA, 18 nt, Human
ugauguaccaugaaacaa

SEQ ID NO: 2072371 - RNA, 15 nt, Human
ugaugucccuaugga

SEQ ID NO: 2072372 - RNA, 18 nt, Human
ugaugguuuauguugacc

SEQ ID NO: 2072373 - RNA, 15 nt, Human
ugaugcuggaugcuc

SEQ ID NO: 2072374 - RNA, 15 nt, Human
ugauguaaaugaagu

SEQ ID NO: 2072375 - RNA, 17 nt, Human
ugauguaaaugaaguaa

SEQ ID NO: 2072376 - RNA, 19 nt, Human
ugauguaaaugaaguaacu

SEQ ID NO: 2072377 - RNA, 21 nt, Human
ugauguaaaugaaguaacuug

SEQ ID NO: 2072378 - RNA, 20 nt, Human
ugaugaugaaaugaggucag

SEQ ID NO: 2072379 - RNA, 23 nt, Human
ugaugaucuuugcagacaggcaa

SEQ ID NO: 2072380 - RNA, 22 nt, Human
ugaugaucuuugcagacaggca

SEQ ID NO: 2072381 - RNA, 18 nt, Human
ugaugccacacagagugg

SEQ ID NO: 2072382 - RNA, 15 nt, Human
ugaugaugauaauga

SEQ ID NO: 2072383 - RNA, 20 nt, Human
ugaucuuugcagacaggcaa

SEQ ID NO: 2072384 - RNA, 19 nt, Human
ugaucuuugcagacaggca

SEQ ID NO: 2072385 - RNA, 21 nt, Human
ugaucugaugcaagcaagaaa

SEQ ID NO: 2072386 - RNA, 23 nt, Human
ugaucuuugcagacaggcaagca

SEQ ID NO: 2072387 - RNA, 21 nt, Human
ugaucuuugcagacaggcaag

SEQ ID NO: 2072388 - RNA, 15 nt, Human
ugaugaaaaauagca

SEQ ID NO: 2072389 - RNA, 21 nt, Human
ugagguuuccuucagacagau

SEQ ID NO: 2072390 - RNA, 14 nt, Human
ugagucccuuccag

SEQ ID NO: 2072391 - RNA, 16 nt, Human
ugagucccuuccaggc

SEQ ID NO: 2072392 - RNA, 18 nt, Human
ugagucccuuccaggcca

SEQ ID NO: 2072393 - RNA, 21 nt, Human
ugagucccuuccaggccauca

SEQ ID NO: 2072394 - RNA, 14 nt, Human
ugagucgaggacag

SEQ ID NO: 2072395 - RNA, 19 nt, Human
ugagguuucaaaccucccu

SEQ ID NO: 2072396 - RNA, 12 nt, Human
ugagguuaggag

SEQ ID NO: 2072397 - RNA, 16 nt, Human
ugaggugcuauguucu

SEQ ID NO: 2072398 - RNA, 15 nt, Human
ugaggugcuauguuc

SEQ ID NO: 2072399 - RNA, 20 nt, Human
ugaggucuuuugacaugugg

SEQ ID NO: 2072400 - RNA, 15 nt, Human
ugaggugcugggagg

SEQ ID NO: 2072401 - RNA, 16 nt, Human
ugaggugcugggaggg

SEQ ID NO: 2072402 - RNA, 17 nt, Human
ugaggugcugggaggga

SEQ ID NO: 2072403 - RNA, 15 nt, Human
ugagguggaagcccu

SEQ ID NO: 2072404 - RNA, 16 nt, Human
ugagguggaagcccuc

SEQ ID NO: 2072405 - RNA, 17 nt, Human
ugagguggaagcccucc

SEQ ID NO: 2072406 - RNA, 20 nt, Human
ugagguggaagcccuccuuc

SEQ ID NO: 2072407 - RNA, 21 nt, Human
ugagguggaagcccuccuucc

SEQ ID NO: 2072408 - RNA, 22 nt, Human
ugagguggaagcccuccuucca

SEQ ID NO: 2072409 - RNA, 23 nt, Human
ugaggacuuaaaauauuccugca

SEQ ID NO: 2072410 - RNA, 11 nt, Human
ugaggagcugc

SEQ ID NO: 2072411 - RNA, 12 nt, Human
ugaggagcugcu

SEQ ID NO: 2072412 - RNA, 13 nt, Human
ugaggcugcagcg

SEQ ID NO: 2072413 - RNA, 12 nt, Human
ugaggcugggaa

SEQ ID NO: 2072414 - RNA, 13 nt, Human
ugaggcuggacuc

SEQ ID NO: 2072415 - RNA, 16 nt, Human
ugaggcuggacuccag

SEQ ID NO: 2072416 - RNA, 21 nt, Human
ugaggcuggacuccagaucug

SEQ ID NO: 2072417 - RNA, 22 nt, Human
ugaggcuggacuccagaucugc

SEQ ID NO: 2072418 - RNA, 16 nt, Human
ugagggaacagacagg

SEQ ID NO: 2072419 - RNA, 17 nt, Human
ugagggaacagacagga

SEQ ID NO: 2072420 - RNA, 17 nt, Human
ugaggucuuuugacaug

SEQ ID NO: 2072421 - RNA, 19 nt, Human
ugaggucuuuugacaugug

SEQ ID NO: 2072422 - RNA, 16 nt, Human
ugaggcuuaacaaugu

SEQ ID NO: 2072423 - RNA, 20 nt, Human
ugaggcuuaacaaugucuug

SEQ ID NO: 2072424 - RNA, 16 nt, Human
ugauaaaagauacauu

SEQ ID NO: 2072425 - RNA, 17 nt, Human
ugauaaaagauacauuu

SEQ ID NO: 2072426 - RNA, 17 nt, Human
ugauaaagaaaagaauc

SEQ ID NO: 2072427 - RNA, 21 nt, Human
ugaguuuagugaucugaacag

SEQ ID NO: 2072428 - RNA, 22 nt, Human
ugaguuuccucaggcugcugga

SEQ ID NO: 2072429 - RNA, 16 nt, Human
ugaguuuccucaggcu

SEQ ID NO: 2072430 - RNA, 17 nt, Human
ugaguuuccucaggcug

SEQ ID NO: 2072431 - RNA, 19 nt, Human
ugaguuuccucaggcugcu

SEQ ID NO: 2072432 - RNA, 15 nt, Human
ugaguuuaccauuug

SEQ ID NO: 2072433 - RNA, 18 nt, Human
ugaguuuaccauuuguaa

SEQ ID NO: 2072434 - RNA, 19 nt, Human
ugaguuuaccauuuguaau

SEQ ID NO: 2072435 - RNA, 20 nt, Human
ugaguuuaccauuuguaaua

SEQ ID NO: 2072436 - RNA, 23 nt, Human
ugaguuguuuucagacucagacu

SEQ ID NO: 2072437 - RNA, 14 nt, Human
ugaguuuaaagcaa

SEQ ID NO: 2072438 - RNA, 20 nt, Human
ugaguugguguugacaugug

SEQ ID NO: 2072439 - RNA, 18 nt, Human
ugagucgaggacagggag

SEQ ID NO: 2072440 - RNA, 16 nt, Human
ugaguugauucagcuc

SEQ ID NO: 2072441 - RNA, 19 nt, Human
ugaguugauucagcucugc

SEQ ID NO: 2072442 - RNA, 16 nt, Human
ugagucgaggacaggg

SEQ ID NO: 2072443 - RNA, 15 nt, Human
ugagucgaggacagg

SEQ ID NO: 2072444 - RNA, 19 nt, Human
ugauaaauuccacuggacu

SEQ ID NO: 2072445 - RNA, 11 nt, Human
ugauagcuuua

SEQ ID NO: 2072446 - RNA, 13 nt, Human
ugauagcuuuauu

SEQ ID NO: 2072447 - RNA, 14 nt, Human
ugauagcuuuauuu

SEQ ID NO: 2072448 - RNA, 23 nt, Human
ugauagcuuuauuuuuuaaguau

SEQ ID NO: 2072449 - RNA, 15 nt, Human
ugauagcguuggaau

SEQ ID NO: 2072450 - RNA, 16 nt, Human
ugauagcguuggaauu

SEQ ID NO: 2072451 - RNA, 20 nt, Human
ugauagcguuggaauuaaaa

SEQ ID NO: 2072452 - RNA, 21 nt, Human
ugagcuccagacccccagcaa

SEQ ID NO: 2072453 - RNA, 18 nt, Human
ugagcuccagacccccag

SEQ ID NO: 2072454 - RNA, 19 nt, Human
ugagcuccagacccccagc

SEQ ID NO: 2072455 - RNA, 20 nt, Human
ugagcuccagacccccagca

SEQ ID NO: 2072456 - RNA, 16 nt, Human
ugagcuccucugggca

SEQ ID NO: 2072457 - RNA, 18 nt, Human
ugagcuccucugggcagg

SEQ ID NO: 2072458 - RNA, 23 nt, Human
ugagcuccccaccaccccagcug

SEQ ID NO: 2072459 - RNA, 13 nt, Human
ugagcuccucugg

SEQ ID NO: 2072460 - RNA, 14 nt, Human
ugagcuccucuggg

SEQ ID NO: 2072461 - RNA, 15 nt, Human
ugagcuccucugggc

SEQ ID NO: 2072462 - RNA, 15 nt, Human
ugagcuccccaaaaa

SEQ ID NO: 2072463 - RNA, 16 nt, Human
ugagcuccccaaaaac

SEQ ID NO: 2072464 - RNA, 21 nt, Human
ugagcuccccaaaaaccucac

SEQ ID NO: 2072465 - RNA, 15 nt, Human
ugagcuccccaccac

SEQ ID NO: 2072466 - RNA, 20 nt, Human
ugagcuccccaccaccccag

SEQ ID NO: 2072467 - RNA, 22 nt, Human
ugagcuccccaccaccccagcu

SEQ ID NO: 2072468 - RNA, 16 nt, Human
ugagccuacagaugaa

SEQ ID NO: 2072469 - RNA, 15 nt, Human
ugagccucagcaucc

SEQ ID NO: 2072470 - RNA, 13 nt, Human
ugagccucagcau

SEQ ID NO: 2072471 - RNA, 13 nt, Human
ugagccccuggga

SEQ ID NO: 2072472 - RNA, 14 nt, Human
ugagccccugggac

SEQ ID NO: 2072473 - RNA, 15 nt, Human
ugagccccugggacu

SEQ ID NO: 2072474 - RNA, 17 nt, Human
ugagcccggaugcuucu

SEQ ID NO: 2072475 - RNA, 18 nt, Human
ugagcccagcccuguucu

SEQ ID NO: 2072476 - RNA, 12 nt, Human
ugagcccaggag

SEQ ID NO: 2072477 - RNA, 13 nt, Human
ugagcccaggagu

SEQ ID NO: 2072478 - RNA, 19 nt, Human
ugagaggggaacagacugg

SEQ ID NO: 2072479 - RNA, 23 nt, Human
ugagaucuaagccuuuccauaag

SEQ ID NO: 2072480 - RNA, 16 nt, Human
ugagaucuaagccuuu

SEQ ID NO: 2072481 - RNA, 20 nt, Human
ugagaucuaagccuuuccau

SEQ ID NO: 2072482 - RNA, 21 nt, Human
ugagaucuaagccuuuccaua

SEQ ID NO: 2072483 - RNA, 22 nt, Human
ugagaucuaagccuuuccauaa

SEQ ID NO: 2072484 - RNA, 23 nt, Human
ugagaguauuuaggcagauugaa

SEQ ID NO: 2072485 - RNA, 14 nt, Human
ugagacucugucuc

SEQ ID NO: 2072486 - RNA, 13 nt, Human
ugagacucugucu

SEQ ID NO: 2072487 - RNA, 12 nt, Human
ugagaccucagc

SEQ ID NO: 2072488 - RNA, 13 nt, Human
ugagaccucagcc

SEQ ID NO: 2072489 - RNA, 12 nt, Human
ugagacucuguc

SEQ ID NO: 2072490 - RNA, 14 nt, Human
ugagaccucagcca

SEQ ID NO: 2072491 - RNA, 18 nt, Human
ugagaggcagacuucccu

SEQ ID NO: 2072492 - RNA, 22 nt, Human
ugacuguacuccucccaggcgc

SEQ ID NO: 2072493 - RNA, 18 nt, Human
ugacuguacuccucccag

SEQ ID NO: 2072494 - RNA, 17 nt, Human
ugacuguacuccuccca

SEQ ID NO: 2072495 - RNA, 16 nt, Human
ugacuguacuccuccc

SEQ ID NO: 2072496 - RNA, 15 nt, Human
ugacuguaucugugu

SEQ ID NO: 2072497 - RNA, 23 nt, Human
ugacuggguuucucuguauagua

SEQ ID NO: 2072498 - RNA, 12 nt, Human
ugagacccuguc

SEQ ID NO: 2072499 - RNA, 15 nt, Human
ugagaccccugucuc

SEQ ID NO: 2072500 - RNA, 16 nt, Human
ugagaccccugucucc

SEQ ID NO: 2072501 - RNA, 14 nt, Human
ugagacccugucuc

SEQ ID NO: 2072502 - RNA, 15 nt, Human
ugagacccugucucu

SEQ ID NO: 2072503 - RNA, 22 nt, Human
ugagacccccacaccucaguuc

SEQ ID NO: 2072504 - RNA, 15 nt, Human
ugagaaaugaauaau

SEQ ID NO: 2072505 - RNA, 20 nt, Human
ugagaaaugaauaauuuccc

SEQ ID NO: 2072506 - RNA, 22 nt, Human
ugagaaaugaauaauuucccaa

SEQ ID NO: 2072507 - RNA, 17 nt, Human
ugaccucaaccugugau

SEQ ID NO: 2072508 - RNA, 18 nt, Human
ugaccucaaccugugaug

SEQ ID NO: 2072509 - RNA, 21 nt, Human
ugaccucaagauguccuccuu

SEQ ID NO: 2072510 - RNA, 21 nt, Human
ugaccuaagauuuauuuuguu

SEQ ID NO: 2072511 - RNA, 13 nt, Human
ugaccuacucuca

SEQ ID NO: 2072512 - RNA, 20 nt, Human
ugacccugcgaaggggcccu

SEQ ID NO: 2072513 - RNA, 21 nt, Human
ugacccugcgaaggggcccug

SEQ ID NO: 2072514 - RNA, 12 nt, Human
ugacccugcaga

SEQ ID NO: 2072515 - RNA, 16 nt, Human
ugacccugcagagaug

SEQ ID NO: 2072516 - RNA, 16 nt, Human
ugacccugaucagucu

SEQ ID NO: 2072517 - RNA, 15 nt, Human
ugacccucuccaccc

SEQ ID NO: 2072518 - RNA, 18 nt, Human
ugacccucuccaccccau

SEQ ID NO: 2072519 - RNA, 12 nt, Human
ugacccucccuu

SEQ ID NO: 2072520 - RNA, 13 nt, Human
ugacccucccuuc

SEQ ID NO: 2072521 - RNA, 16 nt, Human
ugacccucccuuccug

SEQ ID NO: 2072522 - RNA, 15 nt, Human
ucuugaacuccuggc

SEQ ID NO: 2072523 - RNA, 12 nt, Human
ugaccucugccu

SEQ ID NO: 2072524 - RNA, 21 nt, Human
ugaccucuauaauugccacug

SEQ ID NO: 2072525 - RNA, 14 nt, Human
ugaccucacuguga

SEQ ID NO: 2072526 - RNA, 22 nt, Human
ugaccucaggugauccacccac

SEQ ID NO: 2072527 - RNA, 17 nt, Human
ugaccuccacagcuucc

SEQ ID NO: 2072528 - RNA, 14 nt, Human
ugaccuccacagcu

SEQ ID NO: 2072529 - RNA, 15 nt, Human
ugaccuccacagcuu

SEQ ID NO: 2072530 - RNA, 14 nt, Human
ugaccucccucuaa

SEQ ID NO: 2072531 - RNA, 13 nt, Human
ugaccucccucua

SEQ ID NO: 2072532 - RNA, 13 nt, Human
ugaccucccccuc

SEQ ID NO: 2072533 - RNA, 16 nt, Human
ugaccucccccuccuu

SEQ ID NO: 2072534 - RNA, 17 nt, Human
ugaccucccccuccuuc

SEQ ID NO: 2072535 - RNA, 18 nt, Human
ugaccucccccuccuucc

SEQ ID NO: 2072536 - RNA, 19 nt, Human
ugaccucccccuccuuccc

SEQ ID NO: 2072537 - RNA, 22 nt, Human
ugaccucccucuaauuuaucuu

SEQ ID NO: 2072538 - RNA, 20 nt, Human
ugacugauguuaggcugggc

SEQ ID NO: 2072539 - RNA, 19 nt, Human
ugacugagcagacugguga

SEQ ID NO: 2072540 - RNA, 19 nt, Human
ugacugagcaagacccugu

SEQ ID NO: 2072541 - RNA, 22 nt, Human
ugacugagcaagacccugucuc

SEQ ID NO: 2072542 - RNA, 15 nt, Human
ugacugagcagacug

SEQ ID NO: 2072543 - RNA, 18 nt, Human
ugacugcacguggcuucu

SEQ ID NO: 2072544 - RNA, 22 nt, Human
ugacugcacguggcuucugaug

SEQ ID NO: 2072545 - RNA, 21 nt, Human
ugacugcauuuuacuguacag

SEQ ID NO: 2072546 - RNA, 19 nt, Human
ugacgucaagucuccuucc

SEQ ID NO: 2072547 - RNA, 23 nt, Human
ugacgugcaccuguacucaggag

SEQ ID NO: 2072548 - RNA, 18 nt, Human
ugacgugcaccuguacuc

SEQ ID NO: 2072549 - RNA, 19 nt, Human
ugacgugcaccuguacuca

SEQ ID NO: 2072550 - RNA, 18 nt, Human
ugacggaagaacauagaa

SEQ ID NO: 2072551 - RNA, 21 nt, Human
ugacggaaggaccuauguuug

SEQ ID NO: 2072552 - RNA, 22 nt, Human
ugacggaaggaccuauguuugc

SEQ ID NO: 2072553 - RNA, 23 nt, Human
ugacggaaggaccuauguuugcu

SEQ ID NO: 2072554 - RNA, 15 nt, Human
ugacggcgcccccag

SEQ ID NO: 2072555 - RNA, 18 nt, Human
ugacggcgcccccagugu

SEQ ID NO: 2072556 - RNA, 19 nt, Human
ugacggcgcccccagugug

SEQ ID NO: 2072557 - RNA, 20 nt, Human
ugacggcgcccccagugugc

SEQ ID NO: 2072558 - RNA, 14 nt, Human
ugacgaggcugggc

SEQ ID NO: 2072559 - RNA, 15 nt, Human
ugacgaggcugggcc

SEQ ID NO: 2072560 - RNA, 14 nt, Human
ugacggaagaacau

SEQ ID NO: 2072561 - RNA, 20 nt, Human
ugaccuuuugacuuaaagca

SEQ ID NO: 2072562 - RNA, 20 nt, Human
ugacgacaaagcugcuaaau

SEQ ID NO: 2072563 - RNA, 21 nt, Human
ugcaaugacacagucuuggcu

SEQ ID NO: 2072564 - RNA, 16 nt, Human
ugcaauggcagccuug

SEQ ID NO: 2072565 - RNA, 15 nt, Human
ugcaauggcagccuu

SEQ ID NO: 2072566 - RNA, 14 nt, Human
ugcaauggcagccu

SEQ ID NO: 2072567 - RNA, 13 nt, Human
ugcaauggcagcc

SEQ ID NO: 2072568 - RNA, 17 nt, Human
ugcaaugguuaacaucu

SEQ ID NO: 2072569 - RNA, 16 nt, Human
ugcaaugacaucuuca

SEQ ID NO: 2072570 - RNA, 17 nt, Human
ugcaaugacaucuucaa

SEQ ID NO: 2072571 - RNA, 15 nt, Human
ugcaaugaaggaaau

SEQ ID NO: 2072572 - RNA, 16 nt, Human
ugcaaugugcuacuga

SEQ ID NO: 2072573 - RNA, 17 nt, Human
ugcaauuuuaacacaca

SEQ ID NO: 2072574 - RNA, 18 nt, Human
ugcaauuuuaacacacau

SEQ ID NO: 2072575 - RNA, 21 nt, Human
ugcaauuguaggggugugugu

SEQ ID NO: 2072576 - RNA, 22 nt, Human
ugcaauuguaggggugugugug

SEQ ID NO: 2072577 - RNA, 17 nt, Human
ugcacaaagcccuucca

SEQ ID NO: 2072578 - RNA, 15 nt, Human
ugcacaaagcccuuc

SEQ ID NO: 2072579 - RNA, 16 nt, Human
ugcaccuguacucagg

SEQ ID NO: 2072580 - RNA, 17 nt, Human
ugcaccuguacucagga

SEQ ID NO: 2072581 - RNA, 20 nt, Human
ugcaccuguacucaggaggc

SEQ ID NO: 2072582 - RNA, 14 nt, Human
ugcaccuuaucuua

SEQ ID NO: 2072583 - RNA, 22 nt, Human
ugcaccuuaucuuaaagcacuu

SEQ ID NO: 2072584 - RNA, 16 nt, Human
ugcacgcacacugucu

SEQ ID NO: 2072585 - RNA, 15 nt, Human
ugcacagugcaucuc

SEQ ID NO: 2072586 - RNA, 17 nt, Human
ugcacagugcaucucag

SEQ ID NO: 2072587 - RNA, 16 nt, Human
ugcacagugcaucuca

SEQ ID NO: 2072588 - RNA, 21 nt, Human
ugcagaggggcuuucuggaga

SEQ ID NO: 2072589 - RNA, 22 nt, Human
ugcagaggggcuuucuggagag

SEQ ID NO: 2072590 - RNA, 19 nt, Human
ugcagaggguacuuuaaga

SEQ ID NO: 2072591 - RNA, 22 nt, Human
ugcacuuauuuaugaaccugcc

SEQ ID NO: 2072592 - RNA, 20 nt, Human
ugcagaggggcuuucuggag

SEQ ID NO: 2072593 - RNA, 16 nt, Human
ugcacuuaaauaucaa

SEQ ID NO: 2072594 - RNA, 17 nt, Human
ugcacuuaaauaucaau

SEQ ID NO: 2072595 - RNA, 21 nt, Human
ugcacugacauuguuggccaa

SEQ ID NO: 2072596 - RNA, 18 nt, Human
ugcacugacauuguuggc

SEQ ID NO: 2072597 - RNA, 17 nt, Human
ugcacgcacacugucug

SEQ ID NO: 2072598 - RNA, 18 nt, Human
ugcacugacccacagccu

SEQ ID NO: 2072599 - RNA, 22 nt, Human
ugcacugacccacagccucugc

SEQ ID NO: 2072600 - RNA, 19 nt, Human
ugauuuuuaaagaaaaguu

SEQ ID NO: 2072601 - RNA, 17 nt, Human
ugauuuugcuguagaag

SEQ ID NO: 2072602 - RNA, 19 nt, Human
ugauuuugcuguagaagau

SEQ ID NO: 2072603 - RNA, 14 nt, Human
ugauuuugcuguag

SEQ ID NO: 2072604 - RNA, 16 nt, Human
ugauuuugcuguagaa

SEQ ID NO: 2072605 - RNA, 15 nt, Human
ugauuuucauugcug

SEQ ID NO: 2072606 - RNA, 13 nt, Human
ugauuuucauugc

SEQ ID NO: 2072607 - RNA, 12 nt, Human
ugauuuuaacaa

SEQ ID NO: 2072608 - RNA, 14 nt, Human
ugauguggcaacug

SEQ ID NO: 2072609 - RNA, 16 nt, Human
ugauguggcaacugcu

SEQ ID NO: 2072610 - RNA, 22 nt, Human
ugauuuuaacaauaacuacugu

SEQ ID NO: 2072611 - RNA, 18 nt, Human
ugauuuuaacaauaacua

SEQ ID NO: 2072612 - RNA, 19 nt, Human
ugauuuuaacaauaacuac

SEQ ID NO: 2072613 - RNA, 13 nt, Human
ugauuuuaacaau

SEQ ID NO: 2072614 - RNA, 14 nt, Human
ugauuuuaacaaua

SEQ ID NO: 2072615 - RNA, 16 nt, Human
ugauuuuaacaauaac

SEQ ID NO: 2072616 - RNA, 17 nt, Human
ugauuuuaacaauaacu

SEQ ID NO: 2072617 - RNA, 19 nt, Human
ugauuuuaagaauccaaac

SEQ ID NO: 2072618 - RNA, 18 nt, Human
ugauuuuagcugcagaac

SEQ ID NO: 2072619 - RNA, 19 nt, Human
ugauuuuacaauugaaaug

SEQ ID NO: 2072620 - RNA, 14 nt, Human
ugaugugcaaaaau

SEQ ID NO: 2072621 - RNA, 16 nt, Human
ugaugugcaaaaauuu

SEQ ID NO: 2072622 - RNA, 17 nt, Human
ugaugugcaaaaauuuu

SEQ ID NO: 2072623 - RNA, 18 nt, Human
ugaugugcaaaaauuuuu

SEQ ID NO: 2072624 - RNA, 21 nt, Human
ugaugugcaaaaauuuuugga

SEQ ID NO: 2072625 - RNA, 22 nt, Human
ugaugugcaaaaauuuuuggau

SEQ ID NO: 2072626 - RNA, 16 nt, Human
ugaugucccuauggaa

SEQ ID NO: 2072627 - RNA, 23 nt, Human
ugaugucuuuguuaagacugcug

SEQ ID NO: 2072628 - RNA, 22 nt, Human
ugauuuuuuuuuagaacagaaa

SEQ ID NO: 2072629 - RNA, 23 nt, Human
ugauuuuuuuuuagaacagaaaa

SEQ ID NO: 2072630 - RNA, 16 nt, Human
ugauuuuuuuuuuuca

SEQ ID NO: 2072631 - RNA, 17 nt, Human
ugcaaaaauuuuuggau

SEQ ID NO: 2072632 - RNA, 20 nt, Human
ugcaaaaauuuuuggauuga

SEQ ID NO: 2072633 - RNA, 18 nt, Human
ugcaaaacaugcuaccug

SEQ ID NO: 2072634 - RNA, 13 nt, Human
ugauuuuuaucca

SEQ ID NO: 2072635 - RNA, 14 nt, Human
ugauuuuuauccaa

SEQ ID NO: 2072636 - RNA, 13 nt, Human
ugauuuuuuucca

SEQ ID NO: 2072637 - RNA, 13 nt, Human
ugcaacuucugcc

SEQ ID NO: 2072638 - RNA, 14 nt, Human
ugcaacuucugccu

SEQ ID NO: 2072639 - RNA, 16 nt, Human
ugcaacuuguaaaugu

SEQ ID NO: 2072640 - RNA, 17 nt, Human
ugcaacuucuuuuuauu

SEQ ID NO: 2072641 - RNA, 21 nt, Human
ugcaacuucuuuuuauuuucu

SEQ ID NO: 2072642 - RNA, 18 nt, Human
ugcaacuuguaaaugugg

SEQ ID NO: 2072643 - RNA, 14 nt, Human
ugcaaccuguugau

SEQ ID NO: 2072644 - RNA, 21 nt, Human
ugcaaccuccgccucuugggu

SEQ ID NO: 2072645 - RNA, 20 nt, Human
ugcaaccuccgccucuuggg

SEQ ID NO: 2072646 - RNA, 18 nt, Human
ugcaaccuccgccucuug

SEQ ID NO: 2072647 - RNA, 20 nt, Human
ugcaaacauaacaaaaucac

SEQ ID NO: 2072648 - RNA, 22 nt, Human
ugcaaacaugggguuggcuggg

SEQ ID NO: 2072649 - RNA, 23 nt, Human
ugcaaacacacaaagguauaauu

SEQ ID NO: 2072650 - RNA, 14 nt, Human
ugcaaaauuuccag

SEQ ID NO: 2072651 - RNA, 15 nt, Human
ugcaaaauuuccagu

SEQ ID NO: 2072652 - RNA, 16 nt, Human
ugcaaaauuuccagua

SEQ ID NO: 2072653 - RNA, 21 nt, Human
ugcaaaauuuccaguaccuuu

SEQ ID NO: 2072654 - RNA, 17 nt, Human
ugcaaaaugagacccuc

SEQ ID NO: 2072655 - RNA, 23 nt, Human
ugcaaaagguucacuaaagcagu

SEQ ID NO: 2072656 - RNA, 22 nt, Human
ugcaaaagguucacuaaagcag

SEQ ID NO: 2072657 - RNA, 17 nt, Human
ugcaacaggcugggcuu

SEQ ID NO: 2072658 - RNA, 16 nt, Human
ugcaacaggcugggcu

SEQ ID NO: 2072659 - RNA, 15 nt, Human
ugcaacaggcugggc

SEQ ID NO: 2072660 - RNA, 14 nt, Human
ugcaacaggcuggg

SEQ ID NO: 2072661 - RNA, 13 nt, Human
ugcaacaguagca

SEQ ID NO: 2072662 - RNA, 14 nt, Human
ugcaacaguagcau

SEQ ID NO: 2072663 - RNA, 20 nt, Human
ugcaacaggcugggcuucag

SEQ ID NO: 2072664 - RNA, 19 nt, Human
ugcaacaggcugggcuuca

SEQ ID NO: 2072665 - RNA, 14 nt, Human
ugcaaccuccgccu

SEQ ID NO: 2072666 - RNA, 13 nt, Human
ugcaaccuccgcc

SEQ ID NO: 2072667 - RNA, 15 nt, Human
ugcaacccuuacccc

SEQ ID NO: 2072668 - RNA, 17 nt, Human
ugcaacccuuaccccuu

SEQ ID NO: 2072669 - RNA, 13 nt, Human
ugccucccugucc

SEQ ID NO: 2072670 - RNA, 15 nt, Human
ugccucccuguccac

SEQ ID NO: 2072671 - RNA, 16 nt, Human
ugccucccuguccacc

SEQ ID NO: 2072672 - RNA, 17 nt, Human
ugccucccuguccaccc

SEQ ID NO: 2072673 - RNA, 19 nt, Human
ugccucccugacccugcag

SEQ ID NO: 2072674 - RNA, 20 nt, Human
ugccucccugacccugcaga

SEQ ID NO: 2072675 - RNA, 13 nt, Human
ugccuaagcccuc

SEQ ID NO: 2072676 - RNA, 20 nt, Human
ugccgugugcccucgggcga

SEQ ID NO: 2072677 - RNA, 16 nt, Human
ugccguuacucuccaa

SEQ ID NO: 2072678 - RNA, 19 nt, Human
ugccguuacucuccaaccu

SEQ ID NO: 2072679 - RNA, 22 nt, Human
ugccguuacucuccaaccugga

SEQ ID NO: 2072680 - RNA, 14 nt, Human
ugccucugccuguc

SEQ ID NO: 2072681 - RNA, 13 nt, Human
ugccucugccugu

SEQ ID NO: 2072682 - RNA, 18 nt, Human
ugccucugccugucuccc

SEQ ID NO: 2072683 - RNA, 16 nt, Human
ugccucugccugcauu

SEQ ID NO: 2072684 - RNA, 17 nt, Human
ugccucuggaggccucu

SEQ ID NO: 2072685 - RNA, 20 nt, Human
ugccucuggaggccucuggg

SEQ ID NO: 2072686 - RNA, 13 nt, Human
ugccucugggacu

SEQ ID NO: 2072687 - RNA, 19 nt, Human
ugccugguggcagcugcgg

SEQ ID NO: 2072688 - RNA, 13 nt, Human
ugccuguaaacau

SEQ ID NO: 2072689 - RNA, 16 nt, Human
ugccuguaguuaggaa

SEQ ID NO: 2072690 - RNA, 17 nt, Human
ugccuguaguuaggaaa

SEQ ID NO: 2072691 - RNA, 18 nt, Human
ugccuguaguuaggaaau

SEQ ID NO: 2072692 - RNA, 19 nt, Human
ugccuguaguuaggaaaua

SEQ ID NO: 2072693 - RNA, 20 nt, Human
ugccuguaguuaggaaauaa

SEQ ID NO: 2072694 - RNA, 21 nt, Human
ugccuguaguuaggaaauaaa

SEQ ID NO: 2072695 - RNA, 22 nt, Human
ugccuguaguuaggaaauaaaa

SEQ ID NO: 2072696 - RNA, 18 nt, Human
ugccugguggcagcugcg

SEQ ID NO: 2072697 - RNA, 17 nt, Human
ugccugguggcagcugc

SEQ ID NO: 2072698 - RNA, 22 nt, Human
ugccuggguuccaauccuggcu

SEQ ID NO: 2072699 - RNA, 16 nt, Human
ugccuggguggggcug

SEQ ID NO: 2072700 - RNA, 17 nt, Human
ugccuggguggggcugc

SEQ ID NO: 2072701 - RNA, 19 nt, Human
ugccuggguggggcugcuc

SEQ ID NO: 2072702 - RNA, 21 nt, Human
ugccuggguggggcugcuccu

SEQ ID NO: 2072703 - RNA, 22 nt, Human
ugccuggguggggcugcuccuc

SEQ ID NO: 2072704 - RNA, 23 nt, Human
ugccuggguggggcugcuccucc

SEQ ID NO: 2072705 - RNA, 24 nt, Human
ugccuggguggggcugcuccucca

SEQ ID NO: 2072706 - RNA, 13 nt, Human
ugccugcccaccc

SEQ ID NO: 2072707 - RNA, 14 nt, Human
ugccugcccacccg

SEQ ID NO: 2072708 - RNA, 15 nt, Human
ugccugcccacccgu

SEQ ID NO: 2072709 - RNA, 16 nt, Human
ugccugcccacccgug

SEQ ID NO: 2072710 - RNA, 13 nt, Human
ugccugcauucug

SEQ ID NO: 2072711 - RNA, 15 nt, Human
ugccugcauguauuu

SEQ ID NO: 2072712 - RNA, 15 nt, Human
ugccugcagccccgc

SEQ ID NO: 2072713 - RNA, 22 nt, Human
ugccugcagccccgcgccuccu

SEQ ID NO: 2072714 - RNA, 13 nt, Human
ugccucuuccucc

SEQ ID NO: 2072715 - RNA, 21 nt, Human
ugccucuucucuacucuaggg

SEQ ID NO: 2072716 - RNA, 11 nt, Human
ugccugcagcc

SEQ ID NO: 2072717 - RNA, 23 nt, Human
ugcccugcugccgccucccagcc

SEQ ID NO: 2072718 - RNA, 21 nt, Human
ugcccugcugccgccucccag

SEQ ID NO: 2072719 - RNA, 11 nt, Human
ugcccugcugc

SEQ ID NO: 2072720 - RNA, 19 nt, Human
ugcccuggaggaaccgaaa

SEQ ID NO: 2072721 - RNA, 18 nt, Human
ugcccuggauccaucagg

SEQ ID NO: 2072722 - RNA, 21 nt, Human
ugcccuggugcugccacacuu

SEQ ID NO: 2072723 - RNA, 15 nt, Human
ugcccugguuucacu

SEQ ID NO: 2072724 - RNA, 17 nt, Human
ugcccugguuucacugg

SEQ ID NO: 2072725 - RNA, 18 nt, Human
ugcccuggugcugccaca

SEQ ID NO: 2072726 - RNA, 20 nt, Human
ugcccuggugcugccacacu

SEQ ID NO: 2072727 - RNA, 22 nt, Human
ugcccugguuucacuggcccaa

SEQ ID NO: 2072728 - RNA, 14 nt, Human
ugccggguuuuaua

SEQ ID NO: 2072729 - RNA, 18 nt, Human
ugccggguuuuauauuuu

SEQ ID NO: 2072730 - RNA, 11 nt, Human
ugcccugcccc

SEQ ID NO: 2072731 - RNA, 16 nt, Human
ugcccugcccuagcuc

SEQ ID NO: 2072732 - RNA, 18 nt, Human
ugcccggggcagcugcca

SEQ ID NO: 2072733 - RNA, 20 nt, Human
ugcccggggcagcugccaga

SEQ ID NO: 2072734 - RNA, 23 nt, Human
ugcccggggcagcugccagagaa

SEQ ID NO: 2072735 - RNA, 13 nt, Human
ugcccgucuucag

SEQ ID NO: 2072736 - RNA, 16 nt, Human
ugcccgucuucagccu

SEQ ID NO: 2072737 - RNA, 17 nt, Human
ugcccgucuucagccua

SEQ ID NO: 2072738 - RNA, 18 nt, Human
ugcccgucuucagccuag

SEQ ID NO: 2072739 - RNA, 19 nt, Human
ugcccgucuucagccuagc

SEQ ID NO: 2072740 - RNA, 20 nt, Human
ugccacugagagaucugcug

SEQ ID NO: 2072741 - RNA, 13 nt, Human
ugccacugcacuc

SEQ ID NO: 2072742 - RNA, 14 nt, Human
ugccacugcacucc

SEQ ID NO: 2072743 - RNA, 17 nt, Human
ugccacugcccgagcug

SEQ ID NO: 2072744 - RNA, 12 nt, Human
ugccauccaggu

SEQ ID NO: 2072745 - RNA, 15 nt, Human
ugccauccagguuca

SEQ ID NO: 2072746 - RNA, 17 nt, Human
ugccagguuuuuggucu

SEQ ID NO: 2072747 - RNA, 18 nt, Human
ugccacugcccgagcugg

SEQ ID NO: 2072748 - RNA, 19 nt, Human
ugccacugcccgagcuggu

SEQ ID NO: 2072749 - RNA, 16 nt, Human
ugccauguuggccagg

SEQ ID NO: 2072750 - RNA, 15 nt, Human
ugccauguuggccag

SEQ ID NO: 2072751 - RNA, 12 nt, Human
ugccauguuggc

SEQ ID NO: 2072752 - RNA, 18 nt, Human
ugcccacgcuggagugca

SEQ ID NO: 2072753 - RNA, 11 nt, Human
ugcccaccugu

SEQ ID NO: 2072754 - RNA, 21 nt, Human
ugcccagaacuggacucagga

SEQ ID NO: 2072755 - RNA, 17 nt, Human
ugccaugugugcugaac

SEQ ID NO: 2072756 - RNA, 15 nt, Human
ugccaugugaagagg

SEQ ID NO: 2072757 - RNA, 16 nt, Human
ugccaugugaagaggg

SEQ ID NO: 2072758 - RNA, 15 nt, Human
ugccaugugccaggu

SEQ ID NO: 2072759 - RNA, 14 nt, Human
ugccaugugccagg

SEQ ID NO: 2072760 - RNA, 18 nt, Human
ugccauguacaguauguu

SEQ ID NO: 2072761 - RNA, 20 nt, Human
ugccaugacaacuucuaauu

SEQ ID NO: 2072762 - RNA, 16 nt, Human
ugccaugaacuggagg

SEQ ID NO: 2072763 - RNA, 19 nt, Human
ugccaugaacuggaggcca

SEQ ID NO: 2072764 - RNA, 22 nt, Human
ugccaugaacuggaggccagga

SEQ ID NO: 2072765 - RNA, 15 nt, Human
ugcauguauaaauga

SEQ ID NO: 2072766 - RNA, 17 nt, Human
ugcauguauaaaugaag

SEQ ID NO: 2072767 - RNA, 22 nt, Human
ugcauguuaggaaaauuucaca

SEQ ID NO: 2072768 - RNA, 15 nt, Human
ugcagaugccagagc

SEQ ID NO: 2072769 - RNA, 16 nt, Human
ugcagaugccagagca

SEQ ID NO: 2072770 - RNA, 11 nt, Human
ugcagaugcca

SEQ ID NO: 2072771 - RNA, 19 nt, Human
ugcauccguaguucccuga

SEQ ID NO: 2072772 - RNA, 20 nt, Human
ugcauccguaguucccugaa

SEQ ID NO: 2072773 - RNA, 16 nt, Human
ugcauccgugagcagu

SEQ ID NO: 2072774 - RNA, 23 nt, Human
ugcauccgugagcagugugucuc

SEQ ID NO: 2072775 - RNA, 21 nt, Human
ugcauccauuccucagggaca

SEQ ID NO: 2072776 - RNA, 20 nt, Human
ugcauccauuccucagggac

SEQ ID NO: 2072777 - RNA, 13 nt, Human
ugcagauucauuu

SEQ ID NO: 2072778 - RNA, 17 nt, Human
ugccaccaacuggcccu

SEQ ID NO: 2072779 - RNA, 18 nt, Human
ugccaccaacuggcccuc

SEQ ID NO: 2072780 - RNA, 19 nt, Human
ugccaccaacuggcccucu

SEQ ID NO: 2072781 - RNA, 20 nt, Human
ugccaccaacuggcccucuu

SEQ ID NO: 2072782 - RNA, 21 nt, Human
ugccaccaacuggcccucuuc

SEQ ID NO: 2072783 - RNA, 21 nt, Human
ugcauuuuaaaguuaaacauu

SEQ ID NO: 2072784 - RNA, 17 nt, Human
ugcauuuucaccccacc

SEQ ID NO: 2072785 - RNA, 16 nt, Human
ugcauuuucugaaacu

SEQ ID NO: 2072786 - RNA, 19 nt, Human
ugcauuuucugaaacuaau

SEQ ID NO: 2072787 - RNA, 20 nt, Human
ugcauuuucugaaacuaaug

SEQ ID NO: 2072788 - RNA, 22 nt, Human
ugcauuuucugaaacuaaugaa

SEQ ID NO: 2072789 - RNA, 23 nt, Human
ugcauuuucugaaacuaaugaaa

SEQ ID NO: 2072790 - RNA, 16 nt, Human
ugcauuuucuggguuc

SEQ ID NO: 2072791 - RNA, 23 nt, Human
ugcauuuucuggguucugggugg

SEQ ID NO: 2072792 - RNA, 18 nt, Human
ugcauuuugcagcaguga

SEQ ID NO: 2072793 - RNA, 23 nt, Human
ugcauuacagagaggagaaacac

SEQ ID NO: 2072794 - RNA, 14 nt, Human
ugcauuacauuccu

SEQ ID NO: 2072795 - RNA, 19 nt, Human
ugcauuagaaauagacagu

SEQ ID NO: 2072796 - RNA, 20 nt, Human
ugcauuagaaauagacagua

SEQ ID NO: 2072797 - RNA, 22 nt, Human
ugcauuagaaauagacaguaua

SEQ ID NO: 2072798 - RNA, 13 nt, Human
ugcauuagaaauu

SEQ ID NO: 2072799 - RNA, 14 nt, Human
ugcauuagaaauua

SEQ ID NO: 2072800 - RNA, 23 nt, Human
ugcauuagaaauuagcuguguga

SEQ ID NO: 2072801 - RNA, 15 nt, Human
uuuucagauauaaaa

SEQ ID NO: 2072802 - RNA, 14 nt, Human
uuuucagacucaga

SEQ ID NO: 2072803 - RNA, 14 nt, Human
uuuucagacugcuu

SEQ ID NO: 2072804 - RNA, 18 nt, Human
uuuucagacugcuuuaaa

SEQ ID NO: 2072805 - RNA, 20 nt, Human
uuuucccagauacuucccau

SEQ ID NO: 2072806 - RNA, 16 nt, Human
uuuucagacucagacu

SEQ ID NO: 2072807 - RNA, 17 nt, Human
uuuucagaaccucuucc

SEQ ID NO: 2072808 - RNA, 18 nt, Human
uuuucagaaccucuuccc

SEQ ID NO: 2072809 - RNA, 11 nt, Human
uuuucagaauc

SEQ ID NO: 2072810 - RNA, 13 nt, Human
uuuucagaaucug

SEQ ID NO: 2072811 - RNA, 16 nt, Human
uuuucagaaucugaau

SEQ ID NO: 2072812 - RNA, 17 nt, Human
uuuucagaaucugaaug

SEQ ID NO: 2072813 - RNA, 20 nt, Human
uuuucagaaucugaauguaa

SEQ ID NO: 2072814 - RNA, 21 nt, Human
uuuucagaaucugaauguaau

SEQ ID NO: 2072815 - RNA, 22 nt, Human
uuuucagaaucugaauguaauu

SEQ ID NO: 2072816 - RNA, 23 nt, Human
uuuucagaaucugaauguaauuu

SEQ ID NO: 2072817 - RNA, 11 nt, Human
uuuucagaccc

SEQ ID NO: 2072818 - RNA, 22 nt, Human
uuuucagaaccucuuccccaga

SEQ ID NO: 2072819 - RNA, 15 nt, Human
uuuucagaaauaugu

SEQ ID NO: 2072820 - RNA, 18 nt, Human
uuuucccuauuagagaag

SEQ ID NO: 2072821 - RNA, 22 nt, Human
uuuucccuauuagagaagagau

SEQ ID NO: 2072822 - RNA, 16 nt, Human
uuuucccccaaagugg

SEQ ID NO: 2072823 - RNA, 18 nt, Human
uuuuccccccacucuccc

SEQ ID NO: 2072824 - RNA, 19 nt, Human
uuuuccccccacucucccc

SEQ ID NO: 2072825 - RNA, 19 nt, Human
uuuuccccggucccuugag

SEQ ID NO: 2072826 - RNA, 23 nt, Human
uuuuccccggucccuugagaccu

SEQ ID NO: 2072827 - RNA, 14 nt, Human
uuuucaaauuguau

SEQ ID NO: 2072828 - RNA, 19 nt, Human
uuuucaaauuguaucuagu

SEQ ID NO: 2072829 - RNA, 21 nt, Human
uuuucaaaccaguauacaaga

SEQ ID NO: 2072830 - RNA, 22 nt, Human
uuuucaaaccaguauacaagau

SEQ ID NO: 2072831 - RNA, 23 nt, Human
uuuucaccuguuuuuaagcuguu

SEQ ID NO: 2072832 - RNA, 13 nt, Human
uuuucaccccacc

SEQ ID NO: 2072833 - RNA, 20 nt, Human
uuuucaccccacccuucccc

SEQ ID NO: 2072834 - RNA, 14 nt, Human
uuuuccuaaaugca

SEQ ID NO: 2072835 - RNA, 15 nt, Human
uuuuccuaaauguau

SEQ ID NO: 2072836 - RNA, 20 nt, Human
uuuugaacuaauaaaagcau

SEQ ID NO: 2072837 - RNA, 21 nt, Human
uuuugaacuaauaaaagcaua

SEQ ID NO: 2072838 - RNA, 16 nt, Human
uuuucuucaugcaaug

SEQ ID NO: 2072839 - RNA, 11 nt, Human
uuuucuuccuu

SEQ ID NO: 2072840 - RNA, 15 nt, Human
uuuucuuguuuauca

SEQ ID NO: 2072841 - RNA, 18 nt, Human
uuuucuuguuuaucagca

SEQ ID NO: 2072842 - RNA, 19 nt, Human
uuuucuuguuuaucagcag

SEQ ID NO: 2072843 - RNA, 13 nt, Human
uuuucuucucccu

SEQ ID NO: 2072844 - RNA, 21 nt, Human
uuuucuucaacaucaauguuc

SEQ ID NO: 2072845 - RNA, 22 nt, Human
uuuucuucaacaucaauguuca

SEQ ID NO: 2072846 - RNA, 23 nt, Human
uuuuacaaauuggagcagggaca

SEQ ID NO: 2072847 - RNA, 17 nt, Human
uuuuacaauaaaaucuu

SEQ ID NO: 2072848 - RNA, 14 nt, Human
uuuuacaauugaaa

SEQ ID NO: 2072849 - RNA, 17 nt, Human
uuuuaaauaaaagcagc

SEQ ID NO: 2072850 - RNA, 19 nt, Human
uuuuacaaaaaagaaaaga

SEQ ID NO: 2072851 - RNA, 15 nt, Human
uuuuaaauaaaagca

SEQ ID NO: 2072852 - RNA, 17 nt, Human
uuuuaaauaaaagugau

SEQ ID NO: 2072853 - RNA, 16 nt, Human
uuuuaaaguauauauu

SEQ ID NO: 2072854 - RNA, 21 nt, Human
uuuuaaagucuugcugugguc

SEQ ID NO: 2072855 - RNA, 18 nt, Human
uuuuaccuaccacagugu

SEQ ID NO: 2072856 - RNA, 19 nt, Human
uuuuaccuaccacaguguc

SEQ ID NO: 2072857 - RNA, 20 nt, Human
uuuuaccuaccacagugucu

SEQ ID NO: 2072858 - RNA, 16 nt, Human
uuuuacaauugaaaug

SEQ ID NO: 2072859 - RNA, 21 nt, Human
uuuuaccuaccacagugucug

SEQ ID NO: 2072860 - RNA, 14 nt, Human
uuuuacuacugugg

SEQ ID NO: 2072861 - RNA, 15 nt, Human
uuuuauacaggggaa

SEQ ID NO: 2072862 - RNA, 14 nt, Human
uuuuauacaguagu

SEQ ID NO: 2072863 - RNA, 17 nt, Human
uuuuauacaguagugag

SEQ ID NO: 2072864 - RNA, 23 nt, Human
uuuuauacaguagugagaagaau

SEQ ID NO: 2072865 - RNA, 13 nt, Human
uuuuaucuuuucu

SEQ ID NO: 2072866 - RNA, 16 nt, Human
uuuuaucuuuucuaca

SEQ ID NO: 2072867 - RNA, 17 nt, Human
uuuuaucuuuucuacag

SEQ ID NO: 2072868 - RNA, 23 nt, Human
uuuuaugaagaaaaaauacauuu

SEQ ID NO: 2072869 - RNA, 23 nt, Human
uuuuaucuccccuucacaugcau

SEQ ID NO: 2072870 - RNA, 18 nt, Human
uuuuauuuuuagacagag

SEQ ID NO: 2072871 - RNA, 16 nt, Human
uuuuauuuuuuauaca

SEQ ID NO: 2072872 - RNA, 17 nt, Human
uuuuauuuuuuucuacc

SEQ ID NO: 2072873 - RNA, 17 nt, Human
uuuucaaaauaaaaaug

SEQ ID NO: 2072874 - RNA, 17 nt, Human
uuuuauauaauaaagua

SEQ ID NO: 2072875 - RNA, 22 nt, Human
uuuuauauaauaaaguauucca

SEQ ID NO: 2072876 - RNA, 12 nt, Human
uuuuauacugua

SEQ ID NO: 2072877 - RNA, 15 nt, Human
uuuuauacuguacuu

SEQ ID NO: 2072878 - RNA, 16 nt, Human
uuuccguggcacugca

SEQ ID NO: 2072879 - RNA, 14 nt, Human
uuugaguguuuuaa

SEQ ID NO: 2072880 - RNA, 21 nt, Human
uuugaguggaugauguuucgu

SEQ ID NO: 2072881 - RNA, 16 nt, Human
uuugaguggaugaugu

SEQ ID NO: 2072882 - RNA, 20 nt, Human
uuugaguggaugauguuucg

SEQ ID NO: 2072883 - RNA, 14 nt, Human
uuuccuaaaaguuc

SEQ ID NO: 2072884 - RNA, 22 nt, Human
uuuccacaagauucccagagac

SEQ ID NO: 2072885 - RNA, 19 nt, Human
uuuccacaaaaucugucca

SEQ ID NO: 2072886 - RNA, 20 nt, Human
uuuccacaagauucccagag

SEQ ID NO: 2072887 - RNA, 12 nt, Human
uuuggaaaauaa

SEQ ID NO: 2072888 - RNA, 16 nt, Human
uuuggacacacacagc

SEQ ID NO: 2072889 - RNA, 17 nt, Human
uuuggacacacacagcu

SEQ ID NO: 2072890 - RNA, 21 nt, Human
uuugcaguagagucaucucca

SEQ ID NO: 2072891 - RNA, 12 nt, Human
uuugcaggcuca

SEQ ID NO: 2072892 - RNA, 14 nt, Human
uuugcauuccuaca

SEQ ID NO: 2072893 - RNA, 21 nt, Human
uuugguccuucaaaggcuugu

SEQ ID NO: 2072894 - RNA, 22 nt, Human
uuugguccuaagucccugcccc

SEQ ID NO: 2072895 - RNA, 23 nt, Human
uuuguauuuuauuuuuuucucuc

SEQ ID NO: 2072896 - RNA, 12 nt, Human
uuugugugagag

SEQ ID NO: 2072897 - RNA, 14 nt, Human
uuugugugagagac

SEQ ID NO: 2072898 - RNA, 14 nt, Human
uuugucaaacugua

SEQ ID NO: 2072899 - RNA, 15 nt, Human
uuugugugaaauaau

SEQ ID NO: 2072900 - RNA, 15 nt, Human
uuuguugucagcuga

SEQ ID NO: 2072901 - RNA, 13 nt, Human
uuuguuaccuuua

SEQ ID NO: 2072902 - RNA, 13 nt, Human
uuuguuauucuua

SEQ ID NO: 2072903 - RNA, 16 nt, Human
uuuguuauucuuaaga

SEQ ID NO: 2072904 - RNA, 20 nt, Human
uuuuaaacccuauugguaaa

SEQ ID NO: 2072905 - RNA, 12 nt, Human
uuuguuguaaaa

SEQ ID NO: 2072906 - RNA, 15 nt, Human
uuuguuguaaagagu

SEQ ID NO: 2072907 - RNA, 16 nt, Human
uuuguuguaaagaguu

SEQ ID NO: 2072908 - RNA, 17 nt, Human
uuuguuguaaagaguug

SEQ ID NO: 2072909 - RNA, 19 nt, Human
uuuuaaaaucacuaacauu

SEQ ID NO: 2072910 - RNA, 20 nt, Human
uuuuaaaaucacuaacauua

SEQ ID NO: 2072911 - RNA, 12 nt, Human
uuuuucaguuuu

SEQ ID NO: 2072912 - RNA, 15 nt, Human
uuuuucaguuuucag

SEQ ID NO: 2072913 - RNA, 21 nt, Human
uuuuucauugauaugaaaaau

SEQ ID NO: 2072914 - RNA, 18 nt, Human
uuuuuaaguuacacauuu

SEQ ID NO: 2072915 - RNA, 18 nt, Human
uuuuuaauaaaaaggcac

SEQ ID NO: 2072916 - RNA, 17 nt, Human
uuuuuaauaaagacagg

SEQ ID NO: 2072917 - RNA, 20 nt, Human
uuuuuaauaaagacaggguu

SEQ ID NO: 2072918 - RNA, 21 nt, Human
uuuuuaauauguaaggaaugc

SEQ ID NO: 2072919 - RNA, 14 nt, Human
uuuuucagaaauau

SEQ ID NO: 2072920 - RNA, 21 nt, Human
uuuuucagcagacuaugaaua

SEQ ID NO: 2072921 - RNA, 22 nt, Human
uuuuuaacucaauauuuuccau

SEQ ID NO: 2072922 - RNA, 21 nt, Human
uuuugaagcuaauuauuuuaa

SEQ ID NO: 2072923 - RNA, 22 nt, Human
uuuugaagcuaauuauuuuaau

SEQ ID NO: 2072924 - RNA, 17 nt, Human
uuuugacuuaaagcaga

SEQ ID NO: 2072925 - RNA, 22 nt, Human
uuuugacuagggauucaggcug

SEQ ID NO: 2072926 - RNA, 20 nt, Human
uuuuuaaauuuucuucaguu

SEQ ID NO: 2072927 - RNA, 13 nt, Human
uuuuuuuaaaauc

SEQ ID NO: 2072928 - RNA, 13 nt, Human
uuuuuuccacuua

SEQ ID NO: 2072929 - RNA, 18 nt, Human
uuuuucccuaucacugaa

SEQ ID NO: 2072930 - RNA, 17 nt, Human
uuuuuuaaguauuuaua

SEQ ID NO: 2072931 - RNA, 21 nt, Human
uuuuuccaucauaauucuaau

SEQ ID NO: 2072932 - RNA, 12 nt, Human
uuuuuuaauuga

SEQ ID NO: 2072933 - RNA, 23 nt, Human
uuuuuuacaaauuggagcaggga

SEQ ID NO: 2072934 - RNA, 18 nt, Human
uuuuuucaauauuuauua

SEQ ID NO: 2072935 - RNA, 12 nt, Human
uuuuuucaucuu

SEQ ID NO: 2072936 - RNA, 19 nt, Human
uugcacguauuuuaauagc

SEQ ID NO: 2072937 - RNA, 17 nt, Human
uugcacgcccaugugug

SEQ ID NO: 2072938 - RNA, 18 nt, Human
uugcacgcccauguguga

SEQ ID NO: 2072939 - RNA, 20 nt, Human
uugcacgcccaugugugagu

SEQ ID NO: 2072940 - RNA, 14 nt, Human
uugcacuccagccu

SEQ ID NO: 2072941 - RNA, 15 nt, Human
uugcacuccagccug

SEQ ID NO: 2072942 - RNA, 21 nt, Human
uuggguguaacaggucuccuc

SEQ ID NO: 2072943 - RNA, 23 nt, Human
uuggguguaacaggucuccucuu

SEQ ID NO: 2072944 - RNA, 20 nt, Human
uuggguuaggagaagucaag

SEQ ID NO: 2072945 - RNA, 22 nt, Human
uuggguucaagcgauucuucug

SEQ ID NO: 2072946 - RNA, 20 nt, Human
uugauuuguuuuagaaugau

SEQ ID NO: 2072947 - RNA, 21 nt, Human
uuggguuaaaaaaaaaaaaag

SEQ ID NO: 2072948 - RNA, 21 nt, Human
uuggugaacauugcaauagaa

SEQ ID NO: 2072949 - RNA, 22 nt, Human
uuguaaaaauuaaaaguuaugg

SEQ ID NO: 2072950 - RNA, 15 nt, Human
uuggucuuauuuauu

SEQ ID NO: 2072951 - RNA, 19 nt, Human
uuggucuuauuuauuauug

SEQ ID NO: 2072952 - RNA, 13 nt, Human
uuggucuguguga

SEQ ID NO: 2072953 - RNA, 20 nt, Human
uuggucagaguaagcugcuu

SEQ ID NO: 2072954 - RNA, 22 nt, Human
uuggucagaguaagcugcuuuu

SEQ ID NO: 2072955 - RNA, 16 nt, Human
uugguauuuaucuauu

SEQ ID NO: 2072956 - RNA, 22 nt, Human
uugguauuuaucuauuguaaga

SEQ ID NO: 2072957 - RNA, 23 nt, Human
uugguauuuaucuauuguaagau

SEQ ID NO: 2072958 - RNA, 22 nt, Human
uugguacuacuagaugucuuua

SEQ ID NO: 2072959 - RNA, 21 nt, Human
uuguaaaugugguaaagaguu

SEQ ID NO: 2072960 - RNA, 16 nt, Human
uuguaaaugugguaaa

SEQ ID NO: 2072961 - RNA, 17 nt, Human
uuguaaauagcucaggu

SEQ ID NO: 2072962 - RNA, 21 nt, Human
uuguaaauaagagauuuggag

SEQ ID NO: 2072963 - RNA, 22 nt, Human
uuguaaauacaaguucuauuua

SEQ ID NO: 2072964 - RNA, 23 nt, Human
uuguaaauacaaguucuauuuaa

SEQ ID NO: 2072965 - RNA, 14 nt, Human
uuguaaauacacau

SEQ ID NO: 2072966 - RNA, 15 nt, Human
uuguacguuuaaagu

SEQ ID NO: 2072967 - RNA, 16 nt, Human
uuguacguuuaaagug

SEQ ID NO: 2072968 - RNA, 17 nt, Human
uuguacguuuaaagugu

SEQ ID NO: 2072969 - RNA, 18 nt, Human
uuguacguuuaaagugua

SEQ ID NO: 2072970 - RNA, 18 nt, Human
uuguacauauguaaaaua

SEQ ID NO: 2072971 - RNA, 14 nt, Human
uuguauuaaagaca

SEQ ID NO: 2072972 - RNA, 18 nt, Human
uuguacuacaguucuuuu

SEQ ID NO: 2072973 - RNA, 16 nt, Human
uuguauuaaagacaga

SEQ ID NO: 2072974 - RNA, 20 nt, Human
uugucugaagucacugcaca

SEQ ID NO: 2072975 - RNA, 21 nt, Human
uugucugaagucacugcacag

SEQ ID NO: 2072976 - RNA, 15 nt, Human
uugucuuaaaaagug

SEQ ID NO: 2072977 - RNA, 13 nt, Human
uugucucagagca

SEQ ID NO: 2072978 - RNA, 14 nt, Human
uugugaaaugaugg

SEQ ID NO: 2072979 - RNA, 17 nt, Human
uugugaaaugaaaacau

SEQ ID NO: 2072980 - RNA, 20 nt, Human
uugucuuuguucuucuacca

SEQ ID NO: 2072981 - RNA, 19 nt, Human
uuguguuucuuuaguuuuu

SEQ ID NO: 2072982 - RNA, 17 nt, Human
uuguguuuuuaauuuau

SEQ ID NO: 2072983 - RNA, 21 nt, Human
uuguguuuuuaauuuauuuau

SEQ ID NO: 2072984 - RNA, 14 nt, Human
uuguuaaaacuggc

SEQ ID NO: 2072985 - RNA, 20 nt, Human
uuguuaaaacuggcaucuga

SEQ ID NO: 2072986 - RNA, 16 nt, Human
uuguuaaaauaacuag

SEQ ID NO: 2072987 - RNA, 21 nt, Human
uuguuaauaaaaguacauguu

SEQ ID NO: 2072988 - RNA, 22 nt, Human
uuguuaagucuaaauauuuccu

SEQ ID NO: 2072989 - RNA, 18 nt, Human
uuguuaaugaaaauguca

SEQ ID NO: 2072990 - RNA, 13 nt, Human
uuguuaauauucu

SEQ ID NO: 2072991 - RNA, 14 nt, Human
uuguuaauauucuu

SEQ ID NO: 2072992 - RNA, 15 nt, Human
uuguuaauauucuuu

SEQ ID NO: 2072993 - RNA, 17 nt, Human
uuguuaaugaaaauguc

SEQ ID NO: 2072994 - RNA, 14 nt, Human
uuguuaauaaaagu

SEQ ID NO: 2072995 - RNA, 19 nt, Human
uuguuaauaaaaguacaug

SEQ ID NO: 2072996 - RNA, 18 nt, Human
uuguguuuuuaauuuauu

SEQ ID NO: 2072997 - RNA, 14 nt, Human
uuguuaaauauuua

SEQ ID NO: 2072998 - RNA, 11 nt, Human
uuguuaacuuu

SEQ ID NO: 2072999 - RNA, 14 nt, Human
uuguuaacuuuggg

SEQ ID NO: 2073000 - RNA, 17 nt, Human
uuguuaagauaugaugu

SEQ ID NO: 2073001 - RNA, 21 nt, Human
uuguuacaggcaccgagaaug

SEQ ID NO: 2073002 - RNA, 12 nt, Human
uuguuaccuuua

SEQ ID NO: 2073003 - RNA, 19 nt, Human
uuguuaaugguuugaauau

SEQ ID NO: 2073004 - RNA, 19 nt, Human
uuguuaaugaaaaugucag

SEQ ID NO: 2073005 - RNA, 17 nt, Human
uuguuaauggugcaaau

SEQ ID NO: 2073006 - RNA, 20 nt, Human
uuguuucauugacuaucaaa

SEQ ID NO: 2073007 - RNA, 20 nt, Human
uuguuuauuuaucagugaca

SEQ ID NO: 2073008 - RNA, 17 nt, Human
uuguuuauuuuuauaua

SEQ ID NO: 2073009 - RNA, 16 nt, Human
uuguuugaaaauauua

SEQ ID NO: 2073010 - RNA, 19 nt, Human
uuguuugcucaccuggggu

SEQ ID NO: 2073011 - RNA, 13 nt, Human
uuguuugcuuauu

SEQ ID NO: 2073012 - RNA, 16 nt, Human
uuguuucucccccugg

SEQ ID NO: 2073013 - RNA, 21 nt, Human
uuguuguuaaugaaaauguca

SEQ ID NO: 2073014 - RNA, 19 nt, Human
uuguuauggcuuaaugaca

SEQ ID NO: 2073015 - RNA, 14 nt, Human
uuguuauggcuuaa

SEQ ID NO: 2073016 - RNA, 23 nt, Human
uugugcuacaugacgacaaagcu

SEQ ID NO: 2073017 - RNA, 14 nt, Human
uugugcugaugaga

SEQ ID NO: 2073018 - RNA, 22 nt, Human
uugugcugaucgugcuaaauuu

SEQ ID NO: 2073019 - RNA, 11 nt, Human
uugugcagaga

SEQ ID NO: 2073020 - RNA, 23 nt, Human
uugugaaaugaaaacauguaaua

SEQ ID NO: 2073021 - RNA, 13 nt, Human
uuguguuguuuga

SEQ ID NO: 2073022 - RNA, 21 nt, Human
uuguguuguuugaaaauauua

SEQ ID NO: 2073023 - RNA, 13 nt, Human
uuguguucuaaua

SEQ ID NO: 2073024 - RNA, 20 nt, Human
uuguguucuguuuguuaaaa

SEQ ID NO: 2073025 - RNA, 22 nt, Human
uuguguucuguuuguuaaaacu

SEQ ID NO: 2073026 - RNA, 19 nt, Human
uuguggcagaaguguuuca

SEQ ID NO: 2073027 - RNA, 22 nt, Human
uuguggaggagcucaggacacu

SEQ ID NO: 2073028 - RNA, 21 nt, Human
uuguggaaaaugaaaauuagg

SEQ ID NO: 2073029 - RNA, 18 nt, Human
uuguggaaagccucugcu

SEQ ID NO: 2073030 - RNA, 16 nt, Human
uuguggacacagcucu

SEQ ID NO: 2073031 - RNA, 17 nt, Human
uuguggacacagcucuu

SEQ ID NO: 2073032 - RNA, 18 nt, Human
uuuaaguuacacauuuuu

SEQ ID NO: 2073033 - RNA, 22 nt, Human
uuuaaguguaacuggcaguuuu

SEQ ID NO: 2073034 - RNA, 18 nt, Human
uuuaagugcuuuguaaug

SEQ ID NO: 2073035 - RNA, 14 nt, Human
uuuaaguguaacug

SEQ ID NO: 2073036 - RNA, 20 nt, Human
uuuaauaaaaaggcaccuau

SEQ ID NO: 2073037 - RNA, 11 nt, Human
uuuaauaaaag

SEQ ID NO: 2073038 - RNA, 19 nt, Human
uuuaauaacauaacaaaua

SEQ ID NO: 2073039 - RNA, 22 nt, Human
uuuaagacagucccaucaaaac

SEQ ID NO: 2073040 - RNA, 16 nt, Human
uuuaagaccagccugg

SEQ ID NO: 2073041 - RNA, 11 nt, Human
uuuaagaaaau

SEQ ID NO: 2073042 - RNA, 12 nt, Human
uuuaagaaaaua

SEQ ID NO: 2073043 - RNA, 13 nt, Human
uuuaagaaaauac

SEQ ID NO: 2073044 - RNA, 16 nt, Human
uuuaagaaaauacaau

SEQ ID NO: 2073045 - RNA, 20 nt, Human
uuuaagaaaauacaauaaac

SEQ ID NO: 2073046 - RNA, 21 nt, Human
uuuaagaaaauacaauaaacu

SEQ ID NO: 2073047 - RNA, 22 nt, Human
uuuaagaaaauacaauaaacua

SEQ ID NO: 2073048 - RNA, 22 nt, Human
uuuaagaaaaaauaacacacau

SEQ ID NO: 2073049 - RNA, 18 nt, Human
uuuaagaaaaaauaacac

SEQ ID NO: 2073050 - RNA, 19 nt, Human
uuuaacuuuaucacauuau

SEQ ID NO: 2073051 - RNA, 15 nt, Human
uuuaacuagaauuua

SEQ ID NO: 2073052 - RNA, 22 nt, Human
uuuaacgaaugaagaugucuaa

SEQ ID NO: 2073053 - RNA, 17 nt, Human
uuuaacuagaauuuauu

SEQ ID NO: 2073054 - RNA, 24 nt, Human
uuuaacucaauauuuuccaugaaa

SEQ ID NO: 2073055 - RNA, 18 nt, Human
uuuaacucaggacuccag

SEQ ID NO: 2073056 - RNA, 19 nt, Human
uuuaacucaggacuccagc

SEQ ID NO: 2073057 - RNA, 17 nt, Human
uuuaaauuuucuucagu

SEQ ID NO: 2073058 - RNA, 21 nt, Human
uuuaaauuuucuucaguuggu

SEQ ID NO: 2073059 - RNA, 22 nt, Human
uuuaaauuuucuucaguuggug

SEQ ID NO: 2073060 - RNA, 15 nt, Human
uuguuugcuuauugu

SEQ ID NO: 2073061 - RNA, 23 nt, Human
uuguuuggaucaaaaucuguaga

SEQ ID NO: 2073062 - RNA, 23 nt, Human
uuuaacaacuaugauuuggaaaa

SEQ ID NO: 2073063 - RNA, 18 nt, Human
uuuaacaauaacuacugu

SEQ ID NO: 2073064 - RNA, 20 nt, Human
uuuaacaauaacuacugugu

SEQ ID NO: 2073065 - RNA, 21 nt, Human
uuuaacaauaacuacuguguu

SEQ ID NO: 2073066 - RNA, 22 nt, Human
uuuaacaauaacuacuguguuc

SEQ ID NO: 2073067 - RNA, 23 nt, Human
uuuaacaauaacuacuguguucc

SEQ ID NO: 2073068 - RNA, 11 nt, Human
uuuaacaaugc

SEQ ID NO: 2073069 - RNA, 14 nt, Human
uuuaacaaugcgaa

SEQ ID NO: 2073070 - RNA, 18 nt, Human
uuuaacaaugcgaauggu

SEQ ID NO: 2073071 - RNA, 20 nt, Human
uuuaacaaugcgaaugguag

SEQ ID NO: 2073072 - RNA, 14 nt, Human
uuuaacauaaaggu

SEQ ID NO: 2073073 - RNA, 22 nt, Human
uuuaacauaaagguuauuuucu

SEQ ID NO: 2073074 - RNA, 22 nt, Human
uuuaauagcgucauaacuagaa

SEQ ID NO: 2073075 - RNA, 21 nt, Human
uuuaauagcgucauaacuaga

SEQ ID NO: 2073076 - RNA, 14 nt, Human
uuuaauacagggua

SEQ ID NO: 2073077 - RNA, 19 nt, Human
uuuaauagaauauaauuau

SEQ ID NO: 2073078 - RNA, 21 nt, Human
uuuaauagaauauaauuaucg

SEQ ID NO: 2073079 - RNA, 21 nt, Human
uuuacaccaguuccuuucaau

SEQ ID NO: 2073080 - RNA, 15 nt, Human
uuuacacuuuugaga

SEQ ID NO: 2073081 - RNA, 19 nt, Human
uuuacacuuuugagacuuu

SEQ ID NO: 2073082 - RNA, 16 nt, Human
uuuacagcugccugca

SEQ ID NO: 2073083 - RNA, 15 nt, Human
uuuacagcugccugc

SEQ ID NO: 2073084 - RNA, 14 nt, Human
uuuacagaauugcu

SEQ ID NO: 2073085 - RNA, 19 nt, Human
uuuacagaauugcuuguuu

SEQ ID NO: 2073086 - RNA, 20 nt, Human
uuuacagcuuucaugauuag

SEQ ID NO: 2073087 - RNA, 23 nt, Human
uuuacagcuuucaugauuagcaa

SEQ ID NO: 2073088 - RNA, 17 nt, Human
uuuaccaaguuauauaa

SEQ ID NO: 2073089 - RNA, 20 nt, Human
uuuaccaaguuauauaaaga

SEQ ID NO: 2073090 - RNA, 21 nt, Human
uuuaccaaguuauauaaagag

SEQ ID NO: 2073091 - RNA, 14 nt, Human
uuuagaaauauaau

SEQ ID NO: 2073092 - RNA, 23 nt, Human
uuuagaaagaagcccaauauuau

SEQ ID NO: 2073093 - RNA, 22 nt, Human
uuuagaaacuuaucuuacaaag

SEQ ID NO: 2073094 - RNA, 19 nt, Human
uuuacuucuuauacauuug

SEQ ID NO: 2073095 - RNA, 22 nt, Human
uuuacuucuuauacauuugaua

SEQ ID NO: 2073096 - RNA, 15 nt, Human
uuuacuuguuucaga

SEQ ID NO: 2073097 - RNA, 17 nt, Human
uuuacuuguuucagagu

SEQ ID NO: 2073098 - RNA, 22 nt, Human
uuuaccacugcugugaacaagu

SEQ ID NO: 2073099 - RNA, 18 nt, Human
uuuacuugcauugaauau

SEQ ID NO: 2073100 - RNA, 21 nt, Human
uuuacuugcauugaauauauu

SEQ ID NO: 2073101 - RNA, 12 nt, Human
uuuagacagagu

SEQ ID NO: 2073102 - RNA, 16 nt, Human
uuuagacaaaucuaag

SEQ ID NO: 2073103 - RNA, 21 nt, Human
uuuagacaaaucuaagggaaa

SEQ ID NO: 2073104 - RNA, 17 nt, Human
uuuauaaaaaaaaugaa

SEQ ID NO: 2073105 - RNA, 18 nt, Human
uuuauaaaaaaaaugaaa

SEQ ID NO: 2073106 - RNA, 19 nt, Human
uuuauaaaaaaaaugaaau

SEQ ID NO: 2073107 - RNA, 20 nt, Human
uuuauaaaaaaaaugaaaug

SEQ ID NO: 2073108 - RNA, 21 nt, Human
uuuauaaaaaaaaugaaaugu

SEQ ID NO: 2073109 - RNA, 14 nt, Human
uuucagauauaaaa

SEQ ID NO: 2073110 - RNA, 16 nt, Human
uuucagauauaaaaga

SEQ ID NO: 2073111 - RNA, 18 nt, Human
uuucagauauaaaagacu

SEQ ID NO: 2073112 - RNA, 12 nt, Human
uuucagaugcuu

SEQ ID NO: 2073113 - RNA, 14 nt, Human
uuucagaugcuucu

SEQ ID NO: 2073114 - RNA, 16 nt, Human
uuucagaugcuucugg

SEQ ID NO: 2073115 - RNA, 15 nt, Human
uuucagaugcuuuag

SEQ ID NO: 2073116 - RNA, 20 nt, Human
uuucagaugcuucugggaga

SEQ ID NO: 2073117 - RNA, 16 nt, Human
uuucacaaccuucugu

SEQ ID NO: 2073118 - RNA, 22 nt, Human
uuucacaaccuucuguggcuca

SEQ ID NO: 2073119 - RNA, 17 nt, Human
uuucaauuuugcaugcu

SEQ ID NO: 2073120 - RNA, 19 nt, Human
uuucaauuuccaagagcug

SEQ ID NO: 2073121 - RNA, 18 nt, Human
uuucaauaacgaaguugg

SEQ ID NO: 2073122 - RNA, 21 nt, Human
uuucaauaacgaaguugggca

SEQ ID NO: 2073123 - RNA, 22 nt, Human
uuucaauaacgaaguugggcaa

SEQ ID NO: 2073124 - RNA, 21 nt, Human
uuucaagugaaucuaaaagcu

SEQ ID NO: 2073125 - RNA, 23 nt, Human
uuucagcaccuacaguguacagu

SEQ ID NO: 2073126 - RNA, 21 nt, Human
uuucagcaauauuuaaggaga

SEQ ID NO: 2073127 - RNA, 14 nt, Human
uuucagcagacuau

SEQ ID NO: 2073128 - RNA, 21 nt, Human
uuucagcagacuaugaauauu

SEQ ID NO: 2073129 - RNA, 13 nt, Human
uuucaguguacau

SEQ ID NO: 2073130 - RNA, 14 nt, Human
uuucaguguacaug

SEQ ID NO: 2073131 - RNA, 13 nt, Human
uuuccaagagcug

SEQ ID NO: 2073132 - RNA, 14 nt, Human
uuuccaagagcuga

SEQ ID NO: 2073133 - RNA, 16 nt, Human
uuuccaagagcugagg

SEQ ID NO: 2073134 - RNA, 13 nt, Human
uuuccaaggagcu

SEQ ID NO: 2073135 - RNA, 18 nt, Human
uuuccaaggagcugagaa

SEQ ID NO: 2073136 - RNA, 19 nt, Human
uuuccaaggagcugagaau

SEQ ID NO: 2073137 - RNA, 22 nt, Human
uuuccaaggagcugagaauaga

SEQ ID NO: 2073138 - RNA, 12 nt, Human
uuuccaagcaaa

SEQ ID NO: 2073139 - RNA, 13 nt, Human
uuuccaagcaaau

SEQ ID NO: 2073140 - RNA, 14 nt, Human
uuuccaagcaaaug

SEQ ID NO: 2073141 - RNA, 18 nt, Human
uuuccaagcaaauguuac

SEQ ID NO: 2073142 - RNA, 20 nt, Human
uuuccaagcaaauguuacau

SEQ ID NO: 2073143 - RNA, 21 nt, Human
uuuccaagcaaauguuacaua

SEQ ID NO: 2073144 - RNA, 22 nt, Human
uuuccaagcaaauguuacauag

SEQ ID NO: 2073145 - RNA, 23 nt, Human
uuuccaaauucacaaguuguguu

SEQ ID NO: 2073146 - RNA, 22 nt, Human
uuuauggccucagcugccucac

SEQ ID NO: 2073147 - RNA, 12 nt, Human
uuuauggccuca

SEQ ID NO: 2073148 - RNA, 13 nt, Human
uuuauggccucag

SEQ ID NO: 2073149 - RNA, 15 nt, Human
uuuauaauuuuaaga

SEQ ID NO: 2073150 - RNA, 18 nt, Human
uuuauaauuuuaagauuc

SEQ ID NO: 2073151 - RNA, 21 nt, Human
uuuauaauuuuaagauuccuu

SEQ ID NO: 2073152 - RNA, 22 nt, Human
uuuauaauuuuaagauuccuuu

SEQ ID NO: 2073153 - RNA, 21 nt, Human
uuuauaacucaucauaaaaua

SEQ ID NO: 2073154 - RNA, 20 nt, Human
uuuauaagcagauuuaacaa

SEQ ID NO: 2073155 - RNA, 19 nt, Human
uuuauaacuaguccuuuac

SEQ ID NO: 2073156 - RNA, 16 nt, Human
uuuauaacucaucaua

SEQ ID NO: 2073157 - RNA, 18 nt, Human
uuuauaacucaucauaaa

SEQ ID NO: 2073158 - RNA, 19 nt, Human
uuuauaacucaucauaaaa

SEQ ID NO: 2073159 - RNA, 20 nt, Human
uuuauaacucaucauaaaau

SEQ ID NO: 2073160 - RNA, 22 nt, Human
uuuauaacucaucauaaaauaa

SEQ ID NO: 2073161 - RNA, 13 nt, Human
uuucaagcaucuc

SEQ ID NO: 2073162 - RNA, 14 nt, Human
uuucaagcaucucc

SEQ ID NO: 2073163 - RNA, 17 nt, Human
uuucaagcaucuccuga

SEQ ID NO: 2073164 - RNA, 20 nt, Human
uuucaagcaucuccugagga

SEQ ID NO: 2073165 - RNA, 22 nt, Human
uuucaagccugccuaggaauuc

SEQ ID NO: 2073166 - RNA, 18 nt, Human
uuucaagaccccugucuu

SEQ ID NO: 2073167 - RNA, 20 nt, Human
uuucaacgcagcccugcuuu

SEQ ID NO: 2073168 - RNA, 16 nt, Human
uuucaacgcagcccug

SEQ ID NO: 2073169 - RNA, 12 nt, Human
uuuauuuacuuc

SEQ ID NO: 2073170 - RNA, 15 nt, Human
uuucaacgcagcccu

SEQ ID NO: 2073171 - RNA, 21 nt, Human
uuucaacgcagcccugcuuug

SEQ ID NO: 2073172 - RNA, 15 nt, Human
uuuauugaugugcaa

SEQ ID NO: 2073173 - RNA, 16 nt, Human
uuuauugaugugcaaa

SEQ ID NO: 2073174 - RNA, 18 nt, Human
uuuauugaugugcaaaaa

SEQ ID NO: 2073175 - RNA, 19 nt, Human
uuuauugaugugcaaaaau

SEQ ID NO: 2073176 - RNA, 13 nt, Human
uuuauugcacaaa

SEQ ID NO: 2073177 - RNA, 17 nt, Human
uuuauugcacaaaauau

SEQ ID NO: 2073178 - RNA, 21 nt, Human
uuuauugcacaaaauauaaag

SEQ ID NO: 2073179 - RNA, 19 nt, Human
uuuauuuaguuccuugagu

SEQ ID NO: 2073180 - RNA, 17 nt, Human
uuuauuuaauguuaugu

SEQ ID NO: 2073181 - RNA, 14 nt, Human
uuuauuccuuguga

SEQ ID NO: 2073182 - RNA, 22 nt, Human
uuuauuccuauauaguuuauug

SEQ ID NO: 2073183 - RNA, 18 nt, Human
uuuauuaugcuguauuuu

SEQ ID NO: 2073184 - RNA, 14 nt, Human
uuuauugagaauuu

SEQ ID NO: 2073185 - RNA, 12 nt, Human
uuuauugacaau

SEQ ID NO: 2073186 - RNA, 13 nt, Human
uuuauucuuguga

SEQ ID NO: 2073187 - RNA, 17 nt, Human
uuuauucuugugaauau

SEQ ID NO: 2073188 - RNA, 22 nt, Human
uucugauaugcaguuuuccuua

SEQ ID NO: 2073189 - RNA, 13 nt, Human
uucugaugaaucu

SEQ ID NO: 2073190 - RNA, 15 nt, Human
uucugaugaaucuug

SEQ ID NO: 2073191 - RNA, 17 nt, Human
uucugauuagaaaugac

SEQ ID NO: 2073192 - RNA, 14 nt, Human
uucugauuagaaau

SEQ ID NO: 2073193 - RNA, 15 nt, Human
uucugauuagaaaug

SEQ ID NO: 2073194 - RNA, 15 nt, Human
uucugcaaauagaaa

SEQ ID NO: 2073195 - RNA, 17 nt, Human
uucugcaaauagaaaac

SEQ ID NO: 2073196 - RNA, 19 nt, Human
uucugcaaauagaaaacag

SEQ ID NO: 2073197 - RNA, 23 nt, Human
uucugcaaauagaaaacaggaaa

SEQ ID NO: 2073198 - RNA, 14 nt, Human
uucugauuuuaugu

SEQ ID NO: 2073199 - RNA, 16 nt, Human
uucugauuuuauguaa

SEQ ID NO: 2073200 - RNA, 23 nt, Human
uucugauuuuauguaaaauuuug

SEQ ID NO: 2073201 - RNA, 19 nt, Human
uucugccuuugcagaaaca

SEQ ID NO: 2073202 - RNA, 20 nt, Human
uucugccuuugcagaaacag

SEQ ID NO: 2073203 - RNA, 21 nt, Human
uucugcaagcacaucugcauu

SEQ ID NO: 2073204 - RNA, 22 nt, Human
uucugcaagcacaucugcauuu

SEQ ID NO: 2073205 - RNA, 15 nt, Human
uucugcuaccucacu

SEQ ID NO: 2073206 - RNA, 19 nt, Human
uucugcucacauaucuguc

SEQ ID NO: 2073207 - RNA, 16 nt, Human
uucugcuaccucacug

SEQ ID NO: 2073208 - RNA, 21 nt, Human
uucugcuaccucacugggguc

SEQ ID NO: 2073209 - RNA, 20 nt, Human
uucugcuccacccuuggccu

SEQ ID NO: 2073210 - RNA, 17 nt, Human
uucugcuccacccuugg

SEQ ID NO: 2073211 - RNA, 18 nt, Human
uucugcuccacccuuggc

SEQ ID NO: 2073212 - RNA, 9 nt, Human
uucugcucc

SEQ ID NO: 2073213 - RNA, 13 nt, Human
uucugcuccaccc

SEQ ID NO: 2073214 - RNA, 15 nt, Human
uucugcuccacccuu

SEQ ID NO: 2073215 - RNA, 16 nt, Human
uucugcuccacccuug

SEQ ID NO: 2073216 - RNA, 18 nt, Human
uucugacccugcuucaaa

SEQ ID NO: 2073217 - RNA, 21 nt, Human
uucugacccugcuucaaauau

SEQ ID NO: 2073218 - RNA, 14 nt, Human
uucugaguguuuuu

SEQ ID NO: 2073219 - RNA, 18 nt, Human
uucugagaagguccuuaa

SEQ ID NO: 2073220 - RNA, 16 nt, Human
uucucugcccauuccc

SEQ ID NO: 2073221 - RNA, 21 nt, Human
uucucugcccauuccccagcc

SEQ ID NO: 2073222 - RNA, 14 nt, Human
uucugauauagaau

SEQ ID NO: 2073223 - RNA, 18 nt, Human
uucugauauagaauugca

SEQ ID NO: 2073224 - RNA, 20 nt, Human
uucugaguguuuuuacuaca

SEQ ID NO: 2073225 - RNA, 20 nt, Human
uucuacuaaaaauacaaaaa

SEQ ID NO: 2073226 - RNA, 14 nt, Human
uucuaucccaaacu

SEQ ID NO: 2073227 - RNA, 23 nt, Human
uucuaucccaaacuaagcuaugu

SEQ ID NO: 2073228 - RNA, 16 nt, Human
uucuccacccugcucu

SEQ ID NO: 2073229 - RNA, 12 nt, Human
uucuccacugga

SEQ ID NO: 2073230 - RNA, 21 nt, Human
uucuccaccucccacaaagga

SEQ ID NO: 2073231 - RNA, 20 nt, Human
uucucugaggacacuaacca

SEQ ID NO: 2073232 - RNA, 14 nt, Human
uucucugaggacac

SEQ ID NO: 2073233 - RNA, 20 nt, Human
uucucuccugauuauuuauc

SEQ ID NO: 2073234 - RNA, 19 nt, Human
uucuccagacccaccacac

SEQ ID NO: 2073235 - RNA, 17 nt, Human
uucggggaacuccugga

SEQ ID NO: 2073236 - RNA, 15 nt, Human
uuccuuguauuuaaa

SEQ ID NO: 2073237 - RNA, 18 nt, Human
uuccuuguauuuaaauau

SEQ ID NO: 2073238 - RNA, 18 nt, Human
uuccuugcuguccuaggc

SEQ ID NO: 2073239 - RNA, 20 nt, Human
uuccuugcuguccuaggcca

SEQ ID NO: 2073240 - RNA, 16 nt, Human
uuccugcuagaaaugg

SEQ ID NO: 2073241 - RNA, 22 nt, Human
uuccugccuggucuccugcccc

SEQ ID NO: 2073242 - RNA, 15 nt, Human
uuccugccugucucc

SEQ ID NO: 2073243 - RNA, 18 nt, Human
uuccugcagccuggaggc

SEQ ID NO: 2073244 - RNA, 18 nt, Human
uuccugcauucacccaga

SEQ ID NO: 2073245 - RNA, 16 nt, Human
uuccugccugucuccu

SEQ ID NO: 2073246 - RNA, 18 nt, Human
uuccugccugucuccuuu

SEQ ID NO: 2073247 - RNA, 21 nt, Human
uuccugcgggcuuuuccccgg

SEQ ID NO: 2073248 - RNA, 15 nt, Human
uuccuugauaauguu

SEQ ID NO: 2073249 - RNA, 21 nt, Human
uuccuugaguugauucagcuc

SEQ ID NO: 2073250 - RNA, 14 nt, Human
uuccugaaugaaau

SEQ ID NO: 2073251 - RNA, 16 nt, Human
uuccugaaugaaauau

SEQ ID NO: 2073252 - RNA, 14 nt, Human
uuccauggauuuug

SEQ ID NO: 2073253 - RNA, 16 nt, Human
uuccugagcuuggcca

SEQ ID NO: 2073254 - RNA, 11 nt, Human
uuccugagcuu

SEQ ID NO: 2073255 - RNA, 13 nt, Human
uuccugagcuugg

SEQ ID NO: 2073256 - RNA, 20 nt, Human
uuccugagcuuggccagaag

SEQ ID NO: 2073257 - RNA, 15 nt, Human
uuccugcagccugga

SEQ ID NO: 2073258 - RNA, 21 nt, Human
uuccugcagcagagccuggaa

SEQ ID NO: 2073259 - RNA, 14 nt, Human
uuccugcagccugg

SEQ ID NO: 2073260 - RNA, 19 nt, Human
uucuacccagcgagcccug

SEQ ID NO: 2073261 - RNA, 12 nt, Human
uucuacccagcg

SEQ ID NO: 2073262 - RNA, 14 nt, Human
uucuacauuucacc

SEQ ID NO: 2073263 - RNA, 22 nt, Human
uucuacauuucaccuacuuugu

SEQ ID NO: 2073264 - RNA, 18 nt, Human
uucuaccaacuggaagca

SEQ ID NO: 2073265 - RNA, 21 nt, Human
uucuaccacacagcagcaguu

SEQ ID NO: 2073266 - RNA, 16 nt, Human
uucuacaaucuauuua

SEQ ID NO: 2073267 - RNA, 17 nt, Human
uucuacaaucuauuuau

SEQ ID NO: 2073268 - RNA, 15 nt, Human
uucuacagcaaauuu

SEQ ID NO: 2073269 - RNA, 16 nt, Human
uucuacagcaaauuua

SEQ ID NO: 2073270 - RNA, 17 nt, Human
uucuacagcaaauuuau

SEQ ID NO: 2073271 - RNA, 19 nt, Human
uucuacagcaaauuuauaa

SEQ ID NO: 2073272 - RNA, 20 nt, Human
uucuacagcaaauuuauaau

SEQ ID NO: 2073273 - RNA, 21 nt, Human
uucuacagcaaauuuauaauu

SEQ ID NO: 2073274 - RNA, 11 nt, Human
uucuacacucu

SEQ ID NO: 2073275 - RNA, 14 nt, Human
uucuacacucuccu

SEQ ID NO: 2073276 - RNA, 17 nt, Human
uucuacacucuccuggg

SEQ ID NO: 2073277 - RNA, 14 nt, Human
uucuaauugccaug

SEQ ID NO: 2073278 - RNA, 15 nt, Human
uucuaauugccaugu

SEQ ID NO: 2073279 - RNA, 17 nt, Human
uucguggugaucaauua

SEQ ID NO: 2073280 - RNA, 22 nt, Human
uucguggugaucaauuaaaugu

SEQ ID NO: 2073281 - RNA, 23 nt, Human
uucuaaugugugaaucagagcac

SEQ ID NO: 2073282 - RNA, 19 nt, Human
uucguuaacuguguaugua

SEQ ID NO: 2073283 - RNA, 21 nt, Human
uucgugaaguauacuguauuu

SEQ ID NO: 2073284 - RNA, 17 nt, Human
uucgugaaguauacugu

SEQ ID NO: 2073285 - RNA, 18 nt, Human
uucgugaaguauacugua

SEQ ID NO: 2073286 - RNA, 21 nt, Human
uucuacccagcgagcccuggu

SEQ ID NO: 2073287 - RNA, 20 nt, Human
uucuacccagcgagcccugg

SEQ ID NO: 2073288 - RNA, 15 nt, Human
uucuacucauauaua

SEQ ID NO: 2073289 - RNA, 18 nt, Human
uucuaccuugaggucuuu

SEQ ID NO: 2073290 - RNA, 19 nt, Human
uucuaccuugaggucuuuu

SEQ ID NO: 2073291 - RNA, 13 nt, Human
uucuacgccaggg

SEQ ID NO: 2073292 - RNA, 20 nt, Human
uucuauaggaacauaugaaa

SEQ ID NO: 2073293 - RNA, 13 nt, Human
uucuacugcuucu

SEQ ID NO: 2073294 - RNA, 18 nt, Human
uucuacucauauauaucu

SEQ ID NO: 2073295 - RNA, 14 nt, Human
uucuuaguugcugu

SEQ ID NO: 2073296 - RNA, 15 nt, Human
uucuuaguugcugua

SEQ ID NO: 2073297 - RNA, 23 nt, Human
uucuuaguugcuguaugucucgu

SEQ ID NO: 2073298 - RNA, 20 nt, Human
uucuguguguuuucauaaua

SEQ ID NO: 2073299 - RNA, 13 nt, Human
uucugugugaaga

SEQ ID NO: 2073300 - RNA, 13 nt, Human
uucuguguauuua

SEQ ID NO: 2073301 - RNA, 16 nt, Human
uucuguguauuuaauu

SEQ ID NO: 2073302 - RNA, 17 nt, Human
uucuguguauuuaauug

SEQ ID NO: 2073303 - RNA, 20 nt, Human
uucuguguauuuaauuguaa

SEQ ID NO: 2073304 - RNA, 21 nt, Human
uucuguguauuuaauuguaaa

SEQ ID NO: 2073305 - RNA, 22 nt, Human
uucuguguauuuaauuguaaac

SEQ ID NO: 2073306 - RNA, 23 nt, Human
uucuguguauuuaauuguaaacu

SEQ ID NO: 2073307 - RNA, 19 nt, Human
uucuguccuacucuguguc

SEQ ID NO: 2073308 - RNA, 22 nt, Human
uucugucaucuaccuuuucucu

SEQ ID NO: 2073309 - RNA, 16 nt, Human
uucugucucauaugau

SEQ ID NO: 2073310 - RNA, 22 nt, Human
uucuguccuuuuggcacugaga

SEQ ID NO: 2073311 - RNA, 23 nt, Human
uucuguccuuuuggcacugagau

SEQ ID NO: 2073312 - RNA, 18 nt, Human
uucuguauuuuguuuuug

SEQ ID NO: 2073313 - RNA, 15 nt, Human
uucugcuuucaucuu

SEQ ID NO: 2073314 - RNA, 10 nt, Human
uucuggagcc

SEQ ID NO: 2073315 - RNA, 13 nt, Human
uucuggagcccuu

SEQ ID NO: 2073316 - RNA, 15 nt, Human
uucuggagcccuugg

SEQ ID NO: 2073317 - RNA, 19 nt, Human
uucugcuucagccucccga

SEQ ID NO: 2073318 - RNA, 16 nt, Human
uucugcuucagccucc

SEQ ID NO: 2073319 - RNA, 15 nt, Human
uucugcuucagccuc

SEQ ID NO: 2073320 - RNA, 14 nt, Human
uucugcuucagccu

SEQ ID NO: 2073321 - RNA, 13 nt, Human
uucugcuggauaa

SEQ ID NO: 2073322 - RNA, 21 nt, Human
uucugcuggauaaaaugaggu

SEQ ID NO: 2073323 - RNA, 21 nt, Human
uucuucauucaauacaagugu

SEQ ID NO: 2073324 - RNA, 21 nt, Human
uucuuauacauuugauaaagu

SEQ ID NO: 2073325 - RNA, 22 nt, Human
uucuucccuuuuacauacugcu

SEQ ID NO: 2073326 - RNA, 18 nt, Human
uucuucccuuaaaauuua

SEQ ID NO: 2073327 - RNA, 19 nt, Human
uucuucccaucacuggagc

SEQ ID NO: 2073328 - RNA, 20 nt, Human
uucuucccuuuuacauacug

SEQ ID NO: 2073329 - RNA, 21 nt, Human
uucuucccuuuuacauacugc

SEQ ID NO: 2073330 - RNA, 13 nt, Human
uucuuguuuauca

SEQ ID NO: 2073331 - RNA, 23 nt, Human
uucuuguuaguacuauaucuguu

SEQ ID NO: 2073332 - RNA, 13 nt, Human
uucuuguucuguu

SEQ ID NO: 2073333 - RNA, 14 nt, Human
uucuuguucuguuu

SEQ ID NO: 2073334 - RNA, 16 nt, Human
uucuuguucuguuuug

SEQ ID NO: 2073335 - RNA, 13 nt, Human
uucuuccucccuc

SEQ ID NO: 2073336 - RNA, 16 nt, Human
uugaacuccuggccuc

SEQ ID NO: 2073337 - RNA, 15 nt, Human
uugaacuccuggccu

SEQ ID NO: 2073338 - RNA, 14 nt, Human
uugaaaacuacauu

SEQ ID NO: 2073339 - RNA, 15 nt, Human
uugaaaacuacauuu

SEQ ID NO: 2073340 - RNA, 16 nt, Human
uugaaaacuacauuuu

SEQ ID NO: 2073341 - RNA, 20 nt, Human
uugaaaacuacauuuuaaca

SEQ ID NO: 2073342 - RNA, 21 nt, Human
uugaaaacuacauuuuaacau

SEQ ID NO: 2073343 - RNA, 22 nt, Human
uugaaaacuacauuuuaacaug

SEQ ID NO: 2073344 - RNA, 13 nt, Human
uugaaaagacauc

SEQ ID NO: 2073345 - RNA, 13 nt, Human
uugaaaagccaug

SEQ ID NO: 2073346 - RNA, 16 nt, Human
uugaaaagccauguuu

SEQ ID NO: 2073347 - RNA, 19 nt, Human
uugaaaagccauguuuaag

SEQ ID NO: 2073348 - RNA, 20 nt, Human
uugaaaagccauguuuaaga

SEQ ID NO: 2073349 - RNA, 21 nt, Human
uugaaaagccauguuuaagau

SEQ ID NO: 2073350 - RNA, 22 nt, Human
uugaaaagccauguuuaagauu

SEQ ID NO: 2073351 - RNA, 23 nt, Human
uugaaaagccauguuuaagauuu

SEQ ID NO: 2073352 - RNA, 14 nt, Human
uugaaaaaaauugg

SEQ ID NO: 2073353 - RNA, 22 nt, Human
uugaaaaaagaaauucccugga

SEQ ID NO: 2073354 - RNA, 18 nt, Human
uucuuuuuuuucauuaua

SEQ ID NO: 2073355 - RNA, 16 nt, Human
uugaaaaccugacaaa

SEQ ID NO: 2073356 - RNA, 12 nt, Human
uugaaaaagcag

SEQ ID NO: 2073357 - RNA, 22 nt, Human
uugacaagucauuuuaacuuua

SEQ ID NO: 2073358 - RNA, 18 nt, Human
uugacaauaaaugugcuu

SEQ ID NO: 2073359 - RNA, 21 nt, Human
uugaccucaggugauccaccc

SEQ ID NO: 2073360 - RNA, 21 nt, Human
uugacaaguugcgacggagag

SEQ ID NO: 2073361 - RNA, 13 nt, Human
uugacaaacucuc

SEQ ID NO: 2073362 - RNA, 14 nt, Human
uugacaacaaauua

SEQ ID NO: 2073363 - RNA, 16 nt, Human
uugaauuuucaagcau

SEQ ID NO: 2073364 - RNA, 18 nt, Human
uugaauuuucaagcaucu

SEQ ID NO: 2073365 - RNA, 19 nt, Human
uugaauuuucaagcaucuc

SEQ ID NO: 2073366 - RNA, 22 nt, Human
uugaauuuucaagcaucuccug

SEQ ID NO: 2073367 - RNA, 23 nt, Human
uugaauuuucaagcaucuccuga

SEQ ID NO: 2073368 - RNA, 15 nt, Human
uugaacuccugggcu

SEQ ID NO: 2073369 - RNA, 18 nt, Human
uugaacuggguacuugug

SEQ ID NO: 2073370 - RNA, 18 nt, Human
uugaacuuaaauaaaugu

SEQ ID NO: 2073371 - RNA, 22 nt, Human
uugaacuuaaauaaaugucauu

SEQ ID NO: 2073372 - RNA, 12 nt, Human
uugaauuuaaca

SEQ ID NO: 2073373 - RNA, 13 nt, Human
uugaauuuaacaa

SEQ ID NO: 2073374 - RNA, 14 nt, Human
uugaauuuaacaau

SEQ ID NO: 2073375 - RNA, 15 nt, Human
uugaauuuaacaaug

SEQ ID NO: 2073376 - RNA, 16 nt, Human
uugaauuuaacaaugc

SEQ ID NO: 2073377 - RNA, 19 nt, Human
uugaauuuaacaaugcgaa

SEQ ID NO: 2073378 - RNA, 20 nt, Human
uugaauuuaacaaugcgaau

SEQ ID NO: 2073379 - RNA, 19 nt, Human
uugauagcuuuauuuuuua

SEQ ID NO: 2073380 - RNA, 14 nt, Human
uugauagcuuuauu

SEQ ID NO: 2073381 - RNA, 17 nt, Human
uugaggucugcucggcc

SEQ ID NO: 2073382 - RNA, 18 nt, Human
uugauauaaauaaaacau

SEQ ID NO: 2073383 - RNA, 21 nt, Human
uugauauaauuuccauagugu

SEQ ID NO: 2073384 - RNA, 20 nt, Human
uugauauacuuuuuucuuau

SEQ ID NO: 2073385 - RNA, 21 nt, Human
uugauauacuuuuuucuuauu

SEQ ID NO: 2073386 - RNA, 17 nt, Human
uugacuggguuucucug

SEQ ID NO: 2073387 - RNA, 23 nt, Human
uugacuggguuucucuguauagu

SEQ ID NO: 2073388 - RNA, 13 nt, Human
uugagccaggccu

SEQ ID NO: 2073389 - RNA, 17 nt, Human
uugagccaggccugggu

SEQ ID NO: 2073390 - RNA, 22 nt, Human
uugagccaggccugggucugug

SEQ ID NO: 2073391 - RNA, 13 nt, Human
uugagcccaggag

SEQ ID NO: 2073392 - RNA, 11 nt, Human
uugagccuggg

SEQ ID NO: 2073393 - RNA, 13 nt, Human
uugaggguugggc

SEQ ID NO: 2073394 - RNA, 16 nt, Human
uugaggguugggcugg

SEQ ID NO: 2073395 - RNA, 16 nt, Human
uugaggucaaguaaga

SEQ ID NO: 2073396 - RNA, 22 nt, Human
uugaggucaaguaagaagacau

SEQ ID NO: 2073397 - RNA, 21 nt, Human
uugagguaggagaauugcuug

SEQ ID NO: 2073398 - RNA, 18 nt, Human
uugaugaguguaacaaga

SEQ ID NO: 2073399 - RNA, 19 nt, Human
uugaugaguguaacaagaa

SEQ ID NO: 2073400 - RNA, 21 nt, Human
uugaugaguguaacaagaaag

SEQ ID NO: 2073401 - RNA, 22 nt, Human
uugaugaguguaacaagaaagg

SEQ ID NO: 2073402 - RNA, 17 nt, Human
uugaugacccccaacca

SEQ ID NO: 2073403 - RNA, 13 nt, Human
uugaugacuggaa

SEQ ID NO: 2073404 - RNA, 15 nt, Human
uugaugacuggaauu

SEQ ID NO: 2073405 - RNA, 18 nt, Human
uugaugacuggaauuuuu

SEQ ID NO: 2073406 - RNA, 20 nt, Human
uugaugacuggaauuuuuau

SEQ ID NO: 2073407 - RNA, 16 nt, Human
uugaugaucuuugcag

SEQ ID NO: 2073408 - RNA, 13 nt, Human
uugauugcugugu

SEQ ID NO: 2073409 - RNA, 15 nt, Human
uugauugcugugucc

SEQ ID NO: 2073410 - RNA, 12 nt, Human
uugcaaauaguc

SEQ ID NO: 2073411 - RNA, 13 nt, Human
uugauuuuacaau

SEQ ID NO: 2073412 - RNA, 23 nt, Human
uugauuuuacaauugaaaugacu

SEQ ID NO: 2073413 - RNA, 19 nt, Human
uucagauauaaaagacuga

SEQ ID NO: 2073414 - RNA, 14 nt, Human
uucagauauaaaag

SEQ ID NO: 2073415 - RNA, 15 nt, Human
uucagauauaaaaga

SEQ ID NO: 2073416 - RNA, 12 nt, Human
uucagauauaaa

SEQ ID NO: 2073417 - RNA, 12 nt, Human
uucagauacaug

SEQ ID NO: 2073418 - RNA, 13 nt, Human
uucacggaagagc

SEQ ID NO: 2073419 - RNA, 21 nt, Human
uucacgccuguaaucccagca

SEQ ID NO: 2073420 - RNA, 23 nt, Human
uucacgccuguaaucccagcacu

SEQ ID NO: 2073421 - RNA, 18 nt, Human
uucaccuauuucaaaaau

SEQ ID NO: 2073422 - RNA, 17 nt, Human
uucacggaagagccuug

SEQ ID NO: 2073423 - RNA, 14 nt, Human
uucacaacccaucu

SEQ ID NO: 2073424 - RNA, 11 nt, Human
uucaauauuua

SEQ ID NO: 2073425 - RNA, 20 nt, Human
uucaauaagcaucaaacucu

SEQ ID NO: 2073426 - RNA, 22 nt, Human
uucacccuguccaaacugccua

SEQ ID NO: 2073427 - RNA, 21 nt, Human
uucaccuaagucucugugaau

SEQ ID NO: 2073428 - RNA, 17 nt, Human
uucaccuaagucucugu

SEQ ID NO: 2073429 - RNA, 19 nt, Human
uucaccuaagucucuguga

SEQ ID NO: 2073430 - RNA, 21 nt, Human
uucacaaccuucuguggcuca

SEQ ID NO: 2073431 - RNA, 15 nt, Human
uucaaccauucccca

SEQ ID NO: 2073432 - RNA, 19 nt, Human
uucaaccacuguaaaauga

SEQ ID NO: 2073433 - RNA, 21 nt, Human
uucaacaucaauguucauugu

SEQ ID NO: 2073434 - RNA, 14 nt, Human
uucaacaucaaugu

SEQ ID NO: 2073435 - RNA, 15 nt, Human
uucaacaucaauguu

SEQ ID NO: 2073436 - RNA, 16 nt, Human
uucaacaucaauguuc

SEQ ID NO: 2073437 - RNA, 19 nt, Human
uucaacaucaauguucauu

SEQ ID NO: 2073438 - RNA, 22 nt, Human
uucaacaucaauguucauugua

SEQ ID NO: 2073439 - RNA, 18 nt, Human
uucaaauugagagaaugg

SEQ ID NO: 2073440 - RNA, 18 nt, Human
uuauuuuauuuuagcagu

SEQ ID NO: 2073441 - RNA, 22 nt, Human
uuauuuuggaaaauaaauuauu

SEQ ID NO: 2073442 - RNA, 14 nt, Human
uuauuuucaccugu

SEQ ID NO: 2073443 - RNA, 19 nt, Human
uucaaaugggcugcugcuu

SEQ ID NO: 2073444 - RNA, 18 nt, Human
uuauuacccuucuuucca

SEQ ID NO: 2073445 - RNA, 22 nt, Human
uuauuagccagguaaugugaau

SEQ ID NO: 2073446 - RNA, 20 nt, Human
uuauuaguaagaaaacauca

SEQ ID NO: 2073447 - RNA, 19 nt, Human
uuauuucuuaaacaaaugu

SEQ ID NO: 2073448 - RNA, 20 nt, Human
uuauuaguaaaugcuuauca

SEQ ID NO: 2073449 - RNA, 19 nt, Human
uuauuugggguugcaucag

SEQ ID NO: 2073450 - RNA, 21 nt, Human
uuauuugggguugcaucagaa

SEQ ID NO: 2073451 - RNA, 15 nt, Human
uuauuugcagagaca

SEQ ID NO: 2073452 - RNA, 18 nt, Human
uuauuugcagagacagga

SEQ ID NO: 2073453 - RNA, 13 nt, Human
uuccagagccuca

SEQ ID NO: 2073454 - RNA, 20 nt, Human
uuccaucauaauucuaaucu

SEQ ID NO: 2073455 - RNA, 18 nt, Human
uuccauauauuagcauuu

SEQ ID NO: 2073456 - RNA, 14 nt, Human
uuccauaugcuguu

SEQ ID NO: 2073457 - RNA, 20 nt, Human
uuccaaagcacauugaaaga

SEQ ID NO: 2073458 - RNA, 19 nt, Human
uuccaaagcacauugaaag

SEQ ID NO: 2073459 - RNA, 23 nt, Human
uuccaacagcucaagucuucccu

SEQ ID NO: 2073460 - RNA, 19 nt, Human
uucaugccaccauggccag

SEQ ID NO: 2073461 - RNA, 15 nt, Human
uucauuuuuccuaac

SEQ ID NO: 2073462 - RNA, 13 nt, Human
uucauuuuuccua

SEQ ID NO: 2073463 - RNA, 22 nt, Human
uucaugccaccauggccagcca

SEQ ID NO: 2073464 - RNA, 14 nt, Human
uucaugccuuugua

SEQ ID NO: 2073465 - RNA, 15 nt, Human
uucaugccuuuguaa

SEQ ID NO: 2073466 - RNA, 17 nt, Human
uucaugccuuuguaagu

SEQ ID NO: 2073467 - RNA, 18 nt, Human
uucaugccuuuguaaguu

SEQ ID NO: 2073468 - RNA, 21 nt, Human
uucaugccuuuguaaguuauu

SEQ ID NO: 2073469 - RNA, 14 nt, Human
uucaguuaagaaaa

SEQ ID NO: 2073470 - RNA, 15 nt, Human
uucaguuaagaaaaa

SEQ ID NO: 2073471 - RNA, 16 nt, Human
uucaguuaagaaaaaa

SEQ ID NO: 2073472 - RNA, 17 nt, Human
uucaguuaagaaaaaaa

SEQ ID NO: 2073473 - RNA, 18 nt, Human
uucaguuaagaaaaaaau

SEQ ID NO: 2073474 - RNA, 21 nt, Human
uucaguuaagaaaaaaauaau

SEQ ID NO: 2073475 - RNA, 16 nt, Human
uucaguugaucacugg

SEQ ID NO: 2073476 - RNA, 18 nt, Human
uucaguugaucacuggca

SEQ ID NO: 2073477 - RNA, 15 nt, Human
uucauaaccuagccu

SEQ ID NO: 2073478 - RNA, 15 nt, Human
uucauaacagugcca

SEQ ID NO: 2073479 - RNA, 17 nt, Human
uucauaacagugccauu

SEQ ID NO: 2073480 - RNA, 18 nt, Human
uucauaacagugccauug

SEQ ID NO: 2073481 - RNA, 21 nt, Human
uucauaacagugccauugucu

SEQ ID NO: 2073482 - RNA, 22 nt, Human
uucauaacagugccauugucuu

SEQ ID NO: 2073483 - RNA, 14 nt, Human
uucauaacuuucau

SEQ ID NO: 2073484 - RNA, 18 nt, Human
uucauccggcagccugga

SEQ ID NO: 2073485 - RNA, 17 nt, Human
uucauaacuuucauuaa

SEQ ID NO: 2073486 - RNA, 13 nt, Human
uucauccuuagca

SEQ ID NO: 2073487 - RNA, 16 nt, Human
uucaguggcagcugcu

SEQ ID NO: 2073488 - RNA, 15 nt, Human
uucaguggcagcugc

SEQ ID NO: 2073489 - RNA, 17 nt, Human
uucaguggcagcugcuu

SEQ ID NO: 2073490 - RNA, 14 nt, Human
uucagugggagaaa

SEQ ID NO: 2073491 - RNA, 12 nt, Human
uucaguguacau

SEQ ID NO: 2073492 - RNA, 13 nt, Human
uucaguguacaug

SEQ ID NO: 2073493 - RNA, 15 nt, Human
uucagcuccagcuca

SEQ ID NO: 2073494 - RNA, 12 nt, Human
uucagcuccagc

SEQ ID NO: 2073495 - RNA, 22 nt, Human
uucagcuccagcucaccagccc

SEQ ID NO: 2073496 - RNA, 14 nt, Human
uucaguggcagcug

SEQ ID NO: 2073497 - RNA, 22 nt, Human
uucagcuuguaaauagcucagg

SEQ ID NO: 2073498 - RNA, 16 nt, Human
uuaugauuuuuaaaga

SEQ ID NO: 2073499 - RNA, 19 nt, Human
uuaugauuuuuaaagaaaa

SEQ ID NO: 2073500 - RNA, 19 nt, Human
uuauggaagauuuuaaauu

SEQ ID NO: 2073501 - RNA, 22 nt, Human
uuauggaagauuuuaaauucac

SEQ ID NO: 2073502 - RNA, 17 nt, Human
uuauguuguauagauua

SEQ ID NO: 2073503 - RNA, 19 nt, Human
uuauuaacaaauuauguua

SEQ ID NO: 2073504 - RNA, 15 nt, Human
uuauguuuuguuucu

SEQ ID NO: 2073505 - RNA, 16 nt, Human
uuauguuuuguuucug

SEQ ID NO: 2073506 - RNA, 19 nt, Human
uuauguuuuguuucugaaa

SEQ ID NO: 2073507 - RNA, 23 nt, Human
uuauuaagauggauucucagaua

SEQ ID NO: 2073508 - RNA, 17 nt, Human
uuauuaagauggauucu

SEQ ID NO: 2073509 - RNA, 19 nt, Human
uuauuaagauggauucuca

SEQ ID NO: 2073510 - RNA, 20 nt, Human
uuauuaagauggauucucag

SEQ ID NO: 2073511 - RNA, 21 nt, Human
uuauuaagauggauucucaga

SEQ ID NO: 2073512 - RNA, 15 nt, Human
uuauuacauccuugu

SEQ ID NO: 2073513 - RNA, 17 nt, Human
uuauuacauccuugugg

SEQ ID NO: 2073514 - RNA, 18 nt, Human
uuauuacauccuuguggc

SEQ ID NO: 2073515 - RNA, 19 nt, Human
uuauuacauccuuguggca

SEQ ID NO: 2073516 - RNA, 20 nt, Human
uuauuacauccuuguggcac

SEQ ID NO: 2073517 - RNA, 21 nt, Human
uuauuacauccuuguggcaca

SEQ ID NO: 2073518 - RNA, 12 nt, Human
uuauuacaucuu

SEQ ID NO: 2073519 - RNA, 18 nt, Human
uuauuacaucuuucacau

SEQ ID NO: 2073520 - RNA, 13 nt, Human
uuauuaccucuga

SEQ ID NO: 2073521 - RNA, 12 nt, Human
uuauuaccucug

SEQ ID NO: 2073522 - RNA, 15 nt, Human
uuauuaccucugaua

SEQ ID NO: 2073523 - RNA, 14 nt, Human
uuauuacuuauuug

SEQ ID NO: 2073524 - RNA, 13 nt, Human
uuauauugcaaug

SEQ ID NO: 2073525 - RNA, 14 nt, Human
uuauauugagacaa

SEQ ID NO: 2073526 - RNA, 15 nt, Human
uuauauugagacaaa

SEQ ID NO: 2073527 - RNA, 18 nt, Human
uuauauugagacaaaaau

SEQ ID NO: 2073528 - RNA, 19 nt, Human
uuauccuaaaacaaauagu

SEQ ID NO: 2073529 - RNA, 23 nt, Human
uuaucccuuccuuuuagccuagu

SEQ ID NO: 2073530 - RNA, 14 nt, Human
uuaucgaaacucau

SEQ ID NO: 2073531 - RNA, 15 nt, Human
uuaucggaagcagug

SEQ ID NO: 2073532 - RNA, 21 nt, Human
uuaucgccuuuugacagcugu

SEQ ID NO: 2073533 - RNA, 14 nt, Human
uuaucggaagcagu

SEQ ID NO: 2073534 - RNA, 16 nt, Human
uuaucggaagcagugc

SEQ ID NO: 2073535 - RNA, 14 nt, Human
uuaucgggaacagu

SEQ ID NO: 2073536 - RNA, 16 nt, Human
uuaucgggaacagugu

SEQ ID NO: 2073537 - RNA, 17 nt, Human
uuaucgggaacaguguu

SEQ ID NO: 2073538 - RNA, 23 nt, Human
uuaucgggaacaguguuucccau

SEQ ID NO: 2073539 - RNA, 16 nt, Human
uuaucgggagcagugu

SEQ ID NO: 2073540 - RNA, 18 nt, Human
uuaucgggagcagugucu

SEQ ID NO: 2073541 - RNA, 19 nt, Human
uuaucgggagcagugucuu

SEQ ID NO: 2073542 - RNA, 21 nt, Human
uuaucgggagcagugucuucc

SEQ ID NO: 2073543 - RNA, 23 nt, Human
uuaucgggagcagugucuuccau

SEQ ID NO: 2073544 - RNA, 22 nt, Human
uuaucuaaucaugaaacucccu

SEQ ID NO: 2073545 - RNA, 18 nt, Human
uuaucuaaucaugaaacu

SEQ ID NO: 2073546 - RNA, 15 nt, Human
uuaucuauuguaaga

SEQ ID NO: 2073547 - RNA, 16 nt, Human
uuaucuauuguaagau

SEQ ID NO: 2073548 - RNA, 17 nt, Human
uuaucuauuguaagaua

SEQ ID NO: 2073549 - RNA, 18 nt, Human
uuaucuauuguaagauaa

SEQ ID NO: 2073550 - RNA, 21 nt, Human
uuaucuauuguaagauaaaaa

SEQ ID NO: 2073551 - RNA, 13 nt, Human
uuaucuauuugua

SEQ ID NO: 2073552 - RNA, 21 nt, Human
uuaucuauuuguauauauaca

SEQ ID NO: 2073553 - RNA, 22 nt, Human
uuaucuauuuguauauauacau

SEQ ID NO: 2073554 - RNA, 21 nt, Human
uuaucuccccuucacaugcau

SEQ ID NO: 2073555 - RNA, 16 nt, Human
uuaucuuaaaacuccu

SEQ ID NO: 2073556 - RNA, 15 nt, Human
uuaucuuaaagcacu

SEQ ID NO: 2073557 - RNA, 16 nt, Human
uuaucuuacaaagugu

SEQ ID NO: 2073558 - RNA, 20 nt, Human
uuaucuucaggacacucacu

SEQ ID NO: 2073559 - RNA, 18 nt, Human
uuauaauaauguuaacau

SEQ ID NO: 2073560 - RNA, 15 nt, Human
uuauaauaauguuaa

SEQ ID NO: 2073561 - RNA, 20 nt, Human
uuauaaucuuccauacuucu

SEQ ID NO: 2073562 - RNA, 15 nt, Human
uuauaaugaaugaaa

SEQ ID NO: 2073563 - RNA, 14 nt, Human
uuauaagcagauuu

SEQ ID NO: 2073564 - RNA, 16 nt, Human
uuauaagcagauuuaa

SEQ ID NO: 2073565 - RNA, 11 nt, Human
uuauaaggacu

SEQ ID NO: 2073566 - RNA, 13 nt, Human
uuauaaggacugc

SEQ ID NO: 2073567 - RNA, 15 nt, Human
uuauaaggacugcau

SEQ ID NO: 2073568 - RNA, 16 nt, Human
uuauaaggacugcaug

SEQ ID NO: 2073569 - RNA, 17 nt, Human
uuauaaggacugcaugg

SEQ ID NO: 2073570 - RNA, 22 nt, Human
uuauaaggacugcaugguaauu

SEQ ID NO: 2073571 - RNA, 13 nt, Human
uuaguguaaaaau

SEQ ID NO: 2073572 - RNA, 14 nt, Human
uuaguguaaaaaug

SEQ ID NO: 2073573 - RNA, 15 nt, Human
uuaguguaaaaauga

SEQ ID NO: 2073574 - RNA, 17 nt, Human
uuaguguaaaaaugaga

SEQ ID NO: 2073575 - RNA, 18 nt, Human
uuaguguaaaaaugagaa

SEQ ID NO: 2073576 - RNA, 14 nt, Human
uuagugucacuuac

SEQ ID NO: 2073577 - RNA, 23 nt, Human
uuagugucacuuaccuagauuua

SEQ ID NO: 2073578 - RNA, 17 nt, Human
uuagugcggacaaguuu

SEQ ID NO: 2073579 - RNA, 19 nt, Human
uuagugcggacaaguuuua

SEQ ID NO: 2073580 - RNA, 18 nt, Human
uuagucuucucauagcau

SEQ ID NO: 2073581 - RNA, 13 nt, Human
uuagucuucucau

SEQ ID NO: 2073582 - RNA, 14 nt, Human
uuagucuucucaua

SEQ ID NO: 2073583 - RNA, 21 nt, Human
ugugaaaagaaaaaugagccu

SEQ ID NO: 2073584 - RNA, 17 nt, Human
ugugaaaagaaaaauga

SEQ ID NO: 2073585 - RNA, 13 nt, Human
ugugaaaagaaaa

SEQ ID NO: 2073586 - RNA, 15 nt, Human
ugugaaaagaaaaau

SEQ ID NO: 2073587 - RNA, 14 nt, Human
uuauauuccauaua

SEQ ID NO: 2073588 - RNA, 16 nt, Human
uuauauuccauauauu

SEQ ID NO: 2073589 - RNA, 21 nt, Human
uuauauuccauauauuagcau

SEQ ID NO: 2073590 - RNA, 15 nt, Human
uuauauguauccagu

SEQ ID NO: 2073591 - RNA, 20 nt, Human
uuauauguauccaguacauu

SEQ ID NO: 2073592 - RNA, 21 nt, Human
uuauauguauccaguacauuu

SEQ ID NO: 2073593 - RNA, 22 nt, Human
uuauauguauccaguacauuua

SEQ ID NO: 2073594 - RNA, 23 nt, Human
uuauauguauccaguacauuuaa

SEQ ID NO: 2073595 - RNA, 13 nt, Human
uuauaugaacaua

SEQ ID NO: 2073596 - RNA, 21 nt, Human
uuauacaggggaauauuuuau

SEQ ID NO: 2073597 - RNA, 15 nt, Human
uuauacaguuuuaaa

SEQ ID NO: 2073598 - RNA, 16 nt, Human
uuauacaguuuuaaag

SEQ ID NO: 2073599 - RNA, 18 nt, Human
uuauacaguuuuaaagaa

SEQ ID NO: 2073600 - RNA, 19 nt, Human
uuauacaguuuuaaagaau

SEQ ID NO: 2073601 - RNA, 21 nt, Human
uuauacaguuuuaaagaauca

SEQ ID NO: 2073602 - RNA, 12 nt, Human
uuauacaguaca

SEQ ID NO: 2073603 - RNA, 17 nt, Human
uuauacaguagugagaa

SEQ ID NO: 2073604 - RNA, 21 nt, Human
uuauacaguagugagaagaau

SEQ ID NO: 2073605 - RNA, 23 nt, Human
uuauauauuuauaacucaucaua

SEQ ID NO: 2073606 - RNA, 13 nt, Human
uuauauauuuaua

SEQ ID NO: 2073607 - RNA, 14 nt, Human
uuauauauuuauaa

SEQ ID NO: 2073608 - RNA, 15 nt, Human
uuauauauuuauaac

SEQ ID NO: 2073609 - RNA, 20 nt, Human
uuauauauuuauaacucauc

SEQ ID NO: 2073610 - RNA, 19 nt, Human
uuauaucaguccucuuuca

SEQ ID NO: 2073611 - RNA, 18 nt, Human
uuauacagcucagcuuuu

SEQ ID NO: 2073612 - RNA, 15 nt, Human
uuauacaauaucauc

SEQ ID NO: 2073613 - RNA, 16 nt, Human
uuauaauuuuuuucaa

SEQ ID NO: 2073614 - RNA, 15 nt, Human
uuauaauuuuaagau

SEQ ID NO: 2073615 - RNA, 18 nt, Human
uuauaauuuuaagauucc

SEQ ID NO: 2073616 - RNA, 21 nt, Human
uuauaauuuuaagauuccuuu

SEQ ID NO: 2073617 - RNA, 15 nt, Human
aaaaaauauuuuccu

SEQ ID NO: 2073618 - RNA, 11 nt, Human
aaaaaaugucc

SEQ ID NO: 2073619 - RNA, 19 nt, Human
aaaaaaugaaauguuuuaa

SEQ ID NO: 2073620 - RNA, 14 nt, Human
aaaaaaugcucaca

SEQ ID NO: 2073621 - RNA, 22 nt, Human
aaaaaauuagaaauuggcugga

SEQ ID NO: 2073622 - RNA, 13 nt, Human
aaaaacuacacau

SEQ ID NO: 2073623 - RNA, 14 nt, Human
aaaaacagaggcca

SEQ ID NO: 2073624 - RNA, 15 nt, Human
aaaaacagcauugcu

SEQ ID NO: 2073625 - RNA, 17 nt, Human
aaaaacagcauugcuuu

SEQ ID NO: 2073626 - RNA, 14 nt, Human
acuauuuuucagaa

SEQ ID NO: 2073627 - RNA, 15 nt, Human
acuauuuaucugugu

SEQ ID NO: 2073628 - RNA, 18 nt, Human
acuauuuuucagaaucuc

SEQ ID NO: 2073629 - RNA, 13 nt, Human
acucaaaagcugg

SEQ ID NO: 2073630 - RNA, 20 nt, Human
acuauuuaguuuuuguaauu

SEQ ID NO: 2073631 - RNA, 21 nt, Human
acuauuuaguuuuuguaauuu

SEQ ID NO: 2073632 - RNA, 23 nt, Human
acuauuuaguuuuuguaauuuau

SEQ ID NO: 2073633 - RNA, 12 nt, Human
acuauuuaucug

SEQ ID NO: 2073634 - RNA, 14 nt, Human
acuagugcugaagc

SEQ ID NO: 2073635 - RNA, 15 nt, Human
acuagugcugaagcu

SEQ ID NO: 2073636 - RNA, 16 nt, Human
acuagugcugaagcuu

SEQ ID NO: 2073637 - RNA, 14 nt, Human
acuagucugugugc

SEQ ID NO: 2073638 - RNA, 15 nt, Human
acuagucugugugcu

SEQ ID NO: 2073639 - RNA, 23 nt, Human
acuagugacaagcuccuggucuu

SEQ ID NO: 2073640 - RNA, 17 nt, Human
acuagugcugaagcuua

SEQ ID NO: 2073641 - RNA, 18 nt, Human
acuagugcugaagcuuau

SEQ ID NO: 2073642 - RNA, 13 nt, Human
acuaguuacacau

SEQ ID NO: 2073643 - RNA, 19 nt, Human
acuagugcugaagcuuauu

SEQ ID NO: 2073644 - RNA, 15 nt, Human
acuaguguugcuugg

SEQ ID NO: 2073645 - RNA, 19 nt, Human
acucaguccauagcagaga

SEQ ID NO: 2073646 - RNA, 18 nt, Human
acucagggccccagcacu

SEQ ID NO: 2073647 - RNA, 22 nt, Human
acucagggccccagcacuaaag

SEQ ID NO: 2073648 - RNA, 17 nt, Human
acucaggaugcccaggg

SEQ ID NO: 2073649 - RNA, 20 nt, Human
acucagguuguaguaaagaa

SEQ ID NO: 2073650 - RNA, 21 nt, Human
acucagguuguaguaaagaaa

SEQ ID NO: 2073651 - RNA, 22 nt, Human
acucagguuguaguaaagaaau

SEQ ID NO: 2073652 - RNA, 23 nt, Human
acucagguuguaguaaagaaauu

SEQ ID NO: 2073653 - RNA, 15 nt, Human
acucagggccccagc

SEQ ID NO: 2073654 - RNA, 15 nt, Human
acucaggaugcccag

SEQ ID NO: 2073655 - RNA, 16 nt, Human
acucaggaugcccagg

SEQ ID NO: 2073656 - RNA, 18 nt, Human
acucaggaugcccagggc

SEQ ID NO: 2073657 - RNA, 20 nt, Human
acucaggaggcugaggcaga

SEQ ID NO: 2073658 - RNA, 17 nt, Human
acucaggaggcugaggg

SEQ ID NO: 2073659 - RNA, 18 nt, Human
acucaggaggcugagggg

SEQ ID NO: 2073660 - RNA, 14 nt, Human
acucaggaugccca

SEQ ID NO: 2073661 - RNA, 12 nt, Human
acucaggacucc

SEQ ID NO: 2073662 - RNA, 14 nt, Human
acucaggacuccag

SEQ ID NO: 2073663 - RNA, 15 nt, Human
acucaggacuccagc

SEQ ID NO: 2073664 - RNA, 16 nt, Human
acucaggacuccagcc

SEQ ID NO: 2073665 - RNA, 17 nt, Human
acucaggacuccagccc

SEQ ID NO: 2073666 - RNA, 13 nt, Human
acucaggaggcug

SEQ ID NO: 2073667 - RNA, 14 nt, Human
acucaggaggcuga

SEQ ID NO: 2073668 - RNA, 16 nt, Human
acucaggaggcugagg

SEQ ID NO: 2073669 - RNA, 17 nt, Human
acucaggaggcugaggc

SEQ ID NO: 2073670 - RNA, 18 nt, Human
acucaggaggcugaggca

SEQ ID NO: 2073671 - RNA, 19 nt, Human
acucaggaggcugaggcag

SEQ ID NO: 2073672 - RNA, 11 nt, Human
acucagcccug

SEQ ID NO: 2073673 - RNA, 14 nt, Human
acucagcccugagg

SEQ ID NO: 2073674 - RNA, 20 nt, Human
acucagccaaccuuacuuac

SEQ ID NO: 2073675 - RNA, 22 nt, Human
acucagcagcccuccucacccc

SEQ ID NO: 2073676 - RNA, 23 nt, Human
acucagcagcccuccucaccccg

SEQ ID NO: 2073677 - RNA, 18 nt, Human
acucagcagcccuccuca

SEQ ID NO: 2073678 - RNA, 19 nt, Human
acucagcagcccuccucac

SEQ ID NO: 2073679 - RNA, 20 nt, Human
acucagcagcccuccucacc

SEQ ID NO: 2073680 - RNA, 21 nt, Human
acucagcagcccuccucaccc

SEQ ID NO: 2073681 - RNA, 23 nt, Human
acucuauggguaucaaacagcuc

SEQ ID NO: 2073682 - RNA, 19 nt, Human
acucugucgcccagucugg

SEQ ID NO: 2073683 - RNA, 14 nt, Human
acucugucagaugg

SEQ ID NO: 2073684 - RNA, 16 nt, Human
acucugucagauggga

SEQ ID NO: 2073685 - RNA, 17 nt, Human
acucuaggugcccuugg

SEQ ID NO: 2073686 - RNA, 15 nt, Human
acucuagggaaaaac

SEQ ID NO: 2073687 - RNA, 17 nt, Human
acucuagggaaaaacca

SEQ ID NO: 2073688 - RNA, 22 nt, Human
acgcauggaguguguauuguuc

SEQ ID NO: 2073689 - RNA, 19 nt, Human
acgucgucuucuguauacu

SEQ ID NO: 2073690 - RNA, 14 nt, Human
acgucugacaggca

SEQ ID NO: 2073691 - RNA, 13 nt, Human
acgucugacaggc

SEQ ID NO: 2073692 - RNA, 20 nt, Human
acguccugccaccuggggca

SEQ ID NO: 2073693 - RNA, 17 nt, Human
acgcuuucuagcuguug

SEQ ID NO: 2073694 - RNA, 23 nt, Human
acgcugucuccagacccccaccc

SEQ ID NO: 2073695 - RNA, 20 nt, Human
acgcugucuccagaccccca

SEQ ID NO: 2073696 - RNA, 21 nt, Human
acgcugucuccagacccccac

SEQ ID NO: 2073697 - RNA, 22 nt, Human
acgcugucuccagacccccacc

SEQ ID NO: 2073698 - RNA, 15 nt, Human
acggaaaaugccaau

SEQ ID NO: 2073699 - RNA, 18 nt, Human
acggaaaaugccaaucuc

SEQ ID NO: 2073700 - RNA, 19 nt, Human
acggaaaaugccaaucucu

SEQ ID NO: 2073701 - RNA, 17 nt, Human
acggaacguuggacuuu

SEQ ID NO: 2073702 - RNA, 16 nt, Human
acgugacagugccugg

SEQ ID NO: 2073703 - RNA, 19 nt, Human
acgugacagugccugggaa

SEQ ID NO: 2073704 - RNA, 17 nt, Human
acgugacagugccuggg

SEQ ID NO: 2073705 - RNA, 14 nt, Human
acgugacugcccca

SEQ ID NO: 2073706 - RNA, 18 nt, Human
acgugacugccccaacuc

SEQ ID NO: 2073707 - RNA, 20 nt, Human
acgugacugccccaacuccu

SEQ ID NO: 2073708 - RNA, 21 nt, Human
acgugacuguggcacacgccu

SEQ ID NO: 2073709 - RNA, 14 nt, Human
acgugagagugucu

SEQ ID NO: 2073710 - RNA, 15 nt, Human
acgugagagugucuu

SEQ ID NO: 2073711 - RNA, 23 nt, Human
acgugagagugucuucacggcag

SEQ ID NO: 2073712 - RNA, 14 nt, Human
acuaagaaaagaua

SEQ ID NO: 2073713 - RNA, 17 nt, Human
acuaacuugacuuuuaa

SEQ ID NO: 2073714 - RNA, 20 nt, Human
acuaauuggccucuuuaaga

SEQ ID NO: 2073715 - RNA, 10 nt, Human
accucugggc

SEQ ID NO: 2073716 - RNA, 18 nt, Human
accuuggcugcagggagu

SEQ ID NO: 2073717 - RNA, 17 nt, Human
accuuggcugcagggag

SEQ ID NO: 2073718 - RNA, 13 nt, Human
accuuucccaucu

SEQ ID NO: 2073719 - RNA, 18 nt, Human
accuuucccaucuuccaa

SEQ ID NO: 2073720 - RNA, 15 nt, Human
accuuucccuaaaga

SEQ ID NO: 2073721 - RNA, 18 nt, Human
accuuuauuaaaaucuua

SEQ ID NO: 2073722 - RNA, 20 nt, Human
accuuuauuaaaaucuuaaa

SEQ ID NO: 2073723 - RNA, 15 nt, Human
accuuuaugguuucu

SEQ ID NO: 2073724 - RNA, 14 nt, Human
accuuuauuaaaau

SEQ ID NO: 2073725 - RNA, 15 nt, Human
accuuuauuaaaauc

SEQ ID NO: 2073726 - RNA, 16 nt, Human
accuuuauuaaaaucu

SEQ ID NO: 2073727 - RNA, 17 nt, Human
accuuuauuaaaaucuu

SEQ ID NO: 2073728 - RNA, 11 nt, Human
accuguccaau

SEQ ID NO: 2073729 - RNA, 13 nt, Human
accugucccaccu

SEQ ID NO: 2073730 - RNA, 14 nt, Human
accugucccaccuc

SEQ ID NO: 2073731 - RNA, 15 nt, Human
accugucccaccuca

SEQ ID NO: 2073732 - RNA, 12 nt, Human
accugucgccca

SEQ ID NO: 2073733 - RNA, 14 nt, Human
accugucgcccagu

SEQ ID NO: 2073734 - RNA, 16 nt, Human
accugucgcccagugc

SEQ ID NO: 2073735 - RNA, 13 nt, Human
accugucucacca

SEQ ID NO: 2073736 - RNA, 14 nt, Human
accuguccuugcac

SEQ ID NO: 2073737 - RNA, 14 nt, Human
accugucucagccu

SEQ ID NO: 2073738 - RNA, 23 nt, Human
accucuggacuggcuagaguccu

SEQ ID NO: 2073739 - RNA, 14 nt, Human
accucuggacuggc

SEQ ID NO: 2073740 - RNA, 15 nt, Human
accucuggacuggcu

SEQ ID NO: 2073741 - RNA, 16 nt, Human
accucuggacuggcua

SEQ ID NO: 2073742 - RNA, 19 nt, Human
accucuggacuggcuagag

SEQ ID NO: 2073743 - RNA, 18 nt, Human
accugucaccgugagcag

SEQ ID NO: 2073744 - RNA, 19 nt, Human
accugucaccgugagcagc

SEQ ID NO: 2073745 - RNA, 12 nt, Human
accugccgaccu

SEQ ID NO: 2073746 - RNA, 13 nt, Human
accugccgaccuc

SEQ ID NO: 2073747 - RNA, 17 nt, Human
accugccgaccucgucc

SEQ ID NO: 2073748 - RNA, 18 nt, Human
accugccgaccucguccu

SEQ ID NO: 2073749 - RNA, 20 nt, Human
accugccgaccucguccucc

SEQ ID NO: 2073750 - RNA, 23 nt, Human
acugugccuuugaguuuccucag

SEQ ID NO: 2073751 - RNA, 11 nt, Human
acugugccuuu

SEQ ID NO: 2073752 - RNA, 12 nt, Human
acugugaccugu

SEQ ID NO: 2073753 - RNA, 23 nt, Human
acugucucaagagggcacuggug

SEQ ID NO: 2073754 - RNA, 18 nt, Human
acugucucaguuucacuu

SEQ ID NO: 2073755 - RNA, 21 nt, Human
acugucucaagagggcacugg

SEQ ID NO: 2073756 - RNA, 20 nt, Human
acugucucaagagggcacug

SEQ ID NO: 2073757 - RNA, 19 nt, Human
acugucucaagagggcacu

SEQ ID NO: 2073758 - RNA, 22 nt, Human
acugguuuguugcagccaaaga

SEQ ID NO: 2073759 - RNA, 20 nt, Human
acugguuguugccaaacagc

SEQ ID NO: 2073760 - RNA, 17 nt, Human
acuggaagcacagcuuc

SEQ ID NO: 2073761 - RNA, 19 nt, Human
acuggaagcacagcuucau

SEQ ID NO: 2073762 - RNA, 19 nt, Human
acuggaagcauguaggaga

SEQ ID NO: 2073763 - RNA, 20 nt, Human
acuggaagcauguaggagaa

SEQ ID NO: 2073764 - RNA, 18 nt, Human
acugccccaacuccugga

SEQ ID NO: 2073765 - RNA, 21 nt, Human
acugccccaacuccuggaagc

SEQ ID NO: 2073766 - RNA, 15 nt, Human
acugccccaacuccu

SEQ ID NO: 2073767 - RNA, 17 nt, Human
acugccccaacuccugg

SEQ ID NO: 2073768 - RNA, 16 nt, Human
acuggagcccaggagu

SEQ ID NO: 2073769 - RNA, 13 nt, Human
acuggagcccagg

SEQ ID NO: 2073770 - RNA, 14 nt, Human
acuggagcccagga

SEQ ID NO: 2073771 - RNA, 18 nt, Human
acuggagacaaugcagau

SEQ ID NO: 2073772 - RNA, 21 nt, Human
acuggagacaaugcagaugcc

SEQ ID NO: 2073773 - RNA, 21 nt, Human
acuggaagcauguaggagaau

SEQ ID NO: 2073774 - RNA, 17 nt, Human
acuggagaagucuuaga

SEQ ID NO: 2073775 - RNA, 12 nt, Human
acuggagcccag

SEQ ID NO: 2073776 - RNA, 19 nt, Human
acuggagcaccaggcacga

SEQ ID NO: 2073777 - RNA, 14 nt, Human
acuggagagcaaca

SEQ ID NO: 2073778 - RNA, 13 nt, Human
acuggagcaccag

SEQ ID NO: 2073779 - RNA, 15 nt, Human
acuggagcaccaggc

SEQ ID NO: 2073780 - RNA, 16 nt, Human
acuggagcaccaggca

SEQ ID NO: 2073781 - RNA, 17 nt, Human
acuuauuuaugaaccug

SEQ ID NO: 2073782 - RNA, 13 nt, Human
acuuauuuggggu

SEQ ID NO: 2073783 - RNA, 15 nt, Human
acuguuucucugcug

SEQ ID NO: 2073784 - RNA, 13 nt, Human
acuguuucucugc

SEQ ID NO: 2073785 - RNA, 14 nt, Human
acuguuucucugcu

SEQ ID NO: 2073786 - RNA, 16 nt, Human
acuucaaaaacuguca

SEQ ID NO: 2073787 - RNA, 21 nt, Human
acuucaaaaacugucaaagaa

SEQ ID NO: 2073788 - RNA, 15 nt, Human
acuugggccacugug

SEQ ID NO: 2073789 - RNA, 14 nt, Human
acuugggccacugu

SEQ ID NO: 2073790 - RNA, 16 nt, Human
acuugguuuuuaaaaa

SEQ ID NO: 2073791 - RNA, 21 nt, Human
acuugguguccuuucccucca

SEQ ID NO: 2073792 - RNA, 22 nt, Human
acuugguguccuuucccuccac

SEQ ID NO: 2073793 - RNA, 13 nt, Human
acuugguuauaca

SEQ ID NO: 2073794 - RNA, 14 nt, Human
acuugguuauacau

SEQ ID NO: 2073795 - RNA, 15 nt, Human
acuugguuauacaug

SEQ ID NO: 2073796 - RNA, 20 nt, Human
acuugguuauacaugacacu

SEQ ID NO: 2073797 - RNA, 18 nt, Human
acuugguuggguccucac

SEQ ID NO: 2073798 - RNA, 13 nt, Human
acuuuaucacauu

SEQ ID NO: 2073799 - RNA, 14 nt, Human
acuuuaucacauua

SEQ ID NO: 2073800 - RNA, 21 nt, Human
acuuuaucacauuauuugcau

SEQ ID NO: 2073801 - RNA, 19 nt, Human
acuuuaugcagcuuccuuu

SEQ ID NO: 2073802 - RNA, 12 nt, Human
acuuuauuuacu

SEQ ID NO: 2073803 - RNA, 13 nt, Human
acuuuauuuacuu

SEQ ID NO: 2073804 - RNA, 14 nt, Human
acuuuuaaggcagu

SEQ ID NO: 2073805 - RNA, 24 nt, Human
acuuuauuuucugguagauagaaa

SEQ ID NO: 2073806 - RNA, 20 nt, Human
acuuuauuuuauauaauaaa

SEQ ID NO: 2073807 - RNA, 21 nt, Human
acuuuauuuuauauaauaaag

SEQ ID NO: 2073808 - RNA, 23 nt, Human
acuuuauuuuauauaauaaagua

SEQ ID NO: 2073809 - RNA, 13 nt, Human
acuuuauuuucug

SEQ ID NO: 2073810 - RNA, 13 nt, Human
acuuuuagaaacu

SEQ ID NO: 2073811 - RNA, 14 nt, Human
acuuuucuuugugg

SEQ ID NO: 2073812 - RNA, 14 nt, Human
acuuuucuuugaag

SEQ ID NO: 2073813 - RNA, 16 nt, Human
acuuuugagacuuuuu

SEQ ID NO: 2073814 - RNA, 15 nt, Human
agaaaauacaauaaa

SEQ ID NO: 2073815 - RNA, 16 nt, Human
agaaaauacaauaaac

SEQ ID NO: 2073816 - RNA, 17 nt, Human
agaaaauacaauaaacu

SEQ ID NO: 2073817 - RNA, 20 nt, Human
acuuuucauaaccuagccuu

SEQ ID NO: 2073818 - RNA, 14 nt, Human
agaaaggauauuua

SEQ ID NO: 2073819 - RNA, 16 nt, Human
agaaaggauauuuaag

SEQ ID NO: 2073820 - RNA, 18 nt, Human
agaaaggauauuuaagaa

SEQ ID NO: 2073821 - RNA, 19 nt, Human
agaaaggauauuuaagaaa

SEQ ID NO: 2073822 - RNA, 21 nt, Human
agaaaggauauuuaagaaaau

SEQ ID NO: 2073823 - RNA, 18 nt, Human
agaaagggagcagagaag

SEQ ID NO: 2073824 - RNA, 22 nt, Human
agaaaguacuucuccacccugc

SEQ ID NO: 2073825 - RNA, 17 nt, Human
agaaaggggcaggagcu

SEQ ID NO: 2073826 - RNA, 21 nt, Human
agaaaggggcaggagcucaga

SEQ ID NO: 2073827 - RNA, 22 nt, Human
agaaaggggcaggagcucagau

SEQ ID NO: 2073828 - RNA, 23 nt, Human
agaaaggggcaggagcucagaug

SEQ ID NO: 2073829 - RNA, 23 nt, Human
agaaaguacuucuccacccugcu

SEQ ID NO: 2073830 - RNA, 20 nt, Human
agaaagguggacuggaaggg

SEQ ID NO: 2073831 - RNA, 21 nt, Human
agaaaguggccaugccacccu

SEQ ID NO: 2073832 - RNA, 23 nt, Human
agaaagugaagcaaaucagaaac

SEQ ID NO: 2073833 - RNA, 15 nt, Human
agaaagugaauaaaa

SEQ ID NO: 2073834 - RNA, 16 nt, Human
agaaagugaauaaaaa

SEQ ID NO: 2073835 - RNA, 20 nt, Human
agaaagugaauaaaaauuaa

SEQ ID NO: 2073836 - RNA, 21 nt, Human
agaaagugaauaaaaauuaag

SEQ ID NO: 2073837 - RNA, 15 nt, Human
agaaagugaagcaaa

SEQ ID NO: 2073838 - RNA, 14 nt, Human
agaaauaauaugca

SEQ ID NO: 2073839 - RNA, 16 nt, Human
agaaauaauaugcauu

SEQ ID NO: 2073840 - RNA, 15 nt, Human
agaaauaauaugcau

SEQ ID NO: 2073841 - RNA, 19 nt, Human
agaaauaaauagcuauauc

SEQ ID NO: 2073842 - RNA, 22 nt, Human
agaaauaaauagcuauauccau

SEQ ID NO: 2073843 - RNA, 15 nt, Human
agaaauaaauagcua

SEQ ID NO: 2073844 - RNA, 18 nt, Human
agaaauaaauagcuauau

SEQ ID NO: 2073845 - RNA, 20 nt, Human
agaaaguuuccccaccagug

SEQ ID NO: 2073846 - RNA, 12 nt, Human
agaaaguuuccc

SEQ ID NO: 2073847 - RNA, 12 nt, Human
agaaaguugauu

SEQ ID NO: 2073848 - RNA, 17 nt, Human
agaaagugugagcaaac

SEQ ID NO: 2073849 - RNA, 23 nt, Human
agaaagugugagcaaacuaacuu

SEQ ID NO: 2073850 - RNA, 15 nt, Human
agaaaguaauuucuu

SEQ ID NO: 2073851 - RNA, 16 nt, Human
agaaagugugagcaaa

SEQ ID NO: 2073852 - RNA, 14 nt, Human
acacauuuuucaga

SEQ ID NO: 2073853 - RNA, 13 nt, Human
acacagcucuucu

SEQ ID NO: 2073854 - RNA, 11 nt, Human
acacagcucuu

SEQ ID NO: 2073855 - RNA, 14 nt, Human
acacagcagcaguu

SEQ ID NO: 2073856 - RNA, 19 nt, Human
acacagaggcugccucucc

SEQ ID NO: 2073857 - RNA, 19 nt, Human
acacagaguggucuuucug

SEQ ID NO: 2073858 - RNA, 21 nt, Human
acacagaguggucuuucugga

SEQ ID NO: 2073859 - RNA, 23 nt, Human
acacagaguggucuuucuggaga

SEQ ID NO: 2073860 - RNA, 14 nt, Human
acacagcucugucc

SEQ ID NO: 2073861 - RNA, 20 nt, Human
acacagcucuguccugggag

SEQ ID NO: 2073862 - RNA, 12 nt, Human
acacagaggaag

SEQ ID NO: 2073863 - RNA, 13 nt, Human
acacagaggaaga

SEQ ID NO: 2073864 - RNA, 17 nt, Human
acacagaggaagagcag

SEQ ID NO: 2073865 - RNA, 21 nt, Human
acacagaggaagagcaggcac

SEQ ID NO: 2073866 - RNA, 20 nt, Human
acaauuguaaaacugaggca

SEQ ID NO: 2073867 - RNA, 21 nt, Human
acaauugcuuacucauuaaaa

SEQ ID NO: 2073868 - RNA, 19 nt, Human
acaauugaacuuaaauaaa

SEQ ID NO: 2073869 - RNA, 17 nt, Human
acaauugaacuuaaaua

SEQ ID NO: 2073870 - RNA, 12 nt, Human
acaauugaaaug

SEQ ID NO: 2073871 - RNA, 20 nt, Human
acacgcucccucccccugcc

SEQ ID NO: 2073872 - RNA, 14 nt, Human
acaccaaauaaaua

SEQ ID NO: 2073873 - RNA, 17 nt, Human
acacgcgugcacacacc

SEQ ID NO: 2073874 - RNA, 15 nt, Human
acacgcgugcacaca

SEQ ID NO: 2073875 - RNA, 22 nt, Human
acacgagguaugaggucuagga

SEQ ID NO: 2073876 - RNA, 13 nt, Human
acacgcacacaca

SEQ ID NO: 2073877 - RNA, 14 nt, Human
acacgcacacacac

SEQ ID NO: 2073878 - RNA, 20 nt, Human
acacgcacacacacacacag

SEQ ID NO: 2073879 - RNA, 23 nt, Human
acacgcacacacacacacaggag

SEQ ID NO: 2073880 - RNA, 14 nt, Human
aauuuucuucaguu

SEQ ID NO: 2073881 - RNA, 17 nt, Human
aauuuucuucaguuggu

SEQ ID NO: 2073882 - RNA, 13 nt, Human
aauuuucuucaug

SEQ ID NO: 2073883 - RNA, 14 nt, Human
aauuuucuucaugc

SEQ ID NO: 2073884 - RNA, 14 nt, Human
aauuuuguacaaau

SEQ ID NO: 2073885 - RNA, 17 nt, Human
aauuuuguaaaggugaa

SEQ ID NO: 2073886 - RNA, 12 nt, Human
aauuuuguaauu

SEQ ID NO: 2073887 - RNA, 13 nt, Human
aauuuuguaauuu

SEQ ID NO: 2073888 - RNA, 16 nt, Human
aauuuuguaauuuucu

SEQ ID NO: 2073889 - RNA, 17 nt, Human
aauuuuguaauuuucuu

SEQ ID NO: 2073890 - RNA, 13 nt, Human
aauuuuguacaaa

SEQ ID NO: 2073891 - RNA, 19 nt, Human
aauuuucuucaugcaauga

SEQ ID NO: 2073892 - RNA, 22 nt, Human
aauuuucuucaugcaaugacau

SEQ ID NO: 2073893 - RNA, 12 nt, Human
aauuuucuugau

SEQ ID NO: 2073894 - RNA, 13 nt, Human
aauuuucuugaug

SEQ ID NO: 2073895 - RNA, 19 nt, Human
aauuuucuugaugacugga

SEQ ID NO: 2073896 - RNA, 21 nt, Human
aauuuucuugaugacuggaau

SEQ ID NO: 2073897 - RNA, 23 nt, Human
aauuuucuuuaaccagucugaag

SEQ ID NO: 2073898 - RNA, 12 nt, Human
acaagaaaacau

SEQ ID NO: 2073899 - RNA, 15 nt, Human
acaagaaaguuuccc

SEQ ID NO: 2073900 - RNA, 17 nt, Human
acaagaaaguuucccca

SEQ ID NO: 2073901 - RNA, 12 nt, Human
acaagaaaggag

SEQ ID NO: 2073902 - RNA, 13 nt, Human
acaagaaaggaga

SEQ ID NO: 2073903 - RNA, 17 nt, Human
acaagaaaggagagucu

SEQ ID NO: 2073904 - RNA, 18 nt, Human
acaagaaaggagagucuu

SEQ ID NO: 2073905 - RNA, 21 nt, Human
acaagaaaggagagucuugca

SEQ ID NO: 2073906 - RNA, 16 nt, Human
acaagaaaaaaugaau

SEQ ID NO: 2073907 - RNA, 16 nt, Human
acaacuaggcuucagc

SEQ ID NO: 2073908 - RNA, 14 nt, Human
acaacgaggaagcc

SEQ ID NO: 2073909 - RNA, 21 nt, Human
acaagaaaguuuccccaccag

SEQ ID NO: 2073910 - RNA, 17 nt, Human
acaaggauugcuacugu

SEQ ID NO: 2073911 - RNA, 22 nt, Human
acaaaauguaggguuauaauaa

SEQ ID NO: 2073912 - RNA, 18 nt, Human
acaaccuucuguggcuca

SEQ ID NO: 2073913 - RNA, 15 nt, Human
acaacgaggaagccc

SEQ ID NO: 2073914 - RNA, 22 nt, Human
acaaggcugaccaagagagaaa

SEQ ID NO: 2073915 - RNA, 11 nt, Human
acaaggcccca

SEQ ID NO: 2073916 - RNA, 13 nt, Human
acaaggccccaga

SEQ ID NO: 2073917 - RNA, 17 nt, Human
acaaggcauucaagugu

SEQ ID NO: 2073918 - RNA, 23 nt, Human
acaaggcauucaaguguacagug

SEQ ID NO: 2073919 - RNA, 15 nt, Human
acaaggccccagaga

SEQ ID NO: 2073920 - RNA, 16 nt, Human
acaaggccccagagac

SEQ ID NO: 2073921 - RNA, 17 nt, Human
acaaggccccagagacu

SEQ ID NO: 2073922 - RNA, 18 nt, Human
acaaggccccagagacuc

SEQ ID NO: 2073923 - RNA, 17 nt, Human
acaaggcuagaucauga

SEQ ID NO: 2073924 - RNA, 13 nt, Human
acaaggcugacca

SEQ ID NO: 2073925 - RNA, 18 nt, Human
acaaggcugaccaagaga

SEQ ID NO: 2073926 - RNA, 20 nt, Human
acaaggcugaccaagagaga

SEQ ID NO: 2073927 - RNA, 19 nt, Human
acagagugagacucugucu

SEQ ID NO: 2073928 - RNA, 23 nt, Human
acagagucucacuguugcccagg

SEQ ID NO: 2073929 - RNA, 15 nt, Human
acagagggaagaaaa

SEQ ID NO: 2073930 - RNA, 20 nt, Human
acagagggaagaaaagagcu

SEQ ID NO: 2073931 - RNA, 15 nt, Human
acagagugagacucu

SEQ ID NO: 2073932 - RNA, 16 nt, Human
acagagggaagaaaag

SEQ ID NO: 2073933 - RNA, 13 nt, Human
acagagucugggu

SEQ ID NO: 2073934 - RNA, 15 nt, Human
acagaggcagcccca

SEQ ID NO: 2073935 - RNA, 14 nt, Human
acagaggcagcccc

SEQ ID NO: 2073936 - RNA, 14 nt, Human
acagacacaggccc

SEQ ID NO: 2073937 - RNA, 13 nt, Human
acagacacaggcc

SEQ ID NO: 2073938 - RNA, 23 nt, Human
acagaggcagccccauucugccu

SEQ ID NO: 2073939 - RNA, 19 nt, Human
acagaggcagccccauucu

SEQ ID NO: 2073940 - RNA, 15 nt, Human
acagacacaggcccg

SEQ ID NO: 2073941 - RNA, 11 nt, Human
acagacacagg

SEQ ID NO: 2073942 - RNA, 18 nt, Human
acagacaaaaacagccuc

SEQ ID NO: 2073943 - RNA, 19 nt, Human
acagacaaaaacagccuca

SEQ ID NO: 2073944 - RNA, 20 nt, Human
acagacaaaaacagccucac

SEQ ID NO: 2073945 - RNA, 16 nt, Human
acagaauugcuuguuu

SEQ ID NO: 2073946 - RNA, 17 nt, Human
acagaauucugcuaccu

SEQ ID NO: 2073947 - RNA, 15 nt, Human
acagaauucugcuac

SEQ ID NO: 2073948 - RNA, 16 nt, Human
acagaaucauugcuua

SEQ ID NO: 2073949 - RNA, 19 nt, Human
acacugcuuguguuuuuaa

SEQ ID NO: 2073950 - RNA, 23 nt, Human
acacugcuuguguuuuuaacuca

SEQ ID NO: 2073951 - RNA, 12 nt, Human
acacuggccccu

SEQ ID NO: 2073952 - RNA, 13 nt, Human
acacuggccccua

SEQ ID NO: 2073953 - RNA, 16 nt, Human
acacuggccccuagaa

SEQ ID NO: 2073954 - RNA, 21 nt, Human
acacuggcucauauuccugca

SEQ ID NO: 2073955 - RNA, 22 nt, Human
acacugcacucuuaagcuuccg

SEQ ID NO: 2073956 - RNA, 18 nt, Human
acacugcaagagccuugg

SEQ ID NO: 2073957 - RNA, 17 nt, Human
acagccacggccaggcc

SEQ ID NO: 2073958 - RNA, 16 nt, Human
acagccacggccaggc

SEQ ID NO: 2073959 - RNA, 15 nt, Human
acagccacggccagg

SEQ ID NO: 2073960 - RNA, 18 nt, Human
acagccacggccaggcca

SEQ ID NO: 2073961 - RNA, 18 nt, Human
acagcucuucuccaggcu

SEQ ID NO: 2073962 - RNA, 17 nt, Human
acagcucuguguugcca

SEQ ID NO: 2073963 - RNA, 19 nt, Human
acagcucuguguugccaug

SEQ ID NO: 2073964 - RNA, 15 nt, Human
acaggaucagucuga

SEQ ID NO: 2073965 - RNA, 17 nt, Human
acagcucuucuccaggc

SEQ ID NO: 2073966 - RNA, 16 nt, Human
acagcucuucuccagg

SEQ ID NO: 2073967 - RNA, 14 nt, Human
acaggcaaaugcau

SEQ ID NO: 2073968 - RNA, 16 nt, Human
acaggcaacugaggca

SEQ ID NO: 2073969 - RNA, 18 nt, Human
acaggcaacugaggcaga

SEQ ID NO: 2073970 - RNA, 19 nt, Human
acaggcaacugaggcagac

SEQ ID NO: 2073971 - RNA, 16 nt, Human
acaggauggucucugc

SEQ ID NO: 2073972 - RNA, 17 nt, Human
acaggauggucucugcc

SEQ ID NO: 2073973 - RNA, 12 nt, Human
acaggcaagcac

SEQ ID NO: 2073974 - RNA, 18 nt, Human
acaggcaaugcuggcugu

SEQ ID NO: 2073975 - RNA, 20 nt, Human
acagcucuguguugccaugu

SEQ ID NO: 2073976 - RNA, 14 nt, Human
acaggauuauugga

SEQ ID NO: 2073977 - RNA, 15 nt, Human
accagcccagacccu

SEQ ID NO: 2073978 - RNA, 16 nt, Human
accagcacugucucag

SEQ ID NO: 2073979 - RNA, 17 nt, Human
accagcaauauaucuga

SEQ ID NO: 2073980 - RNA, 20 nt, Human
accagaugcugaaagagaaa

SEQ ID NO: 2073981 - RNA, 23 nt, Human
accagcaacuugucuuuuucugg

SEQ ID NO: 2073982 - RNA, 15 nt, Human
accagcacugucuca

SEQ ID NO: 2073983 - RNA, 20 nt, Human
accagauaagaaugcugguu

SEQ ID NO: 2073984 - RNA, 21 nt, Human
accagauaagaaugcugguuu

SEQ ID NO: 2073985 - RNA, 20 nt, Human
accaccuaggccacuccucc

SEQ ID NO: 2073986 - RNA, 21 nt, Human
accaccuaggccacuccucca

SEQ ID NO: 2073987 - RNA, 17 nt, Human
accaccucaaauuuaaa

SEQ ID NO: 2073988 - RNA, 13 nt, Human
accaccgcucccc

SEQ ID NO: 2073989 - RNA, 14 nt, Human
accaccgcucccca

SEQ ID NO: 2073990 - RNA, 15 nt, Human
accaccgcuccccag

SEQ ID NO: 2073991 - RNA, 17 nt, Human
accaccgcuccccagcc

SEQ ID NO: 2073992 - RNA, 18 nt, Human
accaccgcuccccagccc

SEQ ID NO: 2073993 - RNA, 19 nt, Human
accaccgcuccccagccca

SEQ ID NO: 2073994 - RNA, 21 nt, Human
accaccgcuccccagcccagg

SEQ ID NO: 2073995 - RNA, 23 nt, Human
accaccgcuccccagcccagggu

SEQ ID NO: 2073996 - RNA, 16 nt, Human
accaccuaggccacuc

SEQ ID NO: 2073997 - RNA, 17 nt, Human
accaccuaggccacucc

SEQ ID NO: 2073998 - RNA, 18 nt, Human
accaccuaggccacuccu

SEQ ID NO: 2073999 - RNA, 20 nt, Human
acauuuguauguugugaaga

SEQ ID NO: 2074000 - RNA, 21 nt, Human
acauuuccccagaccugagcu

SEQ ID NO: 2074001 - RNA, 16 nt, Human
acauuucauguauucc

SEQ ID NO: 2074002 - RNA, 13 nt, Human
acauuucccaggg

SEQ ID NO: 2074003 - RNA, 14 nt, Human
acauuucaaaguuu

SEQ ID NO: 2074004 - RNA, 20 nt, Human
acauuucaccuacuuuguaa

SEQ ID NO: 2074005 - RNA, 24 nt, Human
acauuucaccuacuuuguaaguga

SEQ ID NO: 2074006 - RNA, 15 nt, Human
acauuuauucugcuc

SEQ ID NO: 2074007 - RNA, 22 nt, Human
accaagaugccaucuguguccu

SEQ ID NO: 2074008 - RNA, 16 nt, Human
accaaguggaccuuga

SEQ ID NO: 2074009 - RNA, 23 nt, Human
accaaguuauaaaucaaugucac

SEQ ID NO: 2074010 - RNA, 23 nt, Human
accaaguuggaacauccuuggaa

SEQ ID NO: 2074011 - RNA, 13 nt, Human
accaaguuauaua

SEQ ID NO: 2074012 - RNA, 15 nt, Human
accaaguuauauaaa

SEQ ID NO: 2074013 - RNA, 21 nt, Human
accaaguuauauaaagagaaa

SEQ ID NO: 2074014 - RNA, 22 nt, Human
accaaguuauauaaagagaaaa

SEQ ID NO: 2074015 - RNA, 20 nt, Human
accaauauuauacuaagaaa

SEQ ID NO: 2074016 - RNA, 17 nt, Human
accaagcaggaagcuca

SEQ ID NO: 2074017 - RNA, 12 nt, Human
accaagcccagu

SEQ ID NO: 2074018 - RNA, 24 nt, Human
accaagcaggaagcucagacuggu

SEQ ID NO: 2074019 - RNA, 13 nt, Human
accaagcaggaag

SEQ ID NO: 2074020 - RNA, 14 nt, Human
accaagcaggaagc

SEQ ID NO: 2074021 - RNA, 15 nt, Human
accaagcaggaagcu

SEQ ID NO: 2074022 - RNA, 16 nt, Human
accaagcaggaagcuc

SEQ ID NO: 2074023 - RNA, 14 nt, Human
acauuuauucugcu

SEQ ID NO: 2074024 - RNA, 18 nt, Human
acaugugcacaugcacgu

SEQ ID NO: 2074025 - RNA, 16 nt, Human
acaugugcacaugcac

SEQ ID NO: 2074026 - RNA, 21 nt, Human
acaugcauuugaggucaagua

SEQ ID NO: 2074027 - RNA, 12 nt, Human
acaugcauuuga

SEQ ID NO: 2074028 - RNA, 22 nt, Human
acaugcagcccaugcccaccug

SEQ ID NO: 2074029 - RNA, 16 nt, Human
acaugcauacauacac

SEQ ID NO: 2074030 - RNA, 19 nt, Human
acaugaucuucuuuauaau

SEQ ID NO: 2074031 - RNA, 17 nt, Human
acaugcauuugagguca

SEQ ID NO: 2074032 - RNA, 19 nt, Human
acaggguuuugccauguug

SEQ ID NO: 2074033 - RNA, 14 nt, Human
acaggguugggccc

SEQ ID NO: 2074034 - RNA, 16 nt, Human
acaggguguugucagc

SEQ ID NO: 2074035 - RNA, 21 nt, Human
acaggguguugucagcaucuu

SEQ ID NO: 2074036 - RNA, 16 nt, Human
acaggguucaaaaugu

SEQ ID NO: 2074037 - RNA, 23 nt, Human
acaggcaaugcuggcuguuggcu

SEQ ID NO: 2074038 - RNA, 19 nt, Human
acaggcaaugcuggcuguu

SEQ ID NO: 2074039 - RNA, 22 nt, Human
acaggcaacugaggcagacagc

SEQ ID NO: 2074040 - RNA, 13 nt, Human
acccauuccuauu

SEQ ID NO: 2074041 - RNA, 17 nt, Human
acccauuccuauuucuu

SEQ ID NO: 2074042 - RNA, 22 nt, Human
acccauucguggugaucaauua

SEQ ID NO: 2074043 - RNA, 22 nt, Human
acccaguguuuuaggagcauga

SEQ ID NO: 2074044 - RNA, 19 nt, Human
acccaguguuuuaggagca

SEQ ID NO: 2074045 - RNA, 16 nt, Human
acccaccucagccucc

SEQ ID NO: 2074046 - RNA, 13 nt, Human
acccaccugcuga

SEQ ID NO: 2074047 - RNA, 12 nt, Human
acccaccugagc

SEQ ID NO: 2074048 - RNA, 13 nt, Human
acccaccugagcu

SEQ ID NO: 2074049 - RNA, 14 nt, Human
acccaccugagcuu

SEQ ID NO: 2074050 - RNA, 16 nt, Human
acccaccugagcuuug

SEQ ID NO: 2074051 - RNA, 18 nt, Human
acccaccugagcuuugga

SEQ ID NO: 2074052 - RNA, 11 nt, Human
acccaccugcu

SEQ ID NO: 2074053 - RNA, 17 nt, Human
acccaccugcugagaga

SEQ ID NO: 2074054 - RNA, 22 nt, Human
acccaccugcugagagacccaa

SEQ ID NO: 2074055 - RNA, 19 nt, Human
acccaccugguggccucug

SEQ ID NO: 2074056 - RNA, 15 nt, Human
acccaccucagccuc

SEQ ID NO: 2074057 - RNA, 14 nt, Human
acccaccucagccu

SEQ ID NO: 2074058 - RNA, 13 nt, Human
acccaccucagcc

SEQ ID NO: 2074059 - RNA, 17 nt, Human
acccacaagugccacug

SEQ ID NO: 2074060 - RNA, 13 nt, Human
acccacaagugcc

SEQ ID NO: 2074061 - RNA, 19 nt, Human
accauauucagugcugugg

SEQ ID NO: 2074062 - RNA, 20 nt, Human
accauauggauauuagucau

SEQ ID NO: 2074063 - RNA, 19 nt, Human
accauccuggccaacauga

SEQ ID NO: 2074064 - RNA, 13 nt, Human
accauccuauuua

SEQ ID NO: 2074065 - RNA, 16 nt, Human
accauccuauuuaacu

SEQ ID NO: 2074066 - RNA, 13 nt, Human
accaucucaggcc

SEQ ID NO: 2074067 - RNA, 14 nt, Human
accaucucaggcca

SEQ ID NO: 2074068 - RNA, 15 nt, Human
accaucucaggccac

SEQ ID NO: 2074069 - RNA, 16 nt, Human
accaucucaggccacc

SEQ ID NO: 2074070 - RNA, 17 nt, Human
accaucucaggccaccu

SEQ ID NO: 2074071 - RNA, 21 nt, Human
accaucucaggccaccugccc

SEQ ID NO: 2074072 - RNA, 15 nt, Human
accccucaccuugca

SEQ ID NO: 2074073 - RNA, 16 nt, Human
accccucaccuugcaa

SEQ ID NO: 2074074 - RNA, 19 nt, Human
accccucaccuugcaacac

SEQ ID NO: 2074075 - RNA, 22 nt, Human
accccucaccuugcaacacaca

SEQ ID NO: 2074076 - RNA, 23 nt, Human
accccucaccuugcaacacacag

SEQ ID NO: 2074077 - RNA, 19 nt, Human
accccuccaugugggcuag

SEQ ID NO: 2074078 - RNA, 16 nt, Human
accccuccaugugggc

SEQ ID NO: 2074079 - RNA, 18 nt, Human
acccccuucuacugagcc

SEQ ID NO: 2074080 - RNA, 19 nt, Human
acccccuucuacugagccu

SEQ ID NO: 2074081 - RNA, 14 nt, Human
acccccuucucugc

SEQ ID NO: 2074082 - RNA, 13 nt, Human
acccccuucucug

SEQ ID NO: 2074083 - RNA, 20 nt, Human
accccucacaggagcuuacu

SEQ ID NO: 2074084 - RNA, 16 nt, Human
acccccuucagugccc

SEQ ID NO: 2074085 - RNA, 18 nt, Human
acccccuucagugcccac

SEQ ID NO: 2074086 - RNA, 20 nt, Human
acccccuucagugcccacca

SEQ ID NO: 2074087 - RNA, 18 nt, Human
accccuccccuaaugccu

SEQ ID NO: 2074088 - RNA, 17 nt, Human
aaauuuuuuuuguuuca

SEQ ID NO: 2074089 - RNA, 18 nt, Human
aaauuuuuuuuguuucau

SEQ ID NO: 2074090 - RNA, 15 nt, Human
aacaaaaaacaauau

SEQ ID NO: 2074091 - RNA, 20 nt, Human
aacaaauuauguuacaucug

SEQ ID NO: 2074092 - RNA, 13 nt, Human
aacaacauguaua

SEQ ID NO: 2074093 - RNA, 13 nt, Human
aacaacaaaaaau

SEQ ID NO: 2074094 - RNA, 18 nt, Human
aacaaccucggcuccugg

SEQ ID NO: 2074095 - RNA, 18 nt, Human
aacacauuugauucugug

SEQ ID NO: 2074096 - RNA, 20 nt, Human
aacacauuugauucugugug

SEQ ID NO: 2074097 - RNA, 21 nt, Human
aacacauuaagccuuccacac

SEQ ID NO: 2074098 - RNA, 21 nt, Human
aacacauuaucgggagcagug

SEQ ID NO: 2074099 - RNA, 18 nt, Human
aacaaccccccaucacaa

SEQ ID NO: 2074100 - RNA, 19 nt, Human
aacaaccccccaucacaaa

SEQ ID NO: 2074101 - RNA, 22 nt, Human
aacaaccccccaucacaaacuu

SEQ ID NO: 2074102 - RNA, 22 nt, Human
aacacaucagcuagcaaaagaa

SEQ ID NO: 2074103 - RNA, 21 nt, Human
aaaucuuauauuccauauauu

SEQ ID NO: 2074104 - RNA, 19 nt, Human
aaaucuuauauuccauaua

SEQ ID NO: 2074105 - RNA, 15 nt, Human
aaaugccuuacuuug

SEQ ID NO: 2074106 - RNA, 16 nt, Human
aaaugccuuacuuugu

SEQ ID NO: 2074107 - RNA, 17 nt, Human
aaaugccuuacuuugua

SEQ ID NO: 2074108 - RNA, 18 nt, Human
aaaugccuuacuuuguau

SEQ ID NO: 2074109 - RNA, 19 nt, Human
aaaugccuuacuuuguaug

SEQ ID NO: 2074110 - RNA, 20 nt, Human
aaaugccuuacuuuguauga

SEQ ID NO: 2074111 - RNA, 22 nt, Human
aaaugccuuacuuuguaugaua

SEQ ID NO: 2074112 - RNA, 14 nt, Human
aaauugcuccuuga

SEQ ID NO: 2074113 - RNA, 13 nt, Human
aaauugcuccuug

SEQ ID NO: 2074114 - RNA, 13 nt, Human
aaauugaauuuaa

SEQ ID NO: 2074115 - RNA, 15 nt, Human
aaauugaauuuaaca

SEQ ID NO: 2074116 - RNA, 16 nt, Human
aaauugaauuuaacaa

SEQ ID NO: 2074117 - RNA, 17 nt, Human
aaauugaauuuaacaau

SEQ ID NO: 2074118 - RNA, 18 nt, Human
aaauugaauuuaacaaug

SEQ ID NO: 2074119 - RNA, 17 nt, Human
aaauuaaagcugaaaac

SEQ ID NO: 2074120 - RNA, 13 nt, Human
aaauuaaagcuga

SEQ ID NO: 2074121 - RNA, 15 nt, Human
aaauuaaacaauuua

SEQ ID NO: 2074122 - RNA, 13 nt, Human
aaauuaaagaaaa

SEQ ID NO: 2074123 - RNA, 14 nt, Human
aaauuaaagaaaau

SEQ ID NO: 2074124 - RNA, 12 nt, Human
aaauuaacacug

SEQ ID NO: 2074125 - RNA, 13 nt, Human
aaauuaacacugc

SEQ ID NO: 2074126 - RNA, 15 nt, Human
aaauuaaauaaaaua

SEQ ID NO: 2074127 - RNA, 12 nt, Human
aaauuaaauaua

SEQ ID NO: 2074128 - RNA, 16 nt, Human
aaauuaaauauaugua

SEQ ID NO: 2074129 - RNA, 19 nt, Human
aaauuaaauauauguaugu

SEQ ID NO: 2074130 - RNA, 20 nt, Human
aaauuaaauauauguaugua

SEQ ID NO: 2074131 - RNA, 23 nt, Human
aaauuaaauauauguauguaaaa

SEQ ID NO: 2074132 - RNA, 21 nt, Human
aaauuaacacugcuuguguuu

SEQ ID NO: 2074133 - RNA, 20 nt, Human
aaauugaaaggcauucucug

SEQ ID NO: 2074134 - RNA, 22 nt, Human
aaauugaaaggcauucucugaa

SEQ ID NO: 2074135 - RNA, 23 nt, Human
aaauugaaaggcauucucugaag

SEQ ID NO: 2074136 - RNA, 21 nt, Human
aaauucuuuuuuaaauuuucu

SEQ ID NO: 2074137 - RNA, 23 nt, Human
aaauucuuuuuuaaauuuucuuc

SEQ ID NO: 2074138 - RNA, 16 nt, Human
aacagcagagguucuu

SEQ ID NO: 2074139 - RNA, 17 nt, Human
aacagcagagguucuuu

SEQ ID NO: 2074140 - RNA, 21 nt, Human
aacagcagagguucuuuuaaa

SEQ ID NO: 2074141 - RNA, 13 nt, Human
aacagcaggccca

SEQ ID NO: 2074142 - RNA, 17 nt, Human
aacagcaggcccaccua

SEQ ID NO: 2074143 - RNA, 21 nt, Human
aacagcaggguagucugguuu

SEQ ID NO: 2074144 - RNA, 23 nt, Human
aacagcauucuugucacaauaaa

SEQ ID NO: 2074145 - RNA, 12 nt, Human
aacagcauugcu

SEQ ID NO: 2074146 - RNA, 14 nt, Human
aacagcauugcuuu

SEQ ID NO: 2074147 - RNA, 15 nt, Human
aacagcauugcuuuc

SEQ ID NO: 2074148 - RNA, 16 nt, Human
aacagcauugcuuucu

SEQ ID NO: 2074149 - RNA, 16 nt, Human
aaccagagcaagcuuu

SEQ ID NO: 2074150 - RNA, 19 nt, Human
aaccagagcaagcuuuuuu

SEQ ID NO: 2074151 - RNA, 13 nt, Human
aaccagagcacug

SEQ ID NO: 2074152 - RNA, 14 nt, Human
aaccagagcacugu

SEQ ID NO: 2074153 - RNA, 18 nt, Human
aaccagagcacuguauac

SEQ ID NO: 2074154 - RNA, 18 nt, Human
aaccagagccauggacuc

SEQ ID NO: 2074155 - RNA, 17 nt, Human
aaccagaagcaacagaa

SEQ ID NO: 2074156 - RNA, 21 nt, Human
aaccagaagcaacagaaaaaa

SEQ ID NO: 2074157 - RNA, 22 nt, Human
aaccagaagcaacagaaaaaau

SEQ ID NO: 2074158 - RNA, 18 nt, Human
aaccagaauaaaguucug

SEQ ID NO: 2074159 - RNA, 14 nt, Human
aaccacggaaaaga

SEQ ID NO: 2074160 - RNA, 19 nt, Human
aaccaccgcuccccagccc

SEQ ID NO: 2074161 - RNA, 20 nt, Human
aaccaccgcuccccagccca

SEQ ID NO: 2074162 - RNA, 15 nt, Human
aaccacuucagcuga

SEQ ID NO: 2074163 - RNA, 18 nt, Human
aaccacgucugucuucac

SEQ ID NO: 2074164 - RNA, 15 nt, Human
aaccacuguaaaaug

SEQ ID NO: 2074165 - RNA, 20 nt, Human
aaccacuguaaaaugaaauu

SEQ ID NO: 2074166 - RNA, 16 nt, Human
aaccacuguaaaauga

SEQ ID NO: 2074167 - RNA, 13 nt, Human
aaccacuuaaaaa

SEQ ID NO: 2074168 - RNA, 19 nt, Human
aaccacuuaaaaaaugucc

SEQ ID NO: 2074169 - RNA, 13 nt, Human
aaccacgcuggac

SEQ ID NO: 2074170 - RNA, 18 nt, Human
aacaucccauugcccugg

SEQ ID NO: 2074171 - RNA, 19 nt, Human
aacaucccauugcccuggu

SEQ ID NO: 2074172 - RNA, 15 nt, Human
aaccaccgcucccca

SEQ ID NO: 2074173 - RNA, 16 nt, Human
aaccaccgcuccccag

SEQ ID NO: 2074174 - RNA, 17 nt, Human
aaccaccgcuccccagc

SEQ ID NO: 2074175 - RNA, 18 nt, Human
aaccaccgcuccccagcc

SEQ ID NO: 2074176 - RNA, 16 nt, Human
aacaucccauugcccu

SEQ ID NO: 2074177 - RNA, 20 nt, Human
aacagcuucaugccuuugua

SEQ ID NO: 2074178 - RNA, 21 nt, Human
aacagcuucaugccuuuguaa

SEQ ID NO: 2074179 - RNA, 22 nt, Human
aacagcuucaugccuuuguaag

SEQ ID NO: 2074180 - RNA, 13 nt, Human
aacagcuguggcu

SEQ ID NO: 2074181 - RNA, 15 nt, Human
aacaggaaaaaaacu

SEQ ID NO: 2074182 - RNA, 22 nt, Human
aacauccaaggagaaacagaga

SEQ ID NO: 2074183 - RNA, 15 nt, Human
aacauccaauaggaa

SEQ ID NO: 2074184 - RNA, 21 nt, Human
aacauccaauaggaaugcuaa

SEQ ID NO: 2074185 - RNA, 22 nt, Human
aacauccaauaggaaugcuaac

SEQ ID NO: 2074186 - RNA, 19 nt, Human
aacauccaaggagaaacag

SEQ ID NO: 2074187 - RNA, 15 nt, Human
aacccuauugguaaa

SEQ ID NO: 2074188 - RNA, 21 nt, Human
aacccuuggagccaauggaga

SEQ ID NO: 2074189 - RNA, 13 nt, Human
aacccuucuuuua

SEQ ID NO: 2074190 - RNA, 14 nt, Human
aacccuucuuuuaa

SEQ ID NO: 2074191 - RNA, 14 nt, Human
aacccuugaaaaga

SEQ ID NO: 2074192 - RNA, 15 nt, Human
aacccuugaaaagac

SEQ ID NO: 2074193 - RNA, 21 nt, Human
aacccuaaaaagcagagcuuu

SEQ ID NO: 2074194 - RNA, 18 nt, Human
aaccuaccuguaacuuuu

SEQ ID NO: 2074195 - RNA, 13 nt, Human
aaccuaagcaaaa

SEQ ID NO: 2074196 - RNA, 16 nt, Human
aacccuuuuggccccc

SEQ ID NO: 2074197 - RNA, 22 nt, Human
aacccuuuuggcccccgagcug

SEQ ID NO: 2074198 - RNA, 15 nt, Human
aaccuaaccccuuuc

SEQ ID NO: 2074199 - RNA, 15 nt, Human
aacuauuggaaagua

SEQ ID NO: 2074200 - RNA, 13 nt, Human
aacuauuuaucug

SEQ ID NO: 2074201 - RNA, 20 nt, Human
aacuauuuaucuguguuuuu

SEQ ID NO: 2074202 - RNA, 15 nt, Human
aacgggcugcccugc

SEQ ID NO: 2074203 - RNA, 21 nt, Human
aacucagaaacaucaguuacu

SEQ ID NO: 2074204 - RNA, 23 nt, Human
aacuauuuaucuguguuuuugaa

SEQ ID NO: 2074205 - RNA, 11 nt, Human
aacgcagcccu

SEQ ID NO: 2074206 - RNA, 18 nt, Human
aacgcagaugauccauga

SEQ ID NO: 2074207 - RNA, 17 nt, Human
aacggaacguuggacuu

SEQ ID NO: 2074208 - RNA, 21 nt, Human
aacggacgagauaaugugaac

SEQ ID NO: 2074209 - RNA, 14 nt, Human
aacggagaaaggug

SEQ ID NO: 2074210 - RNA, 19 nt, Human
aacggagagcgccugcccc

SEQ ID NO: 2074211 - RNA, 12 nt, Human
aacgauuuagaa

SEQ ID NO: 2074212 - RNA, 17 nt, Human
aacgaugaugcuuguaa

SEQ ID NO: 2074213 - RNA, 22 nt, Human
aacgaugaugcuuguaacaaga

SEQ ID NO: 2074214 - RNA, 13 nt, Human
aacgauuuagaaa

SEQ ID NO: 2074215 - RNA, 12 nt, Human
aacugaggcaga

SEQ ID NO: 2074216 - RNA, 20 nt, Human
aacugaggcagacagcagcu

SEQ ID NO: 2074217 - RNA, 16 nt, Human
aacuuaacauucugua

SEQ ID NO: 2074218 - RNA, 17 nt, Human
aacuuaacauucuguaa

SEQ ID NO: 2074219 - RNA, 18 nt, Human
aacuuaaccgcaucagaa

SEQ ID NO: 2074220 - RNA, 22 nt, Human
aacuuaaccgcaucagaagccu

SEQ ID NO: 2074221 - RNA, 21 nt, Human
aacuuaacauucuguaaaaug

SEQ ID NO: 2074222 - RNA, 15 nt, Human
aacuuaagaaacacu

SEQ ID NO: 2074223 - RNA, 16 nt, Human
aacuuaaauuuuaauu

SEQ ID NO: 2074224 - RNA, 19 nt, Human
aacuuaaauuuuaauuuau

SEQ ID NO: 2074225 - RNA, 15 nt, Human
aacugacccucccuu

SEQ ID NO: 2074226 - RNA, 22 nt, Human
aacugacccucccuuccugucc

SEQ ID NO: 2074227 - RNA, 18 nt, Human
aacuuaauaguauuuaug

SEQ ID NO: 2074228 - RNA, 12 nt, Human
aacuuacacaca

SEQ ID NO: 2074229 - RNA, 21 nt, Human
aacuuuaucacauuauuugca

SEQ ID NO: 2074230 - RNA, 19 nt, Human
aaagcccuuaggaagaauu

SEQ ID NO: 2074231 - RNA, 13 nt, Human
aaagccagucuua

SEQ ID NO: 2074232 - RNA, 14 nt, Human
aaagccagucuuaa

SEQ ID NO: 2074233 - RNA, 14 nt, Human
aaagccagaagcug

SEQ ID NO: 2074234 - RNA, 19 nt, Human
aaagccagcugccgaccag

SEQ ID NO: 2074235 - RNA, 18 nt, Human
aaagccacguuccuuacu

SEQ ID NO: 2074236 - RNA, 23 nt, Human
aaagcccuuccaugucgccucug

SEQ ID NO: 2074237 - RNA, 22 nt, Human
aaagcccuuccaugucgccucu

SEQ ID NO: 2074238 - RNA, 16 nt, Human
aaagccuccuccagcc

SEQ ID NO: 2074239 - RNA, 12 nt, Human
aaaggcacagug

SEQ ID NO: 2074240 - RNA, 17 nt, Human
aaaggcaccuauaaaac

SEQ ID NO: 2074241 - RNA, 20 nt, Human
aaaggcaccuauaaaacagg

SEQ ID NO: 2074242 - RNA, 20 nt, Human
aaaggccagcuggcagcaga

SEQ ID NO: 2074243 - RNA, 12 nt, Human
aaaggccagcug

SEQ ID NO: 2074244 - RNA, 14 nt, Human
aaaggccagcuggc

SEQ ID NO: 2074245 - RNA, 18 nt, Human
aaaggccagcuggcagca

SEQ ID NO: 2074246 - RNA, 21 nt, Human
aaaggcaccuauaaaacaggu

SEQ ID NO: 2074247 - RNA, 14 nt, Human
aaaggccucuuccu

SEQ ID NO: 2074248 - RNA, 11 nt, Human
aaaggccucuu

SEQ ID NO: 2074249 - RNA, 23 nt, Human
aaagccaaguuuauauacaauua

SEQ ID NO: 2074250 - RNA, 13 nt, Human
aaauaaaugcaau

SEQ ID NO: 2074251 - RNA, 15 nt, Human
aaauaaaguuacauu

SEQ ID NO: 2074252 - RNA, 12 nt, Human
aaauaaauguac

SEQ ID NO: 2074253 - RNA, 20 nt, Human
aaauaaauagcuauauccau

SEQ ID NO: 2074254 - RNA, 16 nt, Human
aaauaaauagcuauau

SEQ ID NO: 2074255 - RNA, 17 nt, Human
aaaguggccaugccacc

SEQ ID NO: 2074256 - RNA, 17 nt, Human
aaaguggcaagaccaaa

SEQ ID NO: 2074257 - RNA, 19 nt, Human
aaaguggcaagaccaaaau

SEQ ID NO: 2074258 - RNA, 13 nt, Human
aaaguggaaggaa

SEQ ID NO: 2074259 - RNA, 14 nt, Human
aaaguggaaggaaa

SEQ ID NO: 2074260 - RNA, 16 nt, Human
aaaguggaaggaaaga

SEQ ID NO: 2074261 - RNA, 13 nt, Human
aaauaaaagcagc

SEQ ID NO: 2074262 - RNA, 19 nt, Human
aaauaaaagcagcaucugc

SEQ ID NO: 2074263 - RNA, 17 nt, Human
aaauaaaaccuuucaaa

SEQ ID NO: 2074264 - RNA, 20 nt, Human
aaauaaaagaaaugcacaau

SEQ ID NO: 2074265 - RNA, 11 nt, Human
aaauaaaagca

SEQ ID NO: 2074266 - RNA, 16 nt, Human
aaauaaaguauauaua

SEQ ID NO: 2074267 - RNA, 20 nt, Human
aaauaaaguauauauagaau

SEQ ID NO: 2074268 - RNA, 18 nt, Human
aaauaaaguuggugacag

SEQ ID NO: 2074269 - RNA, 13 nt, Human
aaaguggaaaaau

SEQ ID NO: 2074270 - RNA, 12 nt, Human
aaagucuccagc

SEQ ID NO: 2074271 - RNA, 21 nt, Human
aaaggcgcagugcuucucuac

SEQ ID NO: 2074272 - RNA, 17 nt, Human
aaaggcuaccuuauugu

SEQ ID NO: 2074273 - RNA, 19 nt, Human
aaauagugguucuuggaaa

SEQ ID NO: 2074274 - RNA, 21 nt, Human
aaauagugguucuuggaaaaa

SEQ ID NO: 2074275 - RNA, 12 nt, Human
aaauagcuauau

SEQ ID NO: 2074276 - RNA, 16 nt, Human
aaauagcuauauccau

SEQ ID NO: 2074277 - RNA, 19 nt, Human
aaauagcuauauccaugua

SEQ ID NO: 2074278 - RNA, 24 nt, Human
aaauagcucaggugucccugcacu

SEQ ID NO: 2074279 - RNA, 21 nt, Human
aaauagccacuuaccuucaau

SEQ ID NO: 2074280 - RNA, 23 nt, Human
aaauagccacuuaccuucaauaa

SEQ ID NO: 2074281 - RNA, 21 nt, Human
aaauagccgggcaugguggcg

SEQ ID NO: 2074282 - RNA, 22 nt, Human
aaaucuguccaaaggaggcugg

SEQ ID NO: 2074283 - RNA, 17 nt, Human
aaaucuguaagcucuuu

SEQ ID NO: 2074284 - RNA, 19 nt, Human
aaaucuguaagcucuuuga

SEQ ID NO: 2074285 - RNA, 21 nt, Human
aaaucuguaagcucuuugaaa

SEQ ID NO: 2074286 - RNA, 23 nt, Human
aaaucuguaagcucuuugaaaca

SEQ ID NO: 2074287 - RNA, 21 nt, Human
aaaucuguccaaaggaggcug

SEQ ID NO: 2074288 - RNA, 13 nt, Human
aaaucaaugucac

SEQ ID NO: 2074289 - RNA, 19 nt, Human
aaaucaaugcuauaacuau

SEQ ID NO: 2074290 - RNA, 14 nt, Human
aaaucaaguuucca

SEQ ID NO: 2074291 - RNA, 16 nt, Human
aaaucaaguuuccaag

SEQ ID NO: 2074292 - RNA, 20 nt, Human
aaaucaaguuuccaagcaaa

SEQ ID NO: 2074293 - RNA, 16 nt, Human
aaacccuauugguaaa

SEQ ID NO: 2074294 - RNA, 19 nt, Human
aaacccgacagagggaaga

SEQ ID NO: 2074295 - RNA, 18 nt, Human
aaacccgacagagggaag

SEQ ID NO: 2074296 - RNA, 16 nt, Human
aaacccgacagaggga

SEQ ID NO: 2074297 - RNA, 15 nt, Human
aaaccccggggcucc

SEQ ID NO: 2074298 - RNA, 20 nt, Human
aaaccauuaugaagaagaga

SEQ ID NO: 2074299 - RNA, 21 nt, Human
aaacccguuuuaugauuuacu

SEQ ID NO: 2074300 - RNA, 23 nt, Human
aaacccucguuucugauuaaugc

SEQ ID NO: 2074301 - RNA, 23 nt, Human
aaacugagacucagacaggaaag

SEQ ID NO: 2074302 - RNA, 13 nt, Human
aaagaaaucaugu

SEQ ID NO: 2074303 - RNA, 14 nt, Human
aaagaaaucauguu

SEQ ID NO: 2074304 - RNA, 16 nt, Human
aaagaaaucauguuau

SEQ ID NO: 2074305 - RNA, 18 nt, Human
aaagaaaucauguuauga

SEQ ID NO: 2074306 - RNA, 14 nt, Human
aaacucugccagcc

SEQ ID NO: 2074307 - RNA, 14 nt, Human
aaacucugggaaau

SEQ ID NO: 2074308 - RNA, 22 nt, Human
aaacucugggaaauaagagaga

SEQ ID NO: 2074309 - RNA, 21 nt, Human
aaacugagacucagacaggaa

SEQ ID NO: 2074310 - RNA, 13 nt, Human
aaagaguuaagaa

SEQ ID NO: 2074311 - RNA, 21 nt, Human
aaagaaguaacaagagugauu

SEQ ID NO: 2074312 - RNA, 20 nt, Human
aaagaagguuucagaaagaa

SEQ ID NO: 2074313 - RNA, 12 nt, Human
aaagaaggaagu

SEQ ID NO: 2074314 - RNA, 15 nt, Human
aaagaaaugcacaau

SEQ ID NO: 2074315 - RNA, 17 nt, Human
aaagaaaugcacaaugu

SEQ ID NO: 2074316 - RNA, 20 nt, Human
aaagaagcccaauauuauaa

SEQ ID NO: 2074317 - RNA, 16 nt, Human
aaagaguucuuaagga

SEQ ID NO: 2074318 - RNA, 18 nt, Human
aaagaguuugagaccuga

SEQ ID NO: 2074319 - RNA, 19 nt, Human
aaagaguuugagaccugaa

SEQ ID NO: 2074320 - RNA, 12 nt, Human
aaagauauuauu

SEQ ID NO: 2074321 - RNA, 22 nt, Human
aaagauauuauucaccauguaa

SEQ ID NO: 2074322 - RNA, 23 nt, Human
aaaauugauauacuuuuuucuua

SEQ ID NO: 2074323 - RNA, 14 nt, Human
aaaauugaauuuaa

SEQ ID NO: 2074324 - RNA, 15 nt, Human
aaaauugaauuuaac

SEQ ID NO: 2074325 - RNA, 16 nt, Human
aaaauugaauuuaaca

SEQ ID NO: 2074326 - RNA, 17 nt, Human
aaaauugaauuuaacaa

SEQ ID NO: 2074327 - RNA, 19 nt, Human
aaaauugaauuuaacaaug

SEQ ID NO: 2074328 - RNA, 20 nt, Human
aaaauugaauuuaacaaugc

SEQ ID NO: 2074329 - RNA, 21 nt, Human
aaaauugaauuuaacaaugcg

SEQ ID NO: 2074330 - RNA, 12 nt, Human
aaacacuuguaa

SEQ ID NO: 2074331 - RNA, 23 nt, Human
aaacacuaguaccuucagauccu

SEQ ID NO: 2074332 - RNA, 23 nt, Human
aaacacuauuuuuuuuucuuuug

SEQ ID NO: 2074333 - RNA, 12 nt, Human
aaacagaaaaaa

SEQ ID NO: 2074334 - RNA, 13 nt, Human
aaacagaaaaaaa

SEQ ID NO: 2074335 - RNA, 15 nt, Human
aaacagaaaaaaaac

SEQ ID NO: 2074336 - RNA, 17 nt, Human
aaacagaaaaaaaacac

SEQ ID NO: 2074337 - RNA, 22 nt, Human
aaacagacaaaaacagccucac

SEQ ID NO: 2074338 - RNA, 14 nt, Human
aaacagacucaggu

SEQ ID NO: 2074339 - RNA, 18 nt, Human
aaaaacuuuuauaaauua

SEQ ID NO: 2074340 - RNA, 23 nt, Human
aaaaacuuuuauaaauuaaauau

SEQ ID NO: 2074341 - RNA, 20 nt, Human
aaaaacucugggaaauaaga

SEQ ID NO: 2074342 - RNA, 15 nt, Human
aaaaagaaaggaggg

SEQ ID NO: 2074343 - RNA, 13 nt, Human
aaaaaauuggcau

SEQ ID NO: 2074344 - RNA, 21 nt, Human
aaaagugggccagugugggaa

SEQ ID NO: 2074345 - RNA, 19 nt, Human
aaaaguggcaagaccaaaa

SEQ ID NO: 2074346 - RNA, 23 nt, Human
aaaagugaucaauaaaaugugau

SEQ ID NO: 2074347 - RNA, 16 nt, Human
aaaauaaaauuaagaa

SEQ ID NO: 2074348 - RNA, 13 nt, Human
aaaaucauaaacu

SEQ ID NO: 2074349 - RNA, 22 nt, Human
aaaaucauaaacugugugcaga

SEQ ID NO: 2074350 - RNA, 12 nt, Human
aaaaucaugaga

SEQ ID NO: 2074351 - RNA, 15 nt, Human
aaaaucauguacauu

SEQ ID NO: 2074352 - RNA, 14 nt, Human
aaaauccuucuaau

SEQ ID NO: 2074353 - RNA, 15 nt, Human
aaaauccuucuaauc

SEQ ID NO: 2074354 - RNA, 16 nt, Human
aaaauccuucuaaucu

SEQ ID NO: 2074355 - RNA, 22 nt, Human
aaaaucccuuaccucggugccu

SEQ ID NO: 2074356 - RNA, 16 nt, Human
aaaaucauguacauuu

SEQ ID NO: 2074357 - RNA, 17 nt, Human
aaaaucauguacauuuc

SEQ ID NO: 2074358 - RNA, 18 nt, Human
aaaaucauguacauuucu

SEQ ID NO: 2074359 - RNA, 12 nt, Human
aaaaucauugau

SEQ ID NO: 2074360 - RNA, 22 nt, Human
aaaaucauugauugucagcuac

SEQ ID NO: 2074361 - RNA, 12 nt, Human
aaaauccuacca

SEQ ID NO: 2074362 - RNA, 18 nt, Human
aaaauccuaccaaccucu

SEQ ID NO: 2074363 - RNA, 22 nt, Human
aaaaguucauaacagugccauu

SEQ ID NO: 2074364 - RNA, 15 nt, Human
aaaauaaaaggucua

SEQ ID NO: 2074365 - RNA, 12 nt, Human
aaaauaaaauua

SEQ ID NO: 2074366 - RNA, 13 nt, Human
aaaauaaaauuaa

SEQ ID NO: 2074367 - RNA, 14 nt, Human
aaaaguugaaauua

SEQ ID NO: 2074368 - RNA, 19 nt, Human
aaaauaaaauuaaagcuga

SEQ ID NO: 2074369 - RNA, 12 nt, Human
aaaaguuauaac

SEQ ID NO: 2074370 - RNA, 12 nt, Human
aaaaguuauuaa

SEQ ID NO: 2074371 - RNA, 16 nt, Human
aaaaguuaaaaaaaau

SEQ ID NO: 2074372 - RNA, 18 nt, Human
aaaaguuaaaaaaaauaa

SEQ ID NO: 2074373 - RNA, 22 nt, Human
aaaaguuaaaaaaaauaauaaa

SEQ ID NO: 2074374 - RNA, 12 nt, Human
aaaaguugaaau

SEQ ID NO: 2074375 - RNA, 17 nt, Human
aaaaguuauuaauauuu

SEQ ID NO: 2074376 - RNA, 14 nt, Human
aaguccacagugga

SEQ ID NO: 2074377 - RNA, 19 nt, Human
aaguccacaguggaaccag

SEQ ID NO: 2074378 - RNA, 11 nt, Human
aagucccugcc

SEQ ID NO: 2074379 - RNA, 13 nt, Human
aagucccugcccc

SEQ ID NO: 2074380 - RNA, 14 nt, Human
aagucccugccccc

SEQ ID NO: 2074381 - RNA, 17 nt, Human
aagucccugcccccucc

SEQ ID NO: 2074382 - RNA, 18 nt, Human
aaguccucuuuucugaga

SEQ ID NO: 2074383 - RNA, 18 nt, Human
aaguauccugcuucugau

SEQ ID NO: 2074384 - RNA, 17 nt, Human
aaguaguguaucacagu

SEQ ID NO: 2074385 - RNA, 21 nt, Human
aaguaucgggggcuggggcag

SEQ ID NO: 2074386 - RNA, 17 nt, Human
aaguaucuacaugcggu

SEQ ID NO: 2074387 - RNA, 22 nt, Human
aaguccucuuuucugagaggac

SEQ ID NO: 2074388 - RNA, 18 nt, Human
aaguccuuaccucuuccg

SEQ ID NO: 2074389 - RNA, 14 nt, Human
aagucgguuagugg

SEQ ID NO: 2074390 - RNA, 17 nt, Human
aagucuaaauauuuccu

SEQ ID NO: 2074391 - RNA, 21 nt, Human
aagucucacuggcugucagua

SEQ ID NO: 2074392 - RNA, 19 nt, Human
aagucuaggagcugggagg

SEQ ID NO: 2074393 - RNA, 22 nt, Human
aagucuaggagcugggaggaaa

SEQ ID NO: 2074394 - RNA, 16 nt, Human
aagucuaaauauuucc

SEQ ID NO: 2074395 - RNA, 15 nt, Human
aaguaguggagcccc

SEQ ID NO: 2074396 - RNA, 19 nt, Human
aaguagggguuguggguga

SEQ ID NO: 2074397 - RNA, 15 nt, Human
aaguaggcaugaggg

SEQ ID NO: 2074398 - RNA, 21 nt, Human
aaguagaagucuuagauguau

SEQ ID NO: 2074399 - RNA, 18 nt, Human
aaggugccugugaggcag

SEQ ID NO: 2074400 - RNA, 11 nt, Human
aaggugccugu

SEQ ID NO: 2074401 - RNA, 20 nt, Human
aaggugccugugaggcaggg

SEQ ID NO: 2074402 - RNA, 19 nt, Human
aaguagaagucuuagaugu

SEQ ID NO: 2074403 - RNA, 20 nt, Human
aaguagaagucuuagaugua

SEQ ID NO: 2074404 - RNA, 20 nt, Human
aaggucguuuuuuucauucc

SEQ ID NO: 2074405 - RNA, 19 nt, Human
aaggucuagguggaggugg

SEQ ID NO: 2074406 - RNA, 18 nt, Human
aaggucguuuuuuucauu

SEQ ID NO: 2074407 - RNA, 12 nt, Human
aaggucucucuu

SEQ ID NO: 2074408 - RNA, 14 nt, Human
aaggucucucuuug

SEQ ID NO: 2074409 - RNA, 16 nt, Human
aaggucucucuuugga

SEQ ID NO: 2074410 - RNA, 14 nt, Human
aagggaaugcauua

SEQ ID NO: 2074411 - RNA, 12 nt, Human
aagggacaugaa

SEQ ID NO: 2074412 - RNA, 23 nt, Human
aagggaaggccccacagacaagg

SEQ ID NO: 2074413 - RNA, 16 nt, Human
aagggaaauaucauuu

SEQ ID NO: 2074414 - RNA, 16 nt, Human
aagggaacaggaaaag

SEQ ID NO: 2074415 - RNA, 15 nt, Human
aagggaaauaucauu

SEQ ID NO: 2074416 - RNA, 14 nt, Human
aagggaaauaucau

SEQ ID NO: 2074417 - RNA, 13 nt, Human
aagggaaauauca

SEQ ID NO: 2074418 - RNA, 18 nt, Human
aagggagcuaucaggaac

SEQ ID NO: 2074419 - RNA, 16 nt, Human
aagggagcagagaagg

SEQ ID NO: 2074420 - RNA, 16 nt, Human
aagggagagagagagg

SEQ ID NO: 2074421 - RNA, 24 nt, Human
aagggagcacuggguugacuuuca

SEQ ID NO: 2074422 - RNA, 17 nt, Human
aagggagagcggggcag

SEQ ID NO: 2074423 - RNA, 14 nt, Human
aagggccaguccug

SEQ ID NO: 2074424 - RNA, 16 nt, Human
aagggccaguccugcc

SEQ ID NO: 2074425 - RNA, 22 nt, Human
aagggccaguccugccuggcca

SEQ ID NO: 2074426 - RNA, 14 nt, Human
aagggaaacaguca

SEQ ID NO: 2074427 - RNA, 18 nt, Human
aagggaaacagucauuug

SEQ ID NO: 2074428 - RNA, 16 nt, Human
aagucugcauuacauu

SEQ ID NO: 2074429 - RNA, 18 nt, Human
aagucuggaucugggacc

SEQ ID NO: 2074430 - RNA, 15 nt, Human
aagucugugccugga

SEQ ID NO: 2074431 - RNA, 18 nt, Human
aagucugugccuggagcu

SEQ ID NO: 2074432 - RNA, 22 nt, Human
aagucugugccuggagcuccug

SEQ ID NO: 2074433 - RNA, 23 nt, Human
aagucugugccuggagcuccugg

SEQ ID NO: 2074434 - RNA, 12 nt, Human
aagucuccagcc

SEQ ID NO: 2074435 - RNA, 13 nt, Human
aagucuccagccc

SEQ ID NO: 2074436 - RNA, 15 nt, Human
aagucuccagcccac

SEQ ID NO: 2074437 - RNA, 21 nt, Human
aaguggaaaaauagccugccu

SEQ ID NO: 2074438 - RNA, 13 nt, Human
aagugcuuucuuc

SEQ ID NO: 2074439 - RNA, 13 nt, Human
aaguggaaauguu

SEQ ID NO: 2074440 - RNA, 16 nt, Human
aaguggaccaggacag

SEQ ID NO: 2074441 - RNA, 12 nt, Human
aaguggaaggaa

SEQ ID NO: 2074442 - RNA, 13 nt, Human
aaguggaaggaaa

SEQ ID NO: 2074443 - RNA, 14 nt, Human
aaguggaaggaaag

SEQ ID NO: 2074444 - RNA, 15 nt, Human
aaguggaaggaaaga

SEQ ID NO: 2074445 - RNA, 17 nt, Human
aaguggaaggaaagaug

SEQ ID NO: 2074446 - RNA, 19 nt, Human
aaguggaccaggacaggac

SEQ ID NO: 2074447 - RNA, 14 nt, Human
aaguguaacagcug

SEQ ID NO: 2074448 - RNA, 15 nt, Human
aaguguaacagcuga

SEQ ID NO: 2074449 - RNA, 16 nt, Human
aaguguaacagcugag

SEQ ID NO: 2074450 - RNA, 17 nt, Human
aaguguaacagcugagg

SEQ ID NO: 2074451 - RNA, 19 nt, Human
aaguggaaaaauagccugc

SEQ ID NO: 2074452 - RNA, 14 nt, Human
aaguguacuaauua

SEQ ID NO: 2074453 - RNA, 17 nt, Human
aaguguacuaauuaaca

SEQ ID NO: 2074454 - RNA, 21 nt, Human
aaguguaacagcugaggucuc

SEQ ID NO: 2074455 - RNA, 21 nt, Human
aaguguaacauaugcaaacau

SEQ ID NO: 2074456 - RNA, 11 nt, Human
aaguguaacug

SEQ ID NO: 2074457 - RNA, 12 nt, Human
aaguguaacugg

SEQ ID NO: 2074458 - RNA, 19 nt, Human
aaguguaagaaacacacug

SEQ ID NO: 2074459 - RNA, 14 nt, Human
aaguugaggcauuu

SEQ ID NO: 2074460 - RNA, 16 nt, Human
aaguugaggcauuugg

SEQ ID NO: 2074461 - RNA, 22 nt, Human
aaguugcagugagcugauauca

SEQ ID NO: 2074462 - RNA, 19 nt, Human
aagcagaugcaaagaggca

SEQ ID NO: 2074463 - RNA, 21 nt, Human
aagcagaugcaaagaggcaag

SEQ ID NO: 2074464 - RNA, 23 nt, Human
aagcagaugcaaagaggcaagag

SEQ ID NO: 2074465 - RNA, 14 nt, Human
aagcagccaagcuc

SEQ ID NO: 2074466 - RNA, 16 nt, Human
aagcagccaagcuccu

SEQ ID NO: 2074467 - RNA, 16 nt, Human
aagcagcacuuauaaa

SEQ ID NO: 2074468 - RNA, 21 nt, Human
aagcagccaagcuccuuggga

SEQ ID NO: 2074469 - RNA, 13 nt, Human
aagcagcucaaag

SEQ ID NO: 2074470 - RNA, 16 nt, Human
aagcagcucaaaggca

SEQ ID NO: 2074471 - RNA, 18 nt, Human
aagcagcucaaaggcaca

SEQ ID NO: 2074472 - RNA, 19 nt, Human
aagcagcucaaaggcacag

SEQ ID NO: 2074473 - RNA, 14 nt, Human
aagccacagcuggu

SEQ ID NO: 2074474 - RNA, 14 nt, Human
aagccacagcccag

SEQ ID NO: 2074475 - RNA, 18 nt, Human
aagccacagcccaggccu

SEQ ID NO: 2074476 - RNA, 24 nt, Human
aagccacagcccaggccuccagcu

SEQ ID NO: 2074477 - RNA, 16 nt, Human
aagagugauucuugcu

SEQ ID NO: 2074478 - RNA, 17 nt, Human
aagagugcaaaacauug

SEQ ID NO: 2074479 - RNA, 18 nt, Human
aagagugcaaaacauuga

SEQ ID NO: 2074480 - RNA, 14 nt, Human
aagagugcauuuuc

SEQ ID NO: 2074481 - RNA, 22 nt, Human
aagagugacaguggauugcauu

SEQ ID NO: 2074482 - RNA, 12 nt, Human
aagauaaaugug

SEQ ID NO: 2074483 - RNA, 13 nt, Human
aagauaaaugugc

SEQ ID NO: 2074484 - RNA, 11 nt, Human
aagauaaagga

SEQ ID NO: 2074485 - RNA, 14 nt, Human
aagauaaaggacag

SEQ ID NO: 2074486 - RNA, 13 nt, Human
aagauacaucaca

SEQ ID NO: 2074487 - RNA, 15 nt, Human
aagauacaucacagu

SEQ ID NO: 2074488 - RNA, 14 nt, Human
aagauacauuugua

SEQ ID NO: 2074489 - RNA, 15 nt, Human
aagauaccaucagca

SEQ ID NO: 2074490 - RNA, 17 nt, Human
aagauaccaucagcaaa

SEQ ID NO: 2074491 - RNA, 18 nt, Human
aagauaccaucagcaaag

SEQ ID NO: 2074492 - RNA, 14 nt, Human
aagauacgacuuua

SEQ ID NO: 2074493 - RNA, 15 nt, Human
aagauacgacuuuau

SEQ ID NO: 2074494 - RNA, 18 nt, Human
aagauacgacuuuauuuu

SEQ ID NO: 2074495 - RNA, 21 nt, Human
aagauacgacuuuauuuucug

SEQ ID NO: 2074496 - RNA, 15 nt, Human
aagauguuauacaac

SEQ ID NO: 2074497 - RNA, 15 nt, Human
aagaugugucuucaa

SEQ ID NO: 2074498 - RNA, 17 nt, Human
aagaugugucuucaauu

SEQ ID NO: 2074499 - RNA, 19 nt, Human
aagaugugucuucaauuug

SEQ ID NO: 2074500 - RNA, 11 nt, Human
aagauguuugc

SEQ ID NO: 2074501 - RNA, 16 nt, Human
aagauguuugucagau

SEQ ID NO: 2074502 - RNA, 15 nt, Human
aagauguugugucuu

SEQ ID NO: 2074503 - RNA, 18 nt, Human
aagauguugugucuugug

SEQ ID NO: 2074504 - RNA, 20 nt, Human
aagauucccagagacaggaa

SEQ ID NO: 2074505 - RNA, 18 nt, Human
aagauuccuuuucuuguu

SEQ ID NO: 2074506 - RNA, 22 nt, Human
aagauuccuuuucuuguuuauc

SEQ ID NO: 2074507 - RNA, 21 nt, Human
aagcuggucccacucagucca

SEQ ID NO: 2074508 - RNA, 18 nt, Human
aagcuggucccacucagu

SEQ ID NO: 2074509 - RNA, 15 nt, Human
aagcugggcagguug

SEQ ID NO: 2074510 - RNA, 19 nt, Human
aagcuaccucaaacuucca

SEQ ID NO: 2074511 - RNA, 13 nt, Human
aagcuguggccag

SEQ ID NO: 2074512 - RNA, 12 nt, Human
aagcuguguccu

SEQ ID NO: 2074513 - RNA, 22 nt, Human
aagcuguguccuugcaccugca

SEQ ID NO: 2074514 - RNA, 17 nt, Human
aagcuggugggugaaag

SEQ ID NO: 2074515 - RNA, 21 nt, Human
aagcuggugggugaaagaaau

SEQ ID NO: 2074516 - RNA, 23 nt, Human
aagcuggugggugaaagaaauca

SEQ ID NO: 2074517 - RNA, 17 nt, Human
aagcugugacccucaau

SEQ ID NO: 2074518 - RNA, 15 nt, Human
aaggacaggcagaaa

SEQ ID NO: 2074519 - RNA, 17 nt, Human
aaggacaggcagaaaga

SEQ ID NO: 2074520 - RNA, 18 nt, Human
aaggacaggcagaaagag

SEQ ID NO: 2074521 - RNA, 20 nt, Human
aaggacaggcagaaagaguu

SEQ ID NO: 2074522 - RNA, 13 nt, Human
aaggacaggcagg

SEQ ID NO: 2074523 - RNA, 13 nt, Human
aaggacacuagaa

SEQ ID NO: 2074524 - RNA, 20 nt, Human
aagcuguguccuugcaccug

SEQ ID NO: 2074525 - RNA, 23 nt, Human
aaggacuguuuuuuccugagcuu

SEQ ID NO: 2074526 - RNA, 15 nt, Human
aaggauugcuacugu

SEQ ID NO: 2074527 - RNA, 16 nt, Human
aaggauucauguggaa

SEQ ID NO: 2074528 - RNA, 14 nt, Human
aaggauugugauau

SEQ ID NO: 2074529 - RNA, 20 nt, Human
aaggcagggagcgagggaga

SEQ ID NO: 2074530 - RNA, 18 nt, Human
aaggcagggaaaggcucu

SEQ ID NO: 2074531 - RNA, 16 nt, Human
aaggcaggaaugugug

SEQ ID NO: 2074532 - RNA, 19 nt, Human
aaggcaggaauguguggca

SEQ ID NO: 2074533 - RNA, 21 nt, Human
aagcgauucuucugcuucagc

SEQ ID NO: 2074534 - RNA, 22 nt, Human
aagcgcuagaggaagcagccaa

SEQ ID NO: 2074535 - RNA, 21 nt, Human
aagcuaauaaaauaucauuca

SEQ ID NO: 2074536 - RNA, 18 nt, Human
aagcuaauaauucuucac

SEQ ID NO: 2074537 - RNA, 21 nt, Human
aagcggagguugcagggagcc

SEQ ID NO: 2074538 - RNA, 15 nt, Human
aagcuaauuauuuua

SEQ ID NO: 2074539 - RNA, 16 nt, Human
aagcuaauuauuuuaa

SEQ ID NO: 2074540 - RNA, 17 nt, Human
aagcuaauuauuuuaau

SEQ ID NO: 2074541 - RNA, 13 nt, Human
aauguuuccuuua

SEQ ID NO: 2074542 - RNA, 16 nt, Human
aauguuugccucugcc

SEQ ID NO: 2074543 - RNA, 15 nt, Human
aauguuugccucugc

SEQ ID NO: 2074544 - RNA, 12 nt, Human
aauguuuccuuu

SEQ ID NO: 2074545 - RNA, 23 nt, Human
aauguuuaugcaaggaaggaaag

SEQ ID NO: 2074546 - RNA, 22 nt, Human
aauguuuaugagccagacaaau

SEQ ID NO: 2074547 - RNA, 15 nt, Human
aauguuuaugagcca

SEQ ID NO: 2074548 - RNA, 16 nt, Human
aauguuuaugagccag

SEQ ID NO: 2074549 - RNA, 17 nt, Human
aauguuuaugagccaga

SEQ ID NO: 2074550 - RNA, 18 nt, Human
aauguuuaugagccagac

SEQ ID NO: 2074551 - RNA, 21 nt, Human
aauguuuaugcaaggaaggaa

SEQ ID NO: 2074552 - RNA, 22 nt, Human
aauguuuaugcaaggaaggaaa

SEQ ID NO: 2074553 - RNA, 18 nt, Human
aauguccaugauggaaua

SEQ ID NO: 2074554 - RNA, 17 nt, Human
aauguccuccagaagcc

SEQ ID NO: 2074555 - RNA, 18 nt, Human
aauguccuccagaagccu

SEQ ID NO: 2074556 - RNA, 21 nt, Human
aauguccuccagaagccucug

SEQ ID NO: 2074557 - RNA, 23 nt, Human
aauguccuccagaagccucuggc

SEQ ID NO: 2074558 - RNA, 18 nt, Human
aaugucuuuguuggaaaa

SEQ ID NO: 2074559 - RNA, 22 nt, Human
aaugucuuuguuggaaaagaau

SEQ ID NO: 2074560 - RNA, 16 nt, Human
aaugucuuguuaauau

SEQ ID NO: 2074561 - RNA, 17 nt, Human
aaugucuuguuaauauu

SEQ ID NO: 2074562 - RNA, 18 nt, Human
aaugucuuguuaauauuc

SEQ ID NO: 2074563 - RNA, 20 nt, Human
aaugucuuguuaauauucuu

SEQ ID NO: 2074564 - RNA, 21 nt, Human
aaugucuuguuaauauucuuu

SEQ ID NO: 2074565 - RNA, 17 nt, Human
aaugucuuugguccucu

SEQ ID NO: 2074566 - RNA, 14 nt, Human
aauguuuaaugcug

SEQ ID NO: 2074567 - RNA, 17 nt, Human
aaugugaaaagaaaaau

SEQ ID NO: 2074568 - RNA, 15 nt, Human
aaugugaaaagaaaa

SEQ ID NO: 2074569 - RNA, 12 nt, Human
aaugcuggagcg

SEQ ID NO: 2074570 - RNA, 17 nt, Human
aaugguguuuuuuuaau

SEQ ID NO: 2074571 - RNA, 19 nt, Human
aaugcugcgcccuucccca

SEQ ID NO: 2074572 - RNA, 23 nt, Human
aaugcuauaacuauguugauaaa

SEQ ID NO: 2074573 - RNA, 21 nt, Human
aauguccaccaauagaaugag

SEQ ID NO: 2074574 - RNA, 19 nt, Human
aaugucauuaaaauaaaua

SEQ ID NO: 2074575 - RNA, 16 nt, Human
aaugucagauuccuuu

SEQ ID NO: 2074576 - RNA, 20 nt, Human
aaugucagauuccuuucccu

SEQ ID NO: 2074577 - RNA, 18 nt, Human
aaugucaggaacagaagg

SEQ ID NO: 2074578 - RNA, 20 nt, Human
aaugucaggaacagaaggau

SEQ ID NO: 2074579 - RNA, 17 nt, Human
aaugucacuuaaaggcu

SEQ ID NO: 2074580 - RNA, 13 nt, Human
aaugucagaaaaa

SEQ ID NO: 2074581 - RNA, 17 nt, Human
aaugucagaaaaacaau

SEQ ID NO: 2074582 - RNA, 18 nt, Human
aaugucagaaaaacaaua

SEQ ID NO: 2074583 - RNA, 21 nt, Human
aaugucagaaaaacaauaaga

SEQ ID NO: 2074584 - RNA, 22 nt, Human
aaugucagaaaaacaauaagag

SEQ ID NO: 2074585 - RNA, 19 nt, Human
aaugucagaaaccaguuau

SEQ ID NO: 2074586 - RNA, 17 nt, Human
aaugguugacuggguuu

SEQ ID NO: 2074587 - RNA, 19 nt, Human
aaugcgaaugguagucuaa

SEQ ID NO: 2074588 - RNA, 20 nt, Human
aaugcgaaugguagucuaac

SEQ ID NO: 2074589 - RNA, 15 nt, Human
aaugccuuacuuugu

SEQ ID NO: 2074590 - RNA, 16 nt, Human
aaugccuuacuuugua

SEQ ID NO: 2074591 - RNA, 17 nt, Human
aaugccuuacuuuguau

SEQ ID NO: 2074592 - RNA, 18 nt, Human
aaugccuuacuuuguaug

SEQ ID NO: 2074593 - RNA, 19 nt, Human
aaugccuuacuuuguauga

SEQ ID NO: 2074594 - RNA, 21 nt, Human
aaugccuuacuuuguaugaua

SEQ ID NO: 2074595 - RNA, 20 nt, Human
aaugcggccgcauucccuga

SEQ ID NO: 2074596 - RNA, 16 nt, Human
aaugauccccagcugu

SEQ ID NO: 2074597 - RNA, 14 nt, Human
aaugaaguuuauac

SEQ ID NO: 2074598 - RNA, 15 nt, Human
aaugaaguuuauaca

SEQ ID NO: 2074599 - RNA, 17 nt, Human
aaugaaguuuauacagu

SEQ ID NO: 2074600 - RNA, 21 nt, Human
aaugaaguaacuugucuuaaa

SEQ ID NO: 2074601 - RNA, 17 nt, Human
aaugaaguuguagguaa

SEQ ID NO: 2074602 - RNA, 22 nt, Human
aaugaaggugucagaauaauaa

SEQ ID NO: 2074603 - RNA, 19 nt, Human
aaugaaaugcucuccuuuc

SEQ ID NO: 2074604 - RNA, 22 nt, Human
aaugaaggaaauaaaaaagucu

SEQ ID NO: 2074605 - RNA, 23 nt, Human
aaugaaggaaauaaaaaagucuc

SEQ ID NO: 2074606 - RNA, 17 nt, Human
aaugaaaugcucuccuu

SEQ ID NO: 2074607 - RNA, 18 nt, Human
aaugaaaugcucuccuuu

SEQ ID NO: 2074608 - RNA, 20 nt, Human
aaugaaagucuugugacuag

SEQ ID NO: 2074609 - RNA, 21 nt, Human
aaugaaagucuugugacuagu

SEQ ID NO: 2074610 - RNA, 23 nt, Human
aaugaaagucuugugacuagugc

SEQ ID NO: 2074611 - RNA, 15 nt, Human
aaugaaaguuugcac

SEQ ID NO: 2074612 - RNA, 21 nt, Human
aaugaaauaauguacaucugg

SEQ ID NO: 2074613 - RNA, 22 nt, Human
aaugauccccagcuguuuaugc

SEQ ID NO: 2074614 - RNA, 19 nt, Human
aaugauccccagcuguuua

SEQ ID NO: 2074615 - RNA, 20 nt, Human
aaugauccccagcuguuuau

SEQ ID NO: 2074616 - RNA, 22 nt, Human
aaugaucucucugaauccuaag

SEQ ID NO: 2074617 - RNA, 16 nt, Human
aaucucuccauucccg

SEQ ID NO: 2074618 - RNA, 21 nt, Human
aaucucuucuaaaaaaaaaca

SEQ ID NO: 2074619 - RNA, 19 nt, Human
aaugaaagucuugugacua

SEQ ID NO: 2074620 - RNA, 19 nt, Human
aaugaaaguauaacugagu

SEQ ID NO: 2074621 - RNA, 17 nt, Human
aaugaaaguauaacuga

SEQ ID NO: 2074622 - RNA, 14 nt, Human
aaucucucucuguu

SEQ ID NO: 2074623 - RNA, 18 nt, Human
aaucucucucuguugugu

SEQ ID NO: 2074624 - RNA, 17 nt, Human
aauccagacccggcugc

SEQ ID NO: 2074625 - RNA, 19 nt, Human
aauccagacccggcugcgu

SEQ ID NO: 2074626 - RNA, 16 nt, Human
aauccagcgguucuca

SEQ ID NO: 2074627 - RNA, 18 nt, Human
aauccagcgguucucaaa

SEQ ID NO: 2074628 - RNA, 23 nt, Human
aauccaagcgaggucaacagaga

SEQ ID NO: 2074629 - RNA, 17 nt, Human
aauauuaaacccuggau

SEQ ID NO: 2074630 - RNA, 19 nt, Human
aauauuagcuuuacuguuu

SEQ ID NO: 2074631 - RNA, 21 nt, Human
aauauuagcuuuacuguuugu

SEQ ID NO: 2074632 - RNA, 15 nt, Human
aauauuagcuuuacu

SEQ ID NO: 2074633 - RNA, 18 nt, Human
aauauuagcuuuacuguu

SEQ ID NO: 2074634 - RNA, 11 nt, Human
aauauuaucuu

SEQ ID NO: 2074635 - RNA, 15 nt, Human
aauauuaucuuugua

SEQ ID NO: 2074636 - RNA, 22 nt, Human
aauauuauacuaagaaaagaua

SEQ ID NO: 2074637 - RNA, 15 nt, Human
aauauuauacuaaga

SEQ ID NO: 2074638 - RNA, 16 nt, Human
aauauuauacuaagaa

SEQ ID NO: 2074639 - RNA, 11 nt, Human
aaucaagauaa

SEQ ID NO: 2074640 - RNA, 12 nt, Human
aaucaagauaaa

SEQ ID NO: 2074641 - RNA, 15 nt, Human
aaucaagauaaagga

SEQ ID NO: 2074642 - RNA, 17 nt, Human
aaucaagauaaaggaca

SEQ ID NO: 2074643 - RNA, 19 nt, Human
aaucacauucgaguguuuc

SEQ ID NO: 2074644 - RNA, 18 nt, Human
aauauacauucaaacuua

SEQ ID NO: 2074645 - RNA, 19 nt, Human
aauauacauucaaacuuaa

SEQ ID NO: 2074646 - RNA, 20 nt, Human
aauagaauauaauuaucgga

SEQ ID NO: 2074647 - RNA, 17 nt, Human
aauagaauauaauuauc

SEQ ID NO: 2074648 - RNA, 22 nt, Human
aauagaaggauguacauuucca

SEQ ID NO: 2074649 - RNA, 13 nt, Human
aauagaaggaaac

SEQ ID NO: 2074650 - RNA, 14 nt, Human
aauagaaggaaacu

SEQ ID NO: 2074651 - RNA, 19 nt, Human
aauagaaggaaacuagcuu

SEQ ID NO: 2074652 - RNA, 19 nt, Human
aauagaaggauguacauuu

SEQ ID NO: 2074653 - RNA, 20 nt, Human
aauagaaggauguacauuuc

SEQ ID NO: 2074654 - RNA, 19 nt, Human
aauauaccccuuaguguuu

SEQ ID NO: 2074655 - RNA, 18 nt, Human
aauauauauguugauuuc

SEQ ID NO: 2074656 - RNA, 22 nt, Human
aauauauauguugauuucuugu

SEQ ID NO: 2074657 - RNA, 13 nt, Human
aauauauauucug

SEQ ID NO: 2074658 - RNA, 14 nt, Human
aauauauauucugg

SEQ ID NO: 2074659 - RNA, 14 nt, Human
aaguugcgacggag

SEQ ID NO: 2074660 - RNA, 20 nt, Human
aaguugcgacggagagaaaa

SEQ ID NO: 2074661 - RNA, 22 nt, Human
aaguugcgacggagagaaaaaa

SEQ ID NO: 2074662 - RNA, 23 nt, Human
aaguugcgacggagagaaaaaag

SEQ ID NO: 2074663 - RNA, 20 nt, Human
aauacucuacccucuuagaa

SEQ ID NO: 2074664 - RNA, 22 nt, Human
aauacucuacccucuuagaaaa

SEQ ID NO: 2074665 - RNA, 13 nt, Human
aauacucuaauuc

SEQ ID NO: 2074666 - RNA, 15 nt, Human
aauacucuaauucua

SEQ ID NO: 2074667 - RNA, 16 nt, Human
aauacucuaauucuaa

SEQ ID NO: 2074668 - RNA, 17 nt, Human
aauacucuaauucuaac

SEQ ID NO: 2074669 - RNA, 23 nt, Human
aauacucuuaggaagagaaacca

SEQ ID NO: 2074670 - RNA, 13 nt, Human
aauacuagccaga

SEQ ID NO: 2074671 - RNA, 14 nt, Human
aauacuagccagag

SEQ ID NO: 2074672 - RNA, 17 nt, Human
aauagaaaacaggaaaa

SEQ ID NO: 2074673 - RNA, 17 nt, Human
agacgugauuuugcugu

SEQ ID NO: 2074674 - RNA, 18 nt, Human
agacguaugcuuauuuua

SEQ ID NO: 2074675 - RNA, 19 nt, Human
agacguaugcuuauuuuaa

SEQ ID NO: 2074676 - RNA, 14 nt, Human
agacgucccuccac

SEQ ID NO: 2074677 - RNA, 22 nt, Human
agacgugcacgcacacugucug

SEQ ID NO: 2074678 - RNA, 21 nt, Human
agacgugcacgcacacugucu

SEQ ID NO: 2074679 - RNA, 18 nt, Human
agacggagucccaccuug

SEQ ID NO: 2074680 - RNA, 19 nt, Human
agacgguucaccagccucu

SEQ ID NO: 2074681 - RNA, 16 nt, Human
agacguaugcuuauuu

SEQ ID NO: 2074682 - RNA, 13 nt, Human
agacccccacucu

SEQ ID NO: 2074683 - RNA, 20 nt, Human
agacccccagcaacccuccu

SEQ ID NO: 2074684 - RNA, 13 nt, Human
agacccccacccc

SEQ ID NO: 2074685 - RNA, 14 nt, Human
agacccccaccccu

SEQ ID NO: 2074686 - RNA, 16 nt, Human
agacccccaccccuuc

SEQ ID NO: 2074687 - RNA, 17 nt, Human
agacccccaccccuucc

SEQ ID NO: 2074688 - RNA, 19 nt, Human
agacccccaccccuucccc

SEQ ID NO: 2074689 - RNA, 20 nt, Human
agacccccaccccuucccca

SEQ ID NO: 2074690 - RNA, 21 nt, Human
agacccccaccccuuccccac

SEQ ID NO: 2074691 - RNA, 12 nt, Human
agacccccacuc

SEQ ID NO: 2074692 - RNA, 13 nt, Human
agacccccacacc

SEQ ID NO: 2074693 - RNA, 14 nt, Human
agacccccacaccu

SEQ ID NO: 2074694 - RNA, 15 nt, Human
agacccccacaccuc

SEQ ID NO: 2074695 - RNA, 11 nt, Human
agacccccacc

SEQ ID NO: 2074696 - RNA, 12 nt, Human
agacccccaccc

SEQ ID NO: 2074697 - RNA, 16 nt, Human
agacccauuccuauuu

SEQ ID NO: 2074698 - RNA, 20 nt, Human
agacagcucccucugccuga

SEQ ID NO: 2074699 - RNA, 15 nt, Human
agacccauuccuauu

SEQ ID NO: 2074700 - RNA, 15 nt, Human
agacagcucccucug

SEQ ID NO: 2074701 - RNA, 18 nt, Human
agacagcucccucugccu

SEQ ID NO: 2074702 - RNA, 19 nt, Human
agacagcucccucugccug

SEQ ID NO: 2074703 - RNA, 14 nt, Human
agacaacccugcaa

SEQ ID NO: 2074704 - RNA, 20 nt, Human
agacaacccugcaaaggacu

SEQ ID NO: 2074705 - RNA, 21 nt, Human
agacaacccugcaaaggacug

SEQ ID NO: 2074706 - RNA, 15 nt, Human
agacaacagaaguca

SEQ ID NO: 2074707 - RNA, 13 nt, Human
agacaacagaagu

SEQ ID NO: 2074708 - RNA, 14 nt, Human
agacaacagaaguc

SEQ ID NO: 2074709 - RNA, 23 nt, Human
agacagagucucacuguugccca

SEQ ID NO: 2074710 - RNA, 15 nt, Human
agacaagaagcaaau

SEQ ID NO: 2074711 - RNA, 17 nt, Human
agacaaauucuguuucu

SEQ ID NO: 2074712 - RNA, 18 nt, Human
agacaaauucuguuucuu

SEQ ID NO: 2074713 - RNA, 19 nt, Human
agacaaauucuguuucuug

SEQ ID NO: 2074714 - RNA, 21 nt, Human
agacaaauucuguuucuugag

SEQ ID NO: 2074715 - RNA, 23 nt, Human
agacugcgggaugguccuggggc

SEQ ID NO: 2074716 - RNA, 20 nt, Human
agacugcgggaugguccugg

SEQ ID NO: 2074717 - RNA, 22 nt, Human
agacugcgggaugguccugggg

SEQ ID NO: 2074718 - RNA, 16 nt, Human
agacuggaagcacagc

SEQ ID NO: 2074719 - RNA, 17 nt, Human
agacuggaagcacagcu

SEQ ID NO: 2074720 - RNA, 19 nt, Human
agacuggaagcacagcuuc

SEQ ID NO: 2074721 - RNA, 14 nt, Human
agacugcugggacu

SEQ ID NO: 2074722 - RNA, 15 nt, Human
agacugcugggacug

SEQ ID NO: 2074723 - RNA, 19 nt, Human
agagagcugagugagcuga

SEQ ID NO: 2074724 - RNA, 23 nt, Human
agagagccuugguucaucagugu

SEQ ID NO: 2074725 - RNA, 18 nt, Human
agagagcgagcgcuaccc

SEQ ID NO: 2074726 - RNA, 13 nt, Human
agagaacuagugg

SEQ ID NO: 2074727 - RNA, 21 nt, Human
agagaggguggugaccucugc

SEQ ID NO: 2074728 - RNA, 20 nt, Human
agagaggguggugaccucug

SEQ ID NO: 2074729 - RNA, 22 nt, Human
agagaggguggugaccucugcc

SEQ ID NO: 2074730 - RNA, 17 nt, Human
agagagcuguucccaaa

SEQ ID NO: 2074731 - RNA, 23 nt, Human
agagagcugguaguuaguagcau

SEQ ID NO: 2074732 - RNA, 11 nt, Human
agagagcuggu

SEQ ID NO: 2074733 - RNA, 12 nt, Human
agagagcuggua

SEQ ID NO: 2074734 - RNA, 19 nt, Human
agagcccaccuuggcucaa

SEQ ID NO: 2074735 - RNA, 16 nt, Human
agaguucacuauaaau

SEQ ID NO: 2074736 - RNA, 13 nt, Human
agaguucaguaag

SEQ ID NO: 2074737 - RNA, 22 nt, Human
agaguucaguaagaccggaagc

SEQ ID NO: 2074738 - RNA, 16 nt, Human
agaguuagguuuaaca

SEQ ID NO: 2074739 - RNA, 18 nt, Human
agaguuagguuuaacaua

SEQ ID NO: 2074740 - RNA, 20 nt, Human
agaguuagguuuaacauaaa

SEQ ID NO: 2074741 - RNA, 21 nt, Human
agaguuagguuuaacauaaag

SEQ ID NO: 2074742 - RNA, 23 nt, Human
agaguuagguuuaacauaaaggu

SEQ ID NO: 2074743 - RNA, 19 nt, Human
agaguuaguuucuuuggga

SEQ ID NO: 2074744 - RNA, 16 nt, Human
agauauauuuuucaca

SEQ ID NO: 2074745 - RNA, 14 nt, Human
agauauauuuuuca

SEQ ID NO: 2074746 - RNA, 15 nt, Human
agauauauuuuucac

SEQ ID NO: 2074747 - RNA, 19 nt, Human
agauauaugcucugcaugu

SEQ ID NO: 2074748 - RNA, 12 nt, Human
agaucuuucagg

SEQ ID NO: 2074749 - RNA, 13 nt, Human
agaucuuucagga

SEQ ID NO: 2074750 - RNA, 21 nt, Human
agaucuuucaggaaagacgga

SEQ ID NO: 2074751 - RNA, 16 nt, Human
agaugggaugcuugcc

SEQ ID NO: 2074752 - RNA, 16 nt, Human
agaugggcuuguuuuc

SEQ ID NO: 2074753 - RNA, 17 nt, Human
agaugggcuuguuuucu

SEQ ID NO: 2074754 - RNA, 14 nt, Human
agauggcugugccu

SEQ ID NO: 2074755 - RNA, 22 nt, Human
agauggcugacuuugcucuuuc

SEQ ID NO: 2074756 - RNA, 14 nt, Human
agauggccuuugcu

SEQ ID NO: 2074757 - RNA, 15 nt, Human
agauggccuuugcuu

SEQ ID NO: 2074758 - RNA, 23 nt, Human
agauggccuuugcuuaugaauau

SEQ ID NO: 2074759 - RNA, 15 nt, Human
agauggcccucuggu

SEQ ID NO: 2074760 - RNA, 19 nt, Human
agagugugggaagggagag

SEQ ID NO: 2074761 - RNA, 20 nt, Human
agagugugggaagggagagc

SEQ ID NO: 2074762 - RNA, 17 nt, Human
agaguguggccuucgga

SEQ ID NO: 2074763 - RNA, 14 nt, Human
agagugugccugaa

SEQ ID NO: 2074764 - RNA, 22 nt, Human
agagugucuucacggcaggaca

SEQ ID NO: 2074765 - RNA, 19 nt, Human
agagugugaaauagacauu

SEQ ID NO: 2074766 - RNA, 19 nt, Human
agaguggcuccucccggug

SEQ ID NO: 2074767 - RNA, 11 nt, Human
agagugggagc

SEQ ID NO: 2074768 - RNA, 23 nt, Human
agaguggcuccucccggugccca

SEQ ID NO: 2074769 - RNA, 20 nt, Human
agagugucuucacggcagga

SEQ ID NO: 2074770 - RNA, 19 nt, Human
agaguggggauaugauuua

SEQ ID NO: 2074771 - RNA, 19 nt, Human
agaggguggugaccucugc

SEQ ID NO: 2074772 - RNA, 21 nt, Human
agagggcccaggcaggccacc

SEQ ID NO: 2074773 - RNA, 22 nt, Human
agaggguggugaccucugccug

SEQ ID NO: 2074774 - RNA, 20 nt, Human
agaggguggugaccucugcc

SEQ ID NO: 2074775 - RNA, 23 nt, Human
agagggcaugcgcacaaggcuga

SEQ ID NO: 2074776 - RNA, 14 nt, Human
agagggcccaggca

SEQ ID NO: 2074777 - RNA, 16 nt, Human
agagggcccaggcagg

SEQ ID NO: 2074778 - RNA, 17 nt, Human
agagggcccaggcaggc

SEQ ID NO: 2074779 - RNA, 14 nt, Human
agagggcagaggcu

SEQ ID NO: 2074780 - RNA, 15 nt, Human
agaggagaaacacau

SEQ ID NO: 2074781 - RNA, 14 nt, Human
agaggagaaacaca

SEQ ID NO: 2074782 - RNA, 21 nt, Human
agaggacaccuguacuggaga

SEQ ID NO: 2074783 - RNA, 23 nt, Human
agaggacaccuguacuggagagc

SEQ ID NO: 2074784 - RNA, 13 nt, Human
agaggaagagcag

SEQ ID NO: 2074785 - RNA, 17 nt, Human
agaggaagagugcaaaa

SEQ ID NO: 2074786 - RNA, 14 nt, Human
agaggacgugggcg

SEQ ID NO: 2074787 - RNA, 16 nt, Human
agaggacgugggcggc

SEQ ID NO: 2074788 - RNA, 13 nt, Human
agaggaacugggc

SEQ ID NO: 2074789 - RNA, 16 nt, Human
agaggaaggagaggag

SEQ ID NO: 2074790 - RNA, 14 nt, Human
agaggaaccaaccc

SEQ ID NO: 2074791 - RNA, 14 nt, Human
agagccccacacgg

SEQ ID NO: 2074792 - RNA, 14 nt, Human
agccgcuccugucu

SEQ ID NO: 2074793 - RNA, 20 nt, Human
agccgccauugccaccagga

SEQ ID NO: 2074794 - RNA, 21 nt, Human
agccgccauugccaccaggag

SEQ ID NO: 2074795 - RNA, 22 nt, Human
agccgccauugccaccaggaga

SEQ ID NO: 2074796 - RNA, 22 nt, Human
agccgcuccugucugccagcca

SEQ ID NO: 2074797 - RNA, 16 nt, Human
agccgcuccugucugc

SEQ ID NO: 2074798 - RNA, 17 nt, Human
agccgcuccugucugcc

SEQ ID NO: 2074799 - RNA, 19 nt, Human
agccgcuccugucugccag

SEQ ID NO: 2074800 - RNA, 21 nt, Human
agccgcuccugucugccagcc

SEQ ID NO: 2074801 - RNA, 12 nt, Human
agccgcugcugg

SEQ ID NO: 2074802 - RNA, 23 nt, Human
agccgggaacagacaacagaagu

SEQ ID NO: 2074803 - RNA, 21 nt, Human
agccgccaugcuccuggccca

SEQ ID NO: 2074804 - RNA, 13 nt, Human
agccgccacaucc

SEQ ID NO: 2074805 - RNA, 14 nt, Human
agccgccaggaccg

SEQ ID NO: 2074806 - RNA, 21 nt, Human
agccgccaggaccgccaaaga

SEQ ID NO: 2074807 - RNA, 17 nt, Human
agccgccauugccacca

SEQ ID NO: 2074808 - RNA, 18 nt, Human
agccgccauugccaccag

SEQ ID NO: 2074809 - RNA, 19 nt, Human
agccgccauugccaccagg

SEQ ID NO: 2074810 - RNA, 17 nt, Human
agcccuccuuccacgga

SEQ ID NO: 2074811 - RNA, 12 nt, Human
agcccuccuucc

SEQ ID NO: 2074812 - RNA, 13 nt, Human
agcccuccuucca

SEQ ID NO: 2074813 - RNA, 14 nt, Human
agcccuccucaccc

SEQ ID NO: 2074814 - RNA, 11 nt, Human
agcccuccuuc

SEQ ID NO: 2074815 - RNA, 16 nt, Human
agcccucucacugugu

SEQ ID NO: 2074816 - RNA, 17 nt, Human
agcccucucacuguguc

SEQ ID NO: 2074817 - RNA, 18 nt, Human
agcccucucacugugucc

SEQ ID NO: 2074818 - RNA, 19 nt, Human
agcccucucacuguguccc

SEQ ID NO: 2074819 - RNA, 23 nt, Human
agcccucucuggcuaaggacagg

SEQ ID NO: 2074820 - RNA, 21 nt, Human
agccgcaucuucuccaucugg

SEQ ID NO: 2074821 - RNA, 24 nt, Human
agcccuccgccauucucaagcccu

SEQ ID NO: 2074822 - RNA, 12 nt, Human
agcccuccucac

SEQ ID NO: 2074823 - RNA, 13 nt, Human
agcccuccucacc

SEQ ID NO: 2074824 - RNA, 23 nt, Human
agcccuccgccauucucaagccc

SEQ ID NO: 2074825 - RNA, 21 nt, Human
agcccucccuguccuccucgg

SEQ ID NO: 2074826 - RNA, 22 nt, Human
agcccucccuguccuccucgga

SEQ ID NO: 2074827 - RNA, 15 nt, Human
agcccucccuguccu

SEQ ID NO: 2074828 - RNA, 16 nt, Human
agcccucccuguccuc

SEQ ID NO: 2074829 - RNA, 17 nt, Human
agcccucccuguccucc

SEQ ID NO: 2074830 - RNA, 19 nt, Human
agcccucccuguccuccuc

SEQ ID NO: 2074831 - RNA, 20 nt, Human
agcccucccuguccuccucg

SEQ ID NO: 2074832 - RNA, 20 nt, Human
agccgucagccaaauguaau

SEQ ID NO: 2074833 - RNA, 22 nt, Human
agccgggcgugguggcgggcac

SEQ ID NO: 2074834 - RNA, 16 nt, Human
agccgugccuucagcu

SEQ ID NO: 2074835 - RNA, 15 nt, Human
agccgugccuucagc

SEQ ID NO: 2074836 - RNA, 17 nt, Human
agccgugccuucagcuc

SEQ ID NO: 2074837 - RNA, 21 nt, Human
agccucccaaagugcugggau

SEQ ID NO: 2074838 - RNA, 22 nt, Human
agccucccacgacugcccggca

SEQ ID NO: 2074839 - RNA, 16 nt, Human
agccgugcccugcccc

SEQ ID NO: 2074840 - RNA, 19 nt, Human
agccucccgaguagcuggg

SEQ ID NO: 2074841 - RNA, 18 nt, Human
agccucccgaguagcugg

SEQ ID NO: 2074842 - RNA, 20 nt, Human
agccucccgaguagcuggga

SEQ ID NO: 2074843 - RNA, 13 nt, Human
agccucccacccc

SEQ ID NO: 2074844 - RNA, 23 nt, Human
agccuccggaguagcugggacca

SEQ ID NO: 2074845 - RNA, 17 nt, Human
agccuccguauuucaga

SEQ ID NO: 2074846 - RNA, 18 nt, Human
agccuccguauuucagac

SEQ ID NO: 2074847 - RNA, 14 nt, Human
agccuccuccagcc

SEQ ID NO: 2074848 - RNA, 16 nt, Human
agccccauucugccug

SEQ ID NO: 2074849 - RNA, 13 nt, Human
agccccauucugc

SEQ ID NO: 2074850 - RNA, 17 nt, Human
agcccguguggccccuu

SEQ ID NO: 2074851 - RNA, 18 nt, Human
agcccguguggccccuuc

SEQ ID NO: 2074852 - RNA, 19 nt, Human
agcccguguggccccuuca

SEQ ID NO: 2074853 - RNA, 15 nt, Human
agcccguguggcccc

SEQ ID NO: 2074854 - RNA, 16 nt, Human
agcccguguggccccu

SEQ ID NO: 2074855 - RNA, 20 nt, Human
agccccagugccaagcacag

SEQ ID NO: 2074856 - RNA, 23 nt, Human
agccccagugccaagcacagugc

SEQ ID NO: 2074857 - RNA, 15 nt, Human
agccccagugcccac

SEQ ID NO: 2074858 - RNA, 14 nt, Human
agccccagugccca

SEQ ID NO: 2074859 - RNA, 13 nt, Human
agccccagugccc

SEQ ID NO: 2074860 - RNA, 13 nt, Human
agccccagugcca

SEQ ID NO: 2074861 - RNA, 23 nt, Human
agcauccuggcacccggccccug

SEQ ID NO: 2074862 - RNA, 22 nt, Human
agcauccuggcacccggccccu

SEQ ID NO: 2074863 - RNA, 18 nt, Human
agcauccuggcacccggc

SEQ ID NO: 2074864 - RNA, 20 nt, Human
agcauccuuaaguaucagaa

SEQ ID NO: 2074865 - RNA, 19 nt, Human
agcauccuuuucugcagag

SEQ ID NO: 2074866 - RNA, 21 nt, Human
agcauccuuuucugcagaggg

SEQ ID NO: 2074867 - RNA, 20 nt, Human
agcaugaauuuuuuucaucu

SEQ ID NO: 2074868 - RNA, 22 nt, Human
agcaugaaugguauggaacucu

SEQ ID NO: 2074869 - RNA, 22 nt, Human
agcaugacaagccccaggcagg

SEQ ID NO: 2074870 - RNA, 20 nt, Human
agcaugacaagccccaggca

SEQ ID NO: 2074871 - RNA, 21 nt, Human
agcaugacaagccccaggcag

SEQ ID NO: 2074872 - RNA, 17 nt, Human
agcaugacaagccccag

SEQ ID NO: 2074873 - RNA, 18 nt, Human
agcaugacaagccccagg

SEQ ID NO: 2074874 - RNA, 19 nt, Human
agcaugacaagccccaggc

SEQ ID NO: 2074875 - RNA, 18 nt, Human
agcaugaccugugaccag

SEQ ID NO: 2074876 - RNA, 23 nt, Human
agccaagugugguagagugugcc

SEQ ID NO: 2074877 - RNA, 21 nt, Human
agccaagucagcuuugccuuc

SEQ ID NO: 2074878 - RNA, 19 nt, Human
agccaaccuuacuuacagc

SEQ ID NO: 2074879 - RNA, 23 nt, Human
agccaaccuuacuuacagcauaa

SEQ ID NO: 2074880 - RNA, 23 nt, Human
agccaagucagcuuugccuucca

SEQ ID NO: 2074881 - RNA, 14 nt, Human
agccaaccccugug

SEQ ID NO: 2074882 - RNA, 16 nt, Human
agccaaccccugugga

SEQ ID NO: 2074883 - RNA, 19 nt, Human
agcaugagagaauuguauc

SEQ ID NO: 2074884 - RNA, 22 nt, Human
agcaugaccugugaccagcacu

SEQ ID NO: 2074885 - RNA, 23 nt, Human
agcaugaccugugaccagcacug

SEQ ID NO: 2074886 - RNA, 21 nt, Human
agcaugcugugauugugccua

SEQ ID NO: 2074887 - RNA, 13 nt, Human
agcaugcuuucug

SEQ ID NO: 2074888 - RNA, 21 nt, Human
agccaacagucaaaacagaga

SEQ ID NO: 2074889 - RNA, 18 nt, Human
agccaacagaagcuucca

SEQ ID NO: 2074890 - RNA, 20 nt, Human
agccaaauguaauugaauaa

SEQ ID NO: 2074891 - RNA, 23 nt, Human
agccaaauguggcauuugugauc

SEQ ID NO: 2074892 - RNA, 16 nt, Human
agcauggagaacagug

SEQ ID NO: 2074893 - RNA, 17 nt, Human
agccaaaucaaaauaug

SEQ ID NO: 2074894 - RNA, 13 nt, Human
agcaguucugcaa

SEQ ID NO: 2074895 - RNA, 16 nt, Human
agcaguucugcaaaua

SEQ ID NO: 2074896 - RNA, 23 nt, Human
agcaguucugcaaauagaaaaca

SEQ ID NO: 2074897 - RNA, 20 nt, Human
agcaguucaccuauuucaaa

SEQ ID NO: 2074898 - RNA, 22 nt, Human
agcaguucaccuauuucaaaaa

SEQ ID NO: 2074899 - RNA, 21 nt, Human
agcaguuacaaaaaccuuccc

SEQ ID NO: 2074900 - RNA, 20 nt, Human
agcagugucuuccauaaugu

SEQ ID NO: 2074901 - RNA, 15 nt, Human
agcagugugucuccu

SEQ ID NO: 2074902 - RNA, 16 nt, Human
agcagugugucuccug

SEQ ID NO: 2074903 - RNA, 17 nt, Human
agcagugugucuccugc

SEQ ID NO: 2074904 - RNA, 21 nt, Human
agcagugugucuccugcaugc

SEQ ID NO: 2074905 - RNA, 22 nt, Human
agcagugugucuccugcaugca

SEQ ID NO: 2074906 - RNA, 19 nt, Human
agcagugccuuccauaauu

SEQ ID NO: 2074907 - RNA, 12 nt, Human
agcacuguauac

SEQ ID NO: 2074908 - RNA, 15 nt, Human
agcagugucuuccau

SEQ ID NO: 2074909 - RNA, 16 nt, Human
agcagugucuuccaua

SEQ ID NO: 2074910 - RNA, 17 nt, Human
agcagugucuuccauaa

SEQ ID NO: 2074911 - RNA, 22 nt, Human
agcagugucuuccauaauguau

SEQ ID NO: 2074912 - RNA, 16 nt, Human
agcagugccuuccaua

SEQ ID NO: 2074913 - RNA, 17 nt, Human
agcagugccuuccauaa

SEQ ID NO: 2074914 - RNA, 20 nt, Human
agcagugccuuccauaauua

SEQ ID NO: 2074915 - RNA, 22 nt, Human
agcagcgguuuggggagcagag

SEQ ID NO: 2074916 - RNA, 23 nt, Human
agcagcgguuuggggagcagaga

SEQ ID NO: 2074917 - RNA, 15 nt, Human
agcagcggacuucaa

SEQ ID NO: 2074918 - RNA, 17 nt, Human
agcagcgguuuggggag

SEQ ID NO: 2074919 - RNA, 14 nt, Human
agcacugucucagu

SEQ ID NO: 2074920 - RNA, 20 nt, Human
agcacugucucaguuucacu

SEQ ID NO: 2074921 - RNA, 17 nt, Human
agcacuggguugacuuu

SEQ ID NO: 2074922 - RNA, 16 nt, Human
agcacagaaggaggag

SEQ ID NO: 2074923 - RNA, 14 nt, Human
agcacucgugugca

SEQ ID NO: 2074924 - RNA, 19 nt, Human
agcacucugaguuuaccau

SEQ ID NO: 2074925 - RNA, 23 nt, Human
agcacucugaguuuaccauuugu

SEQ ID NO: 2074926 - RNA, 14 nt, Human
agcacacuguagca

SEQ ID NO: 2074927 - RNA, 19 nt, Human
agcacacuguagcauuaca

SEQ ID NO: 2074928 - RNA, 15 nt, Human
agcacagaaaacuag

SEQ ID NO: 2074929 - RNA, 16 nt, Human
agcacagaaaacuaga

SEQ ID NO: 2074930 - RNA, 13 nt, Human
agcacagaaggag

SEQ ID NO: 2074931 - RNA, 18 nt, Human
agaugggcuuguuuucuu

SEQ ID NO: 2074932 - RNA, 19 nt, Human
agaugggcuuguuuucuug

SEQ ID NO: 2074933 - RNA, 18 nt, Human
aggaguggguugauuuca

SEQ ID NO: 2074934 - RNA, 12 nt, Human
aggagucccugg

SEQ ID NO: 2074935 - RNA, 16 nt, Human
aggagucccaaggaaa

SEQ ID NO: 2074936 - RNA, 17 nt, Human
aggagucccaaggaaag

SEQ ID NO: 2074937 - RNA, 20 nt, Human
aggaguuagaggccagccug

SEQ ID NO: 2074938 - RNA, 21 nt, Human
aggaguucaagaccagccugg

SEQ ID NO: 2074939 - RNA, 22 nt, Human
aggaguucaagaccagccuggc

SEQ ID NO: 2074940 - RNA, 17 nt, Human
aggaguuagaggccagc

SEQ ID NO: 2074941 - RNA, 16 nt, Human
aggaguguggccacgu

SEQ ID NO: 2074942 - RNA, 16 nt, Human
aggagugugagaauca

SEQ ID NO: 2074943 - RNA, 16 nt, Human
aggagaauccaagcga

SEQ ID NO: 2074944 - RNA, 18 nt, Human
aggagaauccaagcgagg

SEQ ID NO: 2074945 - RNA, 13 nt, Human
aggagaauugcuu

SEQ ID NO: 2074946 - RNA, 20 nt, Human
aggagaauugcuugaaccug

SEQ ID NO: 2074947 - RNA, 20 nt, Human
aggagaauggcgugaacccg

SEQ ID NO: 2074948 - RNA, 20 nt, Human
aggagaaucgcuugaaccca

SEQ ID NO: 2074949 - RNA, 14 nt, Human
aggagucccaagga

SEQ ID NO: 2074950 - RNA, 14 nt, Human
aggagucagagaga

SEQ ID NO: 2074951 - RNA, 12 nt, Human
aggagaaggaag

SEQ ID NO: 2074952 - RNA, 16 nt, Human
aggagaaggaaggaga

SEQ ID NO: 2074953 - RNA, 19 nt, Human
aggaccuagggauguucug

SEQ ID NO: 2074954 - RNA, 16 nt, Human
aggaccuauguuugcu

SEQ ID NO: 2074955 - RNA, 21 nt, Human
aggaccuauguuugcucagaa

SEQ ID NO: 2074956 - RNA, 22 nt, Human
aggaccuagggauguucuggcc

SEQ ID NO: 2074957 - RNA, 13 nt, Human
aggaccucaggug

SEQ ID NO: 2074958 - RNA, 16 nt, Human
aggaccgccaaagaau

SEQ ID NO: 2074959 - RNA, 22 nt, Human
aggacccuucccuugagcccuc

SEQ ID NO: 2074960 - RNA, 16 nt, Human
aggauguucugggaca

SEQ ID NO: 2074961 - RNA, 15 nt, Human
aggauguucugggac

SEQ ID NO: 2074962 - RNA, 13 nt, Human
aggauggagagag

SEQ ID NO: 2074963 - RNA, 14 nt, Human
aggauggagagagg

SEQ ID NO: 2074964 - RNA, 15 nt, Human
aggauggagagaggg

SEQ ID NO: 2074965 - RNA, 16 nt, Human
aggauggagagagggg

SEQ ID NO: 2074966 - RNA, 17 nt, Human
aggauggagagagggga

SEQ ID NO: 2074967 - RNA, 19 nt, Human
aggauggagagaggggaau

SEQ ID NO: 2074968 - RNA, 18 nt, Human
aggauguaaacagugccu

SEQ ID NO: 2074969 - RNA, 19 nt, Human
aggauguaaacagugccug

SEQ ID NO: 2074970 - RNA, 22 nt, Human
aggauguaaacagugccugcug

SEQ ID NO: 2074971 - RNA, 20 nt, Human
aggauguaaacagugccugc

SEQ ID NO: 2074972 - RNA, 21 nt, Human
aggauguaaacagugccugcu

SEQ ID NO: 2074973 - RNA, 18 nt, Human
aggauguucugggacaca

SEQ ID NO: 2074974 - RNA, 16 nt, Human
aggauuacaugcaugu

SEQ ID NO: 2074975 - RNA, 14 nt, Human
aggauuauuggaaa

SEQ ID NO: 2074976 - RNA, 20 nt, Human
aggacccaucacgccugugc

SEQ ID NO: 2074977 - RNA, 18 nt, Human
aggacccaucacgccugu

SEQ ID NO: 2074978 - RNA, 20 nt, Human
aggacccuucccuugagccc

SEQ ID NO: 2074979 - RNA, 13 nt, Human
aggacccuucccu

SEQ ID NO: 2074980 - RNA, 12 nt, Human
aggacccuuccc

SEQ ID NO: 2074981 - RNA, 19 nt, Human
aggacccuucagagguggc

SEQ ID NO: 2074982 - RNA, 17 nt, Human
aggaauccagacccggc

SEQ ID NO: 2074983 - RNA, 20 nt, Human
aggaauccagacccggcugc

SEQ ID NO: 2074984 - RNA, 13 nt, Human
agcuuuuugucuu

SEQ ID NO: 2074985 - RNA, 13 nt, Human
agcuuuugcuuuu

SEQ ID NO: 2074986 - RNA, 17 nt, Human
agcuuccccucucuccu

SEQ ID NO: 2074987 - RNA, 23 nt, Human
agcuuccauuccaagccugacca

SEQ ID NO: 2074988 - RNA, 14 nt, Human
agcuuccaggaaaa

SEQ ID NO: 2074989 - RNA, 21 nt, Human
agcuuccaggaaaaaggacag

SEQ ID NO: 2074990 - RNA, 22 nt, Human
agcuuccaggaaaaaggacagg

SEQ ID NO: 2074991 - RNA, 20 nt, Human
agcuuccaggcugcauagaa

SEQ ID NO: 2074992 - RNA, 21 nt, Human
agcuuccaggcugcauagaag

SEQ ID NO: 2074993 - RNA, 13 nt, Human
agcugcuaaaucu

SEQ ID NO: 2074994 - RNA, 14 nt, Human
agcugcuaaaucuc

SEQ ID NO: 2074995 - RNA, 15 nt, Human
agcugcuaaaucucc

SEQ ID NO: 2074996 - RNA, 22 nt, Human
agcugcuaaaucuccuauuuuu

SEQ ID NO: 2074997 - RNA, 23 nt, Human
agcugcgguccacccaggagccc

SEQ ID NO: 2074998 - RNA, 17 nt, Human
agcucccuaggagacca

SEQ ID NO: 2074999 - RNA, 15 nt, Human
agcucccuaggagac

SEQ ID NO: 2075000 - RNA, 13 nt, Human
agcucccucugcc

SEQ ID NO: 2075001 - RNA, 14 nt, Human
agcucccucugccu

SEQ ID NO: 2075002 - RNA, 23 nt, Human
agcuccgcuuucuacccagcgag

SEQ ID NO: 2075003 - RNA, 21 nt, Human
agcuccgcuuucuacccagcg

SEQ ID NO: 2075004 - RNA, 20 nt, Human
agcuccgcuuucuacccagc

SEQ ID NO: 2075005 - RNA, 13 nt, Human
agcuccuucuguc

SEQ ID NO: 2075006 - RNA, 12 nt, Human
agcuccuucugu

SEQ ID NO: 2075007 - RNA, 14 nt, Human
agcugagaauagaa

SEQ ID NO: 2075008 - RNA, 15 nt, Human
agcugagaauagaag

SEQ ID NO: 2075009 - RNA, 16 nt, Human
agcugagaauagaagg

SEQ ID NO: 2075010 - RNA, 17 nt, Human
agcugagaauagaagga

SEQ ID NO: 2075011 - RNA, 18 nt, Human
agcugagaauagaaggaa

SEQ ID NO: 2075012 - RNA, 20 nt, Human
agcugagaauagaaggaaac

SEQ ID NO: 2075013 - RNA, 23 nt, Human
agcugagaauagaaggaaacuag

SEQ ID NO: 2075014 - RNA, 21 nt, Human
agcugcgguccacccaggagc

SEQ ID NO: 2075015 - RNA, 15 nt, Human
agcugagcaccaggg

SEQ ID NO: 2075016 - RNA, 13 nt, Human
agcugagcaggga

SEQ ID NO: 2075017 - RNA, 15 nt, Human
agcugagcagggaga

SEQ ID NO: 2075018 - RNA, 12 nt, Human
agcugaaauacu

SEQ ID NO: 2075019 - RNA, 18 nt, Human
aggcuguaucccaugagc

SEQ ID NO: 2075020 - RNA, 13 nt, Human
aggcuguauccca

SEQ ID NO: 2075021 - RNA, 13 nt, Human
aggcuacucaccu

SEQ ID NO: 2075022 - RNA, 15 nt, Human
aggcuagaucaugaa

SEQ ID NO: 2075023 - RNA, 19 nt, Human
aggcuguccuuacccaucu

SEQ ID NO: 2075024 - RNA, 21 nt, Human
aggcuguccuuacccaucugc

SEQ ID NO: 2075025 - RNA, 20 nt, Human
agggacagcccacugagaag

SEQ ID NO: 2075026 - RNA, 21 nt, Human
agggacagcccacugagaagu

SEQ ID NO: 2075027 - RNA, 12 nt, Human
agggaccugggg

SEQ ID NO: 2075028 - RNA, 13 nt, Human
agggaccugggga

SEQ ID NO: 2075029 - RNA, 14 nt, Human
agggaccuggggaa

SEQ ID NO: 2075030 - RNA, 16 nt, Human
agggaccuggggaagc

SEQ ID NO: 2075031 - RNA, 18 nt, Human
aggcguucuucgaggugg

SEQ ID NO: 2075032 - RNA, 19 nt, Human
aggcguucuucgaggugga

SEQ ID NO: 2075033 - RNA, 14 nt, Human
aggcgugaggaugg

SEQ ID NO: 2075034 - RNA, 13 nt, Human
aggcgugaggaug

SEQ ID NO: 2075035 - RNA, 17 nt, Human
aggccgaagaagggucc

SEQ ID NO: 2075036 - RNA, 18 nt, Human
aggccgaagaaggguccu

SEQ ID NO: 2075037 - RNA, 22 nt, Human
aggccgaagaaggguccuuccc

SEQ ID NO: 2075038 - RNA, 15 nt, Human
aggccgagaagcaag

SEQ ID NO: 2075039 - RNA, 19 nt, Human
aggccgagaagcaagaaag

SEQ ID NO: 2075040 - RNA, 18 nt, Human
aggcccuuccucuccacu

SEQ ID NO: 2075041 - RNA, 17 nt, Human
aggcccuuccucuccac

SEQ ID NO: 2075042 - RNA, 15 nt, Human
aggcccuuccucucc

SEQ ID NO: 2075043 - RNA, 13 nt, Human
aggcccuuccucu

SEQ ID NO: 2075044 - RNA, 21 nt, Human
aggguaucaggugcugccauc

SEQ ID NO: 2075045 - RNA, 19 nt, Human
aggguaucaggugcugcca

SEQ ID NO: 2075046 - RNA, 13 nt, Human
agggucaggaagg

SEQ ID NO: 2075047 - RNA, 21 nt, Human
agggucaggaaggaugagcau

SEQ ID NO: 2075048 - RNA, 22 nt, Human
agggucaggaaggaugagcauu

SEQ ID NO: 2075049 - RNA, 20 nt, Human
aggguauccaaguuggacug

SEQ ID NO: 2075050 - RNA, 21 nt, Human
aggguauccaaguuggacugg

SEQ ID NO: 2075051 - RNA, 22 nt, Human
aggguauccaaguuggacuggg

SEQ ID NO: 2075052 - RNA, 13 nt, Human
agggucagagagg

SEQ ID NO: 2075053 - RNA, 21 nt, Human
agggucagagaggagucagag

SEQ ID NO: 2075054 - RNA, 18 nt, Human
agggucaggagaggggca

SEQ ID NO: 2075055 - RNA, 14 nt, Human
agggucaggagagg

SEQ ID NO: 2075056 - RNA, 15 nt, Human
agggucaggagaggg

SEQ ID NO: 2075057 - RNA, 14 nt, Human
aggguccuucccuc

SEQ ID NO: 2075058 - RNA, 21 nt, Human
aggguccuggcuccugagggg

SEQ ID NO: 2075059 - RNA, 22 nt, Human
aggguccuucccucuccccaag

SEQ ID NO: 2075060 - RNA, 16 nt, Human
aggguccuucccucuc

SEQ ID NO: 2075061 - RNA, 17 nt, Human
aggguccuucccucucc

SEQ ID NO: 2075062 - RNA, 17 nt, Human
aggguccuggcuccuga

SEQ ID NO: 2075063 - RNA, 19 nt, Human
aggguccuggcuccugagg

SEQ ID NO: 2075064 - RNA, 20 nt, Human
aggguccuggcuccugaggg

SEQ ID NO: 2075065 - RNA, 13 nt, Human
agguaaaauucua

SEQ ID NO: 2075066 - RNA, 14 nt, Human
agguaaaauucuaa

SEQ ID NO: 2075067 - RNA, 15 nt, Human
agguaaaauucuaaa

SEQ ID NO: 2075068 - RNA, 16 nt, Human
agguaaaauucuaaau

SEQ ID NO: 2075069 - RNA, 19 nt, Human
agguaaaauucuaaauaaa

SEQ ID NO: 2075070 - RNA, 19 nt, Human
agguaaaauugaaaggcau

SEQ ID NO: 2075071 - RNA, 16 nt, Human
agguaaugugaauaaa

SEQ ID NO: 2075072 - RNA, 12 nt, Human
agguacacucuu

SEQ ID NO: 2075073 - RNA, 20 nt, Human
aggucugacacgucugccua

SEQ ID NO: 2075074 - RNA, 15 nt, Human
aggucucucuuugga

SEQ ID NO: 2075075 - RNA, 16 nt, Human
aggucucucuuuggac

SEQ ID NO: 2075076 - RNA, 23 nt, Human
aggucucucuuuggacucucccc

SEQ ID NO: 2075077 - RNA, 15 nt, Human
aggucucuugaggga

SEQ ID NO: 2075078 - RNA, 16 nt, Human
aggucucuugagggag

SEQ ID NO: 2075079 - RNA, 13 nt, Human
aggucugaaaugg

SEQ ID NO: 2075080 - RNA, 15 nt, Human
aggucugaaauggag

SEQ ID NO: 2075081 - RNA, 21 nt, Human
aggucugaaauggagguccuu

SEQ ID NO: 2075082 - RNA, 14 nt, Human
aggucugcucggcc

SEQ ID NO: 2075083 - RNA, 21 nt, Human
agguuaggaguucgagaccag

SEQ ID NO: 2075084 - RNA, 21 nt, Human
agguuacccuguaacaugcaa

SEQ ID NO: 2075085 - RNA, 17 nt, Human
agguuacccuguaacau

SEQ ID NO: 2075086 - RNA, 14 nt, Human
agguuauaggucac

SEQ ID NO: 2075087 - RNA, 17 nt, Human
agguuauaggucacucc

SEQ ID NO: 2075088 - RNA, 19 nt, Human
agguuauaggucacuccug

SEQ ID NO: 2075089 - RNA, 16 nt, Human
agguuauuuucuccug

SEQ ID NO: 2075090 - RNA, 17 nt, Human
agguggaagcccuccuu

SEQ ID NO: 2075091 - RNA, 19 nt, Human
agguggaagcccuccuucc

SEQ ID NO: 2075092 - RNA, 20 nt, Human
agguggaagcccuccuucca

SEQ ID NO: 2075093 - RNA, 21 nt, Human
agguggaagcccuccuuccac

SEQ ID NO: 2075094 - RNA, 16 nt, Human
agguuaacuauguaca

SEQ ID NO: 2075095 - RNA, 22 nt, Human
agguuaacuauguacaauauuu

SEQ ID NO: 2075096 - RNA, 16 nt, Human
agguuaaggcugagga

SEQ ID NO: 2075097 - RNA, 17 nt, Human
agguuaaggcugaggaa

SEQ ID NO: 2075098 - RNA, 24 nt, Human
agguuaaggcugaggaaaggccag

SEQ ID NO: 2075099 - RNA, 14 nt, Human
agguguuuauacag

SEQ ID NO: 2075100 - RNA, 11 nt, Human
agguguuuaua

SEQ ID NO: 2075101 - RNA, 12 nt, Human
agguguuuauac

SEQ ID NO: 2075102 - RNA, 16 nt, Human
agguggacuggaaggg

SEQ ID NO: 2075103 - RNA, 14 nt, Human
agguggacacacaa

SEQ ID NO: 2075104 - RNA, 20 nt, Human
agguggagguugcagugagc

SEQ ID NO: 2075105 - RNA, 20 nt, Human
agguggaggcugcagugagc

SEQ ID NO: 2075106 - RNA, 15 nt, Human
agguggaguggaugc

SEQ ID NO: 2075107 - RNA, 16 nt, Human
agguggaucacagagg

SEQ ID NO: 2075108 - RNA, 13 nt, Human
agguggagguggg

SEQ ID NO: 2075109 - RNA, 17 nt, Human
agguggaucaccugagg

SEQ ID NO: 2075110 - RNA, 19 nt, Human
auaaauuuuuuuuguuuca

SEQ ID NO: 2075111 - RNA, 22 nt, Human
auaaauuuuuuuuguuucauau

SEQ ID NO: 2075112 - RNA, 14 nt, Human
auaaaggauaaacu

SEQ ID NO: 2075113 - RNA, 21 nt, Human
auaaaggauaaacuuuuagaa

SEQ ID NO: 2075114 - RNA, 21 nt, Human
auaacaaaaucacuuccauag

SEQ ID NO: 2075115 - RNA, 16 nt, Human
auaacaaauaaccaac

SEQ ID NO: 2075116 - RNA, 14 nt, Human
auaacaagaucuuu

SEQ ID NO: 2075117 - RNA, 16 nt, Human
auaacaagaucuuuca

SEQ ID NO: 2075118 - RNA, 19 nt, Human
auaacagucuuacugcagg

SEQ ID NO: 2075119 - RNA, 15 nt, Human
auaacauaacaaaua

SEQ ID NO: 2075120 - RNA, 14 nt, Human
auaacagugccauu

SEQ ID NO: 2075121 - RNA, 15 nt, Human
auaacagugccauug

SEQ ID NO: 2075122 - RNA, 21 nt, Human
auaacagugccauugucuuua

SEQ ID NO: 2075123 - RNA, 23 nt, Human
auaacagugccauugucuuuaua

SEQ ID NO: 2075124 - RNA, 19 nt, Human
auaacagugugguaguuaa

SEQ ID NO: 2075125 - RNA, 11 nt, Human
auaaagacagg

SEQ ID NO: 2075126 - RNA, 21 nt, Human
auaaagaacaagguaguuuuu

SEQ ID NO: 2075127 - RNA, 15 nt, Human
auaaagaacaaggua

SEQ ID NO: 2075128 - RNA, 12 nt, Human
auaaagacaccu

SEQ ID NO: 2075129 - RNA, 15 nt, Human
auaaagcaucuaaac

SEQ ID NO: 2075130 - RNA, 17 nt, Human
auaaagcaucuaaacuu

SEQ ID NO: 2075131 - RNA, 20 nt, Human
auaaagccuguuuugucuuu

SEQ ID NO: 2075132 - RNA, 14 nt, Human
auaaagccugcuuu

SEQ ID NO: 2075133 - RNA, 20 nt, Human
auaaagccuuggauguauau

SEQ ID NO: 2075134 - RNA, 13 nt, Human
auaaaaauaaauu

SEQ ID NO: 2075135 - RNA, 22 nt, Human
auaaaaauaaauuugguucuaa

SEQ ID NO: 2075136 - RNA, 17 nt, Human
auaaaagaaaugcacaa

SEQ ID NO: 2075137 - RNA, 18 nt, Human
auaaaagaaaugcacaau

SEQ ID NO: 2075138 - RNA, 21 nt, Human
auaaaagaaaugcacaauguc

SEQ ID NO: 2075139 - RNA, 22 nt, Human
auaaaagaaaugcacaaugucu

SEQ ID NO: 2075140 - RNA, 12 nt, Human
auaaaagacaca

SEQ ID NO: 2075141 - RNA, 14 nt, Human
auaaaagacacaga

SEQ ID NO: 2075142 - RNA, 14 nt, Human
auaaacuuuuagaa

SEQ ID NO: 2075143 - RNA, 15 nt, Human
auaaacuuuuagaaa

SEQ ID NO: 2075144 - RNA, 18 nt, Human
auaaacuuuuagaaacuu

SEQ ID NO: 2075145 - RNA, 15 nt, Human
auaccucaaccuaug

SEQ ID NO: 2075146 - RNA, 18 nt, Human
auaccucaaccuauggua

SEQ ID NO: 2075147 - RNA, 22 nt, Human
auaauguauaaagaacaaggua

SEQ ID NO: 2075148 - RNA, 15 nt, Human
auaauguaagcucua

SEQ ID NO: 2075149 - RNA, 15 nt, Human
auaaugucccuucac

SEQ ID NO: 2075150 - RNA, 13 nt, Human
auaauguuugcua

SEQ ID NO: 2075151 - RNA, 14 nt, Human
auaauguuugcuau

SEQ ID NO: 2075152 - RNA, 17 nt, Human
auaaggccuuaauaugu

SEQ ID NO: 2075153 - RNA, 16 nt, Human
auaaggccuuaauaug

SEQ ID NO: 2075154 - RNA, 14 nt, Human
auaauguaagcucu

SEQ ID NO: 2075155 - RNA, 18 nt, Human
auaaugcuguugccucau

SEQ ID NO: 2075156 - RNA, 10 nt, Human
auaaggacug

SEQ ID NO: 2075157 - RNA, 11 nt, Human
auaaggacugc

SEQ ID NO: 2075158 - RNA, 12 nt, Human
auaaggacugca

SEQ ID NO: 2075159 - RNA, 14 nt, Human
auaaggacugcaug

SEQ ID NO: 2075160 - RNA, 15 nt, Human
auaaggacugcaugg

SEQ ID NO: 2075161 - RNA, 14 nt, Human
auaaggaucagaac

SEQ ID NO: 2075162 - RNA, 20 nt, Human
auaaggaucagaacagcaga

SEQ ID NO: 2075163 - RNA, 22 nt, Human
auaaggaucagaacagcagagg

SEQ ID NO: 2075164 - RNA, 18 nt, Human
auaaggaaagcaauaaau

SEQ ID NO: 2075165 - RNA, 13 nt, Human
auaucauucagca

SEQ ID NO: 2075166 - RNA, 14 nt, Human
auaucauucagcaa

SEQ ID NO: 2075167 - RNA, 23 nt, Human
auaucauuauaacugaaggagaa

SEQ ID NO: 2075168 - RNA, 15 nt, Human
auaucauucagcaac

SEQ ID NO: 2075169 - RNA, 23 nt, Human
auaucauuuauuuuuuacauuau

SEQ ID NO: 2075170 - RNA, 21 nt, Human
auaucauuuauuuuuuacauu

SEQ ID NO: 2075171 - RNA, 21 nt, Human
auaugcuuauacacuuacacu

SEQ ID NO: 2075172 - RNA, 20 nt, Human
auaugcucugauuuaucuga

SEQ ID NO: 2075173 - RNA, 13 nt, Human
auauuaucuuugu

SEQ ID NO: 2075174 - RNA, 19 nt, Human
auauuuacuucuuauacau

SEQ ID NO: 2075175 - RNA, 23 nt, Human
auauuuauuauuuucaccuguuu

SEQ ID NO: 2075176 - RNA, 14 nt, Human
auauuuacguauga

SEQ ID NO: 2075177 - RNA, 16 nt, Human
auauuuacauaugaaa

SEQ ID NO: 2075178 - RNA, 18 nt, Human
auauuuacauaugaaauu

SEQ ID NO: 2075179 - RNA, 19 nt, Human
auauuuacauaugaaauuu

SEQ ID NO: 2075180 - RNA, 20 nt, Human
auauuuacauaugaaauuua

SEQ ID NO: 2075181 - RNA, 17 nt, Human
auaucaaucauuuuccu

SEQ ID NO: 2075182 - RNA, 14 nt, Human
auauuagaaguguu

SEQ ID NO: 2075183 - RNA, 19 nt, Human
auauuaucaugcaaaugcu

SEQ ID NO: 2075184 - RNA, 21 nt, Human
auauuaucaugcaaaugcugu

SEQ ID NO: 2075185 - RNA, 15 nt, Human
auauuaugcaaauuc

SEQ ID NO: 2075186 - RNA, 17 nt, Human
auauuaugcaaauuccc

SEQ ID NO: 2075187 - RNA, 19 nt, Human
auauuaugcaaauucccag

SEQ ID NO: 2075188 - RNA, 16 nt, Human
auauuauggaagauuu

SEQ ID NO: 2075189 - RNA, 20 nt, Human
auauuauucaccauguaaaa

SEQ ID NO: 2075190 - RNA, 23 nt, Human
auauuauucaccauguaaaacaa

SEQ ID NO: 2075191 - RNA, 16 nt, Human
auagccaccccagaaa

SEQ ID NO: 2075192 - RNA, 19 nt, Human
auagccacuuaccuucaau

SEQ ID NO: 2075193 - RNA, 21 nt, Human
auagccacuuaccuucaauaa

SEQ ID NO: 2075194 - RNA, 23 nt, Human
auagccacuuaccuucaauaaag

SEQ ID NO: 2075195 - RNA, 22 nt, Human
auaggugcuuauucucaaagca

SEQ ID NO: 2075196 - RNA, 23 nt, Human
auaggucagugaggcccagggag

SEQ ID NO: 2075197 - RNA, 15 nt, Human
auaggucacuccugg

SEQ ID NO: 2075198 - RNA, 16 nt, Human
auaggucacuccuggg

SEQ ID NO: 2075199 - RNA, 18 nt, Human
auagguuguaaauguguu

SEQ ID NO: 2075200 - RNA, 12 nt, Human
auagguuuagag

SEQ ID NO: 2075201 - RNA, 21 nt, Human
auaguauuccauugugugagu

SEQ ID NO: 2075202 - RNA, 22 nt, Human
auaguauuccauugugugagug

SEQ ID NO: 2075203 - RNA, 18 nt, Human
auaguaugguggcugggu

SEQ ID NO: 2075204 - RNA, 17 nt, Human
auaguaugguggcuggg

SEQ ID NO: 2075205 - RNA, 18 nt, Human
auaguauuuuuauauuua

SEQ ID NO: 2075206 - RNA, 14 nt, Human
auauagaucacaua

SEQ ID NO: 2075207 - RNA, 20 nt, Human
auauagaucacauaacagaa

SEQ ID NO: 2075208 - RNA, 22 nt, Human
auauacuuuuuucuuauuuaac

SEQ ID NO: 2075209 - RNA, 12 nt, Human
auauagaauugc

SEQ ID NO: 2075210 - RNA, 21 nt, Human
auauagaauugcaauuuuaac

SEQ ID NO: 2075211 - RNA, 16 nt, Human
aguuguuaauaaaagu

SEQ ID NO: 2075212 - RNA, 16 nt, Human
aguuguuucauugacu

SEQ ID NO: 2075213 - RNA, 19 nt, Human
aguuguuucauugacuauc

SEQ ID NO: 2075214 - RNA, 13 nt, Human
aguuguuucauug

SEQ ID NO: 2075215 - RNA, 15 nt, Human
aguuguuucauugac

SEQ ID NO: 2075216 - RNA, 18 nt, Human
aguuguggaaagccucug

SEQ ID NO: 2075217 - RNA, 19 nt, Human
aguuguggaaagccucugc

SEQ ID NO: 2075218 - RNA, 20 nt, Human
aguuguggaaagccucugcu

SEQ ID NO: 2075219 - RNA, 21 nt, Human
aguuguggaaagccucugcug

SEQ ID NO: 2075220 - RNA, 14 nt, Human
aguuguguuguucu

SEQ ID NO: 2075221 - RNA, 15 nt, Human
aguuguguuguucuu

SEQ ID NO: 2075222 - RNA, 20 nt, Human
aguuguggagagugcaacag

SEQ ID NO: 2075223 - RNA, 16 nt, Human
aguuguguacucuggc

SEQ ID NO: 2075224 - RNA, 18 nt, Human
aguuguguacucuggccu

SEQ ID NO: 2075225 - RNA, 19 nt, Human
aguuguguacucuggccuc

SEQ ID NO: 2075226 - RNA, 20 nt, Human
aguuguguacucuggccucu

SEQ ID NO: 2075227 - RNA, 21 nt, Human
aguuguguacucuggccucug

SEQ ID NO: 2075228 - RNA, 19 nt, Human
aguucagguaacaggcaga

SEQ ID NO: 2075229 - RNA, 20 nt, Human
aguucagguaacaggcagau

SEQ ID NO: 2075230 - RNA, 19 nt, Human
aguucagguagcugccccu

SEQ ID NO: 2075231 - RNA, 20 nt, Human
aguucagguagcugccccug

SEQ ID NO: 2075232 - RNA, 21 nt, Human
aguucagguagcugccccugg

SEQ ID NO: 2075233 - RNA, 16 nt, Human
aguucauaacagugcc

SEQ ID NO: 2075234 - RNA, 17 nt, Human
aguucauaacagugcca

SEQ ID NO: 2075235 - RNA, 18 nt, Human
aguucauaacagugccau

SEQ ID NO: 2075236 - RNA, 19 nt, Human
aguucauaacagugccauu

SEQ ID NO: 2075237 - RNA, 20 nt, Human
aguucauaacagugccauug

SEQ ID NO: 2075238 - RNA, 22 nt, Human
aguucauaacagugccauuguc

SEQ ID NO: 2075239 - RNA, 20 nt, Human
aguucaguaagaccggaagc

SEQ ID NO: 2075240 - RNA, 13 nt, Human
aguuaaaaaaaau

SEQ ID NO: 2075241 - RNA, 14 nt, Human
aguuaaaaaaaaua

SEQ ID NO: 2075242 - RNA, 15 nt, Human
aguuaaaaaaaauaa

SEQ ID NO: 2075243 - RNA, 16 nt, Human
aguuaaaaaaaauaau

SEQ ID NO: 2075244 - RNA, 18 nt, Human
aguuaaaaaaaauaauaa

SEQ ID NO: 2075245 - RNA, 19 nt, Human
aguuaaaaaaaauaauaaa

SEQ ID NO: 2075246 - RNA, 20 nt, Human
aguuaaaaaaaauaauaaau

SEQ ID NO: 2075247 - RNA, 15 nt, Human
aguuaauauugugaa

SEQ ID NO: 2075248 - RNA, 21 nt, Human
aguuaaauagaguauaugcac

SEQ ID NO: 2075249 - RNA, 16 nt, Human
aguuaaagugaauaac

SEQ ID NO: 2075250 - RNA, 12 nt, Human
aguuaaauaaau

SEQ ID NO: 2075251 - RNA, 14 nt, Human
aguuaaucaacuga

SEQ ID NO: 2075252 - RNA, 16 nt, Human
aguuaaucaacugaaa

SEQ ID NO: 2075253 - RNA, 14 nt, Human
aguuaaucuugcuu

SEQ ID NO: 2075254 - RNA, 15 nt, Human
aguuaaucuugcuuu

SEQ ID NO: 2075255 - RNA, 16 nt, Human
aguuaaucuugcuuuc

SEQ ID NO: 2075256 - RNA, 18 nt, Human
aguuacacuaaaagguga

SEQ ID NO: 2075257 - RNA, 18 nt, Human
aguuaaucuugcuuucuu

SEQ ID NO: 2075258 - RNA, 15 nt, Human
aguguauuauaacag

SEQ ID NO: 2075259 - RNA, 17 nt, Human
aguguaugcacgugugc

SEQ ID NO: 2075260 - RNA, 14 nt, Human
agugggagcugccu

SEQ ID NO: 2075261 - RNA, 13 nt, Human
agugggagaaaac

SEQ ID NO: 2075262 - RNA, 17 nt, Human
agugggagaaaacacuu

SEQ ID NO: 2075263 - RNA, 15 nt, Human
agugggagcugccug

SEQ ID NO: 2075264 - RNA, 16 nt, Human
agugggagcugccugu

SEQ ID NO: 2075265 - RNA, 14 nt, Human
agugggagccaggg

SEQ ID NO: 2075266 - RNA, 14 nt, Human
agugggagaaaaca

SEQ ID NO: 2075267 - RNA, 18 nt, Human
aguguauuuuauaaaauu

SEQ ID NO: 2075268 - RNA, 22 nt, Human
aguguauuuuauaaaauuaaag

SEQ ID NO: 2075269 - RNA, 21 nt, Human
aguguccuccccucaaggaca

SEQ ID NO: 2075270 - RNA, 16 nt, Human
aguguccgagaacuaa

SEQ ID NO: 2075271 - RNA, 14 nt, Human
aguggcucacgccu

SEQ ID NO: 2075272 - RNA, 23 nt, Human
aguggcuuaaaacaacacucaca

SEQ ID NO: 2075273 - RNA, 16 nt, Human
aguggcugucaucagc

SEQ ID NO: 2075274 - RNA, 17 nt, Human
aguggcugucaucagcc

SEQ ID NO: 2075275 - RNA, 19 nt, Human
aguggcuuacuacaugugg

SEQ ID NO: 2075276 - RNA, 21 nt, Human
aguggcuccucccggugccca

SEQ ID NO: 2075277 - RNA, 11 nt, Human
aguggcugcug

SEQ ID NO: 2075278 - RNA, 14 nt, Human
aguggcugcugacu

SEQ ID NO: 2075279 - RNA, 17 nt, Human
aguggcuccucccggug

SEQ ID NO: 2075280 - RNA, 13 nt, Human
aguggcuccuccc

SEQ ID NO: 2075281 - RNA, 17 nt, Human
agugaaggccacagcaa

SEQ ID NO: 2075282 - RNA, 14 nt, Human
agugaccaaggagg

SEQ ID NO: 2075283 - RNA, 22 nt, Human
agugacaucucuuugaugucau

SEQ ID NO: 2075284 - RNA, 20 nt, Human
agugacaguggauugcauuu

SEQ ID NO: 2075285 - RNA, 19 nt, Human
agugacaguggauugcauu

SEQ ID NO: 2075286 - RNA, 22 nt, Human
aguccugggagaaccucaggcu

SEQ ID NO: 2075287 - RNA, 21 nt, Human
aguccugggagaaccucaggc

SEQ ID NO: 2075288 - RNA, 18 nt, Human
agucuggaaugcaguggu

SEQ ID NO: 2075289 - RNA, 20 nt, Human
agucugcugcccuccauccc

SEQ ID NO: 2075290 - RNA, 18 nt, Human
agucugcugcccuccauc

SEQ ID NO: 2075291 - RNA, 19 nt, Human
agucugcuuauccuuccac

SEQ ID NO: 2075292 - RNA, 14 nt, Human
agucugcuucugca

SEQ ID NO: 2075293 - RNA, 20 nt, Human
agugaacuugggccacugug

SEQ ID NO: 2075294 - RNA, 17 nt, Human
agucuggaaugcagugg

SEQ ID NO: 2075295 - RNA, 13 nt, Human
agucugcugcccu

SEQ ID NO: 2075296 - RNA, 15 nt, Human
agucugcugcccucc

SEQ ID NO: 2075297 - RNA, 16 nt, Human
agucugcugcccucca

SEQ ID NO: 2075298 - RNA, 17 nt, Human
agucugcugcccuccau

SEQ ID NO: 2075299 - RNA, 18 nt, Human
agucugauucccaagcuc

SEQ ID NO: 2075300 - RNA, 16 nt, Human
agucugauucccaagc

SEQ ID NO: 2075301 - RNA, 13 nt, Human
agucugcauuaca

SEQ ID NO: 2075302 - RNA, 18 nt, Human
agucugcauuacauuccu

SEQ ID NO: 2075303 - RNA, 19 nt, Human
agugaagagggagaaggga

SEQ ID NO: 2075304 - RNA, 15 nt, Human
agugaauaaaaauua

SEQ ID NO: 2075305 - RNA, 18 nt, Human
agucaaacauuucaaagu

SEQ ID NO: 2075306 - RNA, 13 nt, Human
agucaaagacauu

SEQ ID NO: 2075307 - RNA, 21 nt, Human
agucaaaaggugccugugagg

SEQ ID NO: 2075308 - RNA, 14 nt, Human
agucaaauaacucc

SEQ ID NO: 2075309 - RNA, 12 nt, Human
agucaaaguaaa

SEQ ID NO: 2075310 - RNA, 21 nt, Human
agucaaaguaaaacuugcugc

SEQ ID NO: 2075311 - RNA, 14 nt, Human
agucaacagugaaa

SEQ ID NO: 2075312 - RNA, 20 nt, Human
aguaugcuuggacugaaggg

SEQ ID NO: 2075313 - RNA, 16 nt, Human
aguaugaauaaagaca

SEQ ID NO: 2075314 - RNA, 14 nt, Human
aguaucugggaacu

SEQ ID NO: 2075315 - RNA, 18 nt, Human
aguaucuccucgcaagcu

SEQ ID NO: 2075316 - RNA, 19 nt, Human
aguaucuccucgcaagcug

SEQ ID NO: 2075317 - RNA, 15 nt, Human
aguaucucagggccu

SEQ ID NO: 2075318 - RNA, 16 nt, Human
aucagcuagcaaaaga

SEQ ID NO: 2075319 - RNA, 21 nt, Human
aucagcuagcaaaagaaguaa

SEQ ID NO: 2075320 - RNA, 23 nt, Human
aucagcuagcaaaagaaguaaca

SEQ ID NO: 2075321 - RNA, 16 nt, Human
aucagcuguuugucau

SEQ ID NO: 2075322 - RNA, 18 nt, Human
aucauguuaauccuagcu

SEQ ID NO: 2075323 - RNA, 19 nt, Human
aucauguuaauccuagcug

SEQ ID NO: 2075324 - RNA, 15 nt, Human
aucauguuaugauaa

SEQ ID NO: 2075325 - RNA, 20 nt, Human
aucagccugcuccagcuguu

SEQ ID NO: 2075326 - RNA, 19 nt, Human
aucagccugcuccagcugu

SEQ ID NO: 2075327 - RNA, 17 nt, Human
aucagccugcuccagcu

SEQ ID NO: 2075328 - RNA, 18 nt, Human
aucagccugcuccagcug

SEQ ID NO: 2075329 - RNA, 15 nt, Human
aucagcuauuuacug

SEQ ID NO: 2075330 - RNA, 14 nt, Human
aucagcuauuuacu

SEQ ID NO: 2075331 - RNA, 18 nt, Human
aucagcuccacuuucagu

SEQ ID NO: 2075332 - RNA, 22 nt, Human
aucacauuauuugcauguuacc

SEQ ID NO: 2075333 - RNA, 15 nt, Human
aucacauuauuugca

SEQ ID NO: 2075334 - RNA, 16 nt, Human
aucacauuauuugcau

SEQ ID NO: 2075335 - RNA, 12 nt, Human
aucacagggcag

SEQ ID NO: 2075336 - RNA, 15 nt, Human
aucacagggcagagc

SEQ ID NO: 2075337 - RNA, 22 nt, Human
aucacagcuucagccaggagcu

SEQ ID NO: 2075338 - RNA, 21 nt, Human
aucacagcuucagccaggagc

SEQ ID NO: 2075339 - RNA, 21 nt, Human
aucacagccucugaaaaccaa

SEQ ID NO: 2075340 - RNA, 18 nt, Human
aucacagcuucagccagg

SEQ ID NO: 2075341 - RNA, 14 nt, Human
aucacagcuucagc

SEQ ID NO: 2075342 - RNA, 19 nt, Human
aucacagggcagagccggg

SEQ ID NO: 2075343 - RNA, 20 nt, Human
aucacagggcagagccggga

SEQ ID NO: 2075344 - RNA, 23 nt, Human
auauuuauuguuuauuuaucagu

SEQ ID NO: 2075345 - RNA, 13 nt, Human
auauuuauuguau

SEQ ID NO: 2075346 - RNA, 22 nt, Human
auauuuauuguuuauuuaucag

SEQ ID NO: 2075347 - RNA, 19 nt, Human
auccucccaccucagccuc

SEQ ID NO: 2075348 - RNA, 18 nt, Human
auccucccaccucagccu

SEQ ID NO: 2075349 - RNA, 20 nt, Human
auccucccaccucagccucc

SEQ ID NO: 2075350 - RNA, 19 nt, Human
aucggcccacagcucccac

SEQ ID NO: 2075351 - RNA, 20 nt, Human
aucggcccacagcucccacc

SEQ ID NO: 2075352 - RNA, 23 nt, Human
aucggcccacagcucccacccca

SEQ ID NO: 2075353 - RNA, 21 nt, Human
aucggaucuggggcucuggga

SEQ ID NO: 2075354 - RNA, 23 nt, Human
aucggaggcuugucagagcuggg

SEQ ID NO: 2075355 - RNA, 18 nt, Human
aucggaggcuugucagag

SEQ ID NO: 2075356 - RNA, 20 nt, Human
aucggaggcuugucagagcu

SEQ ID NO: 2075357 - RNA, 21 nt, Human
aucggaggcuugucagagcug

SEQ ID NO: 2075358 - RNA, 22 nt, Human
aucggaggcuugucagagcugg

SEQ ID NO: 2075359 - RNA, 18 nt, Human
aucggaagcagugccuuc

SEQ ID NO: 2075360 - RNA, 13 nt, Human
aucggagacagug

SEQ ID NO: 2075361 - RNA, 14 nt, Human
aucggaagcagugc

SEQ ID NO: 2075362 - RNA, 22 nt, Human
aucggaagcagugccuuccaua

SEQ ID NO: 2075363 - RNA, 15 nt, Human
auccucccaccucag

SEQ ID NO: 2075364 - RNA, 23 nt, Human
auccuccaacuucauuugaugcu

SEQ ID NO: 2075365 - RNA, 23 nt, Human
auccucauuugggguagcuagag

SEQ ID NO: 2075366 - RNA, 21 nt, Human
aucccauugucuucugaccuc

SEQ ID NO: 2075367 - RNA, 23 nt, Human
auccccaaaacaggccaggugug

SEQ ID NO: 2075368 - RNA, 13 nt, Human
auccccgcuggcu

SEQ ID NO: 2075369 - RNA, 16 nt, Human
auccccgcuggcuggg

SEQ ID NO: 2075370 - RNA, 15 nt, Human
auccccuguagagug

SEQ ID NO: 2075371 - RNA, 21 nt, Human
auccuaugguuucuccaucca

SEQ ID NO: 2075372 - RNA, 14 nt, Human
aucccauuuaaaaa

SEQ ID NO: 2075373 - RNA, 21 nt, Human
auccaggcacccaaaccccgg

SEQ ID NO: 2075374 - RNA, 16 nt, Human
aucccauugcccuggu

SEQ ID NO: 2075375 - RNA, 17 nt, Human
aucccauugcccugguu

SEQ ID NO: 2075376 - RNA, 15 nt, Human
aucccauuuaaaaaa

SEQ ID NO: 2075377 - RNA, 13 nt, Human
auccagaaagaaa

SEQ ID NO: 2075378 - RNA, 14 nt, Human
auccagaaagaaaa

SEQ ID NO: 2075379 - RNA, 15 nt, Human
auccagaaagaaaaa

SEQ ID NO: 2075380 - RNA, 20 nt, Human
auccagaauugaccuuuuga

SEQ ID NO: 2075381 - RNA, 15 nt, Human
auccaggcaauggcc

SEQ ID NO: 2075382 - RNA, 15 nt, Human
auccagacccggcug

SEQ ID NO: 2075383 - RNA, 16 nt, Human
aucugggaacucccaa

SEQ ID NO: 2075384 - RNA, 19 nt, Human
aucugggaacucccaagaa

SEQ ID NO: 2075385 - RNA, 20 nt, Human
aucugggaacucccaagaac

SEQ ID NO: 2075386 - RNA, 16 nt, Human
aucugggaagauuucu

SEQ ID NO: 2075387 - RNA, 16 nt, Human
aucugggacccuuucc

SEQ ID NO: 2075388 - RNA, 11 nt, Human
aucuggccuua

SEQ ID NO: 2075389 - RNA, 14 nt, Human
aucuucuuuauaau

SEQ ID NO: 2075390 - RNA, 17 nt, Human
aucucugcuuuggaaau

SEQ ID NO: 2075391 - RNA, 17 nt, Human
aucucugucuaccaucu

SEQ ID NO: 2075392 - RNA, 19 nt, Human
aucucugucuaccaucucc

SEQ ID NO: 2075393 - RNA, 20 nt, Human
aucucugucuaccaucuccc

SEQ ID NO: 2075394 - RNA, 19 nt, Human
aucuccugugcauggguga

SEQ ID NO: 2075395 - RNA, 16 nt, Human
aucuccuugucuuuuu

SEQ ID NO: 2075396 - RNA, 15 nt, Human
aucuccuuucaggga

SEQ ID NO: 2075397 - RNA, 20 nt, Human
aucucgccaccccuccuucc

SEQ ID NO: 2075398 - RNA, 21 nt, Human
aucucgccaccccuccuuccu

SEQ ID NO: 2075399 - RNA, 15 nt, Human
aucuccugugcaugg

SEQ ID NO: 2075400 - RNA, 18 nt, Human
aucuccugugcaugggug

SEQ ID NO: 2075401 - RNA, 19 nt, Human
aucuggacuccucugucca

SEQ ID NO: 2075402 - RNA, 12 nt, Human
aucuggcagggu

SEQ ID NO: 2075403 - RNA, 18 nt, Human
aucuggacuccucugucc

SEQ ID NO: 2075404 - RNA, 17 nt, Human
aucuggacuccucuguc

SEQ ID NO: 2075405 - RNA, 16 nt, Human
aucuggacuccucugu

SEQ ID NO: 2075406 - RNA, 15 nt, Human
aucuggacuccucug

SEQ ID NO: 2075407 - RNA, 22 nt, Human
aucugcuuuuuaaagaaugcuc

SEQ ID NO: 2075408 - RNA, 23 nt, Human
aucuauugcuggcaaagacagaa

SEQ ID NO: 2075409 - RNA, 15 nt, Human
aucucccugccgccu

SEQ ID NO: 2075410 - RNA, 19 nt, Human
aucucccugccgccucaau

SEQ ID NO: 2075411 - RNA, 12 nt, Human
aucucccugccg

SEQ ID NO: 2075412 - RNA, 22 nt, Human
aucucccucgaacccacacugc

SEQ ID NO: 2075413 - RNA, 23 nt, Human
aucucccucgaacccacacugca

SEQ ID NO: 2075414 - RNA, 18 nt, Human
aucuaucuuauauaguuu

SEQ ID NO: 2075415 - RNA, 14 nt, Human
aucuaucagaguau

SEQ ID NO: 2075416 - RNA, 13 nt, Human
augaaagacugua

SEQ ID NO: 2075417 - RNA, 16 nt, Human
augaaagacuguacaa

SEQ ID NO: 2075418 - RNA, 17 nt, Human
augaaagacuguacaaa

SEQ ID NO: 2075419 - RNA, 19 nt, Human
augaaagacuguacaaagu

SEQ ID NO: 2075420 - RNA, 13 nt, Human
augaaaaauagca

SEQ ID NO: 2075421 - RNA, 16 nt, Human
augaaaaauuuaagca

SEQ ID NO: 2075422 - RNA, 17 nt, Human
augaaaaauuuaagcau

SEQ ID NO: 2075423 - RNA, 18 nt, Human
augaaaaauuuaagcauu

SEQ ID NO: 2075424 - RNA, 13 nt, Human
augaaaaauauga

SEQ ID NO: 2075425 - RNA, 13 nt, Human
augaaaaauucuc

SEQ ID NO: 2075426 - RNA, 19 nt, Human
augaaguaacuugucuuaa

SEQ ID NO: 2075427 - RNA, 19 nt, Human
augaaaaauuuaagcauug

SEQ ID NO: 2075428 - RNA, 20 nt, Human
augaaaaauuuaagcauugu

SEQ ID NO: 2075429 - RNA, 21 nt, Human
augaaaaauuuaagcauuguu

SEQ ID NO: 2075430 - RNA, 16 nt, Human
augaaggcaaaaaaau

SEQ ID NO: 2075431 - RNA, 19 nt, Human
augaagguuucugaaaauu

SEQ ID NO: 2075432 - RNA, 17 nt, Human
augaagguuucugaaaa

SEQ ID NO: 2075433 - RNA, 17 nt, Human
augaagggaaaggauau

SEQ ID NO: 2075434 - RNA, 21 nt, Human
augaggcaaugucaggaacag

SEQ ID NO: 2075435 - RNA, 22 nt, Human
augaggaugcagagucagcaga

SEQ ID NO: 2075436 - RNA, 18 nt, Human
augaggcaaugucaggaa

SEQ ID NO: 2075437 - RNA, 18 nt, Human
augaggagugaacauuug

SEQ ID NO: 2075438 - RNA, 14 nt, Human
augaggaguugcug

SEQ ID NO: 2075439 - RNA, 20 nt, Human
augaggaugcagagucagca

SEQ ID NO: 2075440 - RNA, 21 nt, Human
augaggaugcagagucagcag

SEQ ID NO: 2075441 - RNA, 14 nt, Human
augaggaggaagga

SEQ ID NO: 2075442 - RNA, 22 nt, Human
augaggaggcagaaagcagagg

SEQ ID NO: 2075443 - RNA, 21 nt, Human
augagcucgcauuugucaaug

SEQ ID NO: 2075444 - RNA, 22 nt, Human
augagcucgcauuugucaauga

SEQ ID NO: 2075445 - RNA, 21 nt, Human
augagcuccagacccccagca

SEQ ID NO: 2075446 - RNA, 22 nt, Human
augagcuccagacccccagcaa

SEQ ID NO: 2075447 - RNA, 14 nt, Human
augagcuccucuuc

SEQ ID NO: 2075448 - RNA, 22 nt, Human
augagcuccucuuccuggcuuc

SEQ ID NO: 2075449 - RNA, 15 nt, Human
augacggaagaacau

SEQ ID NO: 2075450 - RNA, 16 nt, Human
augacgacaaagcugc

SEQ ID NO: 2075451 - RNA, 21 nt, Human
augacgacaaagcugcuaaau

SEQ ID NO: 2075452 - RNA, 23 nt, Human
augacgacaaagcugcuaaaucu

SEQ ID NO: 2075453 - RNA, 19 nt, Human
augacgacgacaacgauga

SEQ ID NO: 2075454 - RNA, 15 nt, Human
augagcuccagaccc

SEQ ID NO: 2075455 - RNA, 16 nt, Human
augagcuccagacccc

SEQ ID NO: 2075456 - RNA, 17 nt, Human
augagcuccagaccccc

SEQ ID NO: 2075457 - RNA, 20 nt, Human
augagcuccagacccccagc

SEQ ID NO: 2075458 - RNA, 14 nt, Human
augcugccaaauuu

SEQ ID NO: 2075459 - RNA, 16 nt, Human
augcugaaacaggaga

SEQ ID NO: 2075460 - RNA, 18 nt, Human
augcugaaacaggagaga

SEQ ID NO: 2075461 - RNA, 15 nt, Human
augcugaaacaggag

SEQ ID NO: 2075462 - RNA, 16 nt, Human
augcucuuuacuucau

SEQ ID NO: 2075463 - RNA, 14 nt, Human
auggaggaggaggc

SEQ ID NO: 2075464 - RNA, 16 nt, Human
auggaggaggaggcaa

SEQ ID NO: 2075465 - RNA, 15 nt, Human
auggaggaggaggca

SEQ ID NO: 2075466 - RNA, 16 nt, Human
auggaggauggagaga

SEQ ID NO: 2075467 - RNA, 12 nt, Human
auggaggcacac

SEQ ID NO: 2075468 - RNA, 11 nt, Human
auggaggagaa

SEQ ID NO: 2075469 - RNA, 13 nt, Human
auggaggagaaga

SEQ ID NO: 2075470 - RNA, 15 nt, Human
auggaggagaagaau

SEQ ID NO: 2075471 - RNA, 17 nt, Human
auggaggagaagaauuu

SEQ ID NO: 2075472 - RNA, 13 nt, Human
auggaggaauaug

SEQ ID NO: 2075473 - RNA, 22 nt, Human
auggaggaaaaccaagccgugg

SEQ ID NO: 2075474 - RNA, 16 nt, Human
auggaggaaaaccaag

SEQ ID NO: 2075475 - RNA, 18 nt, Human
auggcugugccucugccu

SEQ ID NO: 2075476 - RNA, 15 nt, Human
auggauuuccagcca

SEQ ID NO: 2075477 - RNA, 17 nt, Human
auggauucucagauauu

SEQ ID NO: 2075478 - RNA, 18 nt, Human
auggauucucagauauuu

SEQ ID NO: 2075479 - RNA, 19 nt, Human
auggauucucagauauuua

SEQ ID NO: 2075480 - RNA, 22 nt, Human
auggauucucagauauuuauau

SEQ ID NO: 2075481 - RNA, 14 nt, Human
auggauucucagau

SEQ ID NO: 2075482 - RNA, 16 nt, Human
auggauucucagauau

SEQ ID NO: 2075483 - RNA, 18 nt, Human
auggaggauggagagagg

SEQ ID NO: 2075484 - RNA, 20 nt, Human
augcuuggaauaucugcugu

SEQ ID NO: 2075485 - RNA, 21 nt, Human
augcuuggaauaucugcugua

SEQ ID NO: 2075486 - RNA, 20 nt, Human
auggaaaaggaagacuagag

SEQ ID NO: 2075487 - RNA, 15 nt, Human
auggaaacaaagugg

SEQ ID NO: 2075488 - RNA, 22 nt, Human
auggaaacaaaguggaaggaaa

SEQ ID NO: 2075489 - RNA, 23 nt, Human
auggaaacaaaguggaaggaaag

SEQ ID NO: 2075490 - RNA, 17 nt, Human
augcuuguaacaagaaa

SEQ ID NO: 2075491 - RNA, 18 nt, Human
augcuuguaacaagaaaa

SEQ ID NO: 2075492 - RNA, 20 nt, Human
augcuuguaacaagaaaaca

SEQ ID NO: 2075493 - RNA, 21 nt, Human
augcuuguaacaagaaaacau

SEQ ID NO: 2075494 - RNA, 14 nt, Human
auggaaaaggaaga

SEQ ID NO: 2075495 - RNA, 21 nt, Human
auggaaaagucuucaagggcu

SEQ ID NO: 2075496 - RNA, 22 nt, Human
auggaaaagucuucaagggcug

SEQ ID NO: 2075497 - RNA, 20 nt, Human
auggaaacuguugccagaga

SEQ ID NO: 2075498 - RNA, 22 nt, Human
auggaaacuguugccagagaug

SEQ ID NO: 2075499 - RNA, 20 nt, Human
auggcugugccucugccugu

SEQ ID NO: 2075500 - RNA, 19 nt, Human
auggcugugccucugccug

SEQ ID NO: 2075501 - RNA, 16 nt, Human
auggcuuaguuuucau

SEQ ID NO: 2075502 - RNA, 15 nt, Human
augauggagucaggu

SEQ ID NO: 2075503 - RNA, 21 nt, Human
augaugcuuguaacaagaaaa

SEQ ID NO: 2075504 - RNA, 17 nt, Human
augauggagcgcaccug

SEQ ID NO: 2075505 - RNA, 17 nt, Human
augauguugaauauuug

SEQ ID NO: 2075506 - RNA, 18 nt, Human
augauguugaauauuugu

SEQ ID NO: 2075507 - RNA, 21 nt, Human
augauguuucgugaaguauac

SEQ ID NO: 2075508 - RNA, 20 nt, Human
augcaauuuugcauuugaau

SEQ ID NO: 2075509 - RNA, 18 nt, Human
augcaucuuacugaaggu

SEQ ID NO: 2075510 - RNA, 14 nt, Human
augcaucuuacuga

SEQ ID NO: 2075511 - RNA, 16 nt, Human
augcaucuuacugaag

SEQ ID NO: 2075512 - RNA, 17 nt, Human
augcauauccugagcca

SEQ ID NO: 2075513 - RNA, 18 nt, Human
augcauauccugagccau

SEQ ID NO: 2075514 - RNA, 20 nt, Human
augcacacuagccucuccag

SEQ ID NO: 2075515 - RNA, 22 nt, Human
augcacacuagccucuccagga

SEQ ID NO: 2075516 - RNA, 23 nt, Human
augcauagucccagcuacccagg

SEQ ID NO: 2075517 - RNA, 22 nt, Human
augcauaguucccauguuaaau

SEQ ID NO: 2075518 - RNA, 15 nt, Human
augccugaacuugaa

SEQ ID NO: 2075519 - RNA, 23 nt, Human
auguaauuaaguacuauguauca

SEQ ID NO: 2075520 - RNA, 14 nt, Human
auguauuuuaugua

SEQ ID NO: 2075521 - RNA, 15 nt, Human
auguauuuuauguau

SEQ ID NO: 2075522 - RNA, 17 nt, Human
auguauuuuauguaugu

SEQ ID NO: 2075523 - RNA, 20 nt, Human
auguauuuuauguauguuua

SEQ ID NO: 2075524 - RNA, 14 nt, Human
auguauucaaauac

SEQ ID NO: 2075525 - RNA, 15 nt, Human
auggucgcccaggag

SEQ ID NO: 2075526 - RNA, 16 nt, Human
auggucgcccaggaga

SEQ ID NO: 2075527 - RNA, 20 nt, Human
auguaaggaaugcuuggaau

SEQ ID NO: 2075528 - RNA, 15 nt, Human
auguaauuaaguacu

SEQ ID NO: 2075529 - RNA, 17 nt, Human
auguaauuaaguacuau

SEQ ID NO: 2075530 - RNA, 22 nt, Human
auggucaucuuuuucucuaaaa

SEQ ID NO: 2075531 - RNA, 12 nt, Human
augguccugggg

SEQ ID NO: 2075532 - RNA, 14 nt, Human
augguccuggggcu

SEQ ID NO: 2075533 - RNA, 17 nt, Human
augguccuggggcucug

SEQ ID NO: 2075534 - RNA, 19 nt, Human
augguccuggggcucugug

SEQ ID NO: 2075535 - RNA, 20 nt, Human
augguccuggggcucugugc

SEQ ID NO: 2075536 - RNA, 14 nt, Human
auggucgcccagga

SEQ ID NO: 2075537 - RNA, 19 nt, Human
auggucaccaaaucagcug

SEQ ID NO: 2075538 - RNA, 16 nt, Human
auggucagacacaaac

SEQ ID NO: 2075539 - RNA, 18 nt, Human
auggucagacacaaacaa

SEQ ID NO: 2075540 - RNA, 23 nt, Human
augguaucaauaaauagaccauu

SEQ ID NO: 2075541 - RNA, 21 nt, Human
augguauauuugguacuguau

SEQ ID NO: 2075542 - RNA, 15 nt, Human
augguauuugagaca

SEQ ID NO: 2075543 - RNA, 16 nt, Human
augguauuugagacau

SEQ ID NO: 2075544 - RNA, 20 nt, Human
auggucaacacuuaaggguu

SEQ ID NO: 2075545 - RNA, 19 nt, Human
augguauaaugguugacug

SEQ ID NO: 2075546 - RNA, 23 nt, Human
augugaagggaaggaagaggaag

SEQ ID NO: 2075547 - RNA, 12 nt, Human
augugaaucaga

SEQ ID NO: 2075548 - RNA, 15 nt, Human
augugaaucagaccc

SEQ ID NO: 2075549 - RNA, 16 nt, Human
augugaaucagacccu

SEQ ID NO: 2075550 - RNA, 21 nt, Human
augugaaucagacccuacccc

SEQ ID NO: 2075551 - RNA, 20 nt, Human
augugaaugaucucucugaa

SEQ ID NO: 2075552 - RNA, 11 nt, Human
augucuuauuu

SEQ ID NO: 2075553 - RNA, 12 nt, Human
augucuuauuuu

SEQ ID NO: 2075554 - RNA, 15 nt, Human
augucuuauuuuuag

SEQ ID NO: 2075555 - RNA, 16 nt, Human
augucuuauuuuuaga

SEQ ID NO: 2075556 - RNA, 23 nt, Human
augucuuuguuggaaaagaauac

SEQ ID NO: 2075557 - RNA, 22 nt, Human
augucuuuaggcagcagcuuuu

SEQ ID NO: 2075558 - RNA, 13 nt, Human
augucuuguuaau

SEQ ID NO: 2075559 - RNA, 18 nt, Human
augucuuguuaauauucu

SEQ ID NO: 2075560 - RNA, 20 nt, Human
augucuuguuaauauucuuu

SEQ ID NO: 2075561 - RNA, 21 nt, Human
augucuuguuaauauucuuuc

SEQ ID NO: 2075562 - RNA, 17 nt, Human
augucuuugguccucuu

SEQ ID NO: 2075563 - RNA, 21 nt, Human
augucuuugguccucuugcca

SEQ ID NO: 2075564 - RNA, 20 nt, Human
augucuuuguuggaaaagaa

SEQ ID NO: 2075565 - RNA, 14 nt, Human
augugaacuagcug

SEQ ID NO: 2075566 - RNA, 19 nt, Human
augugaacuagcuggaauu

SEQ ID NO: 2075567 - RNA, 13 nt, Human
augugugagugug

SEQ ID NO: 2075568 - RNA, 22 nt, Human
augugugaggagcugcuggcuu

SEQ ID NO: 2075569 - RNA, 16 nt, Human
augugugagugugugc

SEQ ID NO: 2075570 - RNA, 17 nt, Human
augugugagugugugca

SEQ ID NO: 2075571 - RNA, 15 nt, Human
augugugaggagcug

SEQ ID NO: 2075572 - RNA, 19 nt, Human
augugugaggagcugcugg

SEQ ID NO: 2075573 - RNA, 20 nt, Human
augugggcuaguugggcuuc

SEQ ID NO: 2075574 - RNA, 15 nt, Human
augugugcgagugug

SEQ ID NO: 2075575 - RNA, 18 nt, Human
augugugcgagugugugc

SEQ ID NO: 2075576 - RNA, 19 nt, Human
augugugcgagugugugca

SEQ ID NO: 2075577 - RNA, 12 nt, Human
auguucugggac

SEQ ID NO: 2075578 - RNA, 11 nt, Human
auguucuggga

SEQ ID NO: 2075579 - RNA, 13 nt, Human
auguucuggcccu

SEQ ID NO: 2075580 - RNA, 13 nt, Human
auguucugggaca

SEQ ID NO: 2075581 - RNA, 19 nt, Human
auguuugccucugccucug

SEQ ID NO: 2075582 - RNA, 19 nt, Human
auguuucacgaaguuuguu

SEQ ID NO: 2075583 - RNA, 18 nt, Human
auguuucaggaggcugga

SEQ ID NO: 2075584 - RNA, 16 nt, Human
auguuugcuauugaca

SEQ ID NO: 2075585 - RNA, 22 nt, Human
auguuugccucugccucugaca

SEQ ID NO: 2075586 - RNA, 12 nt, Human
auguuuuagcau

SEQ ID NO: 2075587 - RNA, 16 nt, Human
auguuugcucagaaca

SEQ ID NO: 2075588 - RNA, 19 nt, Human
auguuugcucagaacacau

SEQ ID NO: 2075589 - RNA, 22 nt, Human
auguuugcucagaacacauucu

SEQ ID NO: 2075590 - RNA, 22 nt, Human
auguuugcucagcuucuccaac

SEQ ID NO: 2075591 - RNA, 22 nt, Human
auuaaauauguuagcaaagagu

SEQ ID NO: 2075592 - RNA, 15 nt, Human
auuaaauauaauaug

SEQ ID NO: 2075593 - RNA, 15 nt, Human
auuaaauauauguau

SEQ ID NO: 2075594 - RNA, 16 nt, Human
auuaaauauauguaug

SEQ ID NO: 2075595 - RNA, 17 nt, Human
auuaaauauauguaugu

SEQ ID NO: 2075596 - RNA, 18 nt, Human
auuaaauauauguaugua

SEQ ID NO: 2075597 - RNA, 19 nt, Human
auuaaauauauguauguaa

SEQ ID NO: 2075598 - RNA, 21 nt, Human
auuaaauauauguauguaaaa

SEQ ID NO: 2075599 - RNA, 20 nt, Human
auuaaauauguuagcaaaga

SEQ ID NO: 2075600 - RNA, 15 nt, Human
augugggaagaaaca

SEQ ID NO: 2075601 - RNA, 18 nt, Human
augugggaagaaacaaac

SEQ ID NO: 2075602 - RNA, 20 nt, Human
augugggaagaaacaaaccc

SEQ ID NO: 2075603 - RNA, 15 nt, Human
cucgaacccacacug

SEQ ID NO: 2075604 - RNA, 18 nt, Human
cucgaacccacacugcaa

SEQ ID NO: 2075605 - RNA, 20 nt, Human
cuccuuuacccucaucuguc

SEQ ID NO: 2075606 - RNA, 21 nt, Human
cuccuuuacccucaucugucu

SEQ ID NO: 2075607 - RNA, 22 nt, Human
cuccuuuagcgcccaguugggu

SEQ ID NO: 2075608 - RNA, 14 nt, Human
cuccuuucuggcuu

SEQ ID NO: 2075609 - RNA, 17 nt, Human
cuccuuuagcgcccagu

SEQ ID NO: 2075610 - RNA, 16 nt, Human
cuccuuuagcgcccag

SEQ ID NO: 2075611 - RNA, 22 nt, Human
cuccuagccugugccucuggga

SEQ ID NO: 2075612 - RNA, 16 nt, Human
cuccuuugcaggcuca

SEQ ID NO: 2075613 - RNA, 14 nt, Human
cuccuuucuuucua

SEQ ID NO: 2075614 - RNA, 22 nt, Human
cucgaacauggaacucauuccu

SEQ ID NO: 2075615 - RNA, 23 nt, Human
cucgaacauggaacucauuccug

SEQ ID NO: 2075616 - RNA, 21 nt, Human
cucggguggcuagucagagag

SEQ ID NO: 2075617 - RNA, 19 nt, Human
cucgggcgagucacugccu

SEQ ID NO: 2075618 - RNA, 21 nt, Human
cucgggcgagucacugccucu

SEQ ID NO: 2075619 - RNA, 22 nt, Human
cucgggcgagucacugccucuc

SEQ ID NO: 2075620 - RNA, 20 nt, Human
cucguauaugucucaggucc

SEQ ID NO: 2075621 - RNA, 12 nt, Human
cucguccucccc

SEQ ID NO: 2075622 - RNA, 14 nt, Human
cucguccucccccu

SEQ ID NO: 2075623 - RNA, 15 nt, Human
cucguccucccccug

SEQ ID NO: 2075624 - RNA, 14 nt, Human
cucguggccuuccc

SEQ ID NO: 2075625 - RNA, 18 nt, Human
cucguggccuuccccagc

SEQ ID NO: 2075626 - RNA, 21 nt, Human
cucguggccuuccccagccuc

SEQ ID NO: 2075627 - RNA, 20 nt, Human
cucguggccuuccccagccu

SEQ ID NO: 2075628 - RNA, 14 nt, Human
cucguagccaucuc

SEQ ID NO: 2075629 - RNA, 18 nt, Human
cucguauaugucucaggu

SEQ ID NO: 2075630 - RNA, 14 nt, Human
cucgguggacccag

SEQ ID NO: 2075631 - RNA, 11 nt, Human
cucggugccuu

SEQ ID NO: 2075632 - RNA, 18 nt, Human
cucgguggacccagggau

SEQ ID NO: 2075633 - RNA, 16 nt, Human
cucugcacaagcugca

SEQ ID NO: 2075634 - RNA, 15 nt, Human
cucgugguaggacug

SEQ ID NO: 2075635 - RNA, 16 nt, Human
cucgugguaggacugu

SEQ ID NO: 2075636 - RNA, 17 nt, Human
cucgugguaggacugua

SEQ ID NO: 2075637 - RNA, 12 nt, Human
cucucccuguug

SEQ ID NO: 2075638 - RNA, 12 nt, Human
cucucccuggcc

SEQ ID NO: 2075639 - RNA, 13 nt, Human
cucucccuggccc

SEQ ID NO: 2075640 - RNA, 16 nt, Human
cucuccgaccagacac

SEQ ID NO: 2075641 - RNA, 15 nt, Human
cucuccuccugccca

SEQ ID NO: 2075642 - RNA, 19 nt, Human
cucuccuccugcccaccug

SEQ ID NO: 2075643 - RNA, 20 nt, Human
cucuccuccugcccaccugu

SEQ ID NO: 2075644 - RNA, 17 nt, Human
cucucuucugcuccacc

SEQ ID NO: 2075645 - RNA, 15 nt, Human
cucucuugguuuccu

SEQ ID NO: 2075646 - RNA, 18 nt, Human
cucucuucugcuccaccc

SEQ ID NO: 2075647 - RNA, 15 nt, Human
cucucuuuggacucu

SEQ ID NO: 2075648 - RNA, 16 nt, Human
cucucuuuggacucuc

SEQ ID NO: 2075649 - RNA, 15 nt, Human
cucugaacuucagcu

SEQ ID NO: 2075650 - RNA, 19 nt, Human
cucugaacuucagcuagag

SEQ ID NO: 2075651 - RNA, 14 nt, Human
cuccgggagagggg

SEQ ID NO: 2075652 - RNA, 22 nt, Human
cuccgcuuucuacccagcgagc

SEQ ID NO: 2075653 - RNA, 15 nt, Human
cuccguauuucagac

SEQ ID NO: 2075654 - RNA, 13 nt, Human
cuccguauuucag

SEQ ID NO: 2075655 - RNA, 14 nt, Human
cuccguauuucaga

SEQ ID NO: 2075656 - RNA, 13 nt, Human
cuccggugugccu

SEQ ID NO: 2075657 - RNA, 18 nt, Human
cuccggugugccugcagc

SEQ ID NO: 2075658 - RNA, 19 nt, Human
cuccggugugccugcagcc

SEQ ID NO: 2075659 - RNA, 23 nt, Human
cuccggugugccugcagccccgc

SEQ ID NO: 2075660 - RNA, 15 nt, Human
cuccguccagccgcc

SEQ ID NO: 2075661 - RNA, 20 nt, Human
cuccgcuuucuacccagcga

SEQ ID NO: 2075662 - RNA, 21 nt, Human
cuccgcuuucuacccagcgag

SEQ ID NO: 2075663 - RNA, 11 nt, Human
cucccagccug

SEQ ID NO: 2075664 - RNA, 15 nt, Human
cucccagcucuagac

SEQ ID NO: 2075665 - RNA, 18 nt, Human
cucccagcucuagacaac

SEQ ID NO: 2075666 - RNA, 20 nt, Human
cucccagcucuagacaaccc

SEQ ID NO: 2075667 - RNA, 23 nt, Human
cucccagcucuagacaacccugc

SEQ ID NO: 2075668 - RNA, 11 nt, Human
cuccccagggg

SEQ ID NO: 2075669 - RNA, 21 nt, Human
cuccccaggggagagggucug

SEQ ID NO: 2075670 - RNA, 16 nt, Human
cucccucccucuuucc

SEQ ID NO: 2075671 - RNA, 18 nt, Human
cucccuccccugccauuu

SEQ ID NO: 2075672 - RNA, 15 nt, Human
cucccuccccugccc

SEQ ID NO: 2075673 - RNA, 16 nt, Human
cucccuccccugcccu

SEQ ID NO: 2075674 - RNA, 18 nt, Human
cucccuccccugcccucg

SEQ ID NO: 2075675 - RNA, 18 nt, Human
cucccuccccugcccugg

SEQ ID NO: 2075676 - RNA, 21 nt, Human
cucccuccccugcccuggucc

SEQ ID NO: 2075677 - RNA, 18 nt, Human
cucccucccccugccccu

SEQ ID NO: 2075678 - RNA, 11 nt, Human
cucccuccccu

SEQ ID NO: 2075679 - RNA, 13 nt, Human
cucccuccccugc

SEQ ID NO: 2075680 - RNA, 14 nt, Human
cucccuccccugcc

SEQ ID NO: 2075681 - RNA, 15 nt, Human
cucccuccccugcca

SEQ ID NO: 2075682 - RNA, 15 nt, Human
cucccucuuucccuc

SEQ ID NO: 2075683 - RNA, 18 nt, Human
cucccucuggcccugccu

SEQ ID NO: 2075684 - RNA, 19 nt, Human
cucccucuggcccugccuu

SEQ ID NO: 2075685 - RNA, 20 nt, Human
cucccucuggcccugccuuc

SEQ ID NO: 2075686 - RNA, 21 nt, Human
cucccucugaccugcaggcca

SEQ ID NO: 2075687 - RNA, 17 nt, Human
cucccucuccugccuac

SEQ ID NO: 2075688 - RNA, 14 nt, Human
cucccucugccggc

SEQ ID NO: 2075689 - RNA, 17 nt, Human
cucccucugccggcucu

SEQ ID NO: 2075690 - RNA, 22 nt, Human
cucccucugccugaaccuucca

SEQ ID NO: 2075691 - RNA, 14 nt, Human
cucccucuggcccu

SEQ ID NO: 2075692 - RNA, 15 nt, Human
cucccucuggcccug

SEQ ID NO: 2075693 - RNA, 17 nt, Human
cucccucuggcccugcc

SEQ ID NO: 2075694 - RNA, 23 nt, Human
cucccuccccugcccugguccag

SEQ ID NO: 2075695 - RNA, 13 nt, Human
cucccucuccugc

SEQ ID NO: 2075696 - RNA, 14 nt, Human
cucccucuccugcc

SEQ ID NO: 2075697 - RNA, 15 nt, Human
cucccucuccugccu

SEQ ID NO: 2075698 - RNA, 15 nt, Human
cucccucucucuucu

SEQ ID NO: 2075699 - RNA, 16 nt, Human
cucccucucucuucug

SEQ ID NO: 2075700 - RNA, 17 nt, Human
cucccucucucuucugc

SEQ ID NO: 2075701 - RNA, 20 nt, Human
cucccucucucuucugcucc

SEQ ID NO: 2075702 - RNA, 21 nt, Human
cucccucucucuucugcucca

SEQ ID NO: 2075703 - RNA, 22 nt, Human
cucccucucucuucugcuccac

SEQ ID NO: 2075704 - RNA, 13 nt, Human
cucccucugaccu

SEQ ID NO: 2075705 - RNA, 14 nt, Human
cucccucugaccug

SEQ ID NO: 2075706 - RNA, 17 nt, Human
cucccucugaccugcag

SEQ ID NO: 2075707 - RNA, 18 nt, Human
cucccucugaccugcagg

SEQ ID NO: 2075708 - RNA, 19 nt, Human
cucccucuuucccucccuu

SEQ ID NO: 2075709 - RNA, 22 nt, Human
cucccagauuucagucuuuucc

SEQ ID NO: 2075710 - RNA, 18 nt, Human
cucccagccccugccccu

SEQ ID NO: 2075711 - RNA, 19 nt, Human
cucccagccccugccccuc

SEQ ID NO: 2075712 - RNA, 17 nt, Human
cucccaccucagccucc

SEQ ID NO: 2075713 - RNA, 16 nt, Human
cucccaccucagccuc

SEQ ID NO: 2075714 - RNA, 14 nt, Human
cuccauacucagga

SEQ ID NO: 2075715 - RNA, 14 nt, Human
cucccaccucagcc

SEQ ID NO: 2075716 - RNA, 19 nt, Human
cuccaguggaagaagaaaa

SEQ ID NO: 2075717 - RNA, 11 nt, Human
cuccagggcca

SEQ ID NO: 2075718 - RNA, 16 nt, Human
cuccagggccacgugc

SEQ ID NO: 2075719 - RNA, 17 nt, Human
cuccaguuuucaguuga

SEQ ID NO: 2075720 - RNA, 22 nt, Human
cuccaggcuguaucccaugagc

SEQ ID NO: 2075721 - RNA, 23 nt, Human
cuccaggcuguaucccaugagcc

SEQ ID NO: 2075722 - RNA, 17 nt, Human
cuccaggcugucuuuca

SEQ ID NO: 2075723 - RNA, 22 nt, Human
cucagacaggaaagggaaggcc

SEQ ID NO: 2075724 - RNA, 20 nt, Human
cuccagacaaaccagaagca

SEQ ID NO: 2075725 - RNA, 16 nt, Human
cucagaaucucaaaua

SEQ ID NO: 2075726 - RNA, 17 nt, Human
cucagaaucucaaauaa

SEQ ID NO: 2075727 - RNA, 19 nt, Human
cucagaaucuuuccuuccu

SEQ ID NO: 2075728 - RNA, 19 nt, Human
cucugcacaagcugcaccc

SEQ ID NO: 2075729 - RNA, 17 nt, Human
cucugcacaagcugcac

SEQ ID NO: 2075730 - RNA, 18 nt, Human
cucugcacaagcugcacc

SEQ ID NO: 2075731 - RNA, 13 nt, Human
cucuugagccugg

SEQ ID NO: 2075732 - RNA, 14 nt, Human
cucuugagccuggg

SEQ ID NO: 2075733 - RNA, 15 nt, Human
cucuugagccuggga

SEQ ID NO: 2075734 - RNA, 16 nt, Human
cucuugagccugggag

SEQ ID NO: 2075735 - RNA, 14 nt, Human
cucuugaggccagg

SEQ ID NO: 2075736 - RNA, 16 nt, Human
cucuugaggccaggag

SEQ ID NO: 2075737 - RNA, 17 nt, Human
cucuugaggccaggagu

SEQ ID NO: 2075738 - RNA, 14 nt, Human
cucuugagggagcu

SEQ ID NO: 2075739 - RNA, 15 nt, Human
cucuugagggagcuu

SEQ ID NO: 2075740 - RNA, 22 nt, Human
cucuugccacugccucuuccuc

SEQ ID NO: 2075741 - RNA, 14 nt, Human
cucuugcagagaag

SEQ ID NO: 2075742 - RNA, 15 nt, Human
cucuugcagagaagc

SEQ ID NO: 2075743 - RNA, 17 nt, Human
cucuugcagagaagccu

SEQ ID NO: 2075744 - RNA, 14 nt, Human
cucuuuuuguuuuu

SEQ ID NO: 2075745 - RNA, 12 nt, Human
cucuugcccccc

SEQ ID NO: 2075746 - RNA, 13 nt, Human
cucuugcccccca

SEQ ID NO: 2075747 - RNA, 16 nt, Human
cucuugccccccaccc

SEQ ID NO: 2075748 - RNA, 19 nt, Human
cucuugccccccaccccag

SEQ ID NO: 2075749 - RNA, 20 nt, Human
cucuugccccccaccccagc

SEQ ID NO: 2075750 - RNA, 22 nt, Human
cucuugccccccaccccagccu

SEQ ID NO: 2075751 - RNA, 14 nt, Human
cugaccccccucag

SEQ ID NO: 2075752 - RNA, 15 nt, Human
cugaccccccucagg

SEQ ID NO: 2075753 - RNA, 19 nt, Human
cugaccccccucaggaccc

SEQ ID NO: 2075754 - RNA, 20 nt, Human
cugaccccccucaggacccu

SEQ ID NO: 2075755 - RNA, 23 nt, Human
cugaccccccucaggacccucgc

SEQ ID NO: 2075756 - RNA, 14 nt, Human
cugacacguccacc

SEQ ID NO: 2075757 - RNA, 17 nt, Human
cugacacguccacccca

SEQ ID NO: 2075758 - RNA, 21 nt, Human
cugacacaugcugaacaucac

SEQ ID NO: 2075759 - RNA, 23 nt, Human
cugacacacagcucuguccuggg

SEQ ID NO: 2075760 - RNA, 22 nt, Human
cugacacacagcucuguccugg

SEQ ID NO: 2075761 - RNA, 21 nt, Human
cugacacacagcucuguccug

SEQ ID NO: 2075762 - RNA, 20 nt, Human
cugacacacagcucuguccu

SEQ ID NO: 2075763 - RNA, 19 nt, Human
cugacacacagcucugucc

SEQ ID NO: 2075764 - RNA, 18 nt, Human
cugacacacagcucuguc

SEQ ID NO: 2075765 - RNA, 17 nt, Human
cugacacacagcucugu

SEQ ID NO: 2075766 - RNA, 16 nt, Human
cugacacacagcucug

SEQ ID NO: 2075767 - RNA, 15 nt, Human
cugacacacagcucu

SEQ ID NO: 2075768 - RNA, 13 nt, Human
cugacacacagcu

SEQ ID NO: 2075769 - RNA, 13 nt, Human
cugacaaucaacu

SEQ ID NO: 2075770 - RNA, 21 nt, Human
cugacaaucaacucuaauagu

SEQ ID NO: 2075771 - RNA, 18 nt, Human
cugacacaaaaaaaguug

SEQ ID NO: 2075772 - RNA, 18 nt, Human
cugacacaaaaaguagau

SEQ ID NO: 2075773 - RNA, 11 nt, Human
cugaaagccac

SEQ ID NO: 2075774 - RNA, 12 nt, Human
cugaaagccacg

SEQ ID NO: 2075775 - RNA, 14 nt, Human
cugaagcagaugca

SEQ ID NO: 2075776 - RNA, 14 nt, Human
cugaaaauguaugu

SEQ ID NO: 2075777 - RNA, 14 nt, Human
cugaaagaggccaa

SEQ ID NO: 2075778 - RNA, 22 nt, Human
cugaagcagaugcaaagaggca

SEQ ID NO: 2075779 - RNA, 19 nt, Human
cugaggaaucaacagggca

SEQ ID NO: 2075780 - RNA, 20 nt, Human
cugaggaaucaacagggcag

SEQ ID NO: 2075781 - RNA, 21 nt, Human
cugaggaaucaacagggcagc

SEQ ID NO: 2075782 - RNA, 21 nt, Human
cugaggggaggaucacuggag

SEQ ID NO: 2075783 - RNA, 23 nt, Human
cugaggaauccagacccggcugc

SEQ ID NO: 2075784 - RNA, 16 nt, Human
cugaggggcaucugcc

SEQ ID NO: 2075785 - RNA, 17 nt, Human
cugaggggcaucugccc

SEQ ID NO: 2075786 - RNA, 19 nt, Human
cugaggggcaacgaagaaa

SEQ ID NO: 2075787 - RNA, 21 nt, Human
cugaggggcaacgaagaaaaa

SEQ ID NO: 2075788 - RNA, 22 nt, Human
cugaggggcaacgaagaaaaaa

SEQ ID NO: 2075789 - RNA, 22 nt, Human
cugaggggaggaucacuggagc

SEQ ID NO: 2075790 - RNA, 23 nt, Human
cugaggggaggaucacuggagcc

SEQ ID NO: 2075791 - RNA, 20 nt, Human
cugaggggcaucugccccuc

SEQ ID NO: 2075792 - RNA, 18 nt, Human
cugaggggcaucugcccc

SEQ ID NO: 2075793 - RNA, 19 nt, Human
cugaggggcaucugccccu

SEQ ID NO: 2075794 - RNA, 13 nt, Human
cugaggugggagg

SEQ ID NO: 2075795 - RNA, 22 nt, Human
cugaggugggaggaucucuuga

SEQ ID NO: 2075796 - RNA, 14 nt, Human
cugaggugggcaga

SEQ ID NO: 2075797 - RNA, 20 nt, Human
cugaggugggcagaucacga

SEQ ID NO: 2075798 - RNA, 18 nt, Human
cugagcuuggccagaagg

SEQ ID NO: 2075799 - RNA, 16 nt, Human
cugagcuucucuguga

SEQ ID NO: 2075800 - RNA, 15 nt, Human
cugagcuucucugug

SEQ ID NO: 2075801 - RNA, 12 nt, Human
cugagcuuggcc

SEQ ID NO: 2075802 - RNA, 15 nt, Human
cugagcuuggccaga

SEQ ID NO: 2075803 - RNA, 16 nt, Human
cugagcuuggccagaa

SEQ ID NO: 2075804 - RNA, 17 nt, Human
cugagcuuggccagaag

SEQ ID NO: 2075805 - RNA, 16 nt, Human
cugagcugccauccag

SEQ ID NO: 2075806 - RNA, 15 nt, Human
cugagcugccaucca

SEQ ID NO: 2075807 - RNA, 19 nt, Human
cugacccugcuucaaauau

SEQ ID NO: 2075808 - RNA, 18 nt, Human
cugacccucuccacccca

SEQ ID NO: 2075809 - RNA, 13 nt, Human
cugacccugcaga

SEQ ID NO: 2075810 - RNA, 17 nt, Human
cugacccugcagagaug

SEQ ID NO: 2075811 - RNA, 18 nt, Human
cugacccugcagagaugc

SEQ ID NO: 2075812 - RNA, 14 nt, Human
cuauuuuucagaau

SEQ ID NO: 2075813 - RNA, 15 nt, Human
cuauuuuuauuuaua

SEQ ID NO: 2075814 - RNA, 17 nt, Human
cuauguugcccaggcag

SEQ ID NO: 2075815 - RNA, 16 nt, Human
cuauguugcccaggca

SEQ ID NO: 2075816 - RNA, 18 nt, Human
cucaaaaaaagaaaaaga

SEQ ID NO: 2075817 - RNA, 18 nt, Human
cuauuuuuauuuauauuu

SEQ ID NO: 2075818 - RNA, 16 nt, Human
cuauuuuuauuuauau

SEQ ID NO: 2075819 - RNA, 22 nt, Human
cucaaagaaauuuccacucagg

SEQ ID NO: 2075820 - RNA, 17 nt, Human
cucaaacugccuuggcu

SEQ ID NO: 2075821 - RNA, 11 nt, Human
cucaaaggcac

SEQ ID NO: 2075822 - RNA, 23 nt, Human
cucaaagugacuauucaguuuuc

SEQ ID NO: 2075823 - RNA, 17 nt, Human
cucaaaguuaaccuacc

SEQ ID NO: 2075824 - RNA, 14 nt, Human
cuauguauggaaua

SEQ ID NO: 2075825 - RNA, 22 nt, Human
cuauguauggaauacaguguua

SEQ ID NO: 2075826 - RNA, 14 nt, Human
cuauguugcccagg

SEQ ID NO: 2075827 - RNA, 17 nt, Human
cuauguggcuguaucuu

SEQ ID NO: 2075828 - RNA, 15 nt, Human
cuauguugcccaggc

SEQ ID NO: 2075829 - RNA, 22 nt, Human
cuauguguagggcgggaggaug

SEQ ID NO: 2075830 - RNA, 19 nt, Human
cuauguaucaaugaguaac

SEQ ID NO: 2075831 - RNA, 17 nt, Human
cucacaacagcugccug

SEQ ID NO: 2075832 - RNA, 12 nt, Human
cucaaauaacua

SEQ ID NO: 2075833 - RNA, 14 nt, Human
cucacccgaggcug

SEQ ID NO: 2075834 - RNA, 22 nt, Human
cucaccuugcaacacacagaca

SEQ ID NO: 2075835 - RNA, 14 nt, Human
cucacuucacccug

SEQ ID NO: 2075836 - RNA, 14 nt, Human
cucacuuuucucca

SEQ ID NO: 2075837 - RNA, 19 nt, Human
cucaccuugcaacacacag

SEQ ID NO: 2075838 - RNA, 20 nt, Human
cucaccuugcaacacacaga

SEQ ID NO: 2075839 - RNA, 21 nt, Human
cucaccuugcaacacacagac

SEQ ID NO: 2075840 - RNA, 20 nt, Human
cucaccuugaacaccacgcu

SEQ ID NO: 2075841 - RNA, 22 nt, Human
cucaccuugaacaccacgcuug

SEQ ID NO: 2075842 - RNA, 18 nt, Human
cucaccuugcaacacaca

SEQ ID NO: 2075843 - RNA, 19 nt, Human
cucaccugggcaccugggg

SEQ ID NO: 2075844 - RNA, 21 nt, Human
cucaccugcuggccccucacc

SEQ ID NO: 2075845 - RNA, 20 nt, Human
cucaccugggcaccugggga

SEQ ID NO: 2075846 - RNA, 21 nt, Human
cucaccugggcaccuggggag

SEQ ID NO: 2075847 - RNA, 11 nt, Human
cucaccugggg

SEQ ID NO: 2075848 - RNA, 12 nt, Human
cucaccuggggu

SEQ ID NO: 2075849 - RNA, 21 nt, Human
cucaccuggggugugggaggc

SEQ ID NO: 2075850 - RNA, 15 nt, Human
cucacuuuucuccau

SEQ ID NO: 2075851 - RNA, 16 nt, Human
cucagaagguauuccu

SEQ ID NO: 2075852 - RNA, 19 nt, Human
cucagaagguauuccuuuu

SEQ ID NO: 2075853 - RNA, 13 nt, Human
cucagaagguauu

SEQ ID NO: 2075854 - RNA, 22 nt, Human
cucaccucuggacuggcuagag

SEQ ID NO: 2075855 - RNA, 15 nt, Human
cucaccucuggacug

SEQ ID NO: 2075856 - RNA, 21 nt, Human
cucaccucuggacuggcuaga

SEQ ID NO: 2075857 - RNA, 16 nt, Human
cucaccucuaaaacag

SEQ ID NO: 2075858 - RNA, 12 nt, Human
cucaccucugcc

SEQ ID NO: 2075859 - RNA, 13 nt, Human
cucaccucugccu

SEQ ID NO: 2075860 - RNA, 14 nt, Human
cucaccucugccuc

SEQ ID NO: 2075861 - RNA, 15 nt, Human
cucaccucugccuca

SEQ ID NO: 2075862 - RNA, 16 nt, Human
cucaccucugccucaa

SEQ ID NO: 2075863 - RNA, 18 nt, Human
cucaccucugccucaaug

SEQ ID NO: 2075864 - RNA, 19 nt, Human
cucaccucugccucaaugu

SEQ ID NO: 2075865 - RNA, 14 nt, Human
cucaccucuggacu

SEQ ID NO: 2075866 - RNA, 15 nt, Human
cucaccugcuggccc

SEQ ID NO: 2075867 - RNA, 16 nt, Human
cucaccugcuggcccc

SEQ ID NO: 2075868 - RNA, 18 nt, Human
cucaccugcuggccccuc

SEQ ID NO: 2075869 - RNA, 19 nt, Human
cucaccugcuggccccuca

SEQ ID NO: 2075870 - RNA, 23 nt, Human
cucaccuaauguuuaugagccag

SEQ ID NO: 2075871 - RNA, 21 nt, Human
cucaccguggcuaagaguguc

SEQ ID NO: 2075872 - RNA, 12 nt, Human
cuaggccugggg

SEQ ID NO: 2075873 - RNA, 13 nt, Human
cuaggccugggga

SEQ ID NO: 2075874 - RNA, 19 nt, Human
cuaggccuggcauggcacc

SEQ ID NO: 2075875 - RNA, 20 nt, Human
cuaggccuggcauggcaccu

SEQ ID NO: 2075876 - RNA, 15 nt, Human
cuaggcgugagaagc

SEQ ID NO: 2075877 - RNA, 19 nt, Human
cuaggccuggccagaugca

SEQ ID NO: 2075878 - RNA, 18 nt, Human
cuaggccuggccagaugc

SEQ ID NO: 2075879 - RNA, 15 nt, Human
cuaggccuggccaga

SEQ ID NO: 2075880 - RNA, 14 nt, Human
cuaggccuggccag

SEQ ID NO: 2075881 - RNA, 13 nt, Human
cuaggccuggcca

SEQ ID NO: 2075882 - RNA, 12 nt, Human
cuaggccgggcg

SEQ ID NO: 2075883 - RNA, 13 nt, Human
cuagaauuuauuc

SEQ ID NO: 2075884 - RNA, 12 nt, Human
cuagaauuuauu

SEQ ID NO: 2075885 - RNA, 21 nt, Human
cuagaauuuaucacacuucug

SEQ ID NO: 2075886 - RNA, 22 nt, Human
cuagaaucagccuaggggucag

SEQ ID NO: 2075887 - RNA, 13 nt, Human
cuauaaaacaggu

SEQ ID NO: 2075888 - RNA, 13 nt, Human
cuaggguggcccu

SEQ ID NO: 2075889 - RNA, 17 nt, Human
cuaggguggcccuugca

SEQ ID NO: 2075890 - RNA, 20 nt, Human
cuaguuccugaugacccagg

SEQ ID NO: 2075891 - RNA, 22 nt, Human
cuaguuccugaugacccaggcu

SEQ ID NO: 2075892 - RNA, 14 nt, Human
cuagggaagauaau

SEQ ID NO: 2075893 - RNA, 21 nt, Human
cuaggggucagggaccaagga

SEQ ID NO: 2075894 - RNA, 15 nt, Human
cuagggagagacccu

SEQ ID NO: 2075895 - RNA, 14 nt, Human
cuagggaggaccuu

SEQ ID NO: 2075896 - RNA, 21 nt, Human
cuagggaggaccuuaucugug

SEQ ID NO: 2075897 - RNA, 23 nt, Human
cuagggaggaccuuaucugugcg

SEQ ID NO: 2075898 - RNA, 15 nt, Human
cuaggcuggagccca

SEQ ID NO: 2075899 - RNA, 14 nt, Human
cuagggaaggccac

SEQ ID NO: 2075900 - RNA, 16 nt, Human
cuagggaaggccaccu

SEQ ID NO: 2075901 - RNA, 17 nt, Human
cuagggaaggccaccug

SEQ ID NO: 2075902 - RNA, 18 nt, Human
cuagggaaggccaccugc

SEQ ID NO: 2075903 - RNA, 19 nt, Human
cuagggaaggccaccugca

SEQ ID NO: 2075904 - RNA, 20 nt, Human
cuagggaaggccaccugcag

SEQ ID NO: 2075905 - RNA, 21 nt, Human
cuagggaaggccaccugcagg

SEQ ID NO: 2075906 - RNA, 11 nt, Human
cuagggaagaa

SEQ ID NO: 2075907 - RNA, 20 nt, Human
cuagggaagaaagcagaaca

SEQ ID NO: 2075908 - RNA, 13 nt, Human
cuagggaccuggg

SEQ ID NO: 2075909 - RNA, 14 nt, Human
cuagggaccugggg

SEQ ID NO: 2075910 - RNA, 18 nt, Human
cuagggaccuggggaagc

SEQ ID NO: 2075911 - RNA, 14 nt, Human
cuagggagagaccc

SEQ ID NO: 2075912 - RNA, 18 nt, Human
cuaccuuccaguuccuca

SEQ ID NO: 2075913 - RNA, 15 nt, Human
cuaccugaucccacu

SEQ ID NO: 2075914 - RNA, 16 nt, Human
cuaccugaucccacuc

SEQ ID NO: 2075915 - RNA, 17 nt, Human
cuaccugaucccacucc

SEQ ID NO: 2075916 - RNA, 20 nt, Human
cuaccugauuggugcaaccc

SEQ ID NO: 2075917 - RNA, 15 nt, Human
cuaccuucaaagcug

SEQ ID NO: 2075918 - RNA, 16 nt, Human
cuaccuucaaagcuga

SEQ ID NO: 2075919 - RNA, 23 nt, Human
cuaccuugaggucuuuugacaug

SEQ ID NO: 2075920 - RNA, 22 nt, Human
cuaccuugaggucuuuugacau

SEQ ID NO: 2075921 - RNA, 16 nt, Human
cuacuacaucgcccuc

SEQ ID NO: 2075922 - RNA, 18 nt, Human
cuacuacaucgcccucca

SEQ ID NO: 2075923 - RNA, 13 nt, Human
cuacuaaugaugu

SEQ ID NO: 2075924 - RNA, 14 nt, Human
cuacuaaugauguu

SEQ ID NO: 2075925 - RNA, 15 nt, Human
cuacuaaaaauacaa

SEQ ID NO: 2075926 - RNA, 18 nt, Human
cuacuaaaaauacaaaca

SEQ ID NO: 2075927 - RNA, 19 nt, Human
cuacuaaaaauacaaacaa

SEQ ID NO: 2075928 - RNA, 18 nt, Human
cuacuagggaccugggga

SEQ ID NO: 2075929 - RNA, 20 nt, Human
cuacuagggaccuggggaag

SEQ ID NO: 2075930 - RNA, 21 nt, Human
cuacuagggaccuggggaagc

SEQ ID NO: 2075931 - RNA, 15 nt, Human
cuacuagaugucuuu

SEQ ID NO: 2075932 - RNA, 21 nt, Human
cuacuacaucgcccuccacau

SEQ ID NO: 2075933 - RNA, 18 nt, Human
cuacuaugccagaugccu

SEQ ID NO: 2075934 - RNA, 16 nt, Human
cuacucaagaggcuga

SEQ ID NO: 2075935 - RNA, 20 nt, Human
cuacucaagaggcugaggca

SEQ ID NO: 2075936 - RNA, 15 nt, Human
cuacucacagucucu

SEQ ID NO: 2075937 - RNA, 17 nt, Human
cuacucacagucucuuu

SEQ ID NO: 2075938 - RNA, 18 nt, Human
cuacucacagucucuuua

SEQ ID NO: 2075939 - RNA, 23 nt, Human
cuacucaccuugaacaccacgcu

SEQ ID NO: 2075940 - RNA, 13 nt, Human
cuacucacucaag

SEQ ID NO: 2075941 - RNA, 21 nt, Human
cgagguuucucaaagaaauuu

SEQ ID NO: 2075942 - RNA, 21 nt, Human
cgaggucaacagagaaggcag

SEQ ID NO: 2075943 - RNA, 20 nt, Human
cgagguggaucacagaggcu

SEQ ID NO: 2075944 - RNA, 16 nt, Human
cgagguaugaggucua

SEQ ID NO: 2075945 - RNA, 15 nt, Human
cgaggucaacagaga

SEQ ID NO: 2075946 - RNA, 16 nt, Human
cgaggucaacagagaa

SEQ ID NO: 2075947 - RNA, 17 nt, Human
cgaggucaacagagaag

SEQ ID NO: 2075948 - RNA, 23 nt, Human
cgaggucaacagagaaggcagga

SEQ ID NO: 2075949 - RNA, 21 nt, Human
cgauacaccgggccuggagaa

SEQ ID NO: 2075950 - RNA, 20 nt, Human
cgauacaccgggccuggaga

SEQ ID NO: 2075951 - RNA, 18 nt, Human
cgauacaccgggccugga

SEQ ID NO: 2075952 - RNA, 15 nt, Human
cgagguggcugccug

SEQ ID NO: 2075953 - RNA, 20 nt, Human
cgagguggcugccuggagcc

SEQ ID NO: 2075954 - RNA, 22 nt, Human
cgagguggaucacagaggcuuc

SEQ ID NO: 2075955 - RNA, 23 nt, Human
cgagguggaucacagaggcuucu

SEQ ID NO: 2075956 - RNA, 14 nt, Human
cgcuggcugggggc

SEQ ID NO: 2075957 - RNA, 20 nt, Human
cgcuggcugggggccucacu

SEQ ID NO: 2075958 - RNA, 23 nt, Human
cgccuuagguacuuauuccagau

SEQ ID NO: 2075959 - RNA, 22 nt, Human
cgccuucacuccggugugccug

SEQ ID NO: 2075960 - RNA, 23 nt, Human
cgcuggaccuugaacuggguacu

SEQ ID NO: 2075961 - RNA, 19 nt, Human
cgcuggaccuugaacuggg

SEQ ID NO: 2075962 - RNA, 20 nt, Human
cgcugcucuuaugccauuug

SEQ ID NO: 2075963 - RNA, 20 nt, Human
cgccuguaguccuagccacu

SEQ ID NO: 2075964 - RNA, 13 nt, Human
cgcaugcagcagc

SEQ ID NO: 2075965 - RNA, 14 nt, Human
cgcaugcagcagcu

SEQ ID NO: 2075966 - RNA, 13 nt, Human
cgcaucuucucca

SEQ ID NO: 2075967 - RNA, 14 nt, Human
cgcaucuucuccau

SEQ ID NO: 2075968 - RNA, 15 nt, Human
cgcaucuucuccauc

SEQ ID NO: 2075969 - RNA, 16 nt, Human
cgcaucuucuccaucu

SEQ ID NO: 2075970 - RNA, 21 nt, Human
cgcaucuucuccaucuggcag

SEQ ID NO: 2075971 - RNA, 20 nt, Human
cgccuguagucccagcuacu

SEQ ID NO: 2075972 - RNA, 17 nt, Human
cgccuguaguccuagcc

SEQ ID NO: 2075973 - RNA, 13 nt, Human
cgcaucagacaga

SEQ ID NO: 2075974 - RNA, 15 nt, Human
cgugucccucucgga

SEQ ID NO: 2075975 - RNA, 15 nt, Human
cgugucgugggugug

SEQ ID NO: 2075976 - RNA, 14 nt, Human
cguuaccaggcagg

SEQ ID NO: 2075977 - RNA, 21 nt, Human
cguuacuagcagucacuugau

SEQ ID NO: 2075978 - RNA, 11 nt, Human
cguuaacauug

SEQ ID NO: 2075979 - RNA, 22 nt, Human
cguuaacauugaccaagaacug

SEQ ID NO: 2075980 - RNA, 17 nt, Human
cguuaacuguguaugua

SEQ ID NO: 2075981 - RNA, 19 nt, Human
cguuaacuguguauguaca

SEQ ID NO: 2075982 - RNA, 14 nt, Human
cuaaaggaaaaaac

SEQ ID NO: 2075983 - RNA, 19 nt, Human
cuaaaggaaaaaaccaucc

SEQ ID NO: 2075984 - RNA, 18 nt, Human
cuaaagagagaauguaga

SEQ ID NO: 2075985 - RNA, 19 nt, Human
cuaaagagagaauguagau

SEQ ID NO: 2075986 - RNA, 21 nt, Human
cuaaagaagguuucagaaaga

SEQ ID NO: 2075987 - RNA, 21 nt, Human
cuaaagacccuaaaucugagg

SEQ ID NO: 2075988 - RNA, 16 nt, Human
cuaaagagagaaugua

SEQ ID NO: 2075989 - RNA, 13 nt, Human
cuaaaggccucuu

SEQ ID NO: 2075990 - RNA, 20 nt, Human
cuaacugcuacaaauacucu

SEQ ID NO: 2075991 - RNA, 14 nt, Human
cuaacuccagugaa

SEQ ID NO: 2075992 - RNA, 14 nt, Human
cuaacucugaugua

SEQ ID NO: 2075993 - RNA, 15 nt, Human
cuaacucugauguaa

SEQ ID NO: 2075994 - RNA, 16 nt, Human
cuaacucugauguaaa

SEQ ID NO: 2075995 - RNA, 17 nt, Human
cuaacucugauguaaau

SEQ ID NO: 2075996 - RNA, 21 nt, Human
cuaacucugauguaaaugaag

SEQ ID NO: 2075997 - RNA, 19 nt, Human
cuaacucagaaacaucagu

SEQ ID NO: 2075998 - RNA, 13 nt, Human
cuaacuggaagca

SEQ ID NO: 2075999 - RNA, 13 nt, Human
cgguucaccagcc

SEQ ID NO: 2076000 - RNA, 14 nt, Human
cgguucaccagccu

SEQ ID NO: 2076001 - RNA, 15 nt, Human
cgguucaccagccuc

SEQ ID NO: 2076002 - RNA, 16 nt, Human
cgguucaccagccucu

SEQ ID NO: 2076003 - RNA, 15 nt, Human
cgguugcuucuggga

SEQ ID NO: 2076004 - RNA, 22 nt, Human
cggugguuguuggggcuucuug

SEQ ID NO: 2076005 - RNA, 15 nt, Human
cgguguccauuuaua

SEQ ID NO: 2076006 - RNA, 21 nt, Human
cgguguccauuuauagaauaa

SEQ ID NO: 2076007 - RNA, 15 nt, Human
cggugugccugcagc

SEQ ID NO: 2076008 - RNA, 17 nt, Human
cggugugccugcagccc

SEQ ID NO: 2076009 - RNA, 20 nt, Human
cggugugccugcagccccgc

SEQ ID NO: 2076010 - RNA, 15 nt, Human
cggagacggaguccc

SEQ ID NO: 2076011 - RNA, 15 nt, Human
cggagacagugaucu

SEQ ID NO: 2076012 - RNA, 19 nt, Human
cggugggcauuugugaggc

SEQ ID NO: 2076013 - RNA, 20 nt, Human
cccaggcuggagugcaauga

SEQ ID NO: 2076014 - RNA, 18 nt, Human
cccaggcugccugagcac

SEQ ID NO: 2076015 - RNA, 20 nt, Human
cccaggcugccugagcaccu

SEQ ID NO: 2076016 - RNA, 18 nt, Human
cccaucagcuccagcugc

SEQ ID NO: 2076017 - RNA, 13 nt, Human
cccaucacuggag

SEQ ID NO: 2076018 - RNA, 15 nt, Human
cccaucacuggagca

SEQ ID NO: 2076019 - RNA, 20 nt, Human
cccaucacuggagcaccagg

SEQ ID NO: 2076020 - RNA, 14 nt, Human
cccaucagaaggag

SEQ ID NO: 2076021 - RNA, 15 nt, Human
cccagggaaguuuug

SEQ ID NO: 2076022 - RNA, 14 nt, Human
cccagggagaggcc

SEQ ID NO: 2076023 - RNA, 18 nt, Human
cccagggagaggccauga

SEQ ID NO: 2076024 - RNA, 15 nt, Human
cccagggagcggaaa

SEQ ID NO: 2076025 - RNA, 16 nt, Human
cccaucacgccugugc

SEQ ID NO: 2076026 - RNA, 20 nt, Human
cccagggagcggaaagcagc

SEQ ID NO: 2076027 - RNA, 21 nt, Human
cccaucacaggguugggccca

SEQ ID NO: 2076028 - RNA, 22 nt, Human
cccaucacaggguugggcccag

SEQ ID NO: 2076029 - RNA, 19 nt, Human
cccacuccuaggacauguu

SEQ ID NO: 2076030 - RNA, 21 nt, Human
cccacuggggaaauaacagcu

SEQ ID NO: 2076031 - RNA, 15 nt, Human
cccacuggcagcauc

SEQ ID NO: 2076032 - RNA, 12 nt, Human
cccacuggcugu

SEQ ID NO: 2076033 - RNA, 15 nt, Human
cccacuggcuguggg

SEQ ID NO: 2076034 - RNA, 16 nt, Human
cccacuggcugugggc

SEQ ID NO: 2076035 - RNA, 21 nt, Human
cccacuggcugugggcucccu

SEQ ID NO: 2076036 - RNA, 22 nt, Human
cccacuggcugugggcucccuu

SEQ ID NO: 2076037 - RNA, 23 nt, Human
cccacuggcugugggcucccuuc

SEQ ID NO: 2076038 - RNA, 17 nt, Human
cccagcacuaaagcagu

SEQ ID NO: 2076039 - RNA, 17 nt, Human
cccagcaccaccagguc

SEQ ID NO: 2076040 - RNA, 18 nt, Human
cccagcaccaccaggucu

SEQ ID NO: 2076041 - RNA, 19 nt, Human
cccagcaccaccaggucuc

SEQ ID NO: 2076042 - RNA, 13 nt, Human
cccagcacccagc

SEQ ID NO: 2076043 - RNA, 15 nt, Human
cccagcacccagcaa

SEQ ID NO: 2076044 - RNA, 16 nt, Human
cccagcacuaaagcag

SEQ ID NO: 2076045 - RNA, 10 nt, Human
cccagccauu

SEQ ID NO: 2076046 - RNA, 12 nt, Human
cccagcugcccc

SEQ ID NO: 2076047 - RNA, 14 nt, Human
cccagcugccccuc

SEQ ID NO: 2076048 - RNA, 15 nt, Human
cccagcugccccucc

SEQ ID NO: 2076049 - RNA, 17 nt, Human
cccagcugccccucccu

SEQ ID NO: 2076050 - RNA, 21 nt, Human
cccagcugccccucccugcca

SEQ ID NO: 2076051 - RNA, 14 nt, Human
cccagcugcucccc

SEQ ID NO: 2076052 - RNA, 18 nt, Human
cccagccauuaccaugga

SEQ ID NO: 2076053 - RNA, 15 nt, Human
cccagcugcuccccu

SEQ ID NO: 2076054 - RNA, 21 nt, Human
cccagcugcuccccucccucc

SEQ ID NO: 2076055 - RNA, 12 nt, Human
cccagcugcucu

SEQ ID NO: 2076056 - RNA, 13 nt, Human
cccagcugcucug

SEQ ID NO: 2076057 - RNA, 14 nt, Human
cccagcugcucugc

SEQ ID NO: 2076058 - RNA, 15 nt, Human
cccagcugcucugcc

SEQ ID NO: 2076059 - RNA, 17 nt, Human
cccagcugcucugccca

SEQ ID NO: 2076060 - RNA, 18 nt, Human
cccagcugcucugcccag

SEQ ID NO: 2076061 - RNA, 19 nt, Human
cccagcugcucugcccaga

SEQ ID NO: 2076062 - RNA, 20 nt, Human
cccagcugcucugcccagag

SEQ ID NO: 2076063 - RNA, 23 nt, Human
cccagcugcucugcccagagcug

SEQ ID NO: 2076064 - RNA, 15 nt, Human
cccauucugccugcc

SEQ ID NO: 2076065 - RNA, 14 nt, Human
cccauucugccugc

SEQ ID NO: 2076066 - RNA, 19 nt, Human
cccauucugccugcccagg

SEQ ID NO: 2076067 - RNA, 22 nt, Human
cccauuuuggaaguuuucagga

SEQ ID NO: 2076068 - RNA, 19 nt, Human
cccauuuugcaaaauuucc

SEQ ID NO: 2076069 - RNA, 22 nt, Human
cccauuuugcaaaauuuccagu

SEQ ID NO: 2076070 - RNA, 20 nt, Human
cccauuuuuauaucgaucuc

SEQ ID NO: 2076071 - RNA, 12 nt, Human
cccauuuugcaa

SEQ ID NO: 2076072 - RNA, 15 nt, Human
ccccaugucucucag

SEQ ID NO: 2076073 - RNA, 17 nt, Human
ccccaugucucucagaa

SEQ ID NO: 2076074 - RNA, 14 nt, Human
ccccaugugccugc

SEQ ID NO: 2076075 - RNA, 18 nt, Human
ccccaugugccugcacca

SEQ ID NO: 2076076 - RNA, 23 nt, Human
ccccaugugccugcaccaggaga

SEQ ID NO: 2076077 - RNA, 17 nt, Human
ccccauuagagucagcc

SEQ ID NO: 2076078 - RNA, 18 nt, Human
ccccaugccuguccagcc

SEQ ID NO: 2076079 - RNA, 19 nt, Human
ccccaugccuguccagccu

SEQ ID NO: 2076080 - RNA, 20 nt, Human
ccccaugccuguccagccug

SEQ ID NO: 2076081 - RNA, 21 nt, Human
ccccaugccuguccagccugg

SEQ ID NO: 2076082 - RNA, 22 nt, Human
ccccaugccuguccagccuggg

SEQ ID NO: 2076083 - RNA, 23 nt, Human
ccccaugccuguccagccugggc

SEQ ID NO: 2076084 - RNA, 24 nt, Human
ccccaugccuguccagccugggca

SEQ ID NO: 2076085 - RNA, 20 nt, Human
ccccagauugcaacaggcug

SEQ ID NO: 2076086 - RNA, 18 nt, Human
ccccagcccacuggauca

SEQ ID NO: 2076087 - RNA, 11 nt, Human
ccccagcccag

SEQ ID NO: 2076088 - RNA, 22 nt, Human
ccccagagugugggaagggaga

SEQ ID NO: 2076089 - RNA, 15 nt, Human
ccccagauugcaaca

SEQ ID NO: 2076090 - RNA, 12 nt, Human
ccccagcccagc

SEQ ID NO: 2076091 - RNA, 17 nt, Human
ccccagcccagcccagc

SEQ ID NO: 2076092 - RNA, 18 nt, Human
ccccagcccagcccagcu

SEQ ID NO: 2076093 - RNA, 12 nt, Human
ccccaugccugu

SEQ ID NO: 2076094 - RNA, 21 nt, Human
ccccagcccaggguuccccca

SEQ ID NO: 2076095 - RNA, 13 nt, Human
ccccaugccuguc

SEQ ID NO: 2076096 - RNA, 15 nt, Human
ccccaugccugucca

SEQ ID NO: 2076097 - RNA, 17 nt, Human
ccccaugccuguccagc

SEQ ID NO: 2076098 - RNA, 18 nt, Human
cccccuugccagacaugu

SEQ ID NO: 2076099 - RNA, 16 nt, Human
ccccgcaaaacccacu

SEQ ID NO: 2076100 - RNA, 12 nt, Human
ccccucugcugg

SEQ ID NO: 2076101 - RNA, 13 nt, Human
ccccucugcuggc

SEQ ID NO: 2076102 - RNA, 14 nt, Human
ccccucugcuggcc

SEQ ID NO: 2076103 - RNA, 13 nt, Human
ccccucuggccag

SEQ ID NO: 2076104 - RNA, 16 nt, Human
ccccucuggccaggau

SEQ ID NO: 2076105 - RNA, 16 nt, Human
ccccugccacccuggg

SEQ ID NO: 2076106 - RNA, 14 nt, Human
ccccugccacccug

SEQ ID NO: 2076107 - RNA, 14 nt, Human
ccccugccagugcc

SEQ ID NO: 2076108 - RNA, 15 nt, Human
ccccugccagugccu

SEQ ID NO: 2076109 - RNA, 16 nt, Human
ccccugccagugccuu

SEQ ID NO: 2076110 - RNA, 17 nt, Human
ccccugccagugccuua

SEQ ID NO: 2076111 - RNA, 16 nt, Human
cccggccccugcuggu

SEQ ID NO: 2076112 - RNA, 15 nt, Human
cccggccccugcugg

SEQ ID NO: 2076113 - RNA, 14 nt, Human
cccggcgcgguggc

SEQ ID NO: 2076114 - RNA, 19 nt, Human
cccggcgcgguggcucacg

SEQ ID NO: 2076115 - RNA, 22 nt, Human
cccggcgcgguggcucacgccu

SEQ ID NO: 2076116 - RNA, 18 nt, Human
cccgaauagcugggacua

SEQ ID NO: 2076117 - RNA, 17 nt, Human
cccgaauagcugggacu

SEQ ID NO: 2076118 - RNA, 16 nt, Human
cccgaauagcugggac

SEQ ID NO: 2076119 - RNA, 12 nt, Human
ccccuucucugc

SEQ ID NO: 2076120 - RNA, 18 nt, Human
ccccuucucugcccauuc

SEQ ID NO: 2076121 - RNA, 13 nt, Human
ccccuucucugcu

SEQ ID NO: 2076122 - RNA, 14 nt, Human
ccccuucucugcuc

SEQ ID NO: 2076123 - RNA, 16 nt, Human
ccccuucucugcucca

SEQ ID NO: 2076124 - RNA, 22 nt, Human
ccccuucucugcuccaccacau

SEQ ID NO: 2076125 - RNA, 14 nt, Human
cccucaccugggca

SEQ ID NO: 2076126 - RNA, 15 nt, Human
cccucaccugggcac

SEQ ID NO: 2076127 - RNA, 16 nt, Human
cccucaacaccucugc

SEQ ID NO: 2076128 - RNA, 21 nt, Human
cccucaccuugcaacacacag

SEQ ID NO: 2076129 - RNA, 18 nt, Human
cccucaccuugcaacaca

SEQ ID NO: 2076130 - RNA, 17 nt, Human
cccucaccugggcaccu

SEQ ID NO: 2076131 - RNA, 23 nt, Human
cccucaccugggcaccuggggag

SEQ ID NO: 2076132 - RNA, 23 nt, Human
cccucagccccucuugcccccca

SEQ ID NO: 2076133 - RNA, 17 nt, Human
cccucagccccucuugc

SEQ ID NO: 2076134 - RNA, 21 nt, Human
cccucagccccucuugccccc

SEQ ID NO: 2076135 - RNA, 12 nt, Human
cccucagccccu

SEQ ID NO: 2076136 - RNA, 13 nt, Human
cccucagccccuc

SEQ ID NO: 2076137 - RNA, 14 nt, Human
cccucagccccucu

SEQ ID NO: 2076138 - RNA, 15 nt, Human
cccucaggacccucg

SEQ ID NO: 2076139 - RNA, 17 nt, Human
cccucaggacccucgcu

SEQ ID NO: 2076140 - RNA, 18 nt, Human
cccucaggacccucgcug

SEQ ID NO: 2076141 - RNA, 20 nt, Human
cccucaggacccucgcuggc

SEQ ID NO: 2076142 - RNA, 21 nt, Human
cccucaggacccucgcuggcc

SEQ ID NO: 2076143 - RNA, 22 nt, Human
cccucaggacccucgcuggccc

SEQ ID NO: 2076144 - RNA, 23 nt, Human
cccucaggacccucgcuggcccc

SEQ ID NO: 2076145 - RNA, 18 nt, Human
cccucaggcauaggccug

SEQ ID NO: 2076146 - RNA, 19 nt, Human
cccucaggcauaggccugg

SEQ ID NO: 2076147 - RNA, 20 nt, Human
cccucaggcauaggccuggg

SEQ ID NO: 2076148 - RNA, 21 nt, Human
cccucaggcauaggccugggu

SEQ ID NO: 2076149 - RNA, 22 nt, Human
cccucaggcauaggccugggug

SEQ ID NO: 2076150 - RNA, 23 nt, Human
cccucaggcauaggccugggugc

SEQ ID NO: 2076151 - RNA, 22 nt, Human
cccuccucccuucuacugcuuc

SEQ ID NO: 2076152 - RNA, 11 nt, Human
cccuccucugc

SEQ ID NO: 2076153 - RNA, 12 nt, Human
cccuccucugcc

SEQ ID NO: 2076154 - RNA, 13 nt, Human
cccuccucugcca

SEQ ID NO: 2076155 - RNA, 16 nt, Human
cccuccucugccaccu

SEQ ID NO: 2076156 - RNA, 18 nt, Human
cccuccugaaacuuacac

SEQ ID NO: 2076157 - RNA, 14 nt, Human
cccuccucaccccg

SEQ ID NO: 2076158 - RNA, 16 nt, Human
cccuccucaccucugg

SEQ ID NO: 2076159 - RNA, 17 nt, Human
cccuccucaccucugga

SEQ ID NO: 2076160 - RNA, 18 nt, Human
cccuccucaccucuggac

SEQ ID NO: 2076161 - RNA, 23 nt, Human
cccuccucaccucuggacuggcu

SEQ ID NO: 2076162 - RNA, 13 nt, Human
cccuccucacccc

SEQ ID NO: 2076163 - RNA, 12 nt, Human
cccuccucaccu

SEQ ID NO: 2076164 - RNA, 13 nt, Human
cccuccucaccuc

SEQ ID NO: 2076165 - RNA, 20 nt, Human
ccauucuuuauucuuuuacu

SEQ ID NO: 2076166 - RNA, 18 nt, Human
ccauugcacuccagccug

SEQ ID NO: 2076167 - RNA, 15 nt, Human
ccauugccaccagga

SEQ ID NO: 2076168 - RNA, 16 nt, Human
ccauugccaccaggag

SEQ ID NO: 2076169 - RNA, 17 nt, Human
ccauugccaccaggaga

SEQ ID NO: 2076170 - RNA, 21 nt, Human
ccauugccaccaggagaacca

SEQ ID NO: 2076171 - RNA, 14 nt, Human
ccauugcccugguu

SEQ ID NO: 2076172 - RNA, 20 nt, Human
ccauuuaugugagugugugu

SEQ ID NO: 2076173 - RNA, 16 nt, Human
ccauuucaucuauuuc

SEQ ID NO: 2076174 - RNA, 17 nt, Human
ccauuucaucuauuucu

SEQ ID NO: 2076175 - RNA, 17 nt, Human
ccauuucacaccugaaa

SEQ ID NO: 2076176 - RNA, 22 nt, Human
ccauuucacaccugaaaauguu

SEQ ID NO: 2076177 - RNA, 10 nt, Human
ccauugcuuc

SEQ ID NO: 2076178 - RNA, 12 nt, Human
ccauugcuucac

SEQ ID NO: 2076179 - RNA, 14 nt, Human
ccauugcuucacua

SEQ ID NO: 2076180 - RNA, 11 nt, Human
ccauugcugcu

SEQ ID NO: 2076181 - RNA, 14 nt, Human
ccauugcugcuccu

SEQ ID NO: 2076182 - RNA, 15 nt, Human
ccauugcugcuccuu

SEQ ID NO: 2076183 - RNA, 23 nt, Human
ccauugcugcuccuuagcugcca

SEQ ID NO: 2076184 - RNA, 21 nt, Human
ccauuucaucuauuucugaga

SEQ ID NO: 2076185 - RNA, 13 nt, Human
cccacccaggagg

SEQ ID NO: 2076186 - RNA, 21 nt, Human
cccacccagcacccagcaacu

SEQ ID NO: 2076187 - RNA, 12 nt, Human
cccacccaggag

SEQ ID NO: 2076188 - RNA, 12 nt, Human
cccaccccacac

SEQ ID NO: 2076189 - RNA, 15 nt, Human
cccaagcucugcucc

SEQ ID NO: 2076190 - RNA, 12 nt, Human
cccaagcucugc

SEQ ID NO: 2076191 - RNA, 14 nt, Human
cccaagcucugcuc

SEQ ID NO: 2076192 - RNA, 13 nt, Human
cccaagcucugcu

SEQ ID NO: 2076193 - RNA, 12 nt, Human
cccaacuccugg

SEQ ID NO: 2076194 - RNA, 18 nt, Human
cccaagacagaugcccca

SEQ ID NO: 2076195 - RNA, 13 nt, Human
cccaacuccugga

SEQ ID NO: 2076196 - RNA, 15 nt, Human
cccaacuccuggaag

SEQ ID NO: 2076197 - RNA, 17 nt, Human
cccaacuccuggaagcu

SEQ ID NO: 2076198 - RNA, 23 nt, Human
cccaacuccuggaagcugugucc

SEQ ID NO: 2076199 - RNA, 21 nt, Human
cccaagacagaugccccagag

SEQ ID NO: 2076200 - RNA, 19 nt, Human
cccaagacagaugccccag

SEQ ID NO: 2076201 - RNA, 20 nt, Human
cccaagacagaugccccaga

SEQ ID NO: 2076202 - RNA, 17 nt, Human
cccaagagaugaagagu

SEQ ID NO: 2076203 - RNA, 21 nt, Human
cccaagagaaggggaagcacu

SEQ ID NO: 2076204 - RNA, 15 nt, Human
cccaagagaugaaga

SEQ ID NO: 2076205 - RNA, 22 nt, Human
cccaagacuugguguccuuucc

SEQ ID NO: 2076206 - RNA, 13 nt, Human
cccacucucauuc

SEQ ID NO: 2076207 - RNA, 20 nt, Human
cccacucccuggcucucaga

SEQ ID NO: 2076208 - RNA, 21 nt, Human
cccacucucauuccccaggug

SEQ ID NO: 2076209 - RNA, 17 nt, Human
cccacucuccccacacu

SEQ ID NO: 2076210 - RNA, 14 nt, Human
cccacucucauucc

SEQ ID NO: 2076211 - RNA, 19 nt, Human
cccacucucauuccccagg

SEQ ID NO: 2076212 - RNA, 11 nt, Human
cccacucuccc

SEQ ID NO: 2076213 - RNA, 14 nt, Human
cccacucuccccac

SEQ ID NO: 2076214 - RNA, 15 nt, Human
cccacucuccccaca

SEQ ID NO: 2076215 - RNA, 23 nt, Human
cccacugcuuuuggucuguguga

SEQ ID NO: 2076216 - RNA, 16 nt, Human
cccacugacagccucc

SEQ ID NO: 2076217 - RNA, 21 nt, Human
cccacucugcuuugacugagc

SEQ ID NO: 2076218 - RNA, 13 nt, Human
cccaccccacacu

SEQ ID NO: 2076219 - RNA, 14 nt, Human
cccaccccacacuu

SEQ ID NO: 2076220 - RNA, 15 nt, Human
cccaccccacccccu

SEQ ID NO: 2076221 - RNA, 14 nt, Human
cccaccccagccua

SEQ ID NO: 2076222 - RNA, 12 nt, Human
cccaccccuucc

SEQ ID NO: 2076223 - RNA, 22 nt, Human
cccacucccuggcucucagaag

SEQ ID NO: 2076224 - RNA, 13 nt, Human
cccaccccuuccc

SEQ ID NO: 2076225 - RNA, 15 nt, Human
cccaccccuucccca

SEQ ID NO: 2076226 - RNA, 17 nt, Human
cccaccccuuccccacu

SEQ ID NO: 2076227 - RNA, 22 nt, Human
cccaccccuuccccacugccug

SEQ ID NO: 2076228 - RNA, 19 nt, Human
ccaugucgccucugcauuc

SEQ ID NO: 2076229 - RNA, 17 nt, Human
ccaugucgccucugcau

SEQ ID NO: 2076230 - RNA, 16 nt, Human
ccaugucgccucugca

SEQ ID NO: 2076231 - RNA, 15 nt, Human
ccaugucgccucugc

SEQ ID NO: 2076232 - RNA, 12 nt, Human
ccaugucgccuc

SEQ ID NO: 2076233 - RNA, 16 nt, Human
ccauguagcaggacug

SEQ ID NO: 2076234 - RNA, 13 nt, Human
ccauguacuguag

SEQ ID NO: 2076235 - RNA, 14 nt, Human
ccauguacuguagu

SEQ ID NO: 2076236 - RNA, 15 nt, Human
ccauguacuguaguu

SEQ ID NO: 2076237 - RNA, 22 nt, Human
ccauguacuguaguuuuucuuc

SEQ ID NO: 2076238 - RNA, 17 nt, Human
ccaugaguuugcccugg

SEQ ID NO: 2076239 - RNA, 18 nt, Human
ccaugaguuugcccuggu

SEQ ID NO: 2076240 - RNA, 18 nt, Human
ccaugaggaguugcuguu

SEQ ID NO: 2076241 - RNA, 20 nt, Human
ccaugaggaguugcuguuug

SEQ ID NO: 2076242 - RNA, 15 nt, Human
ccaugaggccucagu

SEQ ID NO: 2076243 - RNA, 23 nt, Human
ccaguuggguggaugccuggugg

SEQ ID NO: 2076244 - RNA, 21 nt, Human
ccaguugcacuuggccucugg

SEQ ID NO: 2076245 - RNA, 14 nt, Human
ccaguugcacuugg

SEQ ID NO: 2076246 - RNA, 20 nt, Human
ccaguugcacuuggccucug

SEQ ID NO: 2076247 - RNA, 19 nt, Human
ccauaauguauaaagaaca

SEQ ID NO: 2076248 - RNA, 20 nt, Human
ccauaauuaugacaguuaua

SEQ ID NO: 2076249 - RNA, 17 nt, Human
ccauaauuuucuucaug

SEQ ID NO: 2076250 - RNA, 21 nt, Human
ccauaauuuucuucaugcaau

SEQ ID NO: 2076251 - RNA, 23 nt, Human
ccauaauuuucuucaugcaauga

SEQ ID NO: 2076252 - RNA, 21 nt, Human
ccauaaucuggacuccucugu

SEQ ID NO: 2076253 - RNA, 14 nt, Human
ccauaaucuggacu

SEQ ID NO: 2076254 - RNA, 19 nt, Human
ccauccagguucagcuugu

SEQ ID NO: 2076255 - RNA, 18 nt, Human
ccauccagguucagcuug

SEQ ID NO: 2076256 - RNA, 15 nt, Human
ccauaaggaauguag

SEQ ID NO: 2076257 - RNA, 17 nt, Human
ccauaagccuccauuua

SEQ ID NO: 2076258 - RNA, 21 nt, Human
ccauaagccuccauuuaguuc

SEQ ID NO: 2076259 - RNA, 12 nt, Human
ccaucccauccc

SEQ ID NO: 2076260 - RNA, 13 nt, Human
ccaucccauccca

SEQ ID NO: 2076261 - RNA, 14 nt, Human
ccaucccaucccau

SEQ ID NO: 2076262 - RNA, 15 nt, Human
ccaucccaucccauc

SEQ ID NO: 2076263 - RNA, 16 nt, Human
ccaucccaucccaucc

SEQ ID NO: 2076264 - RNA, 17 nt, Human
ccaucccaucccauccc

SEQ ID NO: 2076265 - RNA, 18 nt, Human
ccaucccaucccauccca

SEQ ID NO: 2076266 - RNA, 13 nt, Human
ccaucccaucccg

SEQ ID NO: 2076267 - RNA, 18 nt, Human
ccaucccgcucuuuuccu

SEQ ID NO: 2076268 - RNA, 19 nt, Human
ccaucccgcucuuuuccua

SEQ ID NO: 2076269 - RNA, 17 nt, Human
ccaucccgacauggacc

SEQ ID NO: 2076270 - RNA, 22 nt, Human
ccaucccgacauggacccggag

SEQ ID NO: 2076271 - RNA, 13 nt, Human
ccaggaaaaagga

SEQ ID NO: 2076272 - RNA, 15 nt, Human
ccaggaaaaaggaca

SEQ ID NO: 2076273 - RNA, 17 nt, Human
ccagccccagugcccac

SEQ ID NO: 2076274 - RNA, 16 nt, Human
ccacucuacccuccca

SEQ ID NO: 2076275 - RNA, 18 nt, Human
ccacucgcuucccccaua

SEQ ID NO: 2076276 - RNA, 21 nt, Human
ccacucgcuucccccauagcc

SEQ ID NO: 2076277 - RNA, 14 nt, Human
ccacuccuguacac

SEQ ID NO: 2076278 - RNA, 15 nt, Human
ccacuccuguacacu

SEQ ID NO: 2076279 - RNA, 12 nt, Human
ccacuccuuccu

SEQ ID NO: 2076280 - RNA, 13 nt, Human
ccacuccuuccug

SEQ ID NO: 2076281 - RNA, 22 nt, Human
ccacuccuuccugccaccugcu

SEQ ID NO: 2076282 - RNA, 13 nt, Human
ccacucgcuuccc

SEQ ID NO: 2076283 - RNA, 16 nt, Human
ccacucgcuuccccca

SEQ ID NO: 2076284 - RNA, 23 nt, Human
ccagcacuuugggaggccaagga

SEQ ID NO: 2076285 - RNA, 21 nt, Human
ccagcacuuugggaggccaag

SEQ ID NO: 2076286 - RNA, 21 nt, Human
ccagcacuuugggaggcugag

SEQ ID NO: 2076287 - RNA, 14 nt, Human
ccagcacuuuggga

SEQ ID NO: 2076288 - RNA, 16 nt, Human
ccagcacuuugggagg

SEQ ID NO: 2076289 - RNA, 17 nt, Human
ccagcacuuugggaggc

SEQ ID NO: 2076290 - RNA, 11 nt, Human
ccagccccucc

SEQ ID NO: 2076291 - RNA, 12 nt, Human
ccagccccuccc

SEQ ID NO: 2076292 - RNA, 13 nt, Human
ccagccccuccca

SEQ ID NO: 2076293 - RNA, 14 nt, Human
ccagccccucccac

SEQ ID NO: 2076294 - RNA, 15 nt, Human
ccagccccucccacc

SEQ ID NO: 2076295 - RNA, 16 nt, Human
ccagccccucccacca

SEQ ID NO: 2076296 - RNA, 21 nt, Human
ccagccccucccaccacagca

SEQ ID NO: 2076297 - RNA, 14 nt, Human
ccagccccuugaga

SEQ ID NO: 2076298 - RNA, 20 nt, Human
ccagccccucccaccacagc

SEQ ID NO: 2076299 - RNA, 22 nt, Human
ccagcuauugauauaaauaaaa

SEQ ID NO: 2076300 - RNA, 12 nt, Human
ccagcuccaggg

SEQ ID NO: 2076301 - RNA, 13 nt, Human
ccagcuccagggc

SEQ ID NO: 2076302 - RNA, 14 nt, Human
ccagcuccagggcc

SEQ ID NO: 2076303 - RNA, 15 nt, Human
ccagcuccagggcca

SEQ ID NO: 2076304 - RNA, 16 nt, Human
ccagcuccagggccag

SEQ ID NO: 2076305 - RNA, 18 nt, Human
ccagcuccagggccagau

SEQ ID NO: 2076306 - RNA, 14 nt, Human
ccagcucccuagga

SEQ ID NO: 2076307 - RNA, 12 nt, Human
ccaggcuggcgu

SEQ ID NO: 2076308 - RNA, 21 nt, Human
ccaggggaaaaucagccugcu

SEQ ID NO: 2076309 - RNA, 18 nt, Human
ccaggggaccacaccucc

SEQ ID NO: 2076310 - RNA, 13 nt, Human
ccaggggaccaca

SEQ ID NO: 2076311 - RNA, 21 nt, Human
ccaggggagagggucuggaga

SEQ ID NO: 2076312 - RNA, 18 nt, Human
ccaggggagagggucugg

SEQ ID NO: 2076313 - RNA, 20 nt, Human
ccaggggagagggucuggag

SEQ ID NO: 2076314 - RNA, 15 nt, Human
ccaggcugccugagc

SEQ ID NO: 2076315 - RNA, 17 nt, Human
ccaggcugccugagcac

SEQ ID NO: 2076316 - RNA, 14 nt, Human
ccaggcugcuggac

SEQ ID NO: 2076317 - RNA, 19 nt, Human
ccaggcugcucagggcugg

SEQ ID NO: 2076318 - RNA, 17 nt, Human
ccaggcugcucagggcu

SEQ ID NO: 2076319 - RNA, 19 nt, Human
ccaggcugccaaggccaga

SEQ ID NO: 2076320 - RNA, 20 nt, Human
ccaggcugccaaggccagag

SEQ ID NO: 2076321 - RNA, 13 nt, Human
ccaggcugcucag

SEQ ID NO: 2076322 - RNA, 14 nt, Human
ccaggcaggucuug

SEQ ID NO: 2076323 - RNA, 12 nt, Human
ccaggcaggucu

SEQ ID NO: 2076324 - RNA, 23 nt, Human
ccaggcaggucuugaacuccugg

SEQ ID NO: 2076325 - RNA, 22 nt, Human
ccaggauggaggggugguccug

SEQ ID NO: 2076326 - RNA, 14 nt, Human
ccaggauggagggg

SEQ ID NO: 2076327 - RNA, 12 nt, Human
ccagucccuggg

SEQ ID NO: 2076328 - RNA, 13 nt, Human
ccagucccugggg

SEQ ID NO: 2076329 - RNA, 15 nt, Human
ccagucccuggggga

SEQ ID NO: 2076330 - RNA, 19 nt, Human
ccagucccugggggaagcc

SEQ ID NO: 2076331 - RNA, 22 nt, Human
ccagucccugggggaagcccug

SEQ ID NO: 2076332 - RNA, 23 nt, Human
ccagucccugggggaagcccugg

SEQ ID NO: 2076333 - RNA, 18 nt, Human
ccagucccccugccccag

SEQ ID NO: 2076334 - RNA, 19 nt, Human
ccagucagguaguugcaau

SEQ ID NO: 2076335 - RNA, 18 nt, Human
ccaguccaaauguccucc

SEQ ID NO: 2076336 - RNA, 17 nt, Human
ccagucauaccaacuuu

SEQ ID NO: 2076337 - RNA, 19 nt, Human
ccagucauaccaacuuuag

SEQ ID NO: 2076338 - RNA, 21 nt, Human
ccagucaucagcuauucaguu

SEQ ID NO: 2076339 - RNA, 21 nt, Human
ccaguccaaauguccuccaga

SEQ ID NO: 2076340 - RNA, 14 nt, Human
ccaggggucccagc

SEQ ID NO: 2076341 - RNA, 17 nt, Human
ccaggggucccagccac

SEQ ID NO: 2076342 - RNA, 18 nt, Human
ccaggggucccagccacc

SEQ ID NO: 2076343 - RNA, 18 nt, Human
ccaggggaugaguggagg

SEQ ID NO: 2076344 - RNA, 21 nt, Human
ccucgagguuucucaaagaaa

SEQ ID NO: 2076345 - RNA, 15 nt, Human
ccucgaacuccuggg

SEQ ID NO: 2076346 - RNA, 16 nt, Human
ccucgaacuccugggc

SEQ ID NO: 2076347 - RNA, 22 nt, Human
ccucgaacuccugggcucaagc

SEQ ID NO: 2076348 - RNA, 15 nt, Human
ccucgaacccacacu

SEQ ID NO: 2076349 - RNA, 16 nt, Human
ccucgaacccacacug

SEQ ID NO: 2076350 - RNA, 21 nt, Human
ccucgaacccacacugcaaca

SEQ ID NO: 2076351 - RNA, 23 nt, Human
ccucgaacccacacugcaacagg

SEQ ID NO: 2076352 - RNA, 14 nt, Human
ccucgaacuccugg

SEQ ID NO: 2076353 - RNA, 14 nt, Human
ccucgcaagcuggg

SEQ ID NO: 2076354 - RNA, 19 nt, Human
ccuccuaucagaaguuucu

SEQ ID NO: 2076355 - RNA, 20 nt, Human
ccuccuagggaaaaguucau

SEQ ID NO: 2076356 - RNA, 19 nt, Human
ccuccuaucaccuccccuc

SEQ ID NO: 2076357 - RNA, 13 nt, Human
ccuccucaccccg

SEQ ID NO: 2076358 - RNA, 15 nt, Human
ccuccucaccccguc

SEQ ID NO: 2076359 - RNA, 12 nt, Human
ccuccucaccuc

SEQ ID NO: 2076360 - RNA, 12 nt, Human
ccucgcccuggg

SEQ ID NO: 2076361 - RNA, 13 nt, Human
ccucgcccugggu

SEQ ID NO: 2076362 - RNA, 14 nt, Human
ccucgcccuggguc

SEQ ID NO: 2076363 - RNA, 12 nt, Human
ccucgcuggccc

SEQ ID NO: 2076364 - RNA, 13 nt, Human
ccucgcuggcccc

SEQ ID NO: 2076365 - RNA, 14 nt, Human
ccucgcuggccccc

SEQ ID NO: 2076366 - RNA, 15 nt, Human
ccucgcuggccccca

SEQ ID NO: 2076367 - RNA, 16 nt, Human
ccucgcuggcccccac

SEQ ID NO: 2076368 - RNA, 17 nt, Human
ccucgcuggcccccacu

SEQ ID NO: 2076369 - RNA, 18 nt, Human
ccucgcuggcccccacug

SEQ ID NO: 2076370 - RNA, 20 nt, Human
ccucgcuggcccccacuggc

SEQ ID NO: 2076371 - RNA, 22 nt, Human
ccucgcuggcccccacuggcug

SEQ ID NO: 2076372 - RNA, 23 nt, Human
ccucgcuggcccccacuggcugu

SEQ ID NO: 2076373 - RNA, 13 nt, Human
ccuccgccucuug

SEQ ID NO: 2076374 - RNA, 14 nt, Human
ccuccgccucuugg

SEQ ID NO: 2076375 - RNA, 15 nt, Human
ccucccuuggcgugg

SEQ ID NO: 2076376 - RNA, 19 nt, Human
ccuccgccuucacuccggu

SEQ ID NO: 2076377 - RNA, 18 nt, Human
ccuccuaucaccuccccu

SEQ ID NO: 2076378 - RNA, 16 nt, Human
ccucccuucuacugcu

SEQ ID NO: 2076379 - RNA, 17 nt, Human
ccucccuucuacugcuu

SEQ ID NO: 2076380 - RNA, 19 nt, Human
ccucccuucuacugcuucu

SEQ ID NO: 2076381 - RNA, 21 nt, Human
ccucccuucuacugcuucuac

SEQ ID NO: 2076382 - RNA, 14 nt, Human
ccucaaaugagaaa

SEQ ID NO: 2076383 - RNA, 15 nt, Human
ccucaaccuccuggg

SEQ ID NO: 2076384 - RNA, 16 nt, Human
ccucaacaccucugca

SEQ ID NO: 2076385 - RNA, 19 nt, Human
ccucaacccucccucagcc

SEQ ID NO: 2076386 - RNA, 21 nt, Human
ccucaacccucccucagcccc

SEQ ID NO: 2076387 - RNA, 22 nt, Human
ccucaacccucccucagccccu

SEQ ID NO: 2076388 - RNA, 23 nt, Human
ccucaacccucccucagccccuc

SEQ ID NO: 2076389 - RNA, 18 nt, Human
ccucaacccucccucagc

SEQ ID NO: 2076390 - RNA, 16 nt, Human
ccucaacccucccuca

SEQ ID NO: 2076391 - RNA, 19 nt, Human
ccucaaaugggucuggggg

SEQ ID NO: 2076392 - RNA, 14 nt, Human
ccucccagggccag

SEQ ID NO: 2076393 - RNA, 20 nt, Human
ccucauuugggguagcuaga

SEQ ID NO: 2076394 - RNA, 21 nt, Human
ccucauuuuuauaaugucccu

SEQ ID NO: 2076395 - RNA, 17 nt, Human
ccucauuugggguagcu

SEQ ID NO: 2076396 - RNA, 21 nt, Human
ccucccagggccagggcccug

SEQ ID NO: 2076397 - RNA, 16 nt, Human
ccucauuuaucccuca

SEQ ID NO: 2076398 - RNA, 19 nt, Human
ccucauuuaucccucaacc

SEQ ID NO: 2076399 - RNA, 20 nt, Human
ccucauuuaucccucaaccc

SEQ ID NO: 2076400 - RNA, 20 nt, Human
ccucaagugauucuccugcc

SEQ ID NO: 2076401 - RNA, 19 nt, Human
ccucaagggggacugucuu

SEQ ID NO: 2076402 - RNA, 23 nt, Human
ccucaagugauucuccugccuca

SEQ ID NO: 2076403 - RNA, 23 nt, Human
ccucagccuuggauaaugcuguu

SEQ ID NO: 2076404 - RNA, 13 nt, Human
ccucauuccugaa

SEQ ID NO: 2076405 - RNA, 21 nt, Human
ccucauuccaccuucccaugc

SEQ ID NO: 2076406 - RNA, 13 nt, Human
ccucauucaggaa

SEQ ID NO: 2076407 - RNA, 21 nt, Human
ccucaggccaggugcaguggc

SEQ ID NO: 2076408 - RNA, 15 nt, Human
ccucauucaggaaaa

SEQ ID NO: 2076409 - RNA, 16 nt, Human
ccucauucaggaaaac

SEQ ID NO: 2076410 - RNA, 17 nt, Human
ccucauucaggaaaacu

SEQ ID NO: 2076411 - RNA, 22 nt, Human
ccucauucaggaaaacugacag

SEQ ID NO: 2076412 - RNA, 15 nt, Human
ccucaggcaggaagg

SEQ ID NO: 2076413 - RNA, 19 nt, Human
ccucaggcaggaagggcag

SEQ ID NO: 2076414 - RNA, 18 nt, Human
ccucaggcauaggccugg

SEQ ID NO: 2076415 - RNA, 22 nt, Human
ccucaggcauaggccugggugc

SEQ ID NO: 2076416 - RNA, 12 nt, Human
ccucaggcaggu

SEQ ID NO: 2076417 - RNA, 18 nt, Human
ccucaggcaggugggaug

SEQ ID NO: 2076418 - RNA, 13 nt, Human
ccucagcugccuc

SEQ ID NO: 2076419 - RNA, 14 nt, Human
ccucagcugccuca

SEQ ID NO: 2076420 - RNA, 15 nt, Human
ccucagcugccucac

SEQ ID NO: 2076421 - RNA, 16 nt, Human
ccucagcugccucacu

SEQ ID NO: 2076422 - RNA, 17 nt, Human
ccucagcugccucacuu

SEQ ID NO: 2076423 - RNA, 18 nt, Human
ccucagcugccucacuuc

SEQ ID NO: 2076424 - RNA, 12 nt, Human
ccgacagccugg

SEQ ID NO: 2076425 - RNA, 14 nt, Human
ccgacagccuggca

SEQ ID NO: 2076426 - RNA, 13 nt, Human
ccgacagccuggc

SEQ ID NO: 2076427 - RNA, 22 nt, Human
ccgacagccuggcacagggcag

SEQ ID NO: 2076428 - RNA, 15 nt, Human
ccgacagccuggcac

SEQ ID NO: 2076429 - RNA, 15 nt, Human
cccuucuccuuccaa

SEQ ID NO: 2076430 - RNA, 15 nt, Human
ccgaacacccucgaa

SEQ ID NO: 2076431 - RNA, 18 nt, Human
ccgaagaaggguccuucc

SEQ ID NO: 2076432 - RNA, 19 nt, Human
ccgaagaaggguccuuccc

SEQ ID NO: 2076433 - RNA, 20 nt, Human
ccgaagaaggguccuucccu

SEQ ID NO: 2076434 - RNA, 14 nt, Human
cccuucucccacac

SEQ ID NO: 2076435 - RNA, 15 nt, Human
cccuucucccacacu

SEQ ID NO: 2076436 - RNA, 14 nt, Human
cccuccuuucacca

SEQ ID NO: 2076437 - RNA, 21 nt, Human
cccuccuuccuucuugcuucu

SEQ ID NO: 2076438 - RNA, 16 nt, Human
cccuccuuccuugacc

SEQ ID NO: 2076439 - RNA, 15 nt, Human
cccuccuucccagcu

SEQ ID NO: 2076440 - RNA, 16 nt, Human
cccuccuucccagcug

SEQ ID NO: 2076441 - RNA, 17 nt, Human
cccuccuucccagcugc

SEQ ID NO: 2076442 - RNA, 19 nt, Human
cccuccuucccagcugccc

SEQ ID NO: 2076443 - RNA, 18 nt, Human
cccuccuuccuugaccag

SEQ ID NO: 2076444 - RNA, 17 nt, Human
cccuccuugccuccugu

SEQ ID NO: 2076445 - RNA, 18 nt, Human
cccuccuugccuccugug

SEQ ID NO: 2076446 - RNA, 11 nt, Human
cccuccuucca

SEQ ID NO: 2076447 - RNA, 13 nt, Human
cccuccuuuccca

SEQ ID NO: 2076448 - RNA, 20 nt, Human
cccuccuuucccaacacuuc

SEQ ID NO: 2076449 - RNA, 14 nt, Human
cccuguggaaggga

SEQ ID NO: 2076450 - RNA, 18 nt, Human
cccuguggaagggacuag

SEQ ID NO: 2076451 - RNA, 21 nt, Human
cccuguggaagggacuaggag

SEQ ID NO: 2076452 - RNA, 17 nt, Human
cccuguggagcccgcac

SEQ ID NO: 2076453 - RNA, 13 nt, Human
cccuucucccaca

SEQ ID NO: 2076454 - RNA, 13 nt, Human
ccggcagaaggga

SEQ ID NO: 2076455 - RNA, 14 nt, Human
ccggccagcuggga

SEQ ID NO: 2076456 - RNA, 19 nt, Human
ccggccagcugggaucuga

SEQ ID NO: 2076457 - RNA, 18 nt, Human
ccguagaaaucccccuuu

SEQ ID NO: 2076458 - RNA, 20 nt, Human
ccguagaaaucccccuuucu

SEQ ID NO: 2076459 - RNA, 18 nt, Human
ccguacauucaauguuua

SEQ ID NO: 2076460 - RNA, 18 nt, Human
ccguaaagugagcaugcu

SEQ ID NO: 2076461 - RNA, 23 nt, Human
ccguaaagugagcaugcuuucug

SEQ ID NO: 2076462 - RNA, 14 nt, Human
ccgguugcuucugg

SEQ ID NO: 2076463 - RNA, 15 nt, Human
ccgguugcuucuggg

SEQ ID NO: 2076464 - RNA, 16 nt, Human
ccgguugcuucuggga

SEQ ID NO: 2076465 - RNA, 17 nt, Human
ccgguugcuucugggaa

SEQ ID NO: 2076466 - RNA, 19 nt, Human
ccuagccuuagaagucaca

SEQ ID NO: 2076467 - RNA, 23 nt, Human
ccuagccugugccucugggacug

SEQ ID NO: 2076468 - RNA, 22 nt, Human
ccuagccuuagaagucacacag

SEQ ID NO: 2076469 - RNA, 18 nt, Human
ccuaauaaacauccuuca

SEQ ID NO: 2076470 - RNA, 22 nt, Human
ccgucuuagaaguggaccagga

SEQ ID NO: 2076471 - RNA, 13 nt, Human
ccgucugugaauu

SEQ ID NO: 2076472 - RNA, 14 nt, Human
ccgucuucagccua

SEQ ID NO: 2076473 - RNA, 15 nt, Human
ccgucuucagccuag

SEQ ID NO: 2076474 - RNA, 22 nt, Human
ccuaauaaacauccuucaagaa

SEQ ID NO: 2076475 - RNA, 21 nt, Human
ccgugagcagugugucuccug

SEQ ID NO: 2076476 - RNA, 14 nt, Human
ccgugaggauguca

SEQ ID NO: 2076477 - RNA, 18 nt, Human
ccuaauguuuaugagcca

SEQ ID NO: 2076478 - RNA, 14 nt, Human
ccuaauuagagcag

SEQ ID NO: 2076479 - RNA, 17 nt, Human
ccuaauguggcagcugu

SEQ ID NO: 2076480 - RNA, 18 nt, Human
ccuaauguggcagcuguc

SEQ ID NO: 2076481 - RNA, 19 nt, Human
ccuaauguuuaugagccag

SEQ ID NO: 2076482 - RNA, 23 nt, Human
ccuaauuagagcagaugaccccu

SEQ ID NO: 2076483 - RNA, 20 nt, Human
ccugaggugaaagggagcua

SEQ ID NO: 2076484 - RNA, 14 nt, Human
ccugagauggcccu

SEQ ID NO: 2076485 - RNA, 19 nt, Human
ccugagauggcccucuggu

SEQ ID NO: 2076486 - RNA, 20 nt, Human
ccugagauggcccucuggua

SEQ ID NO: 2076487 - RNA, 21 nt, Human
ccugagcaacagagugagacc

SEQ ID NO: 2076488 - RNA, 23 nt, Human
ccugagcaacagagugagacccu

SEQ ID NO: 2076489 - RNA, 21 nt, Human
ccugauauagaucacauaaca

SEQ ID NO: 2076490 - RNA, 19 nt, Human
ccugaguuucaaguauccu

SEQ ID NO: 2076491 - RNA, 14 nt, Human
ccucuugccacugc

SEQ ID NO: 2076492 - RNA, 22 nt, Human
ccucuugccacugccucuuccu

SEQ ID NO: 2076493 - RNA, 23 nt, Human
ccucuugccacugccucuuccuc

SEQ ID NO: 2076494 - RNA, 12 nt, Human
ccucuugccccc

SEQ ID NO: 2076495 - RNA, 16 nt, Human
ccucuugccccccacc

SEQ ID NO: 2076496 - RNA, 21 nt, Human
ccucuugccccccaccccagc

SEQ ID NO: 2076497 - RNA, 23 nt, Human
ccucuugccccccaccccagccu

SEQ ID NO: 2076498 - RNA, 17 nt, Human
ccucuugcggucccuuc

SEQ ID NO: 2076499 - RNA, 16 nt, Human
ccucuuucccucccuu

SEQ ID NO: 2076500 - RNA, 18 nt, Human
ccucuugcggucccuucu

SEQ ID NO: 2076501 - RNA, 19 nt, Human
ccucuuucccucccuuccu

SEQ ID NO: 2076502 - RNA, 15 nt, Human
ccucggaucaccgag

SEQ ID NO: 2076503 - RNA, 17 nt, Human
ccucggaucaccgagag

SEQ ID NO: 2076504 - RNA, 13 nt, Human
ccucggagccuca

SEQ ID NO: 2076505 - RNA, 14 nt, Human
ccucggagccucau

SEQ ID NO: 2076506 - RNA, 16 nt, Human
ccucggagccucaucc

SEQ ID NO: 2076507 - RNA, 23 nt, Human
ccucggagccucauccgaggcag

SEQ ID NO: 2076508 - RNA, 17 nt, Human
ccugccauuugcacccu

SEQ ID NO: 2076509 - RNA, 23 nt, Human
ccugccauuugcacccuccgccu

SEQ ID NO: 2076510 - RNA, 19 nt, Human
ccugcccaggccccugcca

SEQ ID NO: 2076511 - RNA, 18 nt, Human
ccugcccaggccccugcc

SEQ ID NO: 2076512 - RNA, 22 nt, Human
ccugcccaggccccugccaccc

SEQ ID NO: 2076513 - RNA, 21 nt, Human
ccugcccaggccccugccacc

SEQ ID NO: 2076514 - RNA, 15 nt, Human
ccugccucagccucc

SEQ ID NO: 2076515 - RNA, 16 nt, Human
ccugccucagccuccc

SEQ ID NO: 2076516 - RNA, 17 nt, Human
ccugcugauguggcaac

SEQ ID NO: 2076517 - RNA, 21 nt, Human
ccugcugauguggcaacugcu

SEQ ID NO: 2076518 - RNA, 19 nt, Human
ccuggcaauaguguguucu

SEQ ID NO: 2076519 - RNA, 21 nt, Human
ccuggcaauaguguguucuga

SEQ ID NO: 2076520 - RNA, 12 nt, Human
ccuggcaauagu

SEQ ID NO: 2076521 - RNA, 22 nt, Human
ccuggccucaagugauucuccu

SEQ ID NO: 2076522 - RNA, 12 nt, Human
ccuggccugcug

SEQ ID NO: 2076523 - RNA, 13 nt, Human
ccuggccuguucu

SEQ ID NO: 2076524 - RNA, 19 nt, Human
ccuggccuguucuguuuug

SEQ ID NO: 2076525 - RNA, 11 nt, Human
ccuggccuguu

SEQ ID NO: 2076526 - RNA, 13 nt, Human
ccuggccugcugg

SEQ ID NO: 2076527 - RNA, 22 nt, Human
ccugggcucaagcaauccuccu

SEQ ID NO: 2076528 - RNA, 23 nt, Human
ccugggcucaagcaauccuccug

SEQ ID NO: 2076529 - RNA, 12 nt, Human
ccugggcucugc

SEQ ID NO: 2076530 - RNA, 14 nt, Human
ccugggcucugccc

SEQ ID NO: 2076531 - RNA, 20 nt, Human
ccugggcucugccccagcuc

SEQ ID NO: 2076532 - RNA, 22 nt, Human
ccugggcucugccccagcucug

SEQ ID NO: 2076533 - RNA, 24 nt, Human
ccugggcucugccccagcucuggc

SEQ ID NO: 2076534 - RNA, 22 nt, Human
ccugggcugagagaaccucacg

SEQ ID NO: 2076535 - RNA, 18 nt, Human
ccuggggagugggacaga

SEQ ID NO: 2076536 - RNA, 19 nt, Human
ccuggggagugggacagag

SEQ ID NO: 2076537 - RNA, 22 nt, Human
ccuggggagugggacagagucu

SEQ ID NO: 2076538 - RNA, 23 nt, Human
ccuggggagugggacagagucug

SEQ ID NO: 2076539 - RNA, 15 nt, Human
ccuggggagaaagua

SEQ ID NO: 2076540 - RNA, 24 nt, Human
ccuggggagugggacagagucugg

SEQ ID NO: 2076541 - RNA, 19 nt, Human
ccuggggcagucaccugcc

SEQ ID NO: 2076542 - RNA, 20 nt, Human
ccuggggcuaggcuggagcc

SEQ ID NO: 2076543 - RNA, 22 nt, Human
ccuggggcuaggcuggagccca

SEQ ID NO: 2076544 - RNA, 19 nt, Human
ccugguggcagugggagcu

SEQ ID NO: 2076545 - RNA, 18 nt, Human
ccugguggcagugggagc

SEQ ID NO: 2076546 - RNA, 15 nt, Human
ccuggggcucugugc

SEQ ID NO: 2076547 - RNA, 18 nt, Human
ccuggggcucugugcagg

SEQ ID NO: 2076548 - RNA, 15 nt, Human
ccuggggcugaucuc

SEQ ID NO: 2076549 - RNA, 18 nt, Human
ccuggggcugaucucagg

SEQ ID NO: 2076550 - RNA, 20 nt, Human
ccuggggcugaucucaggga

SEQ ID NO: 2076551 - RNA, 22 nt, Human
ccuggggcugaucucagggaag

SEQ ID NO: 2076552 - RNA, 20 nt, Human
ccugguggcagugggagcug

SEQ ID NO: 2076553 - RNA, 21 nt, Human
ccugguuccggaauccugucc

SEQ ID NO: 2076554 - RNA, 20 nt, Human
ccugguuccggaauccuguc

SEQ ID NO: 2076555 - RNA, 13 nt, Human
ccugucuccccuc

SEQ ID NO: 2076556 - RNA, 14 nt, Human
ccugucuccccucu

SEQ ID NO: 2076557 - RNA, 15 nt, Human
ccugucuccccucug

SEQ ID NO: 2076558 - RNA, 17 nt, Human
ccugucuccccucugcu

SEQ ID NO: 2076559 - RNA, 18 nt, Human
ccugucuccccucugcug

SEQ ID NO: 2076560 - RNA, 19 nt, Human
ccugucuccccucugcugg

SEQ ID NO: 2076561 - RNA, 20 nt, Human
ccugucuccccucugcuggc

SEQ ID NO: 2076562 - RNA, 18 nt, Human
ccuguaacuugagaguag

SEQ ID NO: 2076563 - RNA, 20 nt, Human
ccugucucauccccaggggu

SEQ ID NO: 2076564 - RNA, 13 nt, Human
ccuguaaaacuuu

SEQ ID NO: 2076565 - RNA, 14 nt, Human
ccuguaaaacuuua

SEQ ID NO: 2076566 - RNA, 18 nt, Human
ccuguaaaacuuuauuuu

SEQ ID NO: 2076567 - RNA, 20 nt, Human
ccuguaaaacuuuauuuuau

SEQ ID NO: 2076568 - RNA, 12 nt, Human
ccuguaaauuau

SEQ ID NO: 2076569 - RNA, 13 nt, Human
ccuguaaauuauu

SEQ ID NO: 2076570 - RNA, 14 nt, Human
ccuguaaauuauuu

SEQ ID NO: 2076571 - RNA, 15 nt, Human
ccuguaaauuauuuu

SEQ ID NO: 2076572 - RNA, 17 nt, Human
ccuguaaauuauuuuaa

SEQ ID NO: 2076573 - RNA, 18 nt, Human
ccuguaaauuauuuuaaa

SEQ ID NO: 2076574 - RNA, 23 nt, Human
ccuguaaauuauuuuaaauuaua

SEQ ID NO: 2076575 - RNA, 21 nt, Human
ccugucuccuuugcaggcuca

SEQ ID NO: 2076576 - RNA, 22 nt, Human
cauagcuuacaagccagcugga

SEQ ID NO: 2076577 - RNA, 13 nt, Human
cauagcuuccaug

SEQ ID NO: 2076578 - RNA, 19 nt, Human
cauagcugguuccugcuag

SEQ ID NO: 2076579 - RNA, 20 nt, Human
cauagcugguuccugcuaga

SEQ ID NO: 2076580 - RNA, 23 nt, Human
cauagcaagauugcuuaaaauag

SEQ ID NO: 2076581 - RNA, 15 nt, Human
cauagcaagacacau

SEQ ID NO: 2076582 - RNA, 20 nt, Human
cauagcaagacacaucccua

SEQ ID NO: 2076583 - RNA, 14 nt, Human
cauagcaagacaca

SEQ ID NO: 2076584 - RNA, 22 nt, Human
cauagcagagaaugaaagggcc

SEQ ID NO: 2076585 - RNA, 19 nt, Human
cauagcagagaaugaaagg

SEQ ID NO: 2076586 - RNA, 15 nt, Human
cauaauuuguacaua

SEQ ID NO: 2076587 - RNA, 16 nt, Human
cauaauucuuguauau

SEQ ID NO: 2076588 - RNA, 17 nt, Human
cauaauucuuguauauu

SEQ ID NO: 2076589 - RNA, 18 nt, Human
cauaauucuuguauauua

SEQ ID NO: 2076590 - RNA, 13 nt, Human
cagugggagaaaa

SEQ ID NO: 2076591 - RNA, 15 nt, Human
cagugggagcugccu

SEQ ID NO: 2076592 - RNA, 21 nt, Human
cauaauuuguacauauguaaa

SEQ ID NO: 2076593 - RNA, 23 nt, Human
cauaauuuguacauauguaaaau

SEQ ID NO: 2076594 - RNA, 21 nt, Human
cauacacccccaccuccugca

SEQ ID NO: 2076595 - RNA, 22 nt, Human
cauacacccccaccuccugcaa

SEQ ID NO: 2076596 - RNA, 21 nt, Human
cauaauucuaaucuaacaaug

SEQ ID NO: 2076597 - RNA, 21 nt, Human
cauagcuugauaaagggccaa

SEQ ID NO: 2076598 - RNA, 20 nt, Human
cauagcuugauaaagggcca

SEQ ID NO: 2076599 - RNA, 14 nt, Human
cauccccuguagag

SEQ ID NO: 2076600 - RNA, 16 nt, Human
cauccccgcuggcugg

SEQ ID NO: 2076601 - RNA, 15 nt, Human
cauccuguguuucua

SEQ ID NO: 2076602 - RNA, 21 nt, Human
cauccuguguuucuagggaaa

SEQ ID NO: 2076603 - RNA, 22 nt, Human
cauccuguguuucuagggaaau

SEQ ID NO: 2076604 - RNA, 17 nt, Human
cauccuuagcaacagcc

SEQ ID NO: 2076605 - RNA, 21 nt, Human
cauccuucaagaacucugggc

SEQ ID NO: 2076606 - RNA, 13 nt, Human
caucccaggggac

SEQ ID NO: 2076607 - RNA, 14 nt, Human
caucccaggggacc

SEQ ID NO: 2076608 - RNA, 19 nt, Human
caucccaggggaccacacc

SEQ ID NO: 2076609 - RNA, 13 nt, Human
caucccaguggcc

SEQ ID NO: 2076610 - RNA, 20 nt, Human
caucccaguggccucaaccc

SEQ ID NO: 2076611 - RNA, 23 nt, Human
caucccaguggccucaacccucc

SEQ ID NO: 2076612 - RNA, 12 nt, Human
caucccaucauc

SEQ ID NO: 2076613 - RNA, 12 nt, Human
caucccauccca

SEQ ID NO: 2076614 - RNA, 13 nt, Human
caucccaucccau

SEQ ID NO: 2076615 - RNA, 22 nt, Human
cauccuucaagaacucugggcu

SEQ ID NO: 2076616 - RNA, 23 nt, Human
cauccuucaagaacucugggcug

SEQ ID NO: 2076617 - RNA, 18 nt, Human
cauccuuccucacaccag

SEQ ID NO: 2076618 - RNA, 19 nt, Human
caucugccccucccccaac

SEQ ID NO: 2076619 - RNA, 21 nt, Human
caucugggaagauuucuaccu

SEQ ID NO: 2076620 - RNA, 12 nt, Human
caucugcuaaua

SEQ ID NO: 2076621 - RNA, 22 nt, Human
cauccauggccgggcuuggugg

SEQ ID NO: 2076622 - RNA, 16 nt, Human
cauccauguguggacu

SEQ ID NO: 2076623 - RNA, 18 nt, Human
cauccauguuccgagaag

SEQ ID NO: 2076624 - RNA, 17 nt, Human
cauccauguguggacuc

SEQ ID NO: 2076625 - RNA, 18 nt, Human
cauccauguguggacuca

SEQ ID NO: 2076626 - RNA, 19 nt, Human
cauccauguuccgagaaga

SEQ ID NO: 2076627 - RNA, 15 nt, Human
cauccauuccucagg

SEQ ID NO: 2076628 - RNA, 14 nt, Human
cauccauuccucag

SEQ ID NO: 2076629 - RNA, 13 nt, Human
caucccagcggcu

SEQ ID NO: 2076630 - RNA, 14 nt, Human
cauucucacuccua

SEQ ID NO: 2076631 - RNA, 17 nt, Human
cauucucaagcccugca

SEQ ID NO: 2076632 - RNA, 16 nt, Human
cauucucaagcccugc

SEQ ID NO: 2076633 - RNA, 14 nt, Human
cauucucaagcccu

SEQ ID NO: 2076634 - RNA, 13 nt, Human
cauucucacuccu

SEQ ID NO: 2076635 - RNA, 16 nt, Human
cauucgaucucauuca

SEQ ID NO: 2076636 - RNA, 15 nt, Human
cauuccuugauaaug

SEQ ID NO: 2076637 - RNA, 20 nt, Human
cauuccuugauaauguugug

SEQ ID NO: 2076638 - RNA, 21 nt, Human
cauuaugaugugggucaagga

SEQ ID NO: 2076639 - RNA, 22 nt, Human
cauuaugagaggcaaugauugu

SEQ ID NO: 2076640 - RNA, 16 nt, Human
cauuaugagaggcaau

SEQ ID NO: 2076641 - RNA, 19 nt, Human
cauguugagccaggccugg

SEQ ID NO: 2076642 - RNA, 13 nt, Human
cauguuggccagg

SEQ ID NO: 2076643 - RNA, 12 nt, Human
cauguuggccag

SEQ ID NO: 2076644 - RNA, 21 nt, Human
cauguaucccaacuccuauaa

SEQ ID NO: 2076645 - RNA, 20 nt, Human
caugucaccggauccugggu

SEQ ID NO: 2076646 - RNA, 15 nt, Human
cauguauaauauuuu

SEQ ID NO: 2076647 - RNA, 18 nt, Human
cauguauaauauuuuuaa

SEQ ID NO: 2076648 - RNA, 20 nt, Human
cauguauaauauuuuuaauu

SEQ ID NO: 2076649 - RNA, 13 nt, Human
cauguauaaauga

SEQ ID NO: 2076650 - RNA, 14 nt, Human
cauguauaaaugaa

SEQ ID NO: 2076651 - RNA, 18 nt, Human
cauguauaaaugaaguuu

SEQ ID NO: 2076652 - RNA, 21 nt, Human
cauguauaaaugaaguuuaua

SEQ ID NO: 2076653 - RNA, 23 nt, Human
cauguauaaaugaaguuuauaca

SEQ ID NO: 2076654 - RNA, 16 nt, Human
caugcacgugugugca

SEQ ID NO: 2076655 - RNA, 16 nt, Human
caugcacccucauaca

SEQ ID NO: 2076656 - RNA, 20 nt, Human
caugcacccucauacacaga

SEQ ID NO: 2076657 - RNA, 13 nt, Human
caugcuccuggcc

SEQ ID NO: 2076658 - RNA, 22 nt, Human
caugauuaaccacuucagcuga

SEQ ID NO: 2076659 - RNA, 23 nt, Human
caugauuaaccacuucagcugac

SEQ ID NO: 2076660 - RNA, 24 nt, Human
caugauuaaccacuucagcugacu

SEQ ID NO: 2076661 - RNA, 22 nt, Human
caugaagcccaagugaaaucaa

SEQ ID NO: 2076662 - RNA, 15 nt, Human
caugaagguuucuga

SEQ ID NO: 2076663 - RNA, 18 nt, Human
caugaagguuucugaaaa

SEQ ID NO: 2076664 - RNA, 20 nt, Human
caugaaguguguuuccuuca

SEQ ID NO: 2076665 - RNA, 14 nt, Human
caugacacugaaau

SEQ ID NO: 2076666 - RNA, 15 nt, Human
caugacacugaaaug

SEQ ID NO: 2076667 - RNA, 16 nt, Human
caugacacugaaaugc

SEQ ID NO: 2076668 - RNA, 13 nt, Human
cauggccaggugg

SEQ ID NO: 2076669 - RNA, 14 nt, Human
cauggccagguggc

SEQ ID NO: 2076670 - RNA, 14 nt, Human
caugcacagcugua

SEQ ID NO: 2076671 - RNA, 21 nt, Human
cauggcaugggggccucaggg

SEQ ID NO: 2076672 - RNA, 22 nt, Human
cauggcaugggggccucagggc

SEQ ID NO: 2076673 - RNA, 18 nt, Human
ccacgauguggcccuggc

SEQ ID NO: 2076674 - RNA, 17 nt, Human
ccacgauguggcccugg

SEQ ID NO: 2076675 - RNA, 20 nt, Human
ccacgauguggcccuggccu

SEQ ID NO: 2076676 - RNA, 20 nt, Human
ccaccuuuauuaaaaucuua

SEQ ID NO: 2076677 - RNA, 17 nt, Human
ccaccuuuauuaaaauc

SEQ ID NO: 2076678 - RNA, 10 nt, Human
ccaccucagc

SEQ ID NO: 2076679 - RNA, 19 nt, Human
ccaccuuggcugcagggag

SEQ ID NO: 2076680 - RNA, 18 nt, Human
ccaccuuggcugcaggga

SEQ ID NO: 2076681 - RNA, 17 nt, Human
ccacgccuguaauccca

SEQ ID NO: 2076682 - RNA, 18 nt, Human
ccacgcuggaccuugaac

SEQ ID NO: 2076683 - RNA, 13 nt, Human
ccacgcuggagug

SEQ ID NO: 2076684 - RNA, 16 nt, Human
ccaccuuggcugcagg

SEQ ID NO: 2076685 - RNA, 15 nt, Human
ccaccuuggcugcag

SEQ ID NO: 2076686 - RNA, 14 nt, Human
ccaccuuggcugca

SEQ ID NO: 2076687 - RNA, 12 nt, Human
ccaccuuggcug

SEQ ID NO: 2076688 - RNA, 16 nt, Human
ccaccuaggccacucc

SEQ ID NO: 2076689 - RNA, 17 nt, Human
ccaccuaggccacuccu

SEQ ID NO: 2076690 - RNA, 18 nt, Human
ccaccuaggccacuccuc

SEQ ID NO: 2076691 - RNA, 20 nt, Human
ccaccuaggccacuccucca

SEQ ID NO: 2076692 - RNA, 22 nt, Human
ccaccuaggccacuccuccaaa

SEQ ID NO: 2076693 - RNA, 14 nt, Human
ccaccucaaauuua

SEQ ID NO: 2076694 - RNA, 15 nt, Human
ccaccaugcccagcu

SEQ ID NO: 2076695 - RNA, 14 nt, Human
ccaccgcuccccag

SEQ ID NO: 2076696 - RNA, 15 nt, Human
ccaccgcuccccagc

SEQ ID NO: 2076697 - RNA, 17 nt, Human
ccaccgcuccccagccc

SEQ ID NO: 2076698 - RNA, 19 nt, Human
ccaccgggcugggagcucu

SEQ ID NO: 2076699 - RNA, 21 nt, Human
ccaccgcugccuaaguggcug

SEQ ID NO: 2076700 - RNA, 21 nt, Human
ccaccgcuccccagcccaggg

SEQ ID NO: 2076701 - RNA, 13 nt, Human
ccaccgcugccua

SEQ ID NO: 2076702 - RNA, 14 nt, Human
ccaccgcugccuaa

SEQ ID NO: 2076703 - RNA, 15 nt, Human
ccaccgcugccuaag

SEQ ID NO: 2076704 - RNA, 19 nt, Human
ccaccaucaugucuggcua

SEQ ID NO: 2076705 - RNA, 18 nt, Human
ccaccaucaugucuggcu

SEQ ID NO: 2076706 - RNA, 21 nt, Human
ccaccacgauguggcccuggc

SEQ ID NO: 2076707 - RNA, 17 nt, Human
ccaccacuaggacucug

SEQ ID NO: 2076708 - RNA, 20 nt, Human
ccaccacuaggacucugagg

SEQ ID NO: 2076709 - RNA, 22 nt, Human
ccaccaggcugcucagggcugg

SEQ ID NO: 2076710 - RNA, 13 nt, Human
ccaccaggucucc

SEQ ID NO: 2076711 - RNA, 17 nt, Human
ccaccaggucucccggg

SEQ ID NO: 2076712 - RNA, 18 nt, Human
ccaccaggucucccggga

SEQ ID NO: 2076713 - RNA, 23 nt, Human
ccaccaggucucccgggaagcca

SEQ ID NO: 2076714 - RNA, 19 nt, Human
ccaccacgauguggcccug

SEQ ID NO: 2076715 - RNA, 20 nt, Human
ccaccacgauguggcccugg

SEQ ID NO: 2076716 - RNA, 12 nt, Human
ccaccaccuagg

SEQ ID NO: 2076717 - RNA, 18 nt, Human
ccaccaccuaggccacuc

SEQ ID NO: 2076718 - RNA, 20 nt, Human
ccaccaccuaggccacuccu

SEQ ID NO: 2076719 - RNA, 21 nt, Human
ccaccaccuaggccacuccuc

SEQ ID NO: 2076720 - RNA, 22 nt, Human
ccaccaccuaggccacuccucc

SEQ ID NO: 2076721 - RNA, 12 nt, Human
ccacagccgcag

SEQ ID NO: 2076722 - RNA, 15 nt, Human
ccacagccgcagccu

SEQ ID NO: 2076723 - RNA, 18 nt, Human
ccacagccgcagccuccc

SEQ ID NO: 2076724 - RNA, 23 nt, Human
ccacagcccugucagugcagccc

SEQ ID NO: 2076725 - RNA, 21 nt, Human
ccacagcccugucagugcagc

SEQ ID NO: 2076726 - RNA, 20 nt, Human
ccacagcccugucagugcag

SEQ ID NO: 2076727 - RNA, 13 nt, Human
ccacagcccaggc

SEQ ID NO: 2076728 - RNA, 15 nt, Human
ccacagcccaggccu

SEQ ID NO: 2076729 - RNA, 16 nt, Human
ccacagcccaggccuc

SEQ ID NO: 2076730 - RNA, 21 nt, Human
ccacagcccaggccuccagcu

SEQ ID NO: 2076731 - RNA, 19 nt, Human
ccacagcccgcaugcagca

SEQ ID NO: 2076732 - RNA, 13 nt, Human
ccacagcccuguc

SEQ ID NO: 2076733 - RNA, 14 nt, Human
ccacagcccuguca

SEQ ID NO: 2076734 - RNA, 15 nt, Human
ccacagcccugucag

SEQ ID NO: 2076735 - RNA, 22 nt, Human
ccacagagaaaguacuucucca

SEQ ID NO: 2076736 - RNA, 15 nt, Human
ccacagacaagguag

SEQ ID NO: 2076737 - RNA, 16 nt, Human
ccacagaagugcuuuc

SEQ ID NO: 2076738 - RNA, 21 nt, Human
ccacagacaagguagcccugg

SEQ ID NO: 2076739 - RNA, 21 nt, Human
ccacacuucaggcucuucucc

SEQ ID NO: 2076740 - RNA, 20 nt, Human
ccacacuucaggcucuucuc

SEQ ID NO: 2076741 - RNA, 16 nt, Human
ccacacuucaggcucu

SEQ ID NO: 2076742 - RNA, 16 nt, Human
cauuuuuuaaaacaag

SEQ ID NO: 2076743 - RNA, 17 nt, Human
cauuuuuuaaaacaaga

SEQ ID NO: 2076744 - RNA, 14 nt, Human
cauuugugaaauga

SEQ ID NO: 2076745 - RNA, 16 nt, Human
cauuugugaaaugaug

SEQ ID NO: 2076746 - RNA, 14 nt, Human
cauuuuuuaaaaca

SEQ ID NO: 2076747 - RNA, 15 nt, Human
cauuuuuuaaaacaa

SEQ ID NO: 2076748 - RNA, 17 nt, Human
cauuugucacacacuuu

SEQ ID NO: 2076749 - RNA, 15 nt, Human
cauuuggauuggaug

SEQ ID NO: 2076750 - RNA, 18 nt, Human
cauuucauuccuaacaca

SEQ ID NO: 2076751 - RNA, 21 nt, Human
cauuucauuccuaacacagca

SEQ ID NO: 2076752 - RNA, 15 nt, Human
cauuucauuccuaac

SEQ ID NO: 2076753 - RNA, 20 nt, Human
cauuucaucuauuucugaga

SEQ ID NO: 2076754 - RNA, 21 nt, Human
cauuucaucuaccauuuucug

SEQ ID NO: 2076755 - RNA, 14 nt, Human
cauuucaucuauuu

SEQ ID NO: 2076756 - RNA, 15 nt, Human
cauuucaucuauuuc

SEQ ID NO: 2076757 - RNA, 16 nt, Human
cauuucaucuauuucu

SEQ ID NO: 2076758 - RNA, 17 nt, Human
cauuucaucuauuucug

SEQ ID NO: 2076759 - RNA, 18 nt, Human
cauuucaucuauuucuga

SEQ ID NO: 2076760 - RNA, 21 nt, Human
cauuuauggucaacacuuaag

SEQ ID NO: 2076761 - RNA, 20 nt, Human
cauuuauggucaacacuuaa

SEQ ID NO: 2076762 - RNA, 14 nt, Human
cauuuauguuuauu

SEQ ID NO: 2076763 - RNA, 15 nt, Human
cauuuauucugcuca

SEQ ID NO: 2076764 - RNA, 14 nt, Human
cauuuauucugcuc

SEQ ID NO: 2076765 - RNA, 21 nt, Human
cauuuauaauguuugcuauug

SEQ ID NO: 2076766 - RNA, 14 nt, Human
cauuuauaauguuu

SEQ ID NO: 2076767 - RNA, 17 nt, Human
cauuuauaauguuugcu

SEQ ID NO: 2076768 - RNA, 15 nt, Human
cauuguaaacaaacu

SEQ ID NO: 2076769 - RNA, 20 nt, Human
cauugcuucacaacccaucu

SEQ ID NO: 2076770 - RNA, 15 nt, Human
cauugcuucacuacc

SEQ ID NO: 2076771 - RNA, 17 nt, Human
cauugcuucacuaccca

SEQ ID NO: 2076772 - RNA, 11 nt, Human
cauugcuuuac

SEQ ID NO: 2076773 - RNA, 14 nt, Human
cauugcuuuacugg

SEQ ID NO: 2076774 - RNA, 12 nt, Human
cauugcuuucug

SEQ ID NO: 2076775 - RNA, 14 nt, Human
cauugcuuucugaa

SEQ ID NO: 2076776 - RNA, 15 nt, Human
cauugcuuucugaaa

SEQ ID NO: 2076777 - RNA, 15 nt, Human
ccaauccucacuggg

SEQ ID NO: 2076778 - RNA, 17 nt, Human
ccaauccucacugggug

SEQ ID NO: 2076779 - RNA, 18 nt, Human
ccaauccucacugggugg

SEQ ID NO: 2076780 - RNA, 19 nt, Human
ccaaaugcaucaauccugu

SEQ ID NO: 2076781 - RNA, 19 nt, Human
ccaaauauauucucuuugg

SEQ ID NO: 2076782 - RNA, 16 nt, Human
ccaaagugguuucagc

SEQ ID NO: 2076783 - RNA, 22 nt, Human
ccaaagugguauagaaaugcug

SEQ ID NO: 2076784 - RNA, 13 nt, Human
ccaagaaagcagg

SEQ ID NO: 2076785 - RNA, 18 nt, Human
ccaagaacagcaggccca

SEQ ID NO: 2076786 - RNA, 13 nt, Human
ccaagaacugaaa

SEQ ID NO: 2076787 - RNA, 16 nt, Human
ccaagaacugaaaaca

SEQ ID NO: 2076788 - RNA, 17 nt, Human
ccaagaacugaaaacau

SEQ ID NO: 2076789 - RNA, 18 nt, Human
ccaagaacugaaaacaua

SEQ ID NO: 2076790 - RNA, 21 nt, Human
ccaagaacugaaaacauaaaa

SEQ ID NO: 2076791 - RNA, 14 nt, Human
ccaagaacugcaug

SEQ ID NO: 2076792 - RNA, 15 nt, Human
ccaagaacugcaugg

SEQ ID NO: 2076793 - RNA, 22 nt, Human
ccaacggagagcgccugccccu

SEQ ID NO: 2076794 - RNA, 11 nt, Human
ccaacuuuucu

SEQ ID NO: 2076795 - RNA, 14 nt, Human
ccaacuuuucuauu

SEQ ID NO: 2076796 - RNA, 21 nt, Human
ccaacggagagcgccugcccc

SEQ ID NO: 2076797 - RNA, 14 nt, Human
ccaacgaaaagcac

SEQ ID NO: 2076798 - RNA, 15 nt, Human
ccaacgaaaagcaca

SEQ ID NO: 2076799 - RNA, 19 nt, Human
ccaacgaaaagcacaucca

SEQ ID NO: 2076800 - RNA, 19 nt, Human
ccaagcuggucccacucag

SEQ ID NO: 2076801 - RNA, 12 nt, Human
ccaagcuggucc

SEQ ID NO: 2076802 - RNA, 21 nt, Human
ccaaggcaaggggugccuggg

SEQ ID NO: 2076803 - RNA, 22 nt, Human
ccaaggcaaggggugccuggga

SEQ ID NO: 2076804 - RNA, 20 nt, Human
cagcaccuacaguguacagu

SEQ ID NO: 2076805 - RNA, 15 nt, Human
cagcaccuacagugu

SEQ ID NO: 2076806 - RNA, 12 nt, Human
cagcacccugca

SEQ ID NO: 2076807 - RNA, 13 nt, Human
cagcacacucagc

SEQ ID NO: 2076808 - RNA, 12 nt, Human
cagcacagagag

SEQ ID NO: 2076809 - RNA, 13 nt, Human
cagcacagagagg

SEQ ID NO: 2076810 - RNA, 17 nt, Human
cagcacagagagggggc

SEQ ID NO: 2076811 - RNA, 20 nt, Human
cagcacagagagggggccac

SEQ ID NO: 2076812 - RNA, 16 nt, Human
cagcacagagaccccc

SEQ ID NO: 2076813 - RNA, 16 nt, Human
cagccaggagcugggc

SEQ ID NO: 2076814 - RNA, 15 nt, Human
cagccaggagcuggg

SEQ ID NO: 2076815 - RNA, 22 nt, Human
cagccaggagcugggcagaagg

SEQ ID NO: 2076816 - RNA, 11 nt, Human
cagccaggagc

SEQ ID NO: 2076817 - RNA, 14 nt, Human
cagccaggagcugg

SEQ ID NO: 2076818 - RNA, 12 nt, Human
cagccaggagcu

SEQ ID NO: 2076819 - RNA, 19 nt, Human
cagccagcagccagcucuc

SEQ ID NO: 2076820 - RNA, 21 nt, Human
cagccagcagccagcucucag

SEQ ID NO: 2076821 - RNA, 18 nt, Human
cagcauauuuauagcaau

SEQ ID NO: 2076822 - RNA, 17 nt, Human
cagccagcagccagcuc

SEQ ID NO: 2076823 - RNA, 18 nt, Human
cagccagcagccagcucu

SEQ ID NO: 2076824 - RNA, 12 nt, Human
cagcauauuuau

SEQ ID NO: 2076825 - RNA, 14 nt, Human
cagcauauuuauag

SEQ ID NO: 2076826 - RNA, 23 nt, Human
cagaggggaaaccaguguagccu

SEQ ID NO: 2076827 - RNA, 19 nt, Human
cagagcuguuuauggccuc

SEQ ID NO: 2076828 - RNA, 20 nt, Human
cagagcuguuuauggccuca

SEQ ID NO: 2076829 - RNA, 21 nt, Human
cagagcuguuuauggccucag

SEQ ID NO: 2076830 - RNA, 22 nt, Human
cagagcuguuuauggccucagc

SEQ ID NO: 2076831 - RNA, 14 nt, Human
cagagcugggaggg

SEQ ID NO: 2076832 - RNA, 12 nt, Human
cagagcugggug

SEQ ID NO: 2076833 - RNA, 13 nt, Human
cagagcuggguga

SEQ ID NO: 2076834 - RNA, 20 nt, Human
cagaaguuugagaucagccu

SEQ ID NO: 2076835 - RNA, 22 nt, Human
cagaaguuugagaucagccugg

SEQ ID NO: 2076836 - RNA, 23 nt, Human
cagaaguuugagaucagccuggg

SEQ ID NO: 2076837 - RNA, 20 nt, Human
cagagcugggauguuucugu

SEQ ID NO: 2076838 - RNA, 20 nt, Human
cagaguauuugaaaaaugua

SEQ ID NO: 2076839 - RNA, 13 nt, Human
cagagucagcaga

SEQ ID NO: 2076840 - RNA, 15 nt, Human
cagauauuuuuucag

SEQ ID NO: 2076841 - RNA, 20 nt, Human
cagauauuuuuucagaaaua

SEQ ID NO: 2076842 - RNA, 14 nt, Human
cagagucagcagaa

SEQ ID NO: 2076843 - RNA, 11 nt, Human
cagauauuuau

SEQ ID NO: 2076844 - RNA, 12 nt, Human
cagauauuuaua

SEQ ID NO: 2076845 - RNA, 14 nt, Human
cagauauuuauauu

SEQ ID NO: 2076846 - RNA, 16 nt, Human
cagauauuuauauuuu

SEQ ID NO: 2076847 - RNA, 20 nt, Human
cagauauuuauauuuuuauu

SEQ ID NO: 2076848 - RNA, 21 nt, Human
cagauauuuauauuuuuauuu

SEQ ID NO: 2076849 - RNA, 22 nt, Human
cagauauuuauauuuuuauuuu

SEQ ID NO: 2076850 - RNA, 16 nt, Human
cagcugcaccugccag

SEQ ID NO: 2076851 - RNA, 21 nt, Human
cagcugauuuuaacaauaacu

SEQ ID NO: 2076852 - RNA, 17 nt, Human
cagcugcaccugccagc

SEQ ID NO: 2076853 - RNA, 18 nt, Human
cagcugcaccugccagcc

SEQ ID NO: 2076854 - RNA, 20 nt, Human
cagcugcaccugccagccug

SEQ ID NO: 2076855 - RNA, 21 nt, Human
cagcugcaccugccagccugg

SEQ ID NO: 2076856 - RNA, 20 nt, Human
cagcugauuuuaacaauaac

SEQ ID NO: 2076857 - RNA, 12 nt, Human
cagcucccaccc

SEQ ID NO: 2076858 - RNA, 14 nt, Human
cagcucccacccca

SEQ ID NO: 2076859 - RNA, 15 nt, Human
cagcucccaccccac

SEQ ID NO: 2076860 - RNA, 19 nt, Human
cagcucccaccccaccccc

SEQ ID NO: 2076861 - RNA, 20 nt, Human
cagcucccaccccacccccu

SEQ ID NO: 2076862 - RNA, 16 nt, Human
cagcugcagcugggcu

SEQ ID NO: 2076863 - RNA, 16 nt, Human
cagcugcagagacaga

SEQ ID NO: 2076864 - RNA, 13 nt, Human
cagcugccagaga

SEQ ID NO: 2076865 - RNA, 17 nt, Human
cagcugcagcugggcug

SEQ ID NO: 2076866 - RNA, 16 nt, Human
cagcugcaucuacuca

SEQ ID NO: 2076867 - RNA, 17 nt, Human
cagcugcaucuacucag

SEQ ID NO: 2076868 - RNA, 15 nt, Human
cagcugcagagacag

SEQ ID NO: 2076869 - RNA, 22 nt, Human
cagcugcaccugccagccuggc

SEQ ID NO: 2076870 - RNA, 15 nt, Human
cagcugcccccgcuc

SEQ ID NO: 2076871 - RNA, 20 nt, Human
cagcugcccccgcucauggg

SEQ ID NO: 2076872 - RNA, 16 nt, Human
cagcugccagagaagc

SEQ ID NO: 2076873 - RNA, 14 nt, Human
cagcugccagagaa

SEQ ID NO: 2076874 - RNA, 15 nt, Human
cagcugccagagaag

SEQ ID NO: 2076875 - RNA, 19 nt, Human
cagcugccgaccagagccc

SEQ ID NO: 2076876 - RNA, 18 nt, Human
cagcugccgaccagagcc

SEQ ID NO: 2076877 - RNA, 17 nt, Human
cagcugccgaccagagc

SEQ ID NO: 2076878 - RNA, 12 nt, Human
cagcugccccuc

SEQ ID NO: 2076879 - RNA, 13 nt, Human
cagcugccccucc

SEQ ID NO: 2076880 - RNA, 15 nt, Human
cagcugccccucccu

SEQ ID NO: 2076881 - RNA, 16 nt, Human
cagcugccccucccug

SEQ ID NO: 2076882 - RNA, 19 nt, Human
cagcugccccucccugcca

SEQ ID NO: 2076883 - RNA, 22 nt, Human
caggaacacccgacuccucaaa

SEQ ID NO: 2076884 - RNA, 12 nt, Human
caggaacagaag

SEQ ID NO: 2076885 - RNA, 18 nt, Human
cagcuucaugccuuugua

SEQ ID NO: 2076886 - RNA, 19 nt, Human
cagcuucaugccuuuguaa

SEQ ID NO: 2076887 - RNA, 20 nt, Human
cagcuucaugccuuuguaag

SEQ ID NO: 2076888 - RNA, 21 nt, Human
cagcuucaugccuuuguaagu

SEQ ID NO: 2076889 - RNA, 18 nt, Human
cagcuucauuuccugugu

SEQ ID NO: 2076890 - RNA, 17 nt, Human
cagcuucagccaggagc

SEQ ID NO: 2076891 - RNA, 15 nt, Human
cagcuucagccagga

SEQ ID NO: 2076892 - RNA, 15 nt, Human
cagcuucauuuccug

SEQ ID NO: 2076893 - RNA, 18 nt, Human
cagcugugcucuggacag

SEQ ID NO: 2076894 - RNA, 20 nt, Human
cagcugucugugucagccug

SEQ ID NO: 2076895 - RNA, 20 nt, Human
cagcuccagcucaccagccc

SEQ ID NO: 2076896 - RNA, 18 nt, Human
cagcuccagcucaccagc

SEQ ID NO: 2076897 - RNA, 17 nt, Human
cagcuccagcucaccag

SEQ ID NO: 2076898 - RNA, 16 nt, Human
cagcuccagcucacca

SEQ ID NO: 2076899 - RNA, 21 nt, Human
cagcucccaaggcucugagca

SEQ ID NO: 2076900 - RNA, 14 nt, Human
cagcuccagggcca

SEQ ID NO: 2076901 - RNA, 19 nt, Human
cagcuccacucugacuggc

SEQ ID NO: 2076902 - RNA, 22 nt, Human
cagcuccagcucaccagcccca

SEQ ID NO: 2076903 - RNA, 14 nt, Human
cagcuccagcugcu

SEQ ID NO: 2076904 - RNA, 23 nt, Human
cagcuccacucugacuggcacag

SEQ ID NO: 2076905 - RNA, 15 nt, Human
cagcuccagcucacc

SEQ ID NO: 2076906 - RNA, 14 nt, Human
cagcuccagcucac

SEQ ID NO: 2076907 - RNA, 13 nt, Human
cagcuccagcuca

SEQ ID NO: 2076908 - RNA, 18 nt, Human
cagccucuuggccccaga

SEQ ID NO: 2076909 - RNA, 15 nt, Human
cagccucuuaaagcu

SEQ ID NO: 2076910 - RNA, 19 nt, Human
cagccucuuaaagcugccu

SEQ ID NO: 2076911 - RNA, 20 nt, Human
cagccucuuaaagcugccug

SEQ ID NO: 2076912 - RNA, 21 nt, Human
cagccucuuaaagcugccugu

SEQ ID NO: 2076913 - RNA, 14 nt, Human
cagccggggaagac

SEQ ID NO: 2076914 - RNA, 17 nt, Human
cagccggggaagacuug

SEQ ID NO: 2076915 - RNA, 15 nt, Human
cagccggggccugcc

SEQ ID NO: 2076916 - RNA, 11 nt, Human
cagccucuuaa

SEQ ID NO: 2076917 - RNA, 16 nt, Human
cagccgcagccucccu

SEQ ID NO: 2076918 - RNA, 19 nt, Human
cagccgcagccucccucug

SEQ ID NO: 2076919 - RNA, 14 nt, Human
cagccgcuucugac

SEQ ID NO: 2076920 - RNA, 18 nt, Human
cagccgcuucugacugcu

SEQ ID NO: 2076921 - RNA, 14 nt, Human
cagccggcacccac

SEQ ID NO: 2076922 - RNA, 23 nt, Human
cagccccugccccucaugccaac

SEQ ID NO: 2076923 - RNA, 21 nt, Human
cagccgaguggauagaugccc

SEQ ID NO: 2076924 - RNA, 21 nt, Human
cagcccuuagcagggaaacag

SEQ ID NO: 2076925 - RNA, 16 nt, Human
cagcccuuagcaggga

SEQ ID NO: 2076926 - RNA, 15 nt, Human
cagcccuuagcaggg

SEQ ID NO: 2076927 - RNA, 17 nt, Human
cagcggggacagcuccu

SEQ ID NO: 2076928 - RNA, 16 nt, Human
cagcggggacagcucc

SEQ ID NO: 2076929 - RNA, 15 nt, Human
cagcggggacagcuc

SEQ ID NO: 2076930 - RNA, 15 nt, Human
cagcguacucaucau

SEQ ID NO: 2076931 - RNA, 15 nt, Human
cagcgguuuggggag

SEQ ID NO: 2076932 - RNA, 17 nt, Human
cagcguagccucuccgg

SEQ ID NO: 2076933 - RNA, 12 nt, Human
caggagcucuuc

SEQ ID NO: 2076934 - RNA, 15 nt, Human
caggagcucuucagg

SEQ ID NO: 2076935 - RNA, 18 nt, Human
caggagcucuucaggccu

SEQ ID NO: 2076936 - RNA, 19 nt, Human
caggagcucuucaggccuc

SEQ ID NO: 2076937 - RNA, 20 nt, Human
caggagcucuucaggccucc

SEQ ID NO: 2076938 - RNA, 23 nt, Human
caggagcugggcagaaggccaag

SEQ ID NO: 2076939 - RNA, 15 nt, Human
caggagcugggcaga

SEQ ID NO: 2076940 - RNA, 12 nt, Human
caggagcugggc

SEQ ID NO: 2076941 - RNA, 22 nt, Human
caggagcucuucaggccucccu

SEQ ID NO: 2076942 - RNA, 23 nt, Human
caggagcucuucaggccucccuc

SEQ ID NO: 2076943 - RNA, 14 nt, Human
caggagcugggauc

SEQ ID NO: 2076944 - RNA, 22 nt, Human
caggagcugggauccuaagggc

SEQ ID NO: 2076945 - RNA, 15 nt, Human
caggacccucgcugg

SEQ ID NO: 2076946 - RNA, 17 nt, Human
caggacccucgcuggcc

SEQ ID NO: 2076947 - RNA, 18 nt, Human
caggacccucgcuggccc

SEQ ID NO: 2076948 - RNA, 19 nt, Human
caggacccucgcuggcccc

SEQ ID NO: 2076949 - RNA, 20 nt, Human
caggacccucgcuggccccc

SEQ ID NO: 2076950 - RNA, 21 nt, Human
caggacccucgcuggccccca

SEQ ID NO: 2076951 - RNA, 22 nt, Human
caggacccucgcuggcccccac

SEQ ID NO: 2076952 - RNA, 14 nt, Human
caggaacagaagga

SEQ ID NO: 2076953 - RNA, 13 nt, Human
caggaacagaagg

SEQ ID NO: 2076954 - RNA, 12 nt, Human
caggagggaggu

SEQ ID NO: 2076955 - RNA, 19 nt, Human
caggagggagguuugugag

SEQ ID NO: 2076956 - RNA, 23 nt, Human
caggagggagguuugugagagcg

SEQ ID NO: 2076957 - RNA, 16 nt, Human
caggagggcccuaccu

SEQ ID NO: 2076958 - RNA, 12 nt, Human
caggagggcccu

SEQ ID NO: 2076959 - RNA, 13 nt, Human
caggaggggagug

SEQ ID NO: 2076960 - RNA, 22 nt, Human
caggaggggagugaggcaggug

SEQ ID NO: 2076961 - RNA, 20 nt, Human
caggagguggaggcugcagu

SEQ ID NO: 2076962 - RNA, 12 nt, Human
caggagggaggg

SEQ ID NO: 2076963 - RNA, 23 nt, Human
caggcacccaccaucaugucugg

SEQ ID NO: 2076964 - RNA, 22 nt, Human
caggcacccaccaucaugucug

SEQ ID NO: 2076965 - RNA, 18 nt, Human
caggcacccaccaucaug

SEQ ID NO: 2076966 - RNA, 15 nt, Human
caggagguggagguu

SEQ ID NO: 2076967 - RNA, 19 nt, Human
caggagguggagguugcag

SEQ ID NO: 2076968 - RNA, 11 nt, Human
caggagggagg

SEQ ID NO: 2076969 - RNA, 20 nt, Human
caggagguggagguugcagu

SEQ ID NO: 2076970 - RNA, 13 nt, Human
caggcagaucugu

SEQ ID NO: 2076971 - RNA, 15 nt, Human
caggcagaucugugc

SEQ ID NO: 2076972 - RNA, 16 nt, Human
caggcagaucugugcc

SEQ ID NO: 2076973 - RNA, 17 nt, Human
caggcagaucugugccc

SEQ ID NO: 2076974 - RNA, 18 nt, Human
caggcagaucugugcccc

SEQ ID NO: 2076975 - RNA, 19 nt, Human
caggcagaucugugcccca

SEQ ID NO: 2076976 - RNA, 21 nt, Human
caggcagaucugugccccaug

SEQ ID NO: 2076977 - RNA, 22 nt, Human
caggcagaucugugccccaugc

SEQ ID NO: 2076978 - RNA, 21 nt, Human
caggccagagggagugacaga

SEQ ID NO: 2076979 - RNA, 19 nt, Human
caggccagagggagugaca

SEQ ID NO: 2076980 - RNA, 13 nt, Human
caggcagcauuua

SEQ ID NO: 2076981 - RNA, 15 nt, Human
caggcagcacagaga

SEQ ID NO: 2076982 - RNA, 23 nt, Human
caggccagagggagugacagagg

SEQ ID NO: 2076983 - RNA, 19 nt, Human
caggcugggcuucaguggc

SEQ ID NO: 2076984 - RNA, 17 nt, Human
caggcugggcuucagug

SEQ ID NO: 2076985 - RNA, 13 nt, Human
cagggaggcacca

SEQ ID NO: 2076986 - RNA, 22 nt, Human
cagggaggcaccauucaggaac

SEQ ID NO: 2076987 - RNA, 24 nt, Human
cagggaggcaccauucaggaaccu

SEQ ID NO: 2076988 - RNA, 23 nt, Human
cagggaggagguggcagcccugu

SEQ ID NO: 2076989 - RNA, 16 nt, Human
caggcugggcuucagu

SEQ ID NO: 2076990 - RNA, 15 nt, Human
caggcuggcgugcag

SEQ ID NO: 2076991 - RNA, 17 nt, Human
caggcgccccuuccccc

SEQ ID NO: 2076992 - RNA, 13 nt, Human
caggccuccagcu

SEQ ID NO: 2076993 - RNA, 14 nt, Human
caggccuccagcuc

SEQ ID NO: 2076994 - RNA, 15 nt, Human
caggccuccagcuca

SEQ ID NO: 2076995 - RNA, 16 nt, Human
caggccuccagcucag

SEQ ID NO: 2076996 - RNA, 17 nt, Human
caggccuccagcucagc

SEQ ID NO: 2076997 - RNA, 19 nt, Human
caggccuccagcucagcag

SEQ ID NO: 2076998 - RNA, 12 nt, Human
caggccucccuc

SEQ ID NO: 2076999 - RNA, 20 nt, Human
caggcgauccaccugucuca

SEQ ID NO: 2077000 - RNA, 15 nt, Human
caggcgccccuuccc

SEQ ID NO: 2077001 - RNA, 20 nt, Human
caggccugccuguucccauu

SEQ ID NO: 2077002 - RNA, 18 nt, Human
caggccugccagacggca

SEQ ID NO: 2077003 - RNA, 12 nt, Human
caggccugccag

SEQ ID NO: 2077004 - RNA, 14 nt, Human
caggccugccagac

SEQ ID NO: 2077005 - RNA, 22 nt, Human
caggccucccucucucuucugc

SEQ ID NO: 2077006 - RNA, 23 nt, Human
caggccucccucucucuucugcu

SEQ ID NO: 2077007 - RNA, 13 nt, Human
caggccucccucu

SEQ ID NO: 2077008 - RNA, 14 nt, Human
caggccucccucuc

SEQ ID NO: 2077009 - RNA, 15 nt, Human
caggccucccucucu

SEQ ID NO: 2077010 - RNA, 16 nt, Human
caggccucccucucuc

SEQ ID NO: 2077011 - RNA, 17 nt, Human
caggccucccucucucu

SEQ ID NO: 2077012 - RNA, 18 nt, Human
caggccucccucucucuu

SEQ ID NO: 2077013 - RNA, 19 nt, Human
caggccucccucucucuuc

SEQ ID NO: 2077014 - RNA, 18 nt, Human
cagggaggugaccccagg

SEQ ID NO: 2077015 - RNA, 22 nt, Human
cagggaguccgaaagggacuug

SEQ ID NO: 2077016 - RNA, 17 nt, Human
cagggagguggcugggu

SEQ ID NO: 2077017 - RNA, 14 nt, Human
cagggagguggcug

SEQ ID NO: 2077018 - RNA, 20 nt, Human
caggugauccacccaccuca

SEQ ID NO: 2077019 - RNA, 15 nt, Human
caggugcacagacgu

SEQ ID NO: 2077020 - RNA, 23 nt, Human
caggugcacagacgucccuccac

SEQ ID NO: 2077021 - RNA, 14 nt, Human
caggguuggccccu

SEQ ID NO: 2077022 - RNA, 12 nt, Human
caggguuggccc

SEQ ID NO: 2077023 - RNA, 17 nt, Human
caggugauccacccacc

SEQ ID NO: 2077024 - RNA, 16 nt, Human
caggugauccacccac

SEQ ID NO: 2077025 - RNA, 14 nt, Human
cagguugguggggg

SEQ ID NO: 2077026 - RNA, 14 nt, Human
caggugcgaaagga

SEQ ID NO: 2077027 - RNA, 12 nt, Human
caggugcagugg

SEQ ID NO: 2077028 - RNA, 13 nt, Human
caggugcaguggc

SEQ ID NO: 2077029 - RNA, 15 nt, Human
caggugcaguggcuc

SEQ ID NO: 2077030 - RNA, 20 nt, Human
cagggugggauggaggagaa

SEQ ID NO: 2077031 - RNA, 13 nt, Human
cagggucuucccu

SEQ ID NO: 2077032 - RNA, 17 nt, Human
cagggucuucccuaccu

SEQ ID NO: 2077033 - RNA, 21 nt, Human
cagggucuucccuaccucagg

SEQ ID NO: 2077034 - RNA, 15 nt, Human
caggguucuccucuc

SEQ ID NO: 2077035 - RNA, 22 nt, Human
caggguucccccagcccugugg

SEQ ID NO: 2077036 - RNA, 17 nt, Human
caggguucuccucuccc

SEQ ID NO: 2077037 - RNA, 20 nt, Human
caggguucuccucuccccuc

SEQ ID NO: 2077038 - RNA, 21 nt, Human
caggguucuccucuccccucu

SEQ ID NO: 2077039 - RNA, 18 nt, Human
caggguucaaaaugucug

SEQ ID NO: 2077040 - RNA, 15 nt, Human
caggguucccccagc

SEQ ID NO: 2077041 - RNA, 17 nt, Human
caggguucccccagccc

SEQ ID NO: 2077042 - RNA, 18 nt, Human
caggguucccccagcccu

SEQ ID NO: 2077043 - RNA, 20 nt, Human
caggguucccccagcccugu

SEQ ID NO: 2077044 - RNA, 21 nt, Human
caggguucccccagcccugug

SEQ ID NO: 2077045 - RNA, 18 nt, Human
cagggucucacucugucg

SEQ ID NO: 2077046 - RNA, 17 nt, Human
cagggucucacucuguc

SEQ ID NO: 2077047 - RNA, 21 nt, Human
cagggucucacucugucgccc

SEQ ID NO: 2077048 - RNA, 22 nt, Human
cagggucucacucugucgccca

SEQ ID NO: 2077049 - RNA, 15 nt, Human
cagucaaaacagaga

SEQ ID NO: 2077050 - RNA, 19 nt, Human
cagucaaaacagagaugug

SEQ ID NO: 2077051 - RNA, 22 nt, Human
caguauuuuuguuguguucugu

SEQ ID NO: 2077052 - RNA, 16 nt, Human
cagguuuaagcuguua

SEQ ID NO: 2077053 - RNA, 18 nt, Human
cagguuuaagcuguuacu

SEQ ID NO: 2077054 - RNA, 20 nt, Human
caggguguugucagcaucuu

SEQ ID NO: 2077055 - RNA, 15 nt, Human
cagucaaggaguggc

SEQ ID NO: 2077056 - RNA, 14 nt, Human
cagugccauugucu

SEQ ID NO: 2077057 - RNA, 15 nt, Human
cagugccauugucuu

SEQ ID NO: 2077058 - RNA, 16 nt, Human
cagugccauugucuuu

SEQ ID NO: 2077059 - RNA, 17 nt, Human
cagugccauugucuuua

SEQ ID NO: 2077060 - RNA, 18 nt, Human
cagugccauugucuuuau

SEQ ID NO: 2077061 - RNA, 19 nt, Human
cagugccauugucuuuaua

SEQ ID NO: 2077062 - RNA, 21 nt, Human
cagugccauugucuuuauaug

SEQ ID NO: 2077063 - RNA, 22 nt, Human
cagugccauugucuuuauauga

SEQ ID NO: 2077064 - RNA, 15 nt, Human
cagugccaagcacag

SEQ ID NO: 2077065 - RNA, 23 nt, Human
cagugccaagcacagugccugca

SEQ ID NO: 2077066 - RNA, 19 nt, Human
cagugccaagcacagugcc

SEQ ID NO: 2077067 - RNA, 16 nt, Human
cagugggacagggcau

SEQ ID NO: 2077068 - RNA, 19 nt, Human
cagugggacagggcauggc

SEQ ID NO: 2077069 - RNA, 12 nt, Human
cagugcccacag

SEQ ID NO: 2077070 - RNA, 11 nt, Human
cagugggagcu

SEQ ID NO: 2077071 - RNA, 18 nt, Human
cagugggagccagggcug

SEQ ID NO: 2077072 - RNA, 17 nt, Human
cagugggagccagggcu

SEQ ID NO: 2077073 - RNA, 13 nt, Human
cagugggagccag

SEQ ID NO: 2077074 - RNA, 14 nt, Human
cagugggagaaaac

SEQ ID NO: 2077075 - RNA, 20 nt, Human
cagucugauucccaagcucu

SEQ ID NO: 2077076 - RNA, 19 nt, Human
cagucugauucccaagcuc

SEQ ID NO: 2077077 - RNA, 22 nt, Human
cagugcaaugguauaaauuuca

SEQ ID NO: 2077078 - RNA, 15 nt, Human
cagugcacccacucu

SEQ ID NO: 2077079 - RNA, 16 nt, Human
cagugcagcccgugug

SEQ ID NO: 2077080 - RNA, 22 nt, Human
cagugcagcccguguggccccu

SEQ ID NO: 2077081 - RNA, 17 nt, Human
cagugcaccugucauau

SEQ ID NO: 2077082 - RNA, 20 nt, Human
cagugcagcaaccagagcac

SEQ ID NO: 2077083 - RNA, 22 nt, Human
cagugcagcaaccagagcacug

SEQ ID NO: 2077084 - RNA, 23 nt, Human
cagugcagcaaccagagcacugu

SEQ ID NO: 2077085 - RNA, 18 nt, Human
cagucucaggagcauggg

SEQ ID NO: 2077086 - RNA, 19 nt, Human
cagucucaggagcaugggg

SEQ ID NO: 2077087 - RNA, 17 nt, Human
cagucucacccagacuc

SEQ ID NO: 2077088 - RNA, 13 nt, Human
cagucucaggagc

SEQ ID NO: 2077089 - RNA, 14 nt, Human
cagucucaggagca

SEQ ID NO: 2077090 - RNA, 22 nt, Human
cagucugaugagaacucugagc

SEQ ID NO: 2077091 - RNA, 14 nt, Human
auugcuugcacaaa

SEQ ID NO: 2077092 - RNA, 16 nt, Human
auugcuuguuggauuu

SEQ ID NO: 2077093 - RNA, 15 nt, Human
auugcuugauacuuu

SEQ ID NO: 2077094 - RNA, 16 nt, Human
auugcuuaaaauagca

SEQ ID NO: 2077095 - RNA, 17 nt, Human
auugcuuaaaauagcaa

SEQ ID NO: 2077096 - RNA, 15 nt, Human
auugcuuugaaacua

SEQ ID NO: 2077097 - RNA, 13 nt, Human
auugcuuucugaa

SEQ ID NO: 2077098 - RNA, 15 nt, Human
auugcuuucugaaau

SEQ ID NO: 2077099 - RNA, 16 nt, Human
auugcuuucugaaauu

SEQ ID NO: 2077100 - RNA, 17 nt, Human
auugcuuucugaaauua

SEQ ID NO: 2077101 - RNA, 13 nt, Human
auugcuuuacugg

SEQ ID NO: 2077102 - RNA, 14 nt, Human
auugcuuuccacug

SEQ ID NO: 2077103 - RNA, 11 nt, Human
auugcuuucug

SEQ ID NO: 2077104 - RNA, 19 nt, Human
auugcuguguccaacucca

SEQ ID NO: 2077105 - RNA, 20 nt, Human
auugcuguguccaacuccag

SEQ ID NO: 2077106 - RNA, 21 nt, Human
auugcuguguccaacuccagu

SEQ ID NO: 2077107 - RNA, 22 nt, Human
auugcuguguccaacuccagua

SEQ ID NO: 2077108 - RNA, 23 nt, Human
auugcuguguccaacuccaguac

SEQ ID NO: 2077109 - RNA, 10 nt, Human
auuguaacuc

SEQ ID NO: 2077110 - RNA, 13 nt, Human
auuguaagauaaa

SEQ ID NO: 2077111 - RNA, 14 nt, Human
auuguaagauaaaa

SEQ ID NO: 2077112 - RNA, 16 nt, Human
auuguaagauaaaaaa

SEQ ID NO: 2077113 - RNA, 16 nt, Human
auuguguguuauuuaa

SEQ ID NO: 2077114 - RNA, 18 nt, Human
auuguguguuauuuaaau

SEQ ID NO: 2077115 - RNA, 22 nt, Human
auuguuaagucuaaauauuucc

SEQ ID NO: 2077116 - RNA, 21 nt, Human
auuguuaagucuaaauauuuc

SEQ ID NO: 2077117 - RNA, 14 nt, Human
auuguuaaaggcua

SEQ ID NO: 2077118 - RNA, 23 nt, Human
auuguuaagucuaaauauuuccu

SEQ ID NO: 2077119 - RNA, 13 nt, Human
auuguuaaaauaa

SEQ ID NO: 2077120 - RNA, 15 nt, Human
auuguuaaaauaacu

SEQ ID NO: 2077121 - RNA, 15 nt, Human
auuuaugaguuuuug

SEQ ID NO: 2077122 - RNA, 18 nt, Human
auuuaugaguuuuugaua

SEQ ID NO: 2077123 - RNA, 19 nt, Human
auuuaugaguuuuugauag

SEQ ID NO: 2077124 - RNA, 12 nt, Human
auuuauggagga

SEQ ID NO: 2077125 - RNA, 13 nt, Human
auuuaugaaaaga

SEQ ID NO: 2077126 - RNA, 20 nt, Human
auuuaucuguguuuuugaaa

SEQ ID NO: 2077127 - RNA, 19 nt, Human
auuuaucuugucucugggc

SEQ ID NO: 2077128 - RNA, 19 nt, Human
auuuaucugagucaacucc

SEQ ID NO: 2077129 - RNA, 20 nt, Human
auuuaucugggauuaugguu

SEQ ID NO: 2077130 - RNA, 16 nt, Human
auuuaucugugcaaau

SEQ ID NO: 2077131 - RNA, 22 nt, Human
auuuauauguauccaguacauu

SEQ ID NO: 2077132 - RNA, 20 nt, Human
auuuauauauuuauaacuca

SEQ ID NO: 2077133 - RNA, 17 nt, Human
auuuauaagcagauuua

SEQ ID NO: 2077134 - RNA, 14 nt, Human
auuuauaagcagau

SEQ ID NO: 2077135 - RNA, 22 nt, Human
auuuauaagcagauuuaacaau

SEQ ID NO: 2077136 - RNA, 22 nt, Human
auuuauaacucaucauaaaaua

SEQ ID NO: 2077137 - RNA, 23 nt, Human
auuuauaacucaucauaaaauaa

SEQ ID NO: 2077138 - RNA, 15 nt, Human
auuuauaacucauca

SEQ ID NO: 2077139 - RNA, 16 nt, Human
auuuauaacucaucau

SEQ ID NO: 2077140 - RNA, 17 nt, Human
auuuauaacucaucaua

SEQ ID NO: 2077141 - RNA, 18 nt, Human
auuuauaacucaucauaa

SEQ ID NO: 2077142 - RNA, 19 nt, Human
auuuauaacucaucauaaa

SEQ ID NO: 2077143 - RNA, 20 nt, Human
auuuauaacucaucauaaaa

SEQ ID NO: 2077144 - RNA, 21 nt, Human
auuuauaacucaucauaaaau

SEQ ID NO: 2077145 - RNA, 16 nt, Human
auuuaaugaaagacug

SEQ ID NO: 2077146 - RNA, 15 nt, Human
auuuaaugaaagacu

SEQ ID NO: 2077147 - RNA, 20 nt, Human
auuuaaugaaagacuguaca

SEQ ID NO: 2077148 - RNA, 21 nt, Human
auuuaaugaaagacuguacaa

SEQ ID NO: 2077149 - RNA, 11 nt, Human
auuuaauaaag

SEQ ID NO: 2077150 - RNA, 13 nt, Human
auuuaauaacaua

SEQ ID NO: 2077151 - RNA, 13 nt, Human
auuucugugggag

SEQ ID NO: 2077152 - RNA, 16 nt, Human
auuucugugggagaau

SEQ ID NO: 2077153 - RNA, 12 nt, Human
auuucuauuuau

SEQ ID NO: 2077154 - RNA, 13 nt, Human
auuucuaucccaa

SEQ ID NO: 2077155 - RNA, 16 nt, Human
auuucuauuuauuuac

SEQ ID NO: 2077156 - RNA, 13 nt, Human
auuucuauuuauu

SEQ ID NO: 2077157 - RNA, 17 nt, Human
auuucuauuuauuuacu

SEQ ID NO: 2077158 - RNA, 12 nt, Human
auuucuauuuuu

SEQ ID NO: 2077159 - RNA, 13 nt, Human
auucaauaagcau

SEQ ID NO: 2077160 - RNA, 18 nt, Human
auuaugcuguauuuucuu

SEQ ID NO: 2077161 - RNA, 16 nt, Human
auuauggaagauuuua

SEQ ID NO: 2077162 - RNA, 17 nt, Human
auuauggaagauuuuaa

SEQ ID NO: 2077163 - RNA, 20 nt, Human
auuauggaagauuuuaaauu

SEQ ID NO: 2077164 - RNA, 16 nt, Human
auucaaccacuguaaa

SEQ ID NO: 2077165 - RNA, 22 nt, Human
auucaaccacuguaaaaugaaa

SEQ ID NO: 2077166 - RNA, 19 nt, Human
auucaaccacuguaaaaug

SEQ ID NO: 2077167 - RNA, 15 nt, Human
auuagguuuuguaca

SEQ ID NO: 2077168 - RNA, 16 nt, Human
auuaguaaaugcuuau

SEQ ID NO: 2077169 - RNA, 21 nt, Human
auuagguuuuguacaauugaa

SEQ ID NO: 2077170 - RNA, 14 nt, Human
auuaguaaagaaau

SEQ ID NO: 2077171 - RNA, 18 nt, Human
auuaaauuaggaauaaau

SEQ ID NO: 2077172 - RNA, 16 nt, Human
auuaggauuucaugau

SEQ ID NO: 2077173 - RNA, 14 nt, Human
auuaggauuucaug

SEQ ID NO: 2077174 - RNA, 13 nt, Human
auuaaauuaggaa

SEQ ID NO: 2077175 - RNA, 22 nt, Human
auucuucuguacgucugacagg

SEQ ID NO: 2077176 - RNA, 20 nt, Human
auucuucugcuucagccucc

SEQ ID NO: 2077177 - RNA, 19 nt, Human
auucuucugcuucagccuc

SEQ ID NO: 2077178 - RNA, 21 nt, Human
auuccuuggcaugccuuccag

SEQ ID NO: 2077179 - RNA, 21 nt, Human
auucuccuuuuuaccccucua

SEQ ID NO: 2077180 - RNA, 11 nt, Human
auuccuuuccc

SEQ ID NO: 2077181 - RNA, 13 nt, Human
auuccuugauaau

SEQ ID NO: 2077182 - RNA, 20 nt, Human
auuccuugauaauguugugg

SEQ ID NO: 2077183 - RNA, 20 nt, Human
auuccuuggcaugccuucca

SEQ ID NO: 2077184 - RNA, 12 nt, Human
auuccuugugaa

SEQ ID NO: 2077185 - RNA, 15 nt, Human
auuccugcauuugug

SEQ ID NO: 2077186 - RNA, 19 nt, Human
auuccugcagccuggaggc

SEQ ID NO: 2077187 - RNA, 18 nt, Human
auuccugcauuugugaaa

SEQ ID NO: 2077188 - RNA, 14 nt, Human
auuccucagggaca

SEQ ID NO: 2077189 - RNA, 15 nt, Human
auuccugccugucuc

SEQ ID NO: 2077190 - RNA, 17 nt, Human
auuccugccugucuccu

SEQ ID NO: 2077191 - RNA, 10 nt, Human
auuccugggc

SEQ ID NO: 2077192 - RNA, 15 nt, Human
auuccuggagcccga

SEQ ID NO: 2077193 - RNA, 21 nt, Human
auuccuggagcccgaggcacc

SEQ ID NO: 2077194 - RNA, 23 nt, Human
auuccuggagcccgaggcaccag

SEQ ID NO: 2077195 - RNA, 20 nt, Human
auuccuuagcuuagaccuca

SEQ ID NO: 2077196 - RNA, 21 nt, Human
auuccuuagcuuagaccucag

SEQ ID NO: 2077197 - RNA, 24 nt, Human
auuccuuagcuuagaccucagccu

SEQ ID NO: 2077198 - RNA, 22 nt, Human
auuccuuagcuuagaccucagc

SEQ ID NO: 2077199 - RNA, 23 nt, Human
auuccuuagcuuagaccucagcc

SEQ ID NO: 2077200 - RNA, 22 nt, Human
caaaugagaaaaugucuuuauu

SEQ ID NO: 2077201 - RNA, 20 nt, Human
caaaugagaucuaagccuuu

SEQ ID NO: 2077202 - RNA, 18 nt, Human
caaaugcugcgcccuucc

SEQ ID NO: 2077203 - RNA, 19 nt, Human
caaaugcugcgcccuuccc

SEQ ID NO: 2077204 - RNA, 20 nt, Human
caaaugcugcgcccuucccc

SEQ ID NO: 2077205 - RNA, 21 nt, Human
caaaugcugcgcccuucccca

SEQ ID NO: 2077206 - RNA, 19 nt, Human
caacaaauuagguuuugua

SEQ ID NO: 2077207 - RNA, 21 nt, Human
caacaaauuagguuuuguaca

SEQ ID NO: 2077208 - RNA, 18 nt, Human
caaaugcaucaauccugu

SEQ ID NO: 2077209 - RNA, 19 nt, Human
caacaaagccaacagucaa

SEQ ID NO: 2077210 - RNA, 22 nt, Human
caaaugaccagcagauucaaau

SEQ ID NO: 2077211 - RNA, 13 nt, Human
caaaggguggaau

SEQ ID NO: 2077212 - RNA, 23 nt, Human
caaagggugaagcuauuuaucug

SEQ ID NO: 2077213 - RNA, 22 nt, Human
caaaguagaagucuuagaugua

SEQ ID NO: 2077214 - RNA, 19 nt, Human
caaaguaucaggacgagaa

SEQ ID NO: 2077215 - RNA, 19 nt, Human
caaagggugaagcuauuua

SEQ ID NO: 2077216 - RNA, 20 nt, Human
caaagggugaagcuauuuau

SEQ ID NO: 2077217 - RNA, 21 nt, Human
caaagggugaagcuauuuauc

SEQ ID NO: 2077218 - RNA, 11 nt, Human
caacacacaga

SEQ ID NO: 2077219 - RNA, 18 nt, Human
caacacaauguuauucgu

SEQ ID NO: 2077220 - RNA, 14 nt, Human
caacacacacacuc

SEQ ID NO: 2077221 - RNA, 14 nt, Human
caacacaagguggg

SEQ ID NO: 2077222 - RNA, 16 nt, Human
caacacaaggugggca

SEQ ID NO: 2077223 - RNA, 21 nt, Human
caacacaaggugggcagggag

SEQ ID NO: 2077224 - RNA, 21 nt, Human
caacaacauguauaauauuuu

SEQ ID NO: 2077225 - RNA, 22 nt, Human
caacaacauguauaauauuuuu

SEQ ID NO: 2077226 - RNA, 16 nt, Human
caacccccauuucuau

SEQ ID NO: 2077227 - RNA, 16 nt, Human
caaccccccaccugcc

SEQ ID NO: 2077228 - RNA, 17 nt, Human
caaccccccaccugcca

SEQ ID NO: 2077229 - RNA, 20 nt, Human
caaccagauugucagcuccu

SEQ ID NO: 2077230 - RNA, 19 nt, Human
caaccagauugucagcucc

SEQ ID NO: 2077231 - RNA, 21 nt, Human
caaccagaccauugucucaga

SEQ ID NO: 2077232 - RNA, 13 nt, Human
caaccagagcacu

SEQ ID NO: 2077233 - RNA, 15 nt, Human
caaccagagcacugu

SEQ ID NO: 2077234 - RNA, 16 nt, Human
caaccagagcacugua

SEQ ID NO: 2077235 - RNA, 18 nt, Human
caaccagagcacuguaua

SEQ ID NO: 2077236 - RNA, 20 nt, Human
caaccagagcacuguauacc

SEQ ID NO: 2077237 - RNA, 22 nt, Human
caaccauauggauauuagucau

SEQ ID NO: 2077238 - RNA, 18 nt, Human
caaccaucaaaguggcaa

SEQ ID NO: 2077239 - RNA, 12 nt, Human
caaccccugugg

SEQ ID NO: 2077240 - RNA, 14 nt, Human
caaccccuguggag

SEQ ID NO: 2077241 - RNA, 16 nt, Human
caaccccuguggagcc

SEQ ID NO: 2077242 - RNA, 22 nt, Human
caacuaacaagaaacucacccc

SEQ ID NO: 2077243 - RNA, 20 nt, Human
caagaugccaucuguguccu

SEQ ID NO: 2077244 - RNA, 15 nt, Human
caagaugucagacug

SEQ ID NO: 2077245 - RNA, 16 nt, Human
caagaugucagacugg

SEQ ID NO: 2077246 - RNA, 17 nt, Human
caagaugucagacuggc

SEQ ID NO: 2077247 - RNA, 14 nt, Human
caagaccagccugg

SEQ ID NO: 2077248 - RNA, 15 nt, Human
caagaccagccuggc

SEQ ID NO: 2077249 - RNA, 22 nt, Human
caaccccccaucacaaacuuaa

SEQ ID NO: 2077250 - RNA, 23 nt, Human
caacucagucccuaaaaacacag

SEQ ID NO: 2077251 - RNA, 14 nt, Human
caacuccuggaagc

SEQ ID NO: 2077252 - RNA, 17 nt, Human
caacuccuggaagcugu

SEQ ID NO: 2077253 - RNA, 21 nt, Human
caacuccuggaagcugugucc

SEQ ID NO: 2077254 - RNA, 22 nt, Human
caagaauugaagcaggacuaaa

SEQ ID NO: 2077255 - RNA, 19 nt, Human
caagaauucuccaaaacaa

SEQ ID NO: 2077256 - RNA, 21 nt, Human
caagaauucuccaaaacaauu

SEQ ID NO: 2077257 - RNA, 14 nt, Human
caaacauuucaaag

SEQ ID NO: 2077258 - RNA, 15 nt, Human
caaacauuucaaagu

SEQ ID NO: 2077259 - RNA, 21 nt, Human
caaaccccgaccaccugccca

SEQ ID NO: 2077260 - RNA, 18 nt, Human
caaaccccgaccaccugc

SEQ ID NO: 2077261 - RNA, 13 nt, Human
caaacccaugagg

SEQ ID NO: 2077262 - RNA, 13 nt, Human
caaaaggaagucu

SEQ ID NO: 2077263 - RNA, 20 nt, Human
caaacaugugguuaaugcca

SEQ ID NO: 2077264 - RNA, 14 nt, Human
auuuuuauauagcu

SEQ ID NO: 2077265 - RNA, 14 nt, Human
auuuuuauauuuaa

SEQ ID NO: 2077266 - RNA, 16 nt, Human
auuuuuuugagacaga

SEQ ID NO: 2077267 - RNA, 19 nt, Human
caaaagcugggcagguugg

SEQ ID NO: 2077268 - RNA, 19 nt, Human
caaaagaaucagaaacagg

SEQ ID NO: 2077269 - RNA, 14 nt, Human
caaaagaaguaaca

SEQ ID NO: 2077270 - RNA, 17 nt, Human
caaaagaaguaacaaga

SEQ ID NO: 2077271 - RNA, 19 nt, Human
caaaagaaguaacaagagu

SEQ ID NO: 2077272 - RNA, 22 nt, Human
caaaagaaguaacaagagugau

SEQ ID NO: 2077273 - RNA, 15 nt, Human
caaaagaaucagaaa

SEQ ID NO: 2077274 - RNA, 20 nt, Human
caaagauaaucucucagcuu

SEQ ID NO: 2077275 - RNA, 16 nt, Human
caaagauaaucucuca

SEQ ID NO: 2077276 - RNA, 14 nt, Human
auuuuuagacagag

SEQ ID NO: 2077277 - RNA, 18 nt, Human
auuuuuaauauguaagga

SEQ ID NO: 2077278 - RNA, 12 nt, Human
auuuuuauacag

SEQ ID NO: 2077279 - RNA, 13 nt, Human
auuuuuauacagu

SEQ ID NO: 2077280 - RNA, 16 nt, Human
auuuuuauacaguagu

SEQ ID NO: 2077281 - RNA, 20 nt, Human
auuuuuagaugguuacacug

SEQ ID NO: 2077282 - RNA, 22 nt, Human
auuuuuagaugguuacacuguu

SEQ ID NO: 2077283 - RNA, 23 nt, Human
auuuuuagaugguuacacuguua

SEQ ID NO: 2077284 - RNA, 19 nt, Human
auuuucugguaggaauagc

SEQ ID NO: 2077285 - RNA, 18 nt, Human
auuuuauguaaaauuuug

SEQ ID NO: 2077286 - RNA, 12 nt, Human
auuuuauguaug

SEQ ID NO: 2077287 - RNA, 14 nt, Human
auuuuauguauguu

SEQ ID NO: 2077288 - RNA, 16 nt, Human
auuuuauguauguuua

SEQ ID NO: 2077289 - RNA, 22 nt, Human
auuuuauguauguuuacacugu

SEQ ID NO: 2077290 - RNA, 23 nt, Human
auuuuauguauguuuacacuguc

SEQ ID NO: 2077291 - RNA, 15 nt, Human
auuuuagcugcagaa

SEQ ID NO: 2077292 - RNA, 16 nt, Human
auuuuagcugcagaac

SEQ ID NO: 2077293 - RNA, 14 nt, Human
auuuuauauaauaa

SEQ ID NO: 2077294 - RNA, 17 nt, Human
auuuuauauaauaaagu

SEQ ID NO: 2077295 - RNA, 19 nt, Human
auuuuauauaauaaaguau

SEQ ID NO: 2077296 - RNA, 22 nt, Human
auuuuauauaauaaaguauucc

SEQ ID NO: 2077297 - RNA, 17 nt, Human
auuuuaggcacccaucc

SEQ ID NO: 2077298 - RNA, 20 nt, Human
auuuugaauaaauaaaugua

SEQ ID NO: 2077299 - RNA, 18 nt, Human
auuuucuucaugcaauga

SEQ ID NO: 2077300 - RNA, 14 nt, Human
auuuucuucaguug

SEQ ID NO: 2077301 - RNA, 17 nt, Human
auuuucuucaguuggug

SEQ ID NO: 2077302 - RNA, 14 nt, Human
auuuucuucaugca

SEQ ID NO: 2077303 - RNA, 12 nt, Human
auuuugaagcua

SEQ ID NO: 2077304 - RNA, 13 nt, Human
auuuugaagcuaa

SEQ ID NO: 2077305 - RNA, 14 nt, Human
auuuugaagcuaau

SEQ ID NO: 2077306 - RNA, 15 nt, Human
auuuugaagcuaauu

SEQ ID NO: 2077307 - RNA, 18 nt, Human
auuuugaagcuaauuauu

SEQ ID NO: 2077308 - RNA, 21 nt, Human
auuuugaagcuaauuauuuua

SEQ ID NO: 2077309 - RNA, 23 nt, Human
auuuugaagcuaauuauuuuaau

SEQ ID NO: 2077310 - RNA, 21 nt, Human
auuuucuucaugcaaugacau

SEQ ID NO: 2077311 - RNA, 20 nt, Human
cagaaagguuuucuucuuuu

SEQ ID NO: 2077312 - RNA, 18 nt, Human
cagaaaguaauuucuucu

SEQ ID NO: 2077313 - RNA, 20 nt, Human
cagaaaguaauuucuucuca

SEQ ID NO: 2077314 - RNA, 22 nt, Human
cagaaaguaauuucuucucaaa

SEQ ID NO: 2077315 - RNA, 22 nt, Human
cagaaaguggccaugccacccu

SEQ ID NO: 2077316 - RNA, 23 nt, Human
cagaaaguggccaugccacccug

SEQ ID NO: 2077317 - RNA, 20 nt, Human
cagaaauaaaguuggugaca

SEQ ID NO: 2077318 - RNA, 22 nt, Human
cagaaagggagcagagaaggcc

SEQ ID NO: 2077319 - RNA, 16 nt, Human
cagaaaggauauuuaa

SEQ ID NO: 2077320 - RNA, 20 nt, Human
cagaaaggauauuuaagaaa

SEQ ID NO: 2077321 - RNA, 22 nt, Human
cagaaaggauauuuaagaaaau

SEQ ID NO: 2077322 - RNA, 12 nt, Human
cagaaaggagac

SEQ ID NO: 2077323 - RNA, 19 nt, Human
cagaaguuucucagcuccc

SEQ ID NO: 2077324 - RNA, 15 nt, Human
cagaaguuucucagc

SEQ ID NO: 2077325 - RNA, 19 nt, Human
cagaaaucuagaagacugu

SEQ ID NO: 2077326 - RNA, 22 nt, Human
cagaaauaccaaaauuauuuca

SEQ ID NO: 2077327 - RNA, 23 nt, Human
cagaaauaccaaaauuauuucag

SEQ ID NO: 2077328 - RNA, 15 nt, Human
cagaaauaugugguu

SEQ ID NO: 2077329 - RNA, 12 nt, Human
cagaacagccgc

SEQ ID NO: 2077330 - RNA, 17 nt, Human
cagaacagccgcuccug

SEQ ID NO: 2077331 - RNA, 20 nt, Human
cagaacagccgcuccugucu

SEQ ID NO: 2077332 - RNA, 23 nt, Human
cagaaauguacaacuuuuuaccu

SEQ ID NO: 2077333 - RNA, 13 nt, Human
cacugcagccucg

SEQ ID NO: 2077334 - RNA, 14 nt, Human
cacugcagccucga

SEQ ID NO: 2077335 - RNA, 22 nt, Human
cacugcagccucgaacuccugg

SEQ ID NO: 2077336 - RNA, 17 nt, Human
cacugccaugccagcuu

SEQ ID NO: 2077337 - RNA, 23 nt, Human
cacugcagccucaaccuccuggg

SEQ ID NO: 2077338 - RNA, 22 nt, Human
cacugcagccucaaccuccugg

SEQ ID NO: 2077339 - RNA, 21 nt, Human
cacugcagccucaaccuccug

SEQ ID NO: 2077340 - RNA, 20 nt, Human
cacugcagccucaaccuccu

SEQ ID NO: 2077341 - RNA, 14 nt, Human
cacugcagccucaa

SEQ ID NO: 2077342 - RNA, 19 nt, Human
cacugcagccucaaccucc

SEQ ID NO: 2077343 - RNA, 13 nt, Human
cacugggcuucua

SEQ ID NO: 2077344 - RNA, 20 nt, Human
cacugggguccuggggccuc

SEQ ID NO: 2077345 - RNA, 15 nt, Human
cacugggugggguga

SEQ ID NO: 2077346 - RNA, 18 nt, Human
cacuggguggggugagga

SEQ ID NO: 2077347 - RNA, 19 nt, Human
cacuggguggggugaggac

SEQ ID NO: 2077348 - RNA, 21 nt, Human
cacuggguggggugaggacca

SEQ ID NO: 2077349 - RNA, 23 nt, Human
cacuggguggggugaggaccacu

SEQ ID NO: 2077350 - RNA, 15 nt, Human
cacuggguugacuuu

SEQ ID NO: 2077351 - RNA, 23 nt, Human
cacuguugcccaggcuggcgugc

SEQ ID NO: 2077352 - RNA, 19 nt, Human
cacuguugcccaggcuggc

SEQ ID NO: 2077353 - RNA, 18 nt, Human
cacuguugcccaggcugg

SEQ ID NO: 2077354 - RNA, 14 nt, Human
cacuuaaaaaaugu

SEQ ID NO: 2077355 - RNA, 16 nt, Human
cacuuaaaaaaugucc

SEQ ID NO: 2077356 - RNA, 13 nt, Human
cacuugugugugg

SEQ ID NO: 2077357 - RNA, 13 nt, Human
cacuuaagacugu

SEQ ID NO: 2077358 - RNA, 13 nt, Human
cacuuaacagaug

SEQ ID NO: 2077359 - RNA, 15 nt, Human
cacuuaaauaucaau

SEQ ID NO: 2077360 - RNA, 23 nt, Human
cacuuaaauaucaaucauuuucc

SEQ ID NO: 2077361 - RNA, 21 nt, Human
cacuuaagacuguguauucua

SEQ ID NO: 2077362 - RNA, 23 nt, Human
cacuugugugugggcugugagug

SEQ ID NO: 2077363 - RNA, 21 nt, Human
cacuugugugugggcugugag

SEQ ID NO: 2077364 - RNA, 22 nt, Human
cacuugugugugggcugugagu

SEQ ID NO: 2077365 - RNA, 14 nt, Human
cacuuguguguggg

SEQ ID NO: 2077366 - RNA, 15 nt, Human
cacuugugugugggc

SEQ ID NO: 2077367 - RNA, 17 nt, Human
cacuugugugugggcug

SEQ ID NO: 2077368 - RNA, 19 nt, Human
cacuugugugugggcugug

SEQ ID NO: 2077369 - RNA, 18 nt, Human
cacuuguguuaugaagca

SEQ ID NO: 2077370 - RNA, 12 nt, Human
caccuacugagu

SEQ ID NO: 2077371 - RNA, 12 nt, Human
caccucagccuc

SEQ ID NO: 2077372 - RNA, 12 nt, Human
caccucagagcc

SEQ ID NO: 2077373 - RNA, 13 nt, Human
caccucagagccc

SEQ ID NO: 2077374 - RNA, 15 nt, Human
caccucagagccccg

SEQ ID NO: 2077375 - RNA, 16 nt, Human
caccucagagccccgc

SEQ ID NO: 2077376 - RNA, 13 nt, Human
caccuagaucaga

SEQ ID NO: 2077377 - RNA, 17 nt, Human
caccuagaaacuuguua

SEQ ID NO: 2077378 - RNA, 16 nt, Human
caccuaggccacuccu

SEQ ID NO: 2077379 - RNA, 17 nt, Human
caccuaggccacuccuc

SEQ ID NO: 2077380 - RNA, 18 nt, Human
caccuaggccacuccucc

SEQ ID NO: 2077381 - RNA, 19 nt, Human
caccuaggccacuccucca

SEQ ID NO: 2077382 - RNA, 14 nt, Human
caccuuucccaucu

SEQ ID NO: 2077383 - RNA, 20 nt, Human
caccuugggaugaugccuca

SEQ ID NO: 2077384 - RNA, 19 nt, Human
caccuugggaugaugccuc

SEQ ID NO: 2077385 - RNA, 15 nt, Human
caccuuucccuaaag

SEQ ID NO: 2077386 - RNA, 20 nt, Human
caccuuucccuaaagacccu

SEQ ID NO: 2077387 - RNA, 11 nt, Human
caccuuuuaaa

SEQ ID NO: 2077388 - RNA, 13 nt, Human
caccuuuuaaauc

SEQ ID NO: 2077389 - RNA, 15 nt, Human
caccuuuuaaauccu

SEQ ID NO: 2077390 - RNA, 23 nt, Human
caccuuuuaaauccuguugaaaa

SEQ ID NO: 2077391 - RNA, 18 nt, Human
caccuuuuaacucaccuc

SEQ ID NO: 2077392 - RNA, 16 nt, Human
caccuuggcugcaggg

SEQ ID NO: 2077393 - RNA, 15 nt, Human
caccuuggcugcagg

SEQ ID NO: 2077394 - RNA, 21 nt, Human
caccugcccccugguggacag

SEQ ID NO: 2077395 - RNA, 13 nt, Human
caccugcccccuu

SEQ ID NO: 2077396 - RNA, 18 nt, Human
caccuuggcugcagggag

SEQ ID NO: 2077397 - RNA, 13 nt, Human
caccugcccaacc

SEQ ID NO: 2077398 - RNA, 19 nt, Human
caccugcccaaccugcucu

SEQ ID NO: 2077399 - RNA, 18 nt, Human
caccugcccaaccugcuc

SEQ ID NO: 2077400 - RNA, 14 nt, Human
caccugcccccugg

SEQ ID NO: 2077401 - RNA, 15 nt, Human
caccugcccccuggu

SEQ ID NO: 2077402 - RNA, 11 nt, Human
caccucagccu

SEQ ID NO: 2077403 - RNA, 13 nt, Human
caccugcccagau

SEQ ID NO: 2077404 - RNA, 18 nt, Human
caccugcccaucacaggg

SEQ ID NO: 2077405 - RNA, 22 nt, Human
caccugcccaucacaggguugg

SEQ ID NO: 2077406 - RNA, 22 nt, Human
cacucuuauugcccacgcugga

SEQ ID NO: 2077407 - RNA, 21 nt, Human
cacucuuauugcccacgcugg

SEQ ID NO: 2077408 - RNA, 20 nt, Human
cacucuuauugcccacgcug

SEQ ID NO: 2077409 - RNA, 12 nt, Human
cacucuguuccu

SEQ ID NO: 2077410 - RNA, 16 nt, Human
cacucuuaagcuuccg

SEQ ID NO: 2077411 - RNA, 21 nt, Human
cacuacauuauaaaugucucu

SEQ ID NO: 2077412 - RNA, 21 nt, Human
cacuacaugcagcccaugccc

SEQ ID NO: 2077413 - RNA, 23 nt, Human
cacuacaugcagcccaugcccac

SEQ ID NO: 2077414 - RNA, 20 nt, Human
cacuacacuccagccugagc

SEQ ID NO: 2077415 - RNA, 21 nt, Human
cacuacacuccagccugagca

SEQ ID NO: 2077416 - RNA, 15 nt, Human
cacuacaugcagccc

SEQ ID NO: 2077417 - RNA, 22 nt, Human
cacuacccaucgguguccauuu

SEQ ID NO: 2077418 - RNA, 12 nt, Human
cacuccagccug

SEQ ID NO: 2077419 - RNA, 13 nt, Human
cacuccagccuga

SEQ ID NO: 2077420 - RNA, 13 nt, Human
cacuccagccugg

SEQ ID NO: 2077421 - RNA, 14 nt, Human
cacuccagccuggg

SEQ ID NO: 2077422 - RNA, 14 nt, Human
cacuccagccugag

SEQ ID NO: 2077423 - RNA, 15 nt, Human
cacuccagccugagc

SEQ ID NO: 2077424 - RNA, 21 nt, Human
cacuccagccugagcaacaga

SEQ ID NO: 2077425 - RNA, 20 nt, Human
cacucugucgcccagucugg

SEQ ID NO: 2077426 - RNA, 23 nt, Human
cacuccagccugggcgacagagc

SEQ ID NO: 2077427 - RNA, 21 nt, Human
cacuccagccugggcgacaga

SEQ ID NO: 2077428 - RNA, 15 nt, Human
cacuccagccugggc

SEQ ID NO: 2077429 - RNA, 16 nt, Human
cacuccagccugggcg

SEQ ID NO: 2077430 - RNA, 13 nt, Human
cacggccaggcca

SEQ ID NO: 2077431 - RNA, 12 nt, Human
cacggccaggcc

SEQ ID NO: 2077432 - RNA, 17 nt, Human
cacggccaggccagagg

SEQ ID NO: 2077433 - RNA, 14 nt, Human
cacggccaugacca

SEQ ID NO: 2077434 - RNA, 14 nt, Human
cacggcucacugca

SEQ ID NO: 2077435 - RNA, 15 nt, Human
cacggcucacugcag

SEQ ID NO: 2077436 - RNA, 22 nt, Human
cacggccagcugcaucuacuca

SEQ ID NO: 2077437 - RNA, 16 nt, Human
cacuacacuccagccu

SEQ ID NO: 2077438 - RNA, 17 nt, Human
cacuacacuccagccug

SEQ ID NO: 2077439 - RNA, 18 nt, Human
cacuacacuccagccuga

SEQ ID NO: 2077440 - RNA, 19 nt, Human
cacuacacuccagccugag

SEQ ID NO: 2077441 - RNA, 21 nt, Human
cacggcaggacaacgaggaag

SEQ ID NO: 2077442 - RNA, 22 nt, Human
cacggcaggacaacgaggaagc

SEQ ID NO: 2077443 - RNA, 23 nt, Human
cacggcaggacaacgaggaagcc

SEQ ID NO: 2077444 - RNA, 12 nt, Human
caagauuucaga

SEQ ID NO: 2077445 - RNA, 21 nt, Human
caagauugcuuaaaauagcaa

SEQ ID NO: 2077446 - RNA, 16 nt, Human
caagauugcuuaaaau

SEQ ID NO: 2077447 - RNA, 18 nt, Human
caagauugcuuaaaauag

SEQ ID NO: 2077448 - RNA, 19 nt, Human
caagauguccuccuuguuc

SEQ ID NO: 2077449 - RNA, 21 nt, Human
caagauguccuccuuguucua

SEQ ID NO: 2077450 - RNA, 13 nt, Human
caagauugcuuaa

SEQ ID NO: 2077451 - RNA, 17 nt, Human
caagauuuuccacaaga

SEQ ID NO: 2077452 - RNA, 18 nt, Human
caagauuuuccacaagau

SEQ ID NO: 2077453 - RNA, 13 nt, Human
caaggcaaggggu

SEQ ID NO: 2077454 - RNA, 18 nt, Human
caaggcaaggggugccug

SEQ ID NO: 2077455 - RNA, 20 nt, Human
caaggcaaggggugccuggg

SEQ ID NO: 2077456 - RNA, 21 nt, Human
caaggcaaggggugccuggga

SEQ ID NO: 2077457 - RNA, 14 nt, Human
caaggccagagugg

SEQ ID NO: 2077458 - RNA, 19 nt, Human
caaggccgcuguucaccca

SEQ ID NO: 2077459 - RNA, 20 nt, Human
caaggccgcuguucacccac

SEQ ID NO: 2077460 - RNA, 22 nt, Human
caaggccgcuguucacccacag

SEQ ID NO: 2077461 - RNA, 20 nt, Human
caaguuuucauaagcacacu

SEQ ID NO: 2077462 - RNA, 17 nt, Human
caaguuuccaagcaaau

SEQ ID NO: 2077463 - RNA, 18 nt, Human
caaguuuccaagcaaaug

SEQ ID NO: 2077464 - RNA, 22 nt, Human
caaguuuccaagcaaauguuac

SEQ ID NO: 2077465 - RNA, 16 nt, Human
caaguuguuucauuga

SEQ ID NO: 2077466 - RNA, 14 nt, Human
caaggccugucccu

SEQ ID NO: 2077467 - RNA, 16 nt, Human
caaggccugucccugg

SEQ ID NO: 2077468 - RNA, 17 nt, Human
caaggccugucccuggc

SEQ ID NO: 2077469 - RNA, 18 nt, Human
caaggccugucccuggcc

SEQ ID NO: 2077470 - RNA, 15 nt, Human
caaggcucugagcaa

SEQ ID NO: 2077471 - RNA, 19 nt, Human
caaggcuagaucaugaaga

SEQ ID NO: 2077472 - RNA, 19 nt, Human
caaggcgggagcaucucuu

SEQ ID NO: 2077473 - RNA, 16 nt, Human
caagucaugugcauuu

SEQ ID NO: 2077474 - RNA, 13 nt, Human
caagucaugugca

SEQ ID NO: 2077475 - RNA, 20 nt, Human
caagucagcuuugccuucca

SEQ ID NO: 2077476 - RNA, 19 nt, Human
caagucagcuuugccuucc

SEQ ID NO: 2077477 - RNA, 16 nt, Human
caaggcgugaggaugg

SEQ ID NO: 2077478 - RNA, 18 nt, Human
caaggcugaccaagagag

SEQ ID NO: 2077479 - RNA, 19 nt, Human
caaggcugaccaagagaga

SEQ ID NO: 2077480 - RNA, 13 nt, Human
caauaaaaucaug

SEQ ID NO: 2077481 - RNA, 20 nt, Human
caauaaaaucuugaaaaugc

SEQ ID NO: 2077482 - RNA, 14 nt, Human
caauaaaaucaugu

SEQ ID NO: 2077483 - RNA, 15 nt, Human
caauaaaaucaugua

SEQ ID NO: 2077484 - RNA, 20 nt, Human
caauaaaaucauguacauuu

SEQ ID NO: 2077485 - RNA, 15 nt, Human
caauaaaaugugauu

SEQ ID NO: 2077486 - RNA, 16 nt, Human
caauaaaaugugauuu

SEQ ID NO: 2077487 - RNA, 20 nt, Human
caauaaaaugugauuuuucu

SEQ ID NO: 2077488 - RNA, 21 nt, Human
caauaaaaugugauuuuucug

SEQ ID NO: 2077489 - RNA, 22 nt, Human
caauaaaaugugauuuuucuga

SEQ ID NO: 2077490 - RNA, 22 nt, Human
caaucccaccaacccucagagc

SEQ ID NO: 2077491 - RNA, 17 nt, Human
caaucccaccaacccuc

SEQ ID NO: 2077492 - RNA, 16 nt, Human
caaucccaccaacccu

SEQ ID NO: 2077493 - RNA, 21 nt, Human
caauccauguuaguuuuuacu

SEQ ID NO: 2077494 - RNA, 23 nt, Human
caauccauguuaguuuuuacuuu

SEQ ID NO: 2077495 - RNA, 17 nt, Human
caauccagcgguucuca

SEQ ID NO: 2077496 - RNA, 17 nt, Human
caaucaugaaauaugca

SEQ ID NO: 2077497 - RNA, 16 nt, Human
caauggcagccuuggc

SEQ ID NO: 2077498 - RNA, 15 nt, Human
caauggccuaaacuu

SEQ ID NO: 2077499 - RNA, 21 nt, Human
caaugcuggcuguuggcuggg

SEQ ID NO: 2077500 - RNA, 20 nt, Human
caaugcuggcuguuggcugg

SEQ ID NO: 2077501 - RNA, 13 nt, Human
caaugcuggcugu

SEQ ID NO: 2077502 - RNA, 17 nt, Human
caauccuaacacauuau

SEQ ID NO: 2077503 - RNA, 22 nt, Human
caauccuaacacauuaucggga

SEQ ID NO: 2077504 - RNA, 23 nt, Human
caaucccaccaacccucagagcc

SEQ ID NO: 2077505 - RNA, 22 nt, Human
caauccauguuaguuuuuacuu

SEQ ID NO: 2077506 - RNA, 15 nt, Human
caauccccucauuca

SEQ ID NO: 2077507 - RNA, 21 nt, Human
caauccccucauucaggaaaa

SEQ ID NO: 2077508 - RNA, 22 nt, Human
caauccccucauucaggaaaac

SEQ ID NO: 2077509 - RNA, 18 nt, Human
caauggcuuacuccagga

SEQ ID NO: 2077510 - RNA, 21 nt, Human
caauugaauuaaauuaggaau

SEQ ID NO: 2077511 - RNA, 17 nt, Human
caauuuccaagagcuga

SEQ ID NO: 2077512 - RNA, 14 nt, Human
caauugcugcaucu

SEQ ID NO: 2077513 - RNA, 18 nt, Human
caauugcugcaucuuagu

SEQ ID NO: 2077514 - RNA, 20 nt, Human
caauugcuuacucauuaaaa

SEQ ID NO: 2077515 - RNA, 14 nt, Human
cacaagauucccag

SEQ ID NO: 2077516 - RNA, 19 nt, Human
cacagaagacuucccagcu

SEQ ID NO: 2077517 - RNA, 20 nt, Human
cacagaagacuucccagcuu

SEQ ID NO: 2077518 - RNA, 14 nt, Human
cacagcucuguccu

SEQ ID NO: 2077519 - RNA, 11 nt, Human
cacagcucugu

SEQ ID NO: 2077520 - RNA, 19 nt, Human
cacagcucuguccugggag

SEQ ID NO: 2077521 - RNA, 18 nt, Human
cacagcucuguccuggga

SEQ ID NO: 2077522 - RNA, 16 nt, Human
cacagcucuguccugg

SEQ ID NO: 2077523 - RNA, 15 nt, Human
cacagcucuguccug

SEQ ID NO: 2077524 - RNA, 15 nt, Human
cacagcucuucucca

SEQ ID NO: 2077525 - RNA, 14 nt, Human
cacagcucuucucc

SEQ ID NO: 2077526 - RNA, 17 nt, Human
cacagcucuucuccagg

SEQ ID NO: 2077527 - RNA, 19 nt, Human
cacacuuguuccagcucuu

SEQ ID NO: 2077528 - RNA, 20 nt, Human
cacacuuguuccagcucuuu

SEQ ID NO: 2077529 - RNA, 17 nt, Human
cacacuuuuuaagaaau

SEQ ID NO: 2077530 - RNA, 14 nt, Human
cacagaaaacuaga

SEQ ID NO: 2077531 - RNA, 15 nt, Human
cacagaaaacuagaa

SEQ ID NO: 2077532 - RNA, 13 nt, Human
cacagaacccuug

SEQ ID NO: 2077533 - RNA, 18 nt, Human
cacagaaagacugagcuc

SEQ ID NO: 2077534 - RNA, 22 nt, Human
cacagaaagacugagcucaagg

SEQ ID NO: 2077535 - RNA, 11 nt, Human
cacagaaagag

SEQ ID NO: 2077536 - RNA, 13 nt, Human
cacagaaagagag

SEQ ID NO: 2077537 - RNA, 14 nt, Human
cacagaaagagagc

SEQ ID NO: 2077538 - RNA, 15 nt, Human
cacagaaagagagca

SEQ ID NO: 2077539 - RNA, 18 nt, Human
cacagaaagagagcacug

SEQ ID NO: 2077540 - RNA, 15 nt, Human
cacagaaagacugag

SEQ ID NO: 2077541 - RNA, 16 nt, Human
cacagaaaccaauuuu

SEQ ID NO: 2077542 - RNA, 13 nt, Human
caccagggaagau

SEQ ID NO: 2077543 - RNA, 22 nt, Human
cacccaugaagacaggacagug

SEQ ID NO: 2077544 - RNA, 16 nt, Human
cacccaggagccccga

SEQ ID NO: 2077545 - RNA, 18 nt, Human
cacccaccucagccuccc

SEQ ID NO: 2077546 - RNA, 23 nt, Human
cacccagcccauucucucuccug

SEQ ID NO: 2077547 - RNA, 16 nt, Human
caccagccccagugcc

SEQ ID NO: 2077548 - RNA, 15 nt, Human
caccaggcugugggc

SEQ ID NO: 2077549 - RNA, 16 nt, Human
caccaggcugugggcc

SEQ ID NO: 2077550 - RNA, 17 nt, Human
caccaggcugugggccu

SEQ ID NO: 2077551 - RNA, 13 nt, Human
caccagccccagu

SEQ ID NO: 2077552 - RNA, 17 nt, Human
cacccaccucagccucc

SEQ ID NO: 2077553 - RNA, 16 nt, Human
caccagggaugguacu

SEQ ID NO: 2077554 - RNA, 18 nt, Human
caccaggcugugggccuc

SEQ ID NO: 2077555 - RNA, 20 nt, Human
caccaggcuugccugcaggc

SEQ ID NO: 2077556 - RNA, 22 nt, Human
caccccacccccuucagugccc

SEQ ID NO: 2077557 - RNA, 13 nt, Human
caccccacccccu

SEQ ID NO: 2077558 - RNA, 11 nt, Human
caccccacacu

SEQ ID NO: 2077559 - RNA, 12 nt, Human
caccccacacuu

SEQ ID NO: 2077560 - RNA, 13 nt, Human
cacaucugcauuu

SEQ ID NO: 2077561 - RNA, 21 nt, Human
cacaucugcauuuucacccca

SEQ ID NO: 2077562 - RNA, 22 nt, Human
cacaucuccuccauacucagga

SEQ ID NO: 2077563 - RNA, 12 nt, Human
cacaucuucccu

SEQ ID NO: 2077564 - RNA, 17 nt, Human
caccaacaucccauugc

SEQ ID NO: 2077565 - RNA, 22 nt, Human
caccaacaucccauugcccugg

SEQ ID NO: 2077566 - RNA, 19 nt, Human
caccaacccaucagaagga

SEQ ID NO: 2077567 - RNA, 14 nt, Human
cacaucuuccacag

SEQ ID NO: 2077568 - RNA, 13 nt, Human
caccaacccucag

SEQ ID NO: 2077569 - RNA, 23 nt, Human
caccaacaucccauugcccuggu

SEQ ID NO: 2077570 - RNA, 15 nt, Human
ggaagagaaaaaaua

SEQ ID NO: 2077571 - RNA, 13 nt, Human
ggaagagaaacca

SEQ ID NO: 2077572 - RNA, 12 nt, Human
ggaagagaaaca

SEQ ID NO: 2077573 - RNA, 13 nt, Human
ggaagagaaacag

SEQ ID NO: 2077574 - RNA, 14 nt, Human
ggaagagaaacagg

SEQ ID NO: 2077575 - RNA, 13 nt, Human
ggaagagaaaaaa

SEQ ID NO: 2077576 - RNA, 22 nt, Human
ggaagacaaugugaaaagaaaa

SEQ ID NO: 2077577 - RNA, 21 nt, Human
ggaacuugagcgugaaucugu

SEQ ID NO: 2077578 - RNA, 22 nt, Human
ggaagacauggggaggaaggac

SEQ ID NO: 2077579 - RNA, 11 nt, Human
ggaacagaagg

SEQ ID NO: 2077580 - RNA, 12 nt, Human
ggaacagaagga

SEQ ID NO: 2077581 - RNA, 13 nt, Human
ggaacagaaggau

SEQ ID NO: 2077582 - RNA, 19 nt, Human
ggaacagaaggaugaauga

SEQ ID NO: 2077583 - RNA, 17 nt, Human
ggaacagacaggagaaa

SEQ ID NO: 2077584 - RNA, 13 nt, Human
ggaacagacagga

SEQ ID NO: 2077585 - RNA, 15 nt, Human
ggaacagacaggaga

SEQ ID NO: 2077586 - RNA, 16 nt, Human
ggaacagacaggagaa

SEQ ID NO: 2077587 - RNA, 18 nt, Human
ggaacagacaacagaagu

SEQ ID NO: 2077588 - RNA, 20 nt, Human
ggaacagacaacagaaguca

SEQ ID NO: 2077589 - RNA, 21 nt, Human
ggaacagacaacagaagucau

SEQ ID NO: 2077590 - RNA, 21 nt, Human
ggaagcgugaaggccgagaag

SEQ ID NO: 2077591 - RNA, 22 nt, Human
ggaagcgugaaggccgagaagc

SEQ ID NO: 2077592 - RNA, 11 nt, Human
ggaagcccucc

SEQ ID NO: 2077593 - RNA, 12 nt, Human
ggaagcccuccu

SEQ ID NO: 2077594 - RNA, 15 nt, Human
ggaagcccuccuucc

SEQ ID NO: 2077595 - RNA, 16 nt, Human
ggaagcccuccuucca

SEQ ID NO: 2077596 - RNA, 17 nt, Human
ggaagcccuccuuccac

SEQ ID NO: 2077597 - RNA, 12 nt, Human
ggaagcccugga

SEQ ID NO: 2077598 - RNA, 11 nt, Human
ggaagcccugg

SEQ ID NO: 2077599 - RNA, 15 nt, Human
ggaagcccuggauuu

SEQ ID NO: 2077600 - RNA, 23 nt, Human
ggaagcccuggauuucagaaaga

SEQ ID NO: 2077601 - RNA, 19 nt, Human
ggaaggaaagaaagaagga

SEQ ID NO: 2077602 - RNA, 17 nt, Human
ggaaggaccuauguuug

SEQ ID NO: 2077603 - RNA, 19 nt, Human
ggaaggaccuauguuugcu

SEQ ID NO: 2077604 - RNA, 15 nt, Human
ggaaggagacucacc

SEQ ID NO: 2077605 - RNA, 20 nt, Human
ggaaggagacucaccucugc

SEQ ID NO: 2077606 - RNA, 12 nt, Human
ggaaggagagaa

SEQ ID NO: 2077607 - RNA, 17 nt, Human
ggaaguuuguguucugu

SEQ ID NO: 2077608 - RNA, 11 nt, Human
ggaaguuuuca

SEQ ID NO: 2077609 - RNA, 21 nt, Human
ggaaggagacucaccucugcc

SEQ ID NO: 2077610 - RNA, 22 nt, Human
ggaaggagacucaccucugccu

SEQ ID NO: 2077611 - RNA, 13 nt, Human
ggaaggagagccu

SEQ ID NO: 2077612 - RNA, 13 nt, Human
ggaagcugcuccg

SEQ ID NO: 2077613 - RNA, 15 nt, Human
ggaagcugcuccgug

SEQ ID NO: 2077614 - RNA, 17 nt, Human
ggaagcuguguccuugc

SEQ ID NO: 2077615 - RNA, 18 nt, Human
ggaagcuggccgaggguc

SEQ ID NO: 2077616 - RNA, 13 nt, Human
ggaagcuccuggu

SEQ ID NO: 2077617 - RNA, 18 nt, Human
ggaagcucugaagucaca

SEQ ID NO: 2077618 - RNA, 21 nt, Human
ggaagcuguguccuugcaccu

SEQ ID NO: 2077619 - RNA, 23 nt, Human
ggaagcuguguccuugcaccugc

SEQ ID NO: 2077620 - RNA, 19 nt, Human
ggaagcuucuuaaaugaga

SEQ ID NO: 2077621 - RNA, 22 nt, Human
ggaagcuuucucugcuucagcu

SEQ ID NO: 2077622 - RNA, 11 nt, Human
ggaagcuccgc

SEQ ID NO: 2077623 - RNA, 20 nt, Human
ggaagcuccaguccugcucu

SEQ ID NO: 2077624 - RNA, 18 nt, Human
ggaauaacauguaauuaa

SEQ ID NO: 2077625 - RNA, 20 nt, Human
ggaauaaggccuuaauaugu

SEQ ID NO: 2077626 - RNA, 21 nt, Human
ggaaguuuuguggaggagcuc

SEQ ID NO: 2077627 - RNA, 18 nt, Human
ggaaguuuugcauuuaug

SEQ ID NO: 2077628 - RNA, 23 nt, Human
ggaaucagacuucacacugcaag

SEQ ID NO: 2077629 - RNA, 15 nt, Human
ggaauaauagaagaa

SEQ ID NO: 2077630 - RNA, 21 nt, Human
ggaaucagacuucacacugca

SEQ ID NO: 2077631 - RNA, 16 nt, Human
ggaauccagacccggc

SEQ ID NO: 2077632 - RNA, 15 nt, Human
ggaaucuagaagaaa

SEQ ID NO: 2077633 - RNA, 16 nt, Human
ggaaucuagaagaaau

SEQ ID NO: 2077634 - RNA, 17 nt, Human
ggaaucuagaagaaaug

SEQ ID NO: 2077635 - RNA, 18 nt, Human
ggaaucuagaagaaauga

SEQ ID NO: 2077636 - RNA, 19 nt, Human
ggaaucuagaagaaaugaa

SEQ ID NO: 2077637 - RNA, 19 nt, Human
ggaaucgaggaaccagagc

SEQ ID NO: 2077638 - RNA, 20 nt, Human
ggaaucgaggaaccagagcc

SEQ ID NO: 2077639 - RNA, 21 nt, Human
ggaaucgaggaaccagagcca

SEQ ID NO: 2077640 - RNA, 14 nt, Human
ggaauccuguccuc

SEQ ID NO: 2077641 - RNA, 19 nt, Human
ggaauccuguccucagcuu

SEQ ID NO: 2077642 - RNA, 15 nt, Human
ggacaacgaggaagc

SEQ ID NO: 2077643 - RNA, 17 nt, Human
ggacaacgaggaagccc

SEQ ID NO: 2077644 - RNA, 18 nt, Human
ggaaugaagauaccauca

SEQ ID NO: 2077645 - RNA, 16 nt, Human
ggacaacgaggaagcc

SEQ ID NO: 2077646 - RNA, 17 nt, Human
ggacacuaaccacgcug

SEQ ID NO: 2077647 - RNA, 22 nt, Human
ggacacggggcaguggcaaccu

SEQ ID NO: 2077648 - RNA, 19 nt, Human
ggacagcuccuucuguccu

SEQ ID NO: 2077649 - RNA, 22 nt, Human
ggacacuaaccacgcuggaccu

SEQ ID NO: 2077650 - RNA, 20 nt, Human
ggacagcuccuucuguccua

SEQ ID NO: 2077651 - RNA, 18 nt, Human
ggacacagcucuucucca

SEQ ID NO: 2077652 - RNA, 15 nt, Human
ggacacagcucuucu

SEQ ID NO: 2077653 - RNA, 21 nt, Human
ggacacagcucuucuccaggc

SEQ ID NO: 2077654 - RNA, 18 nt, Human
ggacaccuguacuggaga

SEQ ID NO: 2077655 - RNA, 19 nt, Human
ggacaccuguacuggagag

SEQ ID NO: 2077656 - RNA, 21 nt, Human
ggacaccuguacuggagagca

SEQ ID NO: 2077657 - RNA, 22 nt, Human
ggacaaggcuagaucaugaaga

SEQ ID NO: 2077658 - RNA, 14 nt, Human
ggacacagcucuuc

SEQ ID NO: 2077659 - RNA, 21 nt, Human
ggacaaucaugaaauaugcau

SEQ ID NO: 2077660 - RNA, 19 nt, Human
ggacaaucaugaaauaugc

SEQ ID NO: 2077661 - RNA, 23 nt, Human
ggacaggcauguucucugaggac

SEQ ID NO: 2077662 - RNA, 13 nt, Human
ggacaggcagaaa

SEQ ID NO: 2077663 - RNA, 15 nt, Human
ggacaggcagaaaga

SEQ ID NO: 2077664 - RNA, 16 nt, Human
ggacaggcagaaagag

SEQ ID NO: 2077665 - RNA, 17 nt, Human
ggacaggcagaaagagu

SEQ ID NO: 2077666 - RNA, 13 nt, Human
ggacaggcaggug

SEQ ID NO: 2077667 - RNA, 15 nt, Human
ggacccucgcuggcc

SEQ ID NO: 2077668 - RNA, 17 nt, Human
ggacccucgcuggcccc

SEQ ID NO: 2077669 - RNA, 18 nt, Human
ggacccucgcuggccccc

SEQ ID NO: 2077670 - RNA, 20 nt, Human
ggacccucgcuggcccccac

SEQ ID NO: 2077671 - RNA, 21 nt, Human
ggacccucgcuggcccccacu

SEQ ID NO: 2077672 - RNA, 18 nt, Human
ggacguccugccaccugg

SEQ ID NO: 2077673 - RNA, 22 nt, Human
ggacguccugccaccuggggca

SEQ ID NO: 2077674 - RNA, 18 nt, Human
ggacggcauuccugcuua

SEQ ID NO: 2077675 - RNA, 21 nt, Human
ggacggccugaugcucccucc

SEQ ID NO: 2077676 - RNA, 22 nt, Human
ggacggccugaugcucccuccc

SEQ ID NO: 2077677 - RNA, 16 nt, Human
ggaccgaguagaggca

SEQ ID NO: 2077678 - RNA, 17 nt, Human
ggaccgaguagaggcau

SEQ ID NO: 2077679 - RNA, 15 nt, Human
ggaccgccaaagaau

SEQ ID NO: 2077680 - RNA, 22 nt, Human
ggacccuuuccuuccuucccug

SEQ ID NO: 2077681 - RNA, 21 nt, Human
ggacccuucccuugagcccuc

SEQ ID NO: 2077682 - RNA, 12 nt, Human
ggacccuuuccu

SEQ ID NO: 2077683 - RNA, 16 nt, Human
ggacccuuuccuuccu

SEQ ID NO: 2077684 - RNA, 17 nt, Human
ggacccuuuccuuccuu

SEQ ID NO: 2077685 - RNA, 21 nt, Human
ggacccuuuccuuccuucccu

SEQ ID NO: 2077686 - RNA, 23 nt, Human
ggacccuuuccuuccuucccugg

SEQ ID NO: 2077687 - RNA, 14 nt, Human
ggacuacaggugug

SEQ ID NO: 2077688 - RNA, 15 nt, Human
ggacucaaugcacug

SEQ ID NO: 2077689 - RNA, 16 nt, Human
ggacucaaguuucuuc

SEQ ID NO: 2077690 - RNA, 14 nt, Human
ggacuauuauaauu

SEQ ID NO: 2077691 - RNA, 18 nt, Human
ggacucaaugcacugaca

SEQ ID NO: 2077692 - RNA, 16 nt, Human
ggacucaaugcacuga

SEQ ID NO: 2077693 - RNA, 17 nt, Human
ggacucaggaugcccag

SEQ ID NO: 2077694 - RNA, 18 nt, Human
ggacucaggaugcccagg

SEQ ID NO: 2077695 - RNA, 19 nt, Human
ggacucaggaugcccaggg

SEQ ID NO: 2077696 - RNA, 20 nt, Human
ggacucaggaugcccagggc

SEQ ID NO: 2077697 - RNA, 24 nt, Human
ggacucauuucauuccuaacacag

SEQ ID NO: 2077698 - RNA, 22 nt, Human
ggacuccagaucugcaccgccg

SEQ ID NO: 2077699 - RNA, 10 nt, Human
ggacuccagc

SEQ ID NO: 2077700 - RNA, 21 nt, Human
ggacuuucuuuucgccguggc

SEQ ID NO: 2077701 - RNA, 16 nt, Human
ggacuuuccacccccu

SEQ ID NO: 2077702 - RNA, 17 nt, Human
ggacuuuccacccccuc

SEQ ID NO: 2077703 - RNA, 20 nt, Human
ggacuuuccacccccucccu

SEQ ID NO: 2077704 - RNA, 21 nt, Human
ggacuuuccacccccucccug

SEQ ID NO: 2077705 - RNA, 20 nt, Human
ggacuuuauagaucagccag

SEQ ID NO: 2077706 - RNA, 14 nt, Human
ggacuuggaagcuc

SEQ ID NO: 2077707 - RNA, 20 nt, Human
ggacucccuccucaccucug

SEQ ID NO: 2077708 - RNA, 22 nt, Human
ggacucccuccucaccucugga

SEQ ID NO: 2077709 - RNA, 23 nt, Human
ggacuugaaagcauccaugugug

SEQ ID NO: 2077710 - RNA, 15 nt, Human
ggagaaacagagaca

SEQ ID NO: 2077711 - RNA, 23 nt, Human
ggacuuucuuuucgccguggcug

SEQ ID NO: 2077712 - RNA, 16 nt, Human
ggagaaacagagacag

SEQ ID NO: 2077713 - RNA, 19 nt, Human
ggagaaacccuugaaaaga

SEQ ID NO: 2077714 - RNA, 9 nt, Human
ggagacuca

SEQ ID NO: 2077715 - RNA, 13 nt, Human
ggagacucaccuc

SEQ ID NO: 2077716 - RNA, 16 nt, Human
ggagacucaccucugc

SEQ ID NO: 2077717 - RNA, 17 nt, Human
ggagacucaccucugcc

SEQ ID NO: 2077718 - RNA, 18 nt, Human
ggagacucaccucugccu

SEQ ID NO: 2077719 - RNA, 19 nt, Human
ggagacucaccucugccuc

SEQ ID NO: 2077720 - RNA, 21 nt, Human
ggagacucaccucugccucaa

SEQ ID NO: 2077721 - RNA, 18 nt, Human
ggagacuccaugagaagc

SEQ ID NO: 2077722 - RNA, 21 nt, Human
ggagacuccaugagaagccgu

SEQ ID NO: 2077723 - RNA, 13 nt, Human
ggagacucugugg

SEQ ID NO: 2077724 - RNA, 16 nt, Human
ggagacucuguggggc

SEQ ID NO: 2077725 - RNA, 13 nt, Human
gcuggaggcaggg

SEQ ID NO: 2077726 - RNA, 14 nt, Human
gcuggaggcagggc

SEQ ID NO: 2077727 - RNA, 15 nt, Human
gcuggaggcagggcc

SEQ ID NO: 2077728 - RNA, 12 nt, Human
gcuggaggcagg

SEQ ID NO: 2077729 - RNA, 16 nt, Human
gcuggaggcagggccu

SEQ ID NO: 2077730 - RNA, 21 nt, Human
gcuggaggcagggccuugccc

SEQ ID NO: 2077731 - RNA, 22 nt, Human
gcuggagugcagugagccgaga

SEQ ID NO: 2077732 - RNA, 17 nt, Human
gcuggagugcagugagc

SEQ ID NO: 2077733 - RNA, 18 nt, Human
gcuggagugcagugagcc

SEQ ID NO: 2077734 - RNA, 20 nt, Human
gcuggcgugcaguggugcga

SEQ ID NO: 2077735 - RNA, 15 nt, Human
gcugcuggcuugcag

SEQ ID NO: 2077736 - RNA, 11 nt, Human
gcugcuggcuu

SEQ ID NO: 2077737 - RNA, 12 nt, Human
gcugcuggagga

SEQ ID NO: 2077738 - RNA, 14 nt, Human
gcugcuggaggaaa

SEQ ID NO: 2077739 - RNA, 22 nt, Human
gcugcuggaggaaaacugagac

SEQ ID NO: 2077740 - RNA, 14 nt, Human
gcugcugcugcugc

SEQ ID NO: 2077741 - RNA, 20 nt, Human
gcucugcccucccuccuucc

SEQ ID NO: 2077742 - RNA, 13 nt, Human
gcucugcccugcc

SEQ ID NO: 2077743 - RNA, 15 nt, Human
gcucugcccugcccu

SEQ ID NO: 2077744 - RNA, 23 nt, Human
gcuggguggcaccagcagccugg

SEQ ID NO: 2077745 - RNA, 21 nt, Human
gcuggguggcaccagcagccu

SEQ ID NO: 2077746 - RNA, 22 nt, Human
gcuggguggcaccagcagccug

SEQ ID NO: 2077747 - RNA, 16 nt, Human
gcuggcucccagggcc

SEQ ID NO: 2077748 - RNA, 17 nt, Human
gcuggcucccagggcca

SEQ ID NO: 2077749 - RNA, 19 nt, Human
gcuggcucccagggccaug

SEQ ID NO: 2077750 - RNA, 20 nt, Human
gcuggcggcuacucagcagc

SEQ ID NO: 2077751 - RNA, 16 nt, Human
gcuggcggcuacucag

SEQ ID NO: 2077752 - RNA, 17 nt, Human
gcuggcuguuggcuggg

SEQ ID NO: 2077753 - RNA, 16 nt, Human
gcuggcuguuggcugg

SEQ ID NO: 2077754 - RNA, 15 nt, Human
gcuggcuguuggcug

SEQ ID NO: 2077755 - RNA, 11 nt, Human
gcuggcugggg

SEQ ID NO: 2077756 - RNA, 21 nt, Human
gcuggcugggggccucacucc

SEQ ID NO: 2077757 - RNA, 15 nt, Human
gcuggcugggcaugg

SEQ ID NO: 2077758 - RNA, 16 nt, Human
gcuggcugggcaugga

SEQ ID NO: 2077759 - RNA, 15 nt, Human
gcuuugacugagcag

SEQ ID NO: 2077760 - RNA, 22 nt, Human
gcuuugacugagcagacuggug

SEQ ID NO: 2077761 - RNA, 22 nt, Human
gcuuccucauaguaugguggcu

SEQ ID NO: 2077762 - RNA, 19 nt, Human
gcuucuucccuuaaaauuu

SEQ ID NO: 2077763 - RNA, 20 nt, Human
gcuucuucccuuaaaauuua

SEQ ID NO: 2077764 - RNA, 19 nt, Human
gcuucuucagaucagugcu

SEQ ID NO: 2077765 - RNA, 16 nt, Human
gcuucuucagaucagu

SEQ ID NO: 2077766 - RNA, 17 nt, Human
gcuucuaccaacuggaa

SEQ ID NO: 2077767 - RNA, 18 nt, Human
gcuucuaccaacuggaag

SEQ ID NO: 2077768 - RNA, 19 nt, Human
gcuucuaccaacuggaagc

SEQ ID NO: 2077769 - RNA, 20 nt, Human
gcuucuaccaacuggaagca

SEQ ID NO: 2077770 - RNA, 22 nt, Human
gcuucuaccaacuggaagcaca

SEQ ID NO: 2077771 - RNA, 18 nt, Human
gcuuccugacaaucaacu

SEQ ID NO: 2077772 - RNA, 22 nt, Human
gcuuguaacuccaccaacccau

SEQ ID NO: 2077773 - RNA, 14 nt, Human
gcuuguaacaagaa

SEQ ID NO: 2077774 - RNA, 15 nt, Human
gcuuguaacaagaaa

SEQ ID NO: 2077775 - RNA, 16 nt, Human
gcuuguaacaagaaaa

SEQ ID NO: 2077776 - RNA, 17 nt, Human
gcuuguaacaagaaaac

SEQ ID NO: 2077777 - RNA, 18 nt, Human
gcuuguaacaagaaaaca

SEQ ID NO: 2077778 - RNA, 20 nt, Human
gcuuguaaauagcucaggug

SEQ ID NO: 2077779 - RNA, 14 nt, Human
gcuugagcucagga

SEQ ID NO: 2077780 - RNA, 12 nt, Human
gcuugagcccag

SEQ ID NO: 2077781 - RNA, 16 nt, Human
gcuugagcccaggagu

SEQ ID NO: 2077782 - RNA, 14 nt, Human
gcuugagcccagga

SEQ ID NO: 2077783 - RNA, 15 nt, Human
gcuugagcccaggag

SEQ ID NO: 2077784 - RNA, 13 nt, Human
gcuugucagagcu

SEQ ID NO: 2077785 - RNA, 14 nt, Human
gcuugucagagcug

SEQ ID NO: 2077786 - RNA, 21 nt, Human
gcuuguccaacccgaggcccg

SEQ ID NO: 2077787 - RNA, 15 nt, Human
gcuugucagagcugg

SEQ ID NO: 2077788 - RNA, 16 nt, Human
gcuugucagagcuggg

SEQ ID NO: 2077789 - RNA, 17 nt, Human
gcuugucagagcuggga

SEQ ID NO: 2077790 - RNA, 18 nt, Human
gcuugucagagcugggag

SEQ ID NO: 2077791 - RNA, 15 nt, Human
gcuuguaacuccacc

SEQ ID NO: 2077792 - RNA, 16 nt, Human
gcuuguaacuccacca

SEQ ID NO: 2077793 - RNA, 17 nt, Human
gcuuucuugcugguugu

SEQ ID NO: 2077794 - RNA, 12 nt, Human
gcuuucuugcug

SEQ ID NO: 2077795 - RNA, 13 nt, Human
gcuuucuugcugg

SEQ ID NO: 2077796 - RNA, 14 nt, Human
gcuuucuugcuggu

SEQ ID NO: 2077797 - RNA, 18 nt, Human
gcuugucauuaccagacg

SEQ ID NO: 2077798 - RNA, 15 nt, Human
gcuuguccagcgccu

SEQ ID NO: 2077799 - RNA, 16 nt, Human
gcuuguccagcgccua

SEQ ID NO: 2077800 - RNA, 16 nt, Human
gcuuguccccuccuca

SEQ ID NO: 2077801 - RNA, 19 nt, Human
gcuuguccccuccucacuc

SEQ ID NO: 2077802 - RNA, 22 nt, Human
gcuuguccccuccucacucccu

SEQ ID NO: 2077803 - RNA, 15 nt, Human
gcuugucccugccca

SEQ ID NO: 2077804 - RNA, 16 nt, Human
gcuugucccugcccag

SEQ ID NO: 2077805 - RNA, 21 nt, Human
gcuucagccugaggcugagac

SEQ ID NO: 2077806 - RNA, 23 nt, Human
gcuucagccugaggcugagacug

SEQ ID NO: 2077807 - RNA, 12 nt, Human
gcuucagccuga

SEQ ID NO: 2077808 - RNA, 14 nt, Human
gcuucagccugagg

SEQ ID NO: 2077809 - RNA, 15 nt, Human
gcuucagccugaggc

SEQ ID NO: 2077810 - RNA, 20 nt, Human
gcuucagccugaggcugaga

SEQ ID NO: 2077811 - RNA, 17 nt, Human
gcuucagccuccccacc

SEQ ID NO: 2077812 - RNA, 19 nt, Human
gcuucagccaggagcuggg

SEQ ID NO: 2077813 - RNA, 12 nt, Human
gcuucagccucc

SEQ ID NO: 2077814 - RNA, 19 nt, Human
gcuucacggaagagccuug

SEQ ID NO: 2077815 - RNA, 15 nt, Human
gcuucagccaggagc

SEQ ID NO: 2077816 - RNA, 17 nt, Human
gcuuauuuccucauuuu

SEQ ID NO: 2077817 - RNA, 18 nt, Human
gcuucacggaagagccuu

SEQ ID NO: 2077818 - RNA, 19 nt, Human
gcuuauuaaugcuaagggc

SEQ ID NO: 2077819 - RNA, 20 nt, Human
gcuuauuaaugcuaagggca

SEQ ID NO: 2077820 - RNA, 15 nt, Human
gcuuauuaaugcuaa

SEQ ID NO: 2077821 - RNA, 16 nt, Human
gcuuauuaaugcuaag

SEQ ID NO: 2077822 - RNA, 16 nt, Human
gcuuauuuaauaaaga

SEQ ID NO: 2077823 - RNA, 18 nt, Human
gcuuauuuaauuaaaaaa

SEQ ID NO: 2077824 - RNA, 16 nt, Human
gcuuauucucaaagca

SEQ ID NO: 2077825 - RNA, 18 nt, Human
gcuuauucucaaagcagg

SEQ ID NO: 2077826 - RNA, 13 nt, Human
gcuuauuguucca

SEQ ID NO: 2077827 - RNA, 14 nt, Human
gcuuauuguuccaa

SEQ ID NO: 2077828 - RNA, 15 nt, Human
gcuuauuguuccaag

SEQ ID NO: 2077829 - RNA, 17 nt, Human
gcuuauuguuccaagac

SEQ ID NO: 2077830 - RNA, 20 nt, Human
gcuuauuguuccaagacauu

SEQ ID NO: 2077831 - RNA, 21 nt, Human
gcuuauuguuccaagacauug

SEQ ID NO: 2077832 - RNA, 22 nt, Human
gcuuauuguuccaagacauugu

SEQ ID NO: 2077833 - RNA, 11 nt, Human
gcuuauuuaau

SEQ ID NO: 2077834 - RNA, 14 nt, Human
gcuuauuuaauaaa

SEQ ID NO: 2077835 - RNA, 17 nt, Human
gcuucacggaagagccu

SEQ ID NO: 2077836 - RNA, 15 nt, Human
gcuucacggaagagc

SEQ ID NO: 2077837 - RNA, 21 nt, Human
gcucgucggggggacagcucc

SEQ ID NO: 2077838 - RNA, 12 nt, Human
gcuccugggaag

SEQ ID NO: 2077839 - RNA, 22 nt, Human
gcuccugggaaggcuacucacc

SEQ ID NO: 2077840 - RNA, 12 nt, Human
gcucgguggacc

SEQ ID NO: 2077841 - RNA, 14 nt, Human
gcucgguggaccca

SEQ ID NO: 2077842 - RNA, 17 nt, Human
gcucgguggacccaggg

SEQ ID NO: 2077843 - RNA, 18 nt, Human
gcucgguggacccaggga

SEQ ID NO: 2077844 - RNA, 18 nt, Human
gcucugaggacugcacca

SEQ ID NO: 2077845 - RNA, 17 nt, Human
gcucugaucauccacug

SEQ ID NO: 2077846 - RNA, 23 nt, Human
gcucugaucauccacugugccau

SEQ ID NO: 2077847 - RNA, 23 nt, Human
gcucugcaagaauugaagcagga

SEQ ID NO: 2077848 - RNA, 21 nt, Human
gcucugauauuccaugaaugu

SEQ ID NO: 2077849 - RNA, 13 nt, Human
gcucugccccagc

SEQ ID NO: 2077850 - RNA, 15 nt, Human
gcucugccccagcuc

SEQ ID NO: 2077851 - RNA, 20 nt, Human
gcucugccccagcucuggcu

SEQ ID NO: 2077852 - RNA, 18 nt, Human
gcucugccccagcucugg

SEQ ID NO: 2077853 - RNA, 19 nt, Human
gcucugccccagcucuggc

SEQ ID NO: 2077854 - RNA, 21 nt, Human
gcuccacacccucucccagga

SEQ ID NO: 2077855 - RNA, 22 nt, Human
gcuccacacccucucccaggac

SEQ ID NO: 2077856 - RNA, 23 nt, Human
gcuccacacccucucccaggacc

SEQ ID NO: 2077857 - RNA, 19 nt, Human
gcuccaccuugcagcucuc

SEQ ID NO: 2077858 - RNA, 22 nt, Human
gcuccacccuuggccugucuca

SEQ ID NO: 2077859 - RNA, 23 nt, Human
gcuccacccuuggccugucucau

SEQ ID NO: 2077860 - RNA, 21 nt, Human
gcuccacucugacuggcacag

SEQ ID NO: 2077861 - RNA, 13 nt, Human
gcuccaccccacu

SEQ ID NO: 2077862 - RNA, 15 nt, Human
gcuccaccccacuca

SEQ ID NO: 2077863 - RNA, 16 nt, Human
gcuccaccccacucac

SEQ ID NO: 2077864 - RNA, 19 nt, Human
gcuccaccccacucacaga

SEQ ID NO: 2077865 - RNA, 20 nt, Human
gcuccaccccacucacagag

SEQ ID NO: 2077866 - RNA, 19 nt, Human
gcuccaccaagaaagcagg

SEQ ID NO: 2077867 - RNA, 12 nt, Human
gcuccaccacau

SEQ ID NO: 2077868 - RNA, 15 nt, Human
gcuccaccacauccu

SEQ ID NO: 2077869 - RNA, 11 nt, Human
gcuccacccuu

SEQ ID NO: 2077870 - RNA, 13 nt, Human
gcuccacccuugg

SEQ ID NO: 2077871 - RNA, 14 nt, Human
gcuccacccuuggc

SEQ ID NO: 2077872 - RNA, 15 nt, Human
gcuccacccuuggcc

SEQ ID NO: 2077873 - RNA, 16 nt, Human
gcuccacccuuggccu

SEQ ID NO: 2077874 - RNA, 17 nt, Human
gcuccacccuuggccug

SEQ ID NO: 2077875 - RNA, 19 nt, Human
gcuccacccuuggccuguc

SEQ ID NO: 2077876 - RNA, 18 nt, Human
gcuccccuuucgcccaca

SEQ ID NO: 2077877 - RNA, 20 nt, Human
gcucccgggacucacuggca

SEQ ID NO: 2077878 - RNA, 24 nt, Human
gcucccgggacucacuggcagccc

SEQ ID NO: 2077879 - RNA, 19 nt, Human
gcuccccucuauuuagcau

SEQ ID NO: 2077880 - RNA, 21 nt, Human
gcuccccucuauuuagcauga

SEQ ID NO: 2077881 - RNA, 22 nt, Human
gcuccugaggggcaucugcccc

SEQ ID NO: 2077882 - RNA, 23 nt, Human
gcuccugaggggcaucugccccu

SEQ ID NO: 2077883 - RNA, 15 nt, Human
gcucccuaccaccuc

SEQ ID NO: 2077884 - RNA, 18 nt, Human
gcuccugaggggcaucug

SEQ ID NO: 2077885 - RNA, 21 nt, Human
gcuccugaggggcaucugccc

SEQ ID NO: 2077886 - RNA, 18 nt, Human
gcuccuggaaaggcucag

SEQ ID NO: 2077887 - RNA, 23 nt, Human
gcuccuggaaaggcucagucuca

SEQ ID NO: 2077888 - RNA, 21 nt, Human
gcuccuggaaaggcucagucu

SEQ ID NO: 2077889 - RNA, 22 nt, Human
gcuccuggaaaggcucagucuc

SEQ ID NO: 2077890 - RNA, 14 nt, Human
gcuccuggcccacu

SEQ ID NO: 2077891 - RNA, 15 nt, Human
gcuccuggcccacug

SEQ ID NO: 2077892 - RNA, 20 nt, Human
gcuccuggcccacugcaucg

SEQ ID NO: 2077893 - RNA, 17 nt, Human
gcuccuggacucauugc

SEQ ID NO: 2077894 - RNA, 19 nt, Human
gcuccuggacucauugcuu

SEQ ID NO: 2077895 - RNA, 18 nt, Human
gcuccuggcccacugcau

SEQ ID NO: 2077896 - RNA, 19 nt, Human
gcuccuggcccacugcauc

SEQ ID NO: 2077897 - RNA, 20 nt, Human
gcucccccauccuccccuuc

SEQ ID NO: 2077898 - RNA, 17 nt, Human
gcucccccauccucccc

SEQ ID NO: 2077899 - RNA, 18 nt, Human
gcucccccauccuccccu

SEQ ID NO: 2077900 - RNA, 14 nt, Human
gcucccccauccuc

SEQ ID NO: 2077901 - RNA, 16 nt, Human
gcucccccauccuccc

SEQ ID NO: 2077902 - RNA, 20 nt, Human
gcucccccacccccucccca

SEQ ID NO: 2077903 - RNA, 22 nt, Human
gcucccccacccccuccccagg

SEQ ID NO: 2077904 - RNA, 13 nt, Human
gcuccccagugaa

SEQ ID NO: 2077905 - RNA, 14 nt, Human
gcucccccaccccc

SEQ ID NO: 2077906 - RNA, 15 nt, Human
gcucccccacccccu

SEQ ID NO: 2077907 - RNA, 22 nt, Human
gcucccacaggcccuuccucuc

SEQ ID NO: 2077908 - RNA, 18 nt, Human
gcucccaccccacccccu

SEQ ID NO: 2077909 - RNA, 21 nt, Human
gcucccaccccacccccuuca

SEQ ID NO: 2077910 - RNA, 18 nt, Human
gcuccagcucaccagccc

SEQ ID NO: 2077911 - RNA, 21 nt, Human
gcucccacaggcccuuccucu

SEQ ID NO: 2077912 - RNA, 20 nt, Human
gcucccacaggcccuuccuc

SEQ ID NO: 2077913 - RNA, 17 nt, Human
gcucccacaggcccuuc

SEQ ID NO: 2077914 - RNA, 16 nt, Human
gcucccacaggcccuu

SEQ ID NO: 2077915 - RNA, 21 nt, Human
gcuccagcucaccagccccag

SEQ ID NO: 2077916 - RNA, 20 nt, Human
gcuccagcucaccagcccca

SEQ ID NO: 2077917 - RNA, 16 nt, Human
gcuaggccuggccaga

SEQ ID NO: 2077918 - RNA, 14 nt, Human
gcuagucagagaga

SEQ ID NO: 2077919 - RNA, 18 nt, Human
gcuagucagagagagugu

SEQ ID NO: 2077920 - RNA, 23 nt, Human
gcuaggccuggccagaugcacca

SEQ ID NO: 2077921 - RNA, 17 nt, Human
gcuaggccuggccagau

SEQ ID NO: 2077922 - RNA, 13 nt, Human
gcuaugcuugaau

SEQ ID NO: 2077923 - RNA, 17 nt, Human
gcuaugaucgcgccacu

SEQ ID NO: 2077924 - RNA, 18 nt, Human
gcuauggauggcuucuaa

SEQ ID NO: 2077925 - RNA, 15 nt, Human
gcuagucuuucacag

SEQ ID NO: 2077926 - RNA, 22 nt, Human
gcuauggauuuucuaaggaaga

SEQ ID NO: 2077927 - RNA, 13 nt, Human
gcuaugggagccc

SEQ ID NO: 2077928 - RNA, 14 nt, Human
gcuaugggagcccc

SEQ ID NO: 2077929 - RNA, 19 nt, Human
gcuauucaguaauaacucu

SEQ ID NO: 2077930 - RNA, 17 nt, Human
gcuaugggagccccagg

SEQ ID NO: 2077931 - RNA, 20 nt, Human
gcuauucaguaauaacucua

SEQ ID NO: 2077932 - RNA, 22 nt, Human
gcuauugauauaaauaaaacau

SEQ ID NO: 2077933 - RNA, 16 nt, Human
gcuauugacaagucau

SEQ ID NO: 2077934 - RNA, 21 nt, Human
gcuauucaguugguaagcuuc

SEQ ID NO: 2077935 - RNA, 16 nt, Human
gcuauuuuacugucuu

SEQ ID NO: 2077936 - RNA, 17 nt, Human
gcuauuuuacugucuua

SEQ ID NO: 2077937 - RNA, 18 nt, Human
gcuauuuuacugucuuaa

SEQ ID NO: 2077938 - RNA, 22 nt, Human
gcuauuuuuauuuguuugugca

SEQ ID NO: 2077939 - RNA, 15 nt, Human
gcuauuuuuauggaa

SEQ ID NO: 2077940 - RNA, 15 nt, Human
gcucaaaaaaugagc

SEQ ID NO: 2077941 - RNA, 14 nt, Human
gcucacugcagccu

SEQ ID NO: 2077942 - RNA, 13 nt, Human
gcucacugcagcc

SEQ ID NO: 2077943 - RNA, 12 nt, Human
gcucacugcagc

SEQ ID NO: 2077944 - RNA, 11 nt, Human
gcucacugcag

SEQ ID NO: 2077945 - RNA, 16 nt, Human
gcucacugcagccuca

SEQ ID NO: 2077946 - RNA, 15 nt, Human
gcucacugcagccuc

SEQ ID NO: 2077947 - RNA, 17 nt, Human
gcucacugcagccucaa

SEQ ID NO: 2077948 - RNA, 17 nt, Human
gcucaggugucccugca

SEQ ID NO: 2077949 - RNA, 16 nt, Human
gcucaggugucccugc

SEQ ID NO: 2077950 - RNA, 14 nt, Human
gcucaggugucccu

SEQ ID NO: 2077951 - RNA, 24 nt, Human
gcucaggcgauccaccugucucag

SEQ ID NO: 2077952 - RNA, 20 nt, Human
gcucaggccuauaaccccag

SEQ ID NO: 2077953 - RNA, 19 nt, Human
gcucaggcgauccaccugu

SEQ ID NO: 2077954 - RNA, 22 nt, Human
gcucaggcgauccaccugucuc

SEQ ID NO: 2077955 - RNA, 17 nt, Human
gcucacugcagccucga

SEQ ID NO: 2077956 - RNA, 15 nt, Human
gcucagacccccacu

SEQ ID NO: 2077957 - RNA, 19 nt, Human
gcucagacccccacucuca

SEQ ID NO: 2077958 - RNA, 23 nt, Human
gcucagacccccacucucauucc

SEQ ID NO: 2077959 - RNA, 18 nt, Human
gcuacucuguuccuucac

SEQ ID NO: 2077960 - RNA, 18 nt, Human
gcuacugaugagaauuua

SEQ ID NO: 2077961 - RNA, 17 nt, Human
gcuacucuguuccuuca

SEQ ID NO: 2077962 - RNA, 14 nt, Human
gcuacuccggaggc

SEQ ID NO: 2077963 - RNA, 20 nt, Human
gcgggaggauguucugggac

SEQ ID NO: 2077964 - RNA, 22 nt, Human
gcgggaggauguucugggacac

SEQ ID NO: 2077965 - RNA, 21 nt, Human
gcgggaggauguucugggaca

SEQ ID NO: 2077966 - RNA, 20 nt, Human
gcgugcacacaccagagccc

SEQ ID NO: 2077967 - RNA, 23 nt, Human
gcgugcacacaccagagcccacc

SEQ ID NO: 2077968 - RNA, 19 nt, Human
gcgugcacacaccagagcc

SEQ ID NO: 2077969 - RNA, 15 nt, Human
gcgggaugguccugg

SEQ ID NO: 2077970 - RNA, 15 nt, Human
gcgugguuccuuucu

SEQ ID NO: 2077971 - RNA, 19 nt, Human
gcgugucgugggugugugu

SEQ ID NO: 2077972 - RNA, 18 nt, Human
gcgugugcgugcaugugc

SEQ ID NO: 2077973 - RNA, 19 nt, Human
gcguuugcccaaaucugcc

SEQ ID NO: 2077974 - RNA, 20 nt, Human
gcguuugcccaaaucugccu

SEQ ID NO: 2077975 - RNA, 11 nt, Human
gcguguggcuc

SEQ ID NO: 2077976 - RNA, 13 nt, Human
gcguguggcucac

SEQ ID NO: 2077977 - RNA, 14 nt, Human
gcguguggcucacg

SEQ ID NO: 2077978 - RNA, 19 nt, Human
gcguguggcucacgugugu

SEQ ID NO: 2077979 - RNA, 21 nt, Human
gcguguggcucacguguguga

SEQ ID NO: 2077980 - RNA, 17 nt, Human
gcguguguccaugugug

SEQ ID NO: 2077981 - RNA, 18 nt, Human
gcguguguccaugugugu

SEQ ID NO: 2077982 - RNA, 23 nt, Human
gcguguguccaugugugugcaag

SEQ ID NO: 2077983 - RNA, 22 nt, Human
gcuaaucagcauucucacuccu

SEQ ID NO: 2077984 - RNA, 17 nt, Human
gcuaaucagcauucuca

SEQ ID NO: 2077985 - RNA, 16 nt, Human
gcuaaucagcauucuc

SEQ ID NO: 2077986 - RNA, 14 nt, Human
gcuaaucagcauuc

SEQ ID NO: 2077987 - RNA, 23 nt, Human
gcuaauaaaauaucauucagcaa

SEQ ID NO: 2077988 - RNA, 18 nt, Human
gcuaauaaaauaucauuc

SEQ ID NO: 2077989 - RNA, 19 nt, Human
gcuaauaaaauaucauuca

SEQ ID NO: 2077990 - RNA, 20 nt, Human
gcuaauaaaauaucauucag

SEQ ID NO: 2077991 - RNA, 21 nt, Human
gcuaauaaaauaucauucagc

SEQ ID NO: 2077992 - RNA, 20 nt, Human
gcuaauaucaauagaaggau

SEQ ID NO: 2077993 - RNA, 17 nt, Human
gcuaauaaaauaucauu

SEQ ID NO: 2077994 - RNA, 14 nt, Human
gcuaauaaaauauc

SEQ ID NO: 2077995 - RNA, 23 nt, Human
gcuaagugauccucccaccucag

SEQ ID NO: 2077996 - RNA, 13 nt, Human
gcuaaugggacac

SEQ ID NO: 2077997 - RNA, 15 nt, Human
gcuaaugggacacua

SEQ ID NO: 2077998 - RNA, 21 nt, Human
gcuaaugaagggaaaggauau

SEQ ID NO: 2077999 - RNA, 14 nt, Human
gcuaauuauuuuaa

SEQ ID NO: 2078000 - RNA, 15 nt, Human
gcuaauuauuuuaau

SEQ ID NO: 2078001 - RNA, 17 nt, Human
gcuaauuauuuuaauua

SEQ ID NO: 2078002 - RNA, 23 nt, Human
gcuaauuauuuuaauuagguuaa

SEQ ID NO: 2078003 - RNA, 11 nt, Human
gcuacucagca

SEQ ID NO: 2078004 - RNA, 21 nt, Human
gcuacucagaagccugaggcu

SEQ ID NO: 2078005 - RNA, 12 nt, Human
gcuacucagcag

SEQ ID NO: 2078006 - RNA, 16 nt, Human
gcuacucagcagcccu

SEQ ID NO: 2078007 - RNA, 17 nt, Human
gcuacucagcagcccuc

SEQ ID NO: 2078008 - RNA, 18 nt, Human
gcuacucagcagcccucc

SEQ ID NO: 2078009 - RNA, 19 nt, Human
gcuacucagcagcccuccu

SEQ ID NO: 2078010 - RNA, 21 nt, Human
gcuacucagcagcccuccuca

SEQ ID NO: 2078011 - RNA, 22 nt, Human
gcuacucagcagcccuccucac

SEQ ID NO: 2078012 - RNA, 24 nt, Human
gcuacucagcagcccuccucaccc

SEQ ID NO: 2078013 - RNA, 14 nt, Human
gcuacucaggaggc

SEQ ID NO: 2078014 - RNA, 15 nt, Human
gcuacucaggaggcu

SEQ ID NO: 2078015 - RNA, 16 nt, Human
gcuacucaggaggcug

SEQ ID NO: 2078016 - RNA, 23 nt, Human
gcuacucaggaggcugaggcaga

SEQ ID NO: 2078017 - RNA, 15 nt, Human
gcuacucagaagccu

SEQ ID NO: 2078018 - RNA, 16 nt, Human
gcuacucagaagccug

SEQ ID NO: 2078019 - RNA, 17 nt, Human
gcuacucagaagccuga

SEQ ID NO: 2078020 - RNA, 18 nt, Human
gcuacucagaagccugag

SEQ ID NO: 2078021 - RNA, 19 nt, Human
gcuacucagaagccugagg

SEQ ID NO: 2078022 - RNA, 18 nt, Human
gccugccccucccagaac

SEQ ID NO: 2078023 - RNA, 23 nt, Human
gccugccccaaacaaauaugcaa

SEQ ID NO: 2078024 - RNA, 17 nt, Human
gccugccccaaacaaau

SEQ ID NO: 2078025 - RNA, 14 nt, Human
gccugccccuccca

SEQ ID NO: 2078026 - RNA, 15 nt, Human
gccugccccucccag

SEQ ID NO: 2078027 - RNA, 16 nt, Human
gccugccccucccaga

SEQ ID NO: 2078028 - RNA, 15 nt, Human
gccugcccaggcccc

SEQ ID NO: 2078029 - RNA, 22 nt, Human
gccugcccaggccccugccacc

SEQ ID NO: 2078030 - RNA, 17 nt, Human
gccucccaaagugcugg

SEQ ID NO: 2078031 - RNA, 14 nt, Human
gccuccauggugcc

SEQ ID NO: 2078032 - RNA, 16 nt, Human
gccuccauggugccuc

SEQ ID NO: 2078033 - RNA, 17 nt, Human
gccuccauggugccucu

SEQ ID NO: 2078034 - RNA, 18 nt, Human
gccuccauggugccucug

SEQ ID NO: 2078035 - RNA, 19 nt, Human
gccuccauggugccucugg

SEQ ID NO: 2078036 - RNA, 17 nt, Human
gccuccauuccuggagc

SEQ ID NO: 2078037 - RNA, 18 nt, Human
gccuccauuccuggagcc

SEQ ID NO: 2078038 - RNA, 21 nt, Human
gccuccauuccuggagcccga

SEQ ID NO: 2078039 - RNA, 23 nt, Human
gccuccauuccuggagcccgagg

SEQ ID NO: 2078040 - RNA, 16 nt, Human
gccuccauucugacca

SEQ ID NO: 2078041 - RNA, 16 nt, Human
gccucccaaagugcug

SEQ ID NO: 2078042 - RNA, 23 nt, Human
gccuccugugugugcgccuacag

SEQ ID NO: 2078043 - RNA, 19 nt, Human
gccuccugugugugcgccu

SEQ ID NO: 2078044 - RNA, 17 nt, Human
gccucgaacuggcugca

SEQ ID NO: 2078045 - RNA, 17 nt, Human
gccuccauucugaccau

SEQ ID NO: 2078046 - RNA, 17 nt, Human
gccuccauuuaguucuu

SEQ ID NO: 2078047 - RNA, 22 nt, Human
gccucgaacuggcugcaaaggg

SEQ ID NO: 2078048 - RNA, 20 nt, Human
gccucgaacuggcugcaaag

SEQ ID NO: 2078049 - RNA, 20 nt, Human
gccucuuaaagcugccugua

SEQ ID NO: 2078050 - RNA, 19 nt, Human
gccucuuaaauaaaccuuu

SEQ ID NO: 2078051 - RNA, 22 nt, Human
gccucuuaaagcugccuguagu

SEQ ID NO: 2078052 - RNA, 23 nt, Human
gccucuuaaagcugccuguaguu

SEQ ID NO: 2078053 - RNA, 14 nt, Human
gccugcccaggccc

SEQ ID NO: 2078054 - RNA, 13 nt, Human
gccugcccaggcc

SEQ ID NO: 2078055 - RNA, 14 nt, Human
gccucuuggguuca

SEQ ID NO: 2078056 - RNA, 21 nt, Human
gcgauguuucaggaggcugga

SEQ ID NO: 2078057 - RNA, 23 nt, Human
gcgauguuucaggaggcuggagg

SEQ ID NO: 2078058 - RNA, 16 nt, Human
gcgauucccauugaaa

SEQ ID NO: 2078059 - RNA, 22 nt, Human
gcgaucuggguucacugcaacc

SEQ ID NO: 2078060 - RNA, 19 nt, Human
gcgaugaauuuggagacuc

SEQ ID NO: 2078061 - RNA, 17 nt, Human
gcgcacaaggcugacca

SEQ ID NO: 2078062 - RNA, 18 nt, Human
gcgcacaaggcugaccaa

SEQ ID NO: 2078063 - RNA, 12 nt, Human
gcgcaccugccc

SEQ ID NO: 2078064 - RNA, 17 nt, Human
gcgcaccugcccccugg

SEQ ID NO: 2078065 - RNA, 18 nt, Human
gcgcaccugcccccuggu

SEQ ID NO: 2078066 - RNA, 19 nt, Human
gcgcaccugcccccuggug

SEQ ID NO: 2078067 - RNA, 15 nt, Human
gcgagcccugguggc

SEQ ID NO: 2078068 - RNA, 17 nt, Human
gcgagcccugguggcag

SEQ ID NO: 2078069 - RNA, 21 nt, Human
gcgauccaccugucucagccu

SEQ ID NO: 2078070 - RNA, 21 nt, Human
gcgagcuaugaucgcgccacu

SEQ ID NO: 2078071 - RNA, 12 nt, Human
gccuugcccaga

SEQ ID NO: 2078072 - RNA, 14 nt, Human
gccuugcccagaga

SEQ ID NO: 2078073 - RNA, 15 nt, Human
gccuugcccagagau

SEQ ID NO: 2078074 - RNA, 16 nt, Human
gccuugcccagagaug

SEQ ID NO: 2078075 - RNA, 22 nt, Human
gccuugcccagagaugccucca

SEQ ID NO: 2078076 - RNA, 19 nt, Human
gccuugcuaccucaagggg

SEQ ID NO: 2078077 - RNA, 20 nt, Human
gccuugcccagagaugccuc

SEQ ID NO: 2078078 - RNA, 22 nt, Human
gccuugcccggauucugggagg

SEQ ID NO: 2078079 - RNA, 14 nt, Human
gccuguugcccuuu

SEQ ID NO: 2078080 - RNA, 19 nt, Human
gccuggcgacagagcgaga

SEQ ID NO: 2078081 - RNA, 21 nt, Human
gccuggcgaaaccccaucucu

SEQ ID NO: 2078082 - RNA, 16 nt, Human
gccugugccucuggga

SEQ ID NO: 2078083 - RNA, 17 nt, Human
gccugugccucugggac

SEQ ID NO: 2078084 - RNA, 18 nt, Human
gccugugccucugggacu

SEQ ID NO: 2078085 - RNA, 16 nt, Human
gccuguggcggugccu

SEQ ID NO: 2078086 - RNA, 18 nt, Human
gccuguggcggugccugg

SEQ ID NO: 2078087 - RNA, 19 nt, Human
gccuguggcggugccuggg

SEQ ID NO: 2078088 - RNA, 19 nt, Human
gccuguucccauucuugca

SEQ ID NO: 2078089 - RNA, 23 nt, Human
gccuguucccauucuugcauggc

SEQ ID NO: 2078090 - RNA, 21 nt, Human
gcccugcagaggggaaaccag

SEQ ID NO: 2078091 - RNA, 15 nt, Human
gcccugcccuagcuc

SEQ ID NO: 2078092 - RNA, 16 nt, Human
gcccugcccuagcucc

SEQ ID NO: 2078093 - RNA, 17 nt, Human
gcccugcccuagcucca

SEQ ID NO: 2078094 - RNA, 18 nt, Human
gcccugcccuagcuccac

SEQ ID NO: 2078095 - RNA, 15 nt, Human
gccgcaucuucucca

SEQ ID NO: 2078096 - RNA, 17 nt, Human
gccgcaucuucuccauc

SEQ ID NO: 2078097 - RNA, 18 nt, Human
gccgcaucuucuccaucu

SEQ ID NO: 2078098 - RNA, 20 nt, Human
gccgcaucuucuccaucugg

SEQ ID NO: 2078099 - RNA, 14 nt, Human
gccgcauucccuga

SEQ ID NO: 2078100 - RNA, 15 nt, Human
gccgcauucccugag

SEQ ID NO: 2078101 - RNA, 11 nt, Human
gccgcccugua

SEQ ID NO: 2078102 - RNA, 17 nt, Human
gccgcccuguacccucu

SEQ ID NO: 2078103 - RNA, 19 nt, Human
gccgccccagccucugagc

SEQ ID NO: 2078104 - RNA, 22 nt, Human
gcccuuagcagggaaacagcua

SEQ ID NO: 2078105 - RNA, 17 nt, Human
gccgcagccucccucug

SEQ ID NO: 2078106 - RNA, 18 nt, Human
gccgcagccucccucuga

SEQ ID NO: 2078107 - RNA, 20 nt, Human
gcccuuagcagggaaacagc

SEQ ID NO: 2078108 - RNA, 19 nt, Human
gcccuuagcagggaaacag

SEQ ID NO: 2078109 - RNA, 15 nt, Human
gcccugcccuucagc

SEQ ID NO: 2078110 - RNA, 20 nt, Human
gcccugcccuucagcauccu

SEQ ID NO: 2078111 - RNA, 20 nt, Human
gccuaggugacagagugaga

SEQ ID NO: 2078112 - RNA, 17 nt, Human
gccuagggccuggucca

SEQ ID NO: 2078113 - RNA, 17 nt, Human
gccuaggggucagggac

SEQ ID NO: 2078114 - RNA, 15 nt, Human
gccuagucagccaca

SEQ ID NO: 2078115 - RNA, 18 nt, Human
gccuagucagccacaugg

SEQ ID NO: 2078116 - RNA, 19 nt, Human
gccuagucagccacauggg

SEQ ID NO: 2078117 - RNA, 22 nt, Human
gccuagucagccacaugggaaa

SEQ ID NO: 2078118 - RNA, 22 nt, Human
gccuaggggucagggaccaagg

SEQ ID NO: 2078119 - RNA, 18 nt, Human
gccuaguggggucucccu

SEQ ID NO: 2078120 - RNA, 19 nt, Human
gccuaguggggucucccuc

SEQ ID NO: 2078121 - RNA, 22 nt, Human
gccuaguggggucucccucucc

SEQ ID NO: 2078122 - RNA, 23 nt, Human
gccuaguggggucucccucuccu

SEQ ID NO: 2078123 - RNA, 17 nt, Human
gccuaguucauccaauc

SEQ ID NO: 2078124 - RNA, 21 nt, Human
gccuaguucauccaauccuca

SEQ ID NO: 2078125 - RNA, 13 nt, Human
gccgccucaaugu

SEQ ID NO: 2078126 - RNA, 15 nt, Human
gccuagccgaccuca

SEQ ID NO: 2078127 - RNA, 16 nt, Human
gccuagccgaccucag

SEQ ID NO: 2078128 - RNA, 17 nt, Human
gccuagccgaccucagc

SEQ ID NO: 2078129 - RNA, 18 nt, Human
gccuagccgaccucagcc

SEQ ID NO: 2078130 - RNA, 19 nt, Human
gccuagccgaccucagccu

SEQ ID NO: 2078131 - RNA, 20 nt, Human
gccuagccgaccucagccuu

SEQ ID NO: 2078132 - RNA, 15 nt, Human
gccuaggugacagag

SEQ ID NO: 2078133 - RNA, 14 nt, Human
gccuaggugacaga

SEQ ID NO: 2078134 - RNA, 13 nt, Human
gccuaggugacag

SEQ ID NO: 2078135 - RNA, 17 nt, Human
gccuaggaauucccagc

SEQ ID NO: 2078136 - RNA, 20 nt, Human
gcccucaccccugcccuggg

SEQ ID NO: 2078137 - RNA, 16 nt, Human
gccccugccacccugg

SEQ ID NO: 2078138 - RNA, 17 nt, Human
gccccugccacccuggg

SEQ ID NO: 2078139 - RNA, 13 nt, Human
gcccccacuggcu

SEQ ID NO: 2078140 - RNA, 15 nt, Human
gcccccacuggcugu

SEQ ID NO: 2078141 - RNA, 18 nt, Human
gcccccacuggcuguggg

SEQ ID NO: 2078142 - RNA, 19 nt, Human
gcccccacuggcugugggc

SEQ ID NO: 2078143 - RNA, 21 nt, Human
gcccccacuggcugugggcuc

SEQ ID NO: 2078144 - RNA, 13 nt, Human
gccccccacccca

SEQ ID NO: 2078145 - RNA, 14 nt, Human
gccccccaccccag

SEQ ID NO: 2078146 - RNA, 15 nt, Human
gccccugcucuggug

SEQ ID NO: 2078147 - RNA, 13 nt, Human
gccccugcugccu

SEQ ID NO: 2078148 - RNA, 15 nt, Human
gccccugcugccucc

SEQ ID NO: 2078149 - RNA, 12 nt, Human
gccccugccccg

SEQ ID NO: 2078150 - RNA, 18 nt, Human
gcccggggcagcugccag

SEQ ID NO: 2078151 - RNA, 14 nt, Human
gcccggggcagcug

SEQ ID NO: 2078152 - RNA, 17 nt, Human
gcccggggcagcugcca

SEQ ID NO: 2078153 - RNA, 22 nt, Human
gcccggggcagcugccagagaa

SEQ ID NO: 2078154 - RNA, 19 nt, Human
gccccugcugccuccccaa

SEQ ID NO: 2078155 - RNA, 16 nt, Human
gccccugcugccuccc

SEQ ID NO: 2078156 - RNA, 17 nt, Human
gccccugcugccucccc

SEQ ID NO: 2078157 - RNA, 20 nt, Human
gccccugcugccuccccaac

SEQ ID NO: 2078158 - RNA, 21 nt, Human
gcccuaagauugaaaaggaag

SEQ ID NO: 2078159 - RNA, 18 nt, Human
gcccgucauguuccucaa

SEQ ID NO: 2078160 - RNA, 19 nt, Human
gcccucaccccugcccugg

SEQ ID NO: 2078161 - RNA, 13 nt, Human
gcccucaccccug

SEQ ID NO: 2078162 - RNA, 23 nt, Human
gcccucaagacccuuuuggguuu

SEQ ID NO: 2078163 - RNA, 19 nt, Human
gcccucaaaaugacagcca

SEQ ID NO: 2078164 - RNA, 15 nt, Human
gcccucaaucccagc

SEQ ID NO: 2078165 - RNA, 19 nt, Human
ggccagugugaucccaagu

SEQ ID NO: 2078166 - RNA, 20 nt, Human
ggccagugugacaaggauug

SEQ ID NO: 2078167 - RNA, 22 nt, Human
ggccaguccugccuggccaggc

SEQ ID NO: 2078168 - RNA, 18 nt, Human
ggccaguccugccuggcc

SEQ ID NO: 2078169 - RNA, 19 nt, Human
ggccaguccugccuggcca

SEQ ID NO: 2078170 - RNA, 20 nt, Human
ggccaguccugccuggccag

SEQ ID NO: 2078171 - RNA, 21 nt, Human
ggccaguccugccuggccagg

SEQ ID NO: 2078172 - RNA, 16 nt, Human
ggccaguccugccugg

SEQ ID NO: 2078173 - RNA, 21 nt, Human
ggcauacgccuguaguccuag

SEQ ID NO: 2078174 - RNA, 14 nt, Human
ggccccugcugguu

SEQ ID NO: 2078175 - RNA, 13 nt, Human
ggccccugcuggu

SEQ ID NO: 2078176 - RNA, 23 nt, Human
ggccccugcugguucaggguugg

SEQ ID NO: 2078177 - RNA, 13 nt, Human
ggcccggcuccag

SEQ ID NO: 2078178 - RNA, 15 nt, Human
ggcccggcuccaggc

SEQ ID NO: 2078179 - RNA, 22 nt, Human
ggcccggggcuggcggcuacuc

SEQ ID NO: 2078180 - RNA, 23 nt, Human
ggcccggcgcgguggcucacgcc

SEQ ID NO: 2078181 - RNA, 13 nt, Human
ggcccggggcugg

SEQ ID NO: 2078182 - RNA, 19 nt, Human
ggcccggggcuggcggcua

SEQ ID NO: 2078183 - RNA, 14 nt, Human
ggccccugccuugg

SEQ ID NO: 2078184 - RNA, 21 nt, Human
ggcccuugcaguucagcacca

SEQ ID NO: 2078185 - RNA, 15 nt, Human
ggccucacuccagga

SEQ ID NO: 2078186 - RNA, 18 nt, Human
ggccucacuccaggaagg

SEQ ID NO: 2078187 - RNA, 10 nt, Human
ggccucagaa

SEQ ID NO: 2078188 - RNA, 23 nt, Human
ggccucaagugauucuccugccu

SEQ ID NO: 2078189 - RNA, 23 nt, Human
ggcacucagaagacacugauggg

SEQ ID NO: 2078190 - RNA, 17 nt, Human
ggcacugagauauuuau

SEQ ID NO: 2078191 - RNA, 12 nt, Human
ggcacauagaga

SEQ ID NO: 2078192 - RNA, 13 nt, Human
ggcagacagcagc

SEQ ID NO: 2078193 - RNA, 14 nt, Human
ggcagacagcagcu

SEQ ID NO: 2078194 - RNA, 15 nt, Human
ggcagacagcagcuc

SEQ ID NO: 2078195 - RNA, 16 nt, Human
ggcagacagcagcuca

SEQ ID NO: 2078196 - RNA, 17 nt, Human
ggcagacagcagcucag

SEQ ID NO: 2078197 - RNA, 18 nt, Human
ggcagacagcagcucagg

SEQ ID NO: 2078198 - RNA, 19 nt, Human
ggcagacagcagcucaggc

SEQ ID NO: 2078199 - RNA, 24 nt, Human
ggcacuguacuaggcgugagaagc

SEQ ID NO: 2078200 - RNA, 15 nt, Human
ggcacugguggcccg

SEQ ID NO: 2078201 - RNA, 20 nt, Human
ggcagacagcagcucaggca

SEQ ID NO: 2078202 - RNA, 21 nt, Human
ggcagcaggccuguugcuuuu

SEQ ID NO: 2078203 - RNA, 23 nt, Human
ggcagccccauucugccugccca

SEQ ID NO: 2078204 - RNA, 18 nt, Human
ggagagaaggggaggagg

SEQ ID NO: 2078205 - RNA, 20 nt, Human
ggagagaaggggaggagggc

SEQ ID NO: 2078206 - RNA, 21 nt, Human
ggagagaaggggaggagggcg

SEQ ID NO: 2078207 - RNA, 20 nt, Human
ggagacucuguggggccuug

SEQ ID NO: 2078208 - RNA, 12 nt, Human
ggagagaaaaaa

SEQ ID NO: 2078209 - RNA, 13 nt, Human
ggagagaaaaaag

SEQ ID NO: 2078210 - RNA, 15 nt, Human
ggagagaaaaaagaa

SEQ ID NO: 2078211 - RNA, 15 nt, Human
ggcagggcugacucu

SEQ ID NO: 2078212 - RNA, 14 nt, Human
ggcagggcucugau

SEQ ID NO: 2078213 - RNA, 13 nt, Human
ggcagggcucuga

SEQ ID NO: 2078214 - RNA, 16 nt, Human
ggcagggccuugccca

SEQ ID NO: 2078215 - RNA, 18 nt, Human
ggcagggccuugcccaga

SEQ ID NO: 2078216 - RNA, 19 nt, Human
ggcagggccuugcccagag

SEQ ID NO: 2078217 - RNA, 20 nt, Human
ggcagggccuugcccagaga

SEQ ID NO: 2078218 - RNA, 21 nt, Human
ggcagggccuugcccagagau

SEQ ID NO: 2078219 - RNA, 13 nt, Human
ggcacuguggccu

SEQ ID NO: 2078220 - RNA, 13 nt, Human
ggcagcccuguag

SEQ ID NO: 2078221 - RNA, 15 nt, Human
ggcagcccuguaggg

SEQ ID NO: 2078222 - RNA, 17 nt, Human
ggcaguuagagaugccu

SEQ ID NO: 2078223 - RNA, 20 nt, Human
ggcaguuagagaugccuccc

SEQ ID NO: 2078224 - RNA, 21 nt, Human
ggcaguucugggugcucccua

SEQ ID NO: 2078225 - RNA, 14 nt, Human
ggcaguuggccaga

SEQ ID NO: 2078226 - RNA, 15 nt, Human
ggcaguucugggugc

SEQ ID NO: 2078227 - RNA, 18 nt, Human
ggcucagcggggacagcu

SEQ ID NO: 2078228 - RNA, 13 nt, Human
ggcucagccuggu

SEQ ID NO: 2078229 - RNA, 20 nt, Human
ggcucagccuggugggccuc

SEQ ID NO: 2078230 - RNA, 13 nt, Human
ggcucagcucugg

SEQ ID NO: 2078231 - RNA, 14 nt, Human
ggcucagcucuggc

SEQ ID NO: 2078232 - RNA, 18 nt, Human
ggcucagcucuggcucac

SEQ ID NO: 2078233 - RNA, 21 nt, Human
ggcucagcucuggcucacaga

SEQ ID NO: 2078234 - RNA, 20 nt, Human
ggcucagcggggacagcucc

SEQ ID NO: 2078235 - RNA, 19 nt, Human
ggcucagcggggacagcuc

SEQ ID NO: 2078236 - RNA, 14 nt, Human
ggcucagucucagg

SEQ ID NO: 2078237 - RNA, 15 nt, Human
ggcucagucucagga

SEQ ID NO: 2078238 - RNA, 17 nt, Human
ggcucagucucaggagc

SEQ ID NO: 2078239 - RNA, 20 nt, Human
ggcucauagggaagaccugc

SEQ ID NO: 2078240 - RNA, 17 nt, Human
ggcucauauuccugcag

SEQ ID NO: 2078241 - RNA, 20 nt, Human
ggcucauauuccugcagccu

SEQ ID NO: 2078242 - RNA, 21 nt, Human
ggcucauauuccugcagccug

SEQ ID NO: 2078243 - RNA, 22 nt, Human
ggcucauauuccugcagccugg

SEQ ID NO: 2078244 - RNA, 15 nt, Human
ggcugcucagggcug

SEQ ID NO: 2078245 - RNA, 15 nt, Human
ggcugcuacccagaa

SEQ ID NO: 2078246 - RNA, 16 nt, Human
ggcugcuacccagaaa

SEQ ID NO: 2078247 - RNA, 15 nt, Human
ggcugcucugccugu

SEQ ID NO: 2078248 - RNA, 16 nt, Human
ggcugcucugccugug

SEQ ID NO: 2078249 - RNA, 15 nt, Human
ggcugcuccuccagg

SEQ ID NO: 2078250 - RNA, 18 nt, Human
ggcugcuccuccagggcc

SEQ ID NO: 2078251 - RNA, 19 nt, Human
ggcugcuccuccagggcca

SEQ ID NO: 2078252 - RNA, 23 nt, Human
ggcugcuccuccagggccacgug

SEQ ID NO: 2078253 - RNA, 12 nt, Human
ggcugcuccucc

SEQ ID NO: 2078254 - RNA, 13 nt, Human
ggcugcuccucca

SEQ ID NO: 2078255 - RNA, 12 nt, Human
ggcuccuggacu

SEQ ID NO: 2078256 - RNA, 13 nt, Human
ggcuccuggaaag

SEQ ID NO: 2078257 - RNA, 15 nt, Human
ggcucugugcaggga

SEQ ID NO: 2078258 - RNA, 18 nt, Human
ggcucuguggcuugcuag

SEQ ID NO: 2078259 - RNA, 13 nt, Human
ggcucuucuccuu

SEQ ID NO: 2078260 - RNA, 12 nt, Human
ggcucuucuccu

SEQ ID NO: 2078261 - RNA, 23 nt, Human
ggcucuucuccuuucacaaccuu

SEQ ID NO: 2078262 - RNA, 15 nt, Human
ggcucuucuccuuuc

SEQ ID NO: 2078263 - RNA, 14 nt, Human
ggcucuucuccuuu

SEQ ID NO: 2078264 - RNA, 24 nt, Human
ggcugacacguccaccccagugca

SEQ ID NO: 2078265 - RNA, 16 nt, Human
ggcucuucuccuuuca

SEQ ID NO: 2078266 - RNA, 22 nt, Human
ggcugcccuggugcugccacac

SEQ ID NO: 2078267 - RNA, 17 nt, Human
ggcugccaaggccagag

SEQ ID NO: 2078268 - RNA, 14 nt, Human
ggcugccuggagcc

SEQ ID NO: 2078269 - RNA, 15 nt, Human
ggcugccuggagccc

SEQ ID NO: 2078270 - RNA, 18 nt, Human
ggcugccuggagccccac

SEQ ID NO: 2078271 - RNA, 16 nt, Human
ggcugccuggccccca

SEQ ID NO: 2078272 - RNA, 16 nt, Human
ggcugccuuagaaccu

SEQ ID NO: 2078273 - RNA, 22 nt, Human
ggcugcggaaugaaccacaucu

SEQ ID NO: 2078274 - RNA, 19 nt, Human
ggcugcccuggugcugcca

SEQ ID NO: 2078275 - RNA, 16 nt, Human
ggcugcccuggugcug

SEQ ID NO: 2078276 - RNA, 15 nt, Human
ggcugcccuggugcu

SEQ ID NO: 2078277 - RNA, 14 nt, Human
ggcugcccuggugc

SEQ ID NO: 2078278 - RNA, 13 nt, Human
ggcugcccuggug

SEQ ID NO: 2078279 - RNA, 15 nt, Human
ggcugccaaggccag

SEQ ID NO: 2078280 - RNA, 15 nt, Human
gggaggucgaggcag

SEQ ID NO: 2078281 - RNA, 17 nt, Human
gggaggguuggggaggg

SEQ ID NO: 2078282 - RNA, 18 nt, Human
gggaggucaaggcugcag

SEQ ID NO: 2078283 - RNA, 21 nt, Human
gggaggggguuacaaacugca

SEQ ID NO: 2078284 - RNA, 22 nt, Human
gggagggguaaaauuccuuagc

SEQ ID NO: 2078285 - RNA, 13 nt, Human
gggaggcuucccc

SEQ ID NO: 2078286 - RNA, 14 nt, Human
gggaggcugaggcg

SEQ ID NO: 2078287 - RNA, 22 nt, Human
gggagaggccaugauucgccca

SEQ ID NO: 2078288 - RNA, 11 nt, Human
gggagcagugu

SEQ ID NO: 2078289 - RNA, 19 nt, Human
gggagcagugucuuccaua

SEQ ID NO: 2078290 - RNA, 20 nt, Human
gggagcagugucuuccauaa

SEQ ID NO: 2078291 - RNA, 10 nt, Human
gggaggcuga

SEQ ID NO: 2078292 - RNA, 12 nt, Human
gggagccagggc

SEQ ID NO: 2078293 - RNA, 23 nt, Human
gggacuuggaagcuccgcuuucu

SEQ ID NO: 2078294 - RNA, 18 nt, Human
gggacuuggaagcuccgc

SEQ ID NO: 2078295 - RNA, 17 nt, Human
gggacuuggaagcuccg

SEQ ID NO: 2078296 - RNA, 15 nt, Human
gggacuuggaagcuc

SEQ ID NO: 2078297 - RNA, 14 nt, Human
aaaaggaagacuag

SEQ ID NO: 2078298 - RNA, 15 nt, Human
aaaaggaagacuaga

SEQ ID NO: 2078299 - RNA, 15 nt, Human
gggagaaaagacaug

SEQ ID NO: 2078300 - RNA, 10 nt, Human
gggagaaaac

SEQ ID NO: 2078301 - RNA, 14 nt, Human
gggagaaccucagg

SEQ ID NO: 2078302 - RNA, 16 nt, Human
gggagaaccucaggcu

SEQ ID NO: 2078303 - RNA, 15 nt, Human
gggagaaccucaggc

SEQ ID NO: 2078304 - RNA, 14 nt, Human
aaaagccaucaugu

SEQ ID NO: 2078305 - RNA, 20 nt, Human
aaaagccaucauguaaauua

SEQ ID NO: 2078306 - RNA, 13 nt, Human
aaaagccauguuu

SEQ ID NO: 2078307 - RNA, 14 nt, Human
aaaagccauguuua

SEQ ID NO: 2078308 - RNA, 15 nt, Human
aaaagccauguuuaa

SEQ ID NO: 2078309 - RNA, 17 nt, Human
aaaagccauguuuaaga

SEQ ID NO: 2078310 - RNA, 20 nt, Human
aaaagccauguuuaagauuu

SEQ ID NO: 2078311 - RNA, 21 nt, Human
aaaagccauguuuaagauuua

SEQ ID NO: 2078312 - RNA, 15 nt, Human
aaaagcuuuuaugag

SEQ ID NO: 2078313 - RNA, 21 nt, Human
aaaagccucaacuagucauuu

SEQ ID NO: 2078314 - RNA, 13 nt, Human
aaaaggaagacua

SEQ ID NO: 2078315 - RNA, 13 nt, Human
aaaaccauugcuu

SEQ ID NO: 2078316 - RNA, 14 nt, Human
aaaaccauugcuuc

SEQ ID NO: 2078317 - RNA, 16 nt, Human
aaaaccauugcuucac

SEQ ID NO: 2078318 - RNA, 12 nt, Human
aaaacccagaga

SEQ ID NO: 2078319 - RNA, 13 nt, Human
aaaaccuuucaaa

SEQ ID NO: 2078320 - RNA, 13 nt, Human
aaaacgcauggag

SEQ ID NO: 2078321 - RNA, 14 nt, Human
aaaacgcauggagu

SEQ ID NO: 2078322 - RNA, 18 nt, Human
aaaacgcauggagugugu

SEQ ID NO: 2078323 - RNA, 20 nt, Human
aaaaccuuucaaauuucaca

SEQ ID NO: 2078324 - RNA, 18 nt, Human
aaaacgguuaaaacuguc

SEQ ID NO: 2078325 - RNA, 17 nt, Human
aaaacgcauggagugug

SEQ ID NO: 2078326 - RNA, 16 nt, Human
aaaacgguuaaaacug

SEQ ID NO: 2078327 - RNA, 21 nt, Human
aaaacuuaaccgcaucagaag

SEQ ID NO: 2078328 - RNA, 15 nt, Human
aaaacugacagagga

SEQ ID NO: 2078329 - RNA, 16 nt, Human
aaaacugacuccuuag

SEQ ID NO: 2078330 - RNA, 14 nt, Human
aaaagauguauccu

SEQ ID NO: 2078331 - RNA, 16 nt, Human
aaaacauccagauaca

SEQ ID NO: 2078332 - RNA, 21 nt, Human
aaaacauccagauacacccaa

SEQ ID NO: 2078333 - RNA, 12 nt, Human
aaaacccaagug

SEQ ID NO: 2078334 - RNA, 17 nt, Human
aaaaccacuagaacucu

SEQ ID NO: 2078335 - RNA, 19 nt, Human
aaaaccacagcccugucag

SEQ ID NO: 2078336 - RNA, 20 nt, Human
aaaaccacagcccugucagu

SEQ ID NO: 2078337 - RNA, 16 nt, Human
aaaaccacuagaacuc

SEQ ID NO: 2078338 - RNA, 22 nt, Human
gggacaugaaauaaaugcccca

SEQ ID NO: 2078339 - RNA, 13 nt, Human
gggacauguggaa

SEQ ID NO: 2078340 - RNA, 14 nt, Human
gggaccagccaaga

SEQ ID NO: 2078341 - RNA, 11 nt, Human
aaaaaugguaa

SEQ ID NO: 2078342 - RNA, 15 nt, Human
aaaaaugguaaaauu

SEQ ID NO: 2078343 - RNA, 16 nt, Human
aaaaaugguaaaauug

SEQ ID NO: 2078344 - RNA, 19 nt, Human
aaaaaugguaaaauugcau

SEQ ID NO: 2078345 - RNA, 19 nt, Human
gggaagaaaagagcuuucu

SEQ ID NO: 2078346 - RNA, 17 nt, Human
gggacagagacaccugc

SEQ ID NO: 2078347 - RNA, 12 nt, Human
gggaagagaaac

SEQ ID NO: 2078348 - RNA, 14 nt, Human
gggaagagaaacag

SEQ ID NO: 2078349 - RNA, 13 nt, Human
gggacagcuccuu

SEQ ID NO: 2078350 - RNA, 12 nt, Human
gggacagcuccu

SEQ ID NO: 2078351 - RNA, 13 nt, Human
gggacagagcaga

SEQ ID NO: 2078352 - RNA, 18 nt, Human
gggacagagacaccugca

SEQ ID NO: 2078353 - RNA, 20 nt, Human
gggacagagacaccugcacc

SEQ ID NO: 2078354 - RNA, 15 nt, Human
ggcugggggccucac

SEQ ID NO: 2078355 - RNA, 15 nt, Human
gggacagcuccuucu

SEQ ID NO: 2078356 - RNA, 18 nt, Human
gggaagaagcucucuccu

SEQ ID NO: 2078357 - RNA, 18 nt, Human
gggaacgugacugcccca

SEQ ID NO: 2078358 - RNA, 14 nt, Human
gggaacgugacugc

SEQ ID NO: 2078359 - RNA, 17 nt, Human
gggaacgugacugcccc

SEQ ID NO: 2078360 - RNA, 15 nt, Human
gggaacucccaagaa

SEQ ID NO: 2078361 - RNA, 22 nt, Human
gggaacucccaagaacagcagg

SEQ ID NO: 2078362 - RNA, 13 nt, Human
gggaacuccugga

SEQ ID NO: 2078363 - RNA, 12 nt, Human
gggaacaguguu

SEQ ID NO: 2078364 - RNA, 15 nt, Human
ggcuucuguuucuag

SEQ ID NO: 2078365 - RNA, 20 nt, Human
ggcuucuguuucuaguugag

SEQ ID NO: 2078366 - RNA, 20 nt, Human
ggcuucuucagaucagugcu

SEQ ID NO: 2078367 - RNA, 20 nt, Human
gggaacaguguuucccauaa

SEQ ID NO: 2078368 - RNA, 18 nt, Human
ggcuucuggagcccuugg

SEQ ID NO: 2078369 - RNA, 20 nt, Human
ggcuucuggagcccuugggu

SEQ ID NO: 2078370 - RNA, 13 nt, Human
ggcuucuggagcc

SEQ ID NO: 2078371 - RNA, 16 nt, Human
ggcuucuggagcccuu

SEQ ID NO: 2078372 - RNA, 22 nt, Human
ggcuucccgcucagcccucccu

SEQ ID NO: 2078373 - RNA, 15 nt, Human
ggcuguagaaggaga

SEQ ID NO: 2078374 - RNA, 21 nt, Human
ggcuuccucaguuccugcccu

SEQ ID NO: 2078375 - RNA, 11 nt, Human
ggcuucugaug

SEQ ID NO: 2078376 - RNA, 16 nt, Human
ggcuucugaugaaucu

SEQ ID NO: 2078377 - RNA, 18 nt, Human
ggcuucugaugaaucuug

SEQ ID NO: 2078378 - RNA, 19 nt, Human
ggcuucugaugaaucuugc

SEQ ID NO: 2078379 - RNA, 21 nt, Human
aaaaauaaauuugguucuaau

SEQ ID NO: 2078380 - RNA, 19 nt, Human
aaaaauaaccccaaaauga

SEQ ID NO: 2078381 - RNA, 22 nt, Human
aaaaauaaccccaaaaugaaga

SEQ ID NO: 2078382 - RNA, 19 nt, Human
ggcugggggccucagugcc

SEQ ID NO: 2078383 - RNA, 17 nt, Human
ggcugggggccucagug

SEQ ID NO: 2078384 - RNA, 16 nt, Human
ggcugggggccucagu

SEQ ID NO: 2078385 - RNA, 15 nt, Human
ggcugggggccucag

SEQ ID NO: 2078386 - RNA, 11 nt, Human
aaaaauaaggu

SEQ ID NO: 2078387 - RNA, 12 nt, Human
aaaaauaauaaa

SEQ ID NO: 2078388 - RNA, 17 nt, Human
aaaaauaauaaauugca

SEQ ID NO: 2078389 - RNA, 16 nt, Human
aaaaauaauaauaaug

SEQ ID NO: 2078390 - RNA, 19 nt, Human
ggcuggguggcaccagcag

SEQ ID NO: 2078391 - RNA, 14 nt, Human
ggcugggugcccac

SEQ ID NO: 2078392 - RNA, 15 nt, Human
ggcugggugcccaca

SEQ ID NO: 2078393 - RNA, 16 nt, Human
ggcugggugcccacag

SEQ ID NO: 2078394 - RNA, 17 nt, Human
ggcugggugcccacagc

SEQ ID NO: 2078395 - RNA, 21 nt, Human
ggcugggugcccacagcccgc

SEQ ID NO: 2078396 - RNA, 22 nt, Human
ggcugggugcccacagcccgca

SEQ ID NO: 2078397 - RNA, 18 nt, Human
ggcuguaucccaugagcc

SEQ ID NO: 2078398 - RNA, 20 nt, Human
ggcuucaguggcagcugcuu

SEQ ID NO: 2078399 - RNA, 19 nt, Human
ggcuucaguggcagcugcu

SEQ ID NO: 2078400 - RNA, 17 nt, Human
ggcuucaguggcagcug

SEQ ID NO: 2078401 - RNA, 18 nt, Human
ggcuucaguggcagcugc

SEQ ID NO: 2078402 - RNA, 18 nt, Human
ggcuucccgcucagcccu

SEQ ID NO: 2078403 - RNA, 17 nt, Human
ggcuucccgcucagccc

SEQ ID NO: 2078404 - RNA, 16 nt, Human
ggcuucccgcucagcc

SEQ ID NO: 2078405 - RNA, 15 nt, Human
ggcuucccgcucagc

SEQ ID NO: 2078406 - RNA, 21 nt, Human
ggcuucccgcucagcccuccc

SEQ ID NO: 2078407 - RNA, 19 nt, Human
ggcuucccgcucagcccuc

SEQ ID NO: 2078408 - RNA, 16 nt, Human
ggcuuccucauaguau

SEQ ID NO: 2078409 - RNA, 14 nt, Human
ggcuucccgcucag

SEQ ID NO: 2078410 - RNA, 9 nt, Human
aaagacaga

SEQ ID NO: 2078411 - RNA, 19 nt, Human
aaagacccuaaaucugagg

SEQ ID NO: 2078412 - RNA, 20 nt, Human
aaagacccuaaaucugagga

SEQ ID NO: 2078413 - RNA, 19 nt, Human
aaagacauucugacaucuu

SEQ ID NO: 2078414 - RNA, 15 nt, Human
aaagacaugaauaug

SEQ ID NO: 2078415 - RNA, 14 nt, Human
aaagacaucaagca

SEQ ID NO: 2078416 - RNA, 14 nt, Human
aaagacagagcugg

SEQ ID NO: 2078417 - RNA, 13 nt, Human
aaagacagaagcc

SEQ ID NO: 2078418 - RNA, 19 nt, Human
aaagacugaccaauauugu

SEQ ID NO: 2078419 - RNA, 19 nt, Human
aaagacgauuugucaguua

SEQ ID NO: 2078420 - RNA, 23 nt, Human
aaacuuuauuuuauauaauaaag

SEQ ID NO: 2078421 - RNA, 15 nt, Human
aaacuuuuagaaacu

SEQ ID NO: 2078422 - RNA, 13 nt, Human
aaacuuuuauaaa

SEQ ID NO: 2078423 - RNA, 14 nt, Human
aaacuuuuauaaau

SEQ ID NO: 2078424 - RNA, 16 nt, Human
aaacuuuuauaaauua

SEQ ID NO: 2078425 - RNA, 17 nt, Human
aaacuuuuauaaauuaa

SEQ ID NO: 2078426 - RNA, 18 nt, Human
aaacuuuuauaaauuaaa

SEQ ID NO: 2078427 - RNA, 19 nt, Human
aaacuuuuauaaauuaaau

SEQ ID NO: 2078428 - RNA, 21 nt, Human
aaacuuuuauaaauuaaauau

SEQ ID NO: 2078429 - RNA, 11 nt, Human
aaacuuguaaa

SEQ ID NO: 2078430 - RNA, 12 nt, Human
aaacuuguaaau

SEQ ID NO: 2078431 - RNA, 22 nt, Human
aaacuuccagugcaacacugaa

SEQ ID NO: 2078432 - RNA, 21 nt, Human
aaacuuccagugcaacacuga

SEQ ID NO: 2078433 - RNA, 16 nt, Human
aaacuuccaagaccug

SEQ ID NO: 2078434 - RNA, 12 nt, Human
ggguggggcugc

SEQ ID NO: 2078435 - RNA, 19 nt, Human
aaacuuccagugcaacacu

SEQ ID NO: 2078436 - RNA, 14 nt, Human
ggguggggcugcuc

SEQ ID NO: 2078437 - RNA, 22 nt, Human
aaagauggcugugccucugccu

SEQ ID NO: 2078438 - RNA, 21 nt, Human
aaagauggcugugccucugcc

SEQ ID NO: 2078439 - RNA, 16 nt, Human
aaagauggaugugcuu

SEQ ID NO: 2078440 - RNA, 23 nt, Human
aaagauggcugugccucugccug

SEQ ID NO: 2078441 - RNA, 12 nt, Human
aaagauggccuu

SEQ ID NO: 2078442 - RNA, 14 nt, Human
aaagcaaggaucuu

SEQ ID NO: 2078443 - RNA, 17 nt, Human
aaagcaaggaucuuuca

SEQ ID NO: 2078444 - RNA, 15 nt, Human
aaagcaauaaaugaa

SEQ ID NO: 2078445 - RNA, 17 nt, Human
aaagcaauaaaugaaug

SEQ ID NO: 2078446 - RNA, 13 nt, Human
gguccugucuccc

SEQ ID NO: 2078447 - RNA, 17 nt, Human
gguccugucuccccucu

SEQ ID NO: 2078448 - RNA, 21 nt, Human
gguccugucuccccucugcug

SEQ ID NO: 2078449 - RNA, 23 nt, Human
gguccugucuccccucugcuggc

SEQ ID NO: 2078450 - RNA, 10 nt, Human
gguccuucaa

SEQ ID NO: 2078451 - RNA, 21 nt, Human
gguccuucaaguuagcucagg

SEQ ID NO: 2078452 - RNA, 21 nt, Human
gguccuuugggaaaggagaag

SEQ ID NO: 2078453 - RNA, 15 nt, Human
gguccuuccaggccc

SEQ ID NO: 2078454 - RNA, 16 nt, Human
gguccuuccaggcccc

SEQ ID NO: 2078455 - RNA, 15 nt, Human
gguccuucccucucc

SEQ ID NO: 2078456 - RNA, 19 nt, Human
gguccuucccucuccccaa

SEQ ID NO: 2078457 - RNA, 14 nt, Human
aaagacuguacaaa

SEQ ID NO: 2078458 - RNA, 14 nt, Human
aaagagauacagag

SEQ ID NO: 2078459 - RNA, 21 nt, Human
aaagagauaccaagaugccau

SEQ ID NO: 2078460 - RNA, 20 nt, Human
aaagagaguuaaucaacuga

SEQ ID NO: 2078461 - RNA, 16 nt, Human
aaagacugagcucaag

SEQ ID NO: 2078462 - RNA, 13 nt, Human
aaagacuguacaa

SEQ ID NO: 2078463 - RNA, 19 nt, Human
aaagaugcuucucacugcc

SEQ ID NO: 2078464 - RNA, 17 nt, Human
aaagaugcuucucacug

SEQ ID NO: 2078465 - RNA, 14 nt, Human
aaagaugcuucuca

SEQ ID NO: 2078466 - RNA, 15 nt, Human
aaagagcaagucugg

SEQ ID NO: 2078467 - RNA, 23 nt, Human
aaagagcaagucuggaucuggga

SEQ ID NO: 2078468 - RNA, 11 nt, Human
aaagagcugcc

SEQ ID NO: 2078469 - RNA, 12 nt, Human
aaagagcugccu

SEQ ID NO: 2078470 - RNA, 13 nt, Human
aaagagcugccua

SEQ ID NO: 2078471 - RNA, 22 nt, Human
aaagagcuuucuucccgaaccc

SEQ ID NO: 2078472 - RNA, 15 nt, Human
ggugcagcagugagg

SEQ ID NO: 2078473 - RNA, 16 nt, Human
ggugcaacccuuaccc

SEQ ID NO: 2078474 - RNA, 15 nt, Human
ggugcaagagggagc

SEQ ID NO: 2078475 - RNA, 16 nt, Human
ggugcagagugcccag

SEQ ID NO: 2078476 - RNA, 17 nt, Human
ggugcagagugcccaga

SEQ ID NO: 2078477 - RNA, 19 nt, Human
ggugcagagugcccagaac

SEQ ID NO: 2078478 - RNA, 22 nt, Human
ggugcauacacccccaccuccu

SEQ ID NO: 2078479 - RNA, 21 nt, Human
ggugcuuguucccucucccug

SEQ ID NO: 2078480 - RNA, 18 nt, Human
ggugcaugccgcugcauc

SEQ ID NO: 2078481 - RNA, 19 nt, Human
ggugcauuacagagaggag

SEQ ID NO: 2078482 - RNA, 15 nt, Human
gguggaacaagcaca

SEQ ID NO: 2078483 - RNA, 13 nt, Human
gguggaagcccuc

SEQ ID NO: 2078484 - RNA, 18 nt, Human
gguggaagcccuccuucc

SEQ ID NO: 2078485 - RNA, 19 nt, Human
gguggaagcccuccuucca

SEQ ID NO: 2078486 - RNA, 20 nt, Human
gguggaagcccuccuuccac

SEQ ID NO: 2078487 - RNA, 13 nt, Human
gguggaugccugg

SEQ ID NO: 2078488 - RNA, 15 nt, Human
gguggaguugaaaga

SEQ ID NO: 2078489 - RNA, 20 nt, Human
gguggagguugcagugagcu

SEQ ID NO: 2078490 - RNA, 15 nt, Human
gguggaucacagagg

SEQ ID NO: 2078491 - RNA, 16 nt, Human
gguggaucaccugagg

SEQ ID NO: 2078492 - RNA, 13 nt, Human
gguggacacacaa

SEQ ID NO: 2078493 - RNA, 13 nt, Human
gguggaggagagc

SEQ ID NO: 2078494 - RNA, 18 nt, Human
gguggaggagagccuggu

SEQ ID NO: 2078495 - RNA, 12 nt, Human
ggucgcccagga

SEQ ID NO: 2078496 - RNA, 13 nt, Human
ggucgcccaggag

SEQ ID NO: 2078497 - RNA, 13 nt, Human
ggucgaggcagga

SEQ ID NO: 2078498 - RNA, 20 nt, Human
ggucgaccccaaagccccuu

SEQ ID NO: 2078499 - RNA, 16 nt, Human
ggugaaagaaaucaug

SEQ ID NO: 2078500 - RNA, 17 nt, Human
ggugaaagaaaucaugu

SEQ ID NO: 2078501 - RNA, 19 nt, Human
ggugaaagaaaucauguua

SEQ ID NO: 2078502 - RNA, 13 nt, Human
ggugaaagggagc

SEQ ID NO: 2078503 - RNA, 14 nt, Human
ggucgcccaggaga

SEQ ID NO: 2078504 - RNA, 24 nt, Human
ggugauccacccaccucagccucc

SEQ ID NO: 2078505 - RNA, 23 nt, Human
ggugauccacccaccucagccuc

SEQ ID NO: 2078506 - RNA, 18 nt, Human
ggugauccacccaccuca

SEQ ID NO: 2078507 - RNA, 14 nt, Human
ggugaaagggagcu

SEQ ID NO: 2078508 - RNA, 18 nt, Human
ggugcaaaguucccuacu

SEQ ID NO: 2078509 - RNA, 19 nt, Human
ggugaucaauuaaauguag

SEQ ID NO: 2078510 - RNA, 12 nt, Human
ggugcaaauccu

SEQ ID NO: 2078511 - RNA, 15 nt, Human
aaagcugaaaacugc

SEQ ID NO: 2078512 - RNA, 12 nt, Human
aaagcaccugcc

SEQ ID NO: 2078513 - RNA, 17 nt, Human
gguggaucacagaggcu

SEQ ID NO: 2078514 - RNA, 22 nt, Human
gguccugcuauuucccaagcug

SEQ ID NO: 2078515 - RNA, 13 nt, Human
aaagcaccugccg

SEQ ID NO: 2078516 - RNA, 21 nt, Human
aaagcacuccucccugaugua

SEQ ID NO: 2078517 - RNA, 22 nt, Human
aaagcacuccucccugauguac

SEQ ID NO: 2078518 - RNA, 15 nt, Human
aaagcuuguuaagau

SEQ ID NO: 2078519 - RNA, 14 nt, Human
aaagcuuuccugga

SEQ ID NO: 2078520 - RNA, 15 nt, Human
aaagcuuuccuggag

SEQ ID NO: 2078521 - RNA, 14 nt, Human
aaagcuuuuaugag

SEQ ID NO: 2078522 - RNA, 23 nt, Human
aaagcuuuuaugagcucauguag

SEQ ID NO: 2078523 - RNA, 21 nt, Human
aaagcuuugcuuaugguaaua

SEQ ID NO: 2078524 - RNA, 12 nt, Human
aaagcugaaaac

SEQ ID NO: 2078525 - RNA, 15 nt, Human
aaagcugccuguagu

SEQ ID NO: 2078526 - RNA, 16 nt, Human
aaagcugccuguaguu

SEQ ID NO: 2078527 - RNA, 17 nt, Human
aaagcugccuguaguua

SEQ ID NO: 2078528 - RNA, 21 nt, Human
aaagcugccuguaguuaggaa

SEQ ID NO: 2078529 - RNA, 23 nt, Human
aaagcugccuguaguuaggaaau

SEQ ID NO: 2078530 - RNA, 13 nt, Human
aaagcugcugaca

SEQ ID NO: 2078531 - RNA, 19 nt, Human
aaagcuggugggugaaaga

SEQ ID NO: 2078532 - RNA, 22 nt, Human
aaagcuggugggugaaagaaau

SEQ ID NO: 2078533 - RNA, 23 nt, Human
aaagcuggugggugaaagaaauc

SEQ ID NO: 2078534 - RNA, 15 nt, Human
aaagcugcuaaaucu

SEQ ID NO: 2078535 - RNA, 16 nt, Human
aaagcugcuaaaucuc

SEQ ID NO: 2078536 - RNA, 17 nt, Human
aaagcugcuaaaucucc

SEQ ID NO: 2078537 - RNA, 18 nt, Human
aaagcugcuaaaucuccu

SEQ ID NO: 2078538 - RNA, 22 nt, Human
aaagcugcuaaaucuccuauuu

SEQ ID NO: 2078539 - RNA, 22 nt, Human
aaagggacuuggaagcuccgcu

SEQ ID NO: 2078540 - RNA, 17 nt, Human
aaagggagagagagagg

SEQ ID NO: 2078541 - RNA, 23 nt, Human
aaagggagcacuggguugacuuu

SEQ ID NO: 2078542 - RNA, 22 nt, Human
aaagggagcagagaaggccagg

SEQ ID NO: 2078543 - RNA, 18 nt, Human
aaagggagcuaucaggaa

SEQ ID NO: 2078544 - RNA, 10 nt, Human
aaagggugaa

SEQ ID NO: 2078545 - RNA, 14 nt, Human
aaagggugaagcua

SEQ ID NO: 2078546 - RNA, 19 nt, Human
aaagggugaagcuauuuau

SEQ ID NO: 2078547 - RNA, 21 nt, Human
aaagggugaagcuauuuaucu

SEQ ID NO: 2078548 - RNA, 18 nt, Human
aaagggugcugcuucccu

SEQ ID NO: 2078549 - RNA, 13 nt, Human
aaaggaagcuuuc

SEQ ID NO: 2078550 - RNA, 22 nt, Human
aaaggaagcuuucucugcuuca

SEQ ID NO: 2078551 - RNA, 21 nt, Human
aaaggagagucuugcagugau

SEQ ID NO: 2078552 - RNA, 21 nt, Human
aaaggagagcuagcagcaggg

SEQ ID NO: 2078553 - RNA, 17 nt, Human
aaaggagagcuagcagc

SEQ ID NO: 2078554 - RNA, 17 nt, Human
aaaggaaaucucacccc

SEQ ID NO: 2078555 - RNA, 12 nt, Human
aaaggaagacua

SEQ ID NO: 2078556 - RNA, 13 nt, Human
aaaggaagacuag

SEQ ID NO: 2078557 - RNA, 23 nt, Human
aaaggaaaucucaccccauccca

SEQ ID NO: 2078558 - RNA, 16 nt, Human
gggucccagccacccc

SEQ ID NO: 2078559 - RNA, 23 nt, Human
ggggggcccgccuggcagaacug

SEQ ID NO: 2078560 - RNA, 18 nt, Human
gggggucaggaggcaggg

SEQ ID NO: 2078561 - RNA, 22 nt, Human
gggggcuauagcuacaggaagc

SEQ ID NO: 2078562 - RNA, 18 nt, Human
gggggccugaccuccccc

SEQ ID NO: 2078563 - RNA, 19 nt, Human
ggguccaggggaugggagg

SEQ ID NO: 2078564 - RNA, 16 nt, Human
aaaccaaucaagauaa

SEQ ID NO: 2078565 - RNA, 20 nt, Human
aaaccuuuuggaaaaucugc

SEQ ID NO: 2078566 - RNA, 15 nt, Human
aaacgggcucagcaa

SEQ ID NO: 2078567 - RNA, 19 nt, Human
aaaccuuucaaauuucaca

SEQ ID NO: 2078568 - RNA, 11 nt, Human
aaaccuuucaa

SEQ ID NO: 2078569 - RNA, 17 nt, Human
aaaccuuucaaauuuca

SEQ ID NO: 2078570 - RNA, 22 nt, Human
aaacauuaguucuauuucuauc

SEQ ID NO: 2078571 - RNA, 16 nt, Human
aaaccaagccguggcu

SEQ ID NO: 2078572 - RNA, 16 nt, Human
aaacauugaaguaaug

SEQ ID NO: 2078573 - RNA, 23 nt, Human
aaaccaagucaagugaaaaagga

SEQ ID NO: 2078574 - RNA, 22 nt, Human
aaaccucacccgaggcugccca

SEQ ID NO: 2078575 - RNA, 15 nt, Human
aaacuguccucuuuc

SEQ ID NO: 2078576 - RNA, 18 nt, Human
aaacuguccucuuucaga

SEQ ID NO: 2078577 - RNA, 20 nt, Human
aaacuguccucuuucagaaa

SEQ ID NO: 2078578 - RNA, 21 nt, Human
aaacuguccucuuucagaaaa

SEQ ID NO: 2078579 - RNA, 12 nt, Human
aaacugucccuu

SEQ ID NO: 2078580 - RNA, 14 nt, Human
aaacuggaaguuau

SEQ ID NO: 2078581 - RNA, 15 nt, Human
aaacuggaaguuauu

SEQ ID NO: 2078582 - RNA, 14 nt, Human
aaacuguguaacug

SEQ ID NO: 2078583 - RNA, 17 nt, Human
aaacuguguaacugccc

SEQ ID NO: 2078584 - RNA, 20 nt, Human
aaacuguguaacugcccaaa

SEQ ID NO: 2078585 - RNA, 19 nt, Human
aaacugcucuaagcacacg

SEQ ID NO: 2078586 - RNA, 20 nt, Human
aaacuauuggaaaguacucc

SEQ ID NO: 2078587 - RNA, 19 nt, Human
ggguggcaccagcagccug

SEQ ID NO: 2078588 - RNA, 19 nt, Human
aaacuguguggacugugau

SEQ ID NO: 2078589 - RNA, 20 nt, Human
aaacuguguggacugugaug

SEQ ID NO: 2078590 - RNA, 17 nt, Human
aaacuaggaaauuuuuu

SEQ ID NO: 2078591 - RNA, 15 nt, Human
aaacgguuaaaacug

SEQ ID NO: 2078592 - RNA, 17 nt, Human
aaacgguuaaaacuguc

SEQ ID NO: 2078593 - RNA, 16 nt, Human
aaacucaccauguaaa

SEQ ID NO: 2078594 - RNA, 18 nt, Human
aaacucaccauguaaaag

SEQ ID NO: 2078595 - RNA, 16 nt, Human
aaacucaccugcuggc

SEQ ID NO: 2078596 - RNA, 18 nt, Human
aaacucaccugcuggccc

SEQ ID NO: 2078597 - RNA, 19 nt, Human
aaacucaccugcuggcccc

SEQ ID NO: 2078598 - RNA, 20 nt, Human
aaacucaccugcuggccccu

SEQ ID NO: 2078599 - RNA, 22 nt, Human
aaacucaccugcuggccccuca

SEQ ID NO: 2078600 - RNA, 11 nt, Human
aaacuauuuau

SEQ ID NO: 2078601 - RNA, 13 nt, Human
aaacuauuuaucu

SEQ ID NO: 2078602 - RNA, 22 nt, Human
aaacuauuuaucuguguuuuug

SEQ ID NO: 2078603 - RNA, 15 nt, Human
aaacucauuuccuau

SEQ ID NO: 2078604 - RNA, 22 nt, Human
aaacucauuuccuauguaacug

SEQ ID NO: 2078605 - RNA, 13 nt, Human
gggaugagaaagg

SEQ ID NO: 2078606 - RNA, 17 nt, Human
gggaugacuagaggcag

SEQ ID NO: 2078607 - RNA, 23 nt, Human
gggaugacuagaggcagggaggg

SEQ ID NO: 2078608 - RNA, 17 nt, Human
gggaugccaucuguggg

SEQ ID NO: 2078609 - RNA, 17 nt, Human
aaaauguuuuguaagaa

SEQ ID NO: 2078610 - RNA, 20 nt, Human
aaaauguuuuguaagaaacc

SEQ ID NO: 2078611 - RNA, 21 nt, Human
aaaauguuuuguaagaaacca

SEQ ID NO: 2078612 - RNA, 14 nt, Human
aaaauuuaagcauu

SEQ ID NO: 2078613 - RNA, 15 nt, Human
aaaauuuaagcauug

SEQ ID NO: 2078614 - RNA, 16 nt, Human
aaaauuuaagcauugu

SEQ ID NO: 2078615 - RNA, 21 nt, Human
aaaauuuaagcauuguuugcu

SEQ ID NO: 2078616 - RNA, 23 nt, Human
aaaauuuaagcauuguuugcuua

SEQ ID NO: 2078617 - RNA, 21 nt, Human
aaaauuuuauaaaauuaagca

SEQ ID NO: 2078618 - RNA, 13 nt, Human
aaaauuucacauu

SEQ ID NO: 2078619 - RNA, 13 nt, Human
aaaauuuauaugu

SEQ ID NO: 2078620 - RNA, 19 nt, Human
aaaauuuagaaauauaauu

SEQ ID NO: 2078621 - RNA, 14 nt, Human
aaaauuuuauagcu

SEQ ID NO: 2078622 - RNA, 16 nt, Human
aaaauuuugccuaaua

SEQ ID NO: 2078623 - RNA, 22 nt, Human
aaaauuuugcuccccagugaag

SEQ ID NO: 2078624 - RNA, 23 nt, Human
aaaauuuugcuccccagugaagg

SEQ ID NO: 2078625 - RNA, 10 nt, Human
aaaauuuaua

SEQ ID NO: 2078626 - RNA, 13 nt, Human
aaaauuuuauucc

SEQ ID NO: 2078627 - RNA, 13 nt, Human
aaaauuuuguaau

SEQ ID NO: 2078628 - RNA, 15 nt, Human
aaaauuuuguaauuu

SEQ ID NO: 2078629 - RNA, 17 nt, Human
aaaauuuuguaauuuuc

SEQ ID NO: 2078630 - RNA, 18 nt, Human
aaaauuuuguaauuuucu

SEQ ID NO: 2078631 - RNA, 19 nt, Human
aaaauuuuguaauuuucuu

SEQ ID NO: 2078632 - RNA, 19 nt, Human
aaacacaaacgggcucagc

SEQ ID NO: 2078633 - RNA, 12 nt, Human
aaacaauuuauu

SEQ ID NO: 2078634 - RNA, 13 nt, Human
aaacaauuuauuu

SEQ ID NO: 2078635 - RNA, 16 nt, Human
aaacaauuuauuuuau

SEQ ID NO: 2078636 - RNA, 17 nt, Human
aaacaauuuauuuuauu

SEQ ID NO: 2078637 - RNA, 16 nt, Human
aaacaauauuguuucu

SEQ ID NO: 2078638 - RNA, 17 nt, Human
aaacaauauuguuucua

SEQ ID NO: 2078639 - RNA, 16 nt, Human
aaacaauauuuauugu

SEQ ID NO: 2078640 - RNA, 17 nt, Human
aaacaauauuuauugua

SEQ ID NO: 2078641 - RNA, 18 nt, Human
aaacaauauuuauuguau

SEQ ID NO: 2078642 - RNA, 22 nt, Human
aaacaauauuuauuguauuuua

SEQ ID NO: 2078643 - RNA, 17 nt, Human
aaacaaauaugcaaaag

SEQ ID NO: 2078644 - RNA, 14 nt, Human
aaacaaauaugcaa

SEQ ID NO: 2078645 - RNA, 13 nt, Human
aaacaaauaugca

SEQ ID NO: 2078646 - RNA, 11 nt, Human
aaacaaagugg

SEQ ID NO: 2078647 - RNA, 17 nt, Human
aaacaaaguggaaggaa

SEQ ID NO: 2078648 - RNA, 12 nt, Human
aaacaaauaugc

SEQ ID NO: 2078649 - RNA, 16 nt, Human
aaacaauaaaugugca

SEQ ID NO: 2078650 - RNA, 12 nt, Human
aaacaacaaaaa

SEQ ID NO: 2078651 - RNA, 14 nt, Human
aaacaacaaaaaau

SEQ ID NO: 2078652 - RNA, 14 nt, Human
aaacaauauuguuu

SEQ ID NO: 2078653 - RNA, 15 nt, Human
aaacaauauuguuuc

SEQ ID NO: 2078654 - RNA, 14 nt, Human
aaacacauagauuc

SEQ ID NO: 2078655 - RNA, 18 nt, Human
aaacacauagauucaccu

SEQ ID NO: 2078656 - RNA, 19 nt, Human
aaacacauagauucaccug

SEQ ID NO: 2078657 - RNA, 22 nt, Human
aaacacauagauucaccuguaa

SEQ ID NO: 2078658 - RNA, 12 nt, Human
aaacacagagag

SEQ ID NO: 2078659 - RNA, 14 nt, Human
aaacacaucuuccc

SEQ ID NO: 2078660 - RNA, 16 nt, Human
aaacacaucuucccua

SEQ ID NO: 2078661 - RNA, 21 nt, Human
aaacaggguguugucagcauc

SEQ ID NO: 2078662 - RNA, 23 nt, Human
aaacaggguguugucagcaucuu

SEQ ID NO: 2078663 - RNA, 13 nt, Human
ggggaagcccugg

SEQ ID NO: 2078664 - RNA, 14 nt, Human
ggggaagcccugga

SEQ ID NO: 2078665 - RNA, 22 nt, Human
ggggaauguuugccucugccuc

SEQ ID NO: 2078666 - RNA, 18 nt, Human
ggggaauguuugccucug

SEQ ID NO: 2078667 - RNA, 15 nt, Human
ggggaauucaucucu

SEQ ID NO: 2078668 - RNA, 21 nt, Human
ggggaauauuuuauucaaggu

SEQ ID NO: 2078669 - RNA, 17 nt, Human
aaacaggucaauacagu

SEQ ID NO: 2078670 - RNA, 22 nt, Human
aaacaugggguuggcugggccc

SEQ ID NO: 2078671 - RNA, 21 nt, Human
aaacaugguagaauuggagag

SEQ ID NO: 2078672 - RNA, 16 nt, Human
aaacauguuagaagca

SEQ ID NO: 2078673 - RNA, 17 nt, Human
aaacauguuagaagcaa

SEQ ID NO: 2078674 - RNA, 16 nt, Human
ggggacucagcccuga

SEQ ID NO: 2078675 - RNA, 14 nt, Human
ggggacugucuuuc

SEQ ID NO: 2078676 - RNA, 11 nt, Human
ggggagaaagu

SEQ ID NO: 2078677 - RNA, 14 nt, Human
ggggacucagcccu

SEQ ID NO: 2078678 - RNA, 15 nt, Human
ggggacucagcccug

SEQ ID NO: 2078679 - RNA, 21 nt, Human
ggggacgcugguagagaugga

SEQ ID NO: 2078680 - RNA, 23 nt, Human
ggggacgcugguagagauggagg

SEQ ID NO: 2078681 - RNA, 13 nt, Human
ggggacucagccc

SEQ ID NO: 2078682 - RNA, 18 nt, Human
gggggccucagugccacu

SEQ ID NO: 2078683 - RNA, 17 nt, Human
gggggccucagugccac

SEQ ID NO: 2078684 - RNA, 15 nt, Human
gggggccucagugcc

SEQ ID NO: 2078685 - RNA, 12 nt, Human
gggggccucagu

SEQ ID NO: 2078686 - RNA, 15 nt, Human
ggggccucagugcca

SEQ ID NO: 2078687 - RNA, 12 nt, Human
ggggccucaggu

SEQ ID NO: 2078688 - RNA, 14 nt, Human
gggggccaggugca

SEQ ID NO: 2078689 - RNA, 14 nt, Human
gggggccaugagcu

SEQ ID NO: 2078690 - RNA, 15 nt, Human
gggggccaugagcuc

SEQ ID NO: 2078691 - RNA, 21 nt, Human
gggggccaugaggccucagug

SEQ ID NO: 2078692 - RNA, 17 nt, Human
gggggccucagggcagc

SEQ ID NO: 2078693 - RNA, 21 nt, Human
gggggccucagggcagccugc

SEQ ID NO: 2078694 - RNA, 15 nt, Human
guaauccaccugccu

SEQ ID NO: 2078695 - RNA, 12 nt, Human
guaaucccagca

SEQ ID NO: 2078696 - RNA, 20 nt, Human
guaaucccagcacuuuggga

SEQ ID NO: 2078697 - RNA, 13 nt, Human
guaaucccagcag

SEQ ID NO: 2078698 - RNA, 15 nt, Human
guaaucccagcacuu

SEQ ID NO: 2078699 - RNA, 14 nt, Human
guaaucccagcacu

SEQ ID NO: 2078700 - RNA, 22 nt, Human
guaaucauuucuugggcccucc

SEQ ID NO: 2078701 - RNA, 23 nt, Human
guaaucauuucuugggcccuccu

SEQ ID NO: 2078702 - RNA, 20 nt, Human
guaauuuauaguuuauacag

SEQ ID NO: 2078703 - RNA, 23 nt, Human
guaauuuauaguuuauacaguuu

SEQ ID NO: 2078704 - RNA, 11 nt, Human
guaauuuauuu

SEQ ID NO: 2078705 - RNA, 17 nt, Human
guaaucccagcuacuca

SEQ ID NO: 2078706 - RNA, 18 nt, Human
guaaucccagcuacucag

SEQ ID NO: 2078707 - RNA, 21 nt, Human
guaaucccagcuacucaggag

SEQ ID NO: 2078708 - RNA, 19 nt, Human
guaacucuaauucccauuu

SEQ ID NO: 2078709 - RNA, 22 nt, Human
guaacugcauugagaacugcau

SEQ ID NO: 2078710 - RNA, 18 nt, Human
guaacugcauugagaacu

SEQ ID NO: 2078711 - RNA, 19 nt, Human
guaacugcauugagaacug

SEQ ID NO: 2078712 - RNA, 22 nt, Human
guaaagaaauuuaaaagacacu

SEQ ID NO: 2078713 - RNA, 21 nt, Human
guaaagaaauuuaaaagacac

SEQ ID NO: 2078714 - RNA, 23 nt, Human
guaacucuaauucccauuuugca

SEQ ID NO: 2078715 - RNA, 12 nt, Human
guaacuccacca

SEQ ID NO: 2078716 - RNA, 17 nt, Human
guaacuccaccaaccca

SEQ ID NO: 2078717 - RNA, 13 nt, Human
guaacugacaacu

SEQ ID NO: 2078718 - RNA, 12 nt, Human
guaauaaaguau

SEQ ID NO: 2078719 - RNA, 14 nt, Human
guaauaaaguauau

SEQ ID NO: 2078720 - RNA, 15 nt, Human
guaauaaaguauaua

SEQ ID NO: 2078721 - RNA, 17 nt, Human
guaauaaaguauauaau

SEQ ID NO: 2078722 - RNA, 12 nt, Human
guaauaaagugu

SEQ ID NO: 2078723 - RNA, 16 nt, Human
guaauaaaguguuuuc

SEQ ID NO: 2078724 - RNA, 17 nt, Human
guaauaaaguguuuuca

SEQ ID NO: 2078725 - RNA, 18 nt, Human
guaauaaaguguuuucag

SEQ ID NO: 2078726 - RNA, 19 nt, Human
guaauaaaguguuuucaga

SEQ ID NO: 2078727 - RNA, 20 nt, Human
guaauaaaguguuuucagag

SEQ ID NO: 2078728 - RNA, 14 nt, Human
guacacugaauauu

SEQ ID NO: 2078729 - RNA, 15 nt, Human
guacacugaauauuu

SEQ ID NO: 2078730 - RNA, 19 nt, Human
guacacguaaaucuguuca

SEQ ID NO: 2078731 - RNA, 23 nt, Human
guaauuuuggguggggagaagag

SEQ ID NO: 2078732 - RNA, 13 nt, Human
guaauuuucuuga

SEQ ID NO: 2078733 - RNA, 18 nt, Human
guaauuuucuugaugacu

SEQ ID NO: 2078734 - RNA, 15 nt, Human
guaauuuguguaaua

SEQ ID NO: 2078735 - RNA, 16 nt, Human
guaauuuguguaauaa

SEQ ID NO: 2078736 - RNA, 20 nt, Human
guaauuuguguaauaaagug

SEQ ID NO: 2078737 - RNA, 21 nt, Human
guaauuuguguaauaaagugu

SEQ ID NO: 2078738 - RNA, 22 nt, Human
guaauuuguguaauaaaguguu

SEQ ID NO: 2078739 - RNA, 12 nt, Human
aaauacaaacaa

SEQ ID NO: 2078740 - RNA, 16 nt, Human
aaauacaaguucuauu

SEQ ID NO: 2078741 - RNA, 17 nt, Human
aaauacaaguucuauuu

SEQ ID NO: 2078742 - RNA, 12 nt, Human
aaauacaauaaa

SEQ ID NO: 2078743 - RNA, 13 nt, Human
aaauacaauaaac

SEQ ID NO: 2078744 - RNA, 14 nt, Human
aaauacaauaaacu

SEQ ID NO: 2078745 - RNA, 15 nt, Human
aaauacaauaaacua

SEQ ID NO: 2078746 - RNA, 22 nt, Human
aaauacaauaaacuauuggaaa

SEQ ID NO: 2078747 - RNA, 14 nt, Human
aaauacaugcaucu

SEQ ID NO: 2078748 - RNA, 17 nt, Human
aaauacagauagauaua

SEQ ID NO: 2078749 - RNA, 19 nt, Human
aaauacaacuuaaauaaua

SEQ ID NO: 2078750 - RNA, 18 nt, Human
aaauacacauagcaugua

SEQ ID NO: 2078751 - RNA, 16 nt, Human
aaauacaguauucugu

SEQ ID NO: 2078752 - RNA, 23 nt, Human
aaauaccaaaauuauuucagaaa

SEQ ID NO: 2078753 - RNA, 21 nt, Human
aaauaccaaaauuauuucaga

SEQ ID NO: 2078754 - RNA, 15 nt, Human
aaauauacacacagc

SEQ ID NO: 2078755 - RNA, 19 nt, Human
aaauauaauuguuuuuuau

SEQ ID NO: 2078756 - RNA, 21 nt, Human
aaauauaauuguuuuuuaucu

SEQ ID NO: 2078757 - RNA, 14 nt, Human
aaauacucuaauuc

SEQ ID NO: 2078758 - RNA, 15 nt, Human
aaauacucuaauucu

SEQ ID NO: 2078759 - RNA, 16 nt, Human
aaauacucuaauucua

SEQ ID NO: 2078760 - RNA, 17 nt, Human
aaauacucuaauucuaa

SEQ ID NO: 2078761 - RNA, 18 nt, Human
aaauacucuaauucuaac

SEQ ID NO: 2078762 - RNA, 19 nt, Human
aaauacucuaauucuaacc

SEQ ID NO: 2078763 - RNA, 22 nt, Human
aaauacucuaauucuaaccaga

SEQ ID NO: 2078764 - RNA, 16 nt, Human
aaaguacauguuaaac

SEQ ID NO: 2078765 - RNA, 18 nt, Human
aaaggucccaaggcaagg

SEQ ID NO: 2078766 - RNA, 19 nt, Human
aaaguacuucuccacccug

SEQ ID NO: 2078767 - RNA, 14 nt, Human
aaagguauaauuuu

SEQ ID NO: 2078768 - RNA, 16 nt, Human
aaagguauaauuuuau

SEQ ID NO: 2078769 - RNA, 21 nt, Human
aaaguacuucuccacccugcu

SEQ ID NO: 2078770 - RNA, 20 nt, Human
aaaguacuucuccacccugc

SEQ ID NO: 2078771 - RNA, 23 nt, Human
aaaguacuucuccacccugcucu

SEQ ID NO: 2078772 - RNA, 13 nt, Human
aaaguauauauag

SEQ ID NO: 2078773 - RNA, 17 nt, Human
aaaguauauauagaauc

SEQ ID NO: 2078774 - RNA, 18 nt, Human
aaaguauauauagaaucu

SEQ ID NO: 2078775 - RNA, 14 nt, Human
aaaguauauauuua

SEQ ID NO: 2078776 - RNA, 15 nt, Human
aaaguauauauuuau

SEQ ID NO: 2078777 - RNA, 23 nt, Human
aaaguauauauuuauuuaagcuu

SEQ ID NO: 2078778 - RNA, 14 nt, Human
aaaguauauguuag

SEQ ID NO: 2078779 - RNA, 12 nt, Human
aaaguucugugu

SEQ ID NO: 2078780 - RNA, 13 nt, Human
aaaguucugugua

SEQ ID NO: 2078781 - RNA, 16 nt, Human
aaaguucuguguauuu

SEQ ID NO: 2078782 - RNA, 18 nt, Human
aaaguucuguguauuuaa

SEQ ID NO: 2078783 - RNA, 20 nt, Human
aaaguucuguguauuuaauu

SEQ ID NO: 2078784 - RNA, 21 nt, Human
aaaguucuguguauuuaauug

SEQ ID NO: 2078785 - RNA, 12 nt, Human
aaaguugaaauu

SEQ ID NO: 2078786 - RNA, 21 nt, Human
aaaguuauuaauauuuuaauu

SEQ ID NO: 2078787 - RNA, 20 nt, Human
aaaguuacuuugucagaggc

SEQ ID NO: 2078788 - RNA, 14 nt, Human
aaaguaucauggaa

SEQ ID NO: 2078789 - RNA, 19 nt, Human
aaaguaucauggaaauauu

SEQ ID NO: 2078790 - RNA, 22 nt, Human
aaaguaucauggaaauauuaug

SEQ ID NO: 2078791 - RNA, 14 nt, Human
aaaguauuccaccu

SEQ ID NO: 2078792 - RNA, 16 nt, Human
aaaguauuccaccuua

SEQ ID NO: 2078793 - RNA, 18 nt, Human
aaaguauuccaccuuaaa

SEQ ID NO: 2078794 - RNA, 20 nt, Human
aaaguauuccaccuuaaauu

SEQ ID NO: 2078795 - RNA, 21 nt, Human
aaaguauuccaccuuaaauua

SEQ ID NO: 2078796 - RNA, 16 nt, Human
aaaguuggugacagau

SEQ ID NO: 2078797 - RNA, 12 nt, Human
aaaguuuaaaau

SEQ ID NO: 2078798 - RNA, 13 nt, Human
aaaguuuaaaaug

SEQ ID NO: 2078799 - RNA, 14 nt, Human
aaaguuuaaaaugu

SEQ ID NO: 2078800 - RNA, 16 nt, Human
aaaguuuaaaauguau

SEQ ID NO: 2078801 - RNA, 15 nt, Human
aaauaacuucaagca

SEQ ID NO: 2078802 - RNA, 18 nt, Human
aaauaacuucaagcaaac

SEQ ID NO: 2078803 - RNA, 17 nt, Human
aaauaacuaguguugcu

SEQ ID NO: 2078804 - RNA, 18 nt, Human
aaauaaccccauucuuug

SEQ ID NO: 2078805 - RNA, 21 nt, Human
aaauaacacacauauaaacau

SEQ ID NO: 2078806 - RNA, 15 nt, Human
aaauaacacagagag

SEQ ID NO: 2078807 - RNA, 23 nt, Human
aaauaacacagagagacagacuu

SEQ ID NO: 2078808 - RNA, 21 nt, Human
aaauaaccaacccuucccuga

SEQ ID NO: 2078809 - RNA, 14 nt, Human
aaauaaaaauaaau

SEQ ID NO: 2078810 - RNA, 13 nt, Human
aaauaacacacau

SEQ ID NO: 2078811 - RNA, 21 nt, Human
guaaacauuaguucuauuucu

SEQ ID NO: 2078812 - RNA, 22 nt, Human
guaaacagugccugcugaauga

SEQ ID NO: 2078813 - RNA, 23 nt, Human
guaaacauaauucuuguauauua

SEQ ID NO: 2078814 - RNA, 13 nt, Human
guaaacagugccu

SEQ ID NO: 2078815 - RNA, 14 nt, Human
guaaacagugccug

SEQ ID NO: 2078816 - RNA, 15 nt, Human
guaaacagugccugc

SEQ ID NO: 2078817 - RNA, 17 nt, Human
guaaacagugccugcug

SEQ ID NO: 2078818 - RNA, 18 nt, Human
guaaacagugccugcuga

SEQ ID NO: 2078819 - RNA, 20 nt, Human
guaaacagugccugcugaau

SEQ ID NO: 2078820 - RNA, 17 nt, Human
aaauaauugauuucaag

SEQ ID NO: 2078821 - RNA, 14 nt, Human
aaauaauuuuauga

SEQ ID NO: 2078822 - RNA, 15 nt, Human
aaauaauuuuaugaa

SEQ ID NO: 2078823 - RNA, 22 nt, Human
aaauaauuuuaugaacugcaug

SEQ ID NO: 2078824 - RNA, 23 nt, Human
aaauaauuuuaugaacugcaugu

SEQ ID NO: 2078825 - RNA, 12 nt, Human
aaauaauaaauu

SEQ ID NO: 2078826 - RNA, 16 nt, Human
aaauaauaaauugcau

SEQ ID NO: 2078827 - RNA, 15 nt, Human
aaauaauaauaaugu

SEQ ID NO: 2078828 - RNA, 17 nt, Human
aaauaauaaagaugcuc

SEQ ID NO: 2078829 - RNA, 19 nt, Human
aaauaauaaagaugcucuu

SEQ ID NO: 2078830 - RNA, 13 nt, Human
aaauaauaugcau

SEQ ID NO: 2078831 - RNA, 12 nt, Human
aaauaauaugca

SEQ ID NO: 2078832 - RNA, 14 nt, Human
aaauaauaugcauu

SEQ ID NO: 2078833 - RNA, 12 nt, Human
aaauaauaaauc

SEQ ID NO: 2078834 - RNA, 15 nt, Human
aaauaaucggcccac

SEQ ID NO: 2078835 - RNA, 16 nt, Human
aaauaacuucaagcaa

SEQ ID NO: 2078836 - RNA, 12 nt, Human
aaauaagagaga

SEQ ID NO: 2078837 - RNA, 12 nt, Human
aaauaagagauu

SEQ ID NO: 2078838 - RNA, 14 nt, Human
aaauaagagauuug

SEQ ID NO: 2078839 - RNA, 14 nt, Human
guacucauuaaaaa

SEQ ID NO: 2078840 - RNA, 17 nt, Human
guacucaggaggcugag

SEQ ID NO: 2078841 - RNA, 23 nt, Human
guacucaggaggcugaggggagg

SEQ ID NO: 2078842 - RNA, 15 nt, Human
guacuauguaucaau

SEQ ID NO: 2078843 - RNA, 17 nt, Human
guacuauguaucaauga

SEQ ID NO: 2078844 - RNA, 14 nt, Human
guacuccucccagg

SEQ ID NO: 2078845 - RNA, 15 nt, Human
guacuccugcaaaau

SEQ ID NO: 2078846 - RNA, 20 nt, Human
guacucaucaucaacccuaa

SEQ ID NO: 2078847 - RNA, 16 nt, Human
guacuccugcaaaauu

SEQ ID NO: 2078848 - RNA, 21 nt, Human
guacuccugcaaaauuuuaua

SEQ ID NO: 2078849 - RNA, 12 nt, Human
guacucuggccu

SEQ ID NO: 2078850 - RNA, 13 nt, Human
guacucuggccuc

SEQ ID NO: 2078851 - RNA, 14 nt, Human
guacucuggccucu

SEQ ID NO: 2078852 - RNA, 15 nt, Human
guacucuggccucug

SEQ ID NO: 2078853 - RNA, 14 nt, Human
guacccacugcucu

SEQ ID NO: 2078854 - RNA, 13 nt, Human
guacccacugcuc

SEQ ID NO: 2078855 - RNA, 16 nt, Human
guacuaguuacacauc

SEQ ID NO: 2078856 - RNA, 13 nt, Human
guacuauaucugu

SEQ ID NO: 2078857 - RNA, 14 nt, Human
guacuauaucuguu

SEQ ID NO: 2078858 - RNA, 16 nt, Human
guacuauaucuguuuu

SEQ ID NO: 2078859 - RNA, 17 nt, Human
guacuauaucuguuuua

SEQ ID NO: 2078860 - RNA, 21 nt, Human
guacuauaucuguuuuacugc

SEQ ID NO: 2078861 - RNA, 17 nt, Human
guacuaguuacacaucu

SEQ ID NO: 2078862 - RNA, 13 nt, Human
guacuauguauca

SEQ ID NO: 2078863 - RNA, 14 nt, Human
guacccaccugagc

SEQ ID NO: 2078864 - RNA, 15 nt, Human
guacccaccugagcu

SEQ ID NO: 2078865 - RNA, 16 nt, Human
guacccaccugagcuu

SEQ ID NO: 2078866 - RNA, 17 nt, Human
guacccaccugagcuuu

SEQ ID NO: 2078867 - RNA, 15 nt, Human
guacuacuagauguc

SEQ ID NO: 2078868 - RNA, 20 nt, Human
guacuacuagaugucuuuag

SEQ ID NO: 2078869 - RNA, 22 nt, Human
guacuagggggaagugacaagg

SEQ ID NO: 2078870 - RNA, 21 nt, Human
guacuacuagaugucuuuagg

SEQ ID NO: 2078871 - RNA, 23 nt, Human
guacuguguacagaauucugcua

SEQ ID NO: 2078872 - RNA, 19 nt, Human
guacuuaaaugaaagcaug

SEQ ID NO: 2078873 - RNA, 15 nt, Human
guacuuaauaaauuc

SEQ ID NO: 2078874 - RNA, 17 nt, Human
guacuuaaaugaaagca

SEQ ID NO: 2078875 - RNA, 16 nt, Human
guacuuagcagcuauc

SEQ ID NO: 2078876 - RNA, 19 nt, Human
guacuuagcagcuaucucu

SEQ ID NO: 2078877 - RNA, 13 nt, Human
guacugcagccuc

SEQ ID NO: 2078878 - RNA, 14 nt, Human
guacuguaguuuuu

SEQ ID NO: 2078879 - RNA, 19 nt, Human
guacuggcugauggaguaa

SEQ ID NO: 2078880 - RNA, 14 nt, Human
guacuggcauggua

SEQ ID NO: 2078881 - RNA, 16 nt, Human
guacuggcaugguacg

SEQ ID NO: 2078882 - RNA, 12 nt, Human
guagaagauggc

SEQ ID NO: 2078883 - RNA, 21 nt, Human
guagaagucuuagauguauau

SEQ ID NO: 2078884 - RNA, 15 nt, Human
guagaaggagacaga

SEQ ID NO: 2078885 - RNA, 17 nt, Human
guagaaggguuauauuu

SEQ ID NO: 2078886 - RNA, 13 nt, Human
guagaaggagaca

SEQ ID NO: 2078887 - RNA, 14 nt, Human
guagaaucugugua

SEQ ID NO: 2078888 - RNA, 19 nt, Human
guagaaggguuauauuuua

SEQ ID NO: 2078889 - RNA, 20 nt, Human
guagaaauaucugaaaaugu

SEQ ID NO: 2078890 - RNA, 16 nt, Human
guagaaauaauaugca

SEQ ID NO: 2078891 - RNA, 21 nt, Human
guagaaauaucugaaaaugua

SEQ ID NO: 2078892 - RNA, 23 nt, Human
guagaaauaucugaaaauguaug

SEQ ID NO: 2078893 - RNA, 18 nt, Human
guagaacguaaccacgga

SEQ ID NO: 2078894 - RNA, 19 nt, Human
guagaacguaaccacggaa

SEQ ID NO: 2078895 - RNA, 22 nt, Human
guagaacacaaggucauuugcu

SEQ ID NO: 2078896 - RNA, 23 nt, Human
guagaaauuuuacaauaggugcu

SEQ ID NO: 2078897 - RNA, 17 nt, Human
guagaaauaauaugcau

SEQ ID NO: 2078898 - RNA, 20 nt, Human
guagaaaucccccuuucucu

SEQ ID NO: 2078899 - RNA, 14 nt, Human
guagaaaugaugau

SEQ ID NO: 2078900 - RNA, 11 nt, Human
guagagccagg

SEQ ID NO: 2078901 - RNA, 13 nt, Human
guagagaaacacu

SEQ ID NO: 2078902 - RNA, 15 nt, Human
guagagauggaggag

SEQ ID NO: 2078903 - RNA, 10 nt, Human
guagagccag

SEQ ID NO: 2078904 - RNA, 13 nt, Human
guagagacagggu

SEQ ID NO: 2078905 - RNA, 19 nt, Human
guagccgagagccugcucc

SEQ ID NO: 2078906 - RNA, 15 nt, Human
guagcccuggccaga

SEQ ID NO: 2078907 - RNA, 17 nt, Human
guagcccuggccagagg

SEQ ID NO: 2078908 - RNA, 16 nt, Human
guagagauggaggagg

SEQ ID NO: 2078909 - RNA, 17 nt, Human
guagagauggaggagga

SEQ ID NO: 2078910 - RNA, 21 nt, Human
guagaccugugagaaaacguu

SEQ ID NO: 2078911 - RNA, 18 nt, Human
guagagccagggucucac

SEQ ID NO: 2078912 - RNA, 15 nt, Human
guagagccagggucu

SEQ ID NO: 2078913 - RNA, 12 nt, Human
guagagacaggg

SEQ ID NO: 2078914 - RNA, 11 nt, Human
guagagacagg

SEQ ID NO: 2078915 - RNA, 23 nt, Human
guagacgugcacgcacacugucu

SEQ ID NO: 2078916 - RNA, 20 nt, Human
guagacgugcacgcacacug

SEQ ID NO: 2078917 - RNA, 20 nt, Human
guagaccuagggaggaccuu

SEQ ID NO: 2078918 - RNA, 17 nt, Human
guagaccuagggaggac

SEQ ID NO: 2078919 - RNA, 14 nt, Human
guagaccccuggcu

SEQ ID NO: 2078920 - RNA, 15 nt, Human
guagaccccuggcug

SEQ ID NO: 2078921 - RNA, 16 nt, Human
guagaccccuggcugg

SEQ ID NO: 2078922 - RNA, 17 nt, Human
guagaccccuggcuggu

SEQ ID NO: 2078923 - RNA, 16 nt, Human
guagaccuagggagga

SEQ ID NO: 2078924 - RNA, 18 nt, Human
guagacaguauauaacua

SEQ ID NO: 2078925 - RNA, 19 nt, Human
guagacacaggauagauaa

SEQ ID NO: 2078926 - RNA, 17 nt, Human
guacauucaauguuuau

SEQ ID NO: 2078927 - RNA, 18 nt, Human
guacauucaauguuuaug

SEQ ID NO: 2078928 - RNA, 16 nt, Human
guacauuuaauugaga

SEQ ID NO: 2078929 - RNA, 17 nt, Human
guacauuuaauugagaa

SEQ ID NO: 2078930 - RNA, 23 nt, Human
guacauuuaauugagaagcguau

SEQ ID NO: 2078931 - RNA, 19 nt, Human
guacauggaauaacaugua

SEQ ID NO: 2078932 - RNA, 15 nt, Human
aaauccagaaagaaa

SEQ ID NO: 2078933 - RNA, 14 nt, Human
aaauccagaaagaa

SEQ ID NO: 2078934 - RNA, 14 nt, Human
guacaucuggccuu

SEQ ID NO: 2078935 - RNA, 17 nt, Human
guacauuucugaaauga

SEQ ID NO: 2078936 - RNA, 13 nt, Human
guacauuucugaa

SEQ ID NO: 2078937 - RNA, 14 nt, Human
guaccacucaggcc

SEQ ID NO: 2078938 - RNA, 12 nt, Human
guacccacugcu

SEQ ID NO: 2078939 - RNA, 20 nt, Human
guaccauagcgcugcucuua

SEQ ID NO: 2078940 - RNA, 20 nt, Human
guaccaugaaacaaagcugc

SEQ ID NO: 2078941 - RNA, 22 nt, Human
aaaucauaggaaaguauuuuuu

SEQ ID NO: 2078942 - RNA, 23 nt, Human
aaaucauaaacugugugcagacu

SEQ ID NO: 2078943 - RNA, 14 nt, Human
aaaucauaaacugu

SEQ ID NO: 2078944 - RNA, 16 nt, Human
aaaucauaaacugugu

SEQ ID NO: 2078945 - RNA, 19 nt, Human
aaaucagccguguaaccau

SEQ ID NO: 2078946 - RNA, 12 nt, Human
aaaucagccugc

SEQ ID NO: 2078947 - RNA, 16 nt, Human
aaaucagcugcuacua

SEQ ID NO: 2078948 - RNA, 18 nt, Human
aaaucagccugcuccagc

SEQ ID NO: 2078949 - RNA, 15 nt, Human
aaauauuaucuuugu

SEQ ID NO: 2078950 - RNA, 18 nt, Human
aaauauuaucuuuguaau

SEQ ID NO: 2078951 - RNA, 22 nt, Human
aaauauuaucuuuguaauuauu

SEQ ID NO: 2078952 - RNA, 20 nt, Human
aaauauuauaacuuaaaaaa

SEQ ID NO: 2078953 - RNA, 15 nt, Human
aaauauuccugcauu

SEQ ID NO: 2078954 - RNA, 18 nt, Human
aaaucacuaacauuauau

SEQ ID NO: 2078955 - RNA, 15 nt, Human
aaaucacuuccauag

SEQ ID NO: 2078956 - RNA, 16 nt, Human
aaaucacuuccauagu

SEQ ID NO: 2078957 - RNA, 20 nt, Human
aaauauuauuuuaugaaagg

SEQ ID NO: 2078958 - RNA, 12 nt, Human
aaauauuaugca

SEQ ID NO: 2078959 - RNA, 17 nt, Human
aaauauuaugcaaauuc

SEQ ID NO: 2078960 - RNA, 19 nt, Human
aaauauuaugcaaauuccc

SEQ ID NO: 2078961 - RNA, 22 nt, Human
aaauauuaugcaaauucccaga

SEQ ID NO: 2078962 - RNA, 23 nt, Human
aaauauuauuguggaaaugaaua

SEQ ID NO: 2078963 - RNA, 19 nt, Human
gagguggagguugcaguga

SEQ ID NO: 2078964 - RNA, 20 nt, Human
gagguggagguugcagugag

SEQ ID NO: 2078965 - RNA, 19 nt, Human
gagguggaggcugcaguga

SEQ ID NO: 2078966 - RNA, 20 nt, Human
gagguggaucacagaggcuu

SEQ ID NO: 2078967 - RNA, 15 nt, Human
gagguggcagcccug

SEQ ID NO: 2078968 - RNA, 16 nt, Human
gagguggcagcccugu

SEQ ID NO: 2078969 - RNA, 18 nt, Human
gagguggcagcccuguag

SEQ ID NO: 2078970 - RNA, 12 nt, Human
gagucacugccu

SEQ ID NO: 2078971 - RNA, 14 nt, Human
gagguggcuggguu

SEQ ID NO: 2078972 - RNA, 20 nt, Human
gagguggcucuggaaugaca

SEQ ID NO: 2078973 - RNA, 13 nt, Human
gagguggcugccu

SEQ ID NO: 2078974 - RNA, 14 nt, Human
gagguggcugccug

SEQ ID NO: 2078975 - RNA, 13 nt, Human
gagugagacccug

SEQ ID NO: 2078976 - RNA, 14 nt, Human
gagugcccagaacu

SEQ ID NO: 2078977 - RNA, 14 nt, Human
gagugccccaccug

SEQ ID NO: 2078978 - RNA, 15 nt, Human
gagugccccaccugc

SEQ ID NO: 2078979 - RNA, 19 nt, Human
gagugccccaccugccacu

SEQ ID NO: 2078980 - RNA, 18 nt, Human
gagugcagugagccgaga

SEQ ID NO: 2078981 - RNA, 13 nt, Human
gagugcagugagc

SEQ ID NO: 2078982 - RNA, 18 nt, Human
gagugagacucugucuca

SEQ ID NO: 2078983 - RNA, 14 nt, Human
gagugagacucugu

SEQ ID NO: 2078984 - RNA, 20 nt, Human
gaguccaacguggggcagca

SEQ ID NO: 2078985 - RNA, 22 nt, Human
gaguccaacguggggcagcaca

SEQ ID NO: 2078986 - RNA, 15 nt, Human
gagucacugccucuc

SEQ ID NO: 2078987 - RNA, 21 nt, Human
gagucacugccucucccuggc

SEQ ID NO: 2078988 - RNA, 23 nt, Human
gagucacugccucucccuggccc

SEQ ID NO: 2078989 - RNA, 19 nt, Human
gagucaugaucucccugcc

SEQ ID NO: 2078990 - RNA, 20 nt, Human
gagucaugaucucccugccg

SEQ ID NO: 2078991 - RNA, 16 nt, Human
gagucaugaucucccu

SEQ ID NO: 2078992 - RNA, 13 nt, Human
gagucaucuccau

SEQ ID NO: 2078993 - RNA, 18 nt, Human
gagucaugaucucccugc

SEQ ID NO: 2078994 - RNA, 18 nt, Human
gaggggaauaauagaaga

SEQ ID NO: 2078995 - RNA, 19 nt, Human
gaggggaauaauagaagaa

SEQ ID NO: 2078996 - RNA, 13 nt, Human
gaggccagcccca

SEQ ID NO: 2078997 - RNA, 14 nt, Human
gaggccagccccac

SEQ ID NO: 2078998 - RNA, 12 nt, Human
gaggccagccug

SEQ ID NO: 2078999 - RNA, 22 nt, Human
gaggccagccccacccaggagg

SEQ ID NO: 2079000 - RNA, 13 nt, Human
gaggccagccugg

SEQ ID NO: 2079001 - RNA, 14 nt, Human
gaggccagccuggc

SEQ ID NO: 2079002 - RNA, 16 nt, Human
gaggccagccccaccc

SEQ ID NO: 2079003 - RNA, 18 nt, Human
gaggccagccccacccag

SEQ ID NO: 2079004 - RNA, 20 nt, Human
gaggccagccccacccagga

SEQ ID NO: 2079005 - RNA, 21 nt, Human
gaggccagccccacccaggag

SEQ ID NO: 2079006 - RNA, 20 nt, Human
gaggcucuaaccacacagcc

SEQ ID NO: 2079007 - RNA, 22 nt, Human
gaggcucuaauugaauuuucaa

SEQ ID NO: 2079008 - RNA, 16 nt, Human
gaggcugcagcgagcu

SEQ ID NO: 2079009 - RNA, 14 nt, Human
gaggcugcagucag

SEQ ID NO: 2079010 - RNA, 14 nt, Human
gaggcugccucucc

SEQ ID NO: 2079011 - RNA, 20 nt, Human
gagggcgugacucacccaag

SEQ ID NO: 2079012 - RNA, 12 nt, Human
gaggggaacaga

SEQ ID NO: 2079013 - RNA, 19 nt, Human
gagcugccuguucagcucc

SEQ ID NO: 2079014 - RNA, 16 nt, Human
gagcugccuguucagc

SEQ ID NO: 2079015 - RNA, 15 nt, Human
gagcugccuguucag

SEQ ID NO: 2079016 - RNA, 13 nt, Human
gagcggaaagcag

SEQ ID NO: 2079017 - RNA, 14 nt, Human
gagcggaaagcagc

SEQ ID NO: 2079018 - RNA, 15 nt, Human
gagcggaaagcagcu

SEQ ID NO: 2079019 - RNA, 16 nt, Human
gagcggaaagcagcuc

SEQ ID NO: 2079020 - RNA, 17 nt, Human
gagcggaaagcagcuca

SEQ ID NO: 2079021 - RNA, 18 nt, Human
gagcuggugcauuacaga

SEQ ID NO: 2079022 - RNA, 15 nt, Human
gagcuggugcccgga

SEQ ID NO: 2079023 - RNA, 16 nt, Human
gagcuggugcccggag

SEQ ID NO: 2079024 - RNA, 17 nt, Human
gagcuggugcccggaga

SEQ ID NO: 2079025 - RNA, 21 nt, Human
gagcuggugcccggagauugg

SEQ ID NO: 2079026 - RNA, 18 nt, Human
gagcugguugggaagaca

SEQ ID NO: 2079027 - RNA, 14 nt, Human
gagcuggugucuga

SEQ ID NO: 2079028 - RNA, 16 nt, Human
gagcccuacuuccagg

SEQ ID NO: 2079029 - RNA, 16 nt, Human
gagcccgaggcaccag

SEQ ID NO: 2079030 - RNA, 17 nt, Human
gagcccgcacccccacc

SEQ ID NO: 2079031 - RNA, 19 nt, Human
gagcccgcacccccacccu

SEQ ID NO: 2079032 - RNA, 20 nt, Human
gagcccgcacccccacccuu

SEQ ID NO: 2079033 - RNA, 23 nt, Human
gagcccgcacccccacccuuugg

SEQ ID NO: 2079034 - RNA, 17 nt, Human
gagcccggaugcuucuc

SEQ ID NO: 2079035 - RNA, 20 nt, Human
gagcgccugccccucccaga

SEQ ID NO: 2079036 - RNA, 15 nt, Human
gagcgcuacccacuu

SEQ ID NO: 2079037 - RNA, 16 nt, Human
gagcgccugccccucc

SEQ ID NO: 2079038 - RNA, 18 nt, Human
gagcgccugccccuccca

SEQ ID NO: 2079039 - RNA, 22 nt, Human
gagcgccugccccucccagaac

SEQ ID NO: 2079040 - RNA, 13 nt, Human
gagcgccugcccc

SEQ ID NO: 2079041 - RNA, 15 nt, Human
gagcgccugccccuc

SEQ ID NO: 2079042 - RNA, 16 nt, Human
gagcgagcgcuaccca

SEQ ID NO: 2079043 - RNA, 21 nt, Human
gagcgagacuugguuucaaaa

SEQ ID NO: 2079044 - RNA, 15 nt, Human
gagaagcuacuuugu

SEQ ID NO: 2079045 - RNA, 21 nt, Human
gagaagcguauguuuuuuauu

SEQ ID NO: 2079046 - RNA, 11 nt, Human
gagcagugucu

SEQ ID NO: 2079047 - RNA, 17 nt, Human
gagcagugucuuccaua

SEQ ID NO: 2079048 - RNA, 12 nt, Human
gagcagugucuu

SEQ ID NO: 2079049 - RNA, 23 nt, Human
gacuuuucuguccgagcuuugaa

SEQ ID NO: 2079050 - RNA, 19 nt, Human
gacuuuucgaccaauucaa

SEQ ID NO: 2079051 - RNA, 22 nt, Human
gacuuuucgaccaauucaaccc

SEQ ID NO: 2079052 - RNA, 17 nt, Human
gacuuuucguuaacauu

SEQ ID NO: 2079053 - RNA, 18 nt, Human
gacuuuucguuaacauug

SEQ ID NO: 2079054 - RNA, 19 nt, Human
gacuuuucguuaacauuga

SEQ ID NO: 2079055 - RNA, 21 nt, Human
gacuuuucuguccgagcuuug

SEQ ID NO: 2079056 - RNA, 16 nt, Human
gacuguuuucucuuga

SEQ ID NO: 2079057 - RNA, 18 nt, Human
gacuguuuucucuugaga

SEQ ID NO: 2079058 - RNA, 14 nt, Human
gacuguuuuuuccu

SEQ ID NO: 2079059 - RNA, 19 nt, Human
gacuguuuuuuccugagcu

SEQ ID NO: 2079060 - RNA, 20 nt, Human
gacuguuuuuuccugagcuu

SEQ ID NO: 2079061 - RNA, 12 nt, Human
gacucacccaag

SEQ ID NO: 2079062 - RNA, 21 nt, Human
gacuguuuuuuccugagcuug

SEQ ID NO: 2079063 - RNA, 21 nt, Human
gacugucucaagagggcacug

SEQ ID NO: 2079064 - RNA, 16 nt, Human
gacuguacacacuuua

SEQ ID NO: 2079065 - RNA, 18 nt, Human
gacuguacacacuuuauu

SEQ ID NO: 2079066 - RNA, 23 nt, Human
gacuguacacacuuuauuuacuu

SEQ ID NO: 2079067 - RNA, 23 nt, Human
gacugucucaagagggcacuggu

SEQ ID NO: 2079068 - RNA, 22 nt, Human
gacugucucaagagggcacugg

SEQ ID NO: 2079069 - RNA, 22 nt, Human
gacuguguauucuaguuuuguc

SEQ ID NO: 2079070 - RNA, 17 nt, Human
gacuguacuccucccag

SEQ ID NO: 2079071 - RNA, 16 nt, Human
gacuguacuccuccca

SEQ ID NO: 2079072 - RNA, 22 nt, Human
gacuguacaaaguagaagucuu

SEQ ID NO: 2079073 - RNA, 17 nt, Human
gacucaaugcacugaca

SEQ ID NO: 2079074 - RNA, 14 nt, Human
gacucaaugcacug

SEQ ID NO: 2079075 - RNA, 17 nt, Human
gacucaaguccuuaccu

SEQ ID NO: 2079076 - RNA, 16 nt, Human
gacucaagugucucag

SEQ ID NO: 2079077 - RNA, 15 nt, Human
gacucaauaaaauca

SEQ ID NO: 2079078 - RNA, 17 nt, Human
gacucaauaaaaucaug

SEQ ID NO: 2079079 - RNA, 17 nt, Human
gagaagcggcuggcagc

SEQ ID NO: 2079080 - RNA, 12 nt, Human
gacuagugcuga

SEQ ID NO: 2079081 - RNA, 13 nt, Human
gacuagugcugaa

SEQ ID NO: 2079082 - RNA, 14 nt, Human
gacuagugcugaag

SEQ ID NO: 2079083 - RNA, 15 nt, Human
gacuagugcugaagc

SEQ ID NO: 2079084 - RNA, 16 nt, Human
gacuagugcugaagcu

SEQ ID NO: 2079085 - RNA, 17 nt, Human
gacuagugcugaagcuu

SEQ ID NO: 2079086 - RNA, 18 nt, Human
gacuagugcugaagcuua

SEQ ID NO: 2079087 - RNA, 23 nt, Human
gacuagugcugaagcuuauuaau

SEQ ID NO: 2079088 - RNA, 19 nt, Human
gacuagugcugaagcuuau

SEQ ID NO: 2079089 - RNA, 18 nt, Human
gacuauauuguacacacc

SEQ ID NO: 2079090 - RNA, 22 nt, Human
gacucaacauguuacugaccag

SEQ ID NO: 2079091 - RNA, 20 nt, Human
gacgcugguagagauggagg

SEQ ID NO: 2079092 - RNA, 21 nt, Human
gacgcugguagagauggagga

SEQ ID NO: 2079093 - RNA, 11 nt, Human
gacccucccuu

SEQ ID NO: 2079094 - RNA, 19 nt, Human
gacccuccuccucccccag

SEQ ID NO: 2079095 - RNA, 22 nt, Human
gacccuccuccucccccagagg

SEQ ID NO: 2079096 - RNA, 14 nt, Human
gacccucgcuggcc

SEQ ID NO: 2079097 - RNA, 15 nt, Human
gacccucgcuggccc

SEQ ID NO: 2079098 - RNA, 16 nt, Human
gacccucgcuggcccc

SEQ ID NO: 2079099 - RNA, 18 nt, Human
gacccucgcuggccccca

SEQ ID NO: 2079100 - RNA, 19 nt, Human
gacccucgcuggcccccac

SEQ ID NO: 2079101 - RNA, 20 nt, Human
gacccucgcuggcccccacu

SEQ ID NO: 2079102 - RNA, 21 nt, Human
gacccucgcuggcccccacug

SEQ ID NO: 2079103 - RNA, 15 nt, Human
gacccucguggccuu

SEQ ID NO: 2079104 - RNA, 18 nt, Human
gacccucguggccuuccc

SEQ ID NO: 2079105 - RNA, 18 nt, Human
gacgcugguagagaugga

SEQ ID NO: 2079106 - RNA, 16 nt, Human
gacacuauucacuaaa

SEQ ID NO: 2079107 - RNA, 19 nt, Human
gacacuuuuuugaguggau

SEQ ID NO: 2079108 - RNA, 18 nt, Human
gacagccucccccugucc

SEQ ID NO: 2079109 - RNA, 16 nt, Human
gacagccucccacccc

SEQ ID NO: 2079110 - RNA, 11 nt, Human
gacagccuccc

SEQ ID NO: 2079111 - RNA, 15 nt, Human
gacagcuccuucugu

SEQ ID NO: 2079112 - RNA, 14 nt, Human
gacagcuccuucug

SEQ ID NO: 2079113 - RNA, 12 nt, Human
gacagccuggca

SEQ ID NO: 2079114 - RNA, 11 nt, Human
gacagccuggc

SEQ ID NO: 2079115 - RNA, 13 nt, Human
gacagcuccuucu

SEQ ID NO: 2079116 - RNA, 20 nt, Human
gacagccucccccugucccc

SEQ ID NO: 2079117 - RNA, 16 nt, Human
gaagcaugaaaaagca

SEQ ID NO: 2079118 - RNA, 16 nt, Human
gaagcauguaggagaa

SEQ ID NO: 2079119 - RNA, 17 nt, Human
gaagcauguaggagaau

SEQ ID NO: 2079120 - RNA, 17 nt, Human
gaagcagugccuuccau

SEQ ID NO: 2079121 - RNA, 18 nt, Human
gaagcagugccuuccaua

SEQ ID NO: 2079122 - RNA, 19 nt, Human
gaagcagugccuuccauaa

SEQ ID NO: 2079123 - RNA, 16 nt, Human
gaagcagugagccgca

SEQ ID NO: 2079124 - RNA, 11 nt, Human
gaagcauccag

SEQ ID NO: 2079125 - RNA, 14 nt, Human
gaagcauccaggca

SEQ ID NO: 2079126 - RNA, 13 nt, Human
gaagcaugaaaaa

SEQ ID NO: 2079127 - RNA, 16 nt, Human
gaccaggacaggacca

SEQ ID NO: 2079128 - RNA, 14 nt, Human
gaccaggacucccu

SEQ ID NO: 2079129 - RNA, 16 nt, Human
gaccaggacucccucc

SEQ ID NO: 2079130 - RNA, 17 nt, Human
gaccaggacucccuccu

SEQ ID NO: 2079131 - RNA, 19 nt, Human
gaccaggacucccuccuca

SEQ ID NO: 2079132 - RNA, 21 nt, Human
gaccaggacucccuccucacc

SEQ ID NO: 2079133 - RNA, 23 nt, Human
gaccaggacucccuccucaccuc

SEQ ID NO: 2079134 - RNA, 15 nt, Human
gaccaguggugccuu

SEQ ID NO: 2079135 - RNA, 15 nt, Human
gaccaguugcacuug

SEQ ID NO: 2079136 - RNA, 22 nt, Human
gaccaguggugccuuggaggga

SEQ ID NO: 2079137 - RNA, 13 nt, Human
gaccccuggcuuu

SEQ ID NO: 2079138 - RNA, 22 nt, Human
gaccccuggcuuuucacugcug

SEQ ID NO: 2079139 - RNA, 21 nt, Human
gaccccuggcuuuucacugcu

SEQ ID NO: 2079140 - RNA, 13 nt, Human
gaccccugucucc

SEQ ID NO: 2079141 - RNA, 12 nt, Human
gaccccugucuu

SEQ ID NO: 2079142 - RNA, 13 nt, Human
gacccggcugcgu

SEQ ID NO: 2079143 - RNA, 12 nt, Human
gacccggcugcg

SEQ ID NO: 2079144 - RNA, 16 nt, Human
gacccuauugcugcuu

SEQ ID NO: 2079145 - RNA, 17 nt, Human
gacccuacuuccugcac

SEQ ID NO: 2079146 - RNA, 21 nt, Human
gacccuacuuccugcacugac

SEQ ID NO: 2079147 - RNA, 16 nt, Human
gacccuaccccaccac

SEQ ID NO: 2079148 - RNA, 14 nt, Human
gacccuacaggaga

SEQ ID NO: 2079149 - RNA, 15 nt, Human
gacccuacaggagag

SEQ ID NO: 2079150 - RNA, 11 nt, Human
gacccuacccc

SEQ ID NO: 2079151 - RNA, 14 nt, Human
gacccuaccccacc

SEQ ID NO: 2079152 - RNA, 12 nt, Human
gaccccuggcug

SEQ ID NO: 2079153 - RNA, 22 nt, Human
gacccggagcuaacacuggccc

SEQ ID NO: 2079154 - RNA, 21 nt, Human
gacccggagcuaacacuggcc

SEQ ID NO: 2079155 - RNA, 15 nt, Human
gacccuaaaucugag

SEQ ID NO: 2079156 - RNA, 17 nt, Human
gacccuaaaucugagga

SEQ ID NO: 2079157 - RNA, 17 nt, Human
gacaggguuucaccaug

SEQ ID NO: 2079158 - RNA, 13 nt, Human
gacaggguccugc

SEQ ID NO: 2079159 - RNA, 14 nt, Human
gacaggguccugcu

SEQ ID NO: 2079160 - RNA, 15 nt, Human
gacaggguccugcua

SEQ ID NO: 2079161 - RNA, 15 nt, Human
gacaguaacuugguu

SEQ ID NO: 2079162 - RNA, 17 nt, Human
gacaguaacuugguuau

SEQ ID NO: 2079163 - RNA, 21 nt, Human
gacaguaacuugguuauacau

SEQ ID NO: 2079164 - RNA, 14 nt, Human
gacaguauauaacu

SEQ ID NO: 2079165 - RNA, 13 nt, Human
gccaagccaggga

SEQ ID NO: 2079166 - RNA, 23 nt, Human
gccaaggaggguggaucaccuga

SEQ ID NO: 2079167 - RNA, 22 nt, Human
gccaagcaccuagccucgcucu

SEQ ID NO: 2079168 - RNA, 12 nt, Human
gccaagcagcca

SEQ ID NO: 2079169 - RNA, 20 nt, Human
gccaagcacagugccugcau

SEQ ID NO: 2079170 - RNA, 17 nt, Human
gccaaggacugccgacc

SEQ ID NO: 2079171 - RNA, 14 nt, Human
gccaaggacugccg

SEQ ID NO: 2079172 - RNA, 15 nt, Human
gccaagccccauccu

SEQ ID NO: 2079173 - RNA, 21 nt, Human
gccaagccccauccugccgcc

SEQ ID NO: 2079174 - RNA, 14 nt, Human
gccaagcagccaag

SEQ ID NO: 2079175 - RNA, 16 nt, Human
gccaagcuccuuggga

SEQ ID NO: 2079176 - RNA, 17 nt, Human
gccaagcuccuugggag

SEQ ID NO: 2079177 - RNA, 19 nt, Human
gccaagcuccuugggaggc

SEQ ID NO: 2079178 - RNA, 21 nt, Human
gcauccuggcacccggccccu

SEQ ID NO: 2079179 - RNA, 17 nt, Human
gcauccuggcacccggc

SEQ ID NO: 2079180 - RNA, 18 nt, Human
gcauggcagcaggccugu

SEQ ID NO: 2079181 - RNA, 20 nt, Human
gcauggcagcaggccuguug

SEQ ID NO: 2079182 - RNA, 13 nt, Human
gcauggccaggug

SEQ ID NO: 2079183 - RNA, 17 nt, Human
gcauggccagcagcuug

SEQ ID NO: 2079184 - RNA, 17 nt, Human
gcauggccagguggcca

SEQ ID NO: 2079185 - RNA, 14 nt, Human
gcauggccaggugg

SEQ ID NO: 2079186 - RNA, 23 nt, Human
gcauccuggcacccggccccugc

SEQ ID NO: 2079187 - RNA, 22 nt, Human
gcauccuggcacccggccccug

SEQ ID NO: 2079188 - RNA, 20 nt, Human
gcauccuuuucugcagaggg

SEQ ID NO: 2079189 - RNA, 14 nt, Human
gcauccuggcaccc

SEQ ID NO: 2079190 - RNA, 22 nt, Human
gcauccuuaaguaucagaaagc

SEQ ID NO: 2079191 - RNA, 22 nt, Human
gcauguacccuaaggucauuac

SEQ ID NO: 2079192 - RNA, 22 nt, Human
gcauggggauaaaggagaaggc

SEQ ID NO: 2079193 - RNA, 23 nt, Human
gcauggggauaaaggagaaggca

SEQ ID NO: 2079194 - RNA, 14 nt, Human
gcauguaggagaau

SEQ ID NO: 2079195 - RNA, 15 nt, Human
gcauguaggagaauc

SEQ ID NO: 2079196 - RNA, 17 nt, Human
gcauugguucccuuugc

SEQ ID NO: 2079197 - RNA, 23 nt, Human
gcaugucccuaccgagucucuuc

SEQ ID NO: 2079198 - RNA, 16 nt, Human
gcaugucuuuuuuucu

SEQ ID NO: 2079199 - RNA, 19 nt, Human
gcaugucuuuuuuucuguu

SEQ ID NO: 2079200 - RNA, 20 nt, Human
gccaacagucaaaacagaga

SEQ ID NO: 2079201 - RNA, 23 nt, Human
gccaaccccgcccuaggccuggc

SEQ ID NO: 2079202 - RNA, 14 nt, Human
gccaaccccugugg

SEQ ID NO: 2079203 - RNA, 15 nt, Human
gcauuguugaggugg

SEQ ID NO: 2079204 - RNA, 19 nt, Human
gcauuguggcugucagcag

SEQ ID NO: 2079205 - RNA, 16 nt, Human
gcauuguggcugucag

SEQ ID NO: 2079206 - RNA, 23 nt, Human
gcauuguugagguggucugaaug

SEQ ID NO: 2079207 - RNA, 16 nt, Human
gcauuguugagguggu

SEQ ID NO: 2079208 - RNA, 17 nt, Human
gcauuguuugcuuauug

SEQ ID NO: 2079209 - RNA, 18 nt, Human
gcauuguuugcuuauugu

SEQ ID NO: 2079210 - RNA, 20 nt, Human
gcauuguuugcuuauuguuc

SEQ ID NO: 2079211 - RNA, 21 nt, Human
gcauuguuugcuuauuguucc

SEQ ID NO: 2079212 - RNA, 22 nt, Human
gcauuguuugcuuauuguucca

SEQ ID NO: 2079213 - RNA, 23 nt, Human
gcauuguuugcuuauuguuccaa

SEQ ID NO: 2079214 - RNA, 19 nt, Human
gcauuuauggucaacacuu

SEQ ID NO: 2079215 - RNA, 23 nt, Human
gccaacgacaaagccaaacucug

SEQ ID NO: 2079216 - RNA, 14 nt, Human
gccaacgacaaagc

SEQ ID NO: 2079217 - RNA, 15 nt, Human
gccaaccccugugga

SEQ ID NO: 2079218 - RNA, 18 nt, Human
gcauuuccugcuggucaa

SEQ ID NO: 2079219 - RNA, 13 nt, Human
gccaagaacugaa

SEQ ID NO: 2079220 - RNA, 18 nt, Human
gccaagaacugaaaacau

SEQ ID NO: 2079221 - RNA, 16 nt, Human
gccaagagcagaggca

SEQ ID NO: 2079222 - RNA, 20 nt, Human
gccaagagcagaggcagcga

SEQ ID NO: 2079223 - RNA, 16 nt, Human
gcacucuuaagcuucc

SEQ ID NO: 2079224 - RNA, 21 nt, Human
gcacugaaggcuuucagggcc

SEQ ID NO: 2079225 - RNA, 22 nt, Human
gcacugaaggcuuucagggccu

SEQ ID NO: 2079226 - RNA, 20 nt, Human
gcacuuugggaggccgaggc

SEQ ID NO: 2079227 - RNA, 16 nt, Human
gcacuuugggaggcug

SEQ ID NO: 2079228 - RNA, 21 nt, Human
gcacuuugggaggcugaggug

SEQ ID NO: 2079229 - RNA, 20 nt, Human
gcacuuugggaggcugaggc

SEQ ID NO: 2079230 - RNA, 21 nt, Human
gcacuuugggaggcugaggcg

SEQ ID NO: 2079231 - RNA, 20 nt, Human
gcagcugcuuuugucuaugg

SEQ ID NO: 2079232 - RNA, 13 nt, Human
gcagcugcuuuug

SEQ ID NO: 2079233 - RNA, 23 nt, Human
gcagcugcgguccacccaggagc

SEQ ID NO: 2079234 - RNA, 22 nt, Human
gcagcugcgguccacccaggag

SEQ ID NO: 2079235 - RNA, 17 nt, Human
gcagcuguuagagucca

SEQ ID NO: 2079236 - RNA, 17 nt, Human
gcagcugggagaagggg

SEQ ID NO: 2079237 - RNA, 12 nt, Human
gcagcugggcug

SEQ ID NO: 2079238 - RNA, 14 nt, Human
gcagcuguuagagu

SEQ ID NO: 2079239 - RNA, 16 nt, Human
gcagcuugaggguugg

SEQ ID NO: 2079240 - RNA, 21 nt, Human
gcagcuugaggguugggcugg

SEQ ID NO: 2079241 - RNA, 19 nt, Human
gcagcuugaggguugggcu

SEQ ID NO: 2079242 - RNA, 22 nt, Human
gcagggaaaggcucugaaagcc

SEQ ID NO: 2079243 - RNA, 22 nt, Human
gcagggaaacagcuaaugggac

SEQ ID NO: 2079244 - RNA, 16 nt, Human
gcaggcuggcaccgcc

SEQ ID NO: 2079245 - RNA, 18 nt, Human
gcaggcuggcaccgccuu

SEQ ID NO: 2079246 - RNA, 19 nt, Human
gcaggcuggcaccgccuuc

SEQ ID NO: 2079247 - RNA, 21 nt, Human
gcauacacccccaccuccugc

SEQ ID NO: 2079248 - RNA, 17 nt, Human
gcauacauuuauaaugu

SEQ ID NO: 2079249 - RNA, 22 nt, Human
gcaggugucauauauggggggc

SEQ ID NO: 2079250 - RNA, 20 nt, Human
gcagggaaggggaggcagcc

SEQ ID NO: 2079251 - RNA, 21 nt, Human
gcagggaaguguaagaaacac

SEQ ID NO: 2079252 - RNA, 21 nt, Human
gcagggaaggggaggcagccg

SEQ ID NO: 2079253 - RNA, 13 nt, Human
gcauacaaucuga

SEQ ID NO: 2079254 - RNA, 15 nt, Human
gcauaaaauuggauu

SEQ ID NO: 2079255 - RNA, 15 nt, Human
gcauaaaaauuagcc

SEQ ID NO: 2079256 - RNA, 23 nt, Human
gaugcuucucacugccaugccag

SEQ ID NO: 2079257 - RNA, 16 nt, Human
gaugcugugcuaugaa

SEQ ID NO: 2079258 - RNA, 21 nt, Human
gaugcugucuucguacuggga

SEQ ID NO: 2079259 - RNA, 23 nt, Human
gaugaugacgacgacaacgauga

SEQ ID NO: 2079260 - RNA, 23 nt, Human
gaugaugauaaugaugaugacga

SEQ ID NO: 2079261 - RNA, 14 nt, Human
gaugaugcugccag

SEQ ID NO: 2079262 - RNA, 22 nt, Human
gaugaugcuuguaacaagaaaa

SEQ ID NO: 2079263 - RNA, 23 nt, Human
gauggaggaaaaccaagccgugg

SEQ ID NO: 2079264 - RNA, 13 nt, Human
gauggaggagaag

SEQ ID NO: 2079265 - RNA, 14 nt, Human
gauggaggagaaga

SEQ ID NO: 2079266 - RNA, 12 nt, Human
gauggaggagga

SEQ ID NO: 2079267 - RNA, 11 nt, Human
gauggaggagg

SEQ ID NO: 2079268 - RNA, 21 nt, Human
gauggaggggugguccugacu

SEQ ID NO: 2079269 - RNA, 22 nt, Human
gauggaggggugguccugacuc

SEQ ID NO: 2079270 - RNA, 19 nt, Human
gauggagguucucucggag

SEQ ID NO: 2079271 - RNA, 18 nt, Human
gaugcuuguaacaagaaa

SEQ ID NO: 2079272 - RNA, 20 nt, Human
gaugcuuguaacaagaaaac

SEQ ID NO: 2079273 - RNA, 21 nt, Human
gaugcuuguaacaagaaaaca

SEQ ID NO: 2079274 - RNA, 17 nt, Human
gauguacaguugggaaa

SEQ ID NO: 2079275 - RNA, 23 nt, Human
gauguacaguugggaaaauaugu

SEQ ID NO: 2079276 - RNA, 15 nt, Human
gauguacauuuccaa

SEQ ID NO: 2079277 - RNA, 19 nt, Human
gauguaccaugaaacaaag

SEQ ID NO: 2079278 - RNA, 22 nt, Human
gauguacauuuccaaauucaca

SEQ ID NO: 2079279 - RNA, 19 nt, Human
gaugcuucaugugaacgug

SEQ ID NO: 2079280 - RNA, 13 nt, Human
gauguaagagcuu

SEQ ID NO: 2079281 - RNA, 23 nt, Human
gauguaaauaaccccauucuuug

SEQ ID NO: 2079282 - RNA, 13 nt, Human
gauguaaaugaag

SEQ ID NO: 2079283 - RNA, 17 nt, Human
gaugucccaacuuguaa

SEQ ID NO: 2079284 - RNA, 19 nt, Human
gaugucaucccauugucuu

SEQ ID NO: 2079285 - RNA, 21 nt, Human
gaugucaucccauugucuucu

SEQ ID NO: 2079286 - RNA, 17 nt, Human
gauguccacagaugccu

SEQ ID NO: 2079287 - RNA, 20 nt, Human
gauguccacagaugccucca

SEQ ID NO: 2079288 - RNA, 18 nt, Human
gaugucccaacuuguaaa

SEQ ID NO: 2079289 - RNA, 20 nt, Human
gaugucccuuucuuggccag

SEQ ID NO: 2079290 - RNA, 21 nt, Human
gaugucccuuucuuggccagu

SEQ ID NO: 2079291 - RNA, 18 nt, Human
gaucuggguucacugcaa

SEQ ID NO: 2079292 - RNA, 17 nt, Human
gaucugggaacucccaa

SEQ ID NO: 2079293 - RNA, 19 nt, Human
gaucugggaacucccaaga

SEQ ID NO: 2079294 - RNA, 17 nt, Human
gaucugggacccuuucc

SEQ ID NO: 2079295 - RNA, 20 nt, Human
gaucuggguucacugcaacc

SEQ ID NO: 2079296 - RNA, 18 nt, Human
gaucuggggcucugggau

SEQ ID NO: 2079297 - RNA, 23 nt, Human
gaucugggacccuuuccuuccuu

SEQ ID NO: 2079298 - RNA, 17 nt, Human
gaucuggggcucuggga

SEQ ID NO: 2079299 - RNA, 22 nt, Human
gaucugggacccuuuccuuccu

SEQ ID NO: 2079300 - RNA, 19 nt, Human
gauucuccugccucagccu

SEQ ID NO: 2079301 - RNA, 21 nt, Human
gauucuccugccucagccucc

SEQ ID NO: 2079302 - RNA, 20 nt, Human
gauucuccugccucagccuc

SEQ ID NO: 2079303 - RNA, 19 nt, Human
gauucuguguguuuucaua

SEQ ID NO: 2079304 - RNA, 22 nt, Human
gauucuguguguuuucauaaua

SEQ ID NO: 2079305 - RNA, 21 nt, Human
gauucuucugcuucagccucc

SEQ ID NO: 2079306 - RNA, 19 nt, Human
gauucuuuccauuaugauu

SEQ ID NO: 2079307 - RNA, 22 nt, Human
gauuuaagggauggaaaaggaa

SEQ ID NO: 2079308 - RNA, 21 nt, Human
gauuucagaaagagcaagucu

SEQ ID NO: 2079309 - RNA, 11 nt, Human
gcaaaaauuuu

SEQ ID NO: 2079310 - RNA, 14 nt, Human
gcaaaaauuuuugg

SEQ ID NO: 2079311 - RNA, 20 nt, Human
gauuucaggauacucuguca

SEQ ID NO: 2079312 - RNA, 22 nt, Human
gauuucaggauacucugucaga

SEQ ID NO: 2079313 - RNA, 16 nt, Human
gauuucagucuuuucc

SEQ ID NO: 2079314 - RNA, 17 nt, Human
gauuucagucuuuuccu

SEQ ID NO: 2079315 - RNA, 12 nt, Human
gaugucuuuguu

SEQ ID NO: 2079316 - RNA, 16 nt, Human
gaugucuuuguuaaga

SEQ ID NO: 2079317 - RNA, 16 nt, Human
gaugucuuauuuuuag

SEQ ID NO: 2079318 - RNA, 18 nt, Human
gaugucuuauuuuuagau

SEQ ID NO: 2079319 - RNA, 20 nt, Human
gaugucuuauuuuuagaugg

SEQ ID NO: 2079320 - RNA, 14 nt, Human
gaugucuaauaguu

SEQ ID NO: 2079321 - RNA, 21 nt, Human
gaugugcauuuuugugaaaug

SEQ ID NO: 2079322 - RNA, 23 nt, Human
gaugugcauuuuugugaaaugaa

SEQ ID NO: 2079323 - RNA, 16 nt, Human
gaugugcaaaaauuuu

SEQ ID NO: 2079324 - RNA, 22 nt, Human
gaugugcaaaaauuuuuggauu

SEQ ID NO: 2079325 - RNA, 19 nt, Human
gcacacaccagagcccacc

SEQ ID NO: 2079326 - RNA, 18 nt, Human
gcacacaccagagcccac

SEQ ID NO: 2079327 - RNA, 17 nt, Human
gcacacaccagagccca

SEQ ID NO: 2079328 - RNA, 16 nt, Human
gcacacaccagagccc

SEQ ID NO: 2079329 - RNA, 15 nt, Human
gcacacaccagagcc

SEQ ID NO: 2079330 - RNA, 14 nt, Human
gcacacaccagagc

SEQ ID NO: 2079331 - RNA, 12 nt, Human
gcacacaccaga

SEQ ID NO: 2079332 - RNA, 14 nt, Human
gcaauagagacugu

SEQ ID NO: 2079333 - RNA, 15 nt, Human
gcaauagagacugua

SEQ ID NO: 2079334 - RNA, 17 nt, Human
gcaauagagacuguaga

SEQ ID NO: 2079335 - RNA, 18 nt, Human
gcaaccuccgccucuugg

SEQ ID NO: 2079336 - RNA, 21 nt, Human
gcaacccuuaccccuuagccu

SEQ ID NO: 2079337 - RNA, 12 nt, Human
gcaacccuccua

SEQ ID NO: 2079338 - RNA, 23 nt, Human
gcaacccuccuaucaccuccccu

SEQ ID NO: 2079339 - RNA, 18 nt, Human
gcaacccccagccugcua

SEQ ID NO: 2079340 - RNA, 17 nt, Human
gcaacccccagccugcu

SEQ ID NO: 2079341 - RNA, 16 nt, Human
gcaaaagaugcuucuc

SEQ ID NO: 2079342 - RNA, 17 nt, Human
gcaaaacaugcuaccug

SEQ ID NO: 2079343 - RNA, 21 nt, Human
gcaaaaccacuagaacucucc

SEQ ID NO: 2079344 - RNA, 15 nt, Human
gcaaaaccauugcuu

SEQ ID NO: 2079345 - RNA, 16 nt, Human
gcaaaaccauugcuuc

SEQ ID NO: 2079346 - RNA, 17 nt, Human
gcaaaaccauugcuuca

SEQ ID NO: 2079347 - RNA, 18 nt, Human
gcaaaaccauugcuucac

SEQ ID NO: 2079348 - RNA, 16 nt, Human
gcaaaacccacagaag

SEQ ID NO: 2079349 - RNA, 20 nt, Human
gcaaaacgcauggagugugu

SEQ ID NO: 2079350 - RNA, 14 nt, Human
gcaaaagaaguaac

SEQ ID NO: 2079351 - RNA, 15 nt, Human
gcaaaagaugcuucu

SEQ ID NO: 2079352 - RNA, 22 nt, Human
gcacuauagccuaggugacaga

SEQ ID NO: 2079353 - RNA, 16 nt, Human
gcacuccagccugggc

SEQ ID NO: 2079354 - RNA, 17 nt, Human
gcacuccagccugggca

SEQ ID NO: 2079355 - RNA, 21 nt, Human
gcacuccagccugggcgacag

SEQ ID NO: 2079356 - RNA, 17 nt, Human
gcacuccagccugggug

SEQ ID NO: 2079357 - RNA, 21 nt, Human
gcacucgugugcaacagacaa

SEQ ID NO: 2079358 - RNA, 14 nt, Human
gcacucuagccgga

SEQ ID NO: 2079359 - RNA, 18 nt, Human
gcacucuagccggaguga

SEQ ID NO: 2079360 - RNA, 23 nt, Human
gcacucugaguuuaccauuugua

SEQ ID NO: 2079361 - RNA, 12 nt, Human
gcaccuccugcc

SEQ ID NO: 2079362 - RNA, 23 nt, Human
gcaccuccccccacugcaggccc

SEQ ID NO: 2079363 - RNA, 19 nt, Human
gcaccuccccccacugcag

SEQ ID NO: 2079364 - RNA, 21 nt, Human
gcaccuccccccacugcaggc

SEQ ID NO: 2079365 - RNA, 17 nt, Human
gcaccucccauccuaau

SEQ ID NO: 2079366 - RNA, 13 nt, Human
gcaccucccccca

SEQ ID NO: 2079367 - RNA, 17 nt, Human
gcaccuccccccacugc

SEQ ID NO: 2079368 - RNA, 18 nt, Human
gcaccuccccccacugca

SEQ ID NO: 2079369 - RNA, 18 nt, Human
gcaccuacaguguacagu

SEQ ID NO: 2079370 - RNA, 19 nt, Human
gcaccuacaguguacaguc

SEQ ID NO: 2079371 - RNA, 21 nt, Human
gcaccuacaguguacagucuu

SEQ ID NO: 2079372 - RNA, 12 nt, Human
gcaccucccagc

SEQ ID NO: 2079373 - RNA, 14 nt, Human
gcaccucccagccc

SEQ ID NO: 2079374 - RNA, 17 nt, Human
gcaccucccagccccug

SEQ ID NO: 2079375 - RNA, 11 nt, Human
gcaccucccau

SEQ ID NO: 2079376 - RNA, 14 nt, Human
gcaccucccauccu

SEQ ID NO: 2079377 - RNA, 19 nt, Human
gcacacagcugcagagaca

SEQ ID NO: 2079378 - RNA, 20 nt, Human
gcacacaccagagcccaccu

SEQ ID NO: 2079379 - RNA, 21 nt, Human
gcacacaccuguagucccagc

SEQ ID NO: 2079380 - RNA, 13 nt, Human
gcacacaccugua

SEQ ID NO: 2079381 - RNA, 21 nt, Human
gcacacagcuuuuaguaccca

SEQ ID NO: 2079382 - RNA, 23 nt, Human
gcacacagcuuuuaguacccacc

SEQ ID NO: 2079383 - RNA, 16 nt, Human
gaaaaaaaugacuaaa

SEQ ID NO: 2079384 - RNA, 16 nt, Human
gaaaaaaauuggcauu

SEQ ID NO: 2079385 - RNA, 12 nt, Human
gaaaaaagcuuu

SEQ ID NO: 2079386 - RNA, 23 nt, Human
gaaaaaagaaauucccuggacca

SEQ ID NO: 2079387 - RNA, 21 nt, Human
gaaaaaagaaguguccgagaa

SEQ ID NO: 2079388 - RNA, 13 nt, Human
gaaaaaagaaugu

SEQ ID NO: 2079389 - RNA, 17 nt, Human
gaaaaaauaacacacau

SEQ ID NO: 2079390 - RNA, 23 nt, Human
gaaaagaaaaaugagccuggcaa

SEQ ID NO: 2079391 - RNA, 21 nt, Human
gaaaaaauaauugauuucaag

SEQ ID NO: 2079392 - RNA, 14 nt, Human
gaaaagcaccugcc

SEQ ID NO: 2079393 - RNA, 18 nt, Human
gaaaagauguugugucuu

SEQ ID NO: 2079394 - RNA, 19 nt, Human
gaaaagaauacagaaagau

SEQ ID NO: 2079395 - RNA, 22 nt, Human
gaaaagaaaccccaaacucagg

SEQ ID NO: 2079396 - RNA, 16 nt, Human
gaaaagaauacagaaa

SEQ ID NO: 2079397 - RNA, 18 nt, Human
gaaaagaauacagaaaga

SEQ ID NO: 2079398 - RNA, 22 nt, Human
gaaaagauacgacuuuauuuuc

SEQ ID NO: 2079399 - RNA, 16 nt, Human
gaaaagauacgacuuu

SEQ ID NO: 2079400 - RNA, 19 nt, Human
gaaaagauacgacuuuauu

SEQ ID NO: 2079401 - RNA, 20 nt, Human
gaaaagauacgacuuuauuu

SEQ ID NO: 2079402 - RNA, 18 nt, Human
gaaacaaaguggaaggaa

SEQ ID NO: 2079403 - RNA, 19 nt, Human
gaaacaaaguggaaggaaa

SEQ ID NO: 2079404 - RNA, 20 nt, Human
gaaacaaaguggaaggaaag

SEQ ID NO: 2079405 - RNA, 21 nt, Human
gaaacaaaguggaaggaaaga

SEQ ID NO: 2079406 - RNA, 23 nt, Human
gaaacaaaguggaaggaaagaug

SEQ ID NO: 2079407 - RNA, 16 nt, Human
gaaacuggaaguuauu

SEQ ID NO: 2079408 - RNA, 18 nt, Human
gaaacuguagucucagga

SEQ ID NO: 2079409 - RNA, 16 nt, Human
gaaagaaaauaugcau

SEQ ID NO: 2079410 - RNA, 17 nt, Human
gaaagaaaauaugcauc

SEQ ID NO: 2079411 - RNA, 21 nt, Human
gaaagaaacccgacagaggga

SEQ ID NO: 2079412 - RNA, 22 nt, Human
gaaagaaacccgacagagggaa

SEQ ID NO: 2079413 - RNA, 15 nt, Human
gaaagaaagaaggaa

SEQ ID NO: 2079414 - RNA, 13 nt, Human
gaaagggcccaga

SEQ ID NO: 2079415 - RNA, 20 nt, Human
gaaagggauuuucagcccuc

SEQ ID NO: 2079416 - RNA, 12 nt, Human
gaaagggauuuu

SEQ ID NO: 2079417 - RNA, 11 nt, Human
gaaagaaauca

SEQ ID NO: 2079418 - RNA, 14 nt, Human
gaaagaaaucaugu

SEQ ID NO: 2079419 - RNA, 15 nt, Human
gaaagaaaucauguu

SEQ ID NO: 2079420 - RNA, 16 nt, Human
gaaagaaaucauguua

SEQ ID NO: 2079421 - RNA, 17 nt, Human
gaaagaaaucauguuau

SEQ ID NO: 2079422 - RNA, 21 nt, Human
gaacacccgacuccucaaaag

SEQ ID NO: 2079423 - RNA, 14 nt, Human
gaacacccucgaag

SEQ ID NO: 2079424 - RNA, 13 nt, Human
gaacacuauuuuc

SEQ ID NO: 2079425 - RNA, 16 nt, Human
gaacacuauuuucaga

SEQ ID NO: 2079426 - RNA, 17 nt, Human
gaacacuauuuucagaa

SEQ ID NO: 2079427 - RNA, 18 nt, Human
gaacacuauuuucagaau

SEQ ID NO: 2079428 - RNA, 19 nt, Human
gaacacuauuuucagaauc

SEQ ID NO: 2079429 - RNA, 21 nt, Human
gaacacuauuuucagaaucug

SEQ ID NO: 2079430 - RNA, 18 nt, Human
gaacaccaagacuugaag

SEQ ID NO: 2079431 - RNA, 22 nt, Human
gaacaccacgcuugacaggaca

SEQ ID NO: 2079432 - RNA, 22 nt, Human
gaacacaaagcggggggagggu

SEQ ID NO: 2079433 - RNA, 14 nt, Human
gaacacacuccauc

SEQ ID NO: 2079434 - RNA, 20 nt, Human
gaaaggggcaggagcucaga

SEQ ID NO: 2079435 - RNA, 15 nt, Human
gaacacaguauuuuc

SEQ ID NO: 2079436 - RNA, 21 nt, Human
gaacaaguuguuucauugacu

SEQ ID NO: 2079437 - RNA, 19 nt, Human
gaacaaguuguuucauuga

SEQ ID NO: 2079438 - RNA, 13 nt, Human
gaacaagugaaca

SEQ ID NO: 2079439 - RNA, 17 nt, Human
gaacaagugaacacauu

SEQ ID NO: 2079440 - RNA, 16 nt, Human
gaaagggcccagagag

SEQ ID NO: 2079441 - RNA, 15 nt, Human
gaaagggcccagaga

SEQ ID NO: 2079442 - RNA, 12 nt, Human
gaaaucucaccc

SEQ ID NO: 2079443 - RNA, 19 nt, Human
gaaaugaaaacauguaaua

SEQ ID NO: 2079444 - RNA, 19 nt, Human
gaaaucucacuuuucucca

SEQ ID NO: 2079445 - RNA, 16 nt, Human
gaaaugaaaacaugua

SEQ ID NO: 2079446 - RNA, 13 nt, Human
gaaaugaaagaaa

SEQ ID NO: 2079447 - RNA, 22 nt, Human
gaaccaccacacccagcccacu

SEQ ID NO: 2079448 - RNA, 21 nt, Human
gaaccaccacacccagcccac

SEQ ID NO: 2079449 - RNA, 20 nt, Human
gaaccaccacacccagccca

SEQ ID NO: 2079450 - RNA, 18 nt, Human
gaaccaccacacccagcc

SEQ ID NO: 2079451 - RNA, 14 nt, Human
gaacccaggaggca

SEQ ID NO: 2079452 - RNA, 16 nt, Human
gaacccaggaggugga

SEQ ID NO: 2079453 - RNA, 17 nt, Human
gaaccccaaggagggag

SEQ ID NO: 2079454 - RNA, 15 nt, Human
gaacccaccugcuga

SEQ ID NO: 2079455 - RNA, 19 nt, Human
gaacccaccugcugagaga

SEQ ID NO: 2079456 - RNA, 13 nt, Human
gaacccacacugc

SEQ ID NO: 2079457 - RNA, 14 nt, Human
gaacccacacugca

SEQ ID NO: 2079458 - RNA, 12 nt, Human
gaacccaccugc

SEQ ID NO: 2079459 - RNA, 13 nt, Human
gaacccaccugcu

SEQ ID NO: 2079460 - RNA, 14 nt, Human
gaacccaccugcug

SEQ ID NO: 2079461 - RNA, 20 nt, Human
gaaccaucauuauaaacgug

SEQ ID NO: 2079462 - RNA, 19 nt, Human
gaaccaguuucagguguuu

SEQ ID NO: 2079463 - RNA, 12 nt, Human
gaaccagagcca

SEQ ID NO: 2079464 - RNA, 19 nt, Human
gaaccagagccauggacuc

SEQ ID NO: 2079465 - RNA, 23 nt, Human
gaaccagagccauggacucuaca

SEQ ID NO: 2079466 - RNA, 19 nt, Human
gaaccacuacaugcagccc

SEQ ID NO: 2079467 - RNA, 23 nt, Human
gaaccaccacacccagcccacuu

SEQ ID NO: 2079468 - RNA, 18 nt, Human
gaacucugggcugccaug

SEQ ID NO: 2079469 - RNA, 14 nt, Human
gaacuccuggccuc

SEQ ID NO: 2079470 - RNA, 15 nt, Human
gaacuccuggccuca

SEQ ID NO: 2079471 - RNA, 20 nt, Human
gaacuccuggaaauaucagu

SEQ ID NO: 2079472 - RNA, 13 nt, Human
gaacuccuggccu

SEQ ID NO: 2079473 - RNA, 21 nt, Human
gaacugagcuccucugggcag

SEQ ID NO: 2079474 - RNA, 18 nt, Human
gaacucuuucuggccugc

SEQ ID NO: 2079475 - RNA, 22 nt, Human
gaacucuuucuggccugccuuc

SEQ ID NO: 2079476 - RNA, 13 nt, Human
gaacugaaaacau

SEQ ID NO: 2079477 - RNA, 15 nt, Human
gaacugaaaacauaa

SEQ ID NO: 2079478 - RNA, 16 nt, Human
gaacugaaaacauaaa

SEQ ID NO: 2079479 - RNA, 18 nt, Human
gaacugaaaacauaaaaa

SEQ ID NO: 2079480 - RNA, 19 nt, Human
gaacugaaaacauaaaaag

SEQ ID NO: 2079481 - RNA, 16 nt, Human
gaagacucauucuucu

SEQ ID NO: 2079482 - RNA, 18 nt, Human
gaagacucauucuucugu

SEQ ID NO: 2079483 - RNA, 17 nt, Human
gaagacucauucuucug

SEQ ID NO: 2079484 - RNA, 14 nt, Human
gaagcacagcuuca

SEQ ID NO: 2079485 - RNA, 13 nt, Human
gaagcacagcuuc

SEQ ID NO: 2079486 - RNA, 16 nt, Human
gaacugaugacacuga

SEQ ID NO: 2079487 - RNA, 18 nt, Human
gaagcacagaaaacuaga

SEQ ID NO: 2079488 - RNA, 16 nt, Human
gaagcaccauaacuuu

SEQ ID NO: 2079489 - RNA, 19 nt, Human
gaagcacgugguaaaacac

SEQ ID NO: 2079490 - RNA, 16 nt, Human
gaagcaccccaugcca

SEQ ID NO: 2079491 - RNA, 21 nt, Human
gaagcaccccaugccaaagcu

SEQ ID NO: 2079492 - RNA, 23 nt, Human
gaagcacuuugggauucuuucca

SEQ ID NO: 2079493 - RNA, 23 nt, Human
gaagcagaugcaaagaggcaaga

SEQ ID NO: 2079494 - RNA, 15 nt, Human
gaagcagugagccgc

SEQ ID NO: 2079495 - RNA, 23 nt, Human
gaagcagguugaggggcuccugg

SEQ ID NO: 2079496 - RNA, 19 nt, Human
gaagcagguugaggggcuc

SEQ ID NO: 2079497 - RNA, 22 nt, Human
gaagcagguugaggggcuccug

SEQ ID NO: 2079498 - RNA, 18 nt, Human
gaagcagguugaggggcu

SEQ ID NO: 2079499 - RNA, 22 nt, Human
gaagacauggggaggaaggaca

SEQ ID NO: 2079500 - RNA, 18 nt, Human
gaagacaugaaccaagug

SEQ ID NO: 2079501 - RNA, 15 nt, Human
gaagacaggacagug

SEQ ID NO: 2079502 - RNA, 22 nt, Human
gaagaccugcugagggaccagc

SEQ ID NO: 2079503 - RNA, 16 nt, Human
gaagacacugaugggc

SEQ ID NO: 2079504 - RNA, 14 nt, Human
gaacugcauggacc

SEQ ID NO: 2079505 - RNA, 15 nt, Human
gaacugcauggaccu

SEQ ID NO: 2079506 - RNA, 22 nt, Human
gaacugcauggaccuaacauuc

SEQ ID NO: 2079507 - RNA, 23 nt, Human
gaacugcauggaccuaacauucg

SEQ ID NO: 2079508 - RNA, 17 nt, Human
gaacugcauguauaaau

SEQ ID NO: 2079509 - RNA, 20 nt, Human
gaacugcauguauaaaugaa

SEQ ID NO: 2079510 - RNA, 15 nt, Human
gaacugcauauguuu

SEQ ID NO: 2079511 - RNA, 21 nt, Human
gaacugcauauguuucgcuga

SEQ ID NO: 2079512 - RNA, 21 nt, Human
gaagacacugaugggcaaccc

SEQ ID NO: 2079513 - RNA, 21 nt, Human
gaagacacugaaauauacaca

SEQ ID NO: 2079514 - RNA, 20 nt, Human
cuucuucagaagacacugca

SEQ ID NO: 2079515 - RNA, 14 nt, Human
cuucuuacaugcau

SEQ ID NO: 2079516 - RNA, 20 nt, Human
cuucuuauucucacuccacc

SEQ ID NO: 2079517 - RNA, 22 nt, Human
cuucuuauucucacuccaccac

SEQ ID NO: 2079518 - RNA, 13 nt, Human
cuucuuacaugca

SEQ ID NO: 2079519 - RNA, 19 nt, Human
cuucucuuuaacucaggac

SEQ ID NO: 2079520 - RNA, 20 nt, Human
cuucucuuuaacucaggacu

SEQ ID NO: 2079521 - RNA, 21 nt, Human
cuucucuuuaacucaggacuc

SEQ ID NO: 2079522 - RNA, 20 nt, Human
cuucuuaauauaacugccuu

SEQ ID NO: 2079523 - RNA, 16 nt, Human
cuucuuaaaugagaag

SEQ ID NO: 2079524 - RNA, 21 nt, Human
cuucuuaaaugagaaggaauu

SEQ ID NO: 2079525 - RNA, 21 nt, Human
cuucuuaaccccaguaagcca

SEQ ID NO: 2079526 - RNA, 18 nt, Human
cuucuuaauauaacugcc

SEQ ID NO: 2079527 - RNA, 14 nt, Human
cuucugaccacacu

SEQ ID NO: 2079528 - RNA, 15 nt, Human
cuucugaccacacuu

SEQ ID NO: 2079529 - RNA, 17 nt, Human
cuucugaccacacuucc

SEQ ID NO: 2079530 - RNA, 18 nt, Human
cuucugaccacacuuccu

SEQ ID NO: 2079531 - RNA, 19 nt, Human
cuucugaccacacuuccug

SEQ ID NO: 2079532 - RNA, 23 nt, Human
cuucugaccacacuuccugucca

SEQ ID NO: 2079533 - RNA, 22 nt, Human
cuuccucuuuccaucuacccuc

SEQ ID NO: 2079534 - RNA, 21 nt, Human
cuuccucuuuccaucuacccu

SEQ ID NO: 2079535 - RNA, 15 nt, Human
cuuccucuccacugc

SEQ ID NO: 2079536 - RNA, 14 nt, Human
cuuccucuccacug

SEQ ID NO: 2079537 - RNA, 13 nt, Human
cuuccucuccacu

SEQ ID NO: 2079538 - RNA, 21 nt, Human
cuuccucucauccuuuucucc

SEQ ID NO: 2079539 - RNA, 22 nt, Human
cuuccucucauccuuuucuccu

SEQ ID NO: 2079540 - RNA, 13 nt, Human
cuucuaaaugcau

SEQ ID NO: 2079541 - RNA, 15 nt, Human
cuucuaaaugcauau

SEQ ID NO: 2079542 - RNA, 21 nt, Human
cuucucugugaacgauuuaga

SEQ ID NO: 2079543 - RNA, 22 nt, Human
cuucucugugaacgauuuagaa

SEQ ID NO: 2079544 - RNA, 12 nt, Human
cuucucuuaauu

SEQ ID NO: 2079545 - RNA, 14 nt, Human
cuucucuuaauuua

SEQ ID NO: 2079546 - RNA, 15 nt, Human
cuucucuuaauuuaa

SEQ ID NO: 2079547 - RNA, 16 nt, Human
cuucucuuaauuuaau

SEQ ID NO: 2079548 - RNA, 21 nt, Human
cuucuagugauuucuggggcc

SEQ ID NO: 2079549 - RNA, 23 nt, Human
cuuggccugucucauccccaggg

SEQ ID NO: 2079550 - RNA, 17 nt, Human
cuuggccugucucaucc

SEQ ID NO: 2079551 - RNA, 22 nt, Human
cuuggccugucucauccccagg

SEQ ID NO: 2079552 - RNA, 23 nt, Human
cuugcuagcuaugugaccuugag

SEQ ID NO: 2079553 - RNA, 20 nt, Human
cuugcuagcuaugugaccuu

SEQ ID NO: 2079554 - RNA, 11 nt, Human
cuuggccucag

SEQ ID NO: 2079555 - RNA, 12 nt, Human
cuuggccucaga

SEQ ID NO: 2079556 - RNA, 23 nt, Human
cuuggccucagaauucacaaaau

SEQ ID NO: 2079557 - RNA, 16 nt, Human
cuugcuaccucaaggg

SEQ ID NO: 2079558 - RNA, 21 nt, Human
cuugauuuguuuuagaaugau

SEQ ID NO: 2079559 - RNA, 23 nt, Human
cuugaaggaucuguuuuuaaaaa

SEQ ID NO: 2079560 - RNA, 19 nt, Human
cuugaccagcagaucccag

SEQ ID NO: 2079561 - RNA, 20 nt, Human
cuugaccagcagaucccagc

SEQ ID NO: 2079562 - RNA, 21 nt, Human
cuugaccagcagaucccagcu

SEQ ID NO: 2079563 - RNA, 22 nt, Human
cuugaccagcagaucccagcuc

SEQ ID NO: 2079564 - RNA, 18 nt, Human
cuugauguguuaucucuu

SEQ ID NO: 2079565 - RNA, 18 nt, Human
cuugauucacaaugaaau

SEQ ID NO: 2079566 - RNA, 20 nt, Human
cuugaauugcauuuuuuaaa

SEQ ID NO: 2079567 - RNA, 19 nt, Human
cuugacauaauuucacuga

SEQ ID NO: 2079568 - RNA, 12 nt, Human
cuugaccaagca

SEQ ID NO: 2079569 - RNA, 15 nt, Human
cuugaccaagcagga

SEQ ID NO: 2079570 - RNA, 17 nt, Human
cuugaccaagcaggaag

SEQ ID NO: 2079571 - RNA, 18 nt, Human
cuugaccaagcaggaagc

SEQ ID NO: 2079572 - RNA, 19 nt, Human
cuugaccaagcaggaagcu

SEQ ID NO: 2079573 - RNA, 20 nt, Human
cuugaccaagcaggaagcuc

SEQ ID NO: 2079574 - RNA, 23 nt, Human
cuugaccaagcaggaagcucaga

SEQ ID NO: 2079575 - RNA, 11 nt, Human
cuugaccagca

SEQ ID NO: 2079576 - RNA, 14 nt, Human
cuugaauucauaga

SEQ ID NO: 2079577 - RNA, 17 nt, Human
cuugaagucacccggcc

SEQ ID NO: 2079578 - RNA, 20 nt, Human
cuugaagucacccggccccc

SEQ ID NO: 2079579 - RNA, 17 nt, Human
cuuucuaaugugugaau

SEQ ID NO: 2079580 - RNA, 16 nt, Human
cuuucuacccagcgag

SEQ ID NO: 2079581 - RNA, 15 nt, Human
cuuucuacccagcga

SEQ ID NO: 2079582 - RNA, 18 nt, Human
cuuucucaauaagccuca

SEQ ID NO: 2079583 - RNA, 16 nt, Human
cuuugacugagcagac

SEQ ID NO: 2079584 - RNA, 13 nt, Human
cuuucucccaggc

SEQ ID NO: 2079585 - RNA, 20 nt, Human
cuuucucagccucugaauau

SEQ ID NO: 2079586 - RNA, 22 nt, Human
cuuucucagccgcuucugacug

SEQ ID NO: 2079587 - RNA, 21 nt, Human
cuuucucagccgcuucugacu

SEQ ID NO: 2079588 - RNA, 11 nt, Human
cuuuuauaaau

SEQ ID NO: 2079589 - RNA, 13 nt, Human
cuuuuauaaauua

SEQ ID NO: 2079590 - RNA, 14 nt, Human
cuuuuauaaauuaa

SEQ ID NO: 2079591 - RNA, 15 nt, Human
cuuuuauaaauuaaa

SEQ ID NO: 2079592 - RNA, 16 nt, Human
cuuuuauaaauuaaau

SEQ ID NO: 2079593 - RNA, 18 nt, Human
cuuuuauaaauuaaauau

SEQ ID NO: 2079594 - RNA, 20 nt, Human
cuuuuauaaauuaaauauau

SEQ ID NO: 2079595 - RNA, 24 nt, Human
cuuuuauaaauuaaauauauguau

SEQ ID NO: 2079596 - RNA, 22 nt, Human
cuuuuauaacuaguccuuuacu

SEQ ID NO: 2079597 - RNA, 14 nt, Human
cuuuguaugauauu

SEQ ID NO: 2079598 - RNA, 15 nt, Human
cuuuguaugauauuc

SEQ ID NO: 2079599 - RNA, 20 nt, Human
cuuuguaugauauuccauag

SEQ ID NO: 2079600 - RNA, 14 nt, Human
cuuugauuuagauu

SEQ ID NO: 2079601 - RNA, 19 nt, Human
cuuugauuuagauugagua

SEQ ID NO: 2079602 - RNA, 19 nt, Human
cuuugagauagaagaacug

SEQ ID NO: 2079603 - RNA, 20 nt, Human
cuuugagauagaagaacugc

SEQ ID NO: 2079604 - RNA, 18 nt, Human
cuuugagauagaagaacu

SEQ ID NO: 2079605 - RNA, 17 nt, Human
cuuugagacugggucuc

SEQ ID NO: 2079606 - RNA, 20 nt, Human
cuuuguaauuauuuuuaaua

SEQ ID NO: 2079607 - RNA, 21 nt, Human
cuuuguaaugucaccaccuuc

SEQ ID NO: 2079608 - RNA, 22 nt, Human
cuuuguaaugucaccaccuucc

SEQ ID NO: 2079609 - RNA, 13 nt, Human
cuuuguaauggga

SEQ ID NO: 2079610 - RNA, 17 nt, Human
cuuuguaaugucaccac

SEQ ID NO: 2079611 - RNA, 12 nt, Human
cuuuguaugcac

SEQ ID NO: 2079612 - RNA, 14 nt, Human
cuuuaauugugaau

SEQ ID NO: 2079613 - RNA, 22 nt, Human
cuuuaauugugaauugauaaua

SEQ ID NO: 2079614 - RNA, 23 nt, Human
cuuuaauuguuaagauaugaugu

SEQ ID NO: 2079615 - RNA, 23 nt, Human
cuuuaaugucacaggcaggucca

SEQ ID NO: 2079616 - RNA, 20 nt, Human
cuugugcugaucgugcuaaa

SEQ ID NO: 2079617 - RNA, 14 nt, Human
cuuuacccucaucu

SEQ ID NO: 2079618 - RNA, 15 nt, Human
cuuuacccucaucug

SEQ ID NO: 2079619 - RNA, 17 nt, Human
cuuuacccucaucuguc

SEQ ID NO: 2079620 - RNA, 20 nt, Human
cuuuacccucaucugucugg

SEQ ID NO: 2079621 - RNA, 17 nt, Human
cuuuacauaugcuuuaa

SEQ ID NO: 2079622 - RNA, 20 nt, Human
cuuuacaugggguuuucaau

SEQ ID NO: 2079623 - RNA, 15 nt, Human
cuuggguaggcggga

SEQ ID NO: 2079624 - RNA, 17 nt, Human
cuugggucccagggaag

SEQ ID NO: 2079625 - RNA, 23 nt, Human
cuugggucccccacgugacagug

SEQ ID NO: 2079626 - RNA, 23 nt, Human
cuuggguucaagugauucuccug

SEQ ID NO: 2079627 - RNA, 17 nt, Human
cuuggguuuuuguuacc

SEQ ID NO: 2079628 - RNA, 22 nt, Human
cuuggguguaacaggucuccuc

SEQ ID NO: 2079629 - RNA, 21 nt, Human
cuuggguguaacaggucuccu

SEQ ID NO: 2079630 - RNA, 14 nt, Human
cuuggucacauaca

SEQ ID NO: 2079631 - RNA, 15 nt, Human
cuugguaagaagccg

SEQ ID NO: 2079632 - RNA, 23 nt, Human
cuugguacuacuagaugucuuua

SEQ ID NO: 2079633 - RNA, 18 nt, Human
cuugguacuugcugcuau

SEQ ID NO: 2079634 - RNA, 19 nt, Human
cuugguacuugcugcuauu

SEQ ID NO: 2079635 - RNA, 20 nt, Human
cuugguacuugcugcuauuu

SEQ ID NO: 2079636 - RNA, 15 nt, Human
cuuggucuuauuuau

SEQ ID NO: 2079637 - RNA, 17 nt, Human
cuugugaauauguacau

SEQ ID NO: 2079638 - RNA, 14 nt, Human
cuugugacuagugc

SEQ ID NO: 2079639 - RNA, 15 nt, Human
cuugugacuagugcu

SEQ ID NO: 2079640 - RNA, 16 nt, Human
cuugugacuagugcug

SEQ ID NO: 2079641 - RNA, 17 nt, Human
cuugugacuagugcuga

SEQ ID NO: 2079642 - RNA, 18 nt, Human
cuugugacuagugcugaa

SEQ ID NO: 2079643 - RNA, 19 nt, Human
cuugugacuagugcugaag

SEQ ID NO: 2079644 - RNA, 12 nt, Human
cuugugacauau

SEQ ID NO: 2079645 - RNA, 21 nt, Human
cuugugacauauuaugucuuc

SEQ ID NO: 2079646 - RNA, 20 nt, Human
cuugguguccuuucccucca

SEQ ID NO: 2079647 - RNA, 21 nt, Human
cuugguguccuuucccuccac

SEQ ID NO: 2079648 - RNA, 19 nt, Human
cuugguggcucacgccugu

SEQ ID NO: 2079649 - RNA, 15 nt, Human
cuugguguccaccug

SEQ ID NO: 2079650 - RNA, 16 nt, Human
cuugguguccaccugg

SEQ ID NO: 2079651 - RNA, 17 nt, Human
cuugguguccaccuggc

SEQ ID NO: 2079652 - RNA, 19 nt, Human
cuugguguccaccuggccc

SEQ ID NO: 2079653 - RNA, 14 nt, Human
cuugguguccuuuc

SEQ ID NO: 2079654 - RNA, 20 nt, Human
cugggcaccuggggaguggg

SEQ ID NO: 2079655 - RNA, 16 nt, Human
cugggcaccuggggag

SEQ ID NO: 2079656 - RNA, 17 nt, Human
cugggcaccuggggagu

SEQ ID NO: 2079657 - RNA, 19 nt, Human
cugggcaccuggggagugg

SEQ ID NO: 2079658 - RNA, 14 nt, Human
cugggcauugcuuu

SEQ ID NO: 2079659 - RNA, 16 nt, Human
cugggcauugcuuucc

SEQ ID NO: 2079660 - RNA, 17 nt, Human
cugggcauugcuuucca

SEQ ID NO: 2079661 - RNA, 21 nt, Human
cugggccaaguuccucuagug

SEQ ID NO: 2079662 - RNA, 19 nt, Human
cugggccaagccagggaug

SEQ ID NO: 2079663 - RNA, 15 nt, Human
cugggccaaguuccu

SEQ ID NO: 2079664 - RNA, 18 nt, Human
cugggccaaguuccucua

SEQ ID NO: 2079665 - RNA, 20 nt, Human
cugggccaaguuccucuagu

SEQ ID NO: 2079666 - RNA, 14 nt, Human
cuggggagaaagua

SEQ ID NO: 2079667 - RNA, 20 nt, Human
cuggggagugggacagaguc

SEQ ID NO: 2079668 - RNA, 17 nt, Human
cuggggagugggacaga

SEQ ID NO: 2079669 - RNA, 18 nt, Human
cuggggauacuggcaaag

SEQ ID NO: 2079670 - RNA, 20 nt, Human
cuggguucacugcaaccucc

SEQ ID NO: 2079671 - RNA, 18 nt, Human
cuggguucacugcaaccu

SEQ ID NO: 2079672 - RNA, 17 nt, Human
cuggguuccaauccugg

SEQ ID NO: 2079673 - RNA, 15 nt, Human
cuggguucacugcaa

SEQ ID NO: 2079674 - RNA, 13 nt, Human
cuggguggggcug

SEQ ID NO: 2079675 - RNA, 17 nt, Human
cuggguggggcugcucc

SEQ ID NO: 2079676 - RNA, 18 nt, Human
cuggguggggcugcuccu

SEQ ID NO: 2079677 - RNA, 20 nt, Human
cuggguggggcugcuccucc

SEQ ID NO: 2079678 - RNA, 21 nt, Human
cuggguggggcugcuccucca

SEQ ID NO: 2079679 - RNA, 22 nt, Human
cuggguggggcugcuccuccag

SEQ ID NO: 2079680 - RNA, 16 nt, Human
cuggguggggugagga

SEQ ID NO: 2079681 - RNA, 21 nt, Human
cuggguggggugaggaccacu

SEQ ID NO: 2079682 - RNA, 15 nt, Human
cuggggcagucaccu

SEQ ID NO: 2079683 - RNA, 23 nt, Human
cuggggcaggaggggagugaggc

SEQ ID NO: 2079684 - RNA, 19 nt, Human
cuggggcuaggcuggagcc

SEQ ID NO: 2079685 - RNA, 14 nt, Human
cuggggcucuggga

SEQ ID NO: 2079686 - RNA, 15 nt, Human
cuggggcucugggau

SEQ ID NO: 2079687 - RNA, 14 nt, Human
cuggggcucugugc

SEQ ID NO: 2079688 - RNA, 17 nt, Human
cuggggcucugugcagg

SEQ ID NO: 2079689 - RNA, 19 nt, Human
cuggggcucugugcaggga

SEQ ID NO: 2079690 - RNA, 16 nt, Human
cuggggcugaucucag

SEQ ID NO: 2079691 - RNA, 17 nt, Human
cuggggcugaucucagg

SEQ ID NO: 2079692 - RNA, 20 nt, Human
cuggggcugaucucagggaa

SEQ ID NO: 2079693 - RNA, 21 nt, Human
cuggggcugaucucagggaag

SEQ ID NO: 2079694 - RNA, 22 nt, Human
cuggggcugaucucagggaagc

SEQ ID NO: 2079695 - RNA, 23 nt, Human
cuggggcugaucucagggaagcc

SEQ ID NO: 2079696 - RNA, 15 nt, Human
cuggcagcagagugu

SEQ ID NO: 2079697 - RNA, 11 nt, Human
cuggcagccca

SEQ ID NO: 2079698 - RNA, 22 nt, Human
cuggcagccgugccuucagcuc

SEQ ID NO: 2079699 - RNA, 21 nt, Human
cuggcagccgugccuucagcu

SEQ ID NO: 2079700 - RNA, 13 nt, Human
cuggcagccccag

SEQ ID NO: 2079701 - RNA, 15 nt, Human
cuggcagccccagca

SEQ ID NO: 2079702 - RNA, 16 nt, Human
cuggcagccccagcac

SEQ ID NO: 2079703 - RNA, 18 nt, Human
cuggcagccccagcacca

SEQ ID NO: 2079704 - RNA, 20 nt, Human
cuggcagccgugccuucagc

SEQ ID NO: 2079705 - RNA, 19 nt, Human
cuggcagccgugccuucag

SEQ ID NO: 2079706 - RNA, 13 nt, Human
cugggacuggcca

SEQ ID NO: 2079707 - RNA, 14 nt, Human
cugggacuggccag

SEQ ID NO: 2079708 - RNA, 23 nt, Human
cugggaauguauuauucugcagc

SEQ ID NO: 2079709 - RNA, 13 nt, Human
cugggaauguauu

SEQ ID NO: 2079710 - RNA, 18 nt, Human
cugggaauguauuauucu

SEQ ID NO: 2079711 - RNA, 19 nt, Human
cugggaauguauuauucug

SEQ ID NO: 2079712 - RNA, 22 nt, Human
cugggaauguauuauucugcag

SEQ ID NO: 2079713 - RNA, 11 nt, Human
cugggacacag

SEQ ID NO: 2079714 - RNA, 14 nt, Human
cuggccgggcacag

SEQ ID NO: 2079715 - RNA, 15 nt, Human
cuggccgggcacagc

SEQ ID NO: 2079716 - RNA, 16 nt, Human
cuggccgggcacagcu

SEQ ID NO: 2079717 - RNA, 17 nt, Human
cuggccgggcacagcug

SEQ ID NO: 2079718 - RNA, 20 nt, Human
cuggccgggcacagcugugg

SEQ ID NO: 2079719 - RNA, 12 nt, Human
cuggcccugccu

SEQ ID NO: 2079720 - RNA, 12 nt, Human
cuggcccucuuc

SEQ ID NO: 2079721 - RNA, 13 nt, Human
cuggcccucuucu

SEQ ID NO: 2079722 - RNA, 15 nt, Human
cuggcccucuucuua

SEQ ID NO: 2079723 - RNA, 16 nt, Human
cuggcccucuucuuac

SEQ ID NO: 2079724 - RNA, 21 nt, Human
cuggcccgucauguuccucaa

SEQ ID NO: 2079725 - RNA, 18 nt, Human
cuggcccgucauguuccu

SEQ ID NO: 2079726 - RNA, 14 nt, Human
cugcuucaaauauu

SEQ ID NO: 2079727 - RNA, 19 nt, Human
cugcuucaaauauuucccu

SEQ ID NO: 2079728 - RNA, 20 nt, Human
cugcuuuugucuaugggacu

SEQ ID NO: 2079729 - RNA, 13 nt, Human
cuggauauuuuca

SEQ ID NO: 2079730 - RNA, 15 nt, Human
cuggauauuuucaaa

SEQ ID NO: 2079731 - RNA, 16 nt, Human
cuggauauuuucaaau

SEQ ID NO: 2079732 - RNA, 21 nt, Human
cuggauauuuucaaauuguau

SEQ ID NO: 2079733 - RNA, 22 nt, Human
cuggauauuuucaaauuguauc

SEQ ID NO: 2079734 - RNA, 13 nt, Human
cuggauaaaauga

SEQ ID NO: 2079735 - RNA, 19 nt, Human
cuggauaguccgucucugc

SEQ ID NO: 2079736 - RNA, 18 nt, Human
cuggauaguccgucucug

SEQ ID NO: 2079737 - RNA, 13 nt, Human
cuggauaauuuug

SEQ ID NO: 2079738 - RNA, 15 nt, Human
cuggauaauuuugca

SEQ ID NO: 2079739 - RNA, 21 nt, Human
cuggauaauuuugcauaaaau

SEQ ID NO: 2079740 - RNA, 20 nt, Human
cuggacuugagcuuggcagc

SEQ ID NO: 2079741 - RNA, 22 nt, Human
cuggacugaagccugcaggagu

SEQ ID NO: 2079742 - RNA, 18 nt, Human
cuggacuugagcuuggca

SEQ ID NO: 2079743 - RNA, 16 nt, Human
cuggacugaagccugc

SEQ ID NO: 2079744 - RNA, 19 nt, Human
cuggacugaagccugcagg

SEQ ID NO: 2079745 - RNA, 21 nt, Human
cugcuuuugucuaugggacuc

SEQ ID NO: 2079746 - RNA, 19 nt, Human
cugcuuuuuaaagaaugcu

SEQ ID NO: 2079747 - RNA, 12 nt, Human
cuggaagagagg

SEQ ID NO: 2079748 - RNA, 16 nt, Human
cuggaagagcagcccu

SEQ ID NO: 2079749 - RNA, 13 nt, Human
cuggaagagagga

SEQ ID NO: 2079750 - RNA, 12 nt, Human
cuggaagcacag

SEQ ID NO: 2079751 - RNA, 15 nt, Human
cuggaagcacagaaa

SEQ ID NO: 2079752 - RNA, 19 nt, Human
cuggaagcacagaaaacua

SEQ ID NO: 2079753 - RNA, 22 nt, Human
cuggaagcacagaaaacuagaa

SEQ ID NO: 2079754 - RNA, 23 nt, Human
cuggacugaagccugcaggaguu

SEQ ID NO: 2079755 - RNA, 14 nt, Human
cuggaagcacagcu

SEQ ID NO: 2079756 - RNA, 19 nt, Human
cugcugaccuccacagcuu

SEQ ID NO: 2079757 - RNA, 18 nt, Human
cugcugacuguuuucucu

SEQ ID NO: 2079758 - RNA, 21 nt, Human
cugcugacuguuuucucuuga

SEQ ID NO: 2079759 - RNA, 12 nt, Human
cugcucaucauu

SEQ ID NO: 2079760 - RNA, 16 nt, Human
cugcugaccuccacag

SEQ ID NO: 2079761 - RNA, 18 nt, Human
cugcugaccuccacagcu

SEQ ID NO: 2079762 - RNA, 15 nt, Human
cugccuguaguuagg

SEQ ID NO: 2079763 - RNA, 16 nt, Human
cugccuguaguuagga

SEQ ID NO: 2079764 - RNA, 23 nt, Human
cugcuaggugggccagccccucc

SEQ ID NO: 2079765 - RNA, 15 nt, Human
cugcuaggugggcca

SEQ ID NO: 2079766 - RNA, 16 nt, Human
cugcuaggugggccag

SEQ ID NO: 2079767 - RNA, 20 nt, Human
cugcuaggugggccagcccc

SEQ ID NO: 2079768 - RNA, 21 nt, Human
cugcuaggugggccagccccu

SEQ ID NO: 2079769 - RNA, 22 nt, Human
cugcuaggugggccagccccuc

SEQ ID NO: 2079770 - RNA, 15 nt, Human
cugaugaaucuugcg

SEQ ID NO: 2079771 - RNA, 20 nt, Human
cugaucugaugcaagcaaga

SEQ ID NO: 2079772 - RNA, 19 nt, Human
cugccuguucagcuccagc

SEQ ID NO: 2079773 - RNA, 18 nt, Human
cugccuguucagcuccag

SEQ ID NO: 2079774 - RNA, 17 nt, Human
cugccuguucagcucca

SEQ ID NO: 2079775 - RNA, 16 nt, Human
cugccucucccuggcc

SEQ ID NO: 2079776 - RNA, 15 nt, Human
cugccuggucuccug

SEQ ID NO: 2079777 - RNA, 16 nt, Human
cugccuggucuccugc

SEQ ID NO: 2079778 - RNA, 17 nt, Human
cugccuggucuccugcc

SEQ ID NO: 2079779 - RNA, 19 nt, Human
cugccuggucuccugcccc

SEQ ID NO: 2079780 - RNA, 21 nt, Human
cugccuggucuccugccccca

SEQ ID NO: 2079781 - RNA, 22 nt, Human
cugccuggucuccugcccccac

SEQ ID NO: 2079782 - RNA, 13 nt, Human
cugccuguaguua

SEQ ID NO: 2079783 - RNA, 19 nt, Human
cugccuguaacuugagagu

SEQ ID NO: 2079784 - RNA, 24 nt, Human
cugccuccucuucaacugaccagc

SEQ ID NO: 2079785 - RNA, 15 nt, Human
cugccuccucuucaa

SEQ ID NO: 2079786 - RNA, 14 nt, Human
cugccuccucuuca

SEQ ID NO: 2079787 - RNA, 13 nt, Human
cugccuccucuuc

SEQ ID NO: 2079788 - RNA, 23 nt, Human
cugccucucccaucacuucccua

SEQ ID NO: 2079789 - RNA, 15 nt, Human
cugccucccugucca

SEQ ID NO: 2079790 - RNA, 17 nt, Human
cugccucccuguccacc

SEQ ID NO: 2079791 - RNA, 15 nt, Human
cugccucucccauca

SEQ ID NO: 2079792 - RNA, 22 nt, Human
cugccucucccaucacuucccu

SEQ ID NO: 2079793 - RNA, 16 nt, Human
cuuaggggcugcugac

SEQ ID NO: 2079794 - RNA, 15 nt, Human
cuuaggaagaauuuu

SEQ ID NO: 2079795 - RNA, 17 nt, Human
cuuaggaagagaaacca

SEQ ID NO: 2079796 - RNA, 22 nt, Human
cuuaggaagagaaaccagggag

SEQ ID NO: 2079797 - RNA, 14 nt, Human
cuuaggcagggaag

SEQ ID NO: 2079798 - RNA, 15 nt, Human
cuuaggcagggaagu

SEQ ID NO: 2079799 - RNA, 17 nt, Human
cuuaggcaugcacagcu

SEQ ID NO: 2079800 - RNA, 20 nt, Human
cuuacacaagacuuucccca

SEQ ID NO: 2079801 - RNA, 11 nt, Human
cuuagccuccc

SEQ ID NO: 2079802 - RNA, 14 nt, Human
cuuagccucccuga

SEQ ID NO: 2079803 - RNA, 15 nt, Human
cuuagccucccugaa

SEQ ID NO: 2079804 - RNA, 15 nt, Human
cuuaccauaugugcu

SEQ ID NO: 2079805 - RNA, 13 nt, Human
cuuaccauuaaag

SEQ ID NO: 2079806 - RNA, 23 nt, Human
cuuacccaucugcaccccccugg

SEQ ID NO: 2079807 - RNA, 14 nt, Human
cuuagcagugauuu

SEQ ID NO: 2079808 - RNA, 22 nt, Human
cuuagcagugauuuuuauccaa

SEQ ID NO: 2079809 - RNA, 14 nt, Human
cuuagcaugcacaa

SEQ ID NO: 2079810 - RNA, 18 nt, Human
cuuagcauguguugaaaa

SEQ ID NO: 2079811 - RNA, 14 nt, Human
cuuagcuuaucaau

SEQ ID NO: 2079812 - RNA, 16 nt, Human
cuuagcuuaucaauuu

SEQ ID NO: 2079813 - RNA, 23 nt, Human
cuuagcuuagaccucagccugug

SEQ ID NO: 2079814 - RNA, 21 nt, Human
cuuagcuuagaccucagccug

SEQ ID NO: 2079815 - RNA, 22 nt, Human
cuuagcuuagaccucagccugu

SEQ ID NO: 2079816 - RNA, 14 nt, Human
cuuagcuuagaccu

SEQ ID NO: 2079817 - RNA, 15 nt, Human
cuuagcuuagaccuc

SEQ ID NO: 2079818 - RNA, 16 nt, Human
cuuagcuuagaccuca

SEQ ID NO: 2079819 - RNA, 17 nt, Human
cuuagcuuagaccucag

SEQ ID NO: 2079820 - RNA, 18 nt, Human
cuuagcuuagaccucagc

SEQ ID NO: 2079821 - RNA, 19 nt, Human
cuuagcuuagaccucagcc

SEQ ID NO: 2079822 - RNA, 20 nt, Human
cuuagcuuagaccucagccu

SEQ ID NO: 2079823 - RNA, 15 nt, Human
cuuagcugccaagcc

SEQ ID NO: 2079824 - RNA, 14 nt, Human
cuuagcugccaagu

SEQ ID NO: 2079825 - RNA, 17 nt, Human
cuuagcugccaaguaaa

SEQ ID NO: 2079826 - RNA, 17 nt, Human
cuguuauuucuauuuuu

SEQ ID NO: 2079827 - RNA, 12 nt, Human
cuguucaaggaa

SEQ ID NO: 2079828 - RNA, 17 nt, Human
cuguucaauguuuaaug

SEQ ID NO: 2079829 - RNA, 16 nt, Human
cuguuauuucuauuuu

SEQ ID NO: 2079830 - RNA, 22 nt, Human
cuguuggcugggggccucagug

SEQ ID NO: 2079831 - RNA, 19 nt, Human
cuguuggcugggggccuca

SEQ ID NO: 2079832 - RNA, 14 nt, Human
cuguuggcuggggg

SEQ ID NO: 2079833 - RNA, 14 nt, Human
cuguugucauugcu

SEQ ID NO: 2079834 - RNA, 9 nt, Human
cuguuguuu

SEQ ID NO: 2079835 - RNA, 16 nt, Human
cuuacaagccagcugg

SEQ ID NO: 2079836 - RNA, 17 nt, Human
cuuacaagccagcugga

SEQ ID NO: 2079837 - RNA, 22 nt, Human
cuuacauuagcaguuugcuuug

SEQ ID NO: 2079838 - RNA, 21 nt, Human
cuuacauuagcaguuugcuuu

SEQ ID NO: 2079839 - RNA, 20 nt, Human
cuuacauuuuacuuuuuccu

SEQ ID NO: 2079840 - RNA, 15 nt, Human
cuuaccaaaggauag

SEQ ID NO: 2079841 - RNA, 15 nt, Human
cuuacauugugaaac

SEQ ID NO: 2079842 - RNA, 22 nt, Human
cuuaaauaaaagaaaugcacaa

SEQ ID NO: 2079843 - RNA, 23 nt, Human
cuuaaauaaaagaaaugcacaau

SEQ ID NO: 2079844 - RNA, 21 nt, Human
cuuaaauaauaaacaguggaa

SEQ ID NO: 2079845 - RNA, 20 nt, Human
cuuacaaaguguauuuuaua

SEQ ID NO: 2079846 - RNA, 14 nt, Human
cuuaaaacaacacu

SEQ ID NO: 2079847 - RNA, 21 nt, Human
cugugacccucaauucauauu

SEQ ID NO: 2079848 - RNA, 14 nt, Human
cugugcgcugacaa

SEQ ID NO: 2079849 - RNA, 21 nt, Human
cugugccuuugaguuuccuca

SEQ ID NO: 2079850 - RNA, 13 nt, Human
cugugccuggagc

SEQ ID NO: 2079851 - RNA, 14 nt, Human
cugugccuggagcu

SEQ ID NO: 2079852 - RNA, 17 nt, Human
cugugccuggagcuccu

SEQ ID NO: 2079853 - RNA, 18 nt, Human
cugugccuggagcuccug

SEQ ID NO: 2079854 - RNA, 19 nt, Human
cugugccuggagcuccugg

SEQ ID NO: 2079855 - RNA, 20 nt, Human
cugugccuggagcuccuggg

SEQ ID NO: 2079856 - RNA, 16 nt, Human
cugugaccugccccgc

SEQ ID NO: 2079857 - RNA, 22 nt, Human
cugugaccugccccgcccagcu

SEQ ID NO: 2079858 - RNA, 15 nt, Human
cugugucccucucuc

SEQ ID NO: 2079859 - RNA, 16 nt, Human
cugugucccucucucu

SEQ ID NO: 2079860 - RNA, 19 nt, Human
cugugucccucucucugga

SEQ ID NO: 2079861 - RNA, 20 nt, Human
cugugucccucucucuggaa

SEQ ID NO: 2079862 - RNA, 20 nt, Human
cuguguccugguuagcagag

SEQ ID NO: 2079863 - RNA, 14 nt, Human
cuguguccuugcac

SEQ ID NO: 2079864 - RNA, 16 nt, Human
cuguguccuugcaccu

SEQ ID NO: 2079865 - RNA, 18 nt, Human
cuguguccuugcaccugc

SEQ ID NO: 2079866 - RNA, 19 nt, Human
cuguguccuugcaccugca

SEQ ID NO: 2079867 - RNA, 16 nt, Human
cugugucguagccaag

SEQ ID NO: 2079868 - RNA, 22 nt, Human
cuguguccuugcaccugcaucc

SEQ ID NO: 2079869 - RNA, 14 nt, Human
cugugucacuacgu

SEQ ID NO: 2079870 - RNA, 17 nt, Human
cugugucagcauagaag

SEQ ID NO: 2079871 - RNA, 19 nt, Human
cugugucagcauagaagua

SEQ ID NO: 2079872 - RNA, 23 nt, Human
cugucggagcccugucuccucuc

SEQ ID NO: 2079873 - RNA, 17 nt, Human
cugucggagcccugucu

SEQ ID NO: 2079874 - RNA, 16 nt, Human
cugucgcccagucugg

SEQ ID NO: 2079875 - RNA, 13 nt, Human
cugucgcccagug

SEQ ID NO: 2079876 - RNA, 15 nt, Human
cugucgcccagucug

SEQ ID NO: 2079877 - RNA, 20 nt, Human
cuguagguucaugcccaagc

SEQ ID NO: 2079878 - RNA, 14 nt, Human
cuguagucccagcu

SEQ ID NO: 2079879 - RNA, 19 nt, Human
cugucauaagaaugaauaa

SEQ ID NO: 2079880 - RNA, 16 nt, Human
cugucauaucuucaca

SEQ ID NO: 2079881 - RNA, 18 nt, Human
cugucauaucuucacaau

SEQ ID NO: 2079882 - RNA, 22 nt, Human
cugucauaugcucugauuuauc

SEQ ID NO: 2079883 - RNA, 21 nt, Human
cuguccugggagugagcuggu

SEQ ID NO: 2079884 - RNA, 18 nt, Human
cugucaucuaccuuuucu

SEQ ID NO: 2079885 - RNA, 21 nt, Human
cugucaucuaccuuuucucuu

SEQ ID NO: 2079886 - RNA, 12 nt, Human
cuguccuccucg

SEQ ID NO: 2079887 - RNA, 23 nt, Human
cuguccuccucggaucaccgaga

SEQ ID NO: 2079888 - RNA, 16 nt, Human
cuguccucuuucagaa

SEQ ID NO: 2079889 - RNA, 19 nt, Human
cuguccucuuucagaaaac

SEQ ID NO: 2079890 - RNA, 20 nt, Human
cuguccucuuucagaaaaca

SEQ ID NO: 2079891 - RNA, 21 nt, Human
cuguccucuuucagaaaacag

SEQ ID NO: 2079892 - RNA, 20 nt, Human
cugguugguguugcagaagg

SEQ ID NO: 2079893 - RNA, 21 nt, Human
cugguugguguugcagaaggu

SEQ ID NO: 2079894 - RNA, 13 nt, Human
cugguugucauuu

SEQ ID NO: 2079895 - RNA, 14 nt, Human
cugguugucauuuu

SEQ ID NO: 2079896 - RNA, 14 nt, Human
cuggucuuguaaga

SEQ ID NO: 2079897 - RNA, 15 nt, Human
cuggucuuguaagag

SEQ ID NO: 2079898 - RNA, 14 nt, Human
cuggucuugagaug

SEQ ID NO: 2079899 - RNA, 15 nt, Human
cuggucuugagaugu

SEQ ID NO: 2079900 - RNA, 14 nt, Human
cuggugacaccagc

SEQ ID NO: 2079901 - RNA, 17 nt, Human
cuggugacaccagccuu

SEQ ID NO: 2079902 - RNA, 15 nt, Human
cuggugacaccagcc

SEQ ID NO: 2079903 - RNA, 16 nt, Human
cuggugacaccagccu

SEQ ID NO: 2079904 - RNA, 15 nt, Human
cugguugucauuuuu

SEQ ID NO: 2079905 - RNA, 18 nt, Human
cugguuucacuggcccaa

SEQ ID NO: 2079906 - RNA, 13 nt, Human
cugguuucacugg

SEQ ID NO: 2079907 - RNA, 17 nt, Human
cugguuucacuggccca

SEQ ID NO: 2079908 - RNA, 12 nt, Human
cuguaaagaauu

SEQ ID NO: 2079909 - RNA, 19 nt, Human
cuguagaaaagggaacuga

SEQ ID NO: 2079910 - RNA, 15 nt, Human
cuguacuucaaguua

SEQ ID NO: 2079911 - RNA, 13 nt, Human
cuguagaguggga

SEQ ID NO: 2079912 - RNA, 18 nt, Human
cuguacuuaauaaauuca

SEQ ID NO: 2079913 - RNA, 22 nt, Human
cuguagaccuagggaggaccuu

SEQ ID NO: 2079914 - RNA, 22 nt, Human
cuguagagcagggcaaguaaca

SEQ ID NO: 2079915 - RNA, 18 nt, Human
cuguaguaaacuauuuau

SEQ ID NO: 2079916 - RNA, 19 nt, Human
cuguaguaaacuauuuauc

SEQ ID NO: 2079917 - RNA, 20 nt, Human
cuguaguaaacuauuuaucu

SEQ ID NO: 2079918 - RNA, 12 nt, Human
cuguagucccag

SEQ ID NO: 2079919 - RNA, 18 nt, Human
cuguaguacuccuuaaga

SEQ ID NO: 2079920 - RNA, 21 nt, Human
cuguaguacuccuuaagaaca

SEQ ID NO: 2079921 - RNA, 23 nt, Human
cuguaguacuccuuaagaacaca

SEQ ID NO: 2079922 - RNA, 13 nt, Human
cuguacuuaauaa

SEQ ID NO: 2079923 - RNA, 16 nt, Human
cuguacuuaauaaauu

SEQ ID NO: 2079924 - RNA, 13 nt, Human
cuguacuggagag

SEQ ID NO: 2079925 - RNA, 15 nt, Human
cuguacuggagagca

SEQ ID NO: 2079926 - RNA, 17 nt, Human
cuguacuggagagcaac

SEQ ID NO: 2079927 - RNA, 18 nt, Human
cuguacuggagagcaaca

SEQ ID NO: 2079928 - RNA, 15 nt, Human
aacugaacauuccag

SEQ ID NO: 2079929 - RNA, 16 nt, Human
aacugaacaaaaaaau

SEQ ID NO: 2079930 - RNA, 16 nt, Human
aacucuguggcauuau

SEQ ID NO: 2079931 - RNA, 21 nt, Human
aacucugggcugcuacccaga

SEQ ID NO: 2079932 - RNA, 22 nt, Human
aacucugggcugcuacccagaa

SEQ ID NO: 2079933 - RNA, 14 nt, Human
aacucugccagcca

SEQ ID NO: 2079934 - RNA, 22 nt, Human
aacucugauguaaaugaaguaa

SEQ ID NO: 2079935 - RNA, 15 nt, Human
gugagucgaggacag

SEQ ID NO: 2079936 - RNA, 20 nt, Human
gugagguggguuuucuuccc

SEQ ID NO: 2079937 - RNA, 14 nt, Human
gugaguaagagcug

SEQ ID NO: 2079938 - RNA, 15 nt, Human
gugaguaagagcugg

SEQ ID NO: 2079939 - RNA, 16 nt, Human
gugaguaagagcuggu

SEQ ID NO: 2079940 - RNA, 16 nt, Human
gugagaggggaacaga

SEQ ID NO: 2079941 - RNA, 13 nt, Human
gugagagcugggu

SEQ ID NO: 2079942 - RNA, 23 nt, Human
gugagagggcaugcgcacaaggc

SEQ ID NO: 2079943 - RNA, 13 nt, Human
gugagagugagcu

SEQ ID NO: 2079944 - RNA, 21 nt, Human
gugagcacuaaggugugcucu

SEQ ID NO: 2079945 - RNA, 17 nt, Human
gugagcagacugguggg

SEQ ID NO: 2079946 - RNA, 16 nt, Human
gugagguugggcagcu

SEQ ID NO: 2079947 - RNA, 12 nt, Human
gugaccccaggu

SEQ ID NO: 2079948 - RNA, 15 nt, Human
gugacccagucagag

SEQ ID NO: 2079949 - RNA, 15 nt, Human
gugagaacuacucag

SEQ ID NO: 2079950 - RNA, 11 nt, Human
gugagaagaau

SEQ ID NO: 2079951 - RNA, 14 nt, Human
gugagaagaauauu

SEQ ID NO: 2079952 - RNA, 15 nt, Human
gugagaagaauauug

SEQ ID NO: 2079953 - RNA, 12 nt, Human
gugagagcuggg

SEQ ID NO: 2079954 - RNA, 18 nt, Human
gugaccauguuuuguuua

SEQ ID NO: 2079955 - RNA, 15 nt, Human
gugaccauuuauaau

SEQ ID NO: 2079956 - RNA, 17 nt, Human
gugaccaaugaugguca

SEQ ID NO: 2079957 - RNA, 14 nt, Human
gugaccaaggagga

SEQ ID NO: 2079958 - RNA, 19 nt, Human
gugaccaaguuauaaauca

SEQ ID NO: 2079959 - RNA, 19 nt, Human
gugacagaggcagccccau

SEQ ID NO: 2079960 - RNA, 18 nt, Human
gugacagaggcagcccca

SEQ ID NO: 2079961 - RNA, 16 nt, Human
gugacagaggcagccc

SEQ ID NO: 2079962 - RNA, 16 nt, Human
gugacaugcgggcugg

SEQ ID NO: 2079963 - RNA, 20 nt, Human
gugacaugcgggcugggcag

SEQ ID NO: 2079964 - RNA, 21 nt, Human
gugacaugcgggcugggcagc

SEQ ID NO: 2079965 - RNA, 22 nt, Human
gugacaugcgggcugggcagcu

SEQ ID NO: 2079966 - RNA, 17 nt, Human
gugaaguauacuguauu

SEQ ID NO: 2079967 - RNA, 19 nt, Human
gugaaguauacuguauuuu

SEQ ID NO: 2079968 - RNA, 13 nt, Human
gugaagauguuug

SEQ ID NO: 2079969 - RNA, 15 nt, Human
gugaagauguuugca

SEQ ID NO: 2079970 - RNA, 18 nt, Human
gugaagauguuugcaaua

SEQ ID NO: 2079971 - RNA, 15 nt, Human
gugaagcauccaggc

SEQ ID NO: 2079972 - RNA, 16 nt, Human
gugaagcauccaggca

SEQ ID NO: 2079973 - RNA, 17 nt, Human
gugaagcauccaggcac

SEQ ID NO: 2079974 - RNA, 20 nt, Human
gugaaggccgagaagcaaga

SEQ ID NO: 2079975 - RNA, 18 nt, Human
gugaagacugggugagga

SEQ ID NO: 2079976 - RNA, 19 nt, Human
gugaagagggagaagcaug

SEQ ID NO: 2079977 - RNA, 17 nt, Human
aacuagaauuucauuua

SEQ ID NO: 2079978 - RNA, 17 nt, Human
aacuagaacugaauuuu

SEQ ID NO: 2079979 - RNA, 16 nt, Human
aacuagaaaucugcca

SEQ ID NO: 2079980 - RNA, 17 nt, Human
aacuagaauuuauucaa

SEQ ID NO: 2079981 - RNA, 22 nt, Human
aacuagaauuuauucaauuccu

SEQ ID NO: 2079982 - RNA, 19 nt, Human
aacuagaauuuauucaauu

SEQ ID NO: 2079983 - RNA, 16 nt, Human
aacuacuguguuccug

SEQ ID NO: 2079984 - RNA, 17 nt, Human
aacuacuguguuccugg

SEQ ID NO: 2079985 - RNA, 14 nt, Human
aacuaauaaaagca

SEQ ID NO: 2079986 - RNA, 15 nt, Human
aacuaauaaaagcau

SEQ ID NO: 2079987 - RNA, 13 nt, Human
aacguuggacuuu

SEQ ID NO: 2079988 - RNA, 18 nt, Human
aaccuuucaaauuucaca

SEQ ID NO: 2079989 - RNA, 14 nt, Human
aaccuuucaaauuu

SEQ ID NO: 2079990 - RNA, 19 nt, Human
aaccuugucucuaugccag

SEQ ID NO: 2079991 - RNA, 23 nt, Human
aaccuugucucuaugccagcuca

SEQ ID NO: 2079992 - RNA, 18 nt, Human
aacgugggaguucagcug

SEQ ID NO: 2079993 - RNA, 23 nt, Human
aacgugggaguucagcugcuucu

SEQ ID NO: 2079994 - RNA, 22 nt, Human
aacguggggcagcacagagagg

SEQ ID NO: 2079995 - RNA, 17 nt, Human
aacguggggcagcacag

SEQ ID NO: 2079996 - RNA, 18 nt, Human
aacguggggcagcacaga

SEQ ID NO: 2079997 - RNA, 18 nt, Human
aacguuaagaauuguuaa

SEQ ID NO: 2079998 - RNA, 16 nt, Human
gucuucauccuuagca

SEQ ID NO: 2079999 - RNA, 21 nt, Human
gucuucauccuuagcaacagc

SEQ ID NO: 2080000 - RNA, 22 nt, Human
gucuucagagauaggccugugg

SEQ ID NO: 2080001 - RNA, 16 nt, Human
gucuuccaccuggaag

SEQ ID NO: 2080002 - RNA, 13 nt, Human
gucuuccauaaug

SEQ ID NO: 2080003 - RNA, 15 nt, Human
gucuuccauaaugua

SEQ ID NO: 2080004 - RNA, 16 nt, Human
gucuucaguaagccgu

SEQ ID NO: 2080005 - RNA, 18 nt, Human
gucuucagggggccaggu

SEQ ID NO: 2080006 - RNA, 17 nt, Human
gucuuccauaauguaua

SEQ ID NO: 2080007 - RNA, 15 nt, Human
gucuucccuaccuca

SEQ ID NO: 2080008 - RNA, 21 nt, Human
gucuuuguaaugucaccaccu

SEQ ID NO: 2080009 - RNA, 19 nt, Human
gucuuuguuaagacugcug

SEQ ID NO: 2080010 - RNA, 22 nt, Human
gucuuuguaaugucaccaccuu

SEQ ID NO: 2080011 - RNA, 21 nt, Human
aaccuguugauagcaagugaa

SEQ ID NO: 2080012 - RNA, 16 nt, Human
aaccuuacuuacagca

SEQ ID NO: 2080013 - RNA, 17 nt, Human
aaccugauguuaaaauu

SEQ ID NO: 2080014 - RNA, 18 nt, Human
aaccugauguuaaaauuc

SEQ ID NO: 2080015 - RNA, 24 nt, Human
gucuuuuaggacccuucccuugag

SEQ ID NO: 2080016 - RNA, 19 nt, Human
aaccauccccuccguggca

SEQ ID NO: 2080017 - RNA, 22 nt, Human
aaccaucccugaugucugucug

SEQ ID NO: 2080018 - RNA, 23 nt, Human
gucucuuuaaugucacaggcagg

SEQ ID NO: 2080019 - RNA, 22 nt, Human
gucucuuuaaugucacaggcag

SEQ ID NO: 2080020 - RNA, 16 nt, Human
gucugaagucacugca

SEQ ID NO: 2080021 - RNA, 20 nt, Human
gucucuuuaaugucacaggc

SEQ ID NO: 2080022 - RNA, 19 nt, Human
gucucuuuaaugucacagg

SEQ ID NO: 2080023 - RNA, 18 nt, Human
gucucuuuaaugucacag

SEQ ID NO: 2080024 - RNA, 17 nt, Human
gucucuuuaaucuucag

SEQ ID NO: 2080025 - RNA, 22 nt, Human
gucuggaucugggacccuuucc

SEQ ID NO: 2080026 - RNA, 14 nt, Human
gucugggggucagg

SEQ ID NO: 2080027 - RNA, 16 nt, Human
gucugggguucagccc

SEQ ID NO: 2080028 - RNA, 17 nt, Human
gucugggguucagcccc

SEQ ID NO: 2080029 - RNA, 18 nt, Human
gucugggguucagccccu

SEQ ID NO: 2080030 - RNA, 20 nt, Human
gucugggguucagccccucc

SEQ ID NO: 2080031 - RNA, 23 nt, Human
gucugggguucagccccuccucu

SEQ ID NO: 2080032 - RNA, 23 nt, Human
gucuucagccuagccgaccucag

SEQ ID NO: 2080033 - RNA, 13 nt, Human
gucuucagccuag

SEQ ID NO: 2080034 - RNA, 15 nt, Human
gucuucagccuagcc

SEQ ID NO: 2080035 - RNA, 13 nt, Human
gucugguuucuag

SEQ ID NO: 2080036 - RNA, 17 nt, Human
gucuucacagcucugug

SEQ ID NO: 2080037 - RNA, 15 nt, Human
gucuucacggcagga

SEQ ID NO: 2080038 - RNA, 12 nt, Human
gucuucagccua

SEQ ID NO: 2080039 - RNA, 16 nt, Human
gucuucacagcucugu

SEQ ID NO: 2080040 - RNA, 14 nt, Human
gucugguuucuaga

SEQ ID NO: 2080041 - RNA, 23 nt, Human
gucugacaggcaaugcuggcugu

SEQ ID NO: 2080042 - RNA, 22 nt, Human
gucugacaggcaaugcuggcug

SEQ ID NO: 2080043 - RNA, 19 nt, Human
gucugaagucacugcacag

SEQ ID NO: 2080044 - RNA, 17 nt, Human
gucugaagucacugcac

SEQ ID NO: 2080045 - RNA, 21 nt, Human
gucugacaggcaaugcuggcu

SEQ ID NO: 2080046 - RNA, 18 nt, Human
gucuggagaauaauucuu

SEQ ID NO: 2080047 - RNA, 21 nt, Human
gucuggagaauaauucuuuga

SEQ ID NO: 2080048 - RNA, 10 nt, Human
gucuggaggg

SEQ ID NO: 2080049 - RNA, 11 nt, Human
gucuggagggg

SEQ ID NO: 2080050 - RNA, 23 nt, Human
gucuggaggggagcucugucugu

SEQ ID NO: 2080051 - RNA, 18 nt, Human
gucucuuuaaucuucagu

SEQ ID NO: 2080052 - RNA, 19 nt, Human
gucuggacauucagaacac

SEQ ID NO: 2080053 - RNA, 14 nt, Human
gucuggagaagcag

SEQ ID NO: 2080054 - RNA, 17 nt, Human
gucuggagaagcaguga

SEQ ID NO: 2080055 - RNA, 19 nt, Human
gucuggagaagcagugagc

SEQ ID NO: 2080056 - RNA, 16 nt, Human
gucucaaacuccugac

SEQ ID NO: 2080057 - RNA, 19 nt, Human
gucucaaaaaaagaaaaag

SEQ ID NO: 2080058 - RNA, 22 nt, Human
gucucaaacucuugaccucagg

SEQ ID NO: 2080059 - RNA, 15 nt, Human
gucuaugggacucaa

SEQ ID NO: 2080060 - RNA, 14 nt, Human
gucuaugggacuca

SEQ ID NO: 2080061 - RNA, 20 nt, Human
gucucaaaccuccaaaagcc

SEQ ID NO: 2080062 - RNA, 20 nt, Human
gucucaaacuccugggcuca

SEQ ID NO: 2080063 - RNA, 16 nt, Human
gucucaaacuccuggg

SEQ ID NO: 2080064 - RNA, 17 nt, Human
gucucaagagggcacug

SEQ ID NO: 2080065 - RNA, 15 nt, Human
gucucaagagggcac

SEQ ID NO: 2080066 - RNA, 22 nt, Human
gucucaagagggcacugguggc

SEQ ID NO: 2080067 - RNA, 20 nt, Human
gucucaagagggcacuggug

SEQ ID NO: 2080068 - RNA, 15 nt, Human
gucucaggucccugc

SEQ ID NO: 2080069 - RNA, 19 nt, Human
gucucacaguguugcccag

SEQ ID NO: 2080070 - RNA, 23 nt, Human
gucucacaguguugcccaggcug

SEQ ID NO: 2080071 - RNA, 16 nt, Human
gucucaggucccugca

SEQ ID NO: 2080072 - RNA, 15 nt, Human
gucuccagaccccca

SEQ ID NO: 2080073 - RNA, 16 nt, Human
gucucaguccaccuga

SEQ ID NO: 2080074 - RNA, 16 nt, Human
aaccaaauauuccaga

SEQ ID NO: 2080075 - RNA, 19 nt, Human
aaccaacccuucccugaaa

SEQ ID NO: 2080076 - RNA, 20 nt, Human
aaccaacccuucccugaaaa

SEQ ID NO: 2080077 - RNA, 12 nt, Human
aaccaaaugcau

SEQ ID NO: 2080078 - RNA, 15 nt, Human
aaccaaaugcaucaa

SEQ ID NO: 2080079 - RNA, 17 nt, Human
aaccaaaugcaucaauc

SEQ ID NO: 2080080 - RNA, 18 nt, Human
aaccaaaugcaucaaucc

SEQ ID NO: 2080081 - RNA, 23 nt, Human
aaccaaaugcaucaauccugugu

SEQ ID NO: 2080082 - RNA, 16 nt, Human
aaccaacuuuucuauu

SEQ ID NO: 2080083 - RNA, 16 nt, Human
aaccacagcccuguca

SEQ ID NO: 2080084 - RNA, 12 nt, Human
aaccacagcccu

SEQ ID NO: 2080085 - RNA, 13 nt, Human
aaccacagcccug

SEQ ID NO: 2080086 - RNA, 14 nt, Human
aaccacagcccugu

SEQ ID NO: 2080087 - RNA, 15 nt, Human
aaccacagcccuguc

SEQ ID NO: 2080088 - RNA, 13 nt, Human
aaccacaucuugc

SEQ ID NO: 2080089 - RNA, 16 nt, Human
aacauuuugucauaua

SEQ ID NO: 2080090 - RNA, 13 nt, Human
aacauuuucacac

SEQ ID NO: 2080091 - RNA, 13 nt, Human
gucuccauguuug

SEQ ID NO: 2080092 - RNA, 17 nt, Human
gucuccagacccccacc

SEQ ID NO: 2080093 - RNA, 20 nt, Human
gucuccagacccccaccccu

SEQ ID NO: 2080094 - RNA, 11 nt, Human
gucuccagccc

SEQ ID NO: 2080095 - RNA, 23 nt, Human
gucgcccagucuggaaugcagug

SEQ ID NO: 2080096 - RNA, 14 nt, Human
gucgaggacaggga

SEQ ID NO: 2080097 - RNA, 22 nt, Human
guccuuuuguaccaugguguga

SEQ ID NO: 2080098 - RNA, 17 nt, Human
guccuuuuguaccaugg

SEQ ID NO: 2080099 - RNA, 14 nt, Human
gucgcccagucugg

SEQ ID NO: 2080100 - RNA, 13 nt, Human
gucgcccagucug

SEQ ID NO: 2080101 - RNA, 12 nt, Human
gucgcccaggag

SEQ ID NO: 2080102 - RNA, 13 nt, Human
gucgcccaggaga

SEQ ID NO: 2080103 - RNA, 21 nt, Human
aacauuacucugaaauuguaa

SEQ ID NO: 2080104 - RNA, 15 nt, Human
aacauuauauugcaa

SEQ ID NO: 2080105 - RNA, 23 nt, Human
aacauuaaaacaauauuguuucu

SEQ ID NO: 2080106 - RNA, 21 nt, Human
aacauuaaaacaauauuguuu

SEQ ID NO: 2080107 - RNA, 21 nt, Human
guccugcuauuucccaagcug

SEQ ID NO: 2080108 - RNA, 18 nt, Human
guccuuggggacaucuca

SEQ ID NO: 2080109 - RNA, 22 nt, Human
guccugcucucuacccagccca

SEQ ID NO: 2080110 - RNA, 23 nt, Human
guccugcucucuacccagcccau

SEQ ID NO: 2080111 - RNA, 12 nt, Human
guccuugcacac

SEQ ID NO: 2080112 - RNA, 22 nt, Human
guccuugcacacuccccugcac

SEQ ID NO: 2080113 - RNA, 14 nt, Human
guccuugcaccugc

SEQ ID NO: 2080114 - RNA, 15 nt, Human
guccuugcaccugca

SEQ ID NO: 2080115 - RNA, 16 nt, Human
guccuugcaccugcau

SEQ ID NO: 2080116 - RNA, 17 nt, Human
guccuugcaccugcauc

SEQ ID NO: 2080117 - RNA, 18 nt, Human
guccuugcaccugcaucc

SEQ ID NO: 2080118 - RNA, 21 nt, Human
guagccucgccgucugugaau

SEQ ID NO: 2080119 - RNA, 15 nt, Human
guagccuugcccgga

SEQ ID NO: 2080120 - RNA, 23 nt, Human
guagccuugcccggauucuggga

SEQ ID NO: 2080121 - RNA, 22 nt, Human
guagcucuaggagggcuggcaa

SEQ ID NO: 2080122 - RNA, 14 nt, Human
guagcuagaggaac

SEQ ID NO: 2080123 - RNA, 15 nt, Human
guagcuagaggaacc

SEQ ID NO: 2080124 - RNA, 17 nt, Human
guagcuagaggaaccaa

SEQ ID NO: 2080125 - RNA, 23 nt, Human
guagcuccucaacucaccuaaug

SEQ ID NO: 2080126 - RNA, 14 nt, Human
guccaugugugugc

SEQ ID NO: 2080127 - RNA, 13 nt, Human
guccaugugugug

SEQ ID NO: 2080128 - RNA, 18 nt, Human
gucccaccuuggcugcag

SEQ ID NO: 2080129 - RNA, 17 nt, Human
gucccaccuuggcugca

SEQ ID NO: 2080130 - RNA, 19 nt, Human
gucccaccuuggcugcagg

SEQ ID NO: 2080131 - RNA, 21 nt, Human
guccgaaagggacuuggaagc

SEQ ID NO: 2080132 - RNA, 22 nt, Human
guccgaaagggacuuggaagcu

SEQ ID NO: 2080133 - RNA, 16 nt, Human
gucccgauuguaacuc

SEQ ID NO: 2080134 - RNA, 14 nt, Human
guccguuuacucca

SEQ ID NO: 2080135 - RNA, 22 nt, Human
gucccuuucuuggccaguuauc

SEQ ID NO: 2080136 - RNA, 12 nt, Human
aacaggucuccu

SEQ ID NO: 2080137 - RNA, 13 nt, Human
aacaggucuccuc

SEQ ID NO: 2080138 - RNA, 15 nt, Human
aacaggucuccucuu

SEQ ID NO: 2080139 - RNA, 17 nt, Human
aacaggucuccucuuaa

SEQ ID NO: 2080140 - RNA, 18 nt, Human
aacaggucuccucuuaaa

SEQ ID NO: 2080141 - RNA, 19 nt, Human
aacaggucuccucuuaaaa

SEQ ID NO: 2080142 - RNA, 14 nt, Human
aacagguggagaaa

SEQ ID NO: 2080143 - RNA, 20 nt, Human
aacaggucuccucuuaaaaa

SEQ ID NO: 2080144 - RNA, 17 nt, Human
aacagucuucaggcaaa

SEQ ID NO: 2080145 - RNA, 23 nt, Human
aacagaugcaaugugcuacugau

SEQ ID NO: 2080146 - RNA, 21 nt, Human
aacagaugcaaugugcuacug

SEQ ID NO: 2080147 - RNA, 22 nt, Human
aacagaugcaaugugcuacuga

SEQ ID NO: 2080148 - RNA, 19 nt, Human
aacagagugagacccuguc

SEQ ID NO: 2080149 - RNA, 17 nt, Human
aacagaggccauggcag

SEQ ID NO: 2080150 - RNA, 21 nt, Human
aacagaggccauggcagaaua

SEQ ID NO: 2080151 - RNA, 13 nt, Human
aacagagauguga

SEQ ID NO: 2080152 - RNA, 19 nt, Human
aacagagacaggcccaaga

SEQ ID NO: 2080153 - RNA, 15 nt, Human
aacagagaaggcagg

SEQ ID NO: 2080154 - RNA, 16 nt, Human
aacagagaaggcagga

SEQ ID NO: 2080155 - RNA, 18 nt, Human
guccuaagucccugcccc

SEQ ID NO: 2080156 - RNA, 17 nt, Human
guccuacaguggcuguc

SEQ ID NO: 2080157 - RNA, 18 nt, Human
aacagacuggccugagga

SEQ ID NO: 2080158 - RNA, 23 nt, Human
aacagacuggccugaggagcagc

SEQ ID NO: 2080159 - RNA, 13 nt, Human
aacagagaaggca

SEQ ID NO: 2080160 - RNA, 20 nt, Human
aacagacuggaagcacagcu

SEQ ID NO: 2080161 - RNA, 13 nt, Human
guccuacccaccc

SEQ ID NO: 2080162 - RNA, 14 nt, Human
aacaucaacaucuu

SEQ ID NO: 2080163 - RNA, 17 nt, Human
aacauaugcaaacauaa

SEQ ID NO: 2080164 - RNA, 17 nt, Human
aacauaugaaaauacaa

SEQ ID NO: 2080165 - RNA, 22 nt, Human
aacauguuuuucuucucccuca

SEQ ID NO: 2080166 - RNA, 17 nt, Human
aacauguuacugaccag

SEQ ID NO: 2080167 - RNA, 13 nt, Human
aacauauuuguua

SEQ ID NO: 2080168 - RNA, 20 nt, Human
aacauauuuguuaaauauuu

SEQ ID NO: 2080169 - RNA, 22 nt, Human
aacauauuuguuaaauauuuac

SEQ ID NO: 2080170 - RNA, 16 nt, Human
aacauguuacugacca

SEQ ID NO: 2080171 - RNA, 12 nt, Human
aacauguuggua

SEQ ID NO: 2080172 - RNA, 14 nt, Human
aacauguugguauu

SEQ ID NO: 2080173 - RNA, 15 nt, Human
aacauguugguauuu

SEQ ID NO: 2080174 - RNA, 16 nt, Human
aacauguugguauuua

SEQ ID NO: 2080175 - RNA, 18 nt, Human
aacauguugguauuuauc

SEQ ID NO: 2080176 - RNA, 19 nt, Human
aacauguugguauuuaucu

SEQ ID NO: 2080177 - RNA, 21 nt, Human
aacauguugguauuuaucuau

SEQ ID NO: 2080178 - RNA, 18 nt, Human
aacagucuuacugcaggc

SEQ ID NO: 2080179 - RNA, 14 nt, Human
aacauaacaaauaa

SEQ ID NO: 2080180 - RNA, 21 nt, Human
aacauaaccauuacagggagc

SEQ ID NO: 2080181 - RNA, 16 nt, Human
aagcaagauuucagau

SEQ ID NO: 2080182 - RNA, 17 nt, Human
aagcaaaucagaaacuu

SEQ ID NO: 2080183 - RNA, 14 nt, Human
aagcaaacacauua

SEQ ID NO: 2080184 - RNA, 13 nt, Human
aagcaaacacauu

SEQ ID NO: 2080185 - RNA, 12 nt, Human
aagcaaacacau

SEQ ID NO: 2080186 - RNA, 22 nt, Human
aagcaaaauuauagaaguuuag

SEQ ID NO: 2080187 - RNA, 16 nt, Human
aagaugucagacuggc

SEQ ID NO: 2080188 - RNA, 14 nt, Human
aagaugacuuccca

SEQ ID NO: 2080189 - RNA, 15 nt, Human
aagaugacuucccaa

SEQ ID NO: 2080190 - RNA, 17 nt, Human
aagaugagagaacugga

SEQ ID NO: 2080191 - RNA, 18 nt, Human
aagaugagagaacuggag

SEQ ID NO: 2080192 - RNA, 15 nt, Human
aagaugcaaggacca

SEQ ID NO: 2080193 - RNA, 20 nt, Human
aagaugcaaggaccaggacu

SEQ ID NO: 2080194 - RNA, 18 nt, Human
gugguuauggagagggug

SEQ ID NO: 2080195 - RNA, 23 nt, Human
gugguuaaugccauggacagaag

SEQ ID NO: 2080196 - RNA, 15 nt, Human
aagaucacuuugcuc

SEQ ID NO: 2080197 - RNA, 18 nt, Human
aagaucacuuugcucuga

SEQ ID NO: 2080198 - RNA, 21 nt, Human
aagauccugucuuuaaggaaa

SEQ ID NO: 2080199 - RNA, 14 nt, Human
gugguuauuuuuau

SEQ ID NO: 2080200 - RNA, 19 nt, Human
gugguuauuuuuauacagu

SEQ ID NO: 2080201 - RNA, 17 nt, Human
guguguguauguuugca

SEQ ID NO: 2080202 - RNA, 12 nt, Human
guguguguaugu

SEQ ID NO: 2080203 - RNA, 14 nt, Human
gugugugugugugu

SEQ ID NO: 2080204 - RNA, 13 nt, Human
gugugugugugug

SEQ ID NO: 2080205 - RNA, 18 nt, Human
gugugguugcucacagcu

SEQ ID NO: 2080206 - RNA, 15 nt, Human
gugugguuuagugua

SEQ ID NO: 2080207 - RNA, 17 nt, Human
gugugguuuaguguaaa

SEQ ID NO: 2080208 - RNA, 18 nt, Human
gugugguuuaguguaaaa

SEQ ID NO: 2080209 - RNA, 22 nt, Human
gugugguuuaguguaaaaauga

SEQ ID NO: 2080210 - RNA, 14 nt, Human
guguucuguuguuu

SEQ ID NO: 2080211 - RNA, 17 nt, Human
guguucuguuuguuaaa

SEQ ID NO: 2080212 - RNA, 14 nt, Human
guguguuauuuaaa

SEQ ID NO: 2080213 - RNA, 18 nt, Human
guguguucugauuagaaa

SEQ ID NO: 2080214 - RNA, 20 nt, Human
gugucccaaaaagaaaggag

SEQ ID NO: 2080215 - RNA, 19 nt, Human
gugucuugcaauggcagcc

SEQ ID NO: 2080216 - RNA, 14 nt, Human
guguccaugugugu

SEQ ID NO: 2080217 - RNA, 15 nt, Human
guguccaugugugug

SEQ ID NO: 2080218 - RNA, 16 nt, Human
guguccaugugugugc

SEQ ID NO: 2080219 - RNA, 13 nt, Human
guguccaucccag

SEQ ID NO: 2080220 - RNA, 19 nt, Human
guguccaucccagcggcug

SEQ ID NO: 2080221 - RNA, 16 nt, Human
aagcaaggaucuuuca

SEQ ID NO: 2080222 - RNA, 19 nt, Human
aagcaaggaucuuucaccc

SEQ ID NO: 2080223 - RNA, 21 nt, Human
gugucuugcaauggcagccuu

SEQ ID NO: 2080224 - RNA, 15 nt, Human
gugucuuguguuuuu

SEQ ID NO: 2080225 - RNA, 17 nt, Human
gugugaguaagagcugg

SEQ ID NO: 2080226 - RNA, 18 nt, Human
gugugagucaccaagccc

SEQ ID NO: 2080227 - RNA, 13 nt, Human
gugugagucacca

SEQ ID NO: 2080228 - RNA, 14 nt, Human
gugggucaaggaau

SEQ ID NO: 2080229 - RNA, 20 nt, Human
guggguagaucacgagauca

SEQ ID NO: 2080230 - RNA, 22 nt, Human
gugguggaaacuuuucuuaaaa

SEQ ID NO: 2080231 - RNA, 18 nt, Human
gugguggcccacgccugu

SEQ ID NO: 2080232 - RNA, 18 nt, Human
gugguggcucacgccugu

SEQ ID NO: 2080233 - RNA, 22 nt, Human
gugguggcagugcagcaaccag

SEQ ID NO: 2080234 - RNA, 23 nt, Human
gugguggcauacgccuguagucc

SEQ ID NO: 2080235 - RNA, 21 nt, Human
guggcuucccgcucagcccuc

SEQ ID NO: 2080236 - RNA, 13 nt, Human
guggcuucugaug

SEQ ID NO: 2080237 - RNA, 17 nt, Human
guggcuuucagagccuc

SEQ ID NO: 2080238 - RNA, 17 nt, Human
guggcccgacagccugg

SEQ ID NO: 2080239 - RNA, 21 nt, Human
guggccucaacccucccucag

SEQ ID NO: 2080240 - RNA, 13 nt, Human
guggccucagaau

SEQ ID NO: 2080241 - RNA, 11 nt, Human
guggccucaga

SEQ ID NO: 2080242 - RNA, 12 nt, Human
guggccucagaa

SEQ ID NO: 2080243 - RNA, 14 nt, Human
gugggauggaggag

SEQ ID NO: 2080244 - RNA, 16 nt, Human
gugggauggaggagaa

SEQ ID NO: 2080245 - RNA, 17 nt, Human
gugggauggaggagaag

SEQ ID NO: 2080246 - RNA, 12 nt, Human
gugggagcugag

SEQ ID NO: 2080247 - RNA, 19 nt, Human
gugggagcagcgguuuggg

SEQ ID NO: 2080248 - RNA, 13 nt, Human
gugggagagccca

SEQ ID NO: 2080249 - RNA, 14 nt, Human
gugggagagcccag

SEQ ID NO: 2080250 - RNA, 13 nt, Human
gugggagaggucu

SEQ ID NO: 2080251 - RNA, 15 nt, Human
gugggagagcccagc

SEQ ID NO: 2080252 - RNA, 17 nt, Human
gugggaacgugacugcc

SEQ ID NO: 2080253 - RNA, 16 nt, Human
guggcccgacagccug

SEQ ID NO: 2080254 - RNA, 14 nt, Human
aagagcuauacagu

SEQ ID NO: 2080255 - RNA, 15 nt, Human
aagagcuauacaguu

SEQ ID NO: 2080256 - RNA, 16 nt, Human
aagagcuagcgcugcc

SEQ ID NO: 2080257 - RNA, 19 nt, Human
aagagcuagcgcugccgca

SEQ ID NO: 2080258 - RNA, 20 nt, Human
aagagcuagcgcugccgcac

SEQ ID NO: 2080259 - RNA, 11 nt, Human
aagagcugagg

SEQ ID NO: 2080260 - RNA, 18 nt, Human
aagagcugaggcaauucu

SEQ ID NO: 2080261 - RNA, 18 nt, Human
aagagaugggcuuguuuu

SEQ ID NO: 2080262 - RNA, 20 nt, Human
aagagaugggcuuguuuucu

SEQ ID NO: 2080263 - RNA, 15 nt, Human
aagagauuccugagc

SEQ ID NO: 2080264 - RNA, 16 nt, Human
aagacuguacaaagua

SEQ ID NO: 2080265 - RNA, 17 nt, Human
aagagaugggcuuguuu

SEQ ID NO: 2080266 - RNA, 14 nt, Human
aagaccccugucuu

SEQ ID NO: 2080267 - RNA, 16 nt, Human
aagagauugugguuuc

SEQ ID NO: 2080268 - RNA, 19 nt, Human
aagagauugugguuucauu

SEQ ID NO: 2080269 - RNA, 12 nt, Human
aagaccagucca

SEQ ID NO: 2080270 - RNA, 17 nt, Human
aagacucauucuucugu

SEQ ID NO: 2080271 - RNA, 14 nt, Human
aagacucaguguuc

SEQ ID NO: 2080272 - RNA, 14 nt, Human
aacuuggaaauagu

SEQ ID NO: 2080273 - RNA, 23 nt, Human
aacuuggaaaaauccagaaagaa

SEQ ID NO: 2080274 - RNA, 17 nt, Human
gugccuggguggggcug

SEQ ID NO: 2080275 - RNA, 18 nt, Human
gugccuggguggggcugc

SEQ ID NO: 2080276 - RNA, 15 nt, Human
aacuuggagccccag

SEQ ID NO: 2080277 - RNA, 15 nt, Human
aacuuguaaaugugg

SEQ ID NO: 2080278 - RNA, 15 nt, Human
aacuuguaaaugcug

SEQ ID NO: 2080279 - RNA, 18 nt, Human
aacuuguaaaugcuguca

SEQ ID NO: 2080280 - RNA, 15 nt, Human
aacuugguuauacau

SEQ ID NO: 2080281 - RNA, 21 nt, Human
aacuugguuauacaugacacu

SEQ ID NO: 2080282 - RNA, 14 nt, Human
gugccugcaccagg

SEQ ID NO: 2080283 - RNA, 15 nt, Human
gugccugcaccagga

SEQ ID NO: 2080284 - RNA, 17 nt, Human
gugccugcaccaggaga

SEQ ID NO: 2080285 - RNA, 18 nt, Human
gugccugcaccaggagac

SEQ ID NO: 2080286 - RNA, 19 nt, Human
gugccugcaccaggagaca

SEQ ID NO: 2080287 - RNA, 21 nt, Human
gugccugcaccaggagacaga

SEQ ID NO: 2080288 - RNA, 11 nt, Human
gugccugcagc

SEQ ID NO: 2080289 - RNA, 12 nt, Human
gugccuggagcu

SEQ ID NO: 2080290 - RNA, 17 nt, Human
gugccuggagcuccugg

SEQ ID NO: 2080291 - RNA, 18 nt, Human
gugccuggagcuccuggg

SEQ ID NO: 2080292 - RNA, 19 nt, Human
gugccuggagcuccuggga

SEQ ID NO: 2080293 - RNA, 23 nt, Human
gugccugggaaccuuccugucuu

SEQ ID NO: 2080294 - RNA, 15 nt, Human
gugccugggaaugua

SEQ ID NO: 2080295 - RNA, 16 nt, Human
gugccugggaauguau

SEQ ID NO: 2080296 - RNA, 17 nt, Human
gugccugggaauguauu

SEQ ID NO: 2080297 - RNA, 14 nt, Human
gugccucugggacu

SEQ ID NO: 2080298 - RNA, 15 nt, Human
gugccucugggacug

SEQ ID NO: 2080299 - RNA, 12 nt, Human
gugccugagagu

SEQ ID NO: 2080300 - RNA, 17 nt, Human
gugcacacaccagagcc

SEQ ID NO: 2080301 - RNA, 18 nt, Human
gugcacguacacacacau

SEQ ID NO: 2080302 - RNA, 15 nt, Human
gugcacggccagcug

SEQ ID NO: 2080303 - RNA, 15 nt, Human
gugcacguggagagc

SEQ ID NO: 2080304 - RNA, 16 nt, Human
gugcacguggagagcu

SEQ ID NO: 2080305 - RNA, 18 nt, Human
gugcacguggagagcugg

SEQ ID NO: 2080306 - RNA, 14 nt, Human
gugcacacaccaga

SEQ ID NO: 2080307 - RNA, 12 nt, Human
gugcacacacca

SEQ ID NO: 2080308 - RNA, 15 nt, Human
aacugcauggaccua

SEQ ID NO: 2080309 - RNA, 21 nt, Human
aacugcauggaccuaacauuc

SEQ ID NO: 2080310 - RNA, 14 nt, Human
aacugcauguauaa

SEQ ID NO: 2080311 - RNA, 18 nt, Human
aacugcauguauaaauga

SEQ ID NO: 2080312 - RNA, 19 nt, Human
aacugcauguauaaaugaa

SEQ ID NO: 2080313 - RNA, 21 nt, Human
gugcacguggagagcuggugc

SEQ ID NO: 2080314 - RNA, 14 nt, Human
gugccaagcacagu

SEQ ID NO: 2080315 - RNA, 16 nt, Human
gugccaagcacagugc

SEQ ID NO: 2080316 - RNA, 17 nt, Human
gugccaagcacagugcc

SEQ ID NO: 2080317 - RNA, 18 nt, Human
gugccaagcacagugccu

SEQ ID NO: 2080318 - RNA, 19 nt, Human
gugccaagcacagugccug

SEQ ID NO: 2080319 - RNA, 15 nt, Human
aagaaaaguuuugua

SEQ ID NO: 2080320 - RNA, 16 nt, Human
aagaaaaguuuuguaa

SEQ ID NO: 2080321 - RNA, 21 nt, Human
aagaaaaguuuuguaaauuuc

SEQ ID NO: 2080322 - RNA, 22 nt, Human
aagaaaaguuuuguaaauuucu

SEQ ID NO: 2080323 - RNA, 16 nt, Human
aagaaaagugggccag

SEQ ID NO: 2080324 - RNA, 16 nt, Human
aagaaaauacaauaaa

SEQ ID NO: 2080325 - RNA, 17 nt, Human
aagaaaauacaauaaac

SEQ ID NO: 2080326 - RNA, 18 nt, Human
aagaaaauacaauaaacu

SEQ ID NO: 2080327 - RNA, 12 nt, Human
aagaaaaaucag

SEQ ID NO: 2080328 - RNA, 16 nt, Human
aagaaaagagcuuucu

SEQ ID NO: 2080329 - RNA, 12 nt, Human
aagaaaagaauc

SEQ ID NO: 2080330 - RNA, 20 nt, Human
aagaaaagaaucccuguuca

SEQ ID NO: 2080331 - RNA, 22 nt, Human
aagaaaagguucuuacugcuug

SEQ ID NO: 2080332 - RNA, 22 nt, Human
aagaaaaguagguuuacauuca

SEQ ID NO: 2080333 - RNA, 15 nt, Human
aagaaaagugggcca

SEQ ID NO: 2080334 - RNA, 20 nt, Human
aacuugucuuuuucuggacu

SEQ ID NO: 2080335 - RNA, 17 nt, Human
aacuuguauuaaagaca

SEQ ID NO: 2080336 - RNA, 23 nt, Human
aagaaaguuuccccaccagugaa

SEQ ID NO: 2080337 - RNA, 14 nt, Human
aagaagcucucucc

SEQ ID NO: 2080338 - RNA, 15 nt, Human
aagaagcucucuccu

SEQ ID NO: 2080339 - RNA, 12 nt, Human
aagaaggcuggg

SEQ ID NO: 2080340 - RNA, 17 nt, Human
aagaagccgggaacaga

SEQ ID NO: 2080341 - RNA, 13 nt, Human
aagaaaguuuccc

SEQ ID NO: 2080342 - RNA, 15 nt, Human
aagaaaguuucccca

SEQ ID NO: 2080343 - RNA, 18 nt, Human
aagaaaggggcaggagcu

SEQ ID NO: 2080344 - RNA, 21 nt, Human
aagaaaggggcaggagcucag

SEQ ID NO: 2080345 - RNA, 14 nt, Human
aagaaaauaaaauu

SEQ ID NO: 2080346 - RNA, 15 nt, Human
aagaaaauaaaauua

SEQ ID NO: 2080347 - RNA, 22 nt, Human
aagaaaauaaaauuaagaaugu

SEQ ID NO: 2080348 - RNA, 13 nt, Human
aagaaaauaugca

SEQ ID NO: 2080349 - RNA, 23 nt, Human
aagaaaaucagauggagcaugaa

SEQ ID NO: 2080350 - RNA, 13 nt, Human
guggacuggaagg

SEQ ID NO: 2080351 - RNA, 21 nt, Human
guggacuagaccuccagcugu

SEQ ID NO: 2080352 - RNA, 22 nt, Human
guggcaaagccuucauugccuu

SEQ ID NO: 2080353 - RNA, 15 nt, Human
guggcaagaccaaaa

SEQ ID NO: 2080354 - RNA, 22 nt, Human
guggcacacaccuguaguccca

SEQ ID NO: 2080355 - RNA, 14 nt, Human
guggcagcugcggu

SEQ ID NO: 2080356 - RNA, 23 nt, Human
guggcacauuuuuuuuuuuaauu

SEQ ID NO: 2080357 - RNA, 17 nt, Human
guggcagaaguguuuca

SEQ ID NO: 2080358 - RNA, 20 nt, Human
guggcagauaaucagccucu

SEQ ID NO: 2080359 - RNA, 21 nt, Human
guggcagauaaucagccucuu

SEQ ID NO: 2080360 - RNA, 23 nt, Human
guggcagauaaucagccucuuaa

SEQ ID NO: 2080361 - RNA, 13 nt, Human
guggcaccagcag

SEQ ID NO: 2080362 - RNA, 14 nt, Human
guggcaccagcagc

SEQ ID NO: 2080363 - RNA, 20 nt, Human
aagaauuuucagaccccagc

SEQ ID NO: 2080364 - RNA, 13 nt, Human
aagaauuuuuaaa

SEQ ID NO: 2080365 - RNA, 22 nt, Human
aagaauuuucagaccccagcgg

SEQ ID NO: 2080366 - RNA, 12 nt, Human
aagaccagccug

SEQ ID NO: 2080367 - RNA, 13 nt, Human
aagaccagccugg

SEQ ID NO: 2080368 - RNA, 14 nt, Human
aagaccagccuggc

SEQ ID NO: 2080369 - RNA, 16 nt, Human
aagaauugaacccagg

SEQ ID NO: 2080370 - RNA, 18 nt, Human
aagaauugaacccaggag

SEQ ID NO: 2080371 - RNA, 20 nt, Human
aagaauuucuugguaagaag

SEQ ID NO: 2080372 - RNA, 22 nt, Human
aagaauuucuugguaagaagcc

SEQ ID NO: 2080373 - RNA, 23 nt, Human
aagaauuucuugguaagaagccg

SEQ ID NO: 2080374 - RNA, 17 nt, Human
aagaauuccuacaauau

SEQ ID NO: 2080375 - RNA, 23 nt, Human
aagaauuccuacaauauauauuc

SEQ ID NO: 2080376 - RNA, 19 nt, Human
aagaauucuccaaaacaau

SEQ ID NO: 2080377 - RNA, 20 nt, Human
aagaauucuccaaaacaauu

SEQ ID NO: 2080378 - RNA, 17 nt, Human
guggcagcugcggucca

SEQ ID NO: 2080379 - RNA, 18 nt, Human
guggcagauuuuacaaaa

SEQ ID NO: 2080380 - RNA, 19 nt, Human
guggcagauuuuacaaaag

SEQ ID NO: 2080381 - RNA, 22 nt, Human
guggcagauuuuacaaaagaug

SEQ ID NO: 2080382 - RNA, 15 nt, Human
aagaauauuguuccu

SEQ ID NO: 2080383 - RNA, 21 nt, Human
aagaauauuguuccuaaguuc

SEQ ID NO: 2080384 - RNA, 22 nt, Human
aagaauauuguuccuaaguucu

SEQ ID NO: 2080385 - RNA, 23 nt, Human
aagaagguuucagaaagaagugg

SEQ ID NO: 2080386 - RNA, 17 nt, Human
aagaaggguccuucccu

SEQ ID NO: 2080387 - RNA, 21 nt, Human
aagaaggguccuucccucucc

SEQ ID NO: 2080388 - RNA, 24 nt, Human
aagaaggguccuucccucucccca

SEQ ID NO: 2080389 - RNA, 15 nt, Human
aagaaguaggcauga

SEQ ID NO: 2080390 - RNA, 16 nt, Human
gugcugcuucccucug

SEQ ID NO: 2080391 - RNA, 13 nt, Human
gugcugcuucccu

SEQ ID NO: 2080392 - RNA, 24 nt, Human
guggacacagcucuucuccaggcu

SEQ ID NO: 2080393 - RNA, 17 nt, Human
guggacacagcucuucu

SEQ ID NO: 2080394 - RNA, 15 nt, Human
guggacacagcucuu

SEQ ID NO: 2080395 - RNA, 14 nt, Human
guggacacagcucu

SEQ ID NO: 2080396 - RNA, 21 nt, Human
guggacaccaggagucccugg

SEQ ID NO: 2080397 - RNA, 22 nt, Human
guggacaccaggagucccuggu

SEQ ID NO: 2080398 - RNA, 15 nt, Human
guggacaccaggagu

SEQ ID NO: 2080399 - RNA, 15 nt, Human
gugcugugaccauuu

SEQ ID NO: 2080400 - RNA, 18 nt, Human
gugcugugaccauuuaua

SEQ ID NO: 2080401 - RNA, 19 nt, Human
gugcuguggccugggcaag

SEQ ID NO: 2080402 - RNA, 16 nt, Human
gugcuguggccugggc

SEQ ID NO: 2080403 - RNA, 17 nt, Human
gugcuguggccugggca

SEQ ID NO: 2080404 - RNA, 11 nt, Human
gugcuguggcc

SEQ ID NO: 2080405 - RNA, 11 nt, Human
guggaaggaaa

SEQ ID NO: 2080406 - RNA, 12 nt, Human
guggaaggaaag

SEQ ID NO: 2080407 - RNA, 18 nt, Human
guggaagcccuccuucca

SEQ ID NO: 2080408 - RNA, 16 nt, Human
guggaagcccuccuuc

SEQ ID NO: 2080409 - RNA, 17 nt, Human
guggaagcccuccuucc

SEQ ID NO: 2080410 - RNA, 13 nt, Human
guggaagcccucc

SEQ ID NO: 2080411 - RNA, 14 nt, Human
guggaagcccuccu

SEQ ID NO: 2080412 - RNA, 19 nt, Human
uaaauuuuuuuuguuucau

SEQ ID NO: 2080413 - RNA, 14 nt, Human
uaaauuuucuucag

SEQ ID NO: 2080414 - RNA, 15 nt, Human
uaaauuuucuucagu

SEQ ID NO: 2080415 - RNA, 16 nt, Human
uaaauuuucuucaguu

SEQ ID NO: 2080416 - RNA, 18 nt, Human
uaaauuuucuucaguugg

SEQ ID NO: 2080417 - RNA, 15 nt, Human
uaaauuuuaauuuau

SEQ ID NO: 2080418 - RNA, 18 nt, Human
uaacaaaaacuacacaua

SEQ ID NO: 2080419 - RNA, 12 nt, Human
uaacaaauuaug

SEQ ID NO: 2080420 - RNA, 18 nt, Human
uaacaagaaacucacccc

SEQ ID NO: 2080421 - RNA, 13 nt, Human
uaacaagaaagga

SEQ ID NO: 2080422 - RNA, 14 nt, Human
uaacaagaaaggag

SEQ ID NO: 2080423 - RNA, 15 nt, Human
uaacaagaaaggaga

SEQ ID NO: 2080424 - RNA, 17 nt, Human
uaacaagaaaggagagu

SEQ ID NO: 2080425 - RNA, 13 nt, Human
uaacaagagugau

SEQ ID NO: 2080426 - RNA, 14 nt, Human
uaacaagagugauu

SEQ ID NO: 2080427 - RNA, 19 nt, Human
uaacaagagugauucuugc

SEQ ID NO: 2080428 - RNA, 20 nt, Human
uaacaagagugauucuugcu

SEQ ID NO: 2080429 - RNA, 16 nt, Human
uaacaagaucuuucag

SEQ ID NO: 2080430 - RNA, 17 nt, Human
uaacaagaucuuucagg

SEQ ID NO: 2080431 - RNA, 18 nt, Human
uaacaagaucuuucagga

SEQ ID NO: 2080432 - RNA, 14 nt, Human
uaacaagaaacuca

SEQ ID NO: 2080433 - RNA, 15 nt, Human
uaacaagaaaacaua

SEQ ID NO: 2080434 - RNA, 15 nt, Human
uaacaaccaaagacu

SEQ ID NO: 2080435 - RNA, 22 nt, Human
uaacaacuaugauuuggaaaau

SEQ ID NO: 2080436 - RNA, 21 nt, Human
uaacaacuaugauuuggaaaa

SEQ ID NO: 2080437 - RNA, 16 nt, Human
uaacaacuaugauuug

SEQ ID NO: 2080438 - RNA, 13 nt, Human
uaacaagccaccc

SEQ ID NO: 2080439 - RNA, 17 nt, Human
uaaaugaggggccucag

SEQ ID NO: 2080440 - RNA, 22 nt, Human
uaaauuaccaguaaaguguaac

SEQ ID NO: 2080441 - RNA, 14 nt, Human
uaaauuaggaauaa

SEQ ID NO: 2080442 - RNA, 17 nt, Human
uaaauuaggaauaaaua

SEQ ID NO: 2080443 - RNA, 18 nt, Human
uaaauuaguauuuauuua

SEQ ID NO: 2080444 - RNA, 14 nt, Human
uaaaugauguugaa

SEQ ID NO: 2080445 - RNA, 17 nt, Human
uaaauuauaacuuaaaa

SEQ ID NO: 2080446 - RNA, 21 nt, Human
uaaauuaggaauaaauaaaaa

SEQ ID NO: 2080447 - RNA, 22 nt, Human
uaaauuaggaauaaauaaaaau

SEQ ID NO: 2080448 - RNA, 18 nt, Human
uaaauaaccccauucuuu

SEQ ID NO: 2080449 - RNA, 19 nt, Human
uaaauaaccccauucuuug

SEQ ID NO: 2080450 - RNA, 21 nt, Human
uaaauaaccccauucuuugcu

SEQ ID NO: 2080451 - RNA, 18 nt, Human
uaaauaaaugucauuaaa

SEQ ID NO: 2080452 - RNA, 22 nt, Human
uaaauaaauguaucuuauucac

SEQ ID NO: 2080453 - RNA, 16 nt, Human
uaaauaaaugucauua

SEQ ID NO: 2080454 - RNA, 23 nt, Human
aauacacauagcauguaauggua

SEQ ID NO: 2080455 - RNA, 14 nt, Human
aauacaauaaguua

SEQ ID NO: 2080456 - RNA, 11 nt, Human
aauacaauaaa

SEQ ID NO: 2080457 - RNA, 12 nt, Human
aauacaauaaac

SEQ ID NO: 2080458 - RNA, 13 nt, Human
aauacaauaaacu

SEQ ID NO: 2080459 - RNA, 18 nt, Human
aauaauuauccagaguuu

SEQ ID NO: 2080460 - RNA, 16 nt, Human
aauacaaguucuauuu

SEQ ID NO: 2080461 - RNA, 20 nt, Human
aauacaaguucuauuuaagu

SEQ ID NO: 2080462 - RNA, 23 nt, Human
aauacaaguucuauuuaagugua

SEQ ID NO: 2080463 - RNA, 19 nt, Human
uaaauccuuuuucuuuaua

SEQ ID NO: 2080464 - RNA, 11 nt, Human
uaaauccuguu

SEQ ID NO: 2080465 - RNA, 14 nt, Human
uaaauccuguugaa

SEQ ID NO: 2080466 - RNA, 15 nt, Human
uaaauccuguugaaa

SEQ ID NO: 2080467 - RNA, 16 nt, Human
uaaauccuguugaaaa

SEQ ID NO: 2080468 - RNA, 17 nt, Human
uaaauccuguugaaaag

SEQ ID NO: 2080469 - RNA, 18 nt, Human
uaaauccuguugaaaagc

SEQ ID NO: 2080470 - RNA, 23 nt, Human
uaaauccuguugaaaagccaugu

SEQ ID NO: 2080471 - RNA, 23 nt, Human
uaaaucccauucauaacuuucau

SEQ ID NO: 2080472 - RNA, 15 nt, Human
uaaaucccauucaua

SEQ ID NO: 2080473 - RNA, 17 nt, Human
uaaauccuuuuucuuua

SEQ ID NO: 2080474 - RNA, 20 nt, Human
uaaauaguaaaaauaaaauu

SEQ ID NO: 2080475 - RNA, 19 nt, Human
uaaauaguaaaaauaaaau

SEQ ID NO: 2080476 - RNA, 19 nt, Human
uaaauagcuauauccaugu

SEQ ID NO: 2080477 - RNA, 20 nt, Human
uaaauagcuauauccaugua

SEQ ID NO: 2080478 - RNA, 22 nt, Human
uaaauagcuauauccauguacu

SEQ ID NO: 2080479 - RNA, 15 nt, Human
uaaauagcuauaucc

SEQ ID NO: 2080480 - RNA, 16 nt, Human
uaaauagcuauaucca

SEQ ID NO: 2080481 - RNA, 17 nt, Human
uaaauagcuauauccau

SEQ ID NO: 2080482 - RNA, 18 nt, Human
uaaauagcuauauccaug

SEQ ID NO: 2080483 - RNA, 14 nt, Human
uaaauagcuauauc

SEQ ID NO: 2080484 - RNA, 18 nt, Human
uaaauacacaacacacac

SEQ ID NO: 2080485 - RNA, 19 nt, Human
uaaauacacauagcaugua

SEQ ID NO: 2080486 - RNA, 19 nt, Human
uaaauacaaguucuauuua

SEQ ID NO: 2080487 - RNA, 16 nt, Human
aauaaaaucuugaaaa

SEQ ID NO: 2080488 - RNA, 18 nt, Human
aauaaaauaucauucagc

SEQ ID NO: 2080489 - RNA, 19 nt, Human
aauaaaauaucauucagca

SEQ ID NO: 2080490 - RNA, 20 nt, Human
aauaaaauaucauucagcaa

SEQ ID NO: 2080491 - RNA, 12 nt, Human
aauaaaauauca

SEQ ID NO: 2080492 - RNA, 12 nt, Human
aauaaaauauaa

SEQ ID NO: 2080493 - RNA, 14 nt, Human
aauaaaauauaauu

SEQ ID NO: 2080494 - RNA, 15 nt, Human
aauaaaauauaauug

SEQ ID NO: 2080495 - RNA, 21 nt, Human
aauaaaauauaauuguuuuuu

SEQ ID NO: 2080496 - RNA, 12 nt, Human
aauaaaauaacc

SEQ ID NO: 2080497 - RNA, 14 nt, Human
aauaaaauaucauu

SEQ ID NO: 2080498 - RNA, 15 nt, Human
aauaaaauaucauuc

SEQ ID NO: 2080499 - RNA, 16 nt, Human
aauaaaauaucauuca

SEQ ID NO: 2080500 - RNA, 17 nt, Human
aauaaaauaucauucag

SEQ ID NO: 2080501 - RNA, 21 nt, Human
aauaaaauaucauucagcaac

SEQ ID NO: 2080502 - RNA, 14 nt, Human
aauaaaguauauaa

SEQ ID NO: 2080503 - RNA, 15 nt, Human
aauaaaguauauaau

SEQ ID NO: 2080504 - RNA, 15 nt, Human
aauaaaguauauaua

SEQ ID NO: 2080505 - RNA, 14 nt, Human
aauaaaguaauuau

SEQ ID NO: 2080506 - RNA, 11 nt, Human
aauaaaaucau

SEQ ID NO: 2080507 - RNA, 18 nt, Human
aauaaaaucauguacauu

SEQ ID NO: 2080508 - RNA, 13 nt, Human
aauaaaaggucua

SEQ ID NO: 2080509 - RNA, 16 nt, Human
aauaaaaauaaauuug

SEQ ID NO: 2080510 - RNA, 22 nt, Human
aauaaaaaccaagaagaugucu

SEQ ID NO: 2080511 - RNA, 14 nt, Human
aauaaaaaccaaga

SEQ ID NO: 2080512 - RNA, 19 nt, Human
aauaaaaacugacuccuua

SEQ ID NO: 2080513 - RNA, 21 nt, Human
aauaaaaacugacuccuuaga

SEQ ID NO: 2080514 - RNA, 18 nt, Human
aauaaaagcagcaucugc

SEQ ID NO: 2080515 - RNA, 21 nt, Human
aauaaaagcagcaucugcuaa

SEQ ID NO: 2080516 - RNA, 19 nt, Human
aauaaaagaaaugcacaau

SEQ ID NO: 2080517 - RNA, 17 nt, Human
aauaaaaauuaaggcaa

SEQ ID NO: 2080518 - RNA, 19 nt, Human
aauaaaaauuaaggcaacu

SEQ ID NO: 2080519 - RNA, 13 nt, Human
aauaaaaauggau

SEQ ID NO: 2080520 - RNA, 13 nt, Human
uaaaguguauuau

SEQ ID NO: 2080521 - RNA, 18 nt, Human
uaaaguguauuauaacag

SEQ ID NO: 2080522 - RNA, 13 nt, Human
uaaaguguaacau

SEQ ID NO: 2080523 - RNA, 16 nt, Human
uaaaguguaacauaug

SEQ ID NO: 2080524 - RNA, 15 nt, Human
aauaaaaaagucucu

SEQ ID NO: 2080525 - RNA, 16 nt, Human
uaaaguguaaauccuu

SEQ ID NO: 2080526 - RNA, 22 nt, Human
uaaaguguaaauccuuuuucuu

SEQ ID NO: 2080527 - RNA, 15 nt, Human
uaaagucuugcugug

SEQ ID NO: 2080528 - RNA, 19 nt, Human
uaaagucuugcuguggucu

SEQ ID NO: 2080529 - RNA, 16 nt, Human
uaaagugauaauuucu

SEQ ID NO: 2080530 - RNA, 21 nt, Human
uaaagggaaaggauucaugug

SEQ ID NO: 2080531 - RNA, 17 nt, Human
uaaagucagguccaauu

SEQ ID NO: 2080532 - RNA, 18 nt, Human
uaaagucagguccaauuu

SEQ ID NO: 2080533 - RNA, 18 nt, Human
aauaaauuugguucuaau

SEQ ID NO: 2080534 - RNA, 21 nt, Human
aauaaauuugguucuaauaga

SEQ ID NO: 2080535 - RNA, 14 nt, Human
aauaaauucagaua

SEQ ID NO: 2080536 - RNA, 16 nt, Human
aauaacacagagagac

SEQ ID NO: 2080537 - RNA, 23 nt, Human
aauaacacagagagacagacuug

SEQ ID NO: 2080538 - RNA, 9 nt, Human
aauaaagua

SEQ ID NO: 2080539 - RNA, 12 nt, Human
aauaacauguaa

SEQ ID NO: 2080540 - RNA, 19 nt, Human
aauaacauguaauuaagua

SEQ ID NO: 2080541 - RNA, 22 nt, Human
aauaacauguaauuaaguacua

SEQ ID NO: 2080542 - RNA, 12 nt, Human
aauaaauuauuu

SEQ ID NO: 2080543 - RNA, 15 nt, Human
aauaaauaucuguac

SEQ ID NO: 2080544 - RNA, 21 nt, Human
aauaaauuaaauaaaauaacc

SEQ ID NO: 2080545 - RNA, 16 nt, Human
aauaaauacauucuug

SEQ ID NO: 2080546 - RNA, 19 nt, Human
aauaaauagcuauauccau

SEQ ID NO: 2080547 - RNA, 21 nt, Human
aauaaauagcuauauccaugu

SEQ ID NO: 2080548 - RNA, 14 nt, Human
aauaaauaaaugca

SEQ ID NO: 2080549 - RNA, 12 nt, Human
aauaaauaaaug

SEQ ID NO: 2080550 - RNA, 13 nt, Human
aauaagcuaaaga

SEQ ID NO: 2080551 - RNA, 17 nt, Human
aauaagcaucaaacucu

SEQ ID NO: 2080552 - RNA, 14 nt, Human
aauaagcuaaagag

SEQ ID NO: 2080553 - RNA, 19 nt, Human
aauaacuacuguguuccug

SEQ ID NO: 2080554 - RNA, 17 nt, Human
aauaacuacuguguucc

SEQ ID NO: 2080555 - RNA, 18 nt, Human
aauaacuacuguguuccu

SEQ ID NO: 2080556 - RNA, 13 nt, Human
aauaacuacugug

SEQ ID NO: 2080557 - RNA, 14 nt, Human
aauaacuacugugu

SEQ ID NO: 2080558 - RNA, 15 nt, Human
aauaacuacuguguu

SEQ ID NO: 2080559 - RNA, 16 nt, Human
aauaacuacuguguuc

SEQ ID NO: 2080560 - RNA, 19 nt, Human
aauaacuccucauuguaaa

SEQ ID NO: 2080561 - RNA, 19 nt, Human
aauaacuaguguugcuugg

SEQ ID NO: 2080562 - RNA, 16 nt, Human
aauaacauaacaaaua

SEQ ID NO: 2080563 - RNA, 17 nt, Human
aauaacauaacaaauaa

SEQ ID NO: 2080564 - RNA, 20 nt, Human
aauaacauaauuuguacaua

SEQ ID NO: 2080565 - RNA, 15 nt, Human
aauaacuaaaaggua

SEQ ID NO: 2080566 - RNA, 17 nt, Human
aauaaggccuuaauaug

SEQ ID NO: 2080567 - RNA, 19 nt, Human
uaaacccaguaguggugac

SEQ ID NO: 2080568 - RNA, 20 nt, Human
uaaaccccaccuuuauuccu

SEQ ID NO: 2080569 - RNA, 16 nt, Human
uaaaccgccaaggcug

SEQ ID NO: 2080570 - RNA, 18 nt, Human
uaaaccgccaaggcuggg

SEQ ID NO: 2080571 - RNA, 15 nt, Human
uaaacguuucaguaa

SEQ ID NO: 2080572 - RNA, 22 nt, Human
uaaacguuucaguaauaaaaca

SEQ ID NO: 2080573 - RNA, 23 nt, Human
uaaacuaaugaguuucuuuuaua

SEQ ID NO: 2080574 - RNA, 22 nt, Human
uaaacgugaugaucagcuguuu

SEQ ID NO: 2080575 - RNA, 17 nt, Human
uaaacgugaugaucagc

SEQ ID NO: 2080576 - RNA, 16 nt, Human
uaaacugcauuagaaa

SEQ ID NO: 2080577 - RNA, 17 nt, Human
uaaacucauuucuagca

SEQ ID NO: 2080578 - RNA, 12 nt, Human
uaaacucauuuc

SEQ ID NO: 2080579 - RNA, 14 nt, Human
uaaacuaggaaaau

SEQ ID NO: 2080580 - RNA, 17 nt, Human
uaaacuaggaaaauugg

SEQ ID NO: 2080581 - RNA, 17 nt, Human
uaaacuauuggaaagua

SEQ ID NO: 2080582 - RNA, 10 nt, Human
uaaagacaga

SEQ ID NO: 2080583 - RNA, 15 nt, Human
uaaagacagaggcag

SEQ ID NO: 2080584 - RNA, 9 nt, Human
uaaagacag

SEQ ID NO: 2080585 - RNA, 22 nt, Human
uaaagacaaagacaaauucugu

SEQ ID NO: 2080586 - RNA, 15 nt, Human
uaaagacaccuacug

SEQ ID NO: 2080587 - RNA, 19 nt, Human
uaaagacaaagacaaauuc

SEQ ID NO: 2080588 - RNA, 20 nt, Human
uaaagacaaagacaaauucu

SEQ ID NO: 2080589 - RNA, 21 nt, Human
uaaagacccuaaaucugagga

SEQ ID NO: 2080590 - RNA, 17 nt, Human
uaaagacgauuugucag

SEQ ID NO: 2080591 - RNA, 13 nt, Human
uaaagagaaaauu

SEQ ID NO: 2080592 - RNA, 14 nt, Human
uaaagagaaaauug

SEQ ID NO: 2080593 - RNA, 15 nt, Human
uaaagagaaaauuga

SEQ ID NO: 2080594 - RNA, 16 nt, Human
uaaagagaaaauugaa

SEQ ID NO: 2080595 - RNA, 17 nt, Human
uaaagagaaaauugaau

SEQ ID NO: 2080596 - RNA, 19 nt, Human
uaaagagaaaauugaauuu

SEQ ID NO: 2080597 - RNA, 20 nt, Human
uaaagagaaaauugaauuua

SEQ ID NO: 2080598 - RNA, 23 nt, Human
uaaagagaaaauugaauuuaaca

SEQ ID NO: 2080599 - RNA, 11 nt, Human
uaaagagaaac

SEQ ID NO: 2080600 - RNA, 12 nt, Human
uaaagagaaacu

SEQ ID NO: 2080601 - RNA, 13 nt, Human
uaaagagaaacuu

SEQ ID NO: 2080602 - RNA, 14 nt, Human
uaaagagaaacuuu

SEQ ID NO: 2080603 - RNA, 15 nt, Human
uaaagagaaacuuug

SEQ ID NO: 2080604 - RNA, 19 nt, Human
uaaagagaaacuuugugcu

SEQ ID NO: 2080605 - RNA, 20 nt, Human
uaaagagaaacuuugugcua

SEQ ID NO: 2080606 - RNA, 14 nt, Human
uaaagacaaaaaac

SEQ ID NO: 2080607 - RNA, 11 nt, Human
uaaagacaaag

SEQ ID NO: 2080608 - RNA, 15 nt, Human
uaaagacaaagacaa

SEQ ID NO: 2080609 - RNA, 15 nt, Human
uaaagaaucauuauu

SEQ ID NO: 2080610 - RNA, 17 nt, Human
uaaagaaucauuauuua

SEQ ID NO: 2080611 - RNA, 15 nt, Human
uaaagaauaauaugc

SEQ ID NO: 2080612 - RNA, 14 nt, Human
uaaagaagguuuca

SEQ ID NO: 2080613 - RNA, 13 nt, Human
uaaagauggaaaa

SEQ ID NO: 2080614 - RNA, 22 nt, Human
uaaagaugcaaggaccaggacu

SEQ ID NO: 2080615 - RNA, 20 nt, Human
uaaagaguuguguuguucuu

SEQ ID NO: 2080616 - RNA, 21 nt, Human
uaaagaguuguguuguucuuu

SEQ ID NO: 2080617 - RNA, 21 nt, Human
uaaagaugcaaggaccaggac

SEQ ID NO: 2080618 - RNA, 12 nt, Human
uaaagaguucuu

SEQ ID NO: 2080619 - RNA, 13 nt, Human
uaaagauauuauu

SEQ ID NO: 2080620 - RNA, 14 nt, Human
uaaagauauuauuc

SEQ ID NO: 2080621 - RNA, 15 nt, Human
uaaagauauuauuca

SEQ ID NO: 2080622 - RNA, 16 nt, Human
uaaagauauuauucac

SEQ ID NO: 2080623 - RNA, 18 nt, Human
uaaagaguuaguuugagu

SEQ ID NO: 2080624 - RNA, 20 nt, Human
uaaagaggcugaaagaggcc

SEQ ID NO: 2080625 - RNA, 12 nt, Human
uaaagagagaau

SEQ ID NO: 2080626 - RNA, 17 nt, Human
uaaagaggcugaaagag

SEQ ID NO: 2080627 - RNA, 14 nt, Human
uaaagauuucuuga

SEQ ID NO: 2080628 - RNA, 20 nt, Human
uaaaggcuauacuugucuug

SEQ ID NO: 2080629 - RNA, 17 nt, Human
aaguuacacauuuuuca

SEQ ID NO: 2080630 - RNA, 23 nt, Human
aaguuacauugcuggucuuguaa

SEQ ID NO: 2080631 - RNA, 18 nt, Human
aaguuaaacauugaagua

SEQ ID NO: 2080632 - RNA, 14 nt, Human
aaguuaaauuuuau

SEQ ID NO: 2080633 - RNA, 17 nt, Human
aaguuaaagugaauaac

SEQ ID NO: 2080634 - RNA, 12 nt, Human
aaguuaaauaaa

SEQ ID NO: 2080635 - RNA, 14 nt, Human
aaguuaaauaaauc

SEQ ID NO: 2080636 - RNA, 16 nt, Human
aaguuacuauccuggc

SEQ ID NO: 2080637 - RNA, 18 nt, Human
aaguuacuauccuggcuu

SEQ ID NO: 2080638 - RNA, 12 nt, Human
aaguuacuuugu

SEQ ID NO: 2080639 - RNA, 15 nt, Human
aaguuacuuauucua

SEQ ID NO: 2080640 - RNA, 16 nt, Human
aaguuacuuauucuag

SEQ ID NO: 2080641 - RNA, 19 nt, Human
aaguuacuuugucagaggc

SEQ ID NO: 2080642 - RNA, 17 nt, Human
aaguuauuaauuucuuc

SEQ ID NO: 2080643 - RNA, 19 nt, Human
aaguuauuaauauuuuaau

SEQ ID NO: 2080644 - RNA, 18 nt, Human
aaguuauuaauuucuuca

SEQ ID NO: 2080645 - RNA, 20 nt, Human
guuuuuuuuuccuguccuuc

SEQ ID NO: 2080646 - RNA, 19 nt, Human
guuuuuuuuuccuguccuu

SEQ ID NO: 2080647 - RNA, 17 nt, Human
aaguguuguaaauauuu

SEQ ID NO: 2080648 - RNA, 23 nt, Human
aaguguuggcuaaugaagggaaa

SEQ ID NO: 2080649 - RNA, 18 nt, Human
aaguguuguaaauauuua

SEQ ID NO: 2080650 - RNA, 20 nt, Human
aaguguuguaaauauuuaug

SEQ ID NO: 2080651 - RNA, 22 nt, Human
aaguguuguaaauauuuaugua

SEQ ID NO: 2080652 - RNA, 13 nt, Human
aaguguuuucaga

SEQ ID NO: 2080653 - RNA, 14 nt, Human
aaguguuuucagag

SEQ ID NO: 2080654 - RNA, 15 nt, Human
aaguguuuucagagc

SEQ ID NO: 2080655 - RNA, 17 nt, Human
aaguuaaaaaaaauaau

SEQ ID NO: 2080656 - RNA, 18 nt, Human
aaguuaaaaaaaauaaua

SEQ ID NO: 2080657 - RNA, 20 nt, Human
aaguuaaaaaaaauaauaaa

SEQ ID NO: 2080658 - RNA, 21 nt, Human
aaguuaaaaaaaauaauaaau

SEQ ID NO: 2080659 - RNA, 23 nt, Human
aaguguuucauaaauuugagagu

SEQ ID NO: 2080660 - RNA, 20 nt, Human
aaguguuuccuucauuucug

SEQ ID NO: 2080661 - RNA, 21 nt, Human
aaguguuuccuucauuucuga

SEQ ID NO: 2080662 - RNA, 14 nt, Human
aaguuuaauugacu

SEQ ID NO: 2080663 - RNA, 12 nt, Human
aaguucuauuua

SEQ ID NO: 2080664 - RNA, 15 nt, Human
aaguucuauuuaagu

SEQ ID NO: 2080665 - RNA, 17 nt, Human
aaguucuauuuaagugu

SEQ ID NO: 2080666 - RNA, 15 nt, Human
aaguucugaguguuu

SEQ ID NO: 2080667 - RNA, 18 nt, Human
aaguuuacaaucaaagga

SEQ ID NO: 2080668 - RNA, 19 nt, Human
aaguuuacaaucaaaggaa

SEQ ID NO: 2080669 - RNA, 17 nt, Human
aaguuuagauuuuaauc

SEQ ID NO: 2080670 - RNA, 14 nt, Human
aaguucauaggguc

SEQ ID NO: 2080671 - RNA, 14 nt, Human
aaguuauugacaaa

SEQ ID NO: 2080672 - RNA, 18 nt, Human
aaguuauugacaaacucu

SEQ ID NO: 2080673 - RNA, 22 nt, Human
uaaacaaacuguguaacugccc

SEQ ID NO: 2080674 - RNA, 18 nt, Human
uaaacaaacuguguaacu

SEQ ID NO: 2080675 - RNA, 19 nt, Human
uaaacaaacuguguaacug

SEQ ID NO: 2080676 - RNA, 19 nt, Human
uaaaauuaaagcugaaaac

SEQ ID NO: 2080677 - RNA, 12 nt, Human
uaaaauuaaaga

SEQ ID NO: 2080678 - RNA, 13 nt, Human
uaaaauuaaagaa

SEQ ID NO: 2080679 - RNA, 14 nt, Human
uaaaauuaaagaaa

SEQ ID NO: 2080680 - RNA, 14 nt, Human
uaaaauuaaagcua

SEQ ID NO: 2080681 - RNA, 10 nt, Human
uaaaauuaag

SEQ ID NO: 2080682 - RNA, 14 nt, Human
uaaaauuaagaaug

SEQ ID NO: 2080683 - RNA, 15 nt, Human
uaaaauuaagaaugu

SEQ ID NO: 2080684 - RNA, 18 nt, Human
uaaaauuaagaauguucu

SEQ ID NO: 2080685 - RNA, 18 nt, Human
uaaaauuaaagcugaaaa

SEQ ID NO: 2080686 - RNA, 16 nt, Human
uaaaauuaaagcugaa

SEQ ID NO: 2080687 - RNA, 16 nt, Human
uaaaauuuugccuaau

SEQ ID NO: 2080688 - RNA, 19 nt, Human
uaaaauuuugccuaauaca

SEQ ID NO: 2080689 - RNA, 17 nt, Human
uaaaauuuuaucucuua

SEQ ID NO: 2080690 - RNA, 15 nt, Human
aaguuuugcauuuau

SEQ ID NO: 2080691 - RNA, 15 nt, Human
aaguuuguguucugu

SEQ ID NO: 2080692 - RNA, 19 nt, Human
aaguuuguguucuguuugu

SEQ ID NO: 2080693 - RNA, 21 nt, Human
aaguuuguguucuguuuguua

SEQ ID NO: 2080694 - RNA, 22 nt, Human
aaguuuguguucuguuuguuaa

SEQ ID NO: 2080695 - RNA, 23 nt, Human
aaguuuucagaaccucuucccca

SEQ ID NO: 2080696 - RNA, 11 nt, Human
aaguuuucagg

SEQ ID NO: 2080697 - RNA, 23 nt, Human
aaguuuauaagaggaugaaguga

SEQ ID NO: 2080698 - RNA, 15 nt, Human
aaguuuauacaguac

SEQ ID NO: 2080699 - RNA, 18 nt, Human
aaguuuauacaguacagu

SEQ ID NO: 2080700 - RNA, 20 nt, Human
aaguuucacugacuuagaac

SEQ ID NO: 2080701 - RNA, 12 nt, Human
aaguuucauuua

SEQ ID NO: 2080702 - RNA, 13 nt, Human
aaguuucauuuau

SEQ ID NO: 2080703 - RNA, 13 nt, Human
aaguuuccaagca

SEQ ID NO: 2080704 - RNA, 15 nt, Human
aaguuuccaagcaaa

SEQ ID NO: 2080705 - RNA, 16 nt, Human
aaguuuccaagcaaau

SEQ ID NO: 2080706 - RNA, 19 nt, Human
aaguuuccaagcaaauguu

SEQ ID NO: 2080707 - RNA, 20 nt, Human
aaguuuccaagcaaauguua

SEQ ID NO: 2080708 - RNA, 20 nt, Human
aaguucauaacagugccauu

SEQ ID NO: 2080709 - RNA, 16 nt, Human
aaguuucaguugauuu

SEQ ID NO: 2080710 - RNA, 14 nt, Human
aaguuugcacugua

SEQ ID NO: 2080711 - RNA, 21 nt, Human
aaguuugcacuguaugcugga

SEQ ID NO: 2080712 - RNA, 19 nt, Human
guuugcacuguaugcugga

SEQ ID NO: 2080713 - RNA, 20 nt, Human
guuugcacuguaugcuggac

SEQ ID NO: 2080714 - RNA, 22 nt, Human
guuugcagaaaagcaccugccg

SEQ ID NO: 2080715 - RNA, 19 nt, Human
guuugcagaaaagcaccug

SEQ ID NO: 2080716 - RNA, 22 nt, Human
guuugcacuguaugcuggacgg

SEQ ID NO: 2080717 - RNA, 21 nt, Human
guuugcagaaaagcaccugcc

SEQ ID NO: 2080718 - RNA, 21 nt, Human
guuugcagaagggggucucuu

SEQ ID NO: 2080719 - RNA, 20 nt, Human
guuugcagagcuugaacaca

SEQ ID NO: 2080720 - RNA, 14 nt, Human
guuugccugagggc

SEQ ID NO: 2080721 - RNA, 17 nt, Human
guuugccucugccucug

SEQ ID NO: 2080722 - RNA, 14 nt, Human
guuucucagcuccc

SEQ ID NO: 2080723 - RNA, 23 nt, Human
guuucuagguaauuuuuacagaa

SEQ ID NO: 2080724 - RNA, 15 nt, Human
guuucuagggaaaug

SEQ ID NO: 2080725 - RNA, 18 nt, Human
guuucuagggaaaugaaa

SEQ ID NO: 2080726 - RNA, 14 nt, Human
guuucucccccugg

SEQ ID NO: 2080727 - RNA, 15 nt, Human
guuucucccccuggg

SEQ ID NO: 2080728 - RNA, 17 nt, Human
guuucucccccugggcu

SEQ ID NO: 2080729 - RNA, 22 nt, Human
guuucucccccugggcucugcc

SEQ ID NO: 2080730 - RNA, 23 nt, Human
guuucucccccugggcucugccc

SEQ ID NO: 2080731 - RNA, 12 nt, Human
guuucucugcug

SEQ ID NO: 2080732 - RNA, 13 nt, Human
guuucucugcugu

SEQ ID NO: 2080733 - RNA, 17 nt, Human
guuugcucaccuggggu

SEQ ID NO: 2080734 - RNA, 15 nt, Human
guuugcucagaacac

SEQ ID NO: 2080735 - RNA, 18 nt, Human
guuugcucagaacacauu

SEQ ID NO: 2080736 - RNA, 16 nt, Human
guuuggcgggccaagg

SEQ ID NO: 2080737 - RNA, 18 nt, Human
guuuggcgggccaaggac

SEQ ID NO: 2080738 - RNA, 21 nt, Human
guuuggcgggccaaggacugc

SEQ ID NO: 2080739 - RNA, 16 nt, Human
guuuuaagaggcaggg

SEQ ID NO: 2080740 - RNA, 16 nt, Human
guuuuaaggaagaaaa

SEQ ID NO: 2080741 - RNA, 18 nt, Human
guuuuaaggaagaaaaau

SEQ ID NO: 2080742 - RNA, 19 nt, Human
guuuuaaggaagaaaaauc

SEQ ID NO: 2080743 - RNA, 14 nt, Human
guuuuaagaggcag

SEQ ID NO: 2080744 - RNA, 14 nt, Human
guuuuacugcuuuu

SEQ ID NO: 2080745 - RNA, 15 nt, Human
guuuuacugcagcuu

SEQ ID NO: 2080746 - RNA, 13 nt, Human
guuuuagaaaaca

SEQ ID NO: 2080747 - RNA, 16 nt, Human
guuuuacugcagcuuu

SEQ ID NO: 2080748 - RNA, 18 nt, Human
guuuuacugcagcuuugu

SEQ ID NO: 2080749 - RNA, 18 nt, Human
guuuuauacuguacuuaa

SEQ ID NO: 2080750 - RNA, 23 nt, Human
guuuuauacuguacuuaauaaau

SEQ ID NO: 2080751 - RNA, 19 nt, Human
aaggcugagaggagagaga

SEQ ID NO: 2080752 - RNA, 19 nt, Human
aaggcugaccaagagagaa

SEQ ID NO: 2080753 - RNA, 14 nt, Human
guuguaaauauuua

SEQ ID NO: 2080754 - RNA, 20 nt, Human
guuguaaauauuuauguaaa

SEQ ID NO: 2080755 - RNA, 13 nt, Human
aagggcccagaga

SEQ ID NO: 2080756 - RNA, 15 nt, Human
aagggcccagagagg

SEQ ID NO: 2080757 - RNA, 23 nt, Human
aaggcugaggaaaggccagcugg

SEQ ID NO: 2080758 - RNA, 17 nt, Human
aaggcugaggaaaggcc

SEQ ID NO: 2080759 - RNA, 19 nt, Human
aaggcugaggaaaggccag

SEQ ID NO: 2080760 - RNA, 20 nt, Human
aaggcugaggaaaggccagc

SEQ ID NO: 2080761 - RNA, 19 nt, Human
aaggguaucaggugcugcc

SEQ ID NO: 2080762 - RNA, 17 nt, Human
aaggguaucaggugcug

SEQ ID NO: 2080763 - RNA, 19 nt, Human
aaggggaggaccucugggc

SEQ ID NO: 2080764 - RNA, 13 nt, Human
aaggggaggaggg

SEQ ID NO: 2080765 - RNA, 22 nt, Human
aaggggauguauccaugggggc

SEQ ID NO: 2080766 - RNA, 15 nt, Human
aaggggaggagggcg

SEQ ID NO: 2080767 - RNA, 14 nt, Human
aaggggaggcagcc

SEQ ID NO: 2080768 - RNA, 16 nt, Human
aaggggaggcagccgg

SEQ ID NO: 2080769 - RNA, 16 nt, Human
aagggcccagauucua

SEQ ID NO: 2080770 - RNA, 16 nt, Human
aaggcuggcugggcau

SEQ ID NO: 2080771 - RNA, 15 nt, Human
aaguaaauagcaaca

SEQ ID NO: 2080772 - RNA, 21 nt, Human
guuucuagcaugaagacagag

SEQ ID NO: 2080773 - RNA, 19 nt, Human
guuucuagagccugcugga

SEQ ID NO: 2080774 - RNA, 12 nt, Human
aaguaaaacuug

SEQ ID NO: 2080775 - RNA, 20 nt, Human
aaggguuuguggcugggggc

SEQ ID NO: 2080776 - RNA, 17 nt, Human
aaguaaacuaaugaguu

SEQ ID NO: 2080777 - RNA, 13 nt, Human
aaguaaacugccc

SEQ ID NO: 2080778 - RNA, 16 nt, Human
aagggugcugcuuccc

SEQ ID NO: 2080779 - RNA, 19 nt, Human
aagggugcugcuucccucu

SEQ ID NO: 2080780 - RNA, 19 nt, Human
aaggguccuucccucuccc

SEQ ID NO: 2080781 - RNA, 14 nt, Human
aaggguuauauuuu

SEQ ID NO: 2080782 - RNA, 23 nt, Human
aagggugcugcuucccucugccu

SEQ ID NO: 2080783 - RNA, 20 nt, Human
aagggugcugcuucccucug

SEQ ID NO: 2080784 - RNA, 18 nt, Human
aaggggcagucuggaggg

SEQ ID NO: 2080785 - RNA, 19 nt, Human
aaggggcagucuggagggg

SEQ ID NO: 2080786 - RNA, 20 nt, Human
aaggggcagucuggaggggc

SEQ ID NO: 2080787 - RNA, 14 nt, Human
aaggcuggggcuau

SEQ ID NO: 2080788 - RNA, 17 nt, Human
aaggguuuguggcuggg

SEQ ID NO: 2080789 - RNA, 12 nt, Human
guuuuuugaaaa

SEQ ID NO: 2080790 - RNA, 14 nt, Human
guuuuuuccugagc

SEQ ID NO: 2080791 - RNA, 21 nt, Human
guuuuuuccugagcuuggcca

SEQ ID NO: 2080792 - RNA, 21 nt, Human
guuuuuuaaagucuugcugug

SEQ ID NO: 2080793 - RNA, 19 nt, Human
guuuuuuaucuuuucuaca

SEQ ID NO: 2080794 - RNA, 22 nt, Human
guuuuuuaucuuuucuacagca

SEQ ID NO: 2080795 - RNA, 23 nt, Human
guuuuuuaucuuuucuacagcaa

SEQ ID NO: 2080796 - RNA, 19 nt, Human
guuuuuuuguauaguaaag

SEQ ID NO: 2080797 - RNA, 18 nt, Human
guuuuuuuuaaauaaaag

SEQ ID NO: 2080798 - RNA, 20 nt, Human
guuuuuuuuaaauaaaagca

SEQ ID NO: 2080799 - RNA, 17 nt, Human
guuuuucugccagggag

SEQ ID NO: 2080800 - RNA, 14 nt, Human
guuuuucugccagg

SEQ ID NO: 2080801 - RNA, 13 nt, Human
guuuuugggaugu

SEQ ID NO: 2080802 - RNA, 17 nt, Human
guuuuugggaugucuua

SEQ ID NO: 2080803 - RNA, 19 nt, Human
guuuuugggugcaagaggg

SEQ ID NO: 2080804 - RNA, 15 nt, Human
guuuuuguuaacuuu

SEQ ID NO: 2080805 - RNA, 19 nt, Human
guuuuuguuaacuuugggu

SEQ ID NO: 2080806 - RNA, 16 nt, Human
guuuuugucuuaaaaa

SEQ ID NO: 2080807 - RNA, 18 nt, Human
aagucuuagauguauaua

SEQ ID NO: 2080808 - RNA, 19 nt, Human
aagucuuagauguauauau

SEQ ID NO: 2080809 - RNA, 14 nt, Human
aagugaauaaaaau

SEQ ID NO: 2080810 - RNA, 15 nt, Human
aagugaauaaaaauu

SEQ ID NO: 2080811 - RNA, 16 nt, Human
aagugaauaaaaauua

SEQ ID NO: 2080812 - RNA, 17 nt, Human
aagucuuagauguauau

SEQ ID NO: 2080813 - RNA, 14 nt, Human
aagucaugaacaca

SEQ ID NO: 2080814 - RNA, 15 nt, Human
aagucaugaagccca

SEQ ID NO: 2080815 - RNA, 17 nt, Human
aagucaugaagcccaag

SEQ ID NO: 2080816 - RNA, 23 nt, Human
aagucaugaagcccaagugaaau

SEQ ID NO: 2080817 - RNA, 11 nt, Human
aagucaugagc

SEQ ID NO: 2080818 - RNA, 15 nt, Human
aagugaccaaggagg

SEQ ID NO: 2080819 - RNA, 16 nt, Human
aagugacaaggcccca

SEQ ID NO: 2080820 - RNA, 18 nt, Human
aagugacaaggccccaga

SEQ ID NO: 2080821 - RNA, 19 nt, Human
aagugacaaggccccagag

SEQ ID NO: 2080822 - RNA, 20 nt, Human
aagugacaaggccccagaga

SEQ ID NO: 2080823 - RNA, 21 nt, Human
aagugacaaggccccagagac

SEQ ID NO: 2080824 - RNA, 14 nt, Human
aagugaauuuuucu

SEQ ID NO: 2080825 - RNA, 17 nt, Human
aagugaauuuuucucua

SEQ ID NO: 2080826 - RNA, 19 nt, Human
aagugaauuuuucucuaac

SEQ ID NO: 2080827 - RNA, 14 nt, Human
aagugaauuugaau

SEQ ID NO: 2080828 - RNA, 16 nt, Human
aagugaauuugaauga

SEQ ID NO: 2080829 - RNA, 17 nt, Human
aagugaauuugaaugaa

SEQ ID NO: 2080830 - RNA, 19 nt, Human
aagugaauuugaaugaaaa

SEQ ID NO: 2080831 - RNA, 20 nt, Human
aagugaauuugaaugaaaaa

SEQ ID NO: 2080832 - RNA, 23 nt, Human
aagugaauuugaaugaaaaauuu

SEQ ID NO: 2080833 - RNA, 16 nt, Human
aagugacuguaucugu

SEQ ID NO: 2080834 - RNA, 17 nt, Human
aagugacuguaucugug

SEQ ID NO: 2080835 - RNA, 18 nt, Human
aagugacuguaucugugu

SEQ ID NO: 2080836 - RNA, 15 nt, Human
aagugagaagauggu

SEQ ID NO: 2080837 - RNA, 18 nt, Human
guuuuucuaggccugggg

SEQ ID NO: 2080838 - RNA, 18 nt, Human
aaguauucuuauuuaaug

SEQ ID NO: 2080839 - RNA, 19 nt, Human
aaguauucuuauuuaauga

SEQ ID NO: 2080840 - RNA, 14 nt, Human
aaguauucugccuu

SEQ ID NO: 2080841 - RNA, 18 nt, Human
aaguauucugccuuugca

SEQ ID NO: 2080842 - RNA, 20 nt, Human
aaguauucugccuuugcaga

SEQ ID NO: 2080843 - RNA, 22 nt, Human
aaguauucugccuuugcagaaa

SEQ ID NO: 2080844 - RNA, 22 nt, Human
aagucaaccaauguagaaagcu

SEQ ID NO: 2080845 - RNA, 16 nt, Human
aagucaaccaauguag

SEQ ID NO: 2080846 - RNA, 24 nt, Human
aagucacacaguauuacuucugcu

SEQ ID NO: 2080847 - RNA, 21 nt, Human
aagucaagugaaaaaggagga

SEQ ID NO: 2080848 - RNA, 16 nt, Human
aagucacccggccccc

SEQ ID NO: 2080849 - RNA, 21 nt, Human
aagucacccggcccccaugca

SEQ ID NO: 2080850 - RNA, 16 nt, Human
aagucacucaauuguu

SEQ ID NO: 2080851 - RNA, 21 nt, Human
aagucacucaauuguuuuugu

SEQ ID NO: 2080852 - RNA, 18 nt, Human
aagucaccggagcuuuca

SEQ ID NO: 2080853 - RNA, 14 nt, Human
aagucaccggagcu

SEQ ID NO: 2080854 - RNA, 12 nt, Human
aagucacugcac

SEQ ID NO: 2080855 - RNA, 14 nt, Human
aagucacugcacag

SEQ ID NO: 2080856 - RNA, 20 nt, Human
aagucagugcccaacuguua

SEQ ID NO: 2080857 - RNA, 21 nt, Human
aagucagugcccaacuguuau

SEQ ID NO: 2080858 - RNA, 18 nt, Human
aagucagugggaacguga

SEQ ID NO: 2080859 - RNA, 13 nt, Human
aagucacaaagga

SEQ ID NO: 2080860 - RNA, 15 nt, Human
aagucacaaaggaau

SEQ ID NO: 2080861 - RNA, 18 nt, Human
aagucacaaaggaaugga

SEQ ID NO: 2080862 - RNA, 13 nt, Human
aagucacacagug

SEQ ID NO: 2080863 - RNA, 16 nt, Human
aagucacaucacagga

SEQ ID NO: 2080864 - RNA, 17 nt, Human
aagucacaucacaggac

SEQ ID NO: 2080865 - RNA, 19 nt, Human
aagucacaucacaggacac

SEQ ID NO: 2080866 - RNA, 12 nt, Human
aaguauucaaga

SEQ ID NO: 2080867 - RNA, 15 nt, Human
aaguauuccaccuua

SEQ ID NO: 2080868 - RNA, 16 nt, Human
aaguauuccaccuuaa

SEQ ID NO: 2080869 - RNA, 17 nt, Human
aaguauuccaccuuaaa

SEQ ID NO: 2080870 - RNA, 18 nt, Human
aaguauuccaccuuaaau

SEQ ID NO: 2080871 - RNA, 19 nt, Human
aaguauuccaccuuaaauu

SEQ ID NO: 2080872 - RNA, 20 nt, Human
aaguauuccaccuuaaauua

SEQ ID NO: 2080873 - RNA, 21 nt, Human
aaguauuccaccuuaaauuaa

SEQ ID NO: 2080874 - RNA, 22 nt, Human
aaguauuccuuuccugaucacu

SEQ ID NO: 2080875 - RNA, 16 nt, Human
aaguauguuuuagcau

SEQ ID NO: 2080876 - RNA, 23 nt, Human
aaguacuucuccacccugcucuc

SEQ ID NO: 2080877 - RNA, 22 nt, Human
aaguacuucuccacccugcucu

SEQ ID NO: 2080878 - RNA, 21 nt, Human
aaguacuucuccacccugcuc

SEQ ID NO: 2080879 - RNA, 17 nt, Human
aaguacugcuguaaaua

SEQ ID NO: 2080880 - RNA, 20 nt, Human
aaguacugcuguaaauaaau

SEQ ID NO: 2080881 - RNA, 23 nt, Human
aaguacugcuguaaauaaaugcu

SEQ ID NO: 2080882 - RNA, 14 nt, Human
guuucucccaguuc

SEQ ID NO: 2080883 - RNA, 16 nt, Human
aaguacuauguaucaa

SEQ ID NO: 2080884 - RNA, 15 nt, Human
aaguacuauguauca

SEQ ID NO: 2080885 - RNA, 23 nt, Human
guuggcugggggccucagugcca

SEQ ID NO: 2080886 - RNA, 22 nt, Human
guugcucagcaaggggcucugc

SEQ ID NO: 2080887 - RNA, 18 nt, Human
guugcuccgccucugcug

SEQ ID NO: 2080888 - RNA, 20 nt, Human
guugcuccgccucugcuggc

SEQ ID NO: 2080889 - RNA, 22 nt, Human
guugcuccgccucugcuggcac

SEQ ID NO: 2080890 - RNA, 18 nt, Human
guugcucaaaaaaugagc

SEQ ID NO: 2080891 - RNA, 22 nt, Human
guugcuaagaagcgagcacuga

SEQ ID NO: 2080892 - RNA, 17 nt, Human
guugcccaggcuggcgu

SEQ ID NO: 2080893 - RNA, 16 nt, Human
guugcccaggcuggcg

SEQ ID NO: 2080894 - RNA, 21 nt, Human
aaggccuuauucuacauuuca

SEQ ID NO: 2080895 - RNA, 21 nt, Human
aaggcuaccuuauuguacguu

SEQ ID NO: 2080896 - RNA, 16 nt, Human
aaggcuaaaacuuaac

SEQ ID NO: 2080897 - RNA, 15 nt, Human
guugcccaggcuggc

SEQ ID NO: 2080898 - RNA, 13 nt, Human
guuggcuucuguu

SEQ ID NO: 2080899 - RNA, 23 nt, Human
guuggcuucuguuucuaguugag

SEQ ID NO: 2080900 - RNA, 14 nt, Human
guugggaagacaug

SEQ ID NO: 2080901 - RNA, 11 nt, Human
guuggcugggu

SEQ ID NO: 2080902 - RNA, 12 nt, Human
guuggcugggua

SEQ ID NO: 2080903 - RNA, 17 nt, Human
guugggcuggugucacc

SEQ ID NO: 2080904 - RNA, 23 nt, Human
guuggggugguuuuugagccaug

SEQ ID NO: 2080905 - RNA, 14 nt, Human
guuggggaggggcg

SEQ ID NO: 2080906 - RNA, 14 nt, Human
guugcccaggcugg

SEQ ID NO: 2080907 - RNA, 18 nt, Human
aaggcgggagcaucucuu

SEQ ID NO: 2080908 - RNA, 16 nt, Human
aaggccucuuccuugc

SEQ ID NO: 2080909 - RNA, 16 nt, Human
aaggccugucccuggc

SEQ ID NO: 2080910 - RNA, 23 nt, Human
aaggccugucccuggccaucucu

SEQ ID NO: 2080911 - RNA, 15 nt, Human
aaggccuuaauaugu

SEQ ID NO: 2080912 - RNA, 16 nt, Human
aaggaggaaggagccu

SEQ ID NO: 2080913 - RNA, 15 nt, Human
aaggccccagagacu

SEQ ID NO: 2080914 - RNA, 17 nt, Human
aaggagacucaccucug

SEQ ID NO: 2080915 - RNA, 20 nt, Human
aaggagacucaccucugccu

SEQ ID NO: 2080916 - RNA, 22 nt, Human
aaggagacucaccucugccuca

SEQ ID NO: 2080917 - RNA, 23 nt, Human
aaggagacucaccucugccucaa

SEQ ID NO: 2080918 - RNA, 16 nt, Human
aaggagacucaccucu

SEQ ID NO: 2080919 - RNA, 14 nt, Human
aaggagagccugcu

SEQ ID NO: 2080920 - RNA, 18 nt, Human
aaggagagaaggggagga

SEQ ID NO: 2080921 - RNA, 21 nt, Human
guugagcuucauauaccagca

SEQ ID NO: 2080922 - RNA, 13 nt, Human
aaggagagccugc

SEQ ID NO: 2080923 - RNA, 20 nt, Human
aaggaaggagacucaccucu

SEQ ID NO: 2080924 - RNA, 22 nt, Human
aaggaaggagacucaccucugc

SEQ ID NO: 2080925 - RNA, 19 nt, Human
aaggaagcuuucucugcuu

SEQ ID NO: 2080926 - RNA, 22 nt, Human
aaggaagcuuucucugcuucag

SEQ ID NO: 2080927 - RNA, 11 nt, Human
aaggaaggaaa

SEQ ID NO: 2080928 - RNA, 12 nt, Human
aaggaaggaaag

SEQ ID NO: 2080929 - RNA, 13 nt, Human
aaggaaggaaaga

SEQ ID NO: 2080930 - RNA, 16 nt, Human
aaggaaggaaagaaag

SEQ ID NO: 2080931 - RNA, 23 nt, Human
aaggaggauggcauauaauacaa

SEQ ID NO: 2080932 - RNA, 20 nt, Human
aaggaggaagagaaaaaaua

SEQ ID NO: 2080933 - RNA, 15 nt, Human
aaggaggagagggaa

SEQ ID NO: 2080934 - RNA, 17 nt, Human
aaggaggagagggaaaa

SEQ ID NO: 2080935 - RNA, 22 nt, Human
aaggaucagaacagcagagguu

SEQ ID NO: 2080936 - RNA, 20 nt, Human
aaggauagugcgauguuuca

SEQ ID NO: 2080937 - RNA, 17 nt, Human
aaggauauuuaagaaaa

SEQ ID NO: 2080938 - RNA, 18 nt, Human
aaggauauuuaagaaaau

SEQ ID NO: 2080939 - RNA, 19 nt, Human
aaggauauuuaagaaaaua

SEQ ID NO: 2080940 - RNA, 23 nt, Human
aaggauauuuaagaaaauacaau

SEQ ID NO: 2080941 - RNA, 15 nt, Human
aaggaucuguuuuua

SEQ ID NO: 2080942 - RNA, 12 nt, Human
aaggaucuuuca

SEQ ID NO: 2080943 - RNA, 22 nt, Human
aaggaucuuucacccacagaaa

SEQ ID NO: 2080944 - RNA, 23 nt, Human
aaggaucuuucacccacagaaag

SEQ ID NO: 2080945 - RNA, 21 nt, Human
aaggaucuguuuuuaaaaauc

SEQ ID NO: 2080946 - RNA, 23 nt, Human
aaggaucuguuuuuaaaaaucau

SEQ ID NO: 2080947 - RNA, 17 nt, Human
guuccccuguucacucu

SEQ ID NO: 2080948 - RNA, 15 nt, Human
guuccccuguucacu

SEQ ID NO: 2080949 - RNA, 12 nt, Human
aagcuuuuauga

SEQ ID NO: 2080950 - RNA, 13 nt, Human
aagcuuuuaugag

SEQ ID NO: 2080951 - RNA, 17 nt, Human
aagcuuuuuuauuuuuu

SEQ ID NO: 2080952 - RNA, 22 nt, Human
aagcuuuuuuauuuuuuauaca

SEQ ID NO: 2080953 - RNA, 13 nt, Human
aagcucugcuccu

SEQ ID NO: 2080954 - RNA, 18 nt, Human
aagcuguuacugucuuca

SEQ ID NO: 2080955 - RNA, 13 nt, Human
aagcuuuccugga

SEQ ID NO: 2080956 - RNA, 11 nt, Human
aagcuuucucu

SEQ ID NO: 2080957 - RNA, 17 nt, Human
aagcuuucucugcuuca

SEQ ID NO: 2080958 - RNA, 19 nt, Human
aagcuuucucugcuucagc

SEQ ID NO: 2080959 - RNA, 23 nt, Human
aagcuuucucugcuucagcuugc

SEQ ID NO: 2080960 - RNA, 16 nt, Human
aagcuuugauuuagau

SEQ ID NO: 2080961 - RNA, 22 nt, Human
aagcuuugauuuagauugagua

SEQ ID NO: 2080962 - RNA, 23 nt, Human
aagcuuugcuuaugguaauaaaa

SEQ ID NO: 2080963 - RNA, 23 nt, Human
aagcuguuuccauagggugacac

SEQ ID NO: 2080964 - RNA, 15 nt, Human
aagcuguuuccauag

SEQ ID NO: 2080965 - RNA, 15 nt, Human
guguuuaguugcaga

SEQ ID NO: 2080966 - RNA, 23 nt, Human
guguuuaacggcacuguggccuu

SEQ ID NO: 2080967 - RNA, 22 nt, Human
guguuuauccuaucucuccaac

SEQ ID NO: 2080968 - RNA, 20 nt, Human
aagcuccaucuccacuccag

SEQ ID NO: 2080969 - RNA, 12 nt, Human
aagcucugaagu

SEQ ID NO: 2080970 - RNA, 16 nt, Human
aagcucugaagucaca

SEQ ID NO: 2080971 - RNA, 22 nt, Human
aagcucugaagucacaucacag

SEQ ID NO: 2080972 - RNA, 15 nt, Human
guugagccaggccug

SEQ ID NO: 2080973 - RNA, 23 nt, Human
guugagccaggccugggucugug

SEQ ID NO: 2080974 - RNA, 15 nt, Human
guugacacggccaug

SEQ ID NO: 2080975 - RNA, 20 nt, Human
guugacacggccaugaccac

SEQ ID NO: 2080976 - RNA, 13 nt, Human
guugagcuguuuu

SEQ ID NO: 2080977 - RNA, 20 nt, Human
guugauauuucgaaagcugc

SEQ ID NO: 2080978 - RNA, 20 nt, Human
guugaucacuggcaaugaaa

SEQ ID NO: 2080979 - RNA, 15 nt, Human
guucuguuuguuaaa

SEQ ID NO: 2080980 - RNA, 17 nt, Human
guucuguuuguuaaaac

SEQ ID NO: 2080981 - RNA, 22 nt, Human
guucuguuuguuaaaacuggca

SEQ ID NO: 2080982 - RNA, 16 nt, Human
guucuguuuugccuga

SEQ ID NO: 2080983 - RNA, 12 nt, Human
guucuguuuugu

SEQ ID NO: 2080984 - RNA, 13 nt, Human
guucuguuuuguu

SEQ ID NO: 2080985 - RNA, 13 nt, Human
guucuguguauuu

SEQ ID NO: 2080986 - RNA, 19 nt, Human
guucuguguauuuaauugu

SEQ ID NO: 2080987 - RNA, 23 nt, Human
guucuguguauuuaauuguaaac

SEQ ID NO: 2080988 - RNA, 18 nt, Human
guuccccuguucacucua

SEQ ID NO: 2080989 - RNA, 14 nt, Human
guucuauuuaagug

SEQ ID NO: 2080990 - RNA, 23 nt, Human
guucuauuuaaguguacuaauua

SEQ ID NO: 2080991 - RNA, 17 nt, Human
guucuauuucuauccca

SEQ ID NO: 2080992 - RNA, 18 nt, Human
guucuauuucuaucccaa

SEQ ID NO: 2080993 - RNA, 22 nt, Human
guucucaaacgguacacagacu

SEQ ID NO: 2080994 - RNA, 16 nt, Human
guucucugaggacacu

SEQ ID NO: 2080995 - RNA, 17 nt, Human
guucugucucauaugau

SEQ ID NO: 2080996 - RNA, 13 nt, Human
uacagucuuguau

SEQ ID NO: 2080997 - RNA, 12 nt, Human
uacagucuugua

SEQ ID NO: 2080998 - RNA, 13 nt, Human
uacagugguucua

SEQ ID NO: 2080999 - RNA, 18 nt, Human
uacaguaucucagggccu

SEQ ID NO: 2081000 - RNA, 13 nt, Human
uacaguauucugu

SEQ ID NO: 2081001 - RNA, 14 nt, Human
aauguauuuuuccu

SEQ ID NO: 2081002 - RNA, 13 nt, Human
aaugucacaggca

SEQ ID NO: 2081003 - RNA, 14 nt, Human
aaugucacaggcag

SEQ ID NO: 2081004 - RNA, 18 nt, Human
aauguaucaggaaauaua

SEQ ID NO: 2081005 - RNA, 16 nt, Human
aauguaucuuauucac

SEQ ID NO: 2081006 - RNA, 13 nt, Human
aauguaucuuauu

SEQ ID NO: 2081007 - RNA, 18 nt, Human
aauguaucuuauucacau

SEQ ID NO: 2081008 - RNA, 17 nt, Human
aauguaucuuauucaca

SEQ ID NO: 2081009 - RNA, 14 nt, Human
aauguagcugguuu

SEQ ID NO: 2081010 - RNA, 17 nt, Human
aauguagcugguuuccu

SEQ ID NO: 2081011 - RNA, 20 nt, Human
aauguagguaugaauaaguu

SEQ ID NO: 2081012 - RNA, 21 nt, Human
aauguagcugguuuccucauu

SEQ ID NO: 2081013 - RNA, 13 nt, Human
uacauacugcugu

SEQ ID NO: 2081014 - RNA, 12 nt, Human
uacauacugcug

SEQ ID NO: 2081015 - RNA, 14 nt, Human
aauguacccaguau

SEQ ID NO: 2081016 - RNA, 17 nt, Human
aauguacaucuggccuu

SEQ ID NO: 2081017 - RNA, 18 nt, Human
aauguaauuuguguaaua

SEQ ID NO: 2081018 - RNA, 23 nt, Human
aauguaauuuguguaauaaagug

SEQ ID NO: 2081019 - RNA, 13 nt, Human
aauguacaaaaua

SEQ ID NO: 2081020 - RNA, 15 nt, Human
aauguacaaaauaaa

SEQ ID NO: 2081021 - RNA, 17 nt, Human
aauguacaaaauaaagu

SEQ ID NO: 2081022 - RNA, 21 nt, Human
uacaccucguuagggaagaga

SEQ ID NO: 2081023 - RNA, 22 nt, Human
uacaccucguuagggaagagaa

SEQ ID NO: 2081024 - RNA, 24 nt, Human
uacaccucguuagggaagagaaac

SEQ ID NO: 2081025 - RNA, 14 nt, Human
uacagacuucucca

SEQ ID NO: 2081026 - RNA, 15 nt, Human
uacagacuucuccag

SEQ ID NO: 2081027 - RNA, 16 nt, Human
uacagacguaugcuua

SEQ ID NO: 2081028 - RNA, 17 nt, Human
uacagacguaugcuuau

SEQ ID NO: 2081029 - RNA, 18 nt, Human
uacagacguaugcuuauu

SEQ ID NO: 2081030 - RNA, 12 nt, Human
uacagcaaauuu

SEQ ID NO: 2081031 - RNA, 14 nt, Human
uacagcaaauuuau

SEQ ID NO: 2081032 - RNA, 15 nt, Human
uacagcaaauuuaua

SEQ ID NO: 2081033 - RNA, 16 nt, Human
uacagcaaauuuauaa

SEQ ID NO: 2081034 - RNA, 12 nt, Human
uacaauauuuaa

SEQ ID NO: 2081035 - RNA, 14 nt, Human
uacaauauuuaaaa

SEQ ID NO: 2081036 - RNA, 16 nt, Human
uacaauauuuaaaauu

SEQ ID NO: 2081037 - RNA, 14 nt, Human
uacaauauuuuaag

SEQ ID NO: 2081038 - RNA, 15 nt, Human
uacaauauuuuaagc

SEQ ID NO: 2081039 - RNA, 16 nt, Human
uacaauauuuuaagca

SEQ ID NO: 2081040 - RNA, 17 nt, Human
uacaauauuuuaagcau

SEQ ID NO: 2081041 - RNA, 18 nt, Human
uacaauauuuuaagcauu

SEQ ID NO: 2081042 - RNA, 20 nt, Human
uacaauauuuuaagcauuac

SEQ ID NO: 2081043 - RNA, 21 nt, Human
uacaauauuuuaagcauuacu

SEQ ID NO: 2081044 - RNA, 20 nt, Human
uacaaucaaaggaaaauagu

SEQ ID NO: 2081045 - RNA, 13 nt, Human
uacaauaacauaa

SEQ ID NO: 2081046 - RNA, 21 nt, Human
uacaauaaaacuuugcugcca

SEQ ID NO: 2081047 - RNA, 11 nt, Human
uacaauaaacu

SEQ ID NO: 2081048 - RNA, 12 nt, Human
uacaauaaacua

SEQ ID NO: 2081049 - RNA, 13 nt, Human
uacaauaaacuau

SEQ ID NO: 2081050 - RNA, 19 nt, Human
uacaauaaacuauuggaaa

SEQ ID NO: 2081051 - RNA, 18 nt, Human
uacaaguucuauuuaagu

SEQ ID NO: 2081052 - RNA, 15 nt, Human
uacaauauauauucu

SEQ ID NO: 2081053 - RNA, 14 nt, Human
aaugguuugaauau

SEQ ID NO: 2081054 - RNA, 23 nt, Human
uacaaugaaaaggacuuuauaga

SEQ ID NO: 2081055 - RNA, 13 nt, Human
uacaaucuauuua

SEQ ID NO: 2081056 - RNA, 16 nt, Human
uacaaucuauuuauug

SEQ ID NO: 2081057 - RNA, 17 nt, Human
uacaaucuauuuauugg

SEQ ID NO: 2081058 - RNA, 13 nt, Human
aauguaagcucua

SEQ ID NO: 2081059 - RNA, 15 nt, Human
aauguaagcucuacu

SEQ ID NO: 2081060 - RNA, 17 nt, Human
aaugguuugaauauaaa

SEQ ID NO: 2081061 - RNA, 23 nt, Human
aaugguuugaauauaaacacuau

SEQ ID NO: 2081062 - RNA, 17 nt, Human
uaccccuuacuuagcau

SEQ ID NO: 2081063 - RNA, 18 nt, Human
uaccccuuacuuagcaug

SEQ ID NO: 2081064 - RNA, 19 nt, Human
uaccccuuagccucccuga

SEQ ID NO: 2081065 - RNA, 15 nt, Human
uacccucccaccccc

SEQ ID NO: 2081066 - RNA, 13 nt, Human
uacccucccaccc

SEQ ID NO: 2081067 - RNA, 14 nt, Human
uacccucccacccc

SEQ ID NO: 2081068 - RNA, 20 nt, Human
uacccuggcacuauaaugua

SEQ ID NO: 2081069 - RNA, 22 nt, Human
uacccuggcacuauaauguaag

SEQ ID NO: 2081070 - RNA, 18 nt, Human
uacccuccuuuuuuuccc

SEQ ID NO: 2081071 - RNA, 16 nt, Human
uacccccuaagagcca

SEQ ID NO: 2081072 - RNA, 16 nt, Human
uaccccagcucugcuu

SEQ ID NO: 2081073 - RNA, 18 nt, Human
uaccccagcucugcuugc

SEQ ID NO: 2081074 - RNA, 22 nt, Human
uaccccaccacgauguggcccu

SEQ ID NO: 2081075 - RNA, 17 nt, Human
uaccauccccuguagag

SEQ ID NO: 2081076 - RNA, 15 nt, Human
uaccauaauguauuu

SEQ ID NO: 2081077 - RNA, 15 nt, Human
uaccaugaaacaaag

SEQ ID NO: 2081078 - RNA, 13 nt, Human
uaccaucucccuc

SEQ ID NO: 2081079 - RNA, 21 nt, Human
uaccagacgguucaccagccu

SEQ ID NO: 2081080 - RNA, 17 nt, Human
uacauggguagcuucug

SEQ ID NO: 2081081 - RNA, 23 nt, Human
uaccagacgguucaccagccucu

SEQ ID NO: 2081082 - RNA, 22 nt, Human
uaccagacgguucaccagccuc

SEQ ID NO: 2081083 - RNA, 23 nt, Human
uacauuguuugucugucuucaua

SEQ ID NO: 2081084 - RNA, 19 nt, Human
uacauuuauaauguuugcu

SEQ ID NO: 2081085 - RNA, 18 nt, Human
uaccacugaagauagaag

SEQ ID NO: 2081086 - RNA, 19 nt, Human
uaccacugaagauagaaga

SEQ ID NO: 2081087 - RNA, 21 nt, Human
uaccacugaagauagaagaaa

SEQ ID NO: 2081088 - RNA, 16 nt, Human
uacauuuaauugagaa

SEQ ID NO: 2081089 - RNA, 17 nt, Human
uacauuuaauugagaag

SEQ ID NO: 2081090 - RNA, 13 nt, Human
aauuaaguacuau

SEQ ID NO: 2081091 - RNA, 19 nt, Human
aauuaagaggauacacacg

SEQ ID NO: 2081092 - RNA, 21 nt, Human
aauuaaggcaacugaacaaaa

SEQ ID NO: 2081093 - RNA, 22 nt, Human
aauuaaggcaacugaacaaaaa

SEQ ID NO: 2081094 - RNA, 19 nt, Human
uacauguaaaacauuaucu

SEQ ID NO: 2081095 - RNA, 16 nt, Human
uacaugguugugaccu

SEQ ID NO: 2081096 - RNA, 12 nt, Human
aauuaaguaaac

SEQ ID NO: 2081097 - RNA, 13 nt, Human
uacauuaaagcag

SEQ ID NO: 2081098 - RNA, 15 nt, Human
uacauuaaagcaguc

SEQ ID NO: 2081099 - RNA, 20 nt, Human
uacauuagcaguuugcuuug

SEQ ID NO: 2081100 - RNA, 19 nt, Human
uacauuagcaguuugcuuu

SEQ ID NO: 2081101 - RNA, 22 nt, Human
uacauuaauuauuauugcuguu

SEQ ID NO: 2081102 - RNA, 23 nt, Human
uacauuaauuauuauugcuguug

SEQ ID NO: 2081103 - RNA, 16 nt, Human
uacauugugaaacuuc

SEQ ID NO: 2081104 - RNA, 19 nt, Human
uacauuguuugucugucuu

SEQ ID NO: 2081105 - RNA, 12 nt, Human
aauuaacacugc

SEQ ID NO: 2081106 - RNA, 14 nt, Human
aauuaacauauaau

SEQ ID NO: 2081107 - RNA, 15 nt, Human
aauuaacauauaaua

SEQ ID NO: 2081108 - RNA, 16 nt, Human
aauuaacauauaauau

SEQ ID NO: 2081109 - RNA, 17 nt, Human
aauuaacauauaauaua

SEQ ID NO: 2081110 - RNA, 18 nt, Human
aauuaacauauaauauau

SEQ ID NO: 2081111 - RNA, 19 nt, Human
aauuaacauauaauauaug

SEQ ID NO: 2081112 - RNA, 20 nt, Human
aauuaacauauaauauaugu

SEQ ID NO: 2081113 - RNA, 21 nt, Human
aauuaacauauaauauauguu

SEQ ID NO: 2081114 - RNA, 14 nt, Human
aaugucaaggugcu

SEQ ID NO: 2081115 - RNA, 16 nt, Human
aaugucaaggugcugu

SEQ ID NO: 2081116 - RNA, 17 nt, Human
aaugugaacuagcugga

SEQ ID NO: 2081117 - RNA, 19 nt, Human
aaugugaacuagcuggaau

SEQ ID NO: 2081118 - RNA, 20 nt, Human
aaugugaacuagcuggaauu

SEQ ID NO: 2081119 - RNA, 23 nt, Human
aaugugaaucagacccuacccca

SEQ ID NO: 2081120 - RNA, 18 nt, Human
uacaagccagcuggagaa

SEQ ID NO: 2081121 - RNA, 21 nt, Human
uacaagccauucuaaggaaau

SEQ ID NO: 2081122 - RNA, 16 nt, Human
uaauuuuuuucaauau

SEQ ID NO: 2081123 - RNA, 17 nt, Human
uaauuuuuuuauguuuu

SEQ ID NO: 2081124 - RNA, 21 nt, Human
uaauuuuuuuauguuuuguuu

SEQ ID NO: 2081125 - RNA, 20 nt, Human
uacaauaaaaucuugaaaau

SEQ ID NO: 2081126 - RNA, 21 nt, Human
uacaagcgugagccacugcac

SEQ ID NO: 2081127 - RNA, 20 nt, Human
uacaagcgugagccacugca

SEQ ID NO: 2081128 - RNA, 19 nt, Human
uacaagcgugagccacugc

SEQ ID NO: 2081129 - RNA, 18 nt, Human
uacaagcgugagccacug

SEQ ID NO: 2081130 - RNA, 16 nt, Human
uacaagcgugagccac

SEQ ID NO: 2081131 - RNA, 22 nt, Human
uaauuuuuguguuuuuaauaaa

SEQ ID NO: 2081132 - RNA, 13 nt, Human
uaauuuuuuacua

SEQ ID NO: 2081133 - RNA, 19 nt, Human
uaauuuuuuagagagcugu

SEQ ID NO: 2081134 - RNA, 17 nt, Human
uaauuugccaaaauaau

SEQ ID NO: 2081135 - RNA, 19 nt, Human
uaauuugccaaaauaaugu

SEQ ID NO: 2081136 - RNA, 22 nt, Human
uaauuugccaaaauaaugucuu

SEQ ID NO: 2081137 - RNA, 23 nt, Human
uaauuugccaaaauaaugucuug

SEQ ID NO: 2081138 - RNA, 14 nt, Human
uaauuugauguuua

SEQ ID NO: 2081139 - RNA, 15 nt, Human
uaauuugacuagaaa

SEQ ID NO: 2081140 - RNA, 15 nt, Human
uaauuucuucucaaa

SEQ ID NO: 2081141 - RNA, 22 nt, Human
uaauuugauaguauugugcaua

SEQ ID NO: 2081142 - RNA, 16 nt, Human
uaauuugaugaaagcu

SEQ ID NO: 2081143 - RNA, 17 nt, Human
uaauuugaugaaagcug

SEQ ID NO: 2081144 - RNA, 18 nt, Human
uaauuugaugaaagcuga

SEQ ID NO: 2081145 - RNA, 19 nt, Human
uaauuugaugaaagcugau

SEQ ID NO: 2081146 - RNA, 20 nt, Human
uaauuugaugaaagcugauu

SEQ ID NO: 2081147 - RNA, 24 nt, Human
uaauuugaugaaagcugauuacug

SEQ ID NO: 2081148 - RNA, 16 nt, Human
uaauuugacuagaaaa

SEQ ID NO: 2081149 - RNA, 14 nt, Human
uaauuuaaugcaug

SEQ ID NO: 2081150 - RNA, 14 nt, Human
uaauucauguuucu

SEQ ID NO: 2081151 - RNA, 21 nt, Human
uaauuuaaugcauguuaggaa

SEQ ID NO: 2081152 - RNA, 23 nt, Human
uaauuaguuccucauuagcauuu

SEQ ID NO: 2081153 - RNA, 21 nt, Human
uaauuaucgggaacaguguuu

SEQ ID NO: 2081154 - RNA, 23 nt, Human
uaauuaucgggaacaguguuucc

SEQ ID NO: 2081155 - RNA, 21 nt, Human
uaauuaugacaguuauacugu

SEQ ID NO: 2081156 - RNA, 13 nt, Human
uaauuaugacagu

SEQ ID NO: 2081157 - RNA, 23 nt, Human
uaauuauaccgcuaucauuccaa

SEQ ID NO: 2081158 - RNA, 17 nt, Human
uaauuaucggaagcagu

SEQ ID NO: 2081159 - RNA, 18 nt, Human
uaauuaucggaagcagug

SEQ ID NO: 2081160 - RNA, 19 nt, Human
uaauuaucggaagcagugc

SEQ ID NO: 2081161 - RNA, 21 nt, Human
uaauuaucggaagcagugccu

SEQ ID NO: 2081162 - RNA, 18 nt, Human
uaauuaucgggaacagug

SEQ ID NO: 2081163 - RNA, 19 nt, Human
uaauuaucgggaacagugu

SEQ ID NO: 2081164 - RNA, 20 nt, Human
uaauuaucgggaacaguguu

SEQ ID NO: 2081165 - RNA, 21 nt, Human
aaugcaagauuuuccacaaga

SEQ ID NO: 2081166 - RNA, 14 nt, Human
aaugcaauauguau

SEQ ID NO: 2081167 - RNA, 14 nt, Human
aaugcaaauucuca

SEQ ID NO: 2081168 - RNA, 16 nt, Human
aaugcaaauucucaag

SEQ ID NO: 2081169 - RNA, 15 nt, Human
aaugcaacaacaugu

SEQ ID NO: 2081170 - RNA, 18 nt, Human
aaugcaacaacauguaua

SEQ ID NO: 2081171 - RNA, 16 nt, Human
aaugaccucaagaugu

SEQ ID NO: 2081172 - RNA, 21 nt, Human
aaucuuuuuuagcauaaaauu

SEQ ID NO: 2081173 - RNA, 14 nt, Human
aaugaaaaauucuc

SEQ ID NO: 2081174 - RNA, 17 nt, Human
aaugaaaaauucucagu

SEQ ID NO: 2081175 - RNA, 17 nt, Human
aaugaaaaauuuaagca

SEQ ID NO: 2081176 - RNA, 18 nt, Human
aaugaaaaauuuaagcau

SEQ ID NO: 2081177 - RNA, 14 nt, Human
aaugaaugaaacau

SEQ ID NO: 2081178 - RNA, 17 nt, Human
uaaugugccuaguucuu

SEQ ID NO: 2081179 - RNA, 10 nt, Human
uaaugugaac

SEQ ID NO: 2081180 - RNA, 11 nt, Human
uaaugugaacu

SEQ ID NO: 2081181 - RNA, 13 nt, Human
uaaugugaacuag

SEQ ID NO: 2081182 - RNA, 19 nt, Human
uaaugugaacuagcuggaa

SEQ ID NO: 2081183 - RNA, 13 nt, Human
aaucuugaaaaug

SEQ ID NO: 2081184 - RNA, 15 nt, Human
aaucuugcuuucuuu

SEQ ID NO: 2081185 - RNA, 18 nt, Human
aaucuugcuuucuuuguu

SEQ ID NO: 2081186 - RNA, 15 nt, Human
uaaugucacaggcag

SEQ ID NO: 2081187 - RNA, 17 nt, Human
uaaugucacaggcaggu

SEQ ID NO: 2081188 - RNA, 16 nt, Human
uaaugucacaggcagg

SEQ ID NO: 2081189 - RNA, 23 nt, Human
uaaugaaauaaaucauguuaauc

SEQ ID NO: 2081190 - RNA, 22 nt, Human
uaaugaagggaaaggauauuuu

SEQ ID NO: 2081191 - RNA, 16 nt, Human
uaauguaagcucuacu

SEQ ID NO: 2081192 - RNA, 17 nt, Human
uaauguaagcucuacug

SEQ ID NO: 2081193 - RNA, 18 nt, Human
uaaucaguguagccccaa

SEQ ID NO: 2081194 - RNA, 22 nt, Human
uaaucaguguagccccaagaag

SEQ ID NO: 2081195 - RNA, 14 nt, Human
uaaucagccucuua

SEQ ID NO: 2081196 - RNA, 15 nt, Human
uaaucagccucuuaa

SEQ ID NO: 2081197 - RNA, 16 nt, Human
uaauauucauuguaua

SEQ ID NO: 2081198 - RNA, 12 nt, Human
uaaucagccucu

SEQ ID NO: 2081199 - RNA, 13 nt, Human
uaaucagccucuu

SEQ ID NO: 2081200 - RNA, 21 nt, Human
uaauauugauaugcuuauaca

SEQ ID NO: 2081201 - RNA, 14 nt, Human
uaauauugagaaag

SEQ ID NO: 2081202 - RNA, 19 nt, Human
uaauauugagaaagaaacu

SEQ ID NO: 2081203 - RNA, 21 nt, Human
uaauagaauauaauuaucgga

SEQ ID NO: 2081204 - RNA, 14 nt, Human
uaauauucuuucaa

SEQ ID NO: 2081205 - RNA, 17 nt, Human
uaauauucuuucaauaa

SEQ ID NO: 2081206 - RNA, 20 nt, Human
uaauauucuuucaauaacga

SEQ ID NO: 2081207 - RNA, 14 nt, Human
uaaucuugcuuucu

SEQ ID NO: 2081208 - RNA, 15 nt, Human
uaaucuugcuuucuu

SEQ ID NO: 2081209 - RNA, 12 nt, Human
uaaucauuucuu

SEQ ID NO: 2081210 - RNA, 19 nt, Human
uaaucauuucuugggcccu

SEQ ID NO: 2081211 - RNA, 22 nt, Human
uaaucauuucuugggcccuccu

SEQ ID NO: 2081212 - RNA, 13 nt, Human
uaauacauuaaag

SEQ ID NO: 2081213 - RNA, 16 nt, Human
uaauacauuaaagcag

SEQ ID NO: 2081214 - RNA, 17 nt, Human
uaauacauuaaagcagu

SEQ ID NO: 2081215 - RNA, 18 nt, Human
uaauacauuaaagcaguc

SEQ ID NO: 2081216 - RNA, 20 nt, Human
uaauacagccaaagauaauc

SEQ ID NO: 2081217 - RNA, 12 nt, Human
uaauagaagaac

SEQ ID NO: 2081218 - RNA, 21 nt, Human
uaauagaagaacauccaagga

SEQ ID NO: 2081219 - RNA, 20 nt, Human
aauacaguaucucagggccu

SEQ ID NO: 2081220 - RNA, 15 nt, Human
aauacaguauucugu

SEQ ID NO: 2081221 - RNA, 16 nt, Human
aauacaguauucugua

SEQ ID NO: 2081222 - RNA, 18 nt, Human
aauacaguacaggcagca

SEQ ID NO: 2081223 - RNA, 21 nt, Human
aauacaguacaggcagcacag

SEQ ID NO: 2081224 - RNA, 15 nt, Human
aauacaguacaggca

SEQ ID NO: 2081225 - RNA, 16 nt, Human
aauacaguacaggcag

SEQ ID NO: 2081226 - RNA, 17 nt, Human
aauacaguacaggcagc

SEQ ID NO: 2081227 - RNA, 12 nt, Human
aauacaguguua

SEQ ID NO: 2081228 - RNA, 13 nt, Human
acaagccagcugg

SEQ ID NO: 2081229 - RNA, 15 nt, Human
acaagccagcuggag

SEQ ID NO: 2081230 - RNA, 14 nt, Human
acaagccccaggca

SEQ ID NO: 2081231 - RNA, 15 nt, Human
acaagccccaggcag

SEQ ID NO: 2081232 - RNA, 12 nt, Human
acaagccacccc

SEQ ID NO: 2081233 - RNA, 13 nt, Human
acaagcugcaccc

SEQ ID NO: 2081234 - RNA, 18 nt, Human
acaagcgugagccacugc

SEQ ID NO: 2081235 - RNA, 21 nt, Human
acaagcgugagccacugcacc

SEQ ID NO: 2081236 - RNA, 20 nt, Human
acaagcgugagccacugcac

SEQ ID NO: 2081237 - RNA, 13 nt, Human
acaagagcccagc

SEQ ID NO: 2081238 - RNA, 20 nt, Human
acaagagcccagcagggccu

SEQ ID NO: 2081239 - RNA, 19 nt, Human
acaagagcagccuguggca

SEQ ID NO: 2081240 - RNA, 20 nt, Human
acaagagcagccuguggcau

SEQ ID NO: 2081241 - RNA, 14 nt, Human
acaagagcagccug

SEQ ID NO: 2081242 - RNA, 15 nt, Human
acaagagcagccugu

SEQ ID NO: 2081243 - RNA, 16 nt, Human
acaagagcagccugug

SEQ ID NO: 2081244 - RNA, 18 nt, Human
acaagagcagccuguggc

SEQ ID NO: 2081245 - RNA, 23 nt, Human
acaagaaggguuuuccacccugg

SEQ ID NO: 2081246 - RNA, 12 nt, Human
acaacacucaca

SEQ ID NO: 2081247 - RNA, 14 nt, Human
acaacacacacacu

SEQ ID NO: 2081248 - RNA, 14 nt, Human
acaacaaaaauuug

SEQ ID NO: 2081249 - RNA, 15 nt, Human
acaacaaaaauuuga

SEQ ID NO: 2081250 - RNA, 15 nt, Human
acaacaaccugguca

SEQ ID NO: 2081251 - RNA, 12 nt, Human
uagcauuaacua

SEQ ID NO: 2081252 - RNA, 20 nt, Human
uagcauguugagccaggccu

SEQ ID NO: 2081253 - RNA, 16 nt, Human
uagcauuaacuaaucu

SEQ ID NO: 2081254 - RNA, 22 nt, Human
uagcauuuaguccaaugucuuu

SEQ ID NO: 2081255 - RNA, 22 nt, Human
acaaauguguaucggaugcuuu

SEQ ID NO: 2081256 - RNA, 22 nt, Human
acaaauuauguuacaucuguuu

SEQ ID NO: 2081257 - RNA, 15 nt, Human
acaaauuaucuuaaa

SEQ ID NO: 2081258 - RNA, 20 nt, Human
acaaauuagguuuuguacaa

SEQ ID NO: 2081259 - RNA, 13 nt, Human
uagaucagaacag

SEQ ID NO: 2081260 - RNA, 21 nt, Human
uagcauguguuugguucuggg

SEQ ID NO: 2081261 - RNA, 22 nt, Human
uagcauguguuugguucugggg

SEQ ID NO: 2081262 - RNA, 14 nt, Human
uagaucaugaagaa

SEQ ID NO: 2081263 - RNA, 22 nt, Human
uagauuuuagacccuauugcug

SEQ ID NO: 2081264 - RNA, 17 nt, Human
uagaucacgagaucaag

SEQ ID NO: 2081265 - RNA, 17 nt, Human
uagaucacauaacagaa

SEQ ID NO: 2081266 - RNA, 20 nt, Human
uagaucacauaacagaaugc

SEQ ID NO: 2081267 - RNA, 16 nt, Human
uagaucacgagaucaa

SEQ ID NO: 2081268 - RNA, 22 nt, Human
uagaggaaaaaaaugacuaaaa

SEQ ID NO: 2081269 - RNA, 15 nt, Human
uagaggaagcagcca

SEQ ID NO: 2081270 - RNA, 15 nt, Human
uagagcuucuggcac

SEQ ID NO: 2081271 - RNA, 17 nt, Human
uagaggaaaaaaaugac

SEQ ID NO: 2081272 - RNA, 18 nt, Human
uagaggaaaaaaaugacu

SEQ ID NO: 2081273 - RNA, 14 nt, Human
uagagcagggcaag

SEQ ID NO: 2081274 - RNA, 19 nt, Human
uagagcagaugaccccucc

SEQ ID NO: 2081275 - RNA, 16 nt, Human
acaaaaagcauaaaaa

SEQ ID NO: 2081276 - RNA, 12 nt, Human
acaaaaagacac

SEQ ID NO: 2081277 - RNA, 16 nt, Human
acaaaaagacacuuga

SEQ ID NO: 2081278 - RNA, 18 nt, Human
uagaagauggcacuuaua

SEQ ID NO: 2081279 - RNA, 14 nt, Human
uagaagauguuugc

SEQ ID NO: 2081280 - RNA, 15 nt, Human
uagaagauguuugcu

SEQ ID NO: 2081281 - RNA, 15 nt, Human
uagaagucacacagu

SEQ ID NO: 2081282 - RNA, 13 nt, Human
uagaacugaauuu

SEQ ID NO: 2081283 - RNA, 17 nt, Human
uagaacugaauuuuguc

SEQ ID NO: 2081284 - RNA, 23 nt, Human
uagaacucuccaucuuauuuuca

SEQ ID NO: 2081285 - RNA, 22 nt, Human
uagaacugaauuuugucuuuau

SEQ ID NO: 2081286 - RNA, 16 nt, Human
uagaacuugacccccu

SEQ ID NO: 2081287 - RNA, 21 nt, Human
uagaaccucgagguuucucaa

SEQ ID NO: 2081288 - RNA, 22 nt, Human
uagaacucaguuuuaacuagaa

SEQ ID NO: 2081289 - RNA, 19 nt, Human
uagaacucaguuuuaacua

SEQ ID NO: 2081290 - RNA, 18 nt, Human
uacuucaaguuaaaguga

SEQ ID NO: 2081291 - RNA, 23 nt, Human
uacuucaaguuaaagugaauaac

SEQ ID NO: 2081292 - RNA, 21 nt, Human
uacuucaaguuaaagugaaua

SEQ ID NO: 2081293 - RNA, 21 nt, Human
uagacagagucucacuguugc

SEQ ID NO: 2081294 - RNA, 22 nt, Human
uagacaaguccagccuggcaag

SEQ ID NO: 2081295 - RNA, 23 nt, Human
uagaauuuauucaauuccucugg

SEQ ID NO: 2081296 - RNA, 15 nt, Human
uagacaaaucuaagg

SEQ ID NO: 2081297 - RNA, 15 nt, Human
uagacaacccugcaa

SEQ ID NO: 2081298 - RNA, 22 nt, Human
uagaauuuauucaauuccucug

SEQ ID NO: 2081299 - RNA, 20 nt, Human
uagaauuuauucaauuccuc

SEQ ID NO: 2081300 - RNA, 15 nt, Human
uagaauuuauucaau

SEQ ID NO: 2081301 - RNA, 20 nt, Human
uagaagucuuagauguauau

SEQ ID NO: 2081302 - RNA, 18 nt, Human
uagaagucuuagauguau

SEQ ID NO: 2081303 - RNA, 19 nt, Human
uagaagucuuagauguaua

SEQ ID NO: 2081304 - RNA, 16 nt, Human
uagaagucacacagua

SEQ ID NO: 2081305 - RNA, 16 nt, Human
uagaagucuuagaugu

SEQ ID NO: 2081306 - RNA, 17 nt, Human
uagaagucuuagaugua

SEQ ID NO: 2081307 - RNA, 17 nt, Human
aauuuuuuugagacaga

SEQ ID NO: 2081308 - RNA, 21 nt, Human
aauuuuuuucaucuucucugg

SEQ ID NO: 2081309 - RNA, 15 nt, Human
acaaaaacagccuca

SEQ ID NO: 2081310 - RNA, 21 nt, Human
acaaaaacagccucacagaag

SEQ ID NO: 2081311 - RNA, 19 nt, Human
acaaaaaaaguugaaggcc

SEQ ID NO: 2081312 - RNA, 13 nt, Human
acaaaaaacaaua

SEQ ID NO: 2081313 - RNA, 19 nt, Human
aauuuuucagaugcuucug

SEQ ID NO: 2081314 - RNA, 20 nt, Human
aauuuuucauugauaugaaa

SEQ ID NO: 2081315 - RNA, 23 nt, Human
aauuuuucauugauaugaaaaau

SEQ ID NO: 2081316 - RNA, 22 nt, Human
aauuuuucucuaacucagaaac

SEQ ID NO: 2081317 - RNA, 20 nt, Human
aauuuuucucuaacucagaa

SEQ ID NO: 2081318 - RNA, 15 nt, Human
aauuuuuuaaaaagc

SEQ ID NO: 2081319 - RNA, 17 nt, Human
aauuuuuuauucuugug

SEQ ID NO: 2081320 - RNA, 18 nt, Human
aauuuuuuauucuuguga

SEQ ID NO: 2081321 - RNA, 21 nt, Human
aauuuuuuauucuugugaaua

SEQ ID NO: 2081322 - RNA, 23 nt, Human
aauuuuuuauucuugugaauaug

SEQ ID NO: 2081323 - RNA, 15 nt, Human
aauuuuuuucaauau

SEQ ID NO: 2081324 - RNA, 19 nt, Human
aauuuuuuucaauauuuau

SEQ ID NO: 2081325 - RNA, 18 nt, Human
aauuuuuuuauguuuugu

SEQ ID NO: 2081326 - RNA, 23 nt, Human
aauuuuuuuauguuuuguuucug

SEQ ID NO: 2081327 - RNA, 20 nt, Human
aauuuguacauauguaaaau

SEQ ID NO: 2081328 - RNA, 17 nt, Human
aauuuguaggguuucua

SEQ ID NO: 2081329 - RNA, 14 nt, Human
aauuuguauaaaau

SEQ ID NO: 2081330 - RNA, 15 nt, Human
aauuuguauaaaaug

SEQ ID NO: 2081331 - RNA, 14 nt, Human
aauuugucauuuug

SEQ ID NO: 2081332 - RNA, 16 nt, Human
aauuugucauuuugaa

SEQ ID NO: 2081333 - RNA, 17 nt, Human
aauuugucauuuugaag

SEQ ID NO: 2081334 - RNA, 18 nt, Human
aauuugucauuuugaagc

SEQ ID NO: 2081335 - RNA, 19 nt, Human
aauuugucauuuugaagcu

SEQ ID NO: 2081336 - RNA, 20 nt, Human
aauuugucauuuugaagcua

SEQ ID NO: 2081337 - RNA, 22 nt, Human
aauuugucauuuugaagcuaau

SEQ ID NO: 2081338 - RNA, 14 nt, Human
aauuuuaacacaca

SEQ ID NO: 2081339 - RNA, 12 nt, Human
aauuuuaaauua

SEQ ID NO: 2081340 - RNA, 16 nt, Human
aauuuuaagauuccuu

SEQ ID NO: 2081341 - RNA, 17 nt, Human
aauuuuaagauuccuuu

SEQ ID NO: 2081342 - RNA, 18 nt, Human
aauuuuaagauuccuuuu

SEQ ID NO: 2081343 - RNA, 19 nt, Human
aauuuuaagauuccuuuuc

SEQ ID NO: 2081344 - RNA, 18 nt, Human
aauuuuaaauaaaaguga

SEQ ID NO: 2081345 - RNA, 22 nt, Human
aauuuuaaauaaaagugaucaa

SEQ ID NO: 2081346 - RNA, 17 nt, Human
aauuuuaaauaaaagug

SEQ ID NO: 2081347 - RNA, 19 nt, Human
aauuuuaagugcuuuguaa

SEQ ID NO: 2081348 - RNA, 16 nt, Human
aauuuuuauuaugcau

SEQ ID NO: 2081349 - RNA, 17 nt, Human
aauuuuuauuaugcaua

SEQ ID NO: 2081350 - RNA, 19 nt, Human
aauuuuuauuaugcauaac

SEQ ID NO: 2081351 - RNA, 15 nt, Human
aauuuuucagaugcu

SEQ ID NO: 2081352 - RNA, 17 nt, Human
aauuuuuauuaaauuau

SEQ ID NO: 2081353 - RNA, 18 nt, Human
aauuuuuauuaaauuaug

SEQ ID NO: 2081354 - RNA, 16 nt, Human
aauuucucuacugucu

SEQ ID NO: 2081355 - RNA, 14 nt, Human
aauuucucuacaga

SEQ ID NO: 2081356 - RNA, 23 nt, Human
aauuucucuacagaugucccauu

SEQ ID NO: 2081357 - RNA, 14 nt, Human
aauuugaaauuuag

SEQ ID NO: 2081358 - RNA, 13 nt, Human
aauuugaaccaaa

SEQ ID NO: 2081359 - RNA, 16 nt, Human
aauuugaaccaaaaca

SEQ ID NO: 2081360 - RNA, 17 nt, Human
aauuugaaccaaaacau

SEQ ID NO: 2081361 - RNA, 23 nt, Human
aauuugaaccaaaacauuccguu

SEQ ID NO: 2081362 - RNA, 12 nt, Human
aauuugaaugaa

SEQ ID NO: 2081363 - RNA, 13 nt, Human
aauuugaaugaaa

SEQ ID NO: 2081364 - RNA, 14 nt, Human
aauuugaaugaaaa

SEQ ID NO: 2081365 - RNA, 15 nt, Human
aauuugaaugaaaaa

SEQ ID NO: 2081366 - RNA, 16 nt, Human
aauuugaaugaaaaau

SEQ ID NO: 2081367 - RNA, 21 nt, Human
aauuugauaguauugugcaua

SEQ ID NO: 2081368 - RNA, 20 nt, Human
aauuugauacauaugugaau

SEQ ID NO: 2081369 - RNA, 21 nt, Human
aauuugauacauaugugaaua

SEQ ID NO: 2081370 - RNA, 24 nt, Human
aauuugaguaaucugaucguucuu

SEQ ID NO: 2081371 - RNA, 20 nt, Human
aauuugaguuggaucaucua

SEQ ID NO: 2081372 - RNA, 16 nt, Human
aauuugaugaaagcug

SEQ ID NO: 2081373 - RNA, 17 nt, Human
aauuugaugaaagcuga

SEQ ID NO: 2081374 - RNA, 18 nt, Human
aauuugaucguuccaguu

SEQ ID NO: 2081375 - RNA, 16 nt, Human
aauuuaugaguuuuug

SEQ ID NO: 2081376 - RNA, 19 nt, Human
aauuuaugaguuuuugaua

SEQ ID NO: 2081377 - RNA, 20 nt, Human
aauuuaugaguuuuugauag

SEQ ID NO: 2081378 - RNA, 22 nt, Human
aauuucuaaaaaacagaggcca

SEQ ID NO: 2081379 - RNA, 17 nt, Human
aauuuagaaauauaauu

SEQ ID NO: 2081380 - RNA, 20 nt, Human
aauuuaucuugucucugggc

SEQ ID NO: 2081381 - RNA, 19 nt, Human
aauuuaucuugucucuggg

SEQ ID NO: 2081382 - RNA, 18 nt, Human
aauuuaucuugucucugg

SEQ ID NO: 2081383 - RNA, 19 nt, Human
aauugcuuaccaaaggaua

SEQ ID NO: 2081384 - RNA, 14 nt, Human
uacuguaaagaauu

SEQ ID NO: 2081385 - RNA, 14 nt, Human
aauugcucaaguuc

SEQ ID NO: 2081386 - RNA, 21 nt, Human
aauugcucaugcauaguccca

SEQ ID NO: 2081387 - RNA, 12 nt, Human
aauugcuccuug

SEQ ID NO: 2081388 - RNA, 22 nt, Human
aauuguuuggggaugagaaagg

SEQ ID NO: 2081389 - RNA, 20 nt, Human
aauuguuuaaguguuguaaa

SEQ ID NO: 2081390 - RNA, 15 nt, Human
aauuguuuaaguguu

SEQ ID NO: 2081391 - RNA, 20 nt, Human
aauuguuucaaaauaaaaac

SEQ ID NO: 2081392 - RNA, 13 nt, Human
aauugugugguca

SEQ ID NO: 2081393 - RNA, 21 nt, Human
aauuguguggucaguggcucu

SEQ ID NO: 2081394 - RNA, 12 nt, Human
aauuuaaaacaa

SEQ ID NO: 2081395 - RNA, 13 nt, Human
aauuuaaaacaaa

SEQ ID NO: 2081396 - RNA, 15 nt, Human
aauuuaaaacaaaca

SEQ ID NO: 2081397 - RNA, 16 nt, Human
aauuuaaaacaaacaa

SEQ ID NO: 2081398 - RNA, 14 nt, Human
aauuguuuuuuauc

SEQ ID NO: 2081399 - RNA, 17 nt, Human
aauuguuuuuuaucuuu

SEQ ID NO: 2081400 - RNA, 18 nt, Human
aauuguuuuuuaucuuuu

SEQ ID NO: 2081401 - RNA, 19 nt, Human
aauuguuuuuuaucuuuuc

SEQ ID NO: 2081402 - RNA, 22 nt, Human
aauuguuuuuuaucuuuucuac

SEQ ID NO: 2081403 - RNA, 14 nt, Human
aauuuaaaaaaaua

SEQ ID NO: 2081404 - RNA, 17 nt, Human
aauuuaaaaaaauacag

SEQ ID NO: 2081405 - RNA, 12 nt, Human
aauuuaaagcaa

SEQ ID NO: 2081406 - RNA, 12 nt, Human
aauuuaaaggcu

SEQ ID NO: 2081407 - RNA, 19 nt, Human
aauuuacauacucugcuua

SEQ ID NO: 2081408 - RNA, 19 nt, Human
aauuuaauucauguuucuu

SEQ ID NO: 2081409 - RNA, 23 nt, Human
aauuuaauucauguuucuuaaau

SEQ ID NO: 2081410 - RNA, 14 nt, Human
aauuuaaugcaugu

SEQ ID NO: 2081411 - RNA, 14 nt, Human
aauuuaauauagcu

SEQ ID NO: 2081412 - RNA, 21 nt, Human
aauuuaauuagggguugcuaa

SEQ ID NO: 2081413 - RNA, 18 nt, Human
aauuuaauucauguuucu

SEQ ID NO: 2081414 - RNA, 23 nt, Human
uacugacacuuugccagaaagca

SEQ ID NO: 2081415 - RNA, 17 nt, Human
uacugaagguaaaauug

SEQ ID NO: 2081416 - RNA, 19 nt, Human
uacuggugcagucauuaug

SEQ ID NO: 2081417 - RNA, 14 nt, Human
uacucuuguaagau

SEQ ID NO: 2081418 - RNA, 19 nt, Human
uacucuuguaagauuuuga

SEQ ID NO: 2081419 - RNA, 20 nt, Human
uacucuuguaagauuuugaa

SEQ ID NO: 2081420 - RNA, 21 nt, Human
uacucuuguaagauuuugaaa

SEQ ID NO: 2081421 - RNA, 23 nt, Human
uacucuuguaagauuuugaaaac

SEQ ID NO: 2081422 - RNA, 21 nt, Human
uacucugugucagguggggca

SEQ ID NO: 2081423 - RNA, 14 nt, Human
uacucuguuccuuc

SEQ ID NO: 2081424 - RNA, 19 nt, Human
uacucuguuccuucacauc

SEQ ID NO: 2081425 - RNA, 18 nt, Human
uacucuuaggaagagaaa

SEQ ID NO: 2081426 - RNA, 21 nt, Human
uacucuuaggaagagaaacca

SEQ ID NO: 2081427 - RNA, 14 nt, Human
uacguuaccaggca

SEQ ID NO: 2081428 - RNA, 18 nt, Human
uacgucaaacaugaagug

SEQ ID NO: 2081429 - RNA, 14 nt, Human
uacgucugacaggc

SEQ ID NO: 2081430 - RNA, 18 nt, Human
aauucuuuuuuaaauuuu

SEQ ID NO: 2081431 - RNA, 16 nt, Human
uacguaguguagauuu

SEQ ID NO: 2081432 - RNA, 13 nt, Human
uacguaugagacg

SEQ ID NO: 2081433 - RNA, 17 nt, Human
uacuagucuguguggga

SEQ ID NO: 2081434 - RNA, 19 nt, Human
uacuagucugugugggacu

SEQ ID NO: 2081435 - RNA, 23 nt, Human
uacuagucugugugggacuguac

SEQ ID NO: 2081436 - RNA, 14 nt, Human
uacuaguuacacau

SEQ ID NO: 2081437 - RNA, 19 nt, Human
uacuaguuacacaucuuca

SEQ ID NO: 2081438 - RNA, 22 nt, Human
uacuaguucagacacuuuggaa

SEQ ID NO: 2081439 - RNA, 16 nt, Human
uacuauguaucaauga

SEQ ID NO: 2081440 - RNA, 17 nt, Human
uacuauuaagcaguaaa

SEQ ID NO: 2081441 - RNA, 20 nt, Human
uacuauuaagcaguaaaaac

SEQ ID NO: 2081442 - RNA, 22 nt, Human
uacuauuaagcaguaaaaacug

SEQ ID NO: 2081443 - RNA, 19 nt, Human
uacucaagaggcugaggca

SEQ ID NO: 2081444 - RNA, 15 nt, Human
uacucaagaggcuga

SEQ ID NO: 2081445 - RNA, 18 nt, Human
aauucuucagguggaaaa

SEQ ID NO: 2081446 - RNA, 19 nt, Human
uaccauagcgcugcucuua

SEQ ID NO: 2081447 - RNA, 15 nt, Human
aauucuuacauguuu

SEQ ID NO: 2081448 - RNA, 16 nt, Human
aauucuuaaguauguu

SEQ ID NO: 2081449 - RNA, 13 nt, Human
aauucuuacaugu

SEQ ID NO: 2081450 - RNA, 17 nt, Human
aauucuuacaaacaugu

SEQ ID NO: 2081451 - RNA, 22 nt, Human
aauucuucaccuaagucucugu

SEQ ID NO: 2081452 - RNA, 23 nt, Human
aauucuucaccuaagucucugug

SEQ ID NO: 2081453 - RNA, 14 nt, Human
uacccuuaagcuag

SEQ ID NO: 2081454 - RNA, 20 nt, Human
uacccuuggcucaauccucu

SEQ ID NO: 2081455 - RNA, 18 nt, Human
uacccuucugugcccagc

SEQ ID NO: 2081456 - RNA, 19 nt, Human
uacccuucugugcccagcu

SEQ ID NO: 2081457 - RNA, 20 nt, Human
uacccuucugugcccagcuc

SEQ ID NO: 2081458 - RNA, 21 nt, Human
uacccuucugugcccagcuca

SEQ ID NO: 2081459 - RNA, 14 nt, Human
uacccuucuuucca

SEQ ID NO: 2081460 - RNA, 21 nt, Human
uacccuucuuuccauuucucu

SEQ ID NO: 2081461 - RNA, 22 nt, Human
uacccuucuuuccauuucucuc

SEQ ID NO: 2081462 - RNA, 22 nt, Human
aauugaacuuaaauaaauguca

SEQ ID NO: 2081463 - RNA, 12 nt, Human
aauugaaggaaa

SEQ ID NO: 2081464 - RNA, 13 nt, Human
aauugaaggaaag

SEQ ID NO: 2081465 - RNA, 14 nt, Human
aauugaaggaaaga

SEQ ID NO: 2081466 - RNA, 16 nt, Human
aauugaaggaaagauu

SEQ ID NO: 2081467 - RNA, 12 nt, Human
aauugaaauaua

SEQ ID NO: 2081468 - RNA, 22 nt, Human
aauugaaaggcauucucugaag

SEQ ID NO: 2081469 - RNA, 17 nt, Human
aauugaaaggcauucuc

SEQ ID NO: 2081470 - RNA, 21 nt, Human
aauugaaaggcauucucugaa

SEQ ID NO: 2081471 - RNA, 21 nt, Human
aauugaacuuaaauaaauguc

SEQ ID NO: 2081472 - RNA, 15 nt, Human
aauucuuguauauua

SEQ ID NO: 2081473 - RNA, 16 nt, Human
aauucuuguauauuau

SEQ ID NO: 2081474 - RNA, 20 nt, Human
aauucuuguauauuauggaa

SEQ ID NO: 2081475 - RNA, 13 nt, Human
aauucuuggaaua

SEQ ID NO: 2081476 - RNA, 15 nt, Human
aauucuuggaauacu

SEQ ID NO: 2081477 - RNA, 14 nt, Human
aauucuuguauauu

SEQ ID NO: 2081478 - RNA, 15 nt, Human
acagucuuguauuaa

SEQ ID NO: 2081479 - RNA, 18 nt, Human
acagucuuguauuaaguu

SEQ ID NO: 2081480 - RNA, 22 nt, Human
acagucuuguauuaaguuguua

SEQ ID NO: 2081481 - RNA, 14 nt, Human
acagucuuguauua

SEQ ID NO: 2081482 - RNA, 20 nt, Human
acagucucuuuaaucuucag

SEQ ID NO: 2081483 - RNA, 14 nt, Human
acagucucuuuaau

SEQ ID NO: 2081484 - RNA, 19 nt, Human
acagucucuuuaaucuuca

SEQ ID NO: 2081485 - RNA, 23 nt, Human
acaguccugggagaaccucaggc

SEQ ID NO: 2081486 - RNA, 21 nt, Human
acaguccugggagaaccucag

SEQ ID NO: 2081487 - RNA, 22 nt, Human
acaguccugggagaaccucagg

SEQ ID NO: 2081488 - RNA, 16 nt, Human
acaguuaacuuucaga

SEQ ID NO: 2081489 - RNA, 21 nt, Human
acaguuaaaugagaacaugaa

SEQ ID NO: 2081490 - RNA, 13 nt, Human
acaguuaacuuuc

SEQ ID NO: 2081491 - RNA, 14 nt, Human
acaguuaacuuuca

SEQ ID NO: 2081492 - RNA, 23 nt, Human
acaguguuucccauaauuuucuu

SEQ ID NO: 2081493 - RNA, 19 nt, Human
acaguguuucgacagcuga

SEQ ID NO: 2081494 - RNA, 9 nt, Human
acaguguuu

SEQ ID NO: 2081495 - RNA, 15 nt, Human
acaguguuucccaua

SEQ ID NO: 2081496 - RNA, 16 nt, Human
acaguguuucccauaa

SEQ ID NO: 2081497 - RNA, 18 nt, Human
acaguguuucccauaauu

SEQ ID NO: 2081498 - RNA, 22 nt, Human
acaguguuucccauaauuuucu

SEQ ID NO: 2081499 - RNA, 16 nt, Human
acaguguuauuuucuu

SEQ ID NO: 2081500 - RNA, 20 nt, Human
acaguguuauuuucuuugaa

SEQ ID NO: 2081501 - RNA, 22 nt, Human
acaguguuauuuucuuugaaau

SEQ ID NO: 2081502 - RNA, 17 nt, Human
acagugaaggcuguccu

SEQ ID NO: 2081503 - RNA, 15 nt, Human
acagugugguaguua

SEQ ID NO: 2081504 - RNA, 20 nt, Human
acagugugguaguuaauaaa

SEQ ID NO: 2081505 - RNA, 16 nt, Human
acagggcagagccggg

SEQ ID NO: 2081506 - RNA, 22 nt, Human
acagggcacaccgggcacucag

SEQ ID NO: 2081507 - RNA, 17 nt, Human
acaggcugggcuucagu

SEQ ID NO: 2081508 - RNA, 14 nt, Human
acaggcugggcuuc

SEQ ID NO: 2081509 - RNA, 21 nt, Human
acaggcugggcuucaguggca

SEQ ID NO: 2081510 - RNA, 22 nt, Human
acaguaugguaacuuugcaaau

SEQ ID NO: 2081511 - RNA, 23 nt, Human
acaguaugguaacuuugcaaaug

SEQ ID NO: 2081512 - RNA, 14 nt, Human
acaguaacuugguu

SEQ ID NO: 2081513 - RNA, 15 nt, Human
acaguaacuugguua

SEQ ID NO: 2081514 - RNA, 17 nt, Human
acaguaacuugguuaua

SEQ ID NO: 2081515 - RNA, 20 nt, Human
acaguaacuugguuauacau

SEQ ID NO: 2081516 - RNA, 19 nt, Human
acaguauuacuucugcuac

SEQ ID NO: 2081517 - RNA, 17 nt, Human
acaguauuacuucugcu

SEQ ID NO: 2081518 - RNA, 16 nt, Human
acaguauuacuucugc

SEQ ID NO: 2081519 - RNA, 15 nt, Human
acaguauuacuucug

SEQ ID NO: 2081520 - RNA, 16 nt, Human
acagucaaaacagaga

SEQ ID NO: 2081521 - RNA, 17 nt, Human
acagucaaaacagagau

SEQ ID NO: 2081522 - RNA, 17 nt, Human
acagucaaggaguggcu

SEQ ID NO: 2081523 - RNA, 18 nt, Human
acagucaaggaguggcuu

SEQ ID NO: 2081524 - RNA, 14 nt, Human
acaguauucuguac

SEQ ID NO: 2081525 - RNA, 17 nt, Human
acaguauucuguaccau

SEQ ID NO: 2081526 - RNA, 14 nt, Human
acaguauuuuccca

SEQ ID NO: 2081527 - RNA, 12 nt, Human
acaguccuggga

SEQ ID NO: 2081528 - RNA, 18 nt, Human
acagucaaaacagagaug

SEQ ID NO: 2081529 - RNA, 12 nt, Human
uauuaaaaaugg

SEQ ID NO: 2081530 - RNA, 14 nt, Human
uauuaaaaauggua

SEQ ID NO: 2081531 - RNA, 15 nt, Human
uauuaaaaaugguaa

SEQ ID NO: 2081532 - RNA, 20 nt, Human
uauuaaaaaugguaaaauug

SEQ ID NO: 2081533 - RNA, 23 nt, Human
uauuaaaaauuggcuaguugaau

SEQ ID NO: 2081534 - RNA, 12 nt, Human
uauuaaagacag

SEQ ID NO: 2081535 - RNA, 13 nt, Human
uauuacauaaaua

SEQ ID NO: 2081536 - RNA, 14 nt, Human
uauuacauaaauaa

SEQ ID NO: 2081537 - RNA, 18 nt, Human
uauuacauccuuguggca

SEQ ID NO: 2081538 - RNA, 23 nt, Human
uauuacauccuuguggcacauuu

SEQ ID NO: 2081539 - RNA, 12 nt, Human
uauuacaucuuu

SEQ ID NO: 2081540 - RNA, 17 nt, Human
uauuacaucuuucacau

SEQ ID NO: 2081541 - RNA, 19 nt, Human
uauguuuuaagaggcaggg

SEQ ID NO: 2081542 - RNA, 17 nt, Human
uauguuuuaagaggcag

SEQ ID NO: 2081543 - RNA, 14 nt, Human
uauguuuuagcaug

SEQ ID NO: 2081544 - RNA, 16 nt, Human
uauguuuuagcaugug

SEQ ID NO: 2081545 - RNA, 18 nt, Human
uauguuuuagcauguguu

SEQ ID NO: 2081546 - RNA, 12 nt, Human
uaugugugugua

SEQ ID NO: 2081547 - RNA, 13 nt, Human
uauguguguguau

SEQ ID NO: 2081548 - RNA, 19 nt, Human
uauguguguguaugcuacu

SEQ ID NO: 2081549 - RNA, 19 nt, Human
uauguguguguauguuugc

SEQ ID NO: 2081550 - RNA, 12 nt, Human
uauguguguaua

SEQ ID NO: 2081551 - RNA, 19 nt, Human
uauguguguauauguaugu

SEQ ID NO: 2081552 - RNA, 12 nt, Human
uauguguguaug

SEQ ID NO: 2081553 - RNA, 21 nt, Human
uauguguguaugggugugugu

SEQ ID NO: 2081554 - RNA, 14 nt, Human
acagcucccucugc

SEQ ID NO: 2081555 - RNA, 17 nt, Human
acagcucccucugccug

SEQ ID NO: 2081556 - RNA, 18 nt, Human
acagcucccaccccaccc

SEQ ID NO: 2081557 - RNA, 22 nt, Human
acagcucccaccccacccccuu

SEQ ID NO: 2081558 - RNA, 16 nt, Human
acagcucccucugccu

SEQ ID NO: 2081559 - RNA, 21 nt, Human
uauucacgugcagcagcaaca

SEQ ID NO: 2081560 - RNA, 23 nt, Human
uauucacgugcagcagcaacaca

SEQ ID NO: 2081561 - RNA, 21 nt, Human
uauucacugaaguucuccuga

SEQ ID NO: 2081562 - RNA, 17 nt, Human
uauucaagaaagccagu

SEQ ID NO: 2081563 - RNA, 19 nt, Human
uauucaagaaagccagucu

SEQ ID NO: 2081564 - RNA, 20 nt, Human
uauucaagaaagccagucuu

SEQ ID NO: 2081565 - RNA, 22 nt, Human
uauucaagaaagccagucuuaa

SEQ ID NO: 2081566 - RNA, 23 nt, Human
uauucaagaaagccagucuuaac

SEQ ID NO: 2081567 - RNA, 10 nt, Human
uauucaaggu

SEQ ID NO: 2081568 - RNA, 11 nt, Human
uauucaaggua

SEQ ID NO: 2081569 - RNA, 19 nt, Human
uauucaagguaaaauucua

SEQ ID NO: 2081570 - RNA, 20 nt, Human
uauucaagguaaaauucuaa

SEQ ID NO: 2081571 - RNA, 21 nt, Human
uauucaagguaaaauucuaaa

SEQ ID NO: 2081572 - RNA, 16 nt, Human
uauuagacuuuagaaa

SEQ ID NO: 2081573 - RNA, 12 nt, Human
uauuagagaaga

SEQ ID NO: 2081574 - RNA, 19 nt, Human
uauuaccucugauaccuca

SEQ ID NO: 2081575 - RNA, 14 nt, Human
uauuaccucugaua

SEQ ID NO: 2081576 - RNA, 13 nt, Human
uauuaaagggggg

SEQ ID NO: 2081577 - RNA, 20 nt, Human
uauuaccacugaagauagaa

SEQ ID NO: 2081578 - RNA, 13 nt, Human
uauuaccucugau

SEQ ID NO: 2081579 - RNA, 11 nt, Human
uauuaccucug

SEQ ID NO: 2081580 - RNA, 21 nt, Human
uauuagccagguaaugugaau

SEQ ID NO: 2081581 - RNA, 15 nt, Human
uauuagccacaaaau

SEQ ID NO: 2081582 - RNA, 23 nt, Human
uauuagccacaaaauugggaaag

SEQ ID NO: 2081583 - RNA, 11 nt, Human
uauuguacagu

SEQ ID NO: 2081584 - RNA, 12 nt, Human
uauuguaagaua

SEQ ID NO: 2081585 - RNA, 12 nt, Human
uauuguacaguu

SEQ ID NO: 2081586 - RNA, 13 nt, Human
uauuguacaguuu

SEQ ID NO: 2081587 - RNA, 14 nt, Human
uauuguacaguuuu

SEQ ID NO: 2081588 - RNA, 15 nt, Human
uauuguacaguuuuu

SEQ ID NO: 2081589 - RNA, 17 nt, Human
uauuguacaguuuuuau

SEQ ID NO: 2081590 - RNA, 14 nt, Human
uauuguaccucucu

SEQ ID NO: 2081591 - RNA, 13 nt, Human
uauuguaccucuc

SEQ ID NO: 2081592 - RNA, 11 nt, Human
uauuguaccuc

SEQ ID NO: 2081593 - RNA, 16 nt, Human
uauuguacguuuaaag

SEQ ID NO: 2081594 - RNA, 20 nt, Human
uauuuaagauaguuuugcca

SEQ ID NO: 2081595 - RNA, 16 nt, Human
uauuuaagcuuauguc

SEQ ID NO: 2081596 - RNA, 14 nt, Human
uauuuaaggagaug

SEQ ID NO: 2081597 - RNA, 22 nt, Human
uauuuaaggagauguaagagcu

SEQ ID NO: 2081598 - RNA, 23 nt, Human
uauuuaaggagauguaagagcuu

SEQ ID NO: 2081599 - RNA, 15 nt, Human
uauuuaaguauucaa

SEQ ID NO: 2081600 - RNA, 16 nt, Human
uauuuaaguauucaag

SEQ ID NO: 2081601 - RNA, 18 nt, Human
uauuuaaguauucaagaa

SEQ ID NO: 2081602 - RNA, 21 nt, Human
uauuuaaguauucaagaaagc

SEQ ID NO: 2081603 - RNA, 15 nt, Human
uauuuaaugaaagac

SEQ ID NO: 2081604 - RNA, 21 nt, Human
uauuuaaugaaagacuguaca

SEQ ID NO: 2081605 - RNA, 16 nt, Human
uauugucagauauuuu

SEQ ID NO: 2081606 - RNA, 15 nt, Human
uauugugaaguacau

SEQ ID NO: 2081607 - RNA, 17 nt, Human
uauugugaaguacauau

SEQ ID NO: 2081608 - RNA, 19 nt, Human
uauugugaaguacauauua

SEQ ID NO: 2081609 - RNA, 13 nt, Human
uauuuaagaaaau

SEQ ID NO: 2081610 - RNA, 14 nt, Human
uauuuaagaaaaua

SEQ ID NO: 2081611 - RNA, 19 nt, Human
uauuuaagaaaauacaaua

SEQ ID NO: 2081612 - RNA, 20 nt, Human
uauuuaagaaaauacaauaa

SEQ ID NO: 2081613 - RNA, 21 nt, Human
uauuuaagaaaauacaauaaa

SEQ ID NO: 2081614 - RNA, 22 nt, Human
uauuuaagaaaauacaauaaac

SEQ ID NO: 2081615 - RNA, 17 nt, Human
uauuuagauuguuaaaa

SEQ ID NO: 2081616 - RNA, 19 nt, Human
uauuuagauuguuaaaaua

SEQ ID NO: 2081617 - RNA, 18 nt, Human
uauuuacuucuuauacau

SEQ ID NO: 2081618 - RNA, 22 nt, Human
uauuuacugagcuucucuguga

SEQ ID NO: 2081619 - RNA, 21 nt, Human
uauuuacugagcuucucugug

SEQ ID NO: 2081620 - RNA, 23 nt, Human
uauuuacugagcuucucugugaa

SEQ ID NO: 2081621 - RNA, 19 nt, Human
uauuuacuucguuuugguu

SEQ ID NO: 2081622 - RNA, 19 nt, Human
uauuuacugagcuucucug

SEQ ID NO: 2081623 - RNA, 16 nt, Human
uauuuacugagcuucu

SEQ ID NO: 2081624 - RNA, 14 nt, Human
uauuuacugagcuu

SEQ ID NO: 2081625 - RNA, 17 nt, Human
uauuuacauaugaaauu

SEQ ID NO: 2081626 - RNA, 21 nt, Human
uauuuacauaugaaauuuaau

SEQ ID NO: 2081627 - RNA, 14 nt, Human
uauuuacauaugaa

SEQ ID NO: 2081628 - RNA, 16 nt, Human
uauuuacauaugaaau

SEQ ID NO: 2081629 - RNA, 23 nt, Human
uauuuaauuuuuuugagacagag

SEQ ID NO: 2081630 - RNA, 13 nt, Human
uauuuaauuguaa

SEQ ID NO: 2081631 - RNA, 14 nt, Human
uauuuaauuguaaa

SEQ ID NO: 2081632 - RNA, 15 nt, Human
uauuuaauuguaaac

SEQ ID NO: 2081633 - RNA, 16 nt, Human
uauuuaauuguaaacu

SEQ ID NO: 2081634 - RNA, 17 nt, Human
uauuuaauuguaaacug

SEQ ID NO: 2081635 - RNA, 18 nt, Human
uauuuaauuguaaacugu

SEQ ID NO: 2081636 - RNA, 20 nt, Human
uauuuaauuguaaacuguac

SEQ ID NO: 2081637 - RNA, 15 nt, Human
uauuuaauguuaugu

SEQ ID NO: 2081638 - RNA, 21 nt, Human
uauuuagcaugacaagcccca

SEQ ID NO: 2081639 - RNA, 11 nt, Human
uauuuagcaug

SEQ ID NO: 2081640 - RNA, 22 nt, Human
uauuuagauuguuaaaauaacu

SEQ ID NO: 2081641 - RNA, 13 nt, Human
uauuuauuuaaau

SEQ ID NO: 2081642 - RNA, 17 nt, Human
uauuuagggaacugcuu

SEQ ID NO: 2081643 - RNA, 18 nt, Human
uauuuagggaacugcuug

SEQ ID NO: 2081644 - RNA, 17 nt, Human
uauuuaggcagauugaa

SEQ ID NO: 2081645 - RNA, 13 nt, Human
uauuuauuuacug

SEQ ID NO: 2081646 - RNA, 17 nt, Human
uauuuauuuacugagcu

SEQ ID NO: 2081647 - RNA, 13 nt, Human
uauuuauuuaugg

SEQ ID NO: 2081648 - RNA, 14 nt, Human
uauuuauuuaugga

SEQ ID NO: 2081649 - RNA, 14 nt, Human
uauuuauuuaaauu

SEQ ID NO: 2081650 - RNA, 16 nt, Human
uauuuauuuaagcuua

SEQ ID NO: 2081651 - RNA, 14 nt, Human
uauuucaaaaauuu

SEQ ID NO: 2081652 - RNA, 15 nt, Human
uauuucaaaaauuug

SEQ ID NO: 2081653 - RNA, 16 nt, Human
uauuucaaaaauuugg

SEQ ID NO: 2081654 - RNA, 17 nt, Human
uauuucaaaaauuugga

SEQ ID NO: 2081655 - RNA, 20 nt, Human
uauuucaaaaauuuggaauu

SEQ ID NO: 2081656 - RNA, 21 nt, Human
uauuucaaaaauuuggaauuc

SEQ ID NO: 2081657 - RNA, 22 nt, Human
uauuucaaaaauuuggaauucu

SEQ ID NO: 2081658 - RNA, 20 nt, Human
uauuucaaaauauacauuca

SEQ ID NO: 2081659 - RNA, 17 nt, Human
uauuuauuuuccucccc

SEQ ID NO: 2081660 - RNA, 18 nt, Human
uauuuauuuuccucccca

SEQ ID NO: 2081661 - RNA, 22 nt, Human
uauuucaauuuccaagagcuga

SEQ ID NO: 2081662 - RNA, 17 nt, Human
uauucuggcugauaaaa

SEQ ID NO: 2081663 - RNA, 21 nt, Human
uauucuggcugauaaaagaua

SEQ ID NO: 2081664 - RNA, 12 nt, Human
uauucucuuugg

SEQ ID NO: 2081665 - RNA, 13 nt, Human
uauucucuuuggu

SEQ ID NO: 2081666 - RNA, 20 nt, Human
uauucugccuuugcagaaac

SEQ ID NO: 2081667 - RNA, 15 nt, Human
uauucuuauuuaaug

SEQ ID NO: 2081668 - RNA, 16 nt, Human
uauucuguuggccagu

SEQ ID NO: 2081669 - RNA, 13 nt, Human
acaguuccuucag

SEQ ID NO: 2081670 - RNA, 18 nt, Human
acaguuccucgcccuggg

SEQ ID NO: 2081671 - RNA, 19 nt, Human
acaguuccucgcccugggu

SEQ ID NO: 2081672 - RNA, 20 nt, Human
acaguucaauucucauuugu

SEQ ID NO: 2081673 - RNA, 22 nt, Human
acaguuaggguugaguuacuuc

SEQ ID NO: 2081674 - RNA, 12 nt, Human
acaguuccucgc

SEQ ID NO: 2081675 - RNA, 14 nt, Human
acaguuccucgccc

SEQ ID NO: 2081676 - RNA, 15 nt, Human
acaguuccucgcccu

SEQ ID NO: 2081677 - RNA, 16 nt, Human
acaguuccucgcccug

SEQ ID NO: 2081678 - RNA, 13 nt, Human
uauuguaaauaca

SEQ ID NO: 2081679 - RNA, 16 nt, Human
uauuguaaauacaagu

SEQ ID NO: 2081680 - RNA, 13 nt, Human
uauugguccagcu

SEQ ID NO: 2081681 - RNA, 22 nt, Human
uauugguccagcuugcucuuca

SEQ ID NO: 2081682 - RNA, 18 nt, Human
uauuggguucauuauugg

SEQ ID NO: 2081683 - RNA, 20 nt, Human
uauuggguucauuauuggaa

SEQ ID NO: 2081684 - RNA, 14 nt, Human
uauuggguucauua

SEQ ID NO: 2081685 - RNA, 16 nt, Human
uauuggguucauuauu

SEQ ID NO: 2081686 - RNA, 14 nt, Human
uauugagacaaaaa

SEQ ID NO: 2081687 - RNA, 15 nt, Human
uauugagacaaaaau

SEQ ID NO: 2081688 - RNA, 17 nt, Human
uauugagacaaaaauua

SEQ ID NO: 2081689 - RNA, 18 nt, Human
uauugagaauuuuaaauu

SEQ ID NO: 2081690 - RNA, 15 nt, Human
uauugaaaaaaauug

SEQ ID NO: 2081691 - RNA, 13 nt, Human
uauugaaaaaaau

SEQ ID NO: 2081692 - RNA, 18 nt, Human
uauugaacuuggaaagaa

SEQ ID NO: 2081693 - RNA, 12 nt, Human
uauucuugugaa

SEQ ID NO: 2081694 - RNA, 14 nt, Human
uauucuugugaaua

SEQ ID NO: 2081695 - RNA, 15 nt, Human
uauucuugugaauau

SEQ ID NO: 2081696 - RNA, 22 nt, Human
uauucuugugaauauguacaua

SEQ ID NO: 2081697 - RNA, 17 nt, Human
uauugacaucagcauca

SEQ ID NO: 2081698 - RNA, 18 nt, Human
uauugacaucagcaucac

SEQ ID NO: 2081699 - RNA, 13 nt, Human
uauugacaauaau

SEQ ID NO: 2081700 - RNA, 17 nt, Human
uauugacaauaauuuca

SEQ ID NO: 2081701 - RNA, 18 nt, Human
uauugacaauaauuucag

SEQ ID NO: 2081702 - RNA, 14 nt, Human
uauugacaaacucu

SEQ ID NO: 2081703 - RNA, 15 nt, Human
uauugacaaacucuc

SEQ ID NO: 2081704 - RNA, 16 nt, Human
acaccgggccuggaga

SEQ ID NO: 2081705 - RNA, 18 nt, Human
acaccguucauucaggca

SEQ ID NO: 2081706 - RNA, 21 nt, Human
acaccuacucuaucagagaaa

SEQ ID NO: 2081707 - RNA, 14 nt, Human
acaccuagaucaga

SEQ ID NO: 2081708 - RNA, 15 nt, Human
acaccuagcaucuca

SEQ ID NO: 2081709 - RNA, 18 nt, Human
acaccaggcugugggccu

SEQ ID NO: 2081710 - RNA, 21 nt, Human
acacccagcccacuucugcca

SEQ ID NO: 2081711 - RNA, 20 nt, Human
acacccagcccacuucugcc

SEQ ID NO: 2081712 - RNA, 19 nt, Human
acacccagcccacuucugc

SEQ ID NO: 2081713 - RNA, 21 nt, Human
acaccaggcuugccugcaggc

SEQ ID NO: 2081714 - RNA, 12 nt, Human
acaccaggcugu

SEQ ID NO: 2081715 - RNA, 14 nt, Human
acaccaggcugugg

SEQ ID NO: 2081716 - RNA, 13 nt, Human
acacaucuuccac

SEQ ID NO: 2081717 - RNA, 13 nt, Human
acacaucuucccu

SEQ ID NO: 2081718 - RNA, 14 nt, Human
acacaucuucccua

SEQ ID NO: 2081719 - RNA, 15 nt, Human
acacaucuucccuag

SEQ ID NO: 2081720 - RNA, 19 nt, Human
acaccaggagucccuggua

SEQ ID NO: 2081721 - RNA, 17 nt, Human
acaccaggagucccugg

SEQ ID NO: 2081722 - RNA, 20 nt, Human
acaccagccuuucucccagg

SEQ ID NO: 2081723 - RNA, 23 nt, Human
uaguuuucauacacagccugggc

SEQ ID NO: 2081724 - RNA, 15 nt, Human
acacaucuucaacag

SEQ ID NO: 2081725 - RNA, 14 nt, Human
acacaucuccucca

SEQ ID NO: 2081726 - RNA, 12 nt, Human
acacaucuccuc

SEQ ID NO: 2081727 - RNA, 20 nt, Human
acaagcuuuuuuacacaaau

SEQ ID NO: 2081728 - RNA, 11 nt, Human
acaagcugccu

SEQ ID NO: 2081729 - RNA, 13 nt, Human
acaagcugccucc

SEQ ID NO: 2081730 - RNA, 16 nt, Human
acaagcugccucccug

SEQ ID NO: 2081731 - RNA, 17 nt, Human
acaagcuaggugcuaau

SEQ ID NO: 2081732 - RNA, 22 nt, Human
acaagcuaggugcuaauuaaua

SEQ ID NO: 2081733 - RNA, 19 nt, Human
acaagcugcacccucaggc

SEQ ID NO: 2081734 - RNA, 21 nt, Human
acaagcugcacccucaggcag

SEQ ID NO: 2081735 - RNA, 22 nt, Human
acaagcugcacccucaggcagg

SEQ ID NO: 2081736 - RNA, 23 nt, Human
acaagcugcacccucaggcaggu

SEQ ID NO: 2081737 - RNA, 18 nt, Human
uaguccaaugucuuuuua

SEQ ID NO: 2081738 - RNA, 13 nt, Human
uagucauuuugcu

SEQ ID NO: 2081739 - RNA, 22 nt, Human
uaguccaaugucuuuuuaagcu

SEQ ID NO: 2081740 - RNA, 14 nt, Human
uagucauagaagaa

SEQ ID NO: 2081741 - RNA, 15 nt, Human
uagucauagaagaac

SEQ ID NO: 2081742 - RNA, 17 nt, Human
uagucugugugcugugg

SEQ ID NO: 2081743 - RNA, 22 nt, Human
uagucugugugggacuguacac

SEQ ID NO: 2081744 - RNA, 12 nt, Human
uagucugguuuc

SEQ ID NO: 2081745 - RNA, 13 nt, Human
uagucugguuucu

SEQ ID NO: 2081746 - RNA, 18 nt, Human
uagucugugugaagguga

SEQ ID NO: 2081747 - RNA, 15 nt, Human
uaguucuauuucuau

SEQ ID NO: 2081748 - RNA, 20 nt, Human
uaguucuauuucuaucccaa

SEQ ID NO: 2081749 - RNA, 13 nt, Human
uagugagaagaau

SEQ ID NO: 2081750 - RNA, 15 nt, Human
uagugagaagaauau

SEQ ID NO: 2081751 - RNA, 16 nt, Human
uagugagaagaauauu

SEQ ID NO: 2081752 - RNA, 18 nt, Human
uagugagaagaauauugu

SEQ ID NO: 2081753 - RNA, 19 nt, Human
uagugagaagaauauuguu

SEQ ID NO: 2081754 - RNA, 15 nt, Human
uagugagaccccugu

SEQ ID NO: 2081755 - RNA, 18 nt, Human
uagugagaccccugucuc

SEQ ID NO: 2081756 - RNA, 17 nt, Human
uagugaucugaacagaa

SEQ ID NO: 2081757 - RNA, 18 nt, Human
uagugaucugaacagaaa

SEQ ID NO: 2081758 - RNA, 20 nt, Human
uaguuccucauuagcauuuu

SEQ ID NO: 2081759 - RNA, 23 nt, Human
uaguucccugaaaacccagagag

SEQ ID NO: 2081760 - RNA, 16 nt, Human
uaguuaggaaauaaaa

SEQ ID NO: 2081761 - RNA, 18 nt, Human
uaguuaggaaauaaaacc

SEQ ID NO: 2081762 - RNA, 21 nt, Human
uaguuaggaaauaaaaccuuu

SEQ ID NO: 2081763 - RNA, 22 nt, Human
uaguuaggaaauaaaaccuuuc

SEQ ID NO: 2081764 - RNA, 23 nt, Human
uaguuaggaaauaaaaccuuuca

SEQ ID NO: 2081765 - RNA, 15 nt, Human
uaguuaguagcaugu

SEQ ID NO: 2081766 - RNA, 16 nt, Human
uaguuaguagcauguu

SEQ ID NO: 2081767 - RNA, 20 nt, Human
uauagccuaggugacagagu

SEQ ID NO: 2081768 - RNA, 13 nt, Human
uauagcaauccau

SEQ ID NO: 2081769 - RNA, 16 nt, Human
uauagcuacaggaagc

SEQ ID NO: 2081770 - RNA, 22 nt, Human
uauagcuacaggaagcacccca

SEQ ID NO: 2081771 - RNA, 12 nt, Human
uauagcuauuuu

SEQ ID NO: 2081772 - RNA, 13 nt, Human
uauagcuauuuuu

SEQ ID NO: 2081773 - RNA, 12 nt, Human
uauauauacaua

SEQ ID NO: 2081774 - RNA, 13 nt, Human
uauauauacauaa

SEQ ID NO: 2081775 - RNA, 19 nt, Human
uauauauacauaacagggu

SEQ ID NO: 2081776 - RNA, 12 nt, Human
uauauauagaau

SEQ ID NO: 2081777 - RNA, 13 nt, Human
uauauauagaauc

SEQ ID NO: 2081778 - RNA, 14 nt, Human
uauauccauguacu

SEQ ID NO: 2081779 - RNA, 15 nt, Human
uauauccauguacug

SEQ ID NO: 2081780 - RNA, 16 nt, Human
uauauccauguacugu

SEQ ID NO: 2081781 - RNA, 17 nt, Human
uauauccauguacugua

SEQ ID NO: 2081782 - RNA, 18 nt, Human
uauauccauguacuguag

SEQ ID NO: 2081783 - RNA, 19 nt, Human
uauauccauguacuguagu

SEQ ID NO: 2081784 - RNA, 14 nt, Human
acacuccaucagcu

SEQ ID NO: 2081785 - RNA, 16 nt, Human
uauacaguuuuaaaga

SEQ ID NO: 2081786 - RNA, 19 nt, Human
uauacaguuuuaaagaauc

SEQ ID NO: 2081787 - RNA, 22 nt, Human
uauacaguuuuccuaaauguau

SEQ ID NO: 2081788 - RNA, 14 nt, Human
uauacauuugauaa

SEQ ID NO: 2081789 - RNA, 17 nt, Human
uauaccagcaauauauc

SEQ ID NO: 2081790 - RNA, 21 nt, Human
uauacacuuacacuuuaugca

SEQ ID NO: 2081791 - RNA, 16 nt, Human
uauacaguacaguggu

SEQ ID NO: 2081792 - RNA, 22 nt, Human
uauacaguagugagaagaauau

SEQ ID NO: 2081793 - RNA, 23 nt, Human
uauacaguagugagaagaauauu

SEQ ID NO: 2081794 - RNA, 12 nt, Human
uauacacacagc

SEQ ID NO: 2081795 - RNA, 19 nt, Human
uauacacacacaaagagag

SEQ ID NO: 2081796 - RNA, 20 nt, Human
uauacacacacaaagagagu

SEQ ID NO: 2081797 - RNA, 13 nt, Human
uauacaagauaag

SEQ ID NO: 2081798 - RNA, 17 nt, Human
uauacaagauaagcuuc

SEQ ID NO: 2081799 - RNA, 19 nt, Human
uauacaagauaagcuucca

SEQ ID NO: 2081800 - RNA, 20 nt, Human
uauacaagauaagcuuccag

SEQ ID NO: 2081801 - RNA, 15 nt, Human
uauacaauaacauaa

SEQ ID NO: 2081802 - RNA, 10 nt, Human
acaccucaga

SEQ ID NO: 2081803 - RNA, 12 nt, Human
acaccucagagc

SEQ ID NO: 2081804 - RNA, 18 nt, Human
acaccucagagccccgca

SEQ ID NO: 2081805 - RNA, 18 nt, Human
acaccucaguucccuugg

SEQ ID NO: 2081806 - RNA, 21 nt, Human
acaccucaguucccuuggccu

SEQ ID NO: 2081807 - RNA, 15 nt, Human
acaccuauuuuagac

SEQ ID NO: 2081808 - RNA, 22 nt, Human
acaccuauuuuagacaaaucua

SEQ ID NO: 2081809 - RNA, 17 nt, Human
acaccuacccuccuuuu

SEQ ID NO: 2081810 - RNA, 22 nt, Human
acaccucaguucccuuggccuc

SEQ ID NO: 2081811 - RNA, 23 nt, Human
acaccucaguucccuuggccuca

SEQ ID NO: 2081812 - RNA, 19 nt, Human
uauaaccaacuuuucuauu

SEQ ID NO: 2081813 - RNA, 15 nt, Human
uauaaccaauguuua

SEQ ID NO: 2081814 - RNA, 16 nt, Human
uauaaccaauguuuaa

SEQ ID NO: 2081815 - RNA, 17 nt, Human
uauaaccaauguuuaaa

SEQ ID NO: 2081816 - RNA, 21 nt, Human
uauaaccaauguuuaaaaaag

SEQ ID NO: 2081817 - RNA, 20 nt, Human
acaccucccacccccuguau

SEQ ID NO: 2081818 - RNA, 16 nt, Human
uauaagcauggagaac

SEQ ID NO: 2081819 - RNA, 18 nt, Human
uauaauuuuaagauuccu

SEQ ID NO: 2081820 - RNA, 20 nt, Human
uauaauuuuaagauuccuuu

SEQ ID NO: 2081821 - RNA, 17 nt, Human
uauaauuuuaugaaugu

SEQ ID NO: 2081822 - RNA, 22 nt, Human
uauaauuuuaugaaugucuuug

SEQ ID NO: 2081823 - RNA, 21 nt, Human
uauaacagugugguaguuaau

SEQ ID NO: 2081824 - RNA, 21 nt, Human
acagacagagaaggcagcagg

SEQ ID NO: 2081825 - RNA, 14 nt, Human
uauauugcaaugaa

SEQ ID NO: 2081826 - RNA, 14 nt, Human
uauauugagacaaa

SEQ ID NO: 2081827 - RNA, 19 nt, Human
uauauugagacaaaaauua

SEQ ID NO: 2081828 - RNA, 15 nt, Human
uaucaaguggcaugu

SEQ ID NO: 2081829 - RNA, 17 nt, Human
uaucaaguggcaugugc

SEQ ID NO: 2081830 - RNA, 18 nt, Human
uaucaaguggcaugugcu

SEQ ID NO: 2081831 - RNA, 13 nt, Human
uaucacauuauuu

SEQ ID NO: 2081832 - RNA, 18 nt, Human
uaucacugaagcuuuuua

SEQ ID NO: 2081833 - RNA, 18 nt, Human
uaucacugacacaaaaag

SEQ ID NO: 2081834 - RNA, 19 nt, Human
uaucaauaaauagaccauu

SEQ ID NO: 2081835 - RNA, 16 nt, Human
uaucacacaaagcaga

SEQ ID NO: 2081836 - RNA, 13 nt, Human
uaucaaucauuuu

SEQ ID NO: 2081837 - RNA, 14 nt, Human
uaucaaucauuuuc

SEQ ID NO: 2081838 - RNA, 13 nt, Human
uaucacacuucug

SEQ ID NO: 2081839 - RNA, 17 nt, Human
uaucacacuucugugag

SEQ ID NO: 2081840 - RNA, 23 nt, Human
acagacacaggcccggcuccagg

SEQ ID NO: 2081841 - RNA, 16 nt, Human
acacuccaucagcuua

SEQ ID NO: 2081842 - RNA, 15 nt, Human
acacuccccugcacu

SEQ ID NO: 2081843 - RNA, 17 nt, Human
acacuccccugcacugg

SEQ ID NO: 2081844 - RNA, 16 nt, Human
acagacagacacacac

SEQ ID NO: 2081845 - RNA, 16 nt, Human
acagacuauugacauc

SEQ ID NO: 2081846 - RNA, 19 nt, Human
acagacuauugacaucagc

SEQ ID NO: 2081847 - RNA, 14 nt, Human
acagacuggaagca

SEQ ID NO: 2081848 - RNA, 13 nt, Human
uauauucucuuug

SEQ ID NO: 2081849 - RNA, 14 nt, Human
uauauucucuuugg

SEQ ID NO: 2081850 - RNA, 22 nt, Human
uauauucucuuugguguacaaa

SEQ ID NO: 2081851 - RNA, 20 nt, Human
uaucuagugcagcugauuuu

SEQ ID NO: 2081852 - RNA, 23 nt, Human
uaucuagugcagcugauuuuaac

SEQ ID NO: 2081853 - RNA, 14 nt, Human
uaucuagugcagcu

SEQ ID NO: 2081854 - RNA, 19 nt, Human
uaucuagugcagcugauuu

SEQ ID NO: 2081855 - RNA, 10 nt, Human
uaucagaauu

SEQ ID NO: 2081856 - RNA, 17 nt, Human
uauccaugggggcaggg

SEQ ID NO: 2081857 - RNA, 18 nt, Human
uauccaugggggcagggc

SEQ ID NO: 2081858 - RNA, 19 nt, Human
uauccaugggggcagggca

SEQ ID NO: 2081859 - RNA, 20 nt, Human
uauccaugggggcagggcau

SEQ ID NO: 2081860 - RNA, 13 nt, Human
uauccauguacug

SEQ ID NO: 2081861 - RNA, 14 nt, Human
uauccauguacugu

SEQ ID NO: 2081862 - RNA, 15 nt, Human
uauccauguacugua

SEQ ID NO: 2081863 - RNA, 16 nt, Human
uauccauguacuguag

SEQ ID NO: 2081864 - RNA, 22 nt, Human
uauccauguacuguaguuuuuc

SEQ ID NO: 2081865 - RNA, 18 nt, Human
uauccauguacuguaguu

SEQ ID NO: 2081866 - RNA, 21 nt, Human
acagagugagacucugucuca

SEQ ID NO: 2081867 - RNA, 21 nt, Human
acagagcgagagucugucuca

SEQ ID NO: 2081868 - RNA, 18 nt, Human
acagaguggucuuucugg

SEQ ID NO: 2081869 - RNA, 19 nt, Human
acagaguggucuuucugga

SEQ ID NO: 2081870 - RNA, 21 nt, Human
acagaguggucuuucuggaga

SEQ ID NO: 2081871 - RNA, 24 nt, Human
acagaguggucuuucuggagaggu

SEQ ID NO: 2081872 - RNA, 21 nt, Human
acagagccucgggacaucaaa

SEQ ID NO: 2081873 - RNA, 18 nt, Human
acagagaggagaaacaca

SEQ ID NO: 2081874 - RNA, 21 nt, Human
acagagagggggccaccuccc

SEQ ID NO: 2081875 - RNA, 14 nt, Human
acagagaggagaaa

SEQ ID NO: 2081876 - RNA, 16 nt, Human
acagagaggagaaaca

SEQ ID NO: 2081877 - RNA, 20 nt, Human
acagagaggagaaacacauc

SEQ ID NO: 2081878 - RNA, 20 nt, Human
acagagagacagacuugaga

SEQ ID NO: 2081879 - RNA, 23 nt, Human
acagagagacagacuugagaacu

SEQ ID NO: 2081880 - RNA, 15 nt, Human
acagagaggacgugg

SEQ ID NO: 2081881 - RNA, 16 nt, Human
acagagacaccugcac

SEQ ID NO: 2081882 - RNA, 17 nt, Human
acagagacaccugcacc

SEQ ID NO: 2081883 - RNA, 21 nt, Human
acagagacaccugcaccuccc

SEQ ID NO: 2081884 - RNA, 15 nt, Human
acagagacaggccca

SEQ ID NO: 2081885 - RNA, 21 nt, Human
acagagacaggcccaagagau

SEQ ID NO: 2081886 - RNA, 23 nt, Human
acagagacaggcccaagagauga

SEQ ID NO: 2081887 - RNA, 18 nt, Human
acagacuggagacaaugc

SEQ ID NO: 2081888 - RNA, 20 nt, Human
acagacuggccugaggagca

SEQ ID NO: 2081889 - RNA, 18 nt, Human
uaucuccucgcaagcugg

SEQ ID NO: 2081890 - RNA, 17 nt, Human
acagacuucuccagacc

SEQ ID NO: 2081891 - RNA, 14 nt, Human
acagacuugagaac

SEQ ID NO: 2081892 - RNA, 15 nt, Human
acagacuugagaacu

SEQ ID NO: 2081893 - RNA, 16 nt, Human
acagacuugagaacuu

SEQ ID NO: 2081894 - RNA, 17 nt, Human
acagacuugagaacuug

SEQ ID NO: 2081895 - RNA, 18 nt, Human
acagacuugagaacuuga

SEQ ID NO: 2081896 - RNA, 15 nt, Human
acagacuucuccaga

SEQ ID NO: 2081897 - RNA, 16 nt, Human
acagacuucuccagac

SEQ ID NO: 2081898 - RNA, 19 nt, Human
acagcccaaagaaggaaaa

SEQ ID NO: 2081899 - RNA, 15 nt, Human
acagcccacugagaa

SEQ ID NO: 2081900 - RNA, 13 nt, Human
acagcccaggccu

SEQ ID NO: 2081901 - RNA, 15 nt, Human
acagcccaggccucc

SEQ ID NO: 2081902 - RNA, 20 nt, Human
acagcccaggccuccagcuc

SEQ ID NO: 2081903 - RNA, 21 nt, Human
acagcccaggccuccagcuca

SEQ ID NO: 2081904 - RNA, 15 nt, Human
acagccucccacccc

SEQ ID NO: 2081905 - RNA, 16 nt, Human
acagccucccaccccc

SEQ ID NO: 2081906 - RNA, 18 nt, Human
acagaguuuucacucuua

SEQ ID NO: 2081907 - RNA, 13 nt, Human
acagauaagcaag

SEQ ID NO: 2081908 - RNA, 20 nt, Human
acagaguuuucacucuuauu

SEQ ID NO: 2081909 - RNA, 18 nt, Human
acagcagccccugcacaa

SEQ ID NO: 2081910 - RNA, 15 nt, Human
acagauaagcaagag

SEQ ID NO: 2081911 - RNA, 18 nt, Human
acagauaagcaagagaga

SEQ ID NO: 2081912 - RNA, 19 nt, Human
acagauaagcaagagagau

SEQ ID NO: 2081913 - RNA, 14 nt, Human
acagcagcucaggc

SEQ ID NO: 2081914 - RNA, 20 nt, Human
acagauaagcaagagagaug

SEQ ID NO: 2081915 - RNA, 16 nt, Human
acagcagccucugaag

SEQ ID NO: 2081916 - RNA, 17 nt, Human
acagcagccucugaagu

SEQ ID NO: 2081917 - RNA, 18 nt, Human
acagcagccucugaaguu

SEQ ID NO: 2081918 - RNA, 15 nt, Human
acagcaggcccaccu

SEQ ID NO: 2081919 - RNA, 19 nt, Human
acagcaggcccaccuaccu

SEQ ID NO: 2081920 - RNA, 20 nt, Human
acagcaggcccaccuaccuu

SEQ ID NO: 2081921 - RNA, 15 nt, Human
acagcagcucaggca

SEQ ID NO: 2081922 - RNA, 16 nt, Human
acagcagcucaggcac

SEQ ID NO: 2081923 - RNA, 17 nt, Human
acagcagcucaggcaca

SEQ ID NO: 2081924 - RNA, 14 nt, Human
uaugaucacggcuc

SEQ ID NO: 2081925 - RNA, 21 nt, Human
uaugaguuuuugauagcuuua

SEQ ID NO: 2081926 - RNA, 22 nt, Human
uaugaguuuuugauagcuuuau

SEQ ID NO: 2081927 - RNA, 23 nt, Human
uaugaguuuuugauagcuuuauu

SEQ ID NO: 2081928 - RNA, 18 nt, Human
uaugaguuguuuucagac

SEQ ID NO: 2081929 - RNA, 22 nt, Human
uaugaguuguuuucagacucag

SEQ ID NO: 2081930 - RNA, 15 nt, Human
uaugagggaaaauga

SEQ ID NO: 2081931 - RNA, 19 nt, Human
uaugaggucuaggaacaua

SEQ ID NO: 2081932 - RNA, 15 nt, Human
uaugaggucuaggaa

SEQ ID NO: 2081933 - RNA, 15 nt, Human
uaugauaaaaaauuu

SEQ ID NO: 2081934 - RNA, 16 nt, Human
uaugauaaaaaauuuu

SEQ ID NO: 2081935 - RNA, 19 nt, Human
uaugauaaaaaauuuugua

SEQ ID NO: 2081936 - RNA, 20 nt, Human
uaugauaaaaaauuuuguaa

SEQ ID NO: 2081937 - RNA, 21 nt, Human
uaugauaaaaaauuuuguaau

SEQ ID NO: 2081938 - RNA, 23 nt, Human
uaugauaaaaaauuuuguaauuu

SEQ ID NO: 2081939 - RNA, 23 nt, Human
uaugaucacggcucacugcagcc

SEQ ID NO: 2081940 - RNA, 21 nt, Human
uaugaucacggcucacugcag

SEQ ID NO: 2081941 - RNA, 18 nt, Human
uaugaggagugaacauuu

SEQ ID NO: 2081942 - RNA, 14 nt, Human
uaugaggaugcaga

SEQ ID NO: 2081943 - RNA, 22 nt, Human
uaugaggcaaccacaggcagca

SEQ ID NO: 2081944 - RNA, 20 nt, Human
uaucuuggacugacauuuag

SEQ ID NO: 2081945 - RNA, 16 nt, Human
uaugagcuuuauguaa

SEQ ID NO: 2081946 - RNA, 17 nt, Human
uaucuuggacugacauu

SEQ ID NO: 2081947 - RNA, 19 nt, Human
uaugcucugcauguuacau

SEQ ID NO: 2081948 - RNA, 12 nt, Human
uauggccucagc

SEQ ID NO: 2081949 - RNA, 19 nt, Human
uauggccucagcugccuca

SEQ ID NO: 2081950 - RNA, 23 nt, Human
uauggccucagcugccucacuuc

SEQ ID NO: 2081951 - RNA, 15 nt, Human
uaugaucccagcacu

SEQ ID NO: 2081952 - RNA, 15 nt, Human
uaugaucgcgccacu

SEQ ID NO: 2081953 - RNA, 14 nt, Human
uaugcucugcaugu

SEQ ID NO: 2081954 - RNA, 18 nt, Human
uaugcucugcauguuaca

SEQ ID NO: 2081955 - RNA, 18 nt, Human
uaugaugugggucaagga

SEQ ID NO: 2081956 - RNA, 20 nt, Human
acagcuaaucagcauucuca

SEQ ID NO: 2081957 - RNA, 22 nt, Human
acagccuguggcggugccuggg

SEQ ID NO: 2081958 - RNA, 13 nt, Human
acagcucaggcug

SEQ ID NO: 2081959 - RNA, 13 nt, Human
acagcucccaccc

SEQ ID NO: 2081960 - RNA, 14 nt, Human
acagcucccacccc

SEQ ID NO: 2081961 - RNA, 15 nt, Human
acagcucccacccca

SEQ ID NO: 2081962 - RNA, 16 nt, Human
acagcucccaccccac

SEQ ID NO: 2081963 - RNA, 22 nt, Human
uauggggagaaaagacaugaau

SEQ ID NO: 2081964 - RNA, 20 nt, Human
acagccuguggcggugccug

SEQ ID NO: 2081965 - RNA, 21 nt, Human
acagccuguggcggugccugg

SEQ ID NO: 2081966 - RNA, 15 nt, Human
acagccuggcacagg

SEQ ID NO: 2081967 - RNA, 14 nt, Human
acagccuggcacag

SEQ ID NO: 2081968 - RNA, 16 nt, Human
uaugggagccccaggg

SEQ ID NO: 2081969 - RNA, 15 nt, Human
uaugggagccccagg

SEQ ID NO: 2081970 - RNA, 15 nt, Human
acuccugaccucaag

SEQ ID NO: 2081971 - RNA, 13 nt, Human
acuccugcaaaau

SEQ ID NO: 2081972 - RNA, 15 nt, Human
acuccugcaaaauuu

SEQ ID NO: 2081973 - RNA, 15 nt, Human
acuccaguacuggag

SEQ ID NO: 2081974 - RNA, 17 nt, Human
acuccaguacuggagcu

SEQ ID NO: 2081975 - RNA, 14 nt, Human
acuccuaccuggua

SEQ ID NO: 2081976 - RNA, 14 nt, Human
acuccuaccucagc

SEQ ID NO: 2081977 - RNA, 15 nt, Human
acuccuaccucagcc

SEQ ID NO: 2081978 - RNA, 16 nt, Human
acuccuaccucagccu

SEQ ID NO: 2081979 - RNA, 17 nt, Human
acuccuaccucagccua

SEQ ID NO: 2081980 - RNA, 20 nt, Human
acuccagcuggguuggaaaa

SEQ ID NO: 2081981 - RNA, 20 nt, Human
acuccagccugggcgacaga

SEQ ID NO: 2081982 - RNA, 21 nt, Human
acuccagccugggcaacacag

SEQ ID NO: 2081983 - RNA, 19 nt, Human
acuccaggaaggggcugga

SEQ ID NO: 2081984 - RNA, 20 nt, Human
acuccaggaaggggcuggac

SEQ ID NO: 2081985 - RNA, 18 nt, Human
acuccagccugggcaaca

SEQ ID NO: 2081986 - RNA, 23 nt, Human
acuccagccugggcaacagagca

SEQ ID NO: 2081987 - RNA, 15 nt, Human
acuccagccugggcg

SEQ ID NO: 2081988 - RNA, 18 nt, Human
acuccagccugggcgaca

SEQ ID NO: 2081989 - RNA, 14 nt, Human
acuccaacucuucc

SEQ ID NO: 2081990 - RNA, 21 nt, Human
ucccucagucuggcccuuccu

SEQ ID NO: 2081991 - RNA, 23 nt, Human
ucccucauuccaccuucccaugc

SEQ ID NO: 2081992 - RNA, 9 nt, Human
acucaucau

SEQ ID NO: 2081993 - RNA, 12 nt, Human
acucaucauaaa

SEQ ID NO: 2081994 - RNA, 13 nt, Human
acucaucauaaaa

SEQ ID NO: 2081995 - RNA, 14 nt, Human
acucaucauaaaau

SEQ ID NO: 2081996 - RNA, 15 nt, Human
acucaucauaaaaua

SEQ ID NO: 2081997 - RNA, 15 nt, Human
acucaugaucuugug

SEQ ID NO: 2081998 - RNA, 21 nt, Human
acucaugaucuugugacauau

SEQ ID NO: 2081999 - RNA, 16 nt, Human
acucaucauaaaauaa

SEQ ID NO: 2082000 - RNA, 17 nt, Human
acucaucauaaaauaaa

SEQ ID NO: 2082001 - RNA, 19 nt, Human
acucauugcuucacaaccc

SEQ ID NO: 2082002 - RNA, 23 nt, Human
acucauugcuucacaacccaucu

SEQ ID NO: 2082003 - RNA, 16 nt, Human
acucauuuccuaugua

SEQ ID NO: 2082004 - RNA, 15 nt, Human
acucauggguaauaa

SEQ ID NO: 2082005 - RNA, 22 nt, Human
acucauggugaggcuuaacaau

SEQ ID NO: 2082006 - RNA, 20 nt, Human
uccuagcacuuugggaggcc

SEQ ID NO: 2082007 - RNA, 14 nt, Human
uccuaggcauuugc

SEQ ID NO: 2082008 - RNA, 14 nt, Human
uccuagauaaaaag

SEQ ID NO: 2082009 - RNA, 15 nt, Human
uccuagauaaaaaga

SEQ ID NO: 2082010 - RNA, 16 nt, Human
uccuagauaaaaagau

SEQ ID NO: 2082011 - RNA, 17 nt, Human
uccuagauaaaaagaug

SEQ ID NO: 2082012 - RNA, 19 nt, Human
uccguuuccagguguuuau

SEQ ID NO: 2082013 - RNA, 15 nt, Human
uccuaaaacaaauag

SEQ ID NO: 2082014 - RNA, 13 nt, Human
uccuaaaaguuca

SEQ ID NO: 2082015 - RNA, 14 nt, Human
uccguauuucagac

SEQ ID NO: 2082016 - RNA, 15 nt, Human
uccguauuucagacu

SEQ ID NO: 2082017 - RNA, 11 nt, Human
ucccuuugcuc

SEQ ID NO: 2082018 - RNA, 12 nt, Human
ucccuuugcucc

SEQ ID NO: 2082019 - RNA, 13 nt, Human
ucccuuugcucca

SEQ ID NO: 2082020 - RNA, 14 nt, Human
ucccuuugcuccac

SEQ ID NO: 2082021 - RNA, 15 nt, Human
ucccuuugcuccacc

SEQ ID NO: 2082022 - RNA, 16 nt, Human
ucccuuugcuccaccc

SEQ ID NO: 2082023 - RNA, 19 nt, Human
ucccuuugcuccaccccac

SEQ ID NO: 2082024 - RNA, 20 nt, Human
ucccuuugcuccaccccacu

SEQ ID NO: 2082025 - RNA, 22 nt, Human
ucccuuugcuccaccccacuca

SEQ ID NO: 2082026 - RNA, 22 nt, Human
uccgucuaagucaugagcugag

SEQ ID NO: 2082027 - RNA, 20 nt, Human
ucccuuuagcacguuuaaag

SEQ ID NO: 2082028 - RNA, 20 nt, Human
uccgucuaagucaugagcug

SEQ ID NO: 2082029 - RNA, 15 nt, Human
uccgugagcagugug

SEQ ID NO: 2082030 - RNA, 23 nt, Human
uccgugagcagugugucuccugc

SEQ ID NO: 2082031 - RNA, 20 nt, Human
uccgugagugaaccaucauu

SEQ ID NO: 2082032 - RNA, 18 nt, Human
acuccugcaaaauuuuau

SEQ ID NO: 2082033 - RNA, 14 nt, Human
ucccugucaccaag

SEQ ID NO: 2082034 - RNA, 15 nt, Human
ucccugucaccaagc

SEQ ID NO: 2082035 - RNA, 22 nt, Human
ucccugucaccaagcucacagu

SEQ ID NO: 2082036 - RNA, 14 nt, Human
ucccuguugaagcu

SEQ ID NO: 2082037 - RNA, 18 nt, Human
ucccuguuggucgguggg

SEQ ID NO: 2082038 - RNA, 22 nt, Human
ucccuguuucuuccacagugcc

SEQ ID NO: 2082039 - RNA, 15 nt, Human
ucccuugugugugug

SEQ ID NO: 2082040 - RNA, 16 nt, Human
ucccuugugcgugggu

SEQ ID NO: 2082041 - RNA, 13 nt, Human
ucccuugugugug

SEQ ID NO: 2082042 - RNA, 21 nt, Human
ucccuuucacaaaauuuuauu

SEQ ID NO: 2082043 - RNA, 22 nt, Human
ucccuuuccaaaugcccagcuu

SEQ ID NO: 2082044 - RNA, 21 nt, Human
ucccuucaaccauuccccaug

SEQ ID NO: 2082045 - RNA, 12 nt, Human
ucccuguucauu

SEQ ID NO: 2082046 - RNA, 11 nt, Human
ucccuucaacc

SEQ ID NO: 2082047 - RNA, 11 nt, Human
uccucagacug

SEQ ID NO: 2082048 - RNA, 15 nt, Human
uccucagacugcuca

SEQ ID NO: 2082049 - RNA, 22 nt, Human
uccucacuggguggggugagga

SEQ ID NO: 2082050 - RNA, 20 nt, Human
uccucaccccgucugggguu

SEQ ID NO: 2082051 - RNA, 17 nt, Human
uccucacucccuuccca

SEQ ID NO: 2082052 - RNA, 19 nt, Human
uccucacucccuucccaua

SEQ ID NO: 2082053 - RNA, 21 nt, Human
uccucacucccuucccauaag

SEQ ID NO: 2082054 - RNA, 13 nt, Human
uccucacugggug

SEQ ID NO: 2082055 - RNA, 14 nt, Human
uccucacugggugg

SEQ ID NO: 2082056 - RNA, 15 nt, Human
uccucacuggguggg

SEQ ID NO: 2082057 - RNA, 19 nt, Human
acucuuauugcccacgcug

SEQ ID NO: 2082058 - RNA, 16 nt, Human
acucuuauugcccacg

SEQ ID NO: 2082059 - RNA, 20 nt, Human
uccucacaucuuucacacuu

SEQ ID NO: 2082060 - RNA, 23 nt, Human
uccucaacucaccuaauguuuau

SEQ ID NO: 2082061 - RNA, 19 nt, Human
uccucccucccucuuuccc

SEQ ID NO: 2082062 - RNA, 19 nt, Human
uccucucauccuuuucucc

SEQ ID NO: 2082063 - RNA, 20 nt, Human
uccucucauccuuuucuccu

SEQ ID NO: 2082064 - RNA, 15 nt, Human
uccucccugauguac

SEQ ID NO: 2082065 - RNA, 17 nt, Human
uccucccugauguacag

SEQ ID NO: 2082066 - RNA, 17 nt, Human
uccucccucccucuuuc

SEQ ID NO: 2082067 - RNA, 15 nt, Human
uccucccucccucuu

SEQ ID NO: 2082068 - RNA, 16 nt, Human
uccucuccacugccuu

SEQ ID NO: 2082069 - RNA, 15 nt, Human
uccucuccacugccu

SEQ ID NO: 2082070 - RNA, 12 nt, Human
uccucuccccag

SEQ ID NO: 2082071 - RNA, 14 nt, Human
uccucuccacugcc

SEQ ID NO: 2082072 - RNA, 13 nt, Human
uccucuccacugc

SEQ ID NO: 2082073 - RNA, 12 nt, Human
uccucuccacug

SEQ ID NO: 2082074 - RNA, 13 nt, Human
uccuccccuuccc

SEQ ID NO: 2082075 - RNA, 14 nt, Human
uccuccccuucccu

SEQ ID NO: 2082076 - RNA, 15 nt, Human
uccuccccuucccug

SEQ ID NO: 2082077 - RNA, 17 nt, Human
uccuccccuucccugca

SEQ ID NO: 2082078 - RNA, 18 nt, Human
uccuccccuucccugcaa

SEQ ID NO: 2082079 - RNA, 18 nt, Human
uccucaguuccugcagca

SEQ ID NO: 2082080 - RNA, 23 nt, Human
acucugcuuugacugagcagacu

SEQ ID NO: 2082081 - RNA, 20 nt, Human
acucugcuuugacugagcag

SEQ ID NO: 2082082 - RNA, 22 nt, Human
acucugcuuugacugagcagac

SEQ ID NO: 2082083 - RNA, 14 nt, Human
acucugcuuugacu

SEQ ID NO: 2082084 - RNA, 18 nt, Human
acucugauguaaaugaag

SEQ ID NO: 2082085 - RNA, 19 nt, Human
acucugauguaaaugaagu

SEQ ID NO: 2082086 - RNA, 20 nt, Human
acucugaagggcaucaugca

SEQ ID NO: 2082087 - RNA, 21 nt, Human
acucugaagggcaucaugcau

SEQ ID NO: 2082088 - RNA, 16 nt, Human
acucucauuccccagg

SEQ ID NO: 2082089 - RNA, 17 nt, Human
acucucauuccccaggu

SEQ ID NO: 2082090 - RNA, 21 nt, Human
acucucauuccccagguggcu

SEQ ID NO: 2082091 - RNA, 14 nt, Human
acucuccaaccugg

SEQ ID NO: 2082092 - RNA, 17 nt, Human
acucuccaaccuggaca

SEQ ID NO: 2082093 - RNA, 20 nt, Human
acucgcuucccccauagcca

SEQ ID NO: 2082094 - RNA, 14 nt, Human
acucuccccacacu

SEQ ID NO: 2082095 - RNA, 15 nt, Human
acucuccccacacua

SEQ ID NO: 2082096 - RNA, 13 nt, Human
acucuccaucuua

SEQ ID NO: 2082097 - RNA, 19 nt, Human
acucuccaaccuggacaac

SEQ ID NO: 2082098 - RNA, 10 nt, Human
acucucccca

SEQ ID NO: 2082099 - RNA, 11 nt, Human
acucuccccac

SEQ ID NO: 2082100 - RNA, 12 nt, Human
acucuccccaca

SEQ ID NO: 2082101 - RNA, 12 nt, Human
acucgcuucccc

SEQ ID NO: 2082102 - RNA, 15 nt, Human
acucgcuucccccau

SEQ ID NO: 2082103 - RNA, 16 nt, Human
acucgcuucucuguga

SEQ ID NO: 2082104 - RNA, 19 nt, Human
uccuaggcauuugcugaau

SEQ ID NO: 2082105 - RNA, 13 nt, Human
uccuaggccacac

SEQ ID NO: 2082106 - RNA, 20 nt, Human
uccuagggaaaaguucauag

SEQ ID NO: 2082107 - RNA, 17 nt, Human
acucaagacuuccagag

SEQ ID NO: 2082108 - RNA, 13 nt, Human
uccccucauucag

SEQ ID NO: 2082109 - RNA, 16 nt, Human
uccccuccaagguaug

SEQ ID NO: 2082110 - RNA, 20 nt, Human
uccccuccgccaggcgagau

SEQ ID NO: 2082111 - RNA, 17 nt, Human
uccccuccgccaggcga

SEQ ID NO: 2082112 - RNA, 13 nt, Human
uccccuugcccag

SEQ ID NO: 2082113 - RNA, 15 nt, Human
uccccuugcccaggg

SEQ ID NO: 2082114 - RNA, 16 nt, Human
uccccuugcccagggc

SEQ ID NO: 2082115 - RNA, 17 nt, Human
uccccuugcccagggcu

SEQ ID NO: 2082116 - RNA, 16 nt, Human
ucccgaauagcuggga

SEQ ID NO: 2082117 - RNA, 15 nt, Human
ucccgaauagcuggg

SEQ ID NO: 2082118 - RNA, 14 nt, Human
uccccuugagcuga

SEQ ID NO: 2082119 - RNA, 15 nt, Human
uccccuugagcugag

SEQ ID NO: 2082120 - RNA, 16 nt, Human
uccccuugagcugaga

SEQ ID NO: 2082121 - RNA, 14 nt, Human
uccccuccucacuc

SEQ ID NO: 2082122 - RNA, 18 nt, Human
ucccuauuagagaagaga

SEQ ID NO: 2082123 - RNA, 20 nt, Human
ucccucaaagcacacgucau

SEQ ID NO: 2082124 - RNA, 18 nt, Human
ucccucaaagcuuccauu

SEQ ID NO: 2082125 - RNA, 20 nt, Human
ucccucaaagcuuccauucc

SEQ ID NO: 2082126 - RNA, 22 nt, Human
ucccucaaagcuuccauuccac

SEQ ID NO: 2082127 - RNA, 16 nt, Human
ucccucaaccccacca

SEQ ID NO: 2082128 - RNA, 20 nt, Human
ucccgcucagcccucccugc

SEQ ID NO: 2082129 - RNA, 16 nt, Human
ucccgcucagcccucc

SEQ ID NO: 2082130 - RNA, 15 nt, Human
ucccgcucagcccuc

SEQ ID NO: 2082131 - RNA, 14 nt, Human
ucccgcucagcccu

SEQ ID NO: 2082132 - RNA, 13 nt, Human
ucccgcucagccc

SEQ ID NO: 2082133 - RNA, 19 nt, Human
ucccgccucuucuucuuca

SEQ ID NO: 2082134 - RNA, 21 nt, Human
ucccgccucuucuucuucaga

SEQ ID NO: 2082135 - RNA, 18 nt, Human
ucccgaauagcugggacu

SEQ ID NO: 2082136 - RNA, 20 nt, Human
ucccgaguagcugggacuac

SEQ ID NO: 2082137 - RNA, 15 nt, Human
ucccgauuguaacuc

SEQ ID NO: 2082138 - RNA, 23 nt, Human
ucccgaaccccaaggagggagau

SEQ ID NO: 2082139 - RNA, 19 nt, Human
ucccgauucacccugucca

SEQ ID NO: 2082140 - RNA, 17 nt, Human
acuauagccuaggugac

SEQ ID NO: 2082141 - RNA, 15 nt, Human
acuauauuguacaca

SEQ ID NO: 2082142 - RNA, 18 nt, Human
acuauauuaucaugcaaa

SEQ ID NO: 2082143 - RNA, 14 nt, Human
acuauaucuguuuu

SEQ ID NO: 2082144 - RNA, 16 nt, Human
acuauaucuguuuuac

SEQ ID NO: 2082145 - RNA, 19 nt, Human
acuauaucuguuuuacugc

SEQ ID NO: 2082146 - RNA, 23 nt, Human
acuauaucuguuuuacugcuuuu

SEQ ID NO: 2082147 - RNA, 13 nt, Human
acuauauguaugg

SEQ ID NO: 2082148 - RNA, 11 nt, Human
uccccaggccc

SEQ ID NO: 2082149 - RNA, 13 nt, Human
uccccaggcccca

SEQ ID NO: 2082150 - RNA, 19 nt, Human
uccccaggccccaggaagc

SEQ ID NO: 2082151 - RNA, 20 nt, Human
uccccaggccccaggaagcc

SEQ ID NO: 2082152 - RNA, 21 nt, Human
uccccaggccccaggaagccg

SEQ ID NO: 2082153 - RNA, 19 nt, Human
uccccaggccguggcugcc

SEQ ID NO: 2082154 - RNA, 21 nt, Human
uccccaggccguggcugccca

SEQ ID NO: 2082155 - RNA, 23 nt, Human
uccccaggccguggcugcccaca

SEQ ID NO: 2082156 - RNA, 10 nt, Human
uccccacacu

SEQ ID NO: 2082157 - RNA, 18 nt, Human
uccccaccuucaauuccu

SEQ ID NO: 2082158 - RNA, 20 nt, Human
uccccaccuucaauuccugg

SEQ ID NO: 2082159 - RNA, 22 nt, Human
uccccaccuucaauuccugggc

SEQ ID NO: 2082160 - RNA, 23 nt, Human
uccccaccuucaauuccugggcc

SEQ ID NO: 2082161 - RNA, 20 nt, Human
uccccaccuucuucagccac

SEQ ID NO: 2082162 - RNA, 22 nt, Human
acuaucaugucaaacgugaaaa

SEQ ID NO: 2082163 - RNA, 18 nt, Human
acuauguugcccaggcag

SEQ ID NO: 2082164 - RNA, 17 nt, Human
acuauguugcccaggca

SEQ ID NO: 2082165 - RNA, 23 nt, Human
acucaacauguuacugaccagca

SEQ ID NO: 2082166 - RNA, 17 nt, Human
acucaacauguuacuga

SEQ ID NO: 2082167 - RNA, 20 nt, Human
acucaacauguuacugacca

SEQ ID NO: 2082168 - RNA, 21 nt, Human
acucaacauguuacugaccag

SEQ ID NO: 2082169 - RNA, 22 nt, Human
acucaacauguuacugaccagc

SEQ ID NO: 2082170 - RNA, 13 nt, Human
acuauccuggcuu

SEQ ID NO: 2082171 - RNA, 14 nt, Human
acuauuaagcagua

SEQ ID NO: 2082172 - RNA, 20 nt, Human
acuauuaagcaguaaaaacu

SEQ ID NO: 2082173 - RNA, 22 nt, Human
acuauuaagcaguaaaaacugu

SEQ ID NO: 2082174 - RNA, 21 nt, Human
acuauuauaauuuaaugcaug

SEQ ID NO: 2082175 - RNA, 17 nt, Human
acuauuauaauuuaaug

SEQ ID NO: 2082176 - RNA, 23 nt, Human
acuauguugcccaggcaggucuu

SEQ ID NO: 2082177 - RNA, 20 nt, Human
acuauguugcccaggcaggu

SEQ ID NO: 2082178 - RNA, 19 nt, Human
acuauguugcccaggcagg

SEQ ID NO: 2082179 - RNA, 19 nt, Human
uccccaacccugccccugc

SEQ ID NO: 2082180 - RNA, 16 nt, Human
uccccaacccugcccc

SEQ ID NO: 2082181 - RNA, 17 nt, Human
uccccaacccugccccu

SEQ ID NO: 2082182 - RNA, 18 nt, Human
uccccaacccugccccug

SEQ ID NO: 2082183 - RNA, 20 nt, Human
uccccaacccugccccugcc

SEQ ID NO: 2082184 - RNA, 20 nt, Human
ucccauuuuggaaguuuuca

SEQ ID NO: 2082185 - RNA, 16 nt, Human
uccccaaaaaccucac

SEQ ID NO: 2082186 - RNA, 22 nt, Human
uccccaaaaaccucacccgagg

SEQ ID NO: 2082187 - RNA, 15 nt, Human
ucccauaagcuauag

SEQ ID NO: 2082188 - RNA, 22 nt, Human
ucccauaauuuucuucaugcaa

SEQ ID NO: 2082189 - RNA, 17 nt, Human
ucccaguucucuaggga

SEQ ID NO: 2082190 - RNA, 20 nt, Human
ucccaguucaggagucccaa

SEQ ID NO: 2082191 - RNA, 23 nt, Human
ucccaguucaggagucccaagga

SEQ ID NO: 2082192 - RNA, 19 nt, Human
ucccagugccgagaaggaa

SEQ ID NO: 2082193 - RNA, 22 nt, Human
ucccagugccgagaaggaagcc

SEQ ID NO: 2082194 - RNA, 15 nt, Human
ucccagugacacuuc

SEQ ID NO: 2082195 - RNA, 19 nt, Human
ucccagugacacuucagag

SEQ ID NO: 2082196 - RNA, 22 nt, Human
ucccagugacacuucagagagc

SEQ ID NO: 2082197 - RNA, 20 nt, Human
ucccagugacacuucagaga

SEQ ID NO: 2082198 - RNA, 14 nt, Human
ucccaguggccuca

SEQ ID NO: 2082199 - RNA, 18 nt, Human
ucccaguggccucaaccc

SEQ ID NO: 2082200 - RNA, 19 nt, Human
ucccaguggccucaacccu

SEQ ID NO: 2082201 - RNA, 20 nt, Human
ucccaguggccucaacccuc

SEQ ID NO: 2082202 - RNA, 22 nt, Human
ucccaguggccucaacccuccc

SEQ ID NO: 2082203 - RNA, 15 nt, Human
ucccaguucaggagu

SEQ ID NO: 2082204 - RNA, 17 nt, Human
acuacaucgcccuccac

SEQ ID NO: 2082205 - RNA, 19 nt, Human
acuacaucgcccuccacau

SEQ ID NO: 2082206 - RNA, 20 nt, Human
acuacaugcagcccaugccc

SEQ ID NO: 2082207 - RNA, 18 nt, Human
ucccaggggaccacaccu

SEQ ID NO: 2082208 - RNA, 23 nt, Human
acuacaggugugagucaccaagc

SEQ ID NO: 2082209 - RNA, 23 nt, Human
acuaaccagggaagcugucccuc

SEQ ID NO: 2082210 - RNA, 14 nt, Human
acuaaaucuguaag

SEQ ID NO: 2082211 - RNA, 18 nt, Human
acuaaaucuguaagcucu

SEQ ID NO: 2082212 - RNA, 19 nt, Human
acuaaaucuguaagcucuu

SEQ ID NO: 2082213 - RNA, 13 nt, Human
acuaaccacgcug

SEQ ID NO: 2082214 - RNA, 12 nt, Human
acuaaaagaucg

SEQ ID NO: 2082215 - RNA, 22 nt, Human
acuaaaguuagaaaguugauuu

SEQ ID NO: 2082216 - RNA, 13 nt, Human
acuaaagccaagg

SEQ ID NO: 2082217 - RNA, 20 nt, Human
acuaaagcaguggacaccag

SEQ ID NO: 2082218 - RNA, 23 nt, Human
acuaaacugguuuguugcagcca

SEQ ID NO: 2082219 - RNA, 14 nt, Human
uccagcucaccagc

SEQ ID NO: 2082220 - RNA, 15 nt, Human
uccagcucaccagcc

SEQ ID NO: 2082221 - RNA, 21 nt, Human
uccagcuauuuuuauuuguuu

SEQ ID NO: 2082222 - RNA, 13 nt, Human
uccagccugggug

SEQ ID NO: 2082223 - RNA, 17 nt, Human
uccagccugggcgacag

SEQ ID NO: 2082224 - RNA, 20 nt, Human
uccagccugggcgacagagc

SEQ ID NO: 2082225 - RNA, 24 nt, Human
uccagccugggugacagagcaagu

SEQ ID NO: 2082226 - RNA, 12 nt, Human
uccagccugggu

SEQ ID NO: 2082227 - RNA, 20 nt, Human
acguuuuuaauauaaagccu

SEQ ID NO: 2082228 - RNA, 12 nt, Human
acuaaaaauaca

SEQ ID NO: 2082229 - RNA, 17 nt, Human
acuaaaaauacaaacaa

SEQ ID NO: 2082230 - RNA, 13 nt, Human
acuaaaaauauua

SEQ ID NO: 2082231 - RNA, 15 nt, Human
acguuuccugagaag

SEQ ID NO: 2082232 - RNA, 14 nt, Human
acguuuuauugugu

SEQ ID NO: 2082233 - RNA, 15 nt, Human
acguuuuauuguguu

SEQ ID NO: 2082234 - RNA, 16 nt, Human
acguuuuauuguguuu

SEQ ID NO: 2082235 - RNA, 18 nt, Human
acguuuuauuguguuuuu

SEQ ID NO: 2082236 - RNA, 20 nt, Human
acguuuuguuugaaaaagca

SEQ ID NO: 2082237 - RNA, 17 nt, Human
acguuucaguaauaaaa

SEQ ID NO: 2082238 - RNA, 19 nt, Human
acguuucaguaauaaaaca

SEQ ID NO: 2082239 - RNA, 23 nt, Human
acuguagaaaagggaacugaaca

SEQ ID NO: 2082240 - RNA, 15 nt, Human
acuguagaaaugaug

SEQ ID NO: 2082241 - RNA, 14 nt, Human
acuguacuccuccc

SEQ ID NO: 2082242 - RNA, 13 nt, Human
acuguacuccucc

SEQ ID NO: 2082243 - RNA, 17 nt, Human
acuguacuagucugugu

SEQ ID NO: 2082244 - RNA, 21 nt, Human
acuguacagauugcugcuucu

SEQ ID NO: 2082245 - RNA, 22 nt, Human
acuguacagauugcugcuucug

SEQ ID NO: 2082246 - RNA, 14 nt, Human
acuguacaaaguag

SEQ ID NO: 2082247 - RNA, 15 nt, Human
acuguacaaaguaga

SEQ ID NO: 2082248 - RNA, 13 nt, Human
acuguacaaagua

SEQ ID NO: 2082249 - RNA, 13 nt, Human
ucgcuccuguguc

SEQ ID NO: 2082250 - RNA, 12 nt, Human
ucgcuccugugu

SEQ ID NO: 2082251 - RNA, 17 nt, Human
uccuucccucaaagcuu

SEQ ID NO: 2082252 - RNA, 19 nt, Human
acuggguacuuguggacac

SEQ ID NO: 2082253 - RNA, 23 nt, Human
acuggguacuuguggacacagcu

SEQ ID NO: 2082254 - RNA, 20 nt, Human
acuggguacuuguggacaca

SEQ ID NO: 2082255 - RNA, 15 nt, Human
ucgaacuggcugcaa

SEQ ID NO: 2082256 - RNA, 23 nt, Human
ucgaagcgcgccacucgcuuccc

SEQ ID NO: 2082257 - RNA, 14 nt, Human
ucgaagcucagccc

SEQ ID NO: 2082258 - RNA, 15 nt, Human
ucgaagcucagccca

SEQ ID NO: 2082259 - RNA, 16 nt, Human
ucgaagcucagcccac

SEQ ID NO: 2082260 - RNA, 13 nt, Human
ucgaacuggcugc

SEQ ID NO: 2082261 - RNA, 14 nt, Human
ucgaacuggcugca

SEQ ID NO: 2082262 - RNA, 21 nt, Human
uccuuuccaguggccuggcuc

SEQ ID NO: 2082263 - RNA, 22 nt, Human
uccuuuccaguggccuggcucc

SEQ ID NO: 2082264 - RNA, 18 nt, Human
uccuuucauccccaccuu

SEQ ID NO: 2082265 - RNA, 12 nt, Human
uccuuucccuuu

SEQ ID NO: 2082266 - RNA, 13 nt, Human
uccuuucccuuua

SEQ ID NO: 2082267 - RNA, 13 nt, Human
uccuuucccucca

SEQ ID NO: 2082268 - RNA, 14 nt, Human
uccuuucccuccac

SEQ ID NO: 2082269 - RNA, 23 nt, Human
uccuuucagggaauuucaggaac

SEQ ID NO: 2082270 - RNA, 21 nt, Human
uccuuucagggaauuucagga

SEQ ID NO: 2082271 - RNA, 22 nt, Human
uccuuucagggaauuucaggaa

SEQ ID NO: 2082272 - RNA, 15 nt, Human
uccuuucaccacaug

SEQ ID NO: 2082273 - RNA, 20 nt, Human
uccuuucacaaccuucugug

SEQ ID NO: 2082274 - RNA, 19 nt, Human
uccuuucaaugguuugcaa

SEQ ID NO: 2082275 - RNA, 19 nt, Human
uccuuucacaaccuucugu

SEQ ID NO: 2082276 - RNA, 18 nt, Human
uccuuucacaaccuucug

SEQ ID NO: 2082277 - RNA, 16 nt, Human
uccuuucacaaccuuc

SEQ ID NO: 2082278 - RNA, 17 nt, Human
uccuuccugucuuccug

SEQ ID NO: 2082279 - RNA, 19 nt, Human
uccuuccugucuuccugca

SEQ ID NO: 2082280 - RNA, 12 nt, Human
uccuuccugucu

SEQ ID NO: 2082281 - RNA, 13 nt, Human
uccuuccugucuu

SEQ ID NO: 2082282 - RNA, 14 nt, Human
uccuuccugucuuc

SEQ ID NO: 2082283 - RNA, 17 nt, Human
ucgaggacagggaggug

SEQ ID NO: 2082284 - RNA, 14 nt, Human
ucgaggacagggag

SEQ ID NO: 2082285 - RNA, 18 nt, Human
ucgaggcccagcgaccuc

SEQ ID NO: 2082286 - RNA, 22 nt, Human
ucgagcaguccugccucagccu

SEQ ID NO: 2082287 - RNA, 16 nt, Human
ucgacugugaccugug

SEQ ID NO: 2082288 - RNA, 17 nt, Human
ucgacugugaccugugg

SEQ ID NO: 2082289 - RNA, 17 nt, Human
ucgaccaauucaacccu

SEQ ID NO: 2082290 - RNA, 14 nt, Human
ucgaccccaaagcc

SEQ ID NO: 2082291 - RNA, 19 nt, Human
ucgaccccaaagccccuug

SEQ ID NO: 2082292 - RNA, 13 nt, Human
ucgaggacaggga

SEQ ID NO: 2082293 - RNA, 17 nt, Human
ucgagcaguccugccuc

SEQ ID NO: 2082294 - RNA, 21 nt, Human
ucgagcaguccugccucagcc

SEQ ID NO: 2082295 - RNA, 21 nt, Human
acuggcaaacuucagacugaa

SEQ ID NO: 2082296 - RNA, 14 nt, Human
acuggcagcaucuu

SEQ ID NO: 2082297 - RNA, 16 nt, Human
acuggcaguuuuccau

SEQ ID NO: 2082298 - RNA, 22 nt, Human
acuggcaguuuuccauugguuu

SEQ ID NO: 2082299 - RNA, 18 nt, Human
acuggcuagaguccucac

SEQ ID NO: 2082300 - RNA, 21 nt, Human
acuggcuagaguccucacucc

SEQ ID NO: 2082301 - RNA, 14 nt, Human
acuggccugaggag

SEQ ID NO: 2082302 - RNA, 16 nt, Human
acuggccugaggagca

SEQ ID NO: 2082303 - RNA, 17 nt, Human
acuggccugaggagcag

SEQ ID NO: 2082304 - RNA, 19 nt, Human
acuggccugaggagcagca

SEQ ID NO: 2082305 - RNA, 20 nt, Human
acuggcaucugacacaaaaa

SEQ ID NO: 2082306 - RNA, 21 nt, Human
acuggcaucugacacaaaaaa

SEQ ID NO: 2082307 - RNA, 14 nt, Human
acuggcagccccag

SEQ ID NO: 2082308 - RNA, 16 nt, Human
acuggcagccccagca

SEQ ID NO: 2082309 - RNA, 22 nt, Human
acuggcugcaaaggguaucagg

SEQ ID NO: 2082310 - RNA, 22 nt, Human
acuggcucauauuccugcagcc

SEQ ID NO: 2082311 - RNA, 16 nt, Human
acuggcuggcugcagu

SEQ ID NO: 2082312 - RNA, 17 nt, Human
acuggcuggcugcagug

SEQ ID NO: 2082313 - RNA, 18 nt, Human
uccuucagcuuccauuuc

SEQ ID NO: 2082314 - RNA, 12 nt, Human
uccuucagugca

SEQ ID NO: 2082315 - RNA, 12 nt, Human
uccuucccuggc

SEQ ID NO: 2082316 - RNA, 14 nt, Human
uccuucccuggcuu

SEQ ID NO: 2082317 - RNA, 15 nt, Human
uccuucccuggcuug

SEQ ID NO: 2082318 - RNA, 22 nt, Human
uccuucauuucugauauagaau

SEQ ID NO: 2082319 - RNA, 14 nt, Human
uccuuccaacagga

SEQ ID NO: 2082320 - RNA, 20 nt, Human
uccuuccaacaggagcuggg

SEQ ID NO: 2082321 - RNA, 21 nt, Human
uccuuccaacaggagcuggga

SEQ ID NO: 2082322 - RNA, 14 nt, Human
uccuuccaacugcu

SEQ ID NO: 2082323 - RNA, 18 nt, Human
uccuuccaacugcugccc

SEQ ID NO: 2082324 - RNA, 20 nt, Human
uccuuccaacugcugcccca

SEQ ID NO: 2082325 - RNA, 13 nt, Human
uccuucccagcug

SEQ ID NO: 2082326 - RNA, 14 nt, Human
uccuucccagcugc

SEQ ID NO: 2082327 - RNA, 16 nt, Human
uccuucccagcugccc

SEQ ID NO: 2082328 - RNA, 18 nt, Human
uccuucccagcugccccu

SEQ ID NO: 2082329 - RNA, 21 nt, Human
uccuucccagcugccccuccc

SEQ ID NO: 2082330 - RNA, 17 nt, Human
uccuuccccuuucccca

SEQ ID NO: 2082331 - RNA, 12 nt, Human
uccuucccucuc

SEQ ID NO: 2082332 - RNA, 21 nt, Human
uccuuccucacaccaggcuug

SEQ ID NO: 2082333 - RNA, 16 nt, Human
uccuuccucacaccag

SEQ ID NO: 2082334 - RNA, 16 nt, Human
acugcuucuaccaacu

SEQ ID NO: 2082335 - RNA, 20 nt, Human
acugcuucuaccaacuggaa

SEQ ID NO: 2082336 - RNA, 13 nt, Human
acugcuggcugcc

SEQ ID NO: 2082337 - RNA, 13 nt, Human
acuggcaaacuuc

SEQ ID NO: 2082338 - RNA, 16 nt, Human
acuggcaaacuucaga

SEQ ID NO: 2082339 - RNA, 20 nt, Human
acuggcaaacuucagacuga

SEQ ID NO: 2082340 - RNA, 12 nt, Human
acugcugcccca

SEQ ID NO: 2082341 - RNA, 19 nt, Human
acugcugccccaaaggaag

SEQ ID NO: 2082342 - RNA, 22 nt, Human
acugcugccccaaaggaagcuu

SEQ ID NO: 2082343 - RNA, 13 nt, Human
acugcugcugccu

SEQ ID NO: 2082344 - RNA, 12 nt, Human
acugcuggcugc

SEQ ID NO: 2082345 - RNA, 18 nt, Human
acugcugcccagccucca

SEQ ID NO: 2082346 - RNA, 16 nt, Human
acugcugcccagccuc

SEQ ID NO: 2082347 - RNA, 21 nt, Human
acugcugcccagccuccaagc

SEQ ID NO: 2082348 - RNA, 19 nt, Human
acugcucaucauuccuuga

SEQ ID NO: 2082349 - RNA, 23 nt, Human
acugcucaucauuccuugagaaa

SEQ ID NO: 2082350 - RNA, 22 nt, Human
acugcuaggugggccagccccu

SEQ ID NO: 2082351 - RNA, 23 nt, Human
acugcuaggugggccagccccuc

SEQ ID NO: 2082352 - RNA, 16 nt, Human
acugcuaggugggcca

SEQ ID NO: 2082353 - RNA, 17 nt, Human
acugcuaggugggccag

SEQ ID NO: 2082354 - RNA, 20 nt, Human
acugcuaggugggccagccc

SEQ ID NO: 2082355 - RNA, 21 nt, Human
acugcuaggugggccagcccc

SEQ ID NO: 2082356 - RNA, 20 nt, Human
acugcgggaugguccugggg

SEQ ID NO: 2082357 - RNA, 21 nt, Human
acugcgggaugguccuggggc

SEQ ID NO: 2082358 - RNA, 22 nt, Human
acugcgggaugguccuggggcu

SEQ ID NO: 2082359 - RNA, 20 nt, Human
acugcauaccaaccugggca

SEQ ID NO: 2082360 - RNA, 16 nt, Human
acugcauaccaaccug

SEQ ID NO: 2082361 - RNA, 14 nt, Human
acugcauacaaucu

SEQ ID NO: 2082362 - RNA, 18 nt, Human
acugccuuggcuucaggg

SEQ ID NO: 2082363 - RNA, 19 nt, Human
acugcgggaugguccuggg

SEQ ID NO: 2082364 - RNA, 19 nt, Human
uccuguucuuaagacguga

SEQ ID NO: 2082365 - RNA, 14 nt, Human
uccuguucagcauu

SEQ ID NO: 2082366 - RNA, 15 nt, Human
uccuguucagcauuc

SEQ ID NO: 2082367 - RNA, 16 nt, Human
uccuguucagcauucu

SEQ ID NO: 2082368 - RNA, 18 nt, Human
uccuguucagcauucuua

SEQ ID NO: 2082369 - RNA, 17 nt, Human
uccuguugaaaagccau

SEQ ID NO: 2082370 - RNA, 18 nt, Human
uccuguugaaaagccaug

SEQ ID NO: 2082371 - RNA, 22 nt, Human
uccuguugaaaagccauguuua

SEQ ID NO: 2082372 - RNA, 19 nt, Human
uccuguguuucuagggaaa

SEQ ID NO: 2082373 - RNA, 23 nt, Human
uccuguuagcuguuauuucuauu

SEQ ID NO: 2082374 - RNA, 19 nt, Human
uccuguuguuguuaaugaa

SEQ ID NO: 2082375 - RNA, 20 nt, Human
uccuguuguuauggaaacug

SEQ ID NO: 2082376 - RNA, 21 nt, Human
uccuguuguuguuaaugaaaa

SEQ ID NO: 2082377 - RNA, 24 nt, Human
uccugugucuugcaauggcagccu

SEQ ID NO: 2082378 - RNA, 23 nt, Human
uccugugucuugcaauggcagcc

SEQ ID NO: 2082379 - RNA, 23 nt, Human
uccuguguaaucauuucuugggc

SEQ ID NO: 2082380 - RNA, 13 nt, Human
uccugucuguuca

SEQ ID NO: 2082381 - RNA, 18 nt, Human
uccugugugguuuagugu

SEQ ID NO: 2082382 - RNA, 21 nt, Human
uccugugugguuuaguguaaa

SEQ ID NO: 2082383 - RNA, 14 nt, Human
uccugugugugcgc

SEQ ID NO: 2082384 - RNA, 13 nt, Human
uccugugugugcg

SEQ ID NO: 2082385 - RNA, 18 nt, Human
uccugugugugcgccuac

SEQ ID NO: 2082386 - RNA, 12 nt, Human
uccuguguuucu

SEQ ID NO: 2082387 - RNA, 16 nt, Human
acugcagggacugcca

SEQ ID NO: 2082388 - RNA, 18 nt, Human
acugcagggacugccagu

SEQ ID NO: 2082389 - RNA, 17 nt, Human
acugcagggacugccag

SEQ ID NO: 2082390 - RNA, 23 nt, Human
acugcaggccccgcuuguccagc

SEQ ID NO: 2082391 - RNA, 23 nt, Human
acugcagccucaaccuccugggc

SEQ ID NO: 2082392 - RNA, 15 nt, Human
acugcaggccccgcu

SEQ ID NO: 2082393 - RNA, 21 nt, Human
acugcaggccccgcuugucca

SEQ ID NO: 2082394 - RNA, 21 nt, Human
acugcagccucgaacuccugg

SEQ ID NO: 2082395 - RNA, 22 nt, Human
acugcagccucgaacuccuggg

SEQ ID NO: 2082396 - RNA, 23 nt, Human
acugcagccucgaacuccugggc

SEQ ID NO: 2082397 - RNA, 12 nt, Human
acugcaggcccc

SEQ ID NO: 2082398 - RNA, 22 nt, Human
acugcagccucaaccuccuggg

SEQ ID NO: 2082399 - RNA, 21 nt, Human
acugcagccucaaccuccugg

SEQ ID NO: 2082400 - RNA, 13 nt, Human
uccuuaagaacac

SEQ ID NO: 2082401 - RNA, 16 nt, Human
uccuuaagaacacaaa

SEQ ID NO: 2082402 - RNA, 19 nt, Human
acugcagccucaaccuccu

SEQ ID NO: 2082403 - RNA, 17 nt, Human
uccuuaaacugugugga

SEQ ID NO: 2082404 - RNA, 23 nt, Human
uccuuaaacuguguggacuguga

SEQ ID NO: 2082405 - RNA, 14 nt, Human
uccuuaaacugugu

SEQ ID NO: 2082406 - RNA, 15 nt, Human
uccuuaaacugugug

SEQ ID NO: 2082407 - RNA, 16 nt, Human
uccuuaaacugugugg

SEQ ID NO: 2082408 - RNA, 13 nt, Human
uccuguuuuuguu

SEQ ID NO: 2082409 - RNA, 14 nt, Human
uccuguuuuuguua

SEQ ID NO: 2082410 - RNA, 19 nt, Human
uccuguuuuuguuaacuuu

SEQ ID NO: 2082411 - RNA, 21 nt, Human
uccuggguggucugcaggcag

SEQ ID NO: 2082412 - RNA, 22 nt, Human
uccuggguggucugcaggcagg

SEQ ID NO: 2082413 - RNA, 15 nt, Human
uccuggguggucugc

SEQ ID NO: 2082414 - RNA, 19 nt, Human
uccuggguggucugcaggc

SEQ ID NO: 2082415 - RNA, 17 nt, Human
uccuggggugcccucca

SEQ ID NO: 2082416 - RNA, 19 nt, Human
uccuggggugcccuccacu

SEQ ID NO: 2082417 - RNA, 22 nt, Human
uccuggggugcccuccacugcc

SEQ ID NO: 2082418 - RNA, 15 nt, Human
uccugucuuccugca

SEQ ID NO: 2082419 - RNA, 22 nt, Human
uccugguauggguuucucccag

SEQ ID NO: 2082420 - RNA, 17 nt, Human
uccugucuuuaaggaaa

SEQ ID NO: 2082421 - RNA, 18 nt, Human
uccugucuuuaaggaaaa

SEQ ID NO: 2082422 - RNA, 19 nt, Human
uccugucuuuaaggaaaaa

SEQ ID NO: 2082423 - RNA, 18 nt, Human
uccuguguaaucauuucu

SEQ ID NO: 2082424 - RNA, 22 nt, Human
uccuguguaaucauuucuuggg

SEQ ID NO: 2082425 - RNA, 18 nt, Human
uccuguggagaugacuug

SEQ ID NO: 2082426 - RNA, 18 nt, Human
uccugugacuucagcucu

SEQ ID NO: 2082427 - RNA, 20 nt, Human
uccugugcaugggugaaggg

SEQ ID NO: 2082428 - RNA, 15 nt, Human
uccugugcaugggug

SEQ ID NO: 2082429 - RNA, 16 nt, Human
uccugugcauggguga

SEQ ID NO: 2082430 - RNA, 18 nt, Human
uccugugcaugggugaag

SEQ ID NO: 2082431 - RNA, 14 nt, Human
uccugggccccucc

SEQ ID NO: 2082432 - RNA, 15 nt, Human
uccugggccccuccc

SEQ ID NO: 2082433 - RNA, 16 nt, Human
uccugggccccucccu

SEQ ID NO: 2082434 - RNA, 17 nt, Human
uccugggccccucccua

SEQ ID NO: 2082435 - RNA, 18 nt, Human
uccugggccccucccuac

SEQ ID NO: 2082436 - RNA, 19 nt, Human
uccugggccccucccuacc

SEQ ID NO: 2082437 - RNA, 20 nt, Human
uccugggccccucccuaccu

SEQ ID NO: 2082438 - RNA, 21 nt, Human
uccugggccccucccuaccuc

SEQ ID NO: 2082439 - RNA, 22 nt, Human
uccugggccccucccuaccuca

SEQ ID NO: 2082440 - RNA, 23 nt, Human
uccugggccccucccuaccucaa

SEQ ID NO: 2082441 - RNA, 23 nt, Human
uccuggggguucuuucuuccucu

SEQ ID NO: 2082442 - RNA, 22 nt, Human
uccuggggguucuuucuuccuc

SEQ ID NO: 2082443 - RNA, 21 nt, Human
uccuggggguucuuucuuccu

SEQ ID NO: 2082444 - RNA, 19 nt, Human
uccuggggcucugugcagg

SEQ ID NO: 2082445 - RNA, 11 nt, Human
uccugggggcc

SEQ ID NO: 2082446 - RNA, 13 nt, Human
uccugggggccug

SEQ ID NO: 2082447 - RNA, 17 nt, Human
uccugggggccugaccu

SEQ ID NO: 2082448 - RNA, 18 nt, Human
uccugggggccugaccuc

SEQ ID NO: 2082449 - RNA, 19 nt, Human
uccugggggccugaccucc

SEQ ID NO: 2082450 - RNA, 21 nt, Human
uccuggggccucggagccuca

SEQ ID NO: 2082451 - RNA, 22 nt, Human
uccuggggccucggagccucau

SEQ ID NO: 2082452 - RNA, 15 nt, Human
uccuggggccucuug

SEQ ID NO: 2082453 - RNA, 15 nt, Human
uccuggggcucugug

SEQ ID NO: 2082454 - RNA, 16 nt, Human
uccuggggcucugugc

SEQ ID NO: 2082455 - RNA, 18 nt, Human
uccuggggcucugugcag

SEQ ID NO: 2082456 - RNA, 13 nt, Human
uccuggggccucg

SEQ ID NO: 2082457 - RNA, 16 nt, Human
uccugggcucaagcaa

SEQ ID NO: 2082458 - RNA, 12 nt, Human
uccugggcucag

SEQ ID NO: 2082459 - RNA, 13 nt, Human
uccugggcucagg

SEQ ID NO: 2082460 - RNA, 19 nt, Human
uccugaguagcuggauuac

SEQ ID NO: 2082461 - RNA, 21 nt, Human
uccugaggggcaucugccccu

SEQ ID NO: 2082462 - RNA, 22 nt, Human
uccugaggggcaucugccccuc

SEQ ID NO: 2082463 - RNA, 18 nt, Human
acugcacagugcaucuca

SEQ ID NO: 2082464 - RNA, 16 nt, Human
acugcacagugcaucu

SEQ ID NO: 2082465 - RNA, 20 nt, Human
uccugauuauuuaucacaua

SEQ ID NO: 2082466 - RNA, 17 nt, Human
uccugcaaaauuuuaua

SEQ ID NO: 2082467 - RNA, 19 nt, Human
uccugcaaaauuuuauagc

SEQ ID NO: 2082468 - RNA, 21 nt, Human
uccugcacugacccacagccu

SEQ ID NO: 2082469 - RNA, 15 nt, Human
uccugcagcagagcc

SEQ ID NO: 2082470 - RNA, 16 nt, Human
uccugcagcagagccu

SEQ ID NO: 2082471 - RNA, 15 nt, Human
uccugcucucuaccc

SEQ ID NO: 2082472 - RNA, 17 nt, Human
uccugcucucuacccag

SEQ ID NO: 2082473 - RNA, 18 nt, Human
uccugcucucuacccagc

SEQ ID NO: 2082474 - RNA, 19 nt, Human
uccugcucucuacccagcc

SEQ ID NO: 2082475 - RNA, 21 nt, Human
uccugcucucuacccagccca

SEQ ID NO: 2082476 - RNA, 22 nt, Human
uccugcucucuacccagcccau

SEQ ID NO: 2082477 - RNA, 24 nt, Human
uccugcucucuacccagcccaucu

SEQ ID NO: 2082478 - RNA, 14 nt, Human
uccugcuacucugu

SEQ ID NO: 2082479 - RNA, 18 nt, Human
uccugcuaaguuaauguu

SEQ ID NO: 2082480 - RNA, 18 nt, Human
uccugcuacucuguuccu

SEQ ID NO: 2082481 - RNA, 13 nt, Human
uccugcuagaaau

SEQ ID NO: 2082482 - RNA, 14 nt, Human
uccugcuagaaaug

SEQ ID NO: 2082483 - RNA, 15 nt, Human
uccugcuagaaaugg

SEQ ID NO: 2082484 - RNA, 19 nt, Human
uccugcuauuucccaagcu

SEQ ID NO: 2082485 - RNA, 22 nt, Human
uccugcuauuucccaagcugga

SEQ ID NO: 2082486 - RNA, 20 nt, Human
uccugccucgaacuggcugc

SEQ ID NO: 2082487 - RNA, 17 nt, Human
uccugccucagccuccg

SEQ ID NO: 2082488 - RNA, 21 nt, Human
uccugccucgaacuggcugca

SEQ ID NO: 2082489 - RNA, 22 nt, Human
uccugcauucacccagacagcu

SEQ ID NO: 2082490 - RNA, 11 nt, Human
uccugcaugca

SEQ ID NO: 2082491 - RNA, 16 nt, Human
uccugcauucacccag

SEQ ID NO: 2082492 - RNA, 19 nt, Human
uccugccucagccucccaa

SEQ ID NO: 2082493 - RNA, 20 nt, Human
acugagggaccaacugggcc

SEQ ID NO: 2082494 - RNA, 21 nt, Human
acugagggaccaacugggccc

SEQ ID NO: 2082495 - RNA, 22 nt, Human
acugagggaccaacugggccca

SEQ ID NO: 2082496 - RNA, 15 nt, Human
acugaggcagggaag

SEQ ID NO: 2082497 - RNA, 23 nt, Human
acugaggcagacagcagcucagg

SEQ ID NO: 2082498 - RNA, 12 nt, Human
acugaggcaggg

SEQ ID NO: 2082499 - RNA, 14 nt, Human
acugaggcagggaa

SEQ ID NO: 2082500 - RNA, 13 nt, Human
acugaggcagaca

SEQ ID NO: 2082501 - RNA, 15 nt, Human
acugaggcagacagc

SEQ ID NO: 2082502 - RNA, 19 nt, Human
acugaggcagacagcagcu

SEQ ID NO: 2082503 - RNA, 22 nt, Human
acugaggcagacagcagcucag

SEQ ID NO: 2082504 - RNA, 15 nt, Human
acugaggaccagcca

SEQ ID NO: 2082505 - RNA, 15 nt, Human
acugaggcacgagca

SEQ ID NO: 2082506 - RNA, 15 nt, Human
uccucuccccagcaa

SEQ ID NO: 2082507 - RNA, 16 nt, Human
acugagcuucucugug

SEQ ID NO: 2082508 - RNA, 16 nt, Human
acugagcuccucuggg

SEQ ID NO: 2082509 - RNA, 19 nt, Human
acugagcuccucugggcag

SEQ ID NO: 2082510 - RNA, 13 nt, Human
acugagcuccucu

SEQ ID NO: 2082511 - RNA, 14 nt, Human
acugagcuccucug

SEQ ID NO: 2082512 - RNA, 21 nt, Human
acugagcuccucugggcagga

SEQ ID NO: 2082513 - RNA, 18 nt, Human
acugaggaaugaugaagc

SEQ ID NO: 2082514 - RNA, 18 nt, Human
acugagcuucucugugaa

SEQ ID NO: 2082515 - RNA, 17 nt, Human
acugagcuucucuguga

SEQ ID NO: 2082516 - RNA, 18 nt, Human
acugaggggucuccagga

SEQ ID NO: 2082517 - RNA, 21 nt, Human
acugaggggucuccaggagga

SEQ ID NO: 2082518 - RNA, 21 nt, Human
acugaguuaaauuauacugga

SEQ ID NO: 2082519 - RNA, 11 nt, Human
acugcaacagg

SEQ ID NO: 2082520 - RNA, 12 nt, Human
acugcaacagga

SEQ ID NO: 2082521 - RNA, 15 nt, Human
acugcaacaggaacu

SEQ ID NO: 2082522 - RNA, 14 nt, Human
acugcaaccuccgc

SEQ ID NO: 2082523 - RNA, 13 nt, Human
acugcaaccuccg

SEQ ID NO: 2082524 - RNA, 21 nt, Human
acugcaauagagacuguagau

SEQ ID NO: 2082525 - RNA, 22 nt, Human
acugcaauagagacuguagauu

SEQ ID NO: 2082526 - RNA, 22 nt, Human
acugcaaccuccgccucuuggg

SEQ ID NO: 2082527 - RNA, 16 nt, Human
acugcaaccuccgccu

SEQ ID NO: 2082528 - RNA, 16 nt, Human
uccacaguggaaccag

SEQ ID NO: 2082529 - RNA, 20 nt, Human
uccacaguggaaccagccca

SEQ ID NO: 2082530 - RNA, 16 nt, Human
uccaccaacccaucag

SEQ ID NO: 2082531 - RNA, 18 nt, Human
uccaccaacccaucagaa

SEQ ID NO: 2082532 - RNA, 15 nt, Human
uccacaggucucaga

SEQ ID NO: 2082533 - RNA, 17 nt, Human
uccaccaagaaagcagg

SEQ ID NO: 2082534 - RNA, 16 nt, Human
uccaccagccugcacu

SEQ ID NO: 2082535 - RNA, 14 nt, Human
uccaccagccugca

SEQ ID NO: 2082536 - RNA, 15 nt, Human
uccaccagccugcac

SEQ ID NO: 2082537 - RNA, 13 nt, Human
uccaccacccaaa

SEQ ID NO: 2082538 - RNA, 17 nt, Human
uccaccacccaaaaguc

SEQ ID NO: 2082539 - RNA, 14 nt, Human
uccacagugacucc

SEQ ID NO: 2082540 - RNA, 23 nt, Human
uccaauaaaugugaaauucuguc

SEQ ID NO: 2082541 - RNA, 16 nt, Human
uccaauaggaaugcua

SEQ ID NO: 2082542 - RNA, 19 nt, Human
uccaauaggaaugcuaaca

SEQ ID NO: 2082543 - RNA, 11 nt, Human
uccaagcuggu

SEQ ID NO: 2082544 - RNA, 16 nt, Human
uccaaguuggacuggg

SEQ ID NO: 2082545 - RNA, 13 nt, Human
uccaagugugugu

SEQ ID NO: 2082546 - RNA, 14 nt, Human
uccaagugugugug

SEQ ID NO: 2082547 - RNA, 18 nt, Human
uccaagugugugugcgug

SEQ ID NO: 2082548 - RNA, 19 nt, Human
uccaacguggggcagcaca

SEQ ID NO: 2082549 - RNA, 16 nt, Human
uccaacguggcccaga

SEQ ID NO: 2082550 - RNA, 14 nt, Human
uccaacguggccca

SEQ ID NO: 2082551 - RNA, 17 nt, Human
uccaacguggggcagca

SEQ ID NO: 2082552 - RNA, 18 nt, Human
uccaacguggggcagcac

SEQ ID NO: 2082553 - RNA, 19 nt, Human
uccaacagcucaagucuuc

SEQ ID NO: 2082554 - RNA, 14 nt, Human
uccaacaggagcug

SEQ ID NO: 2082555 - RNA, 16 nt, Human
uccaacaggagcuggg

SEQ ID NO: 2082556 - RNA, 17 nt, Human
uccaacaggagcuggga

SEQ ID NO: 2082557 - RNA, 18 nt, Human
uccaagcuccaucuccac

SEQ ID NO: 2082558 - RNA, 18 nt, Human
ucauuuuacccuuggcuc

SEQ ID NO: 2082559 - RNA, 16 nt, Human
ucauuuguuauucuua

SEQ ID NO: 2082560 - RNA, 19 nt, Human
ucauuuguuauucuuaaga

SEQ ID NO: 2082561 - RNA, 16 nt, Human
ucauuugugugcucau

SEQ ID NO: 2082562 - RNA, 21 nt, Human
ucauuugagcagggcucagcg

SEQ ID NO: 2082563 - RNA, 20 nt, Human
ucauuugcuaacuagcuugg

SEQ ID NO: 2082564 - RNA, 16 nt, Human
ucauuugaugcuaaau

SEQ ID NO: 2082565 - RNA, 15 nt, Human
ucauuuuccccccac

SEQ ID NO: 2082566 - RNA, 19 nt, Human
ucauuuuccccccacucuc

SEQ ID NO: 2082567 - RNA, 18 nt, Human
accuggaagcccucucug

SEQ ID NO: 2082568 - RNA, 15 nt, Human
accugcuuucaagac

SEQ ID NO: 2082569 - RNA, 19 nt, Human
ucauuugagcagggcucag

SEQ ID NO: 2082570 - RNA, 16 nt, Human
accugcugagagaccc

SEQ ID NO: 2082571 - RNA, 19 nt, Human
accugcugagagacccaag

SEQ ID NO: 2082572 - RNA, 18 nt, Human
accugaauagcucccaga

SEQ ID NO: 2082573 - RNA, 23 nt, Human
accugaauagcucccagauuuca

SEQ ID NO: 2082574 - RNA, 19 nt, Human
accugcucuccucuugcca

SEQ ID NO: 2082575 - RNA, 22 nt, Human
accugcugagagacccaaggag

SEQ ID NO: 2082576 - RNA, 17 nt, Human
accugcucuccucuugc

SEQ ID NO: 2082577 - RNA, 18 nt, Human
accugcucuccucuugcc

SEQ ID NO: 2082578 - RNA, 23 nt, Human
accuggucacaggacucugccuc

SEQ ID NO: 2082579 - RNA, 22 nt, Human
accuggucacaggacucugccu

SEQ ID NO: 2082580 - RNA, 13 nt, Human
accuggugcugga

SEQ ID NO: 2082581 - RNA, 14 nt, Human
accuggugcuggau

SEQ ID NO: 2082582 - RNA, 10 nt, Human
accuggugcu

SEQ ID NO: 2082583 - RNA, 11 nt, Human
accuggugcug

SEQ ID NO: 2082584 - RNA, 22 nt, Human
accuggugcuggauauuuucaa

SEQ ID NO: 2082585 - RNA, 15 nt, Human
accugguggccucug

SEQ ID NO: 2082586 - RNA, 22 nt, Human
accugguuccggaauccugucc

SEQ ID NO: 2082587 - RNA, 16 nt, Human
accuuacuuacagcau

SEQ ID NO: 2082588 - RNA, 16 nt, Human
accuuaggcagggaag

SEQ ID NO: 2082589 - RNA, 13 nt, Human
accuuaggcaggg

SEQ ID NO: 2082590 - RNA, 15 nt, Human
accuuaggcagggaa

SEQ ID NO: 2082591 - RNA, 17 nt, Human
accuucuccccauucug

SEQ ID NO: 2082592 - RNA, 12 nt, Human
accuucccagcu

SEQ ID NO: 2082593 - RNA, 13 nt, Human
accuucccagcuc

SEQ ID NO: 2082594 - RNA, 14 nt, Human
accuucuccaaaug

SEQ ID NO: 2082595 - RNA, 11 nt, Human
accuucccagc

SEQ ID NO: 2082596 - RNA, 13 nt, Human
accuuaucugugc

SEQ ID NO: 2082597 - RNA, 22 nt, Human
accuuaucugugcgugaaacac

SEQ ID NO: 2082598 - RNA, 11 nt, Human
accuuaucugu

SEQ ID NO: 2082599 - RNA, 19 nt, Human
accuuccauggcucuuuuu

SEQ ID NO: 2082600 - RNA, 14 nt, Human
accuugacagggca

SEQ ID NO: 2082601 - RNA, 15 nt, Human
accuugacagggcac

SEQ ID NO: 2082602 - RNA, 16 nt, Human
accuucuguggcucac

SEQ ID NO: 2082603 - RNA, 19 nt, Human
accuucuucagccaccucu

SEQ ID NO: 2082604 - RNA, 20 nt, Human
accuucuucagccaccucuc

SEQ ID NO: 2082605 - RNA, 15 nt, Human
accuucuguggcuca

SEQ ID NO: 2082606 - RNA, 13 nt, Human
accuucuguggcu

SEQ ID NO: 2082607 - RNA, 12 nt, Human
accuucuguggc

SEQ ID NO: 2082608 - RNA, 18 nt, Human
uccagaccccuggcuuuu

SEQ ID NO: 2082609 - RNA, 17 nt, Human
uccagaccccuggcuuu

SEQ ID NO: 2082610 - RNA, 16 nt, Human
uccagaccccuggcuu

SEQ ID NO: 2082611 - RNA, 15 nt, Human
uccagaccccuggcu

SEQ ID NO: 2082612 - RNA, 23 nt, Human
uccagaccccuggcuuuucacug

SEQ ID NO: 2082613 - RNA, 13 nt, Human
uccagccugagca

SEQ ID NO: 2082614 - RNA, 12 nt, Human
uccagccugggc

SEQ ID NO: 2082615 - RNA, 13 nt, Human
uccagccugggca

SEQ ID NO: 2082616 - RNA, 20 nt, Human
uccagccugggcaacagagc

SEQ ID NO: 2082617 - RNA, 19 nt, Human
uccagccugggcagccagg

SEQ ID NO: 2082618 - RNA, 22 nt, Human
uccagccugggcagccaggcug

SEQ ID NO: 2082619 - RNA, 23 nt, Human
uccagccugggcagccaggcugc

SEQ ID NO: 2082620 - RNA, 11 nt, Human
accuuugucac

SEQ ID NO: 2082621 - RNA, 23 nt, Human
accuuuggguugcaaucugggga

SEQ ID NO: 2082622 - RNA, 13 nt, Human
uccacuacugcua

SEQ ID NO: 2082623 - RNA, 17 nt, Human
uccacguucaccccucc

SEQ ID NO: 2082624 - RNA, 18 nt, Human
uccacguacugcagccuc

SEQ ID NO: 2082625 - RNA, 17 nt, Human
uccacguacugcagccu

SEQ ID NO: 2082626 - RNA, 15 nt, Human
uccacguacugcagc

SEQ ID NO: 2082627 - RNA, 22 nt, Human
uccagaaguuugagaucagccu

SEQ ID NO: 2082628 - RNA, 13 nt, Human
accuagccuuaga

SEQ ID NO: 2082629 - RNA, 13 nt, Human
accuagaucagaa

SEQ ID NO: 2082630 - RNA, 22 nt, Human
accuaugguauaaugguugacu

SEQ ID NO: 2082631 - RNA, 15 nt, Human
accuauagucccagc

SEQ ID NO: 2082632 - RNA, 16 nt, Human
accuauagucccagcu

SEQ ID NO: 2082633 - RNA, 22 nt, Human
accuauagucccagcuacucag

SEQ ID NO: 2082634 - RNA, 18 nt, Human
accguuggggauugggga

SEQ ID NO: 2082635 - RNA, 18 nt, Human
accuaaccccuuuccugc

SEQ ID NO: 2082636 - RNA, 18 nt, Human
accuaagucucugugaau

SEQ ID NO: 2082637 - RNA, 14 nt, Human
accuaagucucugu

SEQ ID NO: 2082638 - RNA, 15 nt, Human
accuaagucucugug

SEQ ID NO: 2082639 - RNA, 16 nt, Human
accuaagucucuguga

SEQ ID NO: 2082640 - RNA, 20 nt, Human
accuaaguuucaguugauuu

SEQ ID NO: 2082641 - RNA, 16 nt, Human
accuccuccacaccag

SEQ ID NO: 2082642 - RNA, 22 nt, Human
accuccccccacugcaggcccc

SEQ ID NO: 2082643 - RNA, 12 nt, Human
accucccccucc

SEQ ID NO: 2082644 - RNA, 23 nt, Human
accuccuacgucaaacaugaagu

SEQ ID NO: 2082645 - RNA, 13 nt, Human
accuccccccacu

SEQ ID NO: 2082646 - RNA, 14 nt, Human
accuccccccacug

SEQ ID NO: 2082647 - RNA, 15 nt, Human
accuccccccacugc

SEQ ID NO: 2082648 - RNA, 16 nt, Human
accuccccccacugca

SEQ ID NO: 2082649 - RNA, 17 nt, Human
accuccccccacugcag

SEQ ID NO: 2082650 - RNA, 18 nt, Human
accuccccccacugcagg

SEQ ID NO: 2082651 - RNA, 20 nt, Human
accuccgccucuuggguuca

SEQ ID NO: 2082652 - RNA, 13 nt, Human
accuccccagccu

SEQ ID NO: 2082653 - RNA, 13 nt, Human
accuccccaggcc

SEQ ID NO: 2082654 - RNA, 14 nt, Human
accuccccaggccg

SEQ ID NO: 2082655 - RNA, 19 nt, Human
accuccccaggccguggcu

SEQ ID NO: 2082656 - RNA, 20 nt, Human
accuccccaggccguggcug

SEQ ID NO: 2082657 - RNA, 17 nt, Human
accucaccaagcugcug

SEQ ID NO: 2082658 - RNA, 21 nt, Human
accucacugggguccuggggc

SEQ ID NO: 2082659 - RNA, 23 nt, Human
accucacugggguccuggggccu

SEQ ID NO: 2082660 - RNA, 10 nt, Human
accucaaggg

SEQ ID NO: 2082661 - RNA, 15 nt, Human
accucaagggggacu

SEQ ID NO: 2082662 - RNA, 20 nt, Human
accucaagggggacugucuu

SEQ ID NO: 2082663 - RNA, 21 nt, Human
accucaagggggacugucuuu

SEQ ID NO: 2082664 - RNA, 13 nt, Human
accucagccuaga

SEQ ID NO: 2082665 - RNA, 15 nt, Human
accucagccuagacc

SEQ ID NO: 2082666 - RNA, 15 nt, Human
accucagcaaccugu

SEQ ID NO: 2082667 - RNA, 14 nt, Human
accucagccaugag

SEQ ID NO: 2082668 - RNA, 22 nt, Human
accucagccaugaggaguugcu

SEQ ID NO: 2082669 - RNA, 23 nt, Human
accucagccaugaggaguugcug

SEQ ID NO: 2082670 - RNA, 10 nt, Human
accucagccu

SEQ ID NO: 2082671 - RNA, 15 nt, Human
accucagagccccgc

SEQ ID NO: 2082672 - RNA, 16 nt, Human
accucagagccccgca

SEQ ID NO: 2082673 - RNA, 20 nt, Human
accucagaguccaggcccca

SEQ ID NO: 2082674 - RNA, 17 nt, Human
accucagaguccaggcc

SEQ ID NO: 2082675 - RNA, 19 nt, Human
accucagaguccaggcccc

SEQ ID NO: 2082676 - RNA, 17 nt, Human
ucauauuccugcagccu

SEQ ID NO: 2082677 - RNA, 23 nt, Human
acccuuuuggcccccgagcuggg

SEQ ID NO: 2082678 - RNA, 14 nt, Human
acccuuuuggcccc

SEQ ID NO: 2082679 - RNA, 23 nt, Human
acccuuuggggggggcccgccug

SEQ ID NO: 2082680 - RNA, 12 nt, Human
acccuuuggggg

SEQ ID NO: 2082681 - RNA, 18 nt, Human
accgagucucuucuccac

SEQ ID NO: 2082682 - RNA, 17 nt, Human
accgagaguagccgaga

SEQ ID NO: 2082683 - RNA, 23 nt, Human
accgagaguagccgagagccugc

SEQ ID NO: 2082684 - RNA, 20 nt, Human
ucauauuuacuucuuauaca

SEQ ID NO: 2082685 - RNA, 21 nt, Human
ucauauuuacuucuuauacau

SEQ ID NO: 2082686 - RNA, 22 nt, Human
ucauauuuacuucuuauacauu

SEQ ID NO: 2082687 - RNA, 16 nt, Human
ucauauuuacuucuua

SEQ ID NO: 2082688 - RNA, 17 nt, Human
accgccaaggcuggggg

SEQ ID NO: 2082689 - RNA, 12 nt, Human
accgcaggaagc

SEQ ID NO: 2082690 - RNA, 13 nt, Human
accgcaggaagcu

SEQ ID NO: 2082691 - RNA, 14 nt, Human
accgcaggaagcug

SEQ ID NO: 2082692 - RNA, 16 nt, Human
accgcaggaagcugcu

SEQ ID NO: 2082693 - RNA, 19 nt, Human
accgcaggaagcugcuccg

SEQ ID NO: 2082694 - RNA, 24 nt, Human
accgagucucuucuccacuggaug

SEQ ID NO: 2082695 - RNA, 21 nt, Human
accgagucucuucuccacugg

SEQ ID NO: 2082696 - RNA, 20 nt, Human
accgagucucuucuccacug

SEQ ID NO: 2082697 - RNA, 13 nt, Human
accgaugcuccag

SEQ ID NO: 2082698 - RNA, 15 nt, Human
accgaugcuccagcc

SEQ ID NO: 2082699 - RNA, 23 nt, Human
accgaugcuccagccaaccccug

SEQ ID NO: 2082700 - RNA, 12 nt, Human
accgccuucucu

SEQ ID NO: 2082701 - RNA, 15 nt, Human
accgcuccccagccc

SEQ ID NO: 2082702 - RNA, 17 nt, Human
accgcuccccagcccag

SEQ ID NO: 2082703 - RNA, 18 nt, Human
accgcuccccagcccagg

SEQ ID NO: 2082704 - RNA, 19 nt, Human
accgcuccccagcccaggg

SEQ ID NO: 2082705 - RNA, 20 nt, Human
accgcuccccagcccagggu

SEQ ID NO: 2082706 - RNA, 18 nt, Human
accgccggccagcuggga

SEQ ID NO: 2082707 - RNA, 23 nt, Human
accggagcuuucaaagaaggaau

SEQ ID NO: 2082708 - RNA, 21 nt, Human
accgcugccuaaguggcugcu

SEQ ID NO: 2082709 - RNA, 14 nt, Human
accggaagcuccug

SEQ ID NO: 2082710 - RNA, 15 nt, Human
accggaagcuccugg

SEQ ID NO: 2082711 - RNA, 16 nt, Human
accggaagcuccuggu

SEQ ID NO: 2082712 - RNA, 17 nt, Human
accggaagcuccuggua

SEQ ID NO: 2082713 - RNA, 19 nt, Human
accgcugccuaaguggcug

SEQ ID NO: 2082714 - RNA, 20 nt, Human
accgcugccuaaguggcugc

SEQ ID NO: 2082715 - RNA, 18 nt, Human
accucuauaauugccacu

SEQ ID NO: 2082716 - RNA, 20 nt, Human
accucuauaauugccacuga

SEQ ID NO: 2082717 - RNA, 14 nt, Human
accucggcuccugg

SEQ ID NO: 2082718 - RNA, 15 nt, Human
accucggcuccugga

SEQ ID NO: 2082719 - RNA, 12 nt, Human
accucugcacaa

SEQ ID NO: 2082720 - RNA, 15 nt, Human
accucugauaccuca

SEQ ID NO: 2082721 - RNA, 13 nt, Human
accucugauaccu

SEQ ID NO: 2082722 - RNA, 23 nt, Human
accucucuuauagaauauuuauu

SEQ ID NO: 2082723 - RNA, 22 nt, Human
accucucuuauagaauauuuau

SEQ ID NO: 2082724 - RNA, 14 nt, Human
accucucuuuuuca

SEQ ID NO: 2082725 - RNA, 15 nt, Human
accucugaagucucu

SEQ ID NO: 2082726 - RNA, 20 nt, Human
accucuccuuuggccauucc

SEQ ID NO: 2082727 - RNA, 17 nt, Human
accucggugccuuccuc

SEQ ID NO: 2082728 - RNA, 19 nt, Human
ucauugggcuguuuucuca

SEQ ID NO: 2082729 - RNA, 23 nt, Human
ucauugggcuguuuucucaacaa

SEQ ID NO: 2082730 - RNA, 16 nt, Human
ucauuguaaacaaacu

SEQ ID NO: 2082731 - RNA, 16 nt, Human
ucauuguaauguuacu

SEQ ID NO: 2082732 - RNA, 17 nt, Human
ucauuguaauguuacug

SEQ ID NO: 2082733 - RNA, 11 nt, Human
ucauugcuuua

SEQ ID NO: 2082734 - RNA, 12 nt, Human
ucauugcuuuac

SEQ ID NO: 2082735 - RNA, 15 nt, Human
ucauugcuuuacugg

SEQ ID NO: 2082736 - RNA, 19 nt, Human
ucauugauaugaaaaauau

SEQ ID NO: 2082737 - RNA, 16 nt, Human
ucauugcuuaugacau

SEQ ID NO: 2082738 - RNA, 21 nt, Human
ucauugcuucacaacccaucu

SEQ ID NO: 2082739 - RNA, 17 nt, Human
ucauugauaugaaaaau

SEQ ID NO: 2082740 - RNA, 18 nt, Human
ucauugauaugaaaaaua

SEQ ID NO: 2082741 - RNA, 13 nt, Human
ucauugauaugaa

SEQ ID NO: 2082742 - RNA, 15 nt, Human
ucauugauaugaaaa

SEQ ID NO: 2082743 - RNA, 16 nt, Human
ucauugauaugaaaaa

SEQ ID NO: 2082744 - RNA, 20 nt, Human
ucauugacuaucaaacugaa

SEQ ID NO: 2082745 - RNA, 21 nt, Human
ucauugacuaucaaacugaag

SEQ ID NO: 2082746 - RNA, 13 nt, Human
ucauguuccucaa

SEQ ID NO: 2082747 - RNA, 18 nt, Human
ucauguuaauccuagcug

SEQ ID NO: 2082748 - RNA, 21 nt, Human
ucauguuaauccuagcugugu

SEQ ID NO: 2082749 - RNA, 22 nt, Human
ucauguuaauccuagcugugug

SEQ ID NO: 2082750 - RNA, 13 nt, Human
ucaugucuggcua

SEQ ID NO: 2082751 - RNA, 23 nt, Human
ucauuccuugagaaaaacaauga

SEQ ID NO: 2082752 - RNA, 21 nt, Human
ucauuaaaauaaauaaaugca

SEQ ID NO: 2082753 - RNA, 15 nt, Human
ucauuaaagcauuua

SEQ ID NO: 2082754 - RNA, 23 nt, Human
ucauccacugugccaugugccag

SEQ ID NO: 2082755 - RNA, 21 nt, Human
ucauccacugugccaugugcc

SEQ ID NO: 2082756 - RNA, 19 nt, Human
ucauccacugugccaugug

SEQ ID NO: 2082757 - RNA, 22 nt, Human
accucacaugcauacauacaca

SEQ ID NO: 2082758 - RNA, 12 nt, Human
ucaugcauuguu

SEQ ID NO: 2082759 - RNA, 16 nt, Human
ucaugagcugagcagg

SEQ ID NO: 2082760 - RNA, 18 nt, Human
ucaugccaaccccgcccu

SEQ ID NO: 2082761 - RNA, 19 nt, Human
ucaugccaccauggccagc

SEQ ID NO: 2082762 - RNA, 22 nt, Human
ucaugccaccauggccagccaa

SEQ ID NO: 2082763 - RNA, 17 nt, Human
ucaugcccaagcccuga

SEQ ID NO: 2082764 - RNA, 12 nt, Human
accccuuuccug

SEQ ID NO: 2082765 - RNA, 20 nt, Human
accccuucgcuccugugucu

SEQ ID NO: 2082766 - RNA, 21 nt, Human
acccgacagagggaagaaaag

SEQ ID NO: 2082767 - RNA, 16 nt, Human
acccgacagagggaag

SEQ ID NO: 2082768 - RNA, 13 nt, Human
acccgaggaaacu

SEQ ID NO: 2082769 - RNA, 14 nt, Human
acccgaggcccgca

SEQ ID NO: 2082770 - RNA, 14 nt, Human
acccgaggcugccc

SEQ ID NO: 2082771 - RNA, 15 nt, Human
acccgaggcugccca

SEQ ID NO: 2082772 - RNA, 17 nt, Human
acccgaggcugcccacu

SEQ ID NO: 2082773 - RNA, 24 nt, Human
acccgaggcugcccacuaugguca

SEQ ID NO: 2082774 - RNA, 13 nt, Human
acccucccagcuc

SEQ ID NO: 2082775 - RNA, 15 nt, Human
acccucccagcucug

SEQ ID NO: 2082776 - RNA, 16 nt, Human
acccucccagcucuga

SEQ ID NO: 2082777 - RNA, 14 nt, Human
acccucccaccccc

SEQ ID NO: 2082778 - RNA, 20 nt, Human
acccucccacccccuucucu

SEQ ID NO: 2082779 - RNA, 23 nt, Human
acccucccacccccuucucugcu

SEQ ID NO: 2082780 - RNA, 12 nt, Human
acccucccaccc

SEQ ID NO: 2082781 - RNA, 13 nt, Human
acccucccacccc

SEQ ID NO: 2082782 - RNA, 21 nt, Human
acccuccuaucaccuccccuc

SEQ ID NO: 2082783 - RNA, 15 nt, Human
acccuccgccuucac

SEQ ID NO: 2082784 - RNA, 22 nt, Human
acccuccgccuucacuccggug

SEQ ID NO: 2082785 - RNA, 17 nt, Human
acccuccuaucaccucc

SEQ ID NO: 2082786 - RNA, 14 nt, Human
acccucuuagaaaa

SEQ ID NO: 2082787 - RNA, 15 nt, Human
acccugccccugccc

SEQ ID NO: 2082788 - RNA, 18 nt, Human
acccugccccugccccgu

SEQ ID NO: 2082789 - RNA, 12 nt, Human
acccuuugcccc

SEQ ID NO: 2082790 - RNA, 20 nt, Human
acccuucccuugagcccucu

SEQ ID NO: 2082791 - RNA, 19 nt, Human
acccuucccuugagcccuc

SEQ ID NO: 2082792 - RNA, 22 nt, Human
acccuuccccuccuucucccuu

SEQ ID NO: 2082793 - RNA, 18 nt, Human
ucagcggggacagcuccu

SEQ ID NO: 2082794 - RNA, 13 nt, Human
ucaggaaccugga

SEQ ID NO: 2082795 - RNA, 15 nt, Human
ucaggaaccuggacc

SEQ ID NO: 2082796 - RNA, 16 nt, Human
ucaggaaccuggacca

SEQ ID NO: 2082797 - RNA, 17 nt, Human
ucaggaaccuggaccaa

SEQ ID NO: 2082798 - RNA, 22 nt, Human
ucaggaaccuggaccaaagcug

SEQ ID NO: 2082799 - RNA, 23 nt, Human
ucaggaaccuggaccaaagcuga

SEQ ID NO: 2082800 - RNA, 14 nt, Human
ucagccuggugggc

SEQ ID NO: 2082801 - RNA, 17 nt, Human
ucagcggggacagcucc

SEQ ID NO: 2082802 - RNA, 16 nt, Human
ucagcggggacagcuc

SEQ ID NO: 2082803 - RNA, 15 nt, Human
ucagcggggacagcu

SEQ ID NO: 2082804 - RNA, 23 nt, Human
accccuuccccacugccugccca

SEQ ID NO: 2082805 - RNA, 21 nt, Human
accccuuccccacugccugcc

SEQ ID NO: 2082806 - RNA, 22 nt, Human
accccuuccccacugccugccc

SEQ ID NO: 2082807 - RNA, 16 nt, Human
ucaggcaugccugugu

SEQ ID NO: 2082808 - RNA, 17 nt, Human
ucaggcaugccugugug

SEQ ID NO: 2082809 - RNA, 14 nt, Human
ucaggcaugccugu

SEQ ID NO: 2082810 - RNA, 15 nt, Human
ucaggcaugccugug

SEQ ID NO: 2082811 - RNA, 19 nt, Human
ucaggcauaggccugggug

SEQ ID NO: 2082812 - RNA, 20 nt, Human
ucaggcauaggccugggugc

SEQ ID NO: 2082813 - RNA, 22 nt, Human
ucaggcauaggccugggugcug

SEQ ID NO: 2082814 - RNA, 19 nt, Human
accccuucgcuccuguguc

SEQ ID NO: 2082815 - RNA, 16 nt, Human
ucagguaacaggcaga

SEQ ID NO: 2082816 - RNA, 15 nt, Human
ucagguaacaggcag

SEQ ID NO: 2082817 - RNA, 13 nt, Human
ucagguaacaggc

SEQ ID NO: 2082818 - RNA, 15 nt, Human
ucagggucauagcau

SEQ ID NO: 2082819 - RNA, 16 nt, Human
ucaggccaggugcagu

SEQ ID NO: 2082820 - RNA, 17 nt, Human
ucaggccaggugcagug

SEQ ID NO: 2082821 - RNA, 18 nt, Human
ucaggccaggugcagugg

SEQ ID NO: 2082822 - RNA, 19 nt, Human
ucaggccaggugcaguggc

SEQ ID NO: 2082823 - RNA, 15 nt, Human
ucaggccauggcucc

SEQ ID NO: 2082824 - RNA, 14 nt, Human
ucagaugcccagag

SEQ ID NO: 2082825 - RNA, 21 nt, Human
ucagaugcccagagggcccag

SEQ ID NO: 2082826 - RNA, 18 nt, Human
ucagaugcacaugagcug

SEQ ID NO: 2082827 - RNA, 15 nt, Human
ucagaugacuagaaa

SEQ ID NO: 2082828 - RNA, 15 nt, Human
ucagaugggaagaca

SEQ ID NO: 2082829 - RNA, 18 nt, Human
ucagaugggaagacauga

SEQ ID NO: 2082830 - RNA, 13 nt, Human
ucagaagacacug

SEQ ID NO: 2082831 - RNA, 15 nt, Human
ucagaaccucuuccc

SEQ ID NO: 2082832 - RNA, 16 nt, Human
ucagaaccucuucccc

SEQ ID NO: 2082833 - RNA, 17 nt, Human
ucagaaccucuucccca

SEQ ID NO: 2082834 - RNA, 18 nt, Human
ucagaaccucuuccccag

SEQ ID NO: 2082835 - RNA, 20 nt, Human
ucagaaccucuuccccagaa

SEQ ID NO: 2082836 - RNA, 13 nt, Human
acccagucccugg

SEQ ID NO: 2082837 - RNA, 15 nt, Human
acccagucccugggg

SEQ ID NO: 2082838 - RNA, 18 nt, Human
ucagcccugggccccacc

SEQ ID NO: 2082839 - RNA, 19 nt, Human
ucagcccugggccccacca

SEQ ID NO: 2082840 - RNA, 14 nt, Human
ucagcccugcccuu

SEQ ID NO: 2082841 - RNA, 23 nt, Human
ucagcccugcccuucagcauccu

SEQ ID NO: 2082842 - RNA, 12 nt, Human
ucagcccugggc

SEQ ID NO: 2082843 - RNA, 18 nt, Human
ucagcccucccugccccu

SEQ ID NO: 2082844 - RNA, 14 nt, Human
ucagccccuccucu

SEQ ID NO: 2082845 - RNA, 15 nt, Human
ucagccccuccucug

SEQ ID NO: 2082846 - RNA, 16 nt, Human
ucagccccuccucugc

SEQ ID NO: 2082847 - RNA, 17 nt, Human
ucagccccuccucugcc

SEQ ID NO: 2082848 - RNA, 12 nt, Human
ucagccccuccu

SEQ ID NO: 2082849 - RNA, 13 nt, Human
ucagccccuccuc

SEQ ID NO: 2082850 - RNA, 19 nt, Human
ucagcccucccugccccuc

SEQ ID NO: 2082851 - RNA, 19 nt, Human
ucagccccuccucugccac

SEQ ID NO: 2082852 - RNA, 13 nt, Human
ucagcccugaggu

SEQ ID NO: 2082853 - RNA, 18 nt, Human
ucagccccuccucugcca

SEQ ID NO: 2082854 - RNA, 23 nt, Human
ucagcccugaggugaaagggagc

SEQ ID NO: 2082855 - RNA, 17 nt, Human
ucagcccaccccccuca

SEQ ID NO: 2082856 - RNA, 18 nt, Human
ucagcccaccccccucau

SEQ ID NO: 2082857 - RNA, 12 nt, Human
ucagccccagcc

SEQ ID NO: 2082858 - RNA, 14 nt, Human
ucagccccagccca

SEQ ID NO: 2082859 - RNA, 15 nt, Human
ucagccccagcccag

SEQ ID NO: 2082860 - RNA, 16 nt, Human
ucagccccagcccagc

SEQ ID NO: 2082861 - RNA, 17 nt, Human
ucagccccagcccagcc

SEQ ID NO: 2082862 - RNA, 22 nt, Human
ucagccccagcccagcccagcu

SEQ ID NO: 2082863 - RNA, 15 nt, Human
acccccagccugcua

SEQ ID NO: 2082864 - RNA, 14 nt, Human
acccccagccugcu

SEQ ID NO: 2082865 - RNA, 13 nt, Human
accccauucuuug

SEQ ID NO: 2082866 - RNA, 23 nt, Human
accccauucuuugcuugaacaca

SEQ ID NO: 2082867 - RNA, 23 nt, Human
accccaugucaccggauccuggg

SEQ ID NO: 2082868 - RNA, 16 nt, Human
accccaugccaaagcu

SEQ ID NO: 2082869 - RNA, 14 nt, Human
acccagucccuggg

SEQ ID NO: 2082870 - RNA, 17 nt, Human
acccccaucucucccuc

SEQ ID NO: 2082871 - RNA, 18 nt, Human
acccccauuucuauuuau

SEQ ID NO: 2082872 - RNA, 17 nt, Human
acccccauuucuauuua

SEQ ID NO: 2082873 - RNA, 19 nt, Human
accccccagaaccuguccu

SEQ ID NO: 2082874 - RNA, 16 nt, Human
acccccucauuguuua

SEQ ID NO: 2082875 - RNA, 20 nt, Human
accccccagaaccuguccuu

SEQ ID NO: 2082876 - RNA, 18 nt, Human
accccccagaaccugucc

SEQ ID NO: 2082877 - RNA, 12 nt, Human
accccccaccug

SEQ ID NO: 2082878 - RNA, 13 nt, Human
accccccaccugc

SEQ ID NO: 2082879 - RNA, 15 nt, Human
accccuggcuuuuca

SEQ ID NO: 2082880 - RNA, 11 nt, Human
accccuggcug

SEQ ID NO: 2082881 - RNA, 13 nt, Human
accccuggcuggu

SEQ ID NO: 2082882 - RNA, 16 nt, Human
accccuuacuuagcau

SEQ ID NO: 2082883 - RNA, 14 nt, Human
accccuuagccucc

SEQ ID NO: 2082884 - RNA, 15 nt, Human
accccuuagccuccc

SEQ ID NO: 2082885 - RNA, 16 nt, Human
accccuuagccucccu

SEQ ID NO: 2082886 - RNA, 17 nt, Human
accccuuagccucccug

SEQ ID NO: 2082887 - RNA, 18 nt, Human
accccuuagccucccuga

SEQ ID NO: 2082888 - RNA, 14 nt, Human
accccuuccccacu

SEQ ID NO: 2082889 - RNA, 15 nt, Human
accccuuccccacug

SEQ ID NO: 2082890 - RNA, 16 nt, Human
accccuuccccacugc

SEQ ID NO: 2082891 - RNA, 18 nt, Human
accccuuccccacugccu

SEQ ID NO: 2082892 - RNA, 20 nt, Human
accccuuccccacugccugc

SEQ ID NO: 2082893 - RNA, 10 nt, Human
ucagccuggg

SEQ ID NO: 2082894 - RNA, 12 nt, Human
ucagccugggca

SEQ ID NO: 2082895 - RNA, 17 nt, Human
accccuccuuccuugac

SEQ ID NO: 2082896 - RNA, 20 nt, Human
accccuccuuccuugaccag

SEQ ID NO: 2082897 - RNA, 12 nt, Human
accccuccuucc

SEQ ID NO: 2082898 - RNA, 16 nt, Human
accccuccuuccuuga

SEQ ID NO: 2082899 - RNA, 12 nt, Human
accccuggcuuu

SEQ ID NO: 2082900 - RNA, 13 nt, Human
acccccuccccag

SEQ ID NO: 2082901 - RNA, 14 nt, Human
acccccuccccagg

SEQ ID NO: 2082902 - RNA, 12 nt, Human
acccccucccca

SEQ ID NO: 2082903 - RNA, 16 nt, Human
acccccuccccagggg

SEQ ID NO: 2082904 - RNA, 14 nt, Human
acccccucccuggc

SEQ ID NO: 2082905 - RNA, 15 nt, Human
acccccucccuggcc

SEQ ID NO: 2082906 - RNA, 16 nt, Human
acccccucccuggccu

SEQ ID NO: 2082907 - RNA, 23 nt, Human
acccaaaagucaaaaggugccug

SEQ ID NO: 2082908 - RNA, 14 nt, Human
acccaaaccuggag

SEQ ID NO: 2082909 - RNA, 15 nt, Human
acccaaaccuggaga

SEQ ID NO: 2082910 - RNA, 16 nt, Human
acccaaaccuggagau

SEQ ID NO: 2082911 - RNA, 23 nt, Human
acccaaccacaucccacucacaa

SEQ ID NO: 2082912 - RNA, 14 nt, Human
acccagcccaucuu

SEQ ID NO: 2082913 - RNA, 12 nt, Human
ucagaacacauu

SEQ ID NO: 2082914 - RNA, 15 nt, Human
ucagaacacauucuu

SEQ ID NO: 2082915 - RNA, 19 nt, Human
ucagaacaccaagacuuga

SEQ ID NO: 2082916 - RNA, 11 nt, Human
acccagcccau

SEQ ID NO: 2082917 - RNA, 18 nt, Human
acccagcccacuucugcc

SEQ ID NO: 2082918 - RNA, 21 nt, Human
acccagacagcucccucugcc

SEQ ID NO: 2082919 - RNA, 22 nt, Human
acccagacagcucccucugccu

SEQ ID NO: 2082920 - RNA, 15 nt, Human
acccagacagcuccc

SEQ ID NO: 2082921 - RNA, 17 nt, Human
acccagcccacuucugc

SEQ ID NO: 2082922 - RNA, 16 nt, Human
acccagcccacuucug

SEQ ID NO: 2082923 - RNA, 23 nt, Human
accauuuugggguacccacugcu

SEQ ID NO: 2082924 - RNA, 22 nt, Human
accauuuugggguacccacugc

SEQ ID NO: 2082925 - RNA, 11 nt, Human
accauuuauaa

SEQ ID NO: 2082926 - RNA, 12 nt, Human
accauuuauaau

SEQ ID NO: 2082927 - RNA, 12 nt, Human
accauuccccau

SEQ ID NO: 2082928 - RNA, 15 nt, Human
accauuccccauggg

SEQ ID NO: 2082929 - RNA, 23 nt, Human
accaugauuaaccacuucagcug

SEQ ID NO: 2082930 - RNA, 22 nt, Human
accaugauuaaccacuucagcu

SEQ ID NO: 2082931 - RNA, 23 nt, Human
accaugacaacccugugguuucc

SEQ ID NO: 2082932 - RNA, 21 nt, Human
accaguugcacuuggccucug

SEQ ID NO: 2082933 - RNA, 21 nt, Human
accaguguagccuugcccgga

SEQ ID NO: 2082934 - RNA, 17 nt, Human
accaguuaugugaauga

SEQ ID NO: 2082935 - RNA, 13 nt, Human
accaguguagccu

SEQ ID NO: 2082936 - RNA, 16 nt, Human
accaguguagccuugc

SEQ ID NO: 2082937 - RNA, 18 nt, Human
ucacuguugcccaggcug

SEQ ID NO: 2082938 - RNA, 17 nt, Human
ucacuguugcccaggcu

SEQ ID NO: 2082939 - RNA, 19 nt, Human
ucacuguugcccaggcugg

SEQ ID NO: 2082940 - RNA, 20 nt, Human
accagggagccccuuugaug

SEQ ID NO: 2082941 - RNA, 21 nt, Human
accagggaugaugcaacaucc

SEQ ID NO: 2082942 - RNA, 18 nt, Human
accagggcaccaagccca

SEQ ID NO: 2082943 - RNA, 22 nt, Human
accagggcgaacgacaauagcu

SEQ ID NO: 2082944 - RNA, 23 nt, Human
accagggcgaacgacaauagcuu

SEQ ID NO: 2082945 - RNA, 24 nt, Human
ucacugcacagugcaucucagccc

SEQ ID NO: 2082946 - RNA, 22 nt, Human
ucacugcacagugcaucucagc

SEQ ID NO: 2082947 - RNA, 20 nt, Human
ucacugcacagugcaucuca

SEQ ID NO: 2082948 - RNA, 19 nt, Human
ucacugacacaaaaaguag

SEQ ID NO: 2082949 - RNA, 12 nt, Human
ucacugcagccu

SEQ ID NO: 2082950 - RNA, 13 nt, Human
ucacugcagccuc

SEQ ID NO: 2082951 - RNA, 16 nt, Human
ucacuguugcccaggc

SEQ ID NO: 2082952 - RNA, 14 nt, Human
ucaccugggcaccu

SEQ ID NO: 2082953 - RNA, 17 nt, Human
ucaccugcuggccccuc

SEQ ID NO: 2082954 - RNA, 19 nt, Human
ucaccugcuggccccucac

SEQ ID NO: 2082955 - RNA, 20 nt, Human
ucaccugcuggccccucacc

SEQ ID NO: 2082956 - RNA, 21 nt, Human
ucaccugcuggccccucaccu

SEQ ID NO: 2082957 - RNA, 15 nt, Human
ucaccugaggucggg

SEQ ID NO: 2082958 - RNA, 17 nt, Human
ucaccugaggucgggag

SEQ ID NO: 2082959 - RNA, 11 nt, Human
ucaccugcugg

SEQ ID NO: 2082960 - RNA, 15 nt, Human
ucaccugcuggcccc

SEQ ID NO: 2082961 - RNA, 16 nt, Human
ucaccugcuggccccu

SEQ ID NO: 2082962 - RNA, 17 nt, Human
ucaccugggcaccuggg

SEQ ID NO: 2082963 - RNA, 23 nt, Human
ucacugaaugcuucugacuucau

SEQ ID NO: 2082964 - RNA, 11 nt, Human
accacaguguc

SEQ ID NO: 2082965 - RNA, 19 nt, Human
accacagcaggugucauau

SEQ ID NO: 2082966 - RNA, 12 nt, Human
accacagugucu

SEQ ID NO: 2082967 - RNA, 13 nt, Human
accacagugucug

SEQ ID NO: 2082968 - RNA, 14 nt, Human
accacauccuccgu

SEQ ID NO: 2082969 - RNA, 20 nt, Human
accacauccuccguccagcc

SEQ ID NO: 2082970 - RNA, 14 nt, Human
accacaucuugcuc

SEQ ID NO: 2082971 - RNA, 14 nt, Human
uauuucaggauucu

SEQ ID NO: 2082972 - RNA, 21 nt, Human
accacacuuccuguccagaga

SEQ ID NO: 2082973 - RNA, 22 nt, Human
accacacuuccuguccagagag

SEQ ID NO: 2082974 - RNA, 13 nt, Human
accacacuuccug

SEQ ID NO: 2082975 - RNA, 16 nt, Human
accacacuuccugucc

SEQ ID NO: 2082976 - RNA, 17 nt, Human
accacacuuccugucca

SEQ ID NO: 2082977 - RNA, 24 nt, Human
accacaucuugcucugcugacaga

SEQ ID NO: 2082978 - RNA, 21 nt, Human
accacaucuugcucugcugac

SEQ ID NO: 2082979 - RNA, 20 nt, Human
accacaucuugcucugcuga

SEQ ID NO: 2082980 - RNA, 16 nt, Human
accacaucuugcucug

SEQ ID NO: 2082981 - RNA, 21 nt, Human
accacauccuccguccagccg

SEQ ID NO: 2082982 - RNA, 22 nt, Human
accacauccuccguccagccgc

SEQ ID NO: 2082983 - RNA, 15 nt, Human
accacuucagcugac

SEQ ID NO: 2082984 - RNA, 18 nt, Human
accacuuaaaaaaugucc

SEQ ID NO: 2082985 - RNA, 13 nt, Human
accacuucagcug

SEQ ID NO: 2082986 - RNA, 14 nt, Human
accacuucagcuga

SEQ ID NO: 2082987 - RNA, 21 nt, Human
accacugaagauagaagaaaa

SEQ ID NO: 2082988 - RNA, 17 nt, Human
accagacaccuugacag

SEQ ID NO: 2082989 - RNA, 23 nt, Human
accagacaccuugacagggcaca

SEQ ID NO: 2082990 - RNA, 22 nt, Human
accagacaccuugacagggcac

SEQ ID NO: 2082991 - RNA, 22 nt, Human
accagagcccaccuuggcucaa

SEQ ID NO: 2082992 - RNA, 19 nt, Human
accagagcccaccuuggcu

SEQ ID NO: 2082993 - RNA, 13 nt, Human
accagagcacugu

SEQ ID NO: 2082994 - RNA, 14 nt, Human
accagagcacugua

SEQ ID NO: 2082995 - RNA, 15 nt, Human
accagagcacuguau

SEQ ID NO: 2082996 - RNA, 16 nt, Human
accagagcacuguaua

SEQ ID NO: 2082997 - RNA, 17 nt, Human
accagagcacuguauac

SEQ ID NO: 2082998 - RNA, 20 nt, Human
accagagcacuguauacccc

SEQ ID NO: 2082999 - RNA, 20 nt, Human
accagagauaauaugagaau

SEQ ID NO: 2083000 - RNA, 13 nt, Human
accagagccaugg

SEQ ID NO: 2083001 - RNA, 14 nt, Human
accagagccaugga

SEQ ID NO: 2083002 - RNA, 17 nt, Human
accagagccauggacuc

SEQ ID NO: 2083003 - RNA, 23 nt, Human
accagagccauggacucuacacu

SEQ ID NO: 2083004 - RNA, 20 nt, Human
accagccuggucaacauggu

SEQ ID NO: 2083005 - RNA, 14 nt, Human
accagccugggcag

SEQ ID NO: 2083006 - RNA, 16 nt, Human
accagccuuucuccca

SEQ ID NO: 2083007 - RNA, 17 nt, Human
accagccuuucucccag

SEQ ID NO: 2083008 - RNA, 20 nt, Human
accagccuggccaacauggu

SEQ ID NO: 2083009 - RNA, 15 nt, Human
accagccuggccaac

SEQ ID NO: 2083010 - RNA, 20 nt, Human
accagccugaccaacauggu

SEQ ID NO: 2083011 - RNA, 13 nt, Human
accagccugggca

SEQ ID NO: 2083012 - RNA, 12 nt, Human
accagccuggcc

SEQ ID NO: 2083013 - RNA, 11 nt, Human
accagccuggc

SEQ ID NO: 2083014 - RNA, 20 nt, Human
accagagccccacacggagg

SEQ ID NO: 2083015 - RNA, 14 nt, Human
accagagccccaca

SEQ ID NO: 2083016 - RNA, 17 nt, Human
accagagccccacacgg

SEQ ID NO: 2083017 - RNA, 14 nt, Human
accagagcucugga

SEQ ID NO: 2083018 - RNA, 15 nt, Human
accagagcucuggag

SEQ ID NO: 2083019 - RNA, 17 nt, Human
accagagcucuggagcc

SEQ ID NO: 2083020 - RNA, 18 nt, Human
accagagcucuggagcca

SEQ ID NO: 2083021 - RNA, 23 nt, Human
accagagcucuggagccaccugu

SEQ ID NO: 2083022 - RNA, 19 nt, Human
accagccuuucucccaggc

SEQ ID NO: 2083023 - RNA, 22 nt, Human
accagccuuucucccaggccag

SEQ ID NO: 2083024 - RNA, 17 nt, Human
accaggacucccuccuc

SEQ ID NO: 2083025 - RNA, 18 nt, Human
accaggacucccuccuca

SEQ ID NO: 2083026 - RNA, 21 nt, Human
accaggacucccuccucaccu

SEQ ID NO: 2083027 - RNA, 14 nt, Human
accaggagaaccac

SEQ ID NO: 2083028 - RNA, 18 nt, Human
accaggagaaccacuaca

SEQ ID NO: 2083029 - RNA, 19 nt, Human
accaggagaaccacuacau

SEQ ID NO: 2083030 - RNA, 20 nt, Human
accaggagaaccacuacaug

SEQ ID NO: 2083031 - RNA, 11 nt, Human
accaggagaca

SEQ ID NO: 2083032 - RNA, 12 nt, Human
accaggagacag

SEQ ID NO: 2083033 - RNA, 17 nt, Human
accaggagucccuggua

SEQ ID NO: 2083034 - RNA, 22 nt, Human
accaggagucccugguaauaag

SEQ ID NO: 2083035 - RNA, 20 nt, Human
accaggcacgaacccaccug

SEQ ID NO: 2083036 - RNA, 21 nt, Human
accaggcacgaacccaccugc

SEQ ID NO: 2083037 - RNA, 22 nt, Human
accaggcacgaacccaccugcu

SEQ ID NO: 2083038 - RNA, 23 nt, Human
accaggcacgaacccaccugcug

SEQ ID NO: 2083039 - RNA, 19 nt, Human
accaggcaacuugggaacu

SEQ ID NO: 2083040 - RNA, 23 nt, Human
ucaccugaagacucauucuucug

SEQ ID NO: 2083041 - RNA, 21 nt, Human
ucaccugagcccggaugcuuc

SEQ ID NO: 2083042 - RNA, 22 nt, Human
ucaccugagcccggaugcuucu

SEQ ID NO: 2083043 - RNA, 23 nt, Human
ucaccugagcccggaugcuucuc

SEQ ID NO: 2083044 - RNA, 19 nt, Human
ucaccugaagacucauucu

SEQ ID NO: 2083045 - RNA, 19 nt, Human
accaggccgccccagccuc

SEQ ID NO: 2083046 - RNA, 16 nt, Human
accaggccgccccagc

SEQ ID NO: 2083047 - RNA, 13 nt, Human
ucaccuccccucc

SEQ ID NO: 2083048 - RNA, 14 nt, Human
ucaccuccccuccu

SEQ ID NO: 2083049 - RNA, 15 nt, Human
ucaccuccccuccuu

SEQ ID NO: 2083050 - RNA, 17 nt, Human
ucaccuccccuccuugc

SEQ ID NO: 2083051 - RNA, 20 nt, Human
ugacuuauuuauauaaauuu

SEQ ID NO: 2083052 - RNA, 17 nt, Human
ugacuuauuuauauaaa

SEQ ID NO: 2083053 - RNA, 21 nt, Human
ugacuuauuuauauaaauuuu

SEQ ID NO: 2083054 - RNA, 17 nt, Human
ugacuguggccaugguc

SEQ ID NO: 2083055 - RNA, 19 nt, Human
ugacuguaucuguguagac

SEQ ID NO: 2083056 - RNA, 13 nt, Human
ugacucauccucu

SEQ ID NO: 2083057 - RNA, 16 nt, Human
ugacuguaucugugua

SEQ ID NO: 2083058 - RNA, 17 nt, Human
ugacuguaucuguguag

SEQ ID NO: 2083059 - RNA, 18 nt, Human
ugacuguaucuguguaga

SEQ ID NO: 2083060 - RNA, 14 nt, Human
ugaccugaggaagc

SEQ ID NO: 2083061 - RNA, 15 nt, Human
ugaccugaggaagcg

SEQ ID NO: 2083062 - RNA, 18 nt, Human
ugacucacuuaucccaag

SEQ ID NO: 2083063 - RNA, 16 nt, Human
ugacucagaugucucu

SEQ ID NO: 2083064 - RNA, 20 nt, Human
ugacuucgacugugaccugu

SEQ ID NO: 2083065 - RNA, 22 nt, Human
ugacuuccccgcauuccaggcu

SEQ ID NO: 2083066 - RNA, 23 nt, Human
ugacuuccccgcauuccaggcuc

SEQ ID NO: 2083067 - RNA, 14 nt, Human
ugacuuccacaccu

SEQ ID NO: 2083068 - RNA, 17 nt, Human
ugacuugacagaacacu

SEQ ID NO: 2083069 - RNA, 19 nt, Human
ugacuugacagaacacugu

SEQ ID NO: 2083070 - RNA, 11 nt, Human
agauucaauuu

SEQ ID NO: 2083071 - RNA, 17 nt, Human
agauucaauuuucuuua

SEQ ID NO: 2083072 - RNA, 12 nt, Human
ugacuuucaggu

SEQ ID NO: 2083073 - RNA, 16 nt, Human
agauuauauugagaca

SEQ ID NO: 2083074 - RNA, 21 nt, Human
agauuauauugagacaaaaau

SEQ ID NO: 2083075 - RNA, 21 nt, Human
agcaaaaccaaauauuccaga

SEQ ID NO: 2083076 - RNA, 23 nt, Human
agauuuuccacaagauucccaga

SEQ ID NO: 2083077 - RNA, 20 nt, Human
agcaacagagugagacccug

SEQ ID NO: 2083078 - RNA, 22 nt, Human
agcaacagagugagacccuguc

SEQ ID NO: 2083079 - RNA, 23 nt, Human
agcaacagagugagacccugucu

SEQ ID NO: 2083080 - RNA, 13 nt, Human
agcaacacaaugu

SEQ ID NO: 2083081 - RNA, 21 nt, Human
agcaacacaauguuauucguu

SEQ ID NO: 2083082 - RNA, 15 nt, Human
agcaacaugcuucau

SEQ ID NO: 2083083 - RNA, 20 nt, Human
agcaacaugcuucaugaaaa

SEQ ID NO: 2083084 - RNA, 21 nt, Human
agcaacaucuagcaaauguua

SEQ ID NO: 2083085 - RNA, 16 nt, Human
agcaaccagagcacug

SEQ ID NO: 2083086 - RNA, 17 nt, Human
agcaaccagagcacugu

SEQ ID NO: 2083087 - RNA, 18 nt, Human
agcaaccagagcacugua

SEQ ID NO: 2083088 - RNA, 14 nt, Human
agauucaccuguaa

SEQ ID NO: 2083089 - RNA, 15 nt, Human
agauucaccuguaaa

SEQ ID NO: 2083090 - RNA, 16 nt, Human
agauucaccuguaaaa

SEQ ID NO: 2083091 - RNA, 17 nt, Human
agauucaccuguaaaac

SEQ ID NO: 2083092 - RNA, 19 nt, Human
agauucaccuguaaaacuu

SEQ ID NO: 2083093 - RNA, 20 nt, Human
agauucaccuguaaaacuuu

SEQ ID NO: 2083094 - RNA, 21 nt, Human
agauucaccuguaaaacuuua

SEQ ID NO: 2083095 - RNA, 21 nt, Human
agauuuacccagaaugucaga

SEQ ID NO: 2083096 - RNA, 18 nt, Human
agauuuagugaaagcuag

SEQ ID NO: 2083097 - RNA, 20 nt, Human
agauuugaagacaaaaauac

SEQ ID NO: 2083098 - RNA, 16 nt, Human
agauuuggagcacucu

SEQ ID NO: 2083099 - RNA, 14 nt, Human
agauuugcccauuu

SEQ ID NO: 2083100 - RNA, 16 nt, Human
agauuugcccauuuac

SEQ ID NO: 2083101 - RNA, 17 nt, Human
agauuugcccauuuaca

SEQ ID NO: 2083102 - RNA, 20 nt, Human
agauuugcccauuuacacuu

SEQ ID NO: 2083103 - RNA, 22 nt, Human
agauuugcccauuuacacuuuu

SEQ ID NO: 2083104 - RNA, 20 nt, Human
agauuuggugaauuugaauc

SEQ ID NO: 2083105 - RNA, 21 nt, Human
agauuuggugaauuugaaucu

SEQ ID NO: 2083106 - RNA, 21 nt, Human
agauuuguacuacaguucuuu

SEQ ID NO: 2083107 - RNA, 13 nt, Human
agauuuaauuugc

SEQ ID NO: 2083108 - RNA, 16 nt, Human
agauuuaauuugccaa

SEQ ID NO: 2083109 - RNA, 17 nt, Human
agauuuaauuugccaaa

SEQ ID NO: 2083110 - RNA, 21 nt, Human
agauuuaauuugccaaaauaa

SEQ ID NO: 2083111 - RNA, 15 nt, Human
agauuuauuuuguua

SEQ ID NO: 2083112 - RNA, 17 nt, Human
ugaccaacaguuccuuc

SEQ ID NO: 2083113 - RNA, 16 nt, Human
ugaccaacauggagaa

SEQ ID NO: 2083114 - RNA, 17 nt, Human
ugaccaacauggagaaa

SEQ ID NO: 2083115 - RNA, 18 nt, Human
ugaccaacauggagaaac

SEQ ID NO: 2083116 - RNA, 20 nt, Human
ugaccaacauggagaaaccc

SEQ ID NO: 2083117 - RNA, 15 nt, Human
ugaccacacuuccug

SEQ ID NO: 2083118 - RNA, 18 nt, Human
ugaccacacuuccugucc

SEQ ID NO: 2083119 - RNA, 20 nt, Human
ugaccacacuuccuguccag

SEQ ID NO: 2083120 - RNA, 23 nt, Human
ugaccacacuuccuguccagaga

SEQ ID NO: 2083121 - RNA, 14 nt, Human
agauccacacacag

SEQ ID NO: 2083122 - RNA, 15 nt, Human
agauccacacacaga

SEQ ID NO: 2083123 - RNA, 16 nt, Human
agauccacacacagag

SEQ ID NO: 2083124 - RNA, 17 nt, Human
agauccacacacagagg

SEQ ID NO: 2083125 - RNA, 18 nt, Human
agauccacacacagagga

SEQ ID NO: 2083126 - RNA, 14 nt, Human
agaucgucaggacc

SEQ ID NO: 2083127 - RNA, 21 nt, Human
agaucgugccguuacucucca

SEQ ID NO: 2083128 - RNA, 22 nt, Human
agaucgugccguuacucuccaa

SEQ ID NO: 2083129 - RNA, 21 nt, Human
agauccugucuuuaaggaaaa

SEQ ID NO: 2083130 - RNA, 20 nt, Human
agauccuuuaaauccuucca

SEQ ID NO: 2083131 - RNA, 14 nt, Human
agaucgcaguuugc

SEQ ID NO: 2083132 - RNA, 15 nt, Human
agaucgcaguuugcc

SEQ ID NO: 2083133 - RNA, 14 nt, Human
agaucggggccaga

SEQ ID NO: 2083134 - RNA, 15 nt, Human
agaucggggccagag

SEQ ID NO: 2083135 - RNA, 17 nt, Human
agaucggggccagaggc

SEQ ID NO: 2083136 - RNA, 18 nt, Human
agaucggggccagaggca

SEQ ID NO: 2083137 - RNA, 19 nt, Human
agaucggggccagaggcag

SEQ ID NO: 2083138 - RNA, 18 nt, Human
ugacauuguagagcuucu

SEQ ID NO: 2083139 - RNA, 20 nt, Human
ugacagugccugggaaugua

SEQ ID NO: 2083140 - RNA, 17 nt, Human
ugacagugccugggaau

SEQ ID NO: 2083141 - RNA, 12 nt, Human
ugacagugaggu

SEQ ID NO: 2083142 - RNA, 19 nt, Human
ugacagugagguccugggg

SEQ ID NO: 2083143 - RNA, 20 nt, Human
ugacagugagguccuggggg

SEQ ID NO: 2083144 - RNA, 14 nt, Human
ugacagugccuggg

SEQ ID NO: 2083145 - RNA, 14 nt, Human
agaucacuuugcuc

SEQ ID NO: 2083146 - RNA, 15 nt, Human
agaucacuuugcucu

SEQ ID NO: 2083147 - RNA, 13 nt, Human
ugaauuuaacaau

SEQ ID NO: 2083148 - RNA, 14 nt, Human
ugaauuuaacaaug

SEQ ID NO: 2083149 - RNA, 16 nt, Human
ugaauuuaacaaugcg

SEQ ID NO: 2083150 - RNA, 18 nt, Human
ugaauuuaacaaugcgaa

SEQ ID NO: 2083151 - RNA, 23 nt, Human
ugaauuuaacaaugcgaauggua

SEQ ID NO: 2083152 - RNA, 17 nt, Human
ugacaguaacuugguua

SEQ ID NO: 2083153 - RNA, 21 nt, Human
ugacaguaacuugguuauaca

SEQ ID NO: 2083154 - RNA, 22 nt, Human
ugacaguaacuugguuauacau

SEQ ID NO: 2083155 - RNA, 14 nt, Human
ugaccccccucagg

SEQ ID NO: 2083156 - RNA, 15 nt, Human
ugaccccccucagga

SEQ ID NO: 2083157 - RNA, 22 nt, Human
ugacccccaaccaaguggcucc

SEQ ID NO: 2083158 - RNA, 13 nt, Human
ugaccucugccug

SEQ ID NO: 2083159 - RNA, 14 nt, Human
ugaccucugccuga

SEQ ID NO: 2083160 - RNA, 17 nt, Human
agaugugucuucaauuu

SEQ ID NO: 2083161 - RNA, 16 nt, Human
ugacccagucccuggg

SEQ ID NO: 2083162 - RNA, 20 nt, Human
ugacccagucccugggggaa

SEQ ID NO: 2083163 - RNA, 12 nt, Human
ugacccaguccc

SEQ ID NO: 2083164 - RNA, 14 nt, Human
ugacccagucccug

SEQ ID NO: 2083165 - RNA, 15 nt, Human
ugacccagucccugg

SEQ ID NO: 2083166 - RNA, 12 nt, Human
ugacccaggcug

SEQ ID NO: 2083167 - RNA, 16 nt, Human
ugacccaggcugccug

SEQ ID NO: 2083168 - RNA, 19 nt, Human
ugacccaggcugccugagc

SEQ ID NO: 2083169 - RNA, 22 nt, Human
agaugucccuuucuuggccagu

SEQ ID NO: 2083170 - RNA, 20 nt, Human
agaugucccuuucuuggcca

SEQ ID NO: 2083171 - RNA, 21 nt, Human
agaugucccuuucuuggccag

SEQ ID NO: 2083172 - RNA, 16 nt, Human
agaugucaucccauug

SEQ ID NO: 2083173 - RNA, 18 nt, Human
agaugucagacuggcugg

SEQ ID NO: 2083174 - RNA, 22 nt, Human
agaugucucuggcgugugggua

SEQ ID NO: 2083175 - RNA, 18 nt, Human
agaugucuaauaguuauu

SEQ ID NO: 2083176 - RNA, 11 nt, Human
agauggauucu

SEQ ID NO: 2083177 - RNA, 15 nt, Human
agauggauucucaga

SEQ ID NO: 2083178 - RNA, 16 nt, Human
agauggauucucagau

SEQ ID NO: 2083179 - RNA, 17 nt, Human
agauggauucucagaua

SEQ ID NO: 2083180 - RNA, 15 nt, Human
agaugucagacuggc

SEQ ID NO: 2083181 - RNA, 16 nt, Human
agauggcaaaugacca

SEQ ID NO: 2083182 - RNA, 18 nt, Human
agauggauugguguaaaa

SEQ ID NO: 2083183 - RNA, 15 nt, Human
agauggauuugccug

SEQ ID NO: 2083184 - RNA, 20 nt, Human
agauggauuugccugugcca

SEQ ID NO: 2083185 - RNA, 18 nt, Human
agauggauucucagauau

SEQ ID NO: 2083186 - RNA, 20 nt, Human
agauggauucucagauauuu

SEQ ID NO: 2083187 - RNA, 18 nt, Human
agaugcuucucacugcca

SEQ ID NO: 2083188 - RNA, 16 nt, Human
agaugcuucucacugc

SEQ ID NO: 2083189 - RNA, 12 nt, Human
agaugcuucugg

SEQ ID NO: 2083190 - RNA, 15 nt, Human
agaugcuucugggag

SEQ ID NO: 2083191 - RNA, 16 nt, Human
agaugcuucugggaga

SEQ ID NO: 2083192 - RNA, 20 nt, Human
agaugcaaagaggcaagagg

SEQ ID NO: 2083193 - RNA, 18 nt, Human
agaugcaaagaggcaaga

SEQ ID NO: 2083194 - RNA, 20 nt, Human
agaugcucagguacagagaa

SEQ ID NO: 2083195 - RNA, 21 nt, Human
agaugcucagguacagagaag

SEQ ID NO: 2083196 - RNA, 14 nt, Human
agaugcaaagaggc

SEQ ID NO: 2083197 - RNA, 15 nt, Human
agaugcaaagaggca

SEQ ID NO: 2083198 - RNA, 16 nt, Human
agaugcaaagaggcaa

SEQ ID NO: 2083199 - RNA, 17 nt, Human
agaugcaaagaggcaag

SEQ ID NO: 2083200 - RNA, 17 nt, Human
ugaagccgccaggaccg

SEQ ID NO: 2083201 - RNA, 16 nt, Human
ugaagcuuauuaaugc

SEQ ID NO: 2083202 - RNA, 14 nt, Human
ugaagcugcaguga

SEQ ID NO: 2083203 - RNA, 17 nt, Human
ugaagcuuauuaaugcu

SEQ ID NO: 2083204 - RNA, 18 nt, Human
ugaagcuuauuaaugcua

SEQ ID NO: 2083205 - RNA, 19 nt, Human
ugaagcuuauuaaugcuaa

SEQ ID NO: 2083206 - RNA, 20 nt, Human
ugaagcuuauuaaugcuaag

SEQ ID NO: 2083207 - RNA, 23 nt, Human
ugaagcuuauuaaugcuaagggc

SEQ ID NO: 2083208 - RNA, 22 nt, Human
ugaagcuuauuaaugcuaaggg

SEQ ID NO: 2083209 - RNA, 19 nt, Human
ugaagccacugaagcuggg

SEQ ID NO: 2083210 - RNA, 15 nt, Human
ugaagcauccaggca

SEQ ID NO: 2083211 - RNA, 16 nt, Human
ugaagcccaagugaaa

SEQ ID NO: 2083212 - RNA, 19 nt, Human
ugaagcccaauaaaccucu

SEQ ID NO: 2083213 - RNA, 15 nt, Human
ugaagcccaauaaac

SEQ ID NO: 2083214 - RNA, 20 nt, Human
ugaagccacugaagcuggga

SEQ ID NO: 2083215 - RNA, 20 nt, Human
ugaagaugucaucccauugu

SEQ ID NO: 2083216 - RNA, 16 nt, Human
ugaagaugucuaauag

SEQ ID NO: 2083217 - RNA, 13 nt, Human
ugaagauguuugc

SEQ ID NO: 2083218 - RNA, 15 nt, Human
ugaagauguuugcaa

SEQ ID NO: 2083219 - RNA, 17 nt, Human
ugaagauguuugcaaua

SEQ ID NO: 2083220 - RNA, 19 nt, Human
ugaagauuauuuuuuauga

SEQ ID NO: 2083221 - RNA, 19 nt, Human
ugaagcagaugcaaagagg

SEQ ID NO: 2083222 - RNA, 22 nt, Human
ugaagcagaugcaaagaggcaa

SEQ ID NO: 2083223 - RNA, 23 nt, Human
ugaagcagaugcaaagaggcaag

SEQ ID NO: 2083224 - RNA, 14 nt, Human
agaggugagggaag

SEQ ID NO: 2083225 - RNA, 19 nt, Human
agaggucuuuuuuaaaagg

SEQ ID NO: 2083226 - RNA, 21 nt, Human
agagggacagcccacugagaa

SEQ ID NO: 2083227 - RNA, 17 nt, Human
agagggaagagugcauu

SEQ ID NO: 2083228 - RNA, 24 nt, Human
agaggcaccacuaaaagaucgcag

SEQ ID NO: 2083229 - RNA, 15 nt, Human
agaggcagaacccug

SEQ ID NO: 2083230 - RNA, 16 nt, Human
agaggcagaacccugg

SEQ ID NO: 2083231 - RNA, 19 nt, Human
agaggcagaacccugguga

SEQ ID NO: 2083232 - RNA, 13 nt, Human
agagggaaaaugu

SEQ ID NO: 2083233 - RNA, 20 nt, Human
agagggaaacgugcccucug

SEQ ID NO: 2083234 - RNA, 14 nt, Human
agagggaagaaaag

SEQ ID NO: 2083235 - RNA, 15 nt, Human
agagggaagaaaaga

SEQ ID NO: 2083236 - RNA, 23 nt, Human
agagggaagaaaagagcuuucuu

SEQ ID NO: 2083237 - RNA, 15 nt, Human
agagcuucuggcacu

SEQ ID NO: 2083238 - RNA, 16 nt, Human
agagcuggugcccgga

SEQ ID NO: 2083239 - RNA, 15 nt, Human
agagcuggugcccgg

SEQ ID NO: 2083240 - RNA, 19 nt, Human
agagcugggugucaagagg

SEQ ID NO: 2083241 - RNA, 13 nt, Human
agagcuggugccc

SEQ ID NO: 2083242 - RNA, 21 nt, Human
agagcugguaguuaguagcau

SEQ ID NO: 2083243 - RNA, 23 nt, Human
agagcugguaguuaguagcaugu

SEQ ID NO: 2083244 - RNA, 13 nt, Human
agagcugggaggg

SEQ ID NO: 2083245 - RNA, 11 nt, Human
agagcugggug

SEQ ID NO: 2083246 - RNA, 12 nt, Human
agagcuggguga

SEQ ID NO: 2083247 - RNA, 16 nt, Human
agagcugggugagugg

SEQ ID NO: 2083248 - RNA, 16 nt, Human
ugaagacaaaaauacu

SEQ ID NO: 2083249 - RNA, 17 nt, Human
ugaagacaaaaauacuc

SEQ ID NO: 2083250 - RNA, 18 nt, Human
ugaagacaaaaauacucu

SEQ ID NO: 2083251 - RNA, 20 nt, Human
ugaagacaaaaauacucuaa

SEQ ID NO: 2083252 - RNA, 21 nt, Human
ugaagacaaaaauacucuaau

SEQ ID NO: 2083253 - RNA, 22 nt, Human
ugaagacaaaaauacucuaauu

SEQ ID NO: 2083254 - RNA, 18 nt, Human
agaggcaacugcauuggc

SEQ ID NO: 2083255 - RNA, 17 nt, Human
agagaauggaaaacaga

SEQ ID NO: 2083256 - RNA, 18 nt, Human
ucuuugguccucuugcca

SEQ ID NO: 2083257 - RNA, 21 nt, Human
ucuuuguaaguaaacugcccu

SEQ ID NO: 2083258 - RNA, 22 nt, Human
ucuuuguaaguaaacugcccug

SEQ ID NO: 2083259 - RNA, 23 nt, Human
ucuuuguaaucguuaugugugua

SEQ ID NO: 2083260 - RNA, 11 nt, Human
ugaagaagaga

SEQ ID NO: 2083261 - RNA, 18 nt, Human
agauaauucuagcuuuga

SEQ ID NO: 2083262 - RNA, 15 nt, Human
agauaaucucucagc

SEQ ID NO: 2083263 - RNA, 18 nt, Human
agagucucacuccccucc

SEQ ID NO: 2083264 - RNA, 19 nt, Human
agauaaucuuagcugccaa

SEQ ID NO: 2083265 - RNA, 13 nt, Human
agauaaucccugu

SEQ ID NO: 2083266 - RNA, 15 nt, Human
agauaaucagccucu

SEQ ID NO: 2083267 - RNA, 16 nt, Human
agauaaucagccucuu

SEQ ID NO: 2083268 - RNA, 17 nt, Human
agauaaucagccucuua

SEQ ID NO: 2083269 - RNA, 12 nt, Human
agauaaaaagau

SEQ ID NO: 2083270 - RNA, 14 nt, Human
agauaaaaagaugg

SEQ ID NO: 2083271 - RNA, 21 nt, Human
agauaaaaagauggccuuugc

SEQ ID NO: 2083272 - RNA, 21 nt, Human
agagugagagggcaugcgcac

SEQ ID NO: 2083273 - RNA, 19 nt, Human
agagugagacucugucuca

SEQ ID NO: 2083274 - RNA, 15 nt, Human
agagugagacccugu

SEQ ID NO: 2083275 - RNA, 14 nt, Human
agagugagagggca

SEQ ID NO: 2083276 - RNA, 19 nt, Human
agauaaacucagaaauuua

SEQ ID NO: 2083277 - RNA, 13 nt, Human
agauaaacucaga

SEQ ID NO: 2083278 - RNA, 14 nt, Human
agauaaagauuucu

SEQ ID NO: 2083279 - RNA, 17 nt, Human
agauaaagauuucuuga

SEQ ID NO: 2083280 - RNA, 18 nt, Human
agauacauuuguauguug

SEQ ID NO: 2083281 - RNA, 23 nt, Human
agauacauuuguauguugugaag

SEQ ID NO: 2083282 - RNA, 21 nt, Human
agauacaugguugugaccuga

SEQ ID NO: 2083283 - RNA, 17 nt, Human
agauacaucacagucac

SEQ ID NO: 2083284 - RNA, 19 nt, Human
agauacaggaaaagcugcu

SEQ ID NO: 2083285 - RNA, 18 nt, Human
agauaccagguugaaaga

SEQ ID NO: 2083286 - RNA, 19 nt, Human
agauaccagguugaaagac

SEQ ID NO: 2083287 - RNA, 14 nt, Human
agauaccaucagca

SEQ ID NO: 2083288 - RNA, 15 nt, Human
agauaccaucagcaa

SEQ ID NO: 2083289 - RNA, 20 nt, Human
agauaccaucagcaaagaau

SEQ ID NO: 2083290 - RNA, 22 nt, Human
agauaccaucagcaaagaauuu

SEQ ID NO: 2083291 - RNA, 14 nt, Human
agauacgacuuuau

SEQ ID NO: 2083292 - RNA, 19 nt, Human
agaucaaccccuucgcucc

SEQ ID NO: 2083293 - RNA, 14 nt, Human
agaucaaccccuuc

SEQ ID NO: 2083294 - RNA, 16 nt, Human
agauacgacuuuauuu

SEQ ID NO: 2083295 - RNA, 18 nt, Human
agauauuuuuucagaaau

SEQ ID NO: 2083296 - RNA, 18 nt, Human
agaucacguuccuucccc

SEQ ID NO: 2083297 - RNA, 15 nt, Human
agaucaagagaucaa

SEQ ID NO: 2083298 - RNA, 19 nt, Human
agauauuuuuucagaaaua

SEQ ID NO: 2083299 - RNA, 21 nt, Human
agauauuuuuucagaaauaug

SEQ ID NO: 2083300 - RNA, 22 nt, Human
agauauuuuuucagaaauaugu

SEQ ID NO: 2083301 - RNA, 22 nt, Human
agauaaugugaacuagcuggaa

SEQ ID NO: 2083302 - RNA, 21 nt, Human
agaucaaccccuucgcuccug

SEQ ID NO: 2083303 - RNA, 22 nt, Human
agagucucacuguugcccaggc

SEQ ID NO: 2083304 - RNA, 20 nt, Human
agagucucacuguugcccag

SEQ ID NO: 2083305 - RNA, 16 nt, Human
agagugagacucuguc

SEQ ID NO: 2083306 - RNA, 15 nt, Human
agagugagacucugu

SEQ ID NO: 2083307 - RNA, 22 nt, Human
agagucggaacggagaaaggug

SEQ ID NO: 2083308 - RNA, 20 nt, Human
ugaaugccacgcgguacaaa

SEQ ID NO: 2083309 - RNA, 23 nt, Human
ugaaugcccacaggcaaaugcau

SEQ ID NO: 2083310 - RNA, 12 nt, Human
ugaauggccugc

SEQ ID NO: 2083311 - RNA, 15 nt, Human
ugaauggccugccuu

SEQ ID NO: 2083312 - RNA, 17 nt, Human
ugaauggccugccuuga

SEQ ID NO: 2083313 - RNA, 21 nt, Human
ugaauggccugccuugaagcc

SEQ ID NO: 2083314 - RNA, 16 nt, Human
ugaaugcauaaaaugu

SEQ ID NO: 2083315 - RNA, 15 nt, Human
ugaaugcauaaaaug

SEQ ID NO: 2083316 - RNA, 18 nt, Human
ugaauauauuauaaucuu

SEQ ID NO: 2083317 - RNA, 14 nt, Human
ugaaggugucagaa

SEQ ID NO: 2083318 - RNA, 15 nt, Human
ugaaggugucagaau

SEQ ID NO: 2083319 - RNA, 19 nt, Human
ugaaggucuugauuuguuu

SEQ ID NO: 2083320 - RNA, 13 nt, Human
ugaagguuucuga

SEQ ID NO: 2083321 - RNA, 16 nt, Human
ugaagguuucugaaaa

SEQ ID NO: 2083322 - RNA, 15 nt, Human
ugaauauaaacacua

SEQ ID NO: 2083323 - RNA, 14 nt, Human
ugaauauaaacacu

SEQ ID NO: 2083324 - RNA, 16 nt, Human
ugaauauaaacacuau

SEQ ID NO: 2083325 - RNA, 22 nt, Human
ugaauauaccccuuaguguuug

SEQ ID NO: 2083326 - RNA, 22 nt, Human
ugagggucagagaggagucaga

SEQ ID NO: 2083327 - RNA, 14 nt, Human
ugaggggcuccugg

SEQ ID NO: 2083328 - RNA, 15 nt, Human
ugaggggcuccugga

SEQ ID NO: 2083329 - RNA, 20 nt, Human
ugaggggucuccaggaggag

SEQ ID NO: 2083330 - RNA, 20 nt, Human
ugagggguauaucugggcug

SEQ ID NO: 2083331 - RNA, 17 nt, Human
ugaggggcaacgaagaa

SEQ ID NO: 2083332 - RNA, 18 nt, Human
ugagggccaagaaagagu

SEQ ID NO: 2083333 - RNA, 17 nt, Human
ugagggcgaggggaggg

SEQ ID NO: 2083334 - RNA, 21 nt, Human
ugaggggaggaucacuggagc

SEQ ID NO: 2083335 - RNA, 22 nt, Human
ugaggggaggaucacuggagcc

SEQ ID NO: 2083336 - RNA, 16 nt, Human
ugaggggcccgagcag

SEQ ID NO: 2083337 - RNA, 22 nt, Human
ugaggggcaucugccccucccc

SEQ ID NO: 2083338 - RNA, 21 nt, Human
ugaggggaggaaacucaccug

SEQ ID NO: 2083339 - RNA, 17 nt, Human
ugaggggcaucugcccc

SEQ ID NO: 2083340 - RNA, 15 nt, Human
ugaggccucagugga

SEQ ID NO: 2083341 - RNA, 19 nt, Human
ugaggccucaguggacuuu

SEQ ID NO: 2083342 - RNA, 17 nt, Human
ugagggaucacagggcc

SEQ ID NO: 2083343 - RNA, 18 nt, Human
ugagggaucacagggccc

SEQ ID NO: 2083344 - RNA, 14 nt, Human
ugagggauaagcaa

SEQ ID NO: 2083345 - RNA, 16 nt, Human
ugagggauaagcaaaa

SEQ ID NO: 2083346 - RNA, 17 nt, Human
ugagggauaagcaaaag

SEQ ID NO: 2083347 - RNA, 17 nt, Human
agcagaggaaggagagg

SEQ ID NO: 2083348 - RNA, 13 nt, Human
agcagaggcagcg

SEQ ID NO: 2083349 - RNA, 17 nt, Human
agcagaggcuggccuca

SEQ ID NO: 2083350 - RNA, 19 nt, Human
agcagaggcuggccucaga

SEQ ID NO: 2083351 - RNA, 18 nt, Human
agcagagggacuuuguau

SEQ ID NO: 2083352 - RNA, 16 nt, Human
agcagaucccagcuca

SEQ ID NO: 2083353 - RNA, 17 nt, Human
agcagaugaccccuccc

SEQ ID NO: 2083354 - RNA, 13 nt, Human
agcagaugcaaag

SEQ ID NO: 2083355 - RNA, 14 nt, Human
agcagaugcaaaga

SEQ ID NO: 2083356 - RNA, 17 nt, Human
agcagaugcaaagaggc

SEQ ID NO: 2083357 - RNA, 18 nt, Human
agcagaugcaaagaggca

SEQ ID NO: 2083358 - RNA, 19 nt, Human
agcagaugcaaagaggcaa

SEQ ID NO: 2083359 - RNA, 20 nt, Human
agcagaugcaaagaggcaag

SEQ ID NO: 2083360 - RNA, 21 nt, Human
agcagaugcaaagaggcaaga

SEQ ID NO: 2083361 - RNA, 22 nt, Human
agcagauuuuaauuuugaauaa

SEQ ID NO: 2083362 - RNA, 21 nt, Human
agcagauuuuaauuuugaaua

SEQ ID NO: 2083363 - RNA, 13 nt, Human
agcagauuuuaau

SEQ ID NO: 2083364 - RNA, 18 nt, Human
agcagauuuaacaauucc

SEQ ID NO: 2083365 - RNA, 20 nt, Human
agcagauuggagaaacccuu

SEQ ID NO: 2083366 - RNA, 20 nt, Human
ugaggguugggcugguguca

SEQ ID NO: 2083367 - RNA, 12 nt, Human
ugagggucuucu

SEQ ID NO: 2083368 - RNA, 19 nt, Human
ugagggucuucuuacaugc

SEQ ID NO: 2083369 - RNA, 21 nt, Human
ugagggugcuuguucccucuc

SEQ ID NO: 2083370 - RNA, 13 nt, Human
ugaggucagagcc

SEQ ID NO: 2083371 - RNA, 16 nt, Human
ugaggucagagccugc

SEQ ID NO: 2083372 - RNA, 14 nt, Human
ugaggucagagccu

SEQ ID NO: 2083373 - RNA, 17 nt, Human
ugaggucagagccugca

SEQ ID NO: 2083374 - RNA, 20 nt, Human
ugaggucaaguaagaagaca

SEQ ID NO: 2083375 - RNA, 14 nt, Human
agcagagcaggggc

SEQ ID NO: 2083376 - RNA, 15 nt, Human
agcagagcaggggca

SEQ ID NO: 2083377 - RNA, 19 nt, Human
ugagcuuggccagaagggg

SEQ ID NO: 2083378 - RNA, 21 nt, Human
ugagcuuggccagaagggggc

SEQ ID NO: 2083379 - RNA, 22 nt, Human
ugagcuuuauguaauaauguga

SEQ ID NO: 2083380 - RNA, 19 nt, Human
ugaggaaaggccagcuggc

SEQ ID NO: 2083381 - RNA, 15 nt, Human
ugagcuuuggacaca

SEQ ID NO: 2083382 - RNA, 17 nt, Human
ugagcuuuggacacaca

SEQ ID NO: 2083383 - RNA, 21 nt, Human
ugagcuuuggacacacacagc

SEQ ID NO: 2083384 - RNA, 22 nt, Human
ugagcuuuggacacacacagcu

SEQ ID NO: 2083385 - RNA, 23 nt, Human
ugagcuuuggacacacacagcuu

SEQ ID NO: 2083386 - RNA, 19 nt, Human
ugagcuuuggacgcacaca

SEQ ID NO: 2083387 - RNA, 21 nt, Human
ugagcuuuggacgcacacagc

SEQ ID NO: 2083388 - RNA, 22 nt, Human
ugagcuuuggacgcacacagcu

SEQ ID NO: 2083389 - RNA, 23 nt, Human
ugagcuuuggacgcacacagcuu

SEQ ID NO: 2083390 - RNA, 15 nt, Human
ugaggaaaggccagc

SEQ ID NO: 2083391 - RNA, 16 nt, Human
ugaggaaaggccagcu

SEQ ID NO: 2083392 - RNA, 18 nt, Human
ugaggaaaggccagcugg

SEQ ID NO: 2083393 - RNA, 17 nt, Human
ugaggaagcgugaaggc

SEQ ID NO: 2083394 - RNA, 16 nt, Human
ugaggaagcuccaguc

SEQ ID NO: 2083395 - RNA, 19 nt, Human
ugaggaagcuccaguccug

SEQ ID NO: 2083396 - RNA, 20 nt, Human
ugaggaagcuccaguccugc

SEQ ID NO: 2083397 - RNA, 23 nt, Human
ugaggaagcuccaguccugcucu

SEQ ID NO: 2083398 - RNA, 22 nt, Human
ugaggaagcgugaaggccgaga

SEQ ID NO: 2083399 - RNA, 16 nt, Human
ugaggaaugaugaagc

SEQ ID NO: 2083400 - RNA, 19 nt, Human
ugaggaaucaacagggcag

SEQ ID NO: 2083401 - RNA, 20 nt, Human
ugaggaaucaacagggcagc

SEQ ID NO: 2083402 - RNA, 22 nt, Human
ugaggaauccagacccggcugc

SEQ ID NO: 2083403 - RNA, 21 nt, Human
ugaggaauccagacccggcug

SEQ ID NO: 2083404 - RNA, 21 nt, Human
ugaggacacuaaccacgcugg

SEQ ID NO: 2083405 - RNA, 22 nt, Human
ugaggccaaacguuuugaacua

SEQ ID NO: 2083406 - RNA, 12 nt, Human
ugaggccaggag

SEQ ID NO: 2083407 - RNA, 13 nt, Human
ugaggccaggagu

SEQ ID NO: 2083408 - RNA, 13 nt, Human
ugaggcccaggga

SEQ ID NO: 2083409 - RNA, 14 nt, Human
ugaggcccagggag

SEQ ID NO: 2083410 - RNA, 17 nt, Human
ugaggcccagggagagg

SEQ ID NO: 2083411 - RNA, 20 nt, Human
ugaggcccagggagaggcca

SEQ ID NO: 2083412 - RNA, 23 nt, Human
ugaggcccagggagaggccauga

SEQ ID NO: 2083413 - RNA, 19 nt, Human
agcagaaucaaaaugaccu

SEQ ID NO: 2083414 - RNA, 21 nt, Human
agcagagaaugaaagggccca

SEQ ID NO: 2083415 - RNA, 23 nt, Human
agcagagaaugaaagggcccaga

SEQ ID NO: 2083416 - RNA, 22 nt, Human
agcagagaaugaaagggcccag

SEQ ID NO: 2083417 - RNA, 14 nt, Human
agcagagaauucuc

SEQ ID NO: 2083418 - RNA, 21 nt, Human
agcagagaauucucuuaucca

SEQ ID NO: 2083419 - RNA, 15 nt, Human
agcagagacacuaac

SEQ ID NO: 2083420 - RNA, 14 nt, Human
agcagacuggugag

SEQ ID NO: 2083421 - RNA, 19 nt, Human
agcagacuggugagcagac

SEQ ID NO: 2083422 - RNA, 16 nt, Human
agcagagaaggccagg

SEQ ID NO: 2083423 - RNA, 10 nt, Human
ugagccuggc

SEQ ID NO: 2083424 - RNA, 14 nt, Human
ugagccugggaggu

SEQ ID NO: 2083425 - RNA, 11 nt, Human
ugagccuggca

SEQ ID NO: 2083426 - RNA, 16 nt, Human
ugagccuggcaagaau

SEQ ID NO: 2083427 - RNA, 19 nt, Human
ugagccugggaggucaagg

SEQ ID NO: 2083428 - RNA, 22 nt, Human
ugagccugggaggucaaggcug

SEQ ID NO: 2083429 - RNA, 13 nt, Human
ugagccuucaguc

SEQ ID NO: 2083430 - RNA, 14 nt, Human
ugagccuucagucu

SEQ ID NO: 2083431 - RNA, 23 nt, Human
agcacuuggagccaaggguucag

SEQ ID NO: 2083432 - RNA, 23 nt, Human
agcaccacccuagucccuucccc

SEQ ID NO: 2083433 - RNA, 14 nt, Human
agcaccaggcacga

SEQ ID NO: 2083434 - RNA, 13 nt, Human
agcaccagggaag

SEQ ID NO: 2083435 - RNA, 23 nt, Human
agcaccaggcacgaacccaccug

SEQ ID NO: 2083436 - RNA, 22 nt, Human
agcacuuugggaggccaaggug

SEQ ID NO: 2083437 - RNA, 14 nt, Human
agcacuuugggagg

SEQ ID NO: 2083438 - RNA, 15 nt, Human
agcacuuugggaggc

SEQ ID NO: 2083439 - RNA, 12 nt, Human
agcacuuuggga

SEQ ID NO: 2083440 - RNA, 16 nt, Human
agcacuuucauugcca

SEQ ID NO: 2083441 - RNA, 19 nt, Human
agcacuuucauugccagug

SEQ ID NO: 2083442 - RNA, 22 nt, Human
agcacuuucauugccagugucu

SEQ ID NO: 2083443 - RNA, 23 nt, Human
agcacuuugggaggccaaggugg

SEQ ID NO: 2083444 - RNA, 16 nt, Human
agcacuuugggaggcu

SEQ ID NO: 2083445 - RNA, 20 nt, Human
agcacuuugggaggccaagg

SEQ ID NO: 2083446 - RNA, 21 nt, Human
agcacuuugggaggcugaggc

SEQ ID NO: 2083447 - RNA, 22 nt, Human
agcacuuugggaggcugaggcg

SEQ ID NO: 2083448 - RNA, 22 nt, Human
agcacuuugggaggcugaggug

SEQ ID NO: 2083449 - RNA, 15 nt, Human
agcagaaaucuagaa

SEQ ID NO: 2083450 - RNA, 20 nt, Human
agcagaacaguuaagcagcc

SEQ ID NO: 2083451 - RNA, 14 nt, Human
agcagaagcucucg

SEQ ID NO: 2083452 - RNA, 14 nt, Human
ugagcaccucccag

SEQ ID NO: 2083453 - RNA, 15 nt, Human
ugagcaccucccagc

SEQ ID NO: 2083454 - RNA, 16 nt, Human
ugagcaccucccagcc

SEQ ID NO: 2083455 - RNA, 20 nt, Human
ugagcaccucccagccccug

SEQ ID NO: 2083456 - RNA, 16 nt, Human
ugagcaccaggggaug

SEQ ID NO: 2083457 - RNA, 13 nt, Human
ugagcaccagggg

SEQ ID NO: 2083458 - RNA, 14 nt, Human
ugagcaccagggga

SEQ ID NO: 2083459 - RNA, 23 nt, Human
ugagcacuaaggugugcucugau

SEQ ID NO: 2083460 - RNA, 22 nt, Human
ugagcacuaaggugugcucuga

SEQ ID NO: 2083461 - RNA, 21 nt, Human
ugagcacuaaggugugcucug

SEQ ID NO: 2083462 - RNA, 20 nt, Human
ugagcacuaaggugugcucu

SEQ ID NO: 2083463 - RNA, 22 nt, Human
agcaacccuccuaucaccuccc

SEQ ID NO: 2083464 - RNA, 19 nt, Human
ugagcaaauguggcuccug

SEQ ID NO: 2083465 - RNA, 18 nt, Human
ugagcaaauguggcuccu

SEQ ID NO: 2083466 - RNA, 16 nt, Human
ugagcaaauguggcuc

SEQ ID NO: 2083467 - RNA, 15 nt, Human
ugagcaaauguggcu

SEQ ID NO: 2083468 - RNA, 23 nt, Human
ugagccacugcaccgggccacag

SEQ ID NO: 2083469 - RNA, 18 nt, Human
ugagccacugcaccgggc

SEQ ID NO: 2083470 - RNA, 21 nt, Human
ugagccacugcaccgggccac

SEQ ID NO: 2083471 - RNA, 19 nt, Human
ugagcaagacccugucucu

SEQ ID NO: 2083472 - RNA, 21 nt, Human
ugagcagacuggugagcagac

SEQ ID NO: 2083473 - RNA, 17 nt, Human
ugagcagacuggugagc

SEQ ID NO: 2083474 - RNA, 19 nt, Human
ugagcagacuggugagcag

SEQ ID NO: 2083475 - RNA, 16 nt, Human
ugagcagacuggugag

SEQ ID NO: 2083476 - RNA, 21 nt, Human
agcacagcucaggaacuagac

SEQ ID NO: 2083477 - RNA, 16 nt, Human
agcacagcuucauuuc

SEQ ID NO: 2083478 - RNA, 14 nt, Human
agcacagugccugc

SEQ ID NO: 2083479 - RNA, 15 nt, Human
agcacagugccugca

SEQ ID NO: 2083480 - RNA, 14 nt, Human
agcacauccaggca

SEQ ID NO: 2083481 - RNA, 22 nt, Human
agcacauccaggcaauggccua

SEQ ID NO: 2083482 - RNA, 15 nt, Human
agcacaucugcauuu

SEQ ID NO: 2083483 - RNA, 16 nt, Human
agcacaucugcauuuu

SEQ ID NO: 2083484 - RNA, 22 nt, Human
agcaccaaaagcuuaccaaggg

SEQ ID NO: 2083485 - RNA, 23 nt, Human
agcacaucugcauuuucacccca

SEQ ID NO: 2083486 - RNA, 15 nt, Human
agcaccaccaggucu

SEQ ID NO: 2083487 - RNA, 16 nt, Human
agcaccaccaggucuc

SEQ ID NO: 2083488 - RNA, 20 nt, Human
agcaccaccaggucucccgg

SEQ ID NO: 2083489 - RNA, 12 nt, Human
agcaccacccua

SEQ ID NO: 2083490 - RNA, 13 nt, Human
agcaagugagagc

SEQ ID NO: 2083491 - RNA, 20 nt, Human
agcaagugagacccugucuc

SEQ ID NO: 2083492 - RNA, 18 nt, Human
ugagccaggccugggucu

SEQ ID NO: 2083493 - RNA, 14 nt, Human
ugagccaggccugg

SEQ ID NO: 2083494 - RNA, 12 nt, Human
ugagccaccacg

SEQ ID NO: 2083495 - RNA, 14 nt, Human
ugagccagacaaau

SEQ ID NO: 2083496 - RNA, 20 nt, Human
ugagccagacaaauggagga

SEQ ID NO: 2083497 - RNA, 14 nt, Human
agcaagugagagcu

SEQ ID NO: 2083498 - RNA, 18 nt, Human
agcaagugagagcugggu

SEQ ID NO: 2083499 - RNA, 16 nt, Human
agcaaguuacagugau

SEQ ID NO: 2083500 - RNA, 22 nt, Human
agcaagugagagcuggguguca

SEQ ID NO: 2083501 - RNA, 21 nt, Human
agcacagcagccccugcacaa

SEQ ID NO: 2083502 - RNA, 19 nt, Human
agaccuaacgagaaauaga

SEQ ID NO: 2083503 - RNA, 12 nt, Human
agacccugucuc

SEQ ID NO: 2083504 - RNA, 13 nt, Human
agacccugucucu

SEQ ID NO: 2083505 - RNA, 16 nt, Human
agacauggggaggaag

SEQ ID NO: 2083506 - RNA, 18 nt, Human
agacauggggaggaagga

SEQ ID NO: 2083507 - RNA, 19 nt, Human
agacauggggaggaaggac

SEQ ID NO: 2083508 - RNA, 17 nt, Human
agacauguggugggaca

SEQ ID NO: 2083509 - RNA, 13 nt, Human
ucuuccuauccca

SEQ ID NO: 2083510 - RNA, 14 nt, Human
ucuuccuaucccau

SEQ ID NO: 2083511 - RNA, 15 nt, Human
ucuuccuaucccauc

SEQ ID NO: 2083512 - RNA, 16 nt, Human
ucuuccuaucccaucc

SEQ ID NO: 2083513 - RNA, 17 nt, Human
ucuuccuaucccauccc

SEQ ID NO: 2083514 - RNA, 18 nt, Human
ucuuccuaucccauccca

SEQ ID NO: 2083515 - RNA, 21 nt, Human
ucuuccggagauguagcaaaa

SEQ ID NO: 2083516 - RNA, 18 nt, Human
ucuuccggagauguagca

SEQ ID NO: 2083517 - RNA, 19 nt, Human
ucuuccggagauguagcaa

SEQ ID NO: 2083518 - RNA, 14 nt, Human
agacccucguggcc

SEQ ID NO: 2083519 - RNA, 16 nt, Human
ucuugcaauggcagcc

SEQ ID NO: 2083520 - RNA, 13 nt, Human
ucuugcaauggca

SEQ ID NO: 2083521 - RNA, 17 nt, Human
ucuugcaauggcagccu

SEQ ID NO: 2083522 - RNA, 14 nt, Human
ucuugcuuucuuug

SEQ ID NO: 2083523 - RNA, 16 nt, Human
ucuuggaaagaaacaa

SEQ ID NO: 2083524 - RNA, 20 nt, Human
ucuugauuuguuuuagaaug

SEQ ID NO: 2083525 - RNA, 21 nt, Human
ucuugauuuguuuuagaauga

SEQ ID NO: 2083526 - RNA, 16 nt, Human
ucuugaugacuggaau

SEQ ID NO: 2083527 - RNA, 18 nt, Human
ucuugaugacuggaauuu

SEQ ID NO: 2083528 - RNA, 19 nt, Human
ucuugaugacuggaauuuu

SEQ ID NO: 2083529 - RNA, 20 nt, Human
ucuugaugacuggaauuuuu

SEQ ID NO: 2083530 - RNA, 18 nt, Human
agacucauucuucuguac

SEQ ID NO: 2083531 - RNA, 17 nt, Human
agacucauucuucugua

SEQ ID NO: 2083532 - RNA, 19 nt, Human
agacuaucuaaauguugaa

SEQ ID NO: 2083533 - RNA, 17 nt, Human
agacuaucuaaauguug

SEQ ID NO: 2083534 - RNA, 18 nt, Human
agacuaucuaaauguuga

SEQ ID NO: 2083535 - RNA, 16 nt, Human
agaccugagcucccca

SEQ ID NO: 2083536 - RNA, 14 nt, Human
agaccugacucagg

SEQ ID NO: 2083537 - RNA, 18 nt, Human
agaccugacucaggcauc

SEQ ID NO: 2083538 - RNA, 15 nt, Human
agacuaucuaaaugu

SEQ ID NO: 2083539 - RNA, 15 nt, Human
ucuuuacuucaugga

SEQ ID NO: 2083540 - RNA, 18 nt, Human
ucuuuaaagucaggucca

SEQ ID NO: 2083541 - RNA, 17 nt, Human
agacucuacagaggcca

SEQ ID NO: 2083542 - RNA, 19 nt, Human
agacucuacagaggccaug

SEQ ID NO: 2083543 - RNA, 15 nt, Human
agagaaucauacuua

SEQ ID NO: 2083544 - RNA, 22 nt, Human
agagaaugaaauugcugaaaga

SEQ ID NO: 2083545 - RNA, 23 nt, Human
agagaaucccuagucuucaagca

SEQ ID NO: 2083546 - RNA, 15 nt, Human
agagaauggaaaaca

SEQ ID NO: 2083547 - RNA, 18 nt, Human
agagaaugaaagggccca

SEQ ID NO: 2083548 - RNA, 17 nt, Human
agacuugaaagaaaggg

SEQ ID NO: 2083549 - RNA, 14 nt, Human
agacuugaaauacu

SEQ ID NO: 2083550 - RNA, 15 nt, Human
agacuugagaacuug

SEQ ID NO: 2083551 - RNA, 12 nt, Human
agacuugcugaa

SEQ ID NO: 2083552 - RNA, 20 nt, Human
agacuugcugaaucggaauc

SEQ ID NO: 2083553 - RNA, 21 nt, Human
agacuucacacugcaagagcc

SEQ ID NO: 2083554 - RNA, 15 nt, Human
agacuucacacugca

SEQ ID NO: 2083555 - RNA, 21 nt, Human
agacuggauaguccgucucug

SEQ ID NO: 2083556 - RNA, 11 nt, Human
agacuguggcu

SEQ ID NO: 2083557 - RNA, 14 nt, Human
agacuguggcugcu

SEQ ID NO: 2083558 - RNA, 20 nt, Human
agacuguggcugcuagcacu

SEQ ID NO: 2083559 - RNA, 19 nt, Human
agacaggguuucaccaugu

SEQ ID NO: 2083560 - RNA, 15 nt, Human
agacaggguccugcu

SEQ ID NO: 2083561 - RNA, 16 nt, Human
agacaggguccugcua

SEQ ID NO: 2083562 - RNA, 17 nt, Human
agacaggguccugcuau

SEQ ID NO: 2083563 - RNA, 18 nt, Human
agacaggcccaagagaug

SEQ ID NO: 2083564 - RNA, 22 nt, Human
agacaggcccaagagaugaaga

SEQ ID NO: 2083565 - RNA, 23 nt, Human
agacaggcccaagagaugaagag

SEQ ID NO: 2083566 - RNA, 21 nt, Human
agacaggguuuugccauguug

SEQ ID NO: 2083567 - RNA, 14 nt, Human
agacaggaaaggga

SEQ ID NO: 2083568 - RNA, 15 nt, Human
agacaggcccaagag

SEQ ID NO: 2083569 - RNA, 16 nt, Human
agacaggcccaagaga

SEQ ID NO: 2083570 - RNA, 18 nt, Human
agacaggaaagggaaggc

SEQ ID NO: 2083571 - RNA, 21 nt, Human
agacaggacagugcuucagcc

SEQ ID NO: 2083572 - RNA, 23 nt, Human
agacaggcaagcaccuccugccu

SEQ ID NO: 2083573 - RNA, 18 nt, Human
ucuuaauauaacugccuu

SEQ ID NO: 2083574 - RNA, 19 nt, Human
ucuuaauauaacugccuua

SEQ ID NO: 2083575 - RNA, 15 nt, Human
ucuuaauauaacugc

SEQ ID NO: 2083576 - RNA, 17 nt, Human
agacaguauauuuauag

SEQ ID NO: 2083577 - RNA, 18 nt, Human
agacaguauauuuauagu

SEQ ID NO: 2083578 - RNA, 23 nt, Human
ucuuaaggauugugauauuuuua

SEQ ID NO: 2083579 - RNA, 18 nt, Human
agacaguauauaacuaac

SEQ ID NO: 2083580 - RNA, 15 nt, Human
agacaguauauuuau

SEQ ID NO: 2083581 - RNA, 13 nt, Human
agacaguaaguau

SEQ ID NO: 2083582 - RNA, 17 nt, Human
agacaguaaguaucuuc

SEQ ID NO: 2083583 - RNA, 22 nt, Human
agacaguaaguaucuucguucu

SEQ ID NO: 2083584 - RNA, 21 nt, Human
agacacugaaauauacacaca

SEQ ID NO: 2083585 - RNA, 20 nt, Human
agacacugaaauauacacac

SEQ ID NO: 2083586 - RNA, 22 nt, Human
agacacugaaauauacacacag

SEQ ID NO: 2083587 - RNA, 13 nt, Human
agacacugaaaua

SEQ ID NO: 2083588 - RNA, 15 nt, Human
agacagacuugagaa

SEQ ID NO: 2083589 - RNA, 16 nt, Human
agacagacacacacac

SEQ ID NO: 2083590 - RNA, 15 nt, Human
agacagacacacaca

SEQ ID NO: 2083591 - RNA, 14 nt, Human
agacagacacacac

SEQ ID NO: 2083592 - RNA, 22 nt, Human
agacagcuucucauccugcagg

SEQ ID NO: 2083593 - RNA, 23 nt, Human
agacagcuucucauccugcaggc

SEQ ID NO: 2083594 - RNA, 18 nt, Human
agacaggaaaauccucug

SEQ ID NO: 2083595 - RNA, 19 nt, Human
agacaggaaaauccucugg

SEQ ID NO: 2083596 - RNA, 20 nt, Human
agacaggaaaauccucuggc

SEQ ID NO: 2083597 - RNA, 21 nt, Human
agacaggaaaauccucuggcu

SEQ ID NO: 2083598 - RNA, 17 nt, Human
agacaccguucauucag

SEQ ID NO: 2083599 - RNA, 22 nt, Human
agacacuaacgacuucagggca

SEQ ID NO: 2083600 - RNA, 18 nt, Human
agacacccuaauguggca

SEQ ID NO: 2083601 - RNA, 13 nt, Human
ucuuaauuaagua

SEQ ID NO: 2083602 - RNA, 14 nt, Human
ucuuaauuaaguaa

SEQ ID NO: 2083603 - RNA, 18 nt, Human
ucuuaauuaaguaaacua

SEQ ID NO: 2083604 - RNA, 19 nt, Human
ucuuaauuaaguaaacuaa

SEQ ID NO: 2083605 - RNA, 20 nt, Human
ucuuaauuaaguaaacuaau

SEQ ID NO: 2083606 - RNA, 21 nt, Human
ucuuaauuaaguaaacuaaug

SEQ ID NO: 2083607 - RNA, 19 nt, Human
ucuuagaaguggaccagga

SEQ ID NO: 2083608 - RNA, 21 nt, Human
ucuuagaaguggaccaggaca

SEQ ID NO: 2083609 - RNA, 18 nt, Human
ucuuagacuugaaauacu

SEQ ID NO: 2083610 - RNA, 23 nt, Human
ucuuagacuugaaauacuacuua

SEQ ID NO: 2083611 - RNA, 22 nt, Human
ucuuauugcccacgcuggagug

SEQ ID NO: 2083612 - RNA, 18 nt, Human
ucuuauugcccacgcugg

SEQ ID NO: 2083613 - RNA, 14 nt, Human
ucuuauugcccacg

SEQ ID NO: 2083614 - RNA, 14 nt, Human
ucuuagauaucuuu

SEQ ID NO: 2083615 - RNA, 17 nt, Human
ucuuagauaucuuuuua

SEQ ID NO: 2083616 - RNA, 21 nt, Human
ucuuagauaucuuuuuauuga

SEQ ID NO: 2083617 - RNA, 23 nt, Human
ucuuagauaucuuuuuauugaug

SEQ ID NO: 2083618 - RNA, 24 nt, Human
ucuuagauaucuuuuuauugaugu

SEQ ID NO: 2083619 - RNA, 20 nt, Human
ucuucccuagaggguuccug

SEQ ID NO: 2083620 - RNA, 20 nt, Human
ucuucccuagggcugggugu

SEQ ID NO: 2083621 - RNA, 13 nt, Human
ucuucccuaccuc

SEQ ID NO: 2083622 - RNA, 14 nt, Human
ucuucccuaccuca

SEQ ID NO: 2083623 - RNA, 21 nt, Human
ucuucccuaccucaggcagga

SEQ ID NO: 2083624 - RNA, 19 nt, Human
ucuucccuuuuacauacug

SEQ ID NO: 2083625 - RNA, 21 nt, Human
ucuucccuuuuacauacugcu

SEQ ID NO: 2083626 - RNA, 22 nt, Human
ucuucccuuuuacauacugcug

SEQ ID NO: 2083627 - RNA, 13 nt, Human
ucuucccuuaaaa

SEQ ID NO: 2083628 - RNA, 15 nt, Human
ucuuccggagaugua

SEQ ID NO: 2083629 - RNA, 16 nt, Human
ucuuccggagauguag

SEQ ID NO: 2083630 - RNA, 12 nt, Human
ucuuccauaaug

SEQ ID NO: 2083631 - RNA, 16 nt, Human
ucuuccauaauguaua

SEQ ID NO: 2083632 - RNA, 14 nt, Human
ucuuauuuaacuua

SEQ ID NO: 2083633 - RNA, 11 nt, Human
ucuucaacaga

SEQ ID NO: 2083634 - RNA, 19 nt, Human
ucuucaacaucaauguuca

SEQ ID NO: 2083635 - RNA, 20 nt, Human
ucuucaacaucaauguucau

SEQ ID NO: 2083636 - RNA, 14 nt, Human
ucuucacggcagga

SEQ ID NO: 2083637 - RNA, 19 nt, Human
ucuucaccuaagucucugu

SEQ ID NO: 2083638 - RNA, 23 nt, Human
ucuucaccuaagucucugugaau

SEQ ID NO: 2083639 - RNA, 13 nt, Human
ucuucagaagaca

SEQ ID NO: 2083640 - RNA, 18 nt, Human
ucuucagaagacacugca

SEQ ID NO: 2083641 - RNA, 14 nt, Human
ucuucacucgcccc

SEQ ID NO: 2083642 - RNA, 24 nt, Human
ucuucaacaucaauguucauugua

SEQ ID NO: 2083643 - RNA, 21 nt, Human
ucuucaacaucaauguucauu

SEQ ID NO: 2083644 - RNA, 23 nt, Human
ucuucaacaucaauguucauugu

SEQ ID NO: 2083645 - RNA, 22 nt, Human
ucuucacaauggugcucauuuc

SEQ ID NO: 2083646 - RNA, 18 nt, Human
ucuucacagcucuguguu

SEQ ID NO: 2083647 - RNA, 20 nt, Human
ucuguuggccagugugacaa

SEQ ID NO: 2083648 - RNA, 19 nt, Human
ucuguuggccagugugaca

SEQ ID NO: 2083649 - RNA, 18 nt, Human
ucuguuggccagugugac

SEQ ID NO: 2083650 - RNA, 13 nt, Human
ucuguuccuggcu

SEQ ID NO: 2083651 - RNA, 22 nt, Human
ucuguuccuggcucagccucaa

SEQ ID NO: 2083652 - RNA, 23 nt, Human
ucuguuccuggcucagccucaaa

SEQ ID NO: 2083653 - RNA, 13 nt, Human
ucuguuccuucac

SEQ ID NO: 2083654 - RNA, 15 nt, Human
ucuguuccuucacau

SEQ ID NO: 2083655 - RNA, 21 nt, Human
ucuguucauuuguuauucuua

SEQ ID NO: 2083656 - RNA, 24 nt, Human
ucuguccaggcacugcugcccagc

SEQ ID NO: 2083657 - RNA, 16 nt, Human
ucugugcgugaaacac

SEQ ID NO: 2083658 - RNA, 22 nt, Human
ucugugcgugaaacacaccagg

SEQ ID NO: 2083659 - RNA, 14 nt, Human
ucugugccuggagc

SEQ ID NO: 2083660 - RNA, 15 nt, Human
ucugugccuggagcu

SEQ ID NO: 2083661 - RNA, 20 nt, Human
ucugugccuggagcuccugg

SEQ ID NO: 2083662 - RNA, 21 nt, Human
ucugugccuggagcuccuggg

SEQ ID NO: 2083663 - RNA, 22 nt, Human
ucugugccccaugccuguccag

SEQ ID NO: 2083664 - RNA, 21 nt, Human
agaauuuauucaauuccucug

SEQ ID NO: 2083665 - RNA, 14 nt, Human
agaauuucaauuug

SEQ ID NO: 2083666 - RNA, 16 nt, Human
agaauuucaauuuguu

SEQ ID NO: 2083667 - RNA, 20 nt, Human
agaauuucaauuuguucagu

SEQ ID NO: 2083668 - RNA, 13 nt, Human
agaauuucuuggu

SEQ ID NO: 2083669 - RNA, 21 nt, Human
agaauuucuugguaagaagcc

SEQ ID NO: 2083670 - RNA, 22 nt, Human
agaauuucuugguaagaagccg

SEQ ID NO: 2083671 - RNA, 14 nt, Human
agaauuuauucaau

SEQ ID NO: 2083672 - RNA, 13 nt, Human
agaauuuauucaa

SEQ ID NO: 2083673 - RNA, 21 nt, Human
agaauuuaucacacuucugug

SEQ ID NO: 2083674 - RNA, 12 nt, Human
ucuguuucuagu

SEQ ID NO: 2083675 - RNA, 13 nt, Human
ucuguuucuaguu

SEQ ID NO: 2083676 - RNA, 22 nt, Human
ucuguuucuauucucuccucag

SEQ ID NO: 2083677 - RNA, 12 nt, Human
ucuguuuguuaa

SEQ ID NO: 2083678 - RNA, 13 nt, Human
ucuguuuguuaaa

SEQ ID NO: 2083679 - RNA, 14 nt, Human
ucuguuuguuaaaa

SEQ ID NO: 2083680 - RNA, 21 nt, Human
ucuguuuguuaaaacuggcau

SEQ ID NO: 2083681 - RNA, 15 nt, Human
agaauuguaucauuu

SEQ ID NO: 2083682 - RNA, 21 nt, Human
agaauuggagaguaaaaacug

SEQ ID NO: 2083683 - RNA, 13 nt, Human
ucuguuuuacugc

SEQ ID NO: 2083684 - RNA, 20 nt, Human
agaauugcaauuuuaacaca

SEQ ID NO: 2083685 - RNA, 22 nt, Human
agaauugcugauucuugaguuu

SEQ ID NO: 2083686 - RNA, 17 nt, Human
ucuggucuccucuuugu

SEQ ID NO: 2083687 - RNA, 16 nt, Human
ucuguagagcagggca

SEQ ID NO: 2083688 - RNA, 23 nt, Human
ucuguagcuccucaacucaccua

SEQ ID NO: 2083689 - RNA, 13 nt, Human
ucuguagcuccuc

SEQ ID NO: 2083690 - RNA, 14 nt, Human
ucuguagcuccuca

SEQ ID NO: 2083691 - RNA, 14 nt, Human
ucuguauacugugg

SEQ ID NO: 2083692 - RNA, 19 nt, Human
ucuguaguacuccuuaaga

SEQ ID NO: 2083693 - RNA, 23 nt, Human
ucuguaguacuccuuaagaacac

SEQ ID NO: 2083694 - RNA, 15 nt, Human
ucuguauauacaaua

SEQ ID NO: 2083695 - RNA, 15 nt, Human
ucugucauuugagca

SEQ ID NO: 2083696 - RNA, 23 nt, Human
ucuguccaaaggaggcuggcagg

SEQ ID NO: 2083697 - RNA, 19 nt, Human
ucuguccaaaggaggcugg

SEQ ID NO: 2083698 - RNA, 22 nt, Human
ucuguccaaaggaggcuggcag

SEQ ID NO: 2083699 - RNA, 18 nt, Human
ucugucauaucuucacaa

SEQ ID NO: 2083700 - RNA, 21 nt, Human
ucugucaucuaccuuuucucu

SEQ ID NO: 2083701 - RNA, 15 nt, Human
ucuguccaaaggagg

SEQ ID NO: 2083702 - RNA, 16 nt, Human
ucuguccaaaggaggc

SEQ ID NO: 2083703 - RNA, 17 nt, Human
ucuguccaaaggaggcu

SEQ ID NO: 2083704 - RNA, 23 nt, Human
ucugucauuugagcagggcucag

SEQ ID NO: 2083705 - RNA, 20 nt, Human
ucugucauuugagcagggcu

SEQ ID NO: 2083706 - RNA, 16 nt, Human
ucuggguucacugcaa

SEQ ID NO: 2083707 - RNA, 14 nt, Human
ucuggguucacugc

SEQ ID NO: 2083708 - RNA, 18 nt, Human
ucugggugcucccuacca

SEQ ID NO: 2083709 - RNA, 16 nt, Human
ucuggggcucugggau

SEQ ID NO: 2083710 - RNA, 16 nt, Human
ucugggugguugcccu

SEQ ID NO: 2083711 - RNA, 19 nt, Human
ucugggugguugcccuuca

SEQ ID NO: 2083712 - RNA, 13 nt, Human
ucuggucccuugc

SEQ ID NO: 2083713 - RNA, 14 nt, Human
ucuggucccuugca

SEQ ID NO: 2083714 - RNA, 11 nt, Human
agaaggaaugu

SEQ ID NO: 2083715 - RNA, 14 nt, Human
agaaggaaugucuu

SEQ ID NO: 2083716 - RNA, 17 nt, Human
agaaggaagugaagagg

SEQ ID NO: 2083717 - RNA, 15 nt, Human
ucuggggcucuggga

SEQ ID NO: 2083718 - RNA, 13 nt, Human
ucuggggccccuu

SEQ ID NO: 2083719 - RNA, 18 nt, Human
ucuggggauacuggcaaa

SEQ ID NO: 2083720 - RNA, 22 nt, Human
agaaggaaggagacucaccucu

SEQ ID NO: 2083721 - RNA, 9 nt, Human
agaaggaag

SEQ ID NO: 2083722 - RNA, 14 nt, Human
agaaggaagacuuu

SEQ ID NO: 2083723 - RNA, 18 nt, Human
agaagcuuccauuccaag

SEQ ID NO: 2083724 - RNA, 16 nt, Human
agaaggaaaaggcagg

SEQ ID NO: 2083725 - RNA, 21 nt, Human
agaacucaugacggaagaguu

SEQ ID NO: 2083726 - RNA, 17 nt, Human
agaacucaguuuuaacu

SEQ ID NO: 2083727 - RNA, 15 nt, Human
agaaccucuucccca

SEQ ID NO: 2083728 - RNA, 22 nt, Human
agaaccucacgcaccucccauc

SEQ ID NO: 2083729 - RNA, 22 nt, Human
agaacguauugguccagcuugc

SEQ ID NO: 2083730 - RNA, 13 nt, Human
agaaccucuuccc

SEQ ID NO: 2083731 - RNA, 14 nt, Human
agaaccucuucccc

SEQ ID NO: 2083732 - RNA, 18 nt, Human
agaaccucacgcaccucc

SEQ ID NO: 2083733 - RNA, 21 nt, Human
agaaccucacgcaccucccau

SEQ ID NO: 2083734 - RNA, 12 nt, Human
agaaccucaggc

SEQ ID NO: 2083735 - RNA, 19 nt, Human
agaaccucaggcuuccuug

SEQ ID NO: 2083736 - RNA, 21 nt, Human
agaaccucaggcuuccuuggc

SEQ ID NO: 2083737 - RNA, 13 nt, Human
agaacugaaaaca

SEQ ID NO: 2083738 - RNA, 14 nt, Human
agaacugaaaacau

SEQ ID NO: 2083739 - RNA, 15 nt, Human
agaacugaaaacaua

SEQ ID NO: 2083740 - RNA, 16 nt, Human
agaacugaaaacauaa

SEQ ID NO: 2083741 - RNA, 17 nt, Human
agaacugaaaacauaaa

SEQ ID NO: 2083742 - RNA, 19 nt, Human
agaacugaaaacauaaaaa

SEQ ID NO: 2083743 - RNA, 21 nt, Human
agaacugaaaacauaaaaagu

SEQ ID NO: 2083744 - RNA, 20 nt, Human
agaacucugggcugccaugu

SEQ ID NO: 2083745 - RNA, 20 nt, Human
agaacucugggcugcuaccc

SEQ ID NO: 2083746 - RNA, 14 nt, Human
agaagaaaaaagaa

SEQ ID NO: 2083747 - RNA, 17 nt, Human
agaagaaaaaagaaugu

SEQ ID NO: 2083748 - RNA, 19 nt, Human
agaagaaaagguucuuacu

SEQ ID NO: 2083749 - RNA, 14 nt, Human
agaacucugggcug

SEQ ID NO: 2083750 - RNA, 23 nt, Human
agaacucuccaucuuauuuucau

SEQ ID NO: 2083751 - RNA, 15 nt, Human
ucugcagaaacagaa

SEQ ID NO: 2083752 - RNA, 15 nt, Human
ucugcacuuaaauau

SEQ ID NO: 2083753 - RNA, 16 nt, Human
ucugcacuuaaauauc

SEQ ID NO: 2083754 - RNA, 15 nt, Human
agaaauuggcuggau

SEQ ID NO: 2083755 - RNA, 14 nt, Human
agaaauuggcugga

SEQ ID NO: 2083756 - RNA, 15 nt, Human
agaaaugucuggaga

SEQ ID NO: 2083757 - RNA, 17 nt, Human
agaaaugucuggagaau

SEQ ID NO: 2083758 - RNA, 19 nt, Human
agaaaugucuggagaauaa

SEQ ID NO: 2083759 - RNA, 12 nt, Human
ucugcagagcag

SEQ ID NO: 2083760 - RNA, 18 nt, Human
agaaauuuaaaagacacu

SEQ ID NO: 2083761 - RNA, 22 nt, Human
agaaauuuuacaauaggugcuu

SEQ ID NO: 2083762 - RNA, 17 nt, Human
agaaauuuaauucaugu

SEQ ID NO: 2083763 - RNA, 21 nt, Human
agaaauuuaauucauguuucu

SEQ ID NO: 2083764 - RNA, 22 nt, Human
agaaauuuaauucauguuucuu

SEQ ID NO: 2083765 - RNA, 17 nt, Human
agaaauuuuucagaugc

SEQ ID NO: 2083766 - RNA, 18 nt, Human
agaaauuuuucagaugcu

SEQ ID NO: 2083767 - RNA, 21 nt, Human
agaaauuuuucagaugcuucu

SEQ ID NO: 2083768 - RNA, 22 nt, Human
agaaauuuuucagaugcuucug

SEQ ID NO: 2083769 - RNA, 23 nt, Human
agaaauuuuucagaugcuucugg

SEQ ID NO: 2083770 - RNA, 23 nt, Human
ucugacuuccccgcauuccaggc

SEQ ID NO: 2083771 - RNA, 14 nt, Human
ucugaccugcaggc

SEQ ID NO: 2083772 - RNA, 15 nt, Human
ucugaccugcaggcc

SEQ ID NO: 2083773 - RNA, 19 nt, Human
ucugacccugcuucaaaua

SEQ ID NO: 2083774 - RNA, 15 nt, Human
agaaagacagagcug

SEQ ID NO: 2083775 - RNA, 18 nt, Human
agaaagaaggaagugaag

SEQ ID NO: 2083776 - RNA, 12 nt, Human
ucugaccucagc

SEQ ID NO: 2083777 - RNA, 13 nt, Human
ucugaccucagca

SEQ ID NO: 2083778 - RNA, 14 nt, Human
ucugaccucagcau

SEQ ID NO: 2083779 - RNA, 12 nt, Human
ucugaccugcag

SEQ ID NO: 2083780 - RNA, 21 nt, Human
ucugacccuagcucuuuccuu

SEQ ID NO: 2083781 - RNA, 14 nt, Human
ucugacccucucca

SEQ ID NO: 2083782 - RNA, 21 nt, Human
ucugaccgaaacagcgcuggg

SEQ ID NO: 2083783 - RNA, 22 nt, Human
ucugauauuccaugaauguauc

SEQ ID NO: 2083784 - RNA, 21 nt, Human
ucugauucccaagcucugcuc

SEQ ID NO: 2083785 - RNA, 20 nt, Human
ucugauucccaagcucugcu

SEQ ID NO: 2083786 - RNA, 19 nt, Human
ucugauucccaagcucugc

SEQ ID NO: 2083787 - RNA, 17 nt, Human
ucugauauuccaugaau

SEQ ID NO: 2083788 - RNA, 19 nt, Human
ucugauauuccaugaaugu

SEQ ID NO: 2083789 - RNA, 20 nt, Human
ucugauauuccaugaaugua

SEQ ID NO: 2083790 - RNA, 13 nt, Human
agaagaaggaaau

SEQ ID NO: 2083791 - RNA, 14 nt, Human
agaagaaggaaaug

SEQ ID NO: 2083792 - RNA, 17 nt, Human
agaagaaggaaaugaau

SEQ ID NO: 2083793 - RNA, 18 nt, Human
agaagaaggaaaugaauu

SEQ ID NO: 2083794 - RNA, 21 nt, Human
agaagaaggaaaugaauuucu

SEQ ID NO: 2083795 - RNA, 13 nt, Human
agaagaaggcagc

SEQ ID NO: 2083796 - RNA, 14 nt, Human
agaagaaggcagca

SEQ ID NO: 2083797 - RNA, 21 nt, Human
agaagaaggcagcagguggca

SEQ ID NO: 2083798 - RNA, 13 nt, Human
ucugccccucccc

SEQ ID NO: 2083799 - RNA, 14 nt, Human
ucugccccuccccc

SEQ ID NO: 2083800 - RNA, 15 nt, Human
ucugccccuccccca

SEQ ID NO: 2083801 - RNA, 16 nt, Human
ucugccccucccccaa

SEQ ID NO: 2083802 - RNA, 18 nt, Human
ucugccccucccccaacc

SEQ ID NO: 2083803 - RNA, 22 nt, Human
ucugccccucccccaaccccca

SEQ ID NO: 2083804 - RNA, 17 nt, Human
ucugccggcccuggggc

SEQ ID NO: 2083805 - RNA, 15 nt, Human
ucugccggcccuggg

SEQ ID NO: 2083806 - RNA, 16 nt, Human
ucugccggcccugggg

SEQ ID NO: 2083807 - RNA, 13 nt, Human
ucugccuuugcag

SEQ ID NO: 2083808 - RNA, 16 nt, Human
ucugccuuugcagaaa

SEQ ID NO: 2083809 - RNA, 19 nt, Human
ucugccuuugcagaaacag

SEQ ID NO: 2083810 - RNA, 20 nt, Human
ucugccuuugcagaaacaga

SEQ ID NO: 2083811 - RNA, 22 nt, Human
ucugcuaacuuggagccccagu

SEQ ID NO: 2083812 - RNA, 22 nt, Human
ucugcuaagcucaaggcgugag

SEQ ID NO: 2083813 - RNA, 16 nt, Human
ucugcucacauaucug

SEQ ID NO: 2083814 - RNA, 17 nt, Human
ucugcuaccucacuggg

SEQ ID NO: 2083815 - RNA, 14 nt, Human
ucugcuaccucacu

SEQ ID NO: 2083816 - RNA, 14 nt, Human
ucugcuaauaaaac

SEQ ID NO: 2083817 - RNA, 17 nt, Human
ucugcucacauaucugu

SEQ ID NO: 2083818 - RNA, 13 nt, Human
ucugcuaugcuug

SEQ ID NO: 2083819 - RNA, 14 nt, Human
ucugcuaugcuuga

SEQ ID NO: 2083820 - RNA, 15 nt, Human
ucugcuaugcuugaa

SEQ ID NO: 2083821 - RNA, 18 nt, Human
ucugcugucagucugcuu

SEQ ID NO: 2083822 - RNA, 16 nt, Human
ucugcuuauccuucca

SEQ ID NO: 2083823 - RNA, 23 nt, Human
ucugcuuuuuaaagaaugcucuu

SEQ ID NO: 2083824 - RNA, 15 nt, Human
ucugcuucugcaccu

SEQ ID NO: 2083825 - RNA, 15 nt, Human
ucuggaaaauaaaag

SEQ ID NO: 2083826 - RNA, 14 nt, Human
ucuggaaaggagga

SEQ ID NO: 2083827 - RNA, 15 nt, Human
ucuggaaaggaggaa

SEQ ID NO: 2083828 - RNA, 16 nt, Human
ucuggaaaggaggaag

SEQ ID NO: 2083829 - RNA, 14 nt, Human
ucuggaucugggac

SEQ ID NO: 2083830 - RNA, 23 nt, Human
ucuggauaauuuugcauaaaauu

SEQ ID NO: 2083831 - RNA, 15 nt, Human
agaagcggcuggcag

SEQ ID NO: 2083832 - RNA, 16 nt, Human
agaagcggcuggcagc

SEQ ID NO: 2083833 - RNA, 23 nt, Human
agaagcgggacgagacccuacag

SEQ ID NO: 2083834 - RNA, 14 nt, Human
agaagccuugguac

SEQ ID NO: 2083835 - RNA, 14 nt, Human
agaagcgagcacug

SEQ ID NO: 2083836 - RNA, 20 nt, Human
agaagcugagcaccagggga

SEQ ID NO: 2083837 - RNA, 19 nt, Human
ucuggccaggauggagggg

SEQ ID NO: 2083838 - RNA, 19 nt, Human
ucuggcccucaccccugcc

SEQ ID NO: 2083839 - RNA, 23 nt, Human
ucuggcccucaccccugcccugg

SEQ ID NO: 2083840 - RNA, 13 nt, Human
ucuggcccugccu

SEQ ID NO: 2083841 - RNA, 14 nt, Human
ucuggcccugccuu

SEQ ID NO: 2083842 - RNA, 15 nt, Human
ucuggcccugccuuc

SEQ ID NO: 2083843 - RNA, 16 nt, Human
ucuggcccugccuucu

SEQ ID NO: 2083844 - RNA, 15 nt, Human
agaaagaagaugaau

SEQ ID NO: 2083845 - RNA, 12 nt, Human
agaaagaagccc

SEQ ID NO: 2083846 - RNA, 12 nt, Human
agaaagaaggaa

SEQ ID NO: 2083847 - RNA, 13 nt, Human
agaaagaaggaag

SEQ ID NO: 2083848 - RNA, 14 nt, Human
agaaagaaggaagu

SEQ ID NO: 2083849 - RNA, 20 nt, Human
agaaagaaacccgacagagg

SEQ ID NO: 2083850 - RNA, 22 nt, Human
agaaagaaacccgacagaggga

SEQ ID NO: 2083851 - RNA, 21 nt, Human
agaaacccgacagagggaaga

SEQ ID NO: 2083852 - RNA, 14 nt, Human
agaaacccugucuc

SEQ ID NO: 2083853 - RNA, 16 nt, Human
agaaaccguccucuuu

SEQ ID NO: 2083854 - RNA, 20 nt, Human
agaaaccuacagaauacuag

SEQ ID NO: 2083855 - RNA, 21 nt, Human
agaaaccaguuaugugaauga

SEQ ID NO: 2083856 - RNA, 13 nt, Human
agaaacccugucu

SEQ ID NO: 2083857 - RNA, 16 nt, Human
agaaacccgacagagg

SEQ ID NO: 2083858 - RNA, 18 nt, Human
agaaacccgacagaggga

SEQ ID NO: 2083859 - RNA, 22 nt, Human
agaaaacuugaauucauagaaa

SEQ ID NO: 2083860 - RNA, 18 nt, Human
agaaaccaaucaagauaa

SEQ ID NO: 2083861 - RNA, 20 nt, Human
agaaaacgguuaaaacuguc

SEQ ID NO: 2083862 - RNA, 18 nt, Human
agaaaacuagaauuucau

SEQ ID NO: 2083863 - RNA, 19 nt, Human
agaaaacuagaauuucauu

SEQ ID NO: 2083864 - RNA, 16 nt, Human
agaaaacccuuuucua

SEQ ID NO: 2083865 - RNA, 22 nt, Human
ucucuuuaaugucacaggcagg

SEQ ID NO: 2083866 - RNA, 10 nt, Human
ucucugccau

SEQ ID NO: 2083867 - RNA, 15 nt, Human
ucucuuuacauuuug

SEQ ID NO: 2083868 - RNA, 23 nt, Human
ucucuuucuccuuagucuucuca

SEQ ID NO: 2083869 - RNA, 13 nt, Human
ucucuugagccug

SEQ ID NO: 2083870 - RNA, 14 nt, Human
ucucuugagccugg

SEQ ID NO: 2083871 - RNA, 15 nt, Human
ucucuugagccuggg

SEQ ID NO: 2083872 - RNA, 12 nt, Human
agaaaaaucagu

SEQ ID NO: 2083873 - RNA, 17 nt, Human
agaaaaaugagccuggc

SEQ ID NO: 2083874 - RNA, 17 nt, Human
agaaaacacuuguaagu

SEQ ID NO: 2083875 - RNA, 13 nt, Human
agaaaacagaaaa

SEQ ID NO: 2083876 - RNA, 14 nt, Human
agaaaacagaaaaa

SEQ ID NO: 2083877 - RNA, 15 nt, Human
agaaaacagaaaaaa

SEQ ID NO: 2083878 - RNA, 19 nt, Human
agaaaacagaaaaaaaaca

SEQ ID NO: 2083879 - RNA, 16 nt, Human
agaaaacagaaaacaa

SEQ ID NO: 2083880 - RNA, 15 nt, Human
agaaaacaucacuga

SEQ ID NO: 2083881 - RNA, 20 nt, Human
agaaaacaggaaaaaaacuu

SEQ ID NO: 2083882 - RNA, 22 nt, Human
agaaaacaggaaaaaaacuuuu

SEQ ID NO: 2083883 - RNA, 23 nt, Human
agaaaacaggaaaaaaacuuuua

SEQ ID NO: 2083884 - RNA, 12 nt, Human
agaaaacagaaa

SEQ ID NO: 2083885 - RNA, 12 nt, Human
ucucugcccauu

SEQ ID NO: 2083886 - RNA, 14 nt, Human
ucucugcccauucc

SEQ ID NO: 2083887 - RNA, 15 nt, Human
ucucugcccauuccc

SEQ ID NO: 2083888 - RNA, 19 nt, Human
ucucugcccauuccccagc

SEQ ID NO: 2083889 - RNA, 18 nt, Human
ucucugccugugagccag

SEQ ID NO: 2083890 - RNA, 19 nt, Human
ucucugccugugagccagu

SEQ ID NO: 2083891 - RNA, 21 nt, Human
ucucugccugugagccagucu

SEQ ID NO: 2083892 - RNA, 11 nt, Human
ucucugcucca

SEQ ID NO: 2083893 - RNA, 12 nt, Human
ucucugcuccac

SEQ ID NO: 2083894 - RNA, 13 nt, Human
ucucugcuccacc

SEQ ID NO: 2083895 - RNA, 14 nt, Human
ucucugcuccacca

SEQ ID NO: 2083896 - RNA, 15 nt, Human
ucucugcuccaccac

SEQ ID NO: 2083897 - RNA, 17 nt, Human
ucucugcuccaccacau

SEQ ID NO: 2083898 - RNA, 19 nt, Human
ucucugcuccaccacaucc

SEQ ID NO: 2083899 - RNA, 16 nt, Human
ucucuucugcuccacc

SEQ ID NO: 2083900 - RNA, 17 nt, Human
ucucuucugcuccaccc

SEQ ID NO: 2083901 - RNA, 13 nt, Human
ucucuucugcucc

SEQ ID NO: 2083902 - RNA, 14 nt, Human
ucucuucugcucca

SEQ ID NO: 2083903 - RNA, 19 nt, Human
ucucuucugcuccacccuu

SEQ ID NO: 2083904 - RNA, 14 nt, Human
ucucuugagagggu

SEQ ID NO: 2083905 - RNA, 19 nt, Human
ucuccuuccccuuucccca

SEQ ID NO: 2083906 - RNA, 11 nt, Human
ucuccuuccaa

SEQ ID NO: 2083907 - RNA, 15 nt, Human
ucuccuuccaacugc

SEQ ID NO: 2083908 - RNA, 16 nt, Human
ucuccuuccaacugcu

SEQ ID NO: 2083909 - RNA, 21 nt, Human
ucuccuuccaacugcugcccc

SEQ ID NO: 2083910 - RNA, 22 nt, Human
ucuccuuccaacugcugcccca

SEQ ID NO: 2083911 - RNA, 14 nt, Human
ucucuccuguccaa

SEQ ID NO: 2083912 - RNA, 13 nt, Human
ucucuccugucca

SEQ ID NO: 2083913 - RNA, 14 nt, Human
ucucuccuguacuu

SEQ ID NO: 2083914 - RNA, 15 nt, Human
acuuuuuuuuaaguu

SEQ ID NO: 2083915 - RNA, 21 nt, Human
acuuuuuugaaauaauaaauc

SEQ ID NO: 2083916 - RNA, 22 nt, Human
acuuuuuugaguggaugauguu

SEQ ID NO: 2083917 - RNA, 23 nt, Human
acuuuuuugcuauccagcuauuu

SEQ ID NO: 2083918 - RNA, 14 nt, Human
acuuuuugguggau

SEQ ID NO: 2083919 - RNA, 17 nt, Human
acuuuuugguggaugua

SEQ ID NO: 2083920 - RNA, 19 nt, Human
acuuuuugguggauguaaa

SEQ ID NO: 2083921 - RNA, 21 nt, Human
acuuuuugguggauguaaaua

SEQ ID NO: 2083922 - RNA, 11 nt, Human
acuuuuuccag

SEQ ID NO: 2083923 - RNA, 19 nt, Human
acuuugggaggcugaggug

SEQ ID NO: 2083924 - RNA, 14 nt, Human
acuuuuggaaucua

SEQ ID NO: 2083925 - RNA, 21 nt, Human
acuuuuggaaucuagaagaaa

SEQ ID NO: 2083926 - RNA, 23 nt, Human
acuuuuggaaucuagaagaaaug

SEQ ID NO: 2083927 - RNA, 19 nt, Human
acuuugguacauggccagu

SEQ ID NO: 2083928 - RNA, 19 nt, Human
acuuugggaggcugaggcg

SEQ ID NO: 2083929 - RNA, 19 nt, Human
acuuugggauucuuuccau

SEQ ID NO: 2083930 - RNA, 19 nt, Human
acuuugaggguguauauuu

SEQ ID NO: 2083931 - RNA, 17 nt, Human
acuuugggaggcugagg

SEQ ID NO: 2083932 - RNA, 17 nt, Human
acuuugggaggccaagg

SEQ ID NO: 2083933 - RNA, 16 nt, Human
acuuugggaggccaag

SEQ ID NO: 2083934 - RNA, 12 nt, Human
acuuugggaggc

SEQ ID NO: 2083935 - RNA, 14 nt, Human
acuuugggaggcca

SEQ ID NO: 2083936 - RNA, 17 nt, Human
acuuguuuuaugcucag

SEQ ID NO: 2083937 - RNA, 20 nt, Human
acuugugugugggcugugag

SEQ ID NO: 2083938 - RNA, 21 nt, Human
acuugugugugggcugugagu

SEQ ID NO: 2083939 - RNA, 22 nt, Human
acuugugugugggcugugagug

SEQ ID NO: 2083940 - RNA, 23 nt, Human
acuugugugugggcugugagugu

SEQ ID NO: 2083941 - RNA, 15 nt, Human
ucuccucucucugua

SEQ ID NO: 2083942 - RNA, 16 nt, Human
acuguagauugcuucu

SEQ ID NO: 2083943 - RNA, 17 nt, Human
acuguagauugcuucug

SEQ ID NO: 2083944 - RNA, 18 nt, Human
acuguagauugcuucugu

SEQ ID NO: 2083945 - RNA, 20 nt, Human
acuguagauugcuucuguag

SEQ ID NO: 2083946 - RNA, 21 nt, Human
acuguagauugcuucuguagu

SEQ ID NO: 2083947 - RNA, 22 nt, Human
acuguagauugcuucuguagua

SEQ ID NO: 2083948 - RNA, 22 nt, Human
acuguagccucgccgucuguga

SEQ ID NO: 2083949 - RNA, 13 nt, Human
acuguagucucag

SEQ ID NO: 2083950 - RNA, 15 nt, Human
acuguagucucagga

SEQ ID NO: 2083951 - RNA, 16 nt, Human
acuguagucucaggac

SEQ ID NO: 2083952 - RNA, 18 nt, Human
acuguaguuuuucuucaa

SEQ ID NO: 2083953 - RNA, 20 nt, Human
acuguaguuuuucuucaaca

SEQ ID NO: 2083954 - RNA, 21 nt, Human
acuguauaccccgugaagcau

SEQ ID NO: 2083955 - RNA, 21 nt, Human
acuguaguuuuucuucaacau

SEQ ID NO: 2083956 - RNA, 12 nt, Human
ucucccacacug

SEQ ID NO: 2083957 - RNA, 13 nt, Human
ucucccaggccag

SEQ ID NO: 2083958 - RNA, 14 nt, Human
ucucccaggccagg

SEQ ID NO: 2083959 - RNA, 18 nt, Human
ucucccaggccaggcucc

SEQ ID NO: 2083960 - RNA, 23 nt, Human
ucucccaggccaggcuccuuccu

SEQ ID NO: 2083961 - RNA, 22 nt, Human
ucucccagggcuacucacucaa

SEQ ID NO: 2083962 - RNA, 12 nt, Human
ugcaguuuuccu

SEQ ID NO: 2083963 - RNA, 15 nt, Human
ugcagugagccaaga

SEQ ID NO: 2083964 - RNA, 22 nt, Human
ugcagugacgugcaccuguacu

SEQ ID NO: 2083965 - RNA, 11 nt, Human
ugcauaaaaug

SEQ ID NO: 2083966 - RNA, 17 nt, Human
ugcauaaaauuggauua

SEQ ID NO: 2083967 - RNA, 17 nt, Human
ugcauaaagucagugcc

SEQ ID NO: 2083968 - RNA, 23 nt, Human
ugcauaauaagcuaaagaggcug

SEQ ID NO: 2083969 - RNA, 24 nt, Human
ugcauaauaagcuaaagaggcuga

SEQ ID NO: 2083970 - RNA, 19 nt, Human
ugcauaauaagcuaaagag

SEQ ID NO: 2083971 - RNA, 22 nt, Human
ugcauaauaagcuaaagaggcu

SEQ ID NO: 2083972 - RNA, 13 nt, Human
ugcagugaauugu

SEQ ID NO: 2083973 - RNA, 18 nt, Human
ugcagugacgugcaccug

SEQ ID NO: 2083974 - RNA, 19 nt, Human
ugcagugacgugcaccugu

SEQ ID NO: 2083975 - RNA, 14 nt, Human
ugcagugagccgag

SEQ ID NO: 2083976 - RNA, 19 nt, Human
ugcagccucaaccuccugg

SEQ ID NO: 2083977 - RNA, 18 nt, Human
ugcagccucaaccuccug

SEQ ID NO: 2083978 - RNA, 14 nt, Human
ugcagcugauuuua

SEQ ID NO: 2083979 - RNA, 15 nt, Human
ugcagcugauuuuaa

SEQ ID NO: 2083980 - RNA, 16 nt, Human
ugcagcugauuuuaac

SEQ ID NO: 2083981 - RNA, 18 nt, Human
ugcagcugauuuuaacaa

SEQ ID NO: 2083982 - RNA, 19 nt, Human
ugcagcugauuuuaacaau

SEQ ID NO: 2083983 - RNA, 20 nt, Human
ugcagcugauuuuaacaaua

SEQ ID NO: 2083984 - RNA, 22 nt, Human
ugcagcugauuuuaacaauaac

SEQ ID NO: 2083985 - RNA, 22 nt, Human
ugcagcuuccuuuugagggaca

SEQ ID NO: 2083986 - RNA, 16 nt, Human
agccuacagaugaacu

SEQ ID NO: 2083987 - RNA, 14 nt, Human
agccucaaaugcag

SEQ ID NO: 2083988 - RNA, 15 nt, Human
agccucagcauccug

SEQ ID NO: 2083989 - RNA, 14 nt, Human
agccucagcauccu

SEQ ID NO: 2083990 - RNA, 13 nt, Human
agccucagcaucc

SEQ ID NO: 2083991 - RNA, 18 nt, Human
agccucaaccuccugggc

SEQ ID NO: 2083992 - RNA, 17 nt, Human
agccucaaccuccuggg

SEQ ID NO: 2083993 - RNA, 23 nt, Human
ugcaugcugcuuuaauugugaau

SEQ ID NO: 2083994 - RNA, 23 nt, Human
agccugcaguuauuaacacuaac

SEQ ID NO: 2083995 - RNA, 16 nt, Human
agccugccucuucucu

SEQ ID NO: 2083996 - RNA, 19 nt, Human
agccugccucuucucuacu

SEQ ID NO: 2083997 - RNA, 17 nt, Human
ugcacguauuuuaauag

SEQ ID NO: 2083998 - RNA, 22 nt, Human
ugcacguaguagggucaggcca

SEQ ID NO: 2083999 - RNA, 12 nt, Human
ugcacguggaga

SEQ ID NO: 2084000 - RNA, 16 nt, Human
ugcacguggagagcug

SEQ ID NO: 2084001 - RNA, 17 nt, Human
ugcacguggagagcugg

SEQ ID NO: 2084002 - RNA, 18 nt, Human
ugcacguggagagcuggu

SEQ ID NO: 2084003 - RNA, 20 nt, Human
ugcacguggagagcuggugc

SEQ ID NO: 2084004 - RNA, 19 nt, Human
ugcacguaguagggucagg

SEQ ID NO: 2084005 - RNA, 14 nt, Human
ugcaccacugcacu

SEQ ID NO: 2084006 - RNA, 22 nt, Human
ugcacuauagccuaggugacag

SEQ ID NO: 2084007 - RNA, 19 nt, Human
ugcacuccagccugggcga

SEQ ID NO: 2084008 - RNA, 21 nt, Human
ugcacguggagagcuggugcc

SEQ ID NO: 2084009 - RNA, 16 nt, Human
agcagcaacacaaugu

SEQ ID NO: 2084010 - RNA, 13 nt, Human
ugcacaaugucuu

SEQ ID NO: 2084011 - RNA, 14 nt, Human
ugcacaaugucuug

SEQ ID NO: 2084012 - RNA, 15 nt, Human
ugcacacaccagagc

SEQ ID NO: 2084013 - RNA, 14 nt, Human
ugcacaagcugcac

SEQ ID NO: 2084014 - RNA, 20 nt, Human
ugcagacucuacagaggcca

SEQ ID NO: 2084015 - RNA, 19 nt, Human
ugcagacucuacagaggcc

SEQ ID NO: 2084016 - RNA, 16 nt, Human
ugcagaaaagcaccug

SEQ ID NO: 2084017 - RNA, 14 nt, Human
ugcagaaacagauu

SEQ ID NO: 2084018 - RNA, 17 nt, Human
ugcagaaacagauuugg

SEQ ID NO: 2084019 - RNA, 21 nt, Human
ugcagaaaagcaccugccgac

SEQ ID NO: 2084020 - RNA, 22 nt, Human
ugcagaaaagcaccugccgacc

SEQ ID NO: 2084021 - RNA, 17 nt, Human
ugcagaaaagcaccugc

SEQ ID NO: 2084022 - RNA, 18 nt, Human
ugcagaaaagcaccugcc

SEQ ID NO: 2084023 - RNA, 19 nt, Human
ugcagaaaagcaccugccg

SEQ ID NO: 2084024 - RNA, 20 nt, Human
ugcagaaaagcaccugccga

SEQ ID NO: 2084025 - RNA, 14 nt, Human
agcccuucauuugg

SEQ ID NO: 2084026 - RNA, 13 nt, Human
agcccuucauuug

SEQ ID NO: 2084027 - RNA, 19 nt, Human
ugcagagaugcgguggcua

SEQ ID NO: 2084028 - RNA, 23 nt, Human
agcccuuccaugucgccucugca

SEQ ID NO: 2084029 - RNA, 22 nt, Human
agcccuuccaugucgccucugc

SEQ ID NO: 2084030 - RNA, 19 nt, Human
agcccuuccaugucgccuc

SEQ ID NO: 2084031 - RNA, 22 nt, Human
ugcagacucuacagaggccaug

SEQ ID NO: 2084032 - RNA, 13 nt, Human
ugcagacuggagg

SEQ ID NO: 2084033 - RNA, 17 nt, Human
ugcagacuggaggggac

SEQ ID NO: 2084034 - RNA, 14 nt, Human
ugcagacuggaggg

SEQ ID NO: 2084035 - RNA, 16 nt, Human
ugcagacuggagggga

SEQ ID NO: 2084036 - RNA, 24 nt, Human
ugcagagacagagaggacgugggc

SEQ ID NO: 2084037 - RNA, 17 nt, Human
ugcagagacaggaccug

SEQ ID NO: 2084038 - RNA, 20 nt, Human
ugcagagacaggaccugacu

SEQ ID NO: 2084039 - RNA, 15 nt, Human
agccucaaccuccug

SEQ ID NO: 2084040 - RNA, 15 nt, Human
agccuauuguaaaua

SEQ ID NO: 2084041 - RNA, 22 nt, Human
agccuaguucauccaauccuca

SEQ ID NO: 2084042 - RNA, 11 nt, Human
agccuauggca

SEQ ID NO: 2084043 - RNA, 17 nt, Human
agccuaggugacagagu

SEQ ID NO: 2084044 - RNA, 15 nt, Human
agccuaggugacaga

SEQ ID NO: 2084045 - RNA, 14 nt, Human
agccuaguucaucc

SEQ ID NO: 2084046 - RNA, 15 nt, Human
agccuaguucaucca

SEQ ID NO: 2084047 - RNA, 17 nt, Human
agccuaguucauccaau

SEQ ID NO: 2084048 - RNA, 20 nt, Human
agccuaguucauccaauccu

SEQ ID NO: 2084049 - RNA, 23 nt, Human
agccuaguucauccaauccucac

SEQ ID NO: 2084050 - RNA, 20 nt, Human
agccuaggggucagggacca

SEQ ID NO: 2084051 - RNA, 23 nt, Human
agccuaggggucagggaccaagg

SEQ ID NO: 2084052 - RNA, 20 nt, Human
agcccuugagcuccccaaaa

SEQ ID NO: 2084053 - RNA, 16 nt, Human
agcccuugaagauauc

SEQ ID NO: 2084054 - RNA, 19 nt, Human
agcccuugaagucacccgg

SEQ ID NO: 2084055 - RNA, 17 nt, Human
agcccuugagcucccca

SEQ ID NO: 2084056 - RNA, 18 nt, Human
agccuaagaugaagagga

SEQ ID NO: 2084057 - RNA, 23 nt, Human
agccuaaucccugggcauugcuu

SEQ ID NO: 2084058 - RNA, 14 nt, Human
agccuaggggucag

SEQ ID NO: 2084059 - RNA, 14 nt, Human
agccuacaggccuc

SEQ ID NO: 2084060 - RNA, 22 nt, Human
agccuaccggcaauuuccggcc

SEQ ID NO: 2084061 - RNA, 13 nt, Human
agccuacaggccu

SEQ ID NO: 2084062 - RNA, 15 nt, Human
agccuaaucccuggg

SEQ ID NO: 2084063 - RNA, 22 nt, Human
agccuaaucccugggcauugcu

SEQ ID NO: 2084064 - RNA, 16 nt, Human
ugccccgugcagacug

SEQ ID NO: 2084065 - RNA, 18 nt, Human
ugccccgugcagacugga

SEQ ID NO: 2084066 - RNA, 20 nt, Human
ugccccgucaccaucucagg

SEQ ID NO: 2084067 - RNA, 21 nt, Human
ugccccgucaccaucucaggc

SEQ ID NO: 2084068 - RNA, 22 nt, Human
ugcccccugguggacaguccug

SEQ ID NO: 2084069 - RNA, 12 nt, Human
ugcccccuucuc

SEQ ID NO: 2084070 - RNA, 13 nt, Human
ugcccccuucucc

SEQ ID NO: 2084071 - RNA, 15 nt, Human
ugcccccuucuccca

SEQ ID NO: 2084072 - RNA, 16 nt, Human
ugcccccuucucccac

SEQ ID NO: 2084073 - RNA, 17 nt, Human
ugcccccuucucccaca

SEQ ID NO: 2084074 - RNA, 18 nt, Human
ugcccccuucucccacac

SEQ ID NO: 2084075 - RNA, 19 nt, Human
ugcccccuucucccacacu

SEQ ID NO: 2084076 - RNA, 20 nt, Human
ugcccccuucucccacacug

SEQ ID NO: 2084077 - RNA, 22 nt, Human
ugcccccuucucccacacugcu

SEQ ID NO: 2084078 - RNA, 17 nt, Human
ugccccgucaccaucuc

SEQ ID NO: 2084079 - RNA, 18 nt, Human
ugccccgucaccaucuca

SEQ ID NO: 2084080 - RNA, 19 nt, Human
ugccccgucaccaucucag

SEQ ID NO: 2084081 - RNA, 21 nt, Human
ugccccgugcagacuggaggg

SEQ ID NO: 2084082 - RNA, 23 nt, Human
ugcccuagagcacacuguagcau

SEQ ID NO: 2084083 - RNA, 16 nt, Human
ugcccuagaugagccc

SEQ ID NO: 2084084 - RNA, 13 nt, Human
ugcccuagcucca

SEQ ID NO: 2084085 - RNA, 14 nt, Human
ugcccuagcuccac

SEQ ID NO: 2084086 - RNA, 14 nt, Human
ugcccuaggcuccg

SEQ ID NO: 2084087 - RNA, 16 nt, Human
ugcccucaaucccagc

SEQ ID NO: 2084088 - RNA, 18 nt, Human
ugcccuaggcuccgucag

SEQ ID NO: 2084089 - RNA, 14 nt, Human
ugccccccacccca

SEQ ID NO: 2084090 - RNA, 15 nt, Human
ugccccccaccccag

SEQ ID NO: 2084091 - RNA, 16 nt, Human
ugccccccaccccagc

SEQ ID NO: 2084092 - RNA, 17 nt, Human
ugccccccaccccagcc

SEQ ID NO: 2084093 - RNA, 12 nt, Human
ugccccccaccc

SEQ ID NO: 2084094 - RNA, 13 nt, Human
ugccccccacccc

SEQ ID NO: 2084095 - RNA, 18 nt, Human
ugccccccaccccagccu

SEQ ID NO: 2084096 - RNA, 20 nt, Human
ugccccccaccccagccuaa

SEQ ID NO: 2084097 - RNA, 12 nt, Human
ugcccccuggug

SEQ ID NO: 2084098 - RNA, 13 nt, Human
ugcccccuggugg

SEQ ID NO: 2084099 - RNA, 21 nt, Human
ugcccccugguggacaguccu

SEQ ID NO: 2084100 - RNA, 11 nt, Human
ugcccaggccc

SEQ ID NO: 2084101 - RNA, 20 nt, Human
ugcccaggcaggucuugaac

SEQ ID NO: 2084102 - RNA, 17 nt, Human
ugcccaggcaggucuug

SEQ ID NO: 2084103 - RNA, 16 nt, Human
ugcccaggcaggucuu

SEQ ID NO: 2084104 - RNA, 16 nt, Human
ugcccacacaccccaa

SEQ ID NO: 2084105 - RNA, 16 nt, Human
ugcccaagcccugaga

SEQ ID NO: 2084106 - RNA, 18 nt, Human
ugcccaagcccugagagu

SEQ ID NO: 2084107 - RNA, 14 nt, Human
ugcccaacuguuau

SEQ ID NO: 2084108 - RNA, 15 nt, Human
ugcccaggcaggucu

SEQ ID NO: 2084109 - RNA, 14 nt, Human
ugcccacaggauca

SEQ ID NO: 2084110 - RNA, 22 nt, Human
ugcccaggccccugccacccug

SEQ ID NO: 2084111 - RNA, 20 nt, Human
ugcccaggccccugccaccc

SEQ ID NO: 2084112 - RNA, 14 nt, Human
ugcccaggccccug

SEQ ID NO: 2084113 - RNA, 12 nt, Human
ugcccaggcccc

SEQ ID NO: 2084114 - RNA, 17 nt, Human
ugcccaggccugccugu

SEQ ID NO: 2084115 - RNA, 15 nt, Human
ugcccaggccugccu

SEQ ID NO: 2084116 - RNA, 11 nt, Human
ugcccacagcc

SEQ ID NO: 2084117 - RNA, 12 nt, Human
ugcccacagccc

SEQ ID NO: 2084118 - RNA, 21 nt, Human
ugcccacagcccgcaugcagc

SEQ ID NO: 2084119 - RNA, 22 nt, Human
agcuaugggagccccagggucu

SEQ ID NO: 2084120 - RNA, 18 nt, Human
agcuaugggagccccagg

SEQ ID NO: 2084121 - RNA, 19 nt, Human
agcuaugggagccccaggg

SEQ ID NO: 2084122 - RNA, 17 nt, Human
agcuaugggagccccag

SEQ ID NO: 2084123 - RNA, 14 nt, Human
agcuauauccaugu

SEQ ID NO: 2084124 - RNA, 15 nt, Human
agcuauauccaugua

SEQ ID NO: 2084125 - RNA, 19 nt, Human
agcuauagacccgaggaaa

SEQ ID NO: 2084126 - RNA, 17 nt, Human
agcuauagacccgagga

SEQ ID NO: 2084127 - RNA, 18 nt, Human
agcuauagacccgaggaa

SEQ ID NO: 2084128 - RNA, 23 nt, Human
agcuauugauauaaauaaaacau

SEQ ID NO: 2084129 - RNA, 17 nt, Human
agcuauugauauaaaua

SEQ ID NO: 2084130 - RNA, 12 nt, Human
agcuaguuuucu

SEQ ID NO: 2084131 - RNA, 13 nt, Human
agcuauacaguuu

SEQ ID NO: 2084132 - RNA, 19 nt, Human
agcuauacaguuuuccuaa

SEQ ID NO: 2084133 - RNA, 14 nt, Human
agcuacuugggagg

SEQ ID NO: 2084134 - RNA, 21 nt, Human
agcuacucagaagccugaggc

SEQ ID NO: 2084135 - RNA, 22 nt, Human
agcuacucaagaggcugaggca

SEQ ID NO: 2084136 - RNA, 13 nt, Human
agcuacucaggag

SEQ ID NO: 2084137 - RNA, 15 nt, Human
agcuacucaggaggc

SEQ ID NO: 2084138 - RNA, 17 nt, Human
agcuacucaggaggcug

SEQ ID NO: 2084139 - RNA, 18 nt, Human
agcuacucaggaggcuga

SEQ ID NO: 2084140 - RNA, 18 nt, Human
agcuacuccggaggcuga

SEQ ID NO: 2084141 - RNA, 19 nt, Human
agcuacuccggaggcugag

SEQ ID NO: 2084142 - RNA, 19 nt, Human
ugccauguuggccaggcug

SEQ ID NO: 2084143 - RNA, 18 nt, Human
ugccauguuggccaggcu

SEQ ID NO: 2084144 - RNA, 17 nt, Human
ugccauguuggccaggc

SEQ ID NO: 2084145 - RNA, 22 nt, Human
agcuauuuuuauuuguuugugc

SEQ ID NO: 2084146 - RNA, 10 nt, Human
agcuauuuuu

SEQ ID NO: 2084147 - RNA, 21 nt, Human
ugccauguuggccaggcuggu

SEQ ID NO: 2084148 - RNA, 20 nt, Human
ugccauguuggccaggcugg

SEQ ID NO: 2084149 - RNA, 18 nt, Human
ugccauguuuugccaccc

SEQ ID NO: 2084150 - RNA, 21 nt, Human
ugccauguuuugccacccccu

SEQ ID NO: 2084151 - RNA, 24 nt, Human
ugcccaaccugcucuccucuugcc

SEQ ID NO: 2084152 - RNA, 23 nt, Human
ugcccaaccugcucuccucuugc

SEQ ID NO: 2084153 - RNA, 13 nt, Human
ugcccaaccucag

SEQ ID NO: 2084154 - RNA, 14 nt, Human
ugcccaaccucagc

SEQ ID NO: 2084155 - RNA, 15 nt, Human
ugcccaaccucagca

SEQ ID NO: 2084156 - RNA, 17 nt, Human
ugcccaaccucagcaac

SEQ ID NO: 2084157 - RNA, 18 nt, Human
ugcccaaccucagcaacc

SEQ ID NO: 2084158 - RNA, 19 nt, Human
ugcccaaccucagcaaccu

SEQ ID NO: 2084159 - RNA, 22 nt, Human
ugcccaaccugcucuccucuug

SEQ ID NO: 2084160 - RNA, 18 nt, Human
ugcccaaccugcucuccu

SEQ ID NO: 2084161 - RNA, 15 nt, Human
ugccauauucuguug

SEQ ID NO: 2084162 - RNA, 17 nt, Human
ugccauauucuguuggc

SEQ ID NO: 2084163 - RNA, 16 nt, Human
ugccauauucuguugg

SEQ ID NO: 2084164 - RNA, 17 nt, Human
ugccagucccccugccc

SEQ ID NO: 2084165 - RNA, 20 nt, Human
ugccacuucacuccagccug

SEQ ID NO: 2084166 - RNA, 19 nt, Human
ugccagucccccugcccca

SEQ ID NO: 2084167 - RNA, 12 nt, Human
ugccacacuuca

SEQ ID NO: 2084168 - RNA, 23 nt, Human
ugccacugccucuuccucccuca

SEQ ID NO: 2084169 - RNA, 23 nt, Human
agcgugucuguauuuauguguga

SEQ ID NO: 2084170 - RNA, 21 nt, Human
agcuacucaagaggcugaggc

SEQ ID NO: 2084171 - RNA, 14 nt, Human
agcuacucagaagc

SEQ ID NO: 2084172 - RNA, 15 nt, Human
agcuacucagaagcc

SEQ ID NO: 2084173 - RNA, 18 nt, Human
agcuacucagaagccuga

SEQ ID NO: 2084174 - RNA, 19 nt, Human
agcuacucagaagccugag

SEQ ID NO: 2084175 - RNA, 20 nt, Human
agcuacucagaagccugagg

SEQ ID NO: 2084176 - RNA, 17 nt, Human
agcgugagccacugcac

SEQ ID NO: 2084177 - RNA, 16 nt, Human
agcgugagccacugca

SEQ ID NO: 2084178 - RNA, 21 nt, Human
ugccauauucuguuggccagu

SEQ ID NO: 2084179 - RNA, 20 nt, Human
ugccauauucuguuggccag

SEQ ID NO: 2084180 - RNA, 15 nt, Human
agcggggacagcucc

SEQ ID NO: 2084181 - RNA, 17 nt, Human
agcggggacagcuccuu

SEQ ID NO: 2084182 - RNA, 16 nt, Human
agcggggacagcuccu

SEQ ID NO: 2084183 - RNA, 15 nt, Human
agcgugagccacugc

SEQ ID NO: 2084184 - RNA, 13 nt, Human
agcgggcgccugu

SEQ ID NO: 2084185 - RNA, 13 nt, Human
agcgugagccacu

SEQ ID NO: 2084186 - RNA, 14 nt, Human
ugcauuuccugaca

SEQ ID NO: 2084187 - RNA, 13 nt, Human
ugcauuuccugac

SEQ ID NO: 2084188 - RNA, 21 nt, Human
agcggcugagucaugaucucc

SEQ ID NO: 2084189 - RNA, 13 nt, Human
ugccacacagagu

SEQ ID NO: 2084190 - RNA, 20 nt, Human
ugccacacagaguggucuuu

SEQ ID NO: 2084191 - RNA, 23 nt, Human
ugccacacagaguggucuuucug

SEQ ID NO: 2084192 - RNA, 16 nt, Human
ugccacacgucugacc

SEQ ID NO: 2084193 - RNA, 13 nt, Human
ugcauuugagguc

SEQ ID NO: 2084194 - RNA, 22 nt, Human
agcgcccaguuggguggaugcc

SEQ ID NO: 2084195 - RNA, 14 nt, Human
agcgcccaguuggg

SEQ ID NO: 2084196 - RNA, 14 nt, Human
agccugcuccagcu

SEQ ID NO: 2084197 - RNA, 18 nt, Human
agccugcggccugcugga

SEQ ID NO: 2084198 - RNA, 15 nt, Human
agccugcguggcuga

SEQ ID NO: 2084199 - RNA, 16 nt, Human
agccugcguggcugac

SEQ ID NO: 2084200 - RNA, 17 nt, Human
agccugcguggcugacc

SEQ ID NO: 2084201 - RNA, 18 nt, Human
agccugcguggcugaccc

SEQ ID NO: 2084202 - RNA, 19 nt, Human
agccugcguggcugacccc

SEQ ID NO: 2084203 - RNA, 21 nt, Human
agccugcguggcugacccccc

SEQ ID NO: 2084204 - RNA, 23 nt, Human
agccugcguggcugaccccccuc

SEQ ID NO: 2084205 - RNA, 11 nt, Human
agccugccugg

SEQ ID NO: 2084206 - RNA, 14 nt, Human
agccugccuggagu

SEQ ID NO: 2084207 - RNA, 22 nt, Human
agcgcgccacucgcuuccccca

SEQ ID NO: 2084208 - RNA, 12 nt, Human
agcgcgccacuc

SEQ ID NO: 2084209 - RNA, 19 nt, Human
agcgcgccacucgcuuccc

SEQ ID NO: 2084210 - RNA, 20 nt, Human
agcgcgccacucgcuucccc

SEQ ID NO: 2084211 - RNA, 20 nt, Human
agcgcuagaggaagcagcca

SEQ ID NO: 2084212 - RNA, 19 nt, Human
agcgcuagaggaagcagcc

SEQ ID NO: 2084213 - RNA, 17 nt, Human
agcgcugccgcacccca

SEQ ID NO: 2084214 - RNA, 18 nt, Human
agcgcugccgcaccccag

SEQ ID NO: 2084215 - RNA, 19 nt, Human
agcgcugccgcaccccaga

SEQ ID NO: 2084216 - RNA, 16 nt, Human
agcggcugagucauga

SEQ ID NO: 2084217 - RNA, 19 nt, Human
agcggcugagucaugaucu

SEQ ID NO: 2084218 - RNA, 17 nt, Human
agcuggagaaauauggu

SEQ ID NO: 2084219 - RNA, 16 nt, Human
agcuggaccucaccaa

SEQ ID NO: 2084220 - RNA, 15 nt, Human
agcuggaccucacca

SEQ ID NO: 2084221 - RNA, 15 nt, Human
agcuggaccaguggu

SEQ ID NO: 2084222 - RNA, 18 nt, Human
agcuggaauuuuuuauuc

SEQ ID NO: 2084223 - RNA, 21 nt, Human
agcuggaauuuuuuauucuug

SEQ ID NO: 2084224 - RNA, 23 nt, Human
agcuggaauuuuuuauucuugug

SEQ ID NO: 2084225 - RNA, 21 nt, Human
agcugccuggaagagcagccc

SEQ ID NO: 2084226 - RNA, 20 nt, Human
agcugccuggaagagcagcc

SEQ ID NO: 2084227 - RNA, 18 nt, Human
agcugccucccuguccac

SEQ ID NO: 2084228 - RNA, 20 nt, Human
agcugccucucgguggccag

SEQ ID NO: 2084229 - RNA, 22 nt, Human
ugccucugacacacagcucugu

SEQ ID NO: 2084230 - RNA, 13 nt, Human
agcugggagaagg

SEQ ID NO: 2084231 - RNA, 12 nt, Human
agcugggaggaa

SEQ ID NO: 2084232 - RNA, 13 nt, Human
agcugggaggaaa

SEQ ID NO: 2084233 - RNA, 14 nt, Human
agcugggaggaaaa

SEQ ID NO: 2084234 - RNA, 15 nt, Human
agcugggaggaaaag

SEQ ID NO: 2084235 - RNA, 18 nt, Human
agcugggaggaaaagaaa

SEQ ID NO: 2084236 - RNA, 19 nt, Human
agcugggacuacaggugug

SEQ ID NO: 2084237 - RNA, 17 nt, Human
agcugggacuacaggug

SEQ ID NO: 2084238 - RNA, 14 nt, Human
agcugggaucugac

SEQ ID NO: 2084239 - RNA, 16 nt, Human
agcugggaucugacug

SEQ ID NO: 2084240 - RNA, 19 nt, Human
agcugggaucugacugcac

SEQ ID NO: 2084241 - RNA, 21 nt, Human
agcugggaucugacugcacgu

SEQ ID NO: 2084242 - RNA, 14 nt, Human
agcugggcagguug

SEQ ID NO: 2084243 - RNA, 17 nt, Human
agcugggauguuucugu

SEQ ID NO: 2084244 - RNA, 16 nt, Human
agcugggcagaaggcc

SEQ ID NO: 2084245 - RNA, 18 nt, Human
agcugggcagaaggccaa

SEQ ID NO: 2084246 - RNA, 19 nt, Human
ugcgaaaggaugaaaguga

SEQ ID NO: 2084247 - RNA, 16 nt, Human
ugcgaaggggcccugg

SEQ ID NO: 2084248 - RNA, 21 nt, Human
ugcgaaggggcccugguccuu

SEQ ID NO: 2084249 - RNA, 18 nt, Human
ugcgaaggggcccugguc

SEQ ID NO: 2084250 - RNA, 22 nt, Human
ugcgaaugguagucuaaccaaa

SEQ ID NO: 2084251 - RNA, 23 nt, Human
ugcgaaugguagucuaaccaaau

SEQ ID NO: 2084252 - RNA, 22 nt, Human
ugcgaaugguuccauucucucu

SEQ ID NO: 2084253 - RNA, 18 nt, Human
ugcggacagccacggcca

SEQ ID NO: 2084254 - RNA, 15 nt, Human
ugcgacggagagaaa

SEQ ID NO: 2084255 - RNA, 16 nt, Human
ugcgacggagagaaaa

SEQ ID NO: 2084256 - RNA, 19 nt, Human
ugcgacggagagaaaaaag

SEQ ID NO: 2084257 - RNA, 13 nt, Human
ugcgaaaggauga

SEQ ID NO: 2084258 - RNA, 17 nt, Human
ugccuguucagcuccag

SEQ ID NO: 2084259 - RNA, 19 nt, Human
ugccuuaccuccugcccag

SEQ ID NO: 2084260 - RNA, 20 nt, Human
ugccuuaccuccugcccagg

SEQ ID NO: 2084261 - RNA, 21 nt, Human
ugccuuaccuccugcccagga

SEQ ID NO: 2084262 - RNA, 16 nt, Human
ugccuguucagcucca

SEQ ID NO: 2084263 - RNA, 15 nt, Human
ugccuguucagcucc

SEQ ID NO: 2084264 - RNA, 21 nt, Human
ugccugugugacaucaguggc

SEQ ID NO: 2084265 - RNA, 17 nt, Human
ugccuuagaaccuuucu

SEQ ID NO: 2084266 - RNA, 14 nt, Human
ugccuuagaaccuu

SEQ ID NO: 2084267 - RNA, 15 nt, Human
ugccuuacuuuguau

SEQ ID NO: 2084268 - RNA, 17 nt, Human
ugccuuacuuuguauga

SEQ ID NO: 2084269 - RNA, 18 nt, Human
ugccuuacuuuguaugau

SEQ ID NO: 2084270 - RNA, 19 nt, Human
ugccuuacuuuguaugaua

SEQ ID NO: 2084271 - RNA, 21 nt, Human
ugccuuagaaccuuucuuaca

SEQ ID NO: 2084272 - RNA, 15 nt, Human
agcugugacccucaa

SEQ ID NO: 2084273 - RNA, 23 nt, Human
ugccuuaccuccugcccaggaga

SEQ ID NO: 2084274 - RNA, 20 nt, Human
agcuggggaagcuucuuaaa

SEQ ID NO: 2084275 - RNA, 20 nt, Human
agcugggggccaugagcucc

SEQ ID NO: 2084276 - RNA, 16 nt, Human
agcugggggccaugag

SEQ ID NO: 2084277 - RNA, 18 nt, Human
agcugggggccaugagcu

SEQ ID NO: 2084278 - RNA, 16 nt, Human
agcugccaagccccau

SEQ ID NO: 2084279 - RNA, 15 nt, Human
agcugccaaguaaau

SEQ ID NO: 2084280 - RNA, 22 nt, Human
agcugccaaguaaauagcaaca

SEQ ID NO: 2084281 - RNA, 12 nt, Human
agcugccagaga

SEQ ID NO: 2084282 - RNA, 13 nt, Human
agcugccagagaa

SEQ ID NO: 2084283 - RNA, 19 nt, Human
ugcccuuggaggccagcca

SEQ ID NO: 2084284 - RNA, 16 nt, Human
ugcccuugucccacuc

SEQ ID NO: 2084285 - RNA, 17 nt, Human
ugcccuugucccacuca

SEQ ID NO: 2084286 - RNA, 14 nt, Human
agcugccagagaag

SEQ ID NO: 2084287 - RNA, 17 nt, Human
ugcccuuggaggccagc

SEQ ID NO: 2084288 - RNA, 22 nt, Human
agcugcaccugccagccuggcu

SEQ ID NO: 2084289 - RNA, 18 nt, Human
agcugcaccugccagccu

SEQ ID NO: 2084290 - RNA, 21 nt, Human
agcugcaccugccagccuggc

SEQ ID NO: 2084291 - RNA, 15 nt, Human
agcugcaucuacuca

SEQ ID NO: 2084292 - RNA, 19 nt, Human
agcugauuuuaacaauaac

SEQ ID NO: 2084293 - RNA, 16 nt, Human
agcugcaccugccagc

SEQ ID NO: 2084294 - RNA, 15 nt, Human
agcugauuuuaacaa

SEQ ID NO: 2084295 - RNA, 16 nt, Human
agcugauuuuaacaau

SEQ ID NO: 2084296 - RNA, 13 nt, Human
ugccgaaacugga

SEQ ID NO: 2084297 - RNA, 15 nt, Human
ugccgaaacuggaag

SEQ ID NO: 2084298 - RNA, 16 nt, Human
ugccgaaacuggaagu

SEQ ID NO: 2084299 - RNA, 18 nt, Human
ugccgaaacuggaaguua

SEQ ID NO: 2084300 - RNA, 17 nt, Human
ugccgccucccagccug

SEQ ID NO: 2084301 - RNA, 18 nt, Human
ugccgccucccagccugg

SEQ ID NO: 2084302 - RNA, 14 nt, Human
ugccggcccugggg

SEQ ID NO: 2084303 - RNA, 15 nt, Human
ugccggcccuggggc

SEQ ID NO: 2084304 - RNA, 16 nt, Human
ugccggcucuggcucu

SEQ ID NO: 2084305 - RNA, 20 nt, Human
ugccucaucuauaacaugca

SEQ ID NO: 2084306 - RNA, 21 nt, Human
ugccucugacacacagcucug

SEQ ID NO: 2084307 - RNA, 20 nt, Human
ugccucugacacacagcucu

SEQ ID NO: 2084308 - RNA, 20 nt, Human
ugccuccaccgcugccuaag

SEQ ID NO: 2084309 - RNA, 14 nt, Human
ugccuccauggugc

SEQ ID NO: 2084310 - RNA, 15 nt, Human
ugccuccauggugcc

SEQ ID NO: 2084311 - RNA, 16 nt, Human
ugccuccauggugccu

SEQ ID NO: 2084312 - RNA, 18 nt, Human
ugccuccauggugccucu

SEQ ID NO: 2084313 - RNA, 20 nt, Human
ugccuccauggugccucugg

SEQ ID NO: 2084314 - RNA, 22 nt, Human
ugccuccauggugccucuggag

SEQ ID NO: 2084315 - RNA, 18 nt, Human
ugccuccaccccccagaa

SEQ ID NO: 2084316 - RNA, 11 nt, Human
ugccuccaccg

SEQ ID NO: 2084317 - RNA, 13 nt, Human
ugccuccaccgcu

SEQ ID NO: 2084318 - RNA, 16 nt, Human
ugccuccaccgcugcc

SEQ ID NO: 2084319 - RNA, 17 nt, Human
ugccuccaccgcugccu

SEQ ID NO: 2084320 - RNA, 18 nt, Human
ugccuccaccgcugccua

SEQ ID NO: 2084321 - RNA, 12 nt, Human
agcucuguccug

SEQ ID NO: 2084322 - RNA, 17 nt, Human
agcucuucuccaggcug

SEQ ID NO: 2084323 - RNA, 21 nt, Human
agcucuggugacaccagccuu

SEQ ID NO: 2084324 - RNA, 13 nt, Human
agcucugcuugcc

SEQ ID NO: 2084325 - RNA, 15 nt, Human
agcucugcuugccga

SEQ ID NO: 2084326 - RNA, 21 nt, Human
agcucugcuugccgaaacugg

SEQ ID NO: 2084327 - RNA, 22 nt, Human
agcucugcuugccgaaacugga

SEQ ID NO: 2084328 - RNA, 23 nt, Human
agcucugcuugccgaaacuggaa

SEQ ID NO: 2084329 - RNA, 17 nt, Human
agcucuggugacaccag

SEQ ID NO: 2084330 - RNA, 19 nt, Human
agcucuggugacaccagcc

SEQ ID NO: 2084331 - RNA, 20 nt, Human
agcucuggugacaccagccu

SEQ ID NO: 2084332 - RNA, 18 nt, Human
agcucuucuccaggcugu

SEQ ID NO: 2084333 - RNA, 14 nt, Human
agcucuucuccauc

SEQ ID NO: 2084334 - RNA, 20 nt, Human
agcucuucugccggcccugg

SEQ ID NO: 2084335 - RNA, 21 nt, Human
agcucuucugccggcccuggg

SEQ ID NO: 2084336 - RNA, 22 nt, Human
agcucuucugccggcccugggg

SEQ ID NO: 2084337 - RNA, 23 nt, Human
agcucuucugccggcccuggggc

SEQ ID NO: 2084338 - RNA, 19 nt, Human
agcucuugaagacacugaa

SEQ ID NO: 2084339 - RNA, 13 nt, Human
agcugcacccuca

SEQ ID NO: 2084340 - RNA, 17 nt, Human
agcugcacccucaggca

SEQ ID NO: 2084341 - RNA, 16 nt, Human
agcugauuacugucaa

SEQ ID NO: 2084342 - RNA, 18 nt, Human
agcugauuacugucaaua

SEQ ID NO: 2084343 - RNA, 19 nt, Human
agcugauuacugucaauaa

SEQ ID NO: 2084344 - RNA, 20 nt, Human
agcugauuacugucaauaaa

SEQ ID NO: 2084345 - RNA, 21 nt, Human
agcugauuacugucaauaaac

SEQ ID NO: 2084346 - RNA, 22 nt, Human
agcugauuacugucaauaaaca

SEQ ID NO: 2084347 - RNA, 14 nt, Human
agcugauuuuaaca

SEQ ID NO: 2084348 - RNA, 18 nt, Human
agcugcacccucaggcag

SEQ ID NO: 2084349 - RNA, 19 nt, Human
agcugcacccucaggcagg

SEQ ID NO: 2084350 - RNA, 20 nt, Human
agcugcacccucaggcaggu

SEQ ID NO: 2084351 - RNA, 22 nt, Human
agcugcacccucaggcaggugg

SEQ ID NO: 2084352 - RNA, 12 nt, Human
agcucugcuccu

SEQ ID NO: 2084353 - RNA, 22 nt, Human
agcucugcuccucuccccagca

SEQ ID NO: 2084354 - RNA, 16 nt, Human
agcucucuccucccuu

SEQ ID NO: 2084355 - RNA, 19 nt, Human
agcucucccucuggcccug

SEQ ID NO: 2084356 - RNA, 20 nt, Human
agcucucccucuggcccugc

SEQ ID NO: 2084357 - RNA, 22 nt, Human
agcucucccucuggcccugccu

SEQ ID NO: 2084358 - RNA, 23 nt, Human
agcucucccucuggcccugccuu

SEQ ID NO: 2084359 - RNA, 11 nt, Human
agcucucccuc

SEQ ID NO: 2084360 - RNA, 13 nt, Human
agcucucccucug

SEQ ID NO: 2084361 - RNA, 14 nt, Human
agcucucccucugg

SEQ ID NO: 2084362 - RNA, 15 nt, Human
agcucucccucuggc

SEQ ID NO: 2084363 - RNA, 16 nt, Human
agcucucccucuggcc

SEQ ID NO: 2084364 - RNA, 17 nt, Human
agcucucccucuggccc

SEQ ID NO: 2084365 - RNA, 18 nt, Human
agcucucccucuggcccu

SEQ ID NO: 2084366 - RNA, 14 nt, Human
ugcccuccacugcc

SEQ ID NO: 2084367 - RNA, 15 nt, Human
ugcccuccacugccc

SEQ ID NO: 2084368 - RNA, 16 nt, Human
ugcccuccacugcccu

SEQ ID NO: 2084369 - RNA, 17 nt, Human
ugcccuccacugcccuc

SEQ ID NO: 2084370 - RNA, 18 nt, Human
ugcccuccacugcccucu

SEQ ID NO: 2084371 - RNA, 19 nt, Human
ugcccuccacugcccucug

SEQ ID NO: 2084372 - RNA, 21 nt, Human
ugcccuccacugcccucuguu

SEQ ID NO: 2084373 - RNA, 12 nt, Human
agcucucagcca

SEQ ID NO: 2084374 - RNA, 13 nt, Human
agcucucagccaa

SEQ ID NO: 2084375 - RNA, 18 nt, Human
ugcccuccacagccgcag

SEQ ID NO: 2084376 - RNA, 21 nt, Human
ugcccuccacagccgcagccu

SEQ ID NO: 2084377 - RNA, 16 nt, Human
aggaaacucaccugcu

SEQ ID NO: 2084378 - RNA, 17 nt, Human
aggaaacucaccugcug

SEQ ID NO: 2084379 - RNA, 20 nt, Human
aggaaacucaccugcuggcc

SEQ ID NO: 2084380 - RNA, 21 nt, Human
aggaaacucaccugcuggccc

SEQ ID NO: 2084381 - RNA, 22 nt, Human
aggaaacucaccugcuggcccc

SEQ ID NO: 2084382 - RNA, 23 nt, Human
aggaaacucaccugcuggccccu

SEQ ID NO: 2084383 - RNA, 17 nt, Human
aggaaagaaagaaggaa

SEQ ID NO: 2084384 - RNA, 21 nt, Human
ugcuauaacuauguugauaaa

SEQ ID NO: 2084385 - RNA, 15 nt, Human
aggaaagauuuguac

SEQ ID NO: 2084386 - RNA, 14 nt, Human
aggaaaauccucug

SEQ ID NO: 2084387 - RNA, 16 nt, Human
aggaaaauaguaaugu

SEQ ID NO: 2084388 - RNA, 12 nt, Human
agcuuugaaaau

SEQ ID NO: 2084389 - RNA, 16 nt, Human
agcuuugaaaauucag

SEQ ID NO: 2084390 - RNA, 18 nt, Human
agcuuugaaaauucagug

SEQ ID NO: 2084391 - RNA, 19 nt, Human
agcuuugaaaauucagugg

SEQ ID NO: 2084392 - RNA, 21 nt, Human
agcuuguaaauagcucaggug

SEQ ID NO: 2084393 - RNA, 20 nt, Human
agcuuguaaauagcucaggu

SEQ ID NO: 2084394 - RNA, 16 nt, Human
agcuuggcuguagaag

SEQ ID NO: 2084395 - RNA, 23 nt, Human
agcuuggcuguagaaggagacag

SEQ ID NO: 2084396 - RNA, 19 nt, Human
agcuuguaaauagcucagg

SEQ ID NO: 2084397 - RNA, 20 nt, Human
agcuuucuguccuuuuggca

SEQ ID NO: 2084398 - RNA, 22 nt, Human
agcuuucuguccuuuuggcacu

SEQ ID NO: 2084399 - RNA, 22 nt, Human
agcuuuccuuuuucccaauaaa

SEQ ID NO: 2084400 - RNA, 23 nt, Human
agcuuuccuuuuucccaauaaau

SEQ ID NO: 2084401 - RNA, 13 nt, Human
agcuuucucugcu

SEQ ID NO: 2084402 - RNA, 15 nt, Human
agcuuucucugcuuc

SEQ ID NO: 2084403 - RNA, 16 nt, Human
agcuuucucugcuuca

SEQ ID NO: 2084404 - RNA, 18 nt, Human
agcuuucucugcuucagc

SEQ ID NO: 2084405 - RNA, 19 nt, Human
agcuuucucugcuucagcu

SEQ ID NO: 2084406 - RNA, 21 nt, Human
agcuuucucugcuucagcuug

SEQ ID NO: 2084407 - RNA, 14 nt, Human
agcuuauuaaugcu

SEQ ID NO: 2084408 - RNA, 15 nt, Human
agcuuauuaaugcua

SEQ ID NO: 2084409 - RNA, 16 nt, Human
agcuuauuaaugcuaa

SEQ ID NO: 2084410 - RNA, 17 nt, Human
agcuuauuaaugcuaag

SEQ ID NO: 2084411 - RNA, 18 nt, Human
agcuuauuaaugcuaagg

SEQ ID NO: 2084412 - RNA, 19 nt, Human
agcuuaucaugcugucuuu

SEQ ID NO: 2084413 - RNA, 23 nt, Human
agcuuggaaacuggaugagguca

SEQ ID NO: 2084414 - RNA, 17 nt, Human
agcuuggaaaggaccag

SEQ ID NO: 2084415 - RNA, 14 nt, Human
agcuuggccagaag

SEQ ID NO: 2084416 - RNA, 19 nt, Human
agcuuauuaaugcuaaggg

SEQ ID NO: 2084417 - RNA, 21 nt, Human
agcuuauuaaugcuaagggca

SEQ ID NO: 2084418 - RNA, 22 nt, Human
agcuuauuaaugcuaagggcag

SEQ ID NO: 2084419 - RNA, 20 nt, Human
agcuugcugcccuaggcucc

SEQ ID NO: 2084420 - RNA, 19 nt, Human
agcuugcuucauugggcug

SEQ ID NO: 2084421 - RNA, 20 nt, Human
agcuugcuucauugggcugu

SEQ ID NO: 2084422 - RNA, 21 nt, Human
ugcggacagccacggccaggc

SEQ ID NO: 2084423 - RNA, 20 nt, Human
ugcggacagccacggccagg

SEQ ID NO: 2084424 - RNA, 14 nt, Human
ugcuaccucacugg

SEQ ID NO: 2084425 - RNA, 15 nt, Human
ugcuaccucacuggg

SEQ ID NO: 2084426 - RNA, 16 nt, Human
ugcuaccucacugggg

SEQ ID NO: 2084427 - RNA, 22 nt, Human
ugcuaccucacugggguccugg

SEQ ID NO: 2084428 - RNA, 14 nt, Human
agcuguuuccauag

SEQ ID NO: 2084429 - RNA, 13 nt, Human
agcuguuugucau

SEQ ID NO: 2084430 - RNA, 15 nt, Human
agcuguuuucccuga

SEQ ID NO: 2084431 - RNA, 18 nt, Human
ugcuaccugaucccacuc

SEQ ID NO: 2084432 - RNA, 19 nt, Human
ugcuaccugaucccacucc

SEQ ID NO: 2084433 - RNA, 23 nt, Human
ugcuaccugaucccacuccuagg

SEQ ID NO: 2084434 - RNA, 20 nt, Human
agcuuaaaggggcuagagug

SEQ ID NO: 2084435 - RNA, 17 nt, Human
agcuuagccaauguggg

SEQ ID NO: 2084436 - RNA, 18 nt, Human
agcuguuuucccugaccu

SEQ ID NO: 2084437 - RNA, 12 nt, Human
agcuuaaaaaaa

SEQ ID NO: 2084438 - RNA, 14 nt, Human
agcuuaaaaaaaac

SEQ ID NO: 2084439 - RNA, 12 nt, Human
agcuuaucucag

SEQ ID NO: 2084440 - RNA, 13 nt, Human
agcuuaucaauuu

SEQ ID NO: 2084441 - RNA, 15 nt, Human
agcuuaucaauuugu

SEQ ID NO: 2084442 - RNA, 16 nt, Human
agcuuaucaauuuguc

SEQ ID NO: 2084443 - RNA, 17 nt, Human
agcuuaucaauuuguca

SEQ ID NO: 2084444 - RNA, 22 nt, Human
agcuuaucaauuugucauuuug

SEQ ID NO: 2084445 - RNA, 23 nt, Human
agcuuaucaauuugucauuuuga

SEQ ID NO: 2084446 - RNA, 15 nt, Human
agcuuaucaugcugu

SEQ ID NO: 2084447 - RNA, 14 nt, Human
agcuuaucucaggg

SEQ ID NO: 2084448 - RNA, 15 nt, Human
agcuuaucucagggg

SEQ ID NO: 2084449 - RNA, 17 nt, Human
ugcugacuguuuucucu

SEQ ID NO: 2084450 - RNA, 22 nt, Human
ugcucugucuucuuugcccaca

SEQ ID NO: 2084451 - RNA, 17 nt, Human
ugcucuggacaggcaug

SEQ ID NO: 2084452 - RNA, 11 nt, Human
ugcucugccca

SEQ ID NO: 2084453 - RNA, 12 nt, Human
ugcucugcccag

SEQ ID NO: 2084454 - RNA, 13 nt, Human
ugcucugcccaga

SEQ ID NO: 2084455 - RNA, 14 nt, Human
ugcucugcccagag

SEQ ID NO: 2084456 - RNA, 15 nt, Human
ugcucugcccagagc

SEQ ID NO: 2084457 - RNA, 17 nt, Human
ugcucugcccagagcug

SEQ ID NO: 2084458 - RNA, 20 nt, Human
ugcucugcccagagcugggu

SEQ ID NO: 2084459 - RNA, 22 nt, Human
ugcucugcccagagcuggguga

SEQ ID NO: 2084460 - RNA, 15 nt, Human
ugcucugcauguuac

SEQ ID NO: 2084461 - RNA, 18 nt, Human
ugcucugcauguuacaua

SEQ ID NO: 2084462 - RNA, 20 nt, Human
ugcuauccugccaaaaucau

SEQ ID NO: 2084463 - RNA, 19 nt, Human
ugcucugaucauccacugu

SEQ ID NO: 2084464 - RNA, 19 nt, Human
ugcuauccagcuauuuuua

SEQ ID NO: 2084465 - RNA, 23 nt, Human
ugcuauauuugugauauaggaau

SEQ ID NO: 2084466 - RNA, 20 nt, Human
ugcuaucaaaauaaauugaa

SEQ ID NO: 2084467 - RNA, 21 nt, Human
ugcuaucaaaauaaauugaaa

SEQ ID NO: 2084468 - RNA, 14 nt, Human
ugcucugauuuauc

SEQ ID NO: 2084469 - RNA, 22 nt, Human
ugcucugaucauccacugugcc

SEQ ID NO: 2084470 - RNA, 22 nt, Human
aggaaagcaauaaaugaauggg

SEQ ID NO: 2084471 - RNA, 18 nt, Human
aggaaagcaauaaaugaa

SEQ ID NO: 2084472 - RNA, 19 nt, Human
aggaaagcaauaaaugaau

SEQ ID NO: 2084473 - RNA, 16 nt, Human
aggaaagcaauaaaug

SEQ ID NO: 2084474 - RNA, 21 nt, Human
ugcugacuguuuucucuugag

SEQ ID NO: 2084475 - RNA, 24 nt, Human
ugcugacuguuuucucuugagagg

SEQ ID NO: 2084476 - RNA, 17 nt, Human
ugcugagggaccagcca

SEQ ID NO: 2084477 - RNA, 19 nt, Human
ugcugagggaccagccaag

SEQ ID NO: 2084478 - RNA, 20 nt, Human
ugcugagggaccagccaaga

SEQ ID NO: 2084479 - RNA, 14 nt, Human
ugcugagggaccag

SEQ ID NO: 2084480 - RNA, 16 nt, Human
ugcugagggaccagcc

SEQ ID NO: 2084481 - RNA, 19 nt, Human
aggaaagccccagcacuaa

SEQ ID NO: 2084482 - RNA, 20 nt, Human
aggaaagccccagcacuaac

SEQ ID NO: 2084483 - RNA, 13 nt, Human
aggaaaggccagc

SEQ ID NO: 2084484 - RNA, 14 nt, Human
aggaaaggccagcu

SEQ ID NO: 2084485 - RNA, 15 nt, Human
aggaaaggccagcug

SEQ ID NO: 2084486 - RNA, 16 nt, Human
aggaaaggccagcugg

SEQ ID NO: 2084487 - RNA, 22 nt, Human
aggaaaggccagcuggcagcag

SEQ ID NO: 2084488 - RNA, 23 nt, Human
aggaauccagacccggcugcgug

SEQ ID NO: 2084489 - RNA, 23 nt, Human
aggaagagcaggcacauggagga

SEQ ID NO: 2084490 - RNA, 19 nt, Human
aggaagcuccaguccugcu

SEQ ID NO: 2084491 - RNA, 20 nt, Human
aggaagcuccaguccugcuc

SEQ ID NO: 2084492 - RNA, 21 nt, Human
aggaagcuccaguccugcucu

SEQ ID NO: 2084493 - RNA, 22 nt, Human
aggaagcuccaguccugcucuc

SEQ ID NO: 2084494 - RNA, 17 nt, Human
aggaagcugcuccgugc

SEQ ID NO: 2084495 - RNA, 19 nt, Human
aggaaucgaggaaccagag

SEQ ID NO: 2084496 - RNA, 20 nt, Human
aggaaucgaggaaccagagc

SEQ ID NO: 2084497 - RNA, 13 nt, Human
aggaaugaagaua

SEQ ID NO: 2084498 - RNA, 19 nt, Human
aggaaugaagauaccauca

SEQ ID NO: 2084499 - RNA, 12 nt, Human
aggaagagcagg

SEQ ID NO: 2084500 - RNA, 17 nt, Human
aggaagagcaggcacau

SEQ ID NO: 2084501 - RNA, 20 nt, Human
aggaagagcaggcacaugga

SEQ ID NO: 2084502 - RNA, 14 nt, Human
aggaagagaaaaaa

SEQ ID NO: 2084503 - RNA, 14 nt, Human
aggaagagaaacca

SEQ ID NO: 2084504 - RNA, 21 nt, Human
aggaaaggccagcuggcagca

SEQ ID NO: 2084505 - RNA, 17 nt, Human
aggaaaggccagcuggc

SEQ ID NO: 2084506 - RNA, 18 nt, Human
aggaaaggccagcuggca

SEQ ID NO: 2084507 - RNA, 15 nt, Human
ugcugccauccaggu

SEQ ID NO: 2084508 - RNA, 14 nt, Human
ugcugccauccagg

SEQ ID NO: 2084509 - RNA, 13 nt, Human
ugcugccauccag

SEQ ID NO: 2084510 - RNA, 12 nt, Human
ugcugccaucca

SEQ ID NO: 2084511 - RNA, 16 nt, Human
ugcugcccagccucca

SEQ ID NO: 2084512 - RNA, 14 nt, Human
ugcugcccagccuc

SEQ ID NO: 2084513 - RNA, 22 nt, Human
ugcugccauccagguucagcuu

SEQ ID NO: 2084514 - RNA, 21 nt, Human
ugcugccauccagguucagcu

SEQ ID NO: 2084515 - RNA, 19 nt, Human
ugcugccacacuucaggcu

SEQ ID NO: 2084516 - RNA, 16 nt, Human
ugcugccacacuucag

SEQ ID NO: 2084517 - RNA, 15 nt, Human
ugcugccacacuuca

SEQ ID NO: 2084518 - RNA, 22 nt, Human
ugcugccacacuucaggcucuu

SEQ ID NO: 2084519 - RNA, 11 nt, Human
ugcugccaucc

SEQ ID NO: 2084520 - RNA, 16 nt, Human
aggacaaagucuccag

SEQ ID NO: 2084521 - RNA, 17 nt, Human
aggacaaagucuccagc

SEQ ID NO: 2084522 - RNA, 18 nt, Human
aggacaaagucuccagcc

SEQ ID NO: 2084523 - RNA, 17 nt, Human
uggaaguaguggagccc

SEQ ID NO: 2084524 - RNA, 16 nt, Human
uggaagcuguguccuu

SEQ ID NO: 2084525 - RNA, 14 nt, Human
uggaaguaguggag

SEQ ID NO: 2084526 - RNA, 13 nt, Human
uggaagcuccgcu

SEQ ID NO: 2084527 - RNA, 17 nt, Human
ugcugcccgucuucagc

SEQ ID NO: 2084528 - RNA, 20 nt, Human
ugcugcccgucuucagccua

SEQ ID NO: 2084529 - RNA, 21 nt, Human
ugcugcccgucuucagccuag

SEQ ID NO: 2084530 - RNA, 17 nt, Human
ugcugccccaugaagcc

SEQ ID NO: 2084531 - RNA, 18 nt, Human
ugcugccccaugaagcca

SEQ ID NO: 2084532 - RNA, 20 nt, Human
ugcugccccaugaagccaca

SEQ ID NO: 2084533 - RNA, 24 nt, Human
ugcugccccaugaagccacagccc

SEQ ID NO: 2084534 - RNA, 13 nt, Human
ugcugcccuccau

SEQ ID NO: 2084535 - RNA, 22 nt, Human
ugcugcccgucuucagccuagc

SEQ ID NO: 2084536 - RNA, 14 nt, Human
ugcugcccuaggcu

SEQ ID NO: 2084537 - RNA, 14 nt, Human
aggauauuuaagaa

SEQ ID NO: 2084538 - RNA, 16 nt, Human
aggauauuuaagaaaa

SEQ ID NO: 2084539 - RNA, 17 nt, Human
aggauauuuaagaaaau

SEQ ID NO: 2084540 - RNA, 18 nt, Human
aggauauuuaagaaaaua

SEQ ID NO: 2084541 - RNA, 19 nt, Human
aggauauuuaagaaaauac

SEQ ID NO: 2084542 - RNA, 15 nt, Human
aggaucaagaaagug

SEQ ID NO: 2084543 - RNA, 24 nt, Human
aggaguuugaggcugcagcgagcu

SEQ ID NO: 2084544 - RNA, 14 nt, Human
aggaucacuggagc

SEQ ID NO: 2084545 - RNA, 15 nt, Human
aggaucacuggagcc

SEQ ID NO: 2084546 - RNA, 16 nt, Human
aggaucacuggagccc

SEQ ID NO: 2084547 - RNA, 18 nt, Human
aggaucacuggagcccag

SEQ ID NO: 2084548 - RNA, 19 nt, Human
aggaucacuggagcccagg

SEQ ID NO: 2084549 - RNA, 20 nt, Human
aggaucacuggagcccagga

SEQ ID NO: 2084550 - RNA, 22 nt, Human
aggaucacuggagcccaggagu

SEQ ID NO: 2084551 - RNA, 19 nt, Human
aggaucacuugagcccagg

SEQ ID NO: 2084552 - RNA, 12 nt, Human
aggaucagaaag

SEQ ID NO: 2084553 - RNA, 13 nt, Human
aggaucagaaagu

SEQ ID NO: 2084554 - RNA, 14 nt, Human
aggaucagaaagua

SEQ ID NO: 2084555 - RNA, 18 nt, Human
aggaucagaaaguaauuu

SEQ ID NO: 2084556 - RNA, 21 nt, Human
aggaguuugagaccaaccugg

SEQ ID NO: 2084557 - RNA, 16 nt, Human
aggaguuugagaccag

SEQ ID NO: 2084558 - RNA, 19 nt, Human
aggaguuugagaccagccu

SEQ ID NO: 2084559 - RNA, 19 nt, Human
aggaguuugaggcugcagc

SEQ ID NO: 2084560 - RNA, 20 nt, Human
aggaguuugaggcugcagcg

SEQ ID NO: 2084561 - RNA, 15 nt, Human
uggaagcuguguccu

SEQ ID NO: 2084562 - RNA, 18 nt, Human
uggaagugagggucagag

SEQ ID NO: 2084563 - RNA, 19 nt, Human
uggaagugagggucagaga

SEQ ID NO: 2084564 - RNA, 21 nt, Human
uggaagugagggucagagagg

SEQ ID NO: 2084565 - RNA, 22 nt, Human
aggauugcuacuguccuaccca

SEQ ID NO: 2084566 - RNA, 21 nt, Human
aggauugcuugagcccaggag

SEQ ID NO: 2084567 - RNA, 22 nt, Human
aggauugcuugagcccaggagu

SEQ ID NO: 2084568 - RNA, 17 nt, Human
aggauugcuugagccca

SEQ ID NO: 2084569 - RNA, 18 nt, Human
aggauugcuugagcccag

SEQ ID NO: 2084570 - RNA, 19 nt, Human
aggauugcuugagcccagg

SEQ ID NO: 2084571 - RNA, 20 nt, Human
aggauugcuugagcccagga

SEQ ID NO: 2084572 - RNA, 12 nt, Human
aggauuucaagc

SEQ ID NO: 2084573 - RNA, 14 nt, Human
aggauuucaagccu

SEQ ID NO: 2084574 - RNA, 15 nt, Human
aggauuucaagccug

SEQ ID NO: 2084575 - RNA, 16 nt, Human
aggauuucaagccugc

SEQ ID NO: 2084576 - RNA, 16 nt, Human
aggauugugauauuuu

SEQ ID NO: 2084577 - RNA, 12 nt, Human
aggaucagucug

SEQ ID NO: 2084578 - RNA, 12 nt, Human
aggaucucuuga

SEQ ID NO: 2084579 - RNA, 20 nt, Human
uggacaccaggagucccugg

SEQ ID NO: 2084580 - RNA, 21 nt, Human
uggacaccaggagucccuggu

SEQ ID NO: 2084581 - RNA, 19 nt, Human
uggacaaacccuucuuuua

SEQ ID NO: 2084582 - RNA, 14 nt, Human
uggaauuuuuuauu

SEQ ID NO: 2084583 - RNA, 15 nt, Human
uggaauuuuuuauuc

SEQ ID NO: 2084584 - RNA, 16 nt, Human
uggaauuuuuuauucu

SEQ ID NO: 2084585 - RNA, 20 nt, Human
uggaauuuuuuauucuugug

SEQ ID NO: 2084586 - RNA, 21 nt, Human
uggaauuuuuuauucuuguga

SEQ ID NO: 2084587 - RNA, 23 nt, Human
uggaauuuuucauugauaugaaa

SEQ ID NO: 2084588 - RNA, 18 nt, Human
uggaauuuuuauuaugca

SEQ ID NO: 2084589 - RNA, 19 nt, Human
uggaauuuuuauuaugcau

SEQ ID NO: 2084590 - RNA, 20 nt, Human
uggaauuuuuauuaugcaua

SEQ ID NO: 2084591 - RNA, 23 nt, Human
uggaauuuuuauuaugcauaacu

SEQ ID NO: 2084592 - RNA, 24 nt, Human
uggaauuuuuauuaugcauaacug

SEQ ID NO: 2084593 - RNA, 12 nt, Human
uggaauuuuuca

SEQ ID NO: 2084594 - RNA, 14 nt, Human
aggcaagcaccucc

SEQ ID NO: 2084595 - RNA, 19 nt, Human
aggcaacugcauuggcuuu

SEQ ID NO: 2084596 - RNA, 16 nt, Human
aggcaacuugggaacu

SEQ ID NO: 2084597 - RNA, 12 nt, Human
aggcaagagaau

SEQ ID NO: 2084598 - RNA, 23 nt, Human
uggagcuucucuuuaacucagga

SEQ ID NO: 2084599 - RNA, 14 nt, Human
aggcacaauauggg

SEQ ID NO: 2084600 - RNA, 22 nt, Human
aggcaaugucaggaacagaagg

SEQ ID NO: 2084601 - RNA, 23 nt, Human
aggcaaugucaggaacagaagga

SEQ ID NO: 2084602 - RNA, 17 nt, Human
aggcacagugaaggcug

SEQ ID NO: 2084603 - RNA, 16 nt, Human
aggcacaugucagcaa

SEQ ID NO: 2084604 - RNA, 13 nt, Human
aggcacauggagg

SEQ ID NO: 2084605 - RNA, 14 nt, Human
aggcacauggagga

SEQ ID NO: 2084606 - RNA, 17 nt, Human
aggcacauggaggagcu

SEQ ID NO: 2084607 - RNA, 16 nt, Human
aggcaaugcuggcugu

SEQ ID NO: 2084608 - RNA, 19 nt, Human
aggcaauggccuaaacuuc

SEQ ID NO: 2084609 - RNA, 17 nt, Human
aggcaaugucaggaaca

SEQ ID NO: 2084610 - RNA, 19 nt, Human
aggcaaugucaggaacaga

SEQ ID NO: 2084611 - RNA, 23 nt, Human
uggaggaaaaccaagccguggcu

SEQ ID NO: 2084612 - RNA, 21 nt, Human
uggaggaaaaccaagccgugg

SEQ ID NO: 2084613 - RNA, 15 nt, Human
aggcaaugcuggcug

SEQ ID NO: 2084614 - RNA, 18 nt, Human
uggagcuggcgucugucu

SEQ ID NO: 2084615 - RNA, 14 nt, Human
uggagccagggagc

SEQ ID NO: 2084616 - RNA, 23 nt, Human
uggagccagggagcggccgccug

SEQ ID NO: 2084617 - RNA, 13 nt, Human
uggagaagcagug

SEQ ID NO: 2084618 - RNA, 18 nt, Human
uggacuuuucguuaacau

SEQ ID NO: 2084619 - RNA, 19 nt, Human
uggacuuuucguuaacauu

SEQ ID NO: 2084620 - RNA, 20 nt, Human
uggacuuuucguuaacauug

SEQ ID NO: 2084621 - RNA, 21 nt, Human
uggacuuuucguuaacauuga

SEQ ID NO: 2084622 - RNA, 22 nt, Human
uggacuuuucguuaacauugac

SEQ ID NO: 2084623 - RNA, 22 nt, Human
aggcagccccauucugccugcc

SEQ ID NO: 2084624 - RNA, 14 nt, Human
aggcaccagugucc

SEQ ID NO: 2084625 - RNA, 20 nt, Human
aggcaccaguguccuccccu

SEQ ID NO: 2084626 - RNA, 12 nt, Human
aggcaccauuca

SEQ ID NO: 2084627 - RNA, 17 nt, Human
aggcaccauucaggaac

SEQ ID NO: 2084628 - RNA, 19 nt, Human
aggcaccauucaggaaccu

SEQ ID NO: 2084629 - RNA, 21 nt, Human
aggcagccccauucugccugc

SEQ ID NO: 2084630 - RNA, 20 nt, Human
aggcagccccauucugccug

SEQ ID NO: 2084631 - RNA, 19 nt, Human
aggcagccccauucugccu

SEQ ID NO: 2084632 - RNA, 15 nt, Human
aggcacccaccauca

SEQ ID NO: 2084633 - RNA, 12 nt, Human
aggcagggaagu

SEQ ID NO: 2084634 - RNA, 21 nt, Human
aggcagggaaguguaagaaac

SEQ ID NO: 2084635 - RNA, 13 nt, Human
aggcagggaaguc

SEQ ID NO: 2084636 - RNA, 19 nt, Human
aggcagggaaguccccagg

SEQ ID NO: 2084637 - RNA, 23 nt, Human
aggcagggaaguccccaggcccc

SEQ ID NO: 2084638 - RNA, 12 nt, Human
aggcagggaggg

SEQ ID NO: 2084639 - RNA, 13 nt, Human
aggcagggagggg

SEQ ID NO: 2084640 - RNA, 14 nt, Human
aggcagggagggga

SEQ ID NO: 2084641 - RNA, 16 nt, Human
aggcagggaggggacu

SEQ ID NO: 2084642 - RNA, 12 nt, Human
aggcaggauggc

SEQ ID NO: 2084643 - RNA, 21 nt, Human
aggcagggucucacucugucg

SEQ ID NO: 2084644 - RNA, 20 nt, Human
aggcagggucucacucuguc

SEQ ID NO: 2084645 - RNA, 18 nt, Human
aggcagggucucacucug

SEQ ID NO: 2084646 - RNA, 19 nt, Human
aggcagggucucacucugu

SEQ ID NO: 2084647 - RNA, 14 nt, Human
aggcagguccaggg

SEQ ID NO: 2084648 - RNA, 22 nt, Human
aggcaggguuuuaucucugucu

SEQ ID NO: 2084649 - RNA, 23 nt, Human
aggcaggguuuuaucucugucua

SEQ ID NO: 2084650 - RNA, 22 nt, Human
aggcagggucucacucugucgc

SEQ ID NO: 2084651 - RNA, 19 nt, Human
aggcagggccuugcccaga

SEQ ID NO: 2084652 - RNA, 20 nt, Human
aggcagggccuugcccagag

SEQ ID NO: 2084653 - RNA, 18 nt, Human
aggcaguuagagaugccu

SEQ ID NO: 2084654 - RNA, 21 nt, Human
aggcaguuagagaugccuccc

SEQ ID NO: 2084655 - RNA, 19 nt, Human
aggcagugaugcuggaugc

SEQ ID NO: 2084656 - RNA, 16 nt, Human
aggcaguggggcuggg

SEQ ID NO: 2084657 - RNA, 21 nt, Human
aggcaggucuugaacuccugg

SEQ ID NO: 2084658 - RNA, 16 nt, Human
aggcucagucucagga

SEQ ID NO: 2084659 - RNA, 17 nt, Human
aggcucagucucaggag

SEQ ID NO: 2084660 - RNA, 18 nt, Human
aggcucagucucaggagc

SEQ ID NO: 2084661 - RNA, 20 nt, Human
aggcucauagggaagaccug

SEQ ID NO: 2084662 - RNA, 21 nt, Human
aggcucauagggaagaccugc

SEQ ID NO: 2084663 - RNA, 22 nt, Human
aggcucauagggaagaccugcu

SEQ ID NO: 2084664 - RNA, 19 nt, Human
aggcucagucucaggagca

SEQ ID NO: 2084665 - RNA, 23 nt, Human
aggcucagucucaggagcauggg

SEQ ID NO: 2084666 - RNA, 13 nt, Human
aggcucaggccau

SEQ ID NO: 2084667 - RNA, 13 nt, Human
uggccuguucugu

SEQ ID NO: 2084668 - RNA, 13 nt, Human
aggccuucuugug

SEQ ID NO: 2084669 - RNA, 14 nt, Human
aggccuucuuguga

SEQ ID NO: 2084670 - RNA, 18 nt, Human
aggccuucuugugaucuu

SEQ ID NO: 2084671 - RNA, 21 nt, Human
aggccuucuugugaucuugcu

SEQ ID NO: 2084672 - RNA, 18 nt, Human
aggccuucucugaaggac

SEQ ID NO: 2084673 - RNA, 17 nt, Human
aggccuucucugaagga

SEQ ID NO: 2084674 - RNA, 14 nt, Human
aggcgccccuuccc

SEQ ID NO: 2084675 - RNA, 21 nt, Human
aggcgcagugcuucucuacag

SEQ ID NO: 2084676 - RNA, 23 nt, Human
aggcgauccaccugucucagccu

SEQ ID NO: 2084677 - RNA, 15 nt, Human
uggcaucccaguggc

SEQ ID NO: 2084678 - RNA, 19 nt, Human
uggcaucccaguggccuca

SEQ ID NO: 2084679 - RNA, 16 nt, Human
uggcaugggggccuca

SEQ ID NO: 2084680 - RNA, 17 nt, Human
uggcaugggggccucag

SEQ ID NO: 2084681 - RNA, 19 nt, Human
uggcaugggggccucaggg

SEQ ID NO: 2084682 - RNA, 20 nt, Human
uggcaugggggccucagggc

SEQ ID NO: 2084683 - RNA, 13 nt, Human
uggcauuaaaacu

SEQ ID NO: 2084684 - RNA, 15 nt, Human
uggcauuaaaacuua

SEQ ID NO: 2084685 - RNA, 20 nt, Human
uggcaugugcugugaccauu

SEQ ID NO: 2084686 - RNA, 22 nt, Human
uggcaugugcugugaccauuua

SEQ ID NO: 2084687 - RNA, 19 nt, Human
uggcccacgcacuucggga

SEQ ID NO: 2084688 - RNA, 20 nt, Human
uggcccacgccuguaauccc

SEQ ID NO: 2084689 - RNA, 13 nt, Human
uggcccacugcau

SEQ ID NO: 2084690 - RNA, 14 nt, Human
uggcccacugcauc

SEQ ID NO: 2084691 - RNA, 12 nt, Human
uggcccucuggu

SEQ ID NO: 2084692 - RNA, 15 nt, Human
uggcccucugguaga

SEQ ID NO: 2084693 - RNA, 13 nt, Human
uggcccucuucuu

SEQ ID NO: 2084694 - RNA, 14 nt, Human
uggcccucuucuua

SEQ ID NO: 2084695 - RNA, 16 nt, Human
uggcccucuucuuacu

SEQ ID NO: 2084696 - RNA, 16 nt, Human
uggcccucaccccugc

SEQ ID NO: 2084697 - RNA, 18 nt, Human
uggcccucaccccugccc

SEQ ID NO: 2084698 - RNA, 20 nt, Human
uggcccucaccccugcccug

SEQ ID NO: 2084699 - RNA, 14 nt, Human
uggcccucaguuuc

SEQ ID NO: 2084700 - RNA, 22 nt, Human
uggcccagccaaacccugucug

SEQ ID NO: 2084701 - RNA, 18 nt, Human
uggccgaggguccuggcu

SEQ ID NO: 2084702 - RNA, 23 nt, Human
uggcccuugcaguucagcaccac

SEQ ID NO: 2084703 - RNA, 22 nt, Human
uggcccuugcaguucagcacca

SEQ ID NO: 2084704 - RNA, 19 nt, Human
uggccgaggguccuggcuc

SEQ ID NO: 2084705 - RNA, 20 nt, Human
uggccgaggguccuggcucc

SEQ ID NO: 2084706 - RNA, 24 nt, Human
uggccugucucauccccagggguc

SEQ ID NO: 2084707 - RNA, 14 nt, Human
uggccugucucauc

SEQ ID NO: 2084708 - RNA, 16 nt, Human
uggccugucucauccc

SEQ ID NO: 2084709 - RNA, 18 nt, Human
uggccugucucaucccca

SEQ ID NO: 2084710 - RNA, 20 nt, Human
uggccugucucauccccagg

SEQ ID NO: 2084711 - RNA, 12 nt, Human
uggccugucuca

SEQ ID NO: 2084712 - RNA, 11 nt, Human
uggccugggca

SEQ ID NO: 2084713 - RNA, 15 nt, Human
uggccucugucauau

SEQ ID NO: 2084714 - RNA, 12 nt, Human
uggccugaggag

SEQ ID NO: 2084715 - RNA, 15 nt, Human
uggccugaggagcag

SEQ ID NO: 2084716 - RNA, 14 nt, Human
uggccugcacuaau

SEQ ID NO: 2084717 - RNA, 16 nt, Human
uggccugcacuaauuu

SEQ ID NO: 2084718 - RNA, 20 nt, Human
uggccugcugggcucuccac

SEQ ID NO: 2084719 - RNA, 18 nt, Human
uggccugccuugaagcca

SEQ ID NO: 2084720 - RNA, 21 nt, Human
uggccugcugggcucuccacc

SEQ ID NO: 2084721 - RNA, 22 nt, Human
uggccugcugggcucuccaccu

SEQ ID NO: 2084722 - RNA, 18 nt, Human
aggccaugggccuccugu

SEQ ID NO: 2084723 - RNA, 21 nt, Human
uggcagccgugccuucagcuc

SEQ ID NO: 2084724 - RNA, 20 nt, Human
uggcagccgugccuucagcu

SEQ ID NO: 2084725 - RNA, 19 nt, Human
uggcagccgugccuucagc

SEQ ID NO: 2084726 - RNA, 18 nt, Human
uggcagccgugccuucag

SEQ ID NO: 2084727 - RNA, 17 nt, Human
uggcagccgugccuuca

SEQ ID NO: 2084728 - RNA, 14 nt, Human
uggcagcagagugu

SEQ ID NO: 2084729 - RNA, 20 nt, Human
uggcagcagaguguggccuu

SEQ ID NO: 2084730 - RNA, 19 nt, Human
uggcagcaggccuguugcu

SEQ ID NO: 2084731 - RNA, 20 nt, Human
uggcagcaggccuguugcuu

SEQ ID NO: 2084732 - RNA, 22 nt, Human
uggcagcaggccuguugcuuuu

SEQ ID NO: 2084733 - RNA, 22 nt, Human
uggcagauuuagugaaagcuag

SEQ ID NO: 2084734 - RNA, 13 nt, Human
uggcagauuuuac

SEQ ID NO: 2084735 - RNA, 15 nt, Human
uggcagauuuuacaa

SEQ ID NO: 2084736 - RNA, 16 nt, Human
uggcagauuuuacaaa

SEQ ID NO: 2084737 - RNA, 17 nt, Human
uggcagauuuuacaaaa

SEQ ID NO: 2084738 - RNA, 20 nt, Human
uggcagauuuuacaaaagau

SEQ ID NO: 2084739 - RNA, 22 nt, Human
uggcagauuuuacaaaagaugu

SEQ ID NO: 2084740 - RNA, 16 nt, Human
uggcaccagcagccug

SEQ ID NO: 2084741 - RNA, 17 nt, Human
uggcaccagcagccugg

SEQ ID NO: 2084742 - RNA, 15 nt, Human
uggcacagggcagug

SEQ ID NO: 2084743 - RNA, 16 nt, Human
uggcacagggcagugg

SEQ ID NO: 2084744 - RNA, 20 nt, Human
uggcacagcccaaagaagga

SEQ ID NO: 2084745 - RNA, 18 nt, Human
uggcacagcccaaagaag

SEQ ID NO: 2084746 - RNA, 20 nt, Human
aggcauaggccugggugcug

SEQ ID NO: 2084747 - RNA, 17 nt, Human
aggcauaggccugggug

SEQ ID NO: 2084748 - RNA, 18 nt, Human
aggcauaggccugggugc

SEQ ID NO: 2084749 - RNA, 19 nt, Human
aggcauaggccugggugcu

SEQ ID NO: 2084750 - RNA, 20 nt, Human
aggcauccuuccucacacca

SEQ ID NO: 2084751 - RNA, 22 nt, Human
uggcacacaccuguagucccag

SEQ ID NO: 2084752 - RNA, 23 nt, Human
aggcaucccaggggaccacaccu

SEQ ID NO: 2084753 - RNA, 14 nt, Human
uggcacagaaacac

SEQ ID NO: 2084754 - RNA, 18 nt, Human
aggcauccuuccucacac

SEQ ID NO: 2084755 - RNA, 13 nt, Human
aggcaucccaggg

SEQ ID NO: 2084756 - RNA, 16 nt, Human
aggcaucccaggggac

SEQ ID NO: 2084757 - RNA, 17 nt, Human
aggcaucccaggggacc

SEQ ID NO: 2084758 - RNA, 18 nt, Human
aggcaucccaggggacca

SEQ ID NO: 2084759 - RNA, 21 nt, Human
aggccccugccacccugggga

SEQ ID NO: 2084760 - RNA, 18 nt, Human
aggccccugccacccugg

SEQ ID NO: 2084761 - RNA, 17 nt, Human
aggccccugccacccug

SEQ ID NO: 2084762 - RNA, 15 nt, Human
aggccccugccaccc

SEQ ID NO: 2084763 - RNA, 13 nt, Human
aggccccugccac

SEQ ID NO: 2084764 - RNA, 16 nt, Human
aggcccggcuccaggc

SEQ ID NO: 2084765 - RNA, 15 nt, Human
aggcccggcuccagg

SEQ ID NO: 2084766 - RNA, 14 nt, Human
aggcccggcuccag

SEQ ID NO: 2084767 - RNA, 17 nt, Human
aggcccggcuccaggcu

SEQ ID NO: 2084768 - RNA, 12 nt, Human
aggccguggcug

SEQ ID NO: 2084769 - RNA, 20 nt, Human
aggccgggugcucagggcug

SEQ ID NO: 2084770 - RNA, 20 nt, Human
aggccguggcugcccacaca

SEQ ID NO: 2084771 - RNA, 17 nt, Human
aggccuagucagccaca

SEQ ID NO: 2084772 - RNA, 20 nt, Human
aggccuagucagccacaugg

SEQ ID NO: 2084773 - RNA, 16 nt, Human
aggccuauaaccccag

SEQ ID NO: 2084774 - RNA, 12 nt, Human
aggccuggccag

SEQ ID NO: 2084775 - RNA, 21 nt, Human
aggccuggcauggcaccuguc

SEQ ID NO: 2084776 - RNA, 13 nt, Human
aggccuggccaga

SEQ ID NO: 2084777 - RNA, 15 nt, Human
uggcaucacagggca

SEQ ID NO: 2084778 - RNA, 18 nt, Human
uggcaucacagggcagag

SEQ ID NO: 2084779 - RNA, 20 nt, Human
uggcaucacagggcagagcc

SEQ ID NO: 2084780 - RNA, 23 nt, Human
uggcaucaccuuaggcagggaag

SEQ ID NO: 2084781 - RNA, 21 nt, Human
uggcucacugcaacuucugcc

SEQ ID NO: 2084782 - RNA, 13 nt, Human
uggcucacugcag

SEQ ID NO: 2084783 - RNA, 15 nt, Human
uggcucacugcagcc

SEQ ID NO: 2084784 - RNA, 16 nt, Human
uggcucacugcagccu

SEQ ID NO: 2084785 - RNA, 17 nt, Human
uggcucacugcagccuc

SEQ ID NO: 2084786 - RNA, 18 nt, Human
uggcucacugcagccucg

SEQ ID NO: 2084787 - RNA, 19 nt, Human
uggcucacgccuguaaucc

SEQ ID NO: 2084788 - RNA, 16 nt, Human
uggcucacgccuguaa

SEQ ID NO: 2084789 - RNA, 16 nt, Human
uggcucacguguguga

SEQ ID NO: 2084790 - RNA, 13 nt, Human
uggcucacgccug

SEQ ID NO: 2084791 - RNA, 14 nt, Human
uggcucacagacug

SEQ ID NO: 2084792 - RNA, 17 nt, Human
uggcucacagacuggag

SEQ ID NO: 2084793 - RNA, 18 nt, Human
uggcucacagacuggaga

SEQ ID NO: 2084794 - RNA, 16 nt, Human
uggcucacaccuguaa

SEQ ID NO: 2084795 - RNA, 16 nt, Human
uggcucaauccucuaa

SEQ ID NO: 2084796 - RNA, 19 nt, Human
uggcucacaccuguaaucc

SEQ ID NO: 2084797 - RNA, 22 nt, Human
uggcucuuuuacccaauaagau

SEQ ID NO: 2084798 - RNA, 15 nt, Human
uggcugacccagucc

SEQ ID NO: 2084799 - RNA, 16 nt, Human
uggcugacccaguccc

SEQ ID NO: 2084800 - RNA, 17 nt, Human
uggcugacccagucccu

SEQ ID NO: 2084801 - RNA, 19 nt, Human
uggcugacccagucccugg

SEQ ID NO: 2084802 - RNA, 20 nt, Human
uggcugacccagucccuggg

SEQ ID NO: 2084803 - RNA, 21 nt, Human
uggcugacccagucccugggg

SEQ ID NO: 2084804 - RNA, 15 nt, Human
uggcugaccccccuc

SEQ ID NO: 2084805 - RNA, 16 nt, Human
uggcugaccccccuca

SEQ ID NO: 2084806 - RNA, 16 nt, Human
uggcugacuuugcucu

SEQ ID NO: 2084807 - RNA, 17 nt, Human
uggcuaauguacugcau

SEQ ID NO: 2084808 - RNA, 19 nt, Human
uggcuaauguacugcauau

SEQ ID NO: 2084809 - RNA, 17 nt, Human
uggcuaagcuuaaaaaa

SEQ ID NO: 2084810 - RNA, 20 nt, Human
uggcuaagcuuaaaaaaaac

SEQ ID NO: 2084811 - RNA, 14 nt, Human
uggcuaaggcacca

SEQ ID NO: 2084812 - RNA, 17 nt, Human
uggcuaaggcaccagcc

SEQ ID NO: 2084813 - RNA, 15 nt, Human
uggcuaagagugucc

SEQ ID NO: 2084814 - RNA, 19 nt, Human
uggcuagaggccagcccca

SEQ ID NO: 2084815 - RNA, 23 nt, Human
uggcuagaggccagccccaccca

SEQ ID NO: 2084816 - RNA, 21 nt, Human
uggcuagaggccagccccacc

SEQ ID NO: 2084817 - RNA, 22 nt, Human
uggcuagaggccagccccaccc

SEQ ID NO: 2084818 - RNA, 23 nt, Human
ugggaaaaaugcccuuaaaucau

SEQ ID NO: 2084819 - RNA, 22 nt, Human
uggcuucaaauauuaugcaggg

SEQ ID NO: 2084820 - RNA, 17 nt, Human
uggcuucacggaagagc

SEQ ID NO: 2084821 - RNA, 20 nt, Human
uggcuucacggaagagccuu

SEQ ID NO: 2084822 - RNA, 15 nt, Human
ugggaaauggcuuga

SEQ ID NO: 2084823 - RNA, 17 nt, Human
uggcugugccucugccu

SEQ ID NO: 2084824 - RNA, 16 nt, Human
uggcugugccucugcc

SEQ ID NO: 2084825 - RNA, 15 nt, Human
uggcugugccucugc

SEQ ID NO: 2084826 - RNA, 14 nt, Human
uggcugugccucug

SEQ ID NO: 2084827 - RNA, 23 nt, Human
uggcugcaaaggguaucaggugc

SEQ ID NO: 2084828 - RNA, 23 nt, Human
uggcuguuggcugggggccucag

SEQ ID NO: 2084829 - RNA, 14 nt, Human
uggcuucacggaag

SEQ ID NO: 2084830 - RNA, 18 nt, Human
uggcuguuggcugggggc

SEQ ID NO: 2084831 - RNA, 16 nt, Human
uggcuguuggcugggg

SEQ ID NO: 2084832 - RNA, 14 nt, Human
uggcuguggcaggc

SEQ ID NO: 2084833 - RNA, 13 nt, Human
uggcugugggcuc

SEQ ID NO: 2084834 - RNA, 14 nt, Human
uggcugugggcucc

SEQ ID NO: 2084835 - RNA, 15 nt, Human
uggcugugggcuccc

SEQ ID NO: 2084836 - RNA, 19 nt, Human
uggcugugccucugccugu

SEQ ID NO: 2084837 - RNA, 18 nt, Human
uggcugugccucugccug

SEQ ID NO: 2084838 - RNA, 22 nt, Human
uggcugugccucugccugucuc

SEQ ID NO: 2084839 - RNA, 14 nt, Human
aggcugggcuucag

SEQ ID NO: 2084840 - RNA, 12 nt, Human
aggcugggccaa

SEQ ID NO: 2084841 - RNA, 13 nt, Human
aggcugggccaag

SEQ ID NO: 2084842 - RNA, 20 nt, Human
aggcugggccaagccaggga

SEQ ID NO: 2084843 - RNA, 18 nt, Human
aggcugggcguaguggcu

SEQ ID NO: 2084844 - RNA, 13 nt, Human
aggcugggcccag

SEQ ID NO: 2084845 - RNA, 14 nt, Human
aggcugggcccaga

SEQ ID NO: 2084846 - RNA, 15 nt, Human
aggcugggcccagag

SEQ ID NO: 2084847 - RNA, 16 nt, Human
aggcugggcccagagg

SEQ ID NO: 2084848 - RNA, 17 nt, Human
aggcugggcccagaggc

SEQ ID NO: 2084849 - RNA, 18 nt, Human
aggcugggcccagaggca

SEQ ID NO: 2084850 - RNA, 20 nt, Human
aggcugggcccagaggcaca

SEQ ID NO: 2084851 - RNA, 21 nt, Human
aggcugggcccagaggcacag

SEQ ID NO: 2084852 - RNA, 22 nt, Human
aggcugggcccagaggcacagc

SEQ ID NO: 2084853 - RNA, 23 nt, Human
aggcugggcuucaguggcagcug

SEQ ID NO: 2084854 - RNA, 22 nt, Human
aggcugggcuucaguggcagcu

SEQ ID NO: 2084855 - RNA, 17 nt, Human
aggcugggggaagaagc

SEQ ID NO: 2084856 - RNA, 21 nt, Human
aggcugggcuucaguggcagc

SEQ ID NO: 2084857 - RNA, 20 nt, Human
aggcugggcuucaguggcag

SEQ ID NO: 2084858 - RNA, 19 nt, Human
aggcugggcuucaguggca

SEQ ID NO: 2084859 - RNA, 18 nt, Human
aggcugggcuucaguggc

SEQ ID NO: 2084860 - RNA, 22 nt, Human
aggcugggggaagaagcucucu

SEQ ID NO: 2084861 - RNA, 14 nt, Human
aggcuuucagggcc

SEQ ID NO: 2084862 - RNA, 13 nt, Human
aggcuuuacuuag

SEQ ID NO: 2084863 - RNA, 19 nt, Human
aggcuuuacuuagcuuauc

SEQ ID NO: 2084864 - RNA, 21 nt, Human
aggcuuuacuuagcuuaucaa

SEQ ID NO: 2084865 - RNA, 18 nt, Human
aggcuugucagagcuggg

SEQ ID NO: 2084866 - RNA, 16 nt, Human
aggcuugucagagcug

SEQ ID NO: 2084867 - RNA, 17 nt, Human
aggcuugucagagcugg

SEQ ID NO: 2084868 - RNA, 20 nt, Human
aggcuugucagagcugggag

SEQ ID NO: 2084869 - RNA, 16 nt, Human
agggaaacuauugucc

SEQ ID NO: 2084870 - RNA, 15 nt, Human
agggaaacgugcccu

SEQ ID NO: 2084871 - RNA, 20 nt, Human
aggcuucagcauauuuauag

SEQ ID NO: 2084872 - RNA, 18 nt, Human
aggcuucaauuuauugca

SEQ ID NO: 2084873 - RNA, 22 nt, Human
aggcuucaauuuauugcacaaa

SEQ ID NO: 2084874 - RNA, 23 nt, Human
aggcuuccacguacugcagccuc

SEQ ID NO: 2084875 - RNA, 11 nt, Human
aggcugggugc

SEQ ID NO: 2084876 - RNA, 14 nt, Human
aggcugggugccca

SEQ ID NO: 2084877 - RNA, 15 nt, Human
aggcugggugcccac

SEQ ID NO: 2084878 - RNA, 16 nt, Human
aggcugggugcccaca

SEQ ID NO: 2084879 - RNA, 17 nt, Human
aggcugggugcccacag

SEQ ID NO: 2084880 - RNA, 18 nt, Human
aggcugggugcccacagc

SEQ ID NO: 2084881 - RNA, 19 nt, Human
aggcugggugcccacagcc

SEQ ID NO: 2084882 - RNA, 13 nt, Human
aggcuuccuuggc

SEQ ID NO: 2084883 - RNA, 15 nt, Human
aggcuugucagagcu

SEQ ID NO: 2084884 - RNA, 17 nt, Human
aggcuugccugcaggca

SEQ ID NO: 2084885 - RNA, 15 nt, Human
aggcuugccugcagg

SEQ ID NO: 2084886 - RNA, 16 nt, Human
aggcuugccugcaggc

SEQ ID NO: 2084887 - RNA, 16 nt, Human
aggcuucuucagauca

SEQ ID NO: 2084888 - RNA, 22 nt, Human
aggcuucuucagaucagugcuu

SEQ ID NO: 2084889 - RNA, 23 nt, Human
aggcuucuucagaucagugcuug

SEQ ID NO: 2084890 - RNA, 18 nt, Human
aggcuugcauaauaagcu

SEQ ID NO: 2084891 - RNA, 21 nt, Human
ugggcaacccccagccugcua

SEQ ID NO: 2084892 - RNA, 16 nt, Human
ugggcaacagagcaag

SEQ ID NO: 2084893 - RNA, 14 nt, Human
ugggcaaacaggca

SEQ ID NO: 2084894 - RNA, 15 nt, Human
ugggcaaacaggcag

SEQ ID NO: 2084895 - RNA, 16 nt, Human
ugggcaaacaggcagu

SEQ ID NO: 2084896 - RNA, 12 nt, Human
ugggcaacagag

SEQ ID NO: 2084897 - RNA, 14 nt, Human
ugggcaacagagca

SEQ ID NO: 2084898 - RNA, 12 nt, Human
ugggagggccca

SEQ ID NO: 2084899 - RNA, 16 nt, Human
ugggcaauauagcaag

SEQ ID NO: 2084900 - RNA, 15 nt, Human
ugggcaauauagcaa

SEQ ID NO: 2084901 - RNA, 17 nt, Human
ugggcaauauaaccaau

SEQ ID NO: 2084902 - RNA, 18 nt, Human
ugggcaauauaaccaaug

SEQ ID NO: 2084903 - RNA, 22 nt, Human
ugggcaauauaaccaauguuua

SEQ ID NO: 2084904 - RNA, 11 nt, Human
ugggaggcuga

SEQ ID NO: 2084905 - RNA, 13 nt, Human
ugggaggcugagg

SEQ ID NO: 2084906 - RNA, 14 nt, Human
ugggaggcugaggc

SEQ ID NO: 2084907 - RNA, 15 nt, Human
ugggaggcugaggcg

SEQ ID NO: 2084908 - RNA, 14 nt, Human
ugggaggcuucccc

SEQ ID NO: 2084909 - RNA, 18 nt, Human
ugggagggauagaggggg

SEQ ID NO: 2084910 - RNA, 22 nt, Human
ugggaggauugcuugagcucag

SEQ ID NO: 2084911 - RNA, 20 nt, Human
ugggaggauucuaugaggca

SEQ ID NO: 2084912 - RNA, 18 nt, Human
ugggaggauugcuugagc

SEQ ID NO: 2084913 - RNA, 21 nt, Human
ugggaggauugcuugagcuca

SEQ ID NO: 2084914 - RNA, 18 nt, Human
ugggacuacaggcaccca

SEQ ID NO: 2084915 - RNA, 17 nt, Human
agggagcggaaagcagc

SEQ ID NO: 2084916 - RNA, 18 nt, Human
agggagcggaaagcagcu

SEQ ID NO: 2084917 - RNA, 16 nt, Human
agggagcgagggagaa

SEQ ID NO: 2084918 - RNA, 14 nt, Human
agggagcggaaagc

SEQ ID NO: 2084919 - RNA, 17 nt, Human
agggagccccuuugaug

SEQ ID NO: 2084920 - RNA, 16 nt, Human
ugggacuacaggugug

SEQ ID NO: 2084921 - RNA, 17 nt, Human
agggagcguagaaucug

SEQ ID NO: 2084922 - RNA, 17 nt, Human
ugggacuagccuggcuu

SEQ ID NO: 2084923 - RNA, 19 nt, Human
ugggacuagccuggcuugg

SEQ ID NO: 2084924 - RNA, 18 nt, Human
ugggacucaaugcacuga

SEQ ID NO: 2084925 - RNA, 12 nt, Human
ugggacugggag

SEQ ID NO: 2084926 - RNA, 13 nt, Human
ugggacugggagg

SEQ ID NO: 2084927 - RNA, 15 nt, Human
ugggacugggagggc

SEQ ID NO: 2084928 - RNA, 16 nt, Human
ugggacugggagggcc

SEQ ID NO: 2084929 - RNA, 18 nt, Human
ugggacugggagggccca

SEQ ID NO: 2084930 - RNA, 14 nt, Human
ugggacuguacaca

SEQ ID NO: 2084931 - RNA, 15 nt, Human
ugggacuguacacac

SEQ ID NO: 2084932 - RNA, 17 nt, Human
ugggacuguacacacuu

SEQ ID NO: 2084933 - RNA, 18 nt, Human
ugggacuguacacacuuu

SEQ ID NO: 2084934 - RNA, 21 nt, Human
ugggacuguacacacuuuauu

SEQ ID NO: 2084935 - RNA, 22 nt, Human
ugggacuguacacacuuuauuu

SEQ ID NO: 2084936 - RNA, 13 nt, Human
agggagagagaga

SEQ ID NO: 2084937 - RNA, 20 nt, Human
agggagcagagaaggccagg

SEQ ID NO: 2084938 - RNA, 23 nt, Human
agggagcagagaaggccaggggc

SEQ ID NO: 2084939 - RNA, 20 nt, Human
agggacuuggaagcuccgcu

SEQ ID NO: 2084940 - RNA, 21 nt, Human
agggagaagacuauauuguac

SEQ ID NO: 2084941 - RNA, 18 nt, Human
agggagaagggauggagg

SEQ ID NO: 2084942 - RNA, 18 nt, Human
agggaaaggauauuuucu

SEQ ID NO: 2084943 - RNA, 22 nt, Human
agggaaaggcucugaaagccag

SEQ ID NO: 2084944 - RNA, 15 nt, Human
agggaaauaucauuu

SEQ ID NO: 2084945 - RNA, 14 nt, Human
agggaaaugaaaga

SEQ ID NO: 2084946 - RNA, 15 nt, Human
agggacuuggaagcu

SEQ ID NO: 2084947 - RNA, 19 nt, Human
agggacuuggaagcuccgc

SEQ ID NO: 2084948 - RNA, 18 nt, Human
agggacuuggaagcuccg

SEQ ID NO: 2084949 - RNA, 14 nt, Human
ugggcucccuuccu

SEQ ID NO: 2084950 - RNA, 15 nt, Human
ugggcucccuuccuc

SEQ ID NO: 2084951 - RNA, 19 nt, Human
ugggcucccuuccucccaa

SEQ ID NO: 2084952 - RNA, 17 nt, Human
ugggcucccuugugcgu

SEQ ID NO: 2084953 - RNA, 16 nt, Human
ugggcucaagcagucu

SEQ ID NO: 2084954 - RNA, 23 nt, Human
ugggcucuccaccucagccuugg

SEQ ID NO: 2084955 - RNA, 21 nt, Human
ugggcucuccaccucagccuu

SEQ ID NO: 2084956 - RNA, 14 nt, Human
ugggcucuccaccu

SEQ ID NO: 2084957 - RNA, 15 nt, Human
ugggcucuccaccuc

SEQ ID NO: 2084958 - RNA, 16 nt, Human
ugggcucuccaccuca

SEQ ID NO: 2084959 - RNA, 17 nt, Human
ugggcucuccaccucag

SEQ ID NO: 2084960 - RNA, 18 nt, Human
ugggcucuccaccucagc

SEQ ID NO: 2084961 - RNA, 19 nt, Human
ugggcucuccaccucagcc

SEQ ID NO: 2084962 - RNA, 20 nt, Human
ugggcucuccaccucagccu

SEQ ID NO: 2084963 - RNA, 21 nt, Human
ugggcucaagcaauccuccug

SEQ ID NO: 2084964 - RNA, 23 nt, Human
ugggcucaagcaauccuccugag

SEQ ID NO: 2084965 - RNA, 11 nt, Human
agggcugggug

SEQ ID NO: 2084966 - RNA, 12 nt, Human
agggcugggugu

SEQ ID NO: 2084967 - RNA, 16 nt, Human
agggcuggucucugcu

SEQ ID NO: 2084968 - RNA, 14 nt, Human
agggcccagagagg

SEQ ID NO: 2084969 - RNA, 16 nt, Human
agggccaagucccacc

SEQ ID NO: 2084970 - RNA, 14 nt, Human
agggcccaggcagg

SEQ ID NO: 2084971 - RNA, 15 nt, Human
agggcccaggcaggc

SEQ ID NO: 2084972 - RNA, 14 nt, Human
agggccccagcacu

SEQ ID NO: 2084973 - RNA, 18 nt, Human
agggccccagcacuaaag

SEQ ID NO: 2084974 - RNA, 18 nt, Human
agggccccagaaggcagg

SEQ ID NO: 2084975 - RNA, 12 nt, Human
agggccccagca

SEQ ID NO: 2084976 - RNA, 17 nt, Human
agggcccaggcaggcca

SEQ ID NO: 2084977 - RNA, 21 nt, Human
agggcugacacguccacccca

SEQ ID NO: 2084978 - RNA, 13 nt, Human
agggcugccacca

SEQ ID NO: 2084979 - RNA, 13 nt, Human
agggcaguggagg

SEQ ID NO: 2084980 - RNA, 14 nt, Human
agggcaguggaggu

SEQ ID NO: 2084981 - RNA, 17 nt, Human
agggcagaggcuggagg

SEQ ID NO: 2084982 - RNA, 20 nt, Human
agggcagaggcuggaggcag

SEQ ID NO: 2084983 - RNA, 22 nt, Human
agggcagaggcuggaggcaggg

SEQ ID NO: 2084984 - RNA, 14 nt, Human
agggcagaggcugg

SEQ ID NO: 2084985 - RNA, 15 nt, Human
agggcagaggcugga

SEQ ID NO: 2084986 - RNA, 17 nt, Human
agggcacugguggcccg

SEQ ID NO: 2084987 - RNA, 14 nt, Human
agggauacacugaa

SEQ ID NO: 2084988 - RNA, 15 nt, Human
agggcagagccggga

SEQ ID NO: 2084989 - RNA, 17 nt, Human
agggcauggccaggugg

SEQ ID NO: 2084990 - RNA, 16 nt, Human
agggcauucaaauggg

SEQ ID NO: 2084991 - RNA, 17 nt, Human
agggcaucaugcaucuu

SEQ ID NO: 2084992 - RNA, 13 nt, Human
agggcccagagag

SEQ ID NO: 2084993 - RNA, 12 nt, Human
agggcccagaga

SEQ ID NO: 2084994 - RNA, 16 nt, Human
agggauacccagugau

SEQ ID NO: 2084995 - RNA, 20 nt, Human
agggagugacagaggcagcc

SEQ ID NO: 2084996 - RNA, 13 nt, Human
agggagguuugug

SEQ ID NO: 2084997 - RNA, 17 nt, Human
agggagguuugugagag

SEQ ID NO: 2084998 - RNA, 18 nt, Human
agggagguuugugagagc

SEQ ID NO: 2084999 - RNA, 23 nt, Human
agggaguccgaaagggacuugga

SEQ ID NO: 2085000 - RNA, 20 nt, Human
agggaguccgaaagggacuu

SEQ ID NO: 2085001 - RNA, 15 nt, Human
ugggccaagccaggg

SEQ ID NO: 2085002 - RNA, 19 nt, Human
ugggccaagccagggaugg

SEQ ID NO: 2085003 - RNA, 20 nt, Human
ugggccaagucaaagacauu

SEQ ID NO: 2085004 - RNA, 14 nt, Human
ugggaggcugaggu

SEQ ID NO: 2085005 - RNA, 17 nt, Human
ugggcauugauggggaa

SEQ ID NO: 2085006 - RNA, 18 nt, Human
ugggcauugauggggaag

SEQ ID NO: 2085007 - RNA, 23 nt, Human
ugggcauugauggggaaggaggc

SEQ ID NO: 2085008 - RNA, 12 nt, Human
ugggcauugcuu

SEQ ID NO: 2085009 - RNA, 13 nt, Human
ugggcauugcuuu

SEQ ID NO: 2085010 - RNA, 16 nt, Human
ugggcauuugugaggc

SEQ ID NO: 2085011 - RNA, 14 nt, Human
ugggcauugcuuuc

SEQ ID NO: 2085012 - RNA, 15 nt, Human
ugggcauugcuuucc

SEQ ID NO: 2085013 - RNA, 20 nt, Human
ugggcauugcuuuccacuga

SEQ ID NO: 2085014 - RNA, 15 nt, Human
ugggcauuugugagg

SEQ ID NO: 2085015 - RNA, 19 nt, Human
agguuucucaaagaaauuu

SEQ ID NO: 2085016 - RNA, 14 nt, Human
agguuucugaaaau

SEQ ID NO: 2085017 - RNA, 16 nt, Human
agguuucucaaagaaa

SEQ ID NO: 2085018 - RNA, 20 nt, Human
agguuggcaaaaaggcagga

SEQ ID NO: 2085019 - RNA, 15 nt, Human
agguuucugaaaauu

SEQ ID NO: 2085020 - RNA, 23 nt, Human
agguuucugaaaauuaacacugc

SEQ ID NO: 2085021 - RNA, 15 nt, Human
uguaauugaauaaag

SEQ ID NO: 2085022 - RNA, 19 nt, Human
uguaauuaaguacuaugua

SEQ ID NO: 2085023 - RNA, 21 nt, Human
uguaauuaaguacuauguauc

SEQ ID NO: 2085024 - RNA, 18 nt, Human
uguaauuaaguacuaugu

SEQ ID NO: 2085025 - RNA, 12 nt, Human
uguacaguuuuu

SEQ ID NO: 2085026 - RNA, 14 nt, Human
uguaauuuucuuga

SEQ ID NO: 2085027 - RNA, 15 nt, Human
uguaauuuucuugau

SEQ ID NO: 2085028 - RNA, 17 nt, Human
uguaauuuucuugauga

SEQ ID NO: 2085029 - RNA, 13 nt, Human
uguacaaaauaaa

SEQ ID NO: 2085030 - RNA, 14 nt, Human
uguacaucuggccu

SEQ ID NO: 2085031 - RNA, 22 nt, Human
uguacaaaagggacaugaaaua

SEQ ID NO: 2085032 - RNA, 14 nt, Human
agguugaagcacca

SEQ ID NO: 2085033 - RNA, 14 nt, Human
agguugcagugagc

SEQ ID NO: 2085034 - RNA, 21 nt, Human
agguugacaauaaaugugcuu

SEQ ID NO: 2085035 - RNA, 19 nt, Human
agguugcagugagccaaga

SEQ ID NO: 2085036 - RNA, 18 nt, Human
agguugcagugagccaag

SEQ ID NO: 2085037 - RNA, 17 nt, Human
agguugcagugagcuga

SEQ ID NO: 2085038 - RNA, 18 nt, Human
agguugcagugagcugag

SEQ ID NO: 2085039 - RNA, 12 nt, Human
aggugugcucug

SEQ ID NO: 2085040 - RNA, 16 nt, Human
agguguccccagccca

SEQ ID NO: 2085041 - RNA, 17 nt, Human
agguguccccagcccac

SEQ ID NO: 2085042 - RNA, 19 nt, Human
agguguccccagcccacug

SEQ ID NO: 2085043 - RNA, 19 nt, Human
agguucuucccuuuuacau

SEQ ID NO: 2085044 - RNA, 12 nt, Human
agguugaaagac

SEQ ID NO: 2085045 - RNA, 23 nt, Human
agguucuucccuuuuacauacug

SEQ ID NO: 2085046 - RNA, 22 nt, Human
aggugugagucaccaagcccag

SEQ ID NO: 2085047 - RNA, 21 nt, Human
aggugugagucaccaagccca

SEQ ID NO: 2085048 - RNA, 20 nt, Human
aggugucccugcacuugcag

SEQ ID NO: 2085049 - RNA, 16 nt, Human
aggugucccugcacuu

SEQ ID NO: 2085050 - RNA, 15 nt, Human
aggugucauuuccau

SEQ ID NO: 2085051 - RNA, 17 nt, Human
aggugucauuuccauua

SEQ ID NO: 2085052 - RNA, 18 nt, Human
aggugggcugagcccugg

SEQ ID NO: 2085053 - RNA, 19 nt, Human
aggugggcugagcccuggc

SEQ ID NO: 2085054 - RNA, 20 nt, Human
aggugggcugagcccuggca

SEQ ID NO: 2085055 - RNA, 23 nt, Human
ugggcucugccccagcucuggcu

SEQ ID NO: 2085056 - RNA, 20 nt, Human
ugggcucugccccagcucug

SEQ ID NO: 2085057 - RNA, 21 nt, Human
ugggcucugccccagcucugg

SEQ ID NO: 2085058 - RNA, 12 nt, Human
ugggcucugccc

SEQ ID NO: 2085059 - RNA, 15 nt, Human
ugggcucugccccag

SEQ ID NO: 2085060 - RNA, 17 nt, Human
ugggcucugccccagcu

SEQ ID NO: 2085061 - RNA, 19 nt, Human
ugggcucugccccagcucu

SEQ ID NO: 2085062 - RNA, 18 nt, Human
aggugccugugaggcagg

SEQ ID NO: 2085063 - RNA, 15 nt, Human
ugggcugcccuggug

SEQ ID NO: 2085064 - RNA, 19 nt, Human
aggugccugugaggcaggg

SEQ ID NO: 2085065 - RNA, 20 nt, Human
aggugccugugaggcagggg

SEQ ID NO: 2085066 - RNA, 22 nt, Human
aggugccugugaggcaggggcg

SEQ ID NO: 2085067 - RNA, 23 nt, Human
aggugccuucuuauucucacucc

SEQ ID NO: 2085068 - RNA, 14 nt, Human
ugggcugcccuggu

SEQ ID NO: 2085069 - RNA, 13 nt, Human
ugggcugcccugg

SEQ ID NO: 2085070 - RNA, 16 nt, Human
ugggcugccaugugaa

SEQ ID NO: 2085071 - RNA, 12 nt, Human
aggugggaggau

SEQ ID NO: 2085072 - RNA, 13 nt, Human
aggugggagcuug

SEQ ID NO: 2085073 - RNA, 15 nt, Human
aggugggcugagccc

SEQ ID NO: 2085074 - RNA, 16 nt, Human
aggugggcugagcccu

SEQ ID NO: 2085075 - RNA, 17 nt, Human
aggugggcugagcccug

SEQ ID NO: 2085076 - RNA, 15 nt, Human
aggugggccuugcua

SEQ ID NO: 2085077 - RNA, 19 nt, Human
aggugggccuugcuaccuc

SEQ ID NO: 2085078 - RNA, 21 nt, Human
aggugggccuugcuaccucaa

SEQ ID NO: 2085079 - RNA, 22 nt, Human
aggugggccuugcuaccucaag

SEQ ID NO: 2085080 - RNA, 12 nt, Human
agguggcugccu

SEQ ID NO: 2085081 - RNA, 13 nt, Human
agguggcugccug

SEQ ID NO: 2085082 - RNA, 17 nt, Human
agguggcugccuggagc

SEQ ID NO: 2085083 - RNA, 18 nt, Human
agguggcugccuggagcc

SEQ ID NO: 2085084 - RNA, 23 nt, Human
agguggcugacccagucccuggg

SEQ ID NO: 2085085 - RNA, 21 nt, Human
aggugccugugaggcaggggc

SEQ ID NO: 2085086 - RNA, 13 nt, Human
aggugccuucuua

SEQ ID NO: 2085087 - RNA, 22 nt, Human
aggugccuucuuauucucacuc

SEQ ID NO: 2085088 - RNA, 23 nt, Human
aggugcuaaauggucgcccagga

SEQ ID NO: 2085089 - RNA, 22 nt, Human
uguagugaaucacguaaagcua

SEQ ID NO: 2085090 - RNA, 14 nt, Human
uguagucucaggac

SEQ ID NO: 2085091 - RNA, 23 nt, Human
uguaguccuagccacucaggagg

SEQ ID NO: 2085092 - RNA, 14 nt, Human
uguagucccagcua

SEQ ID NO: 2085093 - RNA, 17 nt, Human
uguagucccagcuacuc

SEQ ID NO: 2085094 - RNA, 16 nt, Human
uguaggguuauaauaa

SEQ ID NO: 2085095 - RNA, 18 nt, Human
uguaggguaaggugccuu

SEQ ID NO: 2085096 - RNA, 17 nt, Human
uguaggguuauaauaau

SEQ ID NO: 2085097 - RNA, 15 nt, Human
uguagguaucauuuu

SEQ ID NO: 2085098 - RNA, 13 nt, Human
uguaggguuucua

SEQ ID NO: 2085099 - RNA, 19 nt, Human
aguacaggcagcacagaga

SEQ ID NO: 2085100 - RNA, 15 nt, Human
aguaccacucaggcc

SEQ ID NO: 2085101 - RNA, 15 nt, Human
aguaccaucugaaua

SEQ ID NO: 2085102 - RNA, 20 nt, Human
aguagcaguagaugcaugua

SEQ ID NO: 2085103 - RNA, 14 nt, Human
aguagcaugagaga

SEQ ID NO: 2085104 - RNA, 23 nt, Human
aguagcaugagagaauuguauca

SEQ ID NO: 2085105 - RNA, 19 nt, Human
aguagcauguugagccagg

SEQ ID NO: 2085106 - RNA, 20 nt, Human
aguagcauguugagccaggc

SEQ ID NO: 2085107 - RNA, 18 nt, Human
uguauauauuuccuauau

SEQ ID NO: 2085108 - RNA, 17 nt, Human
uguauauauauuaagag

SEQ ID NO: 2085109 - RNA, 13 nt, Human
uguauauauacau

SEQ ID NO: 2085110 - RNA, 14 nt, Human
uguauauauacaua

SEQ ID NO: 2085111 - RNA, 17 nt, Human
uguauauauacauaaca

SEQ ID NO: 2085112 - RNA, 22 nt, Human
uguauauauuuccuauauuguu

SEQ ID NO: 2085113 - RNA, 19 nt, Human
aguaaucugaucguucuuu

SEQ ID NO: 2085114 - RNA, 15 nt, Human
uguauauacaauaac

SEQ ID NO: 2085115 - RNA, 16 nt, Human
uguauauacaauaaca

SEQ ID NO: 2085116 - RNA, 18 nt, Human
uguauauacaauaacaua

SEQ ID NO: 2085117 - RNA, 17 nt, Human
uguauauacaauaacau

SEQ ID NO: 2085118 - RNA, 20 nt, Human
aguaaguaccacucaggcca

SEQ ID NO: 2085119 - RNA, 15 nt, Human
aguaaguaucuucgu

SEQ ID NO: 2085120 - RNA, 23 nt, Human
aguaaguaucuucguucuuguua

SEQ ID NO: 2085121 - RNA, 16 nt, Human
aguaauaaacuguguu

SEQ ID NO: 2085122 - RNA, 13 nt, Human
aguaauaaaacau

SEQ ID NO: 2085123 - RNA, 15 nt, Human
aguaauaaaacaucu

SEQ ID NO: 2085124 - RNA, 16 nt, Human
aguaauaaaacaucuu

SEQ ID NO: 2085125 - RNA, 17 nt, Human
aguaauaaaacaucuuu

SEQ ID NO: 2085126 - RNA, 17 nt, Human
aguaauaaacuguguuu

SEQ ID NO: 2085127 - RNA, 21 nt, Human
uguacauggaauaacauguaa

SEQ ID NO: 2085128 - RNA, 21 nt, Human
agguuuuuuuguauaguaaag

SEQ ID NO: 2085129 - RNA, 22 nt, Human
agguuuuuuuguauaguaaagu

SEQ ID NO: 2085130 - RNA, 19 nt, Human
aguaaaaaacaacuucuuu

SEQ ID NO: 2085131 - RNA, 16 nt, Human
aguaauugugaaaaag

SEQ ID NO: 2085132 - RNA, 15 nt, Human
aguaauugugaaaaa

SEQ ID NO: 2085133 - RNA, 12 nt, Human
aguaauugugaa

SEQ ID NO: 2085134 - RNA, 13 nt, Human
aguaauuuauugu

SEQ ID NO: 2085135 - RNA, 23 nt, Human
aguaauuuauuguuuuuccuugu

SEQ ID NO: 2085136 - RNA, 22 nt, Human
aguaauuuauuguuuuuccuug

SEQ ID NO: 2085137 - RNA, 14 nt, Human
aguacaggcagcac

SEQ ID NO: 2085138 - RNA, 17 nt, Human
aguacaggcagcacaga

SEQ ID NO: 2085139 - RNA, 18 nt, Human
aguacaggcagcacagag

SEQ ID NO: 2085140 - RNA, 12 nt, Human
aguaaugaauuu

SEQ ID NO: 2085141 - RNA, 21 nt, Human
aguaaugaauuuuuaugauau

SEQ ID NO: 2085142 - RNA, 22 nt, Human
aguaaugaauuuuuaugauauu

SEQ ID NO: 2085143 - RNA, 22 nt, Human
agucagccuucccccucccagg

SEQ ID NO: 2085144 - RNA, 23 nt, Human
agucagccuucccccucccaggg

SEQ ID NO: 2085145 - RNA, 19 nt, Human
agucagcuuugccuuccac

SEQ ID NO: 2085146 - RNA, 22 nt, Human
agucagcuuugccuuccacgcu

SEQ ID NO: 2085147 - RNA, 22 nt, Human
agucagugggaacgugacugcc

SEQ ID NO: 2085148 - RNA, 14 nt, Human
agucagcagaacug

SEQ ID NO: 2085149 - RNA, 13 nt, Human
ugucgccucugca

SEQ ID NO: 2085150 - RNA, 14 nt, Human
ugucgccucugcau

SEQ ID NO: 2085151 - RNA, 15 nt, Human
ugucccuggccaucu

SEQ ID NO: 2085152 - RNA, 16 nt, Human
ugucccuggccaucuc

SEQ ID NO: 2085153 - RNA, 17 nt, Human
ugucccuggccaucucu

SEQ ID NO: 2085154 - RNA, 22 nt, Human
ugucccuggccaucucugaacu

SEQ ID NO: 2085155 - RNA, 22 nt, Human
ugucccuaauuuaacccagcuc

SEQ ID NO: 2085156 - RNA, 12 nt, Human
ugucccuacacc

SEQ ID NO: 2085157 - RNA, 13 nt, Human
ugucccugucacc

SEQ ID NO: 2085158 - RNA, 16 nt, Human
ugucccugucaccaag

SEQ ID NO: 2085159 - RNA, 21 nt, Human
ugucccugucaccaagcucac

SEQ ID NO: 2085160 - RNA, 16 nt, Human
agucccaccuuggcug

SEQ ID NO: 2085161 - RNA, 15 nt, Human
agucccaccuuggcu

SEQ ID NO: 2085162 - RNA, 14 nt, Human
agucccaaggaaag

SEQ ID NO: 2085163 - RNA, 17 nt, Human
agucccaaggaaagccc

SEQ ID NO: 2085164 - RNA, 17 nt, Human
agucauaccaacuuuag

SEQ ID NO: 2085165 - RNA, 14 nt, Human
agucaguuugcagu

SEQ ID NO: 2085166 - RNA, 16 nt, Human
agucaguugaaauucu

SEQ ID NO: 2085167 - RNA, 14 nt, Human
agucauagaagaac

SEQ ID NO: 2085168 - RNA, 16 nt, Human
agucauagaagaacua

SEQ ID NO: 2085169 - RNA, 18 nt, Human
agucccagcuacucagga

SEQ ID NO: 2085170 - RNA, 19 nt, Human
agucccagcuacucaggag

SEQ ID NO: 2085171 - RNA, 11 nt, Human
agucccagcua

SEQ ID NO: 2085172 - RNA, 22 nt, Human
agucccagcuacucagaagccu

SEQ ID NO: 2085173 - RNA, 20 nt, Human
agucccaccgguugcuucug

SEQ ID NO: 2085174 - RNA, 23 nt, Human
agucccaccgguugcuucuggga

SEQ ID NO: 2085175 - RNA, 20 nt, Human
agucccaaggaaagccccag

SEQ ID NO: 2085176 - RNA, 21 nt, Human
agucccaaggaaagccccagc

SEQ ID NO: 2085177 - RNA, 19 nt, Human
agucccaccuuggcugcag

SEQ ID NO: 2085178 - RNA, 18 nt, Human
agucccaccuuggcugca

SEQ ID NO: 2085179 - RNA, 12 nt, Human
agucggauuaga

SEQ ID NO: 2085180 - RNA, 20 nt, Human
agucggaacggagaaaggug

SEQ ID NO: 2085181 - RNA, 13 nt, Human
agucgcugaggaa

SEQ ID NO: 2085182 - RNA, 15 nt, Human
agucgcugaggaaaa

SEQ ID NO: 2085183 - RNA, 16 nt, Human
agucgcugaggaaaaa

SEQ ID NO: 2085184 - RNA, 19 nt, Human
agucgcaucucagugcagg

SEQ ID NO: 2085185 - RNA, 16 nt, Human
agucccccugccccag

SEQ ID NO: 2085186 - RNA, 22 nt, Human
aguccuacuuuacauaugcuuu

SEQ ID NO: 2085187 - RNA, 17 nt, Human
aguccuagccacucagg

SEQ ID NO: 2085188 - RNA, 15 nt, Human
aguccucacucccag

SEQ ID NO: 2085189 - RNA, 16 nt, Human
aguccucacucccagu

SEQ ID NO: 2085190 - RNA, 17 nt, Human
aguccucacucccaguc

SEQ ID NO: 2085191 - RNA, 18 nt, Human
aguccucacucccagucc

SEQ ID NO: 2085192 - RNA, 17 nt, Human
agucuaaauauuuccuu

SEQ ID NO: 2085193 - RNA, 23 nt, Human
agucuaaauauuuccuuaaacug

SEQ ID NO: 2085194 - RNA, 16 nt, Human
agucuaaauauuuccu

SEQ ID NO: 2085195 - RNA, 12 nt, Human
agucuaaccaaa

SEQ ID NO: 2085196 - RNA, 13 nt, Human
agucuaaccaaau

SEQ ID NO: 2085197 - RNA, 14 nt, Human
agucuaaccaaaug

SEQ ID NO: 2085198 - RNA, 16 nt, Human
agucuaaccaaaugca

SEQ ID NO: 2085199 - RNA, 17 nt, Human
agucuaaccaaaugcau

SEQ ID NO: 2085200 - RNA, 20 nt, Human
agucuaaccaaaugcaucaa

SEQ ID NO: 2085201 - RNA, 14 nt, Human
agucuacgcucucc

SEQ ID NO: 2085202 - RNA, 15 nt, Human
agucuacgcucuccu

SEQ ID NO: 2085203 - RNA, 17 nt, Human
agucuacgcucuccuuu

SEQ ID NO: 2085204 - RNA, 20 nt, Human
agucuacgcucuccuuucuu

SEQ ID NO: 2085205 - RNA, 18 nt, Human
agucuaggagcugggagg

SEQ ID NO: 2085206 - RNA, 22 nt, Human
agucuaggagcugggaggaaaa

SEQ ID NO: 2085207 - RNA, 20 nt, Human
agucuaggagcugggaggaa

SEQ ID NO: 2085208 - RNA, 17 nt, Human
agucuaguuccugauga

SEQ ID NO: 2085209 - RNA, 22 nt, Human
agucuaguuccugaugacccag

SEQ ID NO: 2085210 - RNA, 14 nt, Human
agucuauuagccac

SEQ ID NO: 2085211 - RNA, 23 nt, Human
agucucacuguugcccaggcugg

SEQ ID NO: 2085212 - RNA, 13 nt, Human
ugucucaucccca

SEQ ID NO: 2085213 - RNA, 16 nt, Human
ugucucauccccaggg

SEQ ID NO: 2085214 - RNA, 23 nt, Human
ugucucauccccaggggucccag

SEQ ID NO: 2085215 - RNA, 19 nt, Human
aguauucuuauuuaaugaa

SEQ ID NO: 2085216 - RNA, 12 nt, Human
aguauucugccu

SEQ ID NO: 2085217 - RNA, 13 nt, Human
aguauucugccuu

SEQ ID NO: 2085218 - RNA, 22 nt, Human
aguauucugccuuugcagaaac

SEQ ID NO: 2085219 - RNA, 23 nt, Human
aguauucugccuuugcagaaaca

SEQ ID NO: 2085220 - RNA, 12 nt, Human
aguauuuauaua

SEQ ID NO: 2085221 - RNA, 13 nt, Human
aguauuuauauau

SEQ ID NO: 2085222 - RNA, 14 nt, Human
aguauuuauauauu

SEQ ID NO: 2085223 - RNA, 15 nt, Human
aguauuuauauauuu

SEQ ID NO: 2085224 - RNA, 16 nt, Human
aguauuuauauauuua

SEQ ID NO: 2085225 - RNA, 17 nt, Human
aguauuuauauauuuau

SEQ ID NO: 2085226 - RNA, 19 nt, Human
aguauuuauauauuuauaa

SEQ ID NO: 2085227 - RNA, 20 nt, Human
aguauuuauauauuuauaac

SEQ ID NO: 2085228 - RNA, 23 nt, Human
aguauuuauauauuuauaacuca

SEQ ID NO: 2085229 - RNA, 20 nt, Human
aguauuuauuuaauguuaug

SEQ ID NO: 2085230 - RNA, 15 nt, Human
aguauuuauuuaaug

SEQ ID NO: 2085231 - RNA, 14 nt, Human
aguauuuucccaau

SEQ ID NO: 2085232 - RNA, 15 nt, Human
agucaccaagcccag

SEQ ID NO: 2085233 - RNA, 13 nt, Human
agucaccaggaau

SEQ ID NO: 2085234 - RNA, 16 nt, Human
agucacccaugaagac

SEQ ID NO: 2085235 - RNA, 17 nt, Human
agucacccaugaagaca

SEQ ID NO: 2085236 - RNA, 20 nt, Human
agucacccaugaagacagga

SEQ ID NO: 2085237 - RNA, 19 nt, Human
agucaccaggaauguuaaa

SEQ ID NO: 2085238 - RNA, 12 nt, Human
ugucagagcugg

SEQ ID NO: 2085239 - RNA, 13 nt, Human
ugucagagcuggg

SEQ ID NO: 2085240 - RNA, 14 nt, Human
ugucagagcuggga

SEQ ID NO: 2085241 - RNA, 15 nt, Human
ugucagagcugggag

SEQ ID NO: 2085242 - RNA, 20 nt, Human
ugucagaggcacaaaagggu

SEQ ID NO: 2085243 - RNA, 15 nt, Human
ugucagauaugauau

SEQ ID NO: 2085244 - RNA, 20 nt, Human
ugucagauauuuuuucagaa

SEQ ID NO: 2085245 - RNA, 21 nt, Human
ugucagauauuuuuucagaaa

SEQ ID NO: 2085246 - RNA, 23 nt, Human
ugucagauauuuuuucagaaaua

SEQ ID NO: 2085247 - RNA, 19 nt, Human
uguauauugucagauauuu

SEQ ID NO: 2085248 - RNA, 18 nt, Human
uguauauuuaaaagaaag

SEQ ID NO: 2085249 - RNA, 21 nt, Human
uguauauuauggaagauuuua

SEQ ID NO: 2085250 - RNA, 23 nt, Human
uguauauuauggaagauuuuaaa

SEQ ID NO: 2085251 - RNA, 16 nt, Human
aguauguuuuagcaug

SEQ ID NO: 2085252 - RNA, 18 nt, Human
aguauguuuuagcaugug

SEQ ID NO: 2085253 - RNA, 19 nt, Human
aguauguuuuagcaugugu

SEQ ID NO: 2085254 - RNA, 20 nt, Human
aguauguuuuagcauguguu

SEQ ID NO: 2085255 - RNA, 12 nt, Human
aguauacaagau

SEQ ID NO: 2085256 - RNA, 14 nt, Human
aguauacaagauaa

SEQ ID NO: 2085257 - RNA, 15 nt, Human
aguauacaagauaag

SEQ ID NO: 2085258 - RNA, 18 nt, Human
aguauacaagauaagcuu

SEQ ID NO: 2085259 - RNA, 14 nt, Human
aguauuccaccuua

SEQ ID NO: 2085260 - RNA, 21 nt, Human
aguauuccaccuuaaauuaaa

SEQ ID NO: 2085261 - RNA, 22 nt, Human
aguauuccaccuuaaauuaaac

SEQ ID NO: 2085262 - RNA, 23 nt, Human
aguauuccaccuuaaauuaaaca

SEQ ID NO: 2085263 - RNA, 23 nt, Human
aguauucaagaaagccagucuua

SEQ ID NO: 2085264 - RNA, 19 nt, Human
aguauuccauugugugagu

SEQ ID NO: 2085265 - RNA, 20 nt, Human
aguauuccauugugugagug

SEQ ID NO: 2085266 - RNA, 22 nt, Human
aguauuccauugugugagugua

SEQ ID NO: 2085267 - RNA, 15 nt, Human
aguauuaaagggggg

SEQ ID NO: 2085268 - RNA, 20 nt, Human
aguauuaaaggggggagggg

SEQ ID NO: 2085269 - RNA, 23 nt, Human
ugucccugcacuugcagacucua

SEQ ID NO: 2085270 - RNA, 22 nt, Human
ugucccugcacuugcagacucu

SEQ ID NO: 2085271 - RNA, 20 nt, Human
ugucccugcacuugcagacu

SEQ ID NO: 2085272 - RNA, 17 nt, Human
ugucccgauuguaacuc

SEQ ID NO: 2085273 - RNA, 16 nt, Human
ugucccgauuguaacu

SEQ ID NO: 2085274 - RNA, 21 nt, Human
uguccccuccucacucccuuc

SEQ ID NO: 2085275 - RNA, 14 nt, Human
uguccagcgccuag

SEQ ID NO: 2085276 - RNA, 14 nt, Human
uguccagccugggc

SEQ ID NO: 2085277 - RNA, 19 nt, Human
uguccagccugggcagcca

SEQ ID NO: 2085278 - RNA, 22 nt, Human
uguccagccugggcagccaggc

SEQ ID NO: 2085279 - RNA, 23 nt, Human
uguccagccugggcagccaggcu

SEQ ID NO: 2085280 - RNA, 12 nt, Human
uguccagccugg

SEQ ID NO: 2085281 - RNA, 20 nt, Human
uguccagccccguagacgug

SEQ ID NO: 2085282 - RNA, 12 nt, Human
uguccagagaca

SEQ ID NO: 2085283 - RNA, 13 nt, Human
uguccagagacaa

SEQ ID NO: 2085284 - RNA, 11 nt, Human
uguccagagag

SEQ ID NO: 2085285 - RNA, 23 nt, Human
uguccagagagagaagugccccu

SEQ ID NO: 2085286 - RNA, 18 nt, Human
uguccaagugugugugcg

SEQ ID NO: 2085287 - RNA, 17 nt, Human
uguccaagugugugugc

SEQ ID NO: 2085288 - RNA, 22 nt, Human
ugucauuugagcagggcucagc

SEQ ID NO: 2085289 - RNA, 21 nt, Human
ugucauuugagcagggcucag

SEQ ID NO: 2085290 - RNA, 20 nt, Human
ugucauuugagcagggcuca

SEQ ID NO: 2085291 - RNA, 20 nt, Human
ugucagguggggcagcuuga

SEQ ID NO: 2085292 - RNA, 18 nt, Human
ugucagguggggcagcuu

SEQ ID NO: 2085293 - RNA, 17 nt, Human
ugucagguggggcagcu

SEQ ID NO: 2085294 - RNA, 11 nt, Human
ugucagauucc

SEQ ID NO: 2085295 - RNA, 14 nt, Human
ugucagauuccuuu

SEQ ID NO: 2085296 - RNA, 15 nt, Human
ugucagauuccuuuc

SEQ ID NO: 2085297 - RNA, 17 nt, Human
ugucagauuccuuuccc

SEQ ID NO: 2085298 - RNA, 21 nt, Human
uguccaaccuaaccccuuucc

SEQ ID NO: 2085299 - RNA, 13 nt, Human
uguccaacuccag

SEQ ID NO: 2085300 - RNA, 14 nt, Human
uguccaacuccagu

SEQ ID NO: 2085301 - RNA, 15 nt, Human
uguccaacuccagua

SEQ ID NO: 2085302 - RNA, 23 nt, Human
uguccaacuccaguacuggagcu

SEQ ID NO: 2085303 - RNA, 15 nt, Human
uguccaaccuaaccc

SEQ ID NO: 2085304 - RNA, 22 nt, Human
uguccaaccuaaccccuuuccu

SEQ ID NO: 2085305 - RNA, 18 nt, Human
uguccaacccgaggcccg

SEQ ID NO: 2085306 - RNA, 19 nt, Human
uguccaaaggaggcuggca

SEQ ID NO: 2085307 - RNA, 13 nt, Human
ugucagcaggaag

SEQ ID NO: 2085308 - RNA, 17 nt, Human
uguccaaacugccuaag

SEQ ID NO: 2085309 - RNA, 15 nt, Human
uguccaaacugccua

SEQ ID NO: 2085310 - RNA, 22 nt, Human
uguccaaacugccuaagcccuc

SEQ ID NO: 2085311 - RNA, 13 nt, Human
uguuaauaaaagu

SEQ ID NO: 2085312 - RNA, 18 nt, Human
uguuaauaaaaguacaug

SEQ ID NO: 2085313 - RNA, 15 nt, Human
uguuaagugguuuca

SEQ ID NO: 2085314 - RNA, 20 nt, Human
uguuaagcgugucuguauuu

SEQ ID NO: 2085315 - RNA, 22 nt, Human
uguuaaguugauggugaugaaa

SEQ ID NO: 2085316 - RNA, 19 nt, Human
uguuaauaaaaguacaugu

SEQ ID NO: 2085317 - RNA, 14 nt, Human
uguuaauauucuuu

SEQ ID NO: 2085318 - RNA, 17 nt, Human
uguuaauauucuuucaa

SEQ ID NO: 2085319 - RNA, 18 nt, Human
uguuaauauucuuucaau

SEQ ID NO: 2085320 - RNA, 19 nt, Human
uguuacauaagauaaaugu

SEQ ID NO: 2085321 - RNA, 22 nt, Human
uguuaacuuaauaguauuuaug

SEQ ID NO: 2085322 - RNA, 14 nt, Human
uguuaacuuagcuu

SEQ ID NO: 2085323 - RNA, 15 nt, Human
aguggggacagagca

SEQ ID NO: 2085324 - RNA, 18 nt, Human
aguggggagacaccucag

SEQ ID NO: 2085325 - RNA, 19 nt, Human
aguggggagacaccucaga

SEQ ID NO: 2085326 - RNA, 20 nt, Human
aguggggagacaccucagag

SEQ ID NO: 2085327 - RNA, 18 nt, Human
aguggggucucccucucc

SEQ ID NO: 2085328 - RNA, 19 nt, Human
aguggggucucccucuccu

SEQ ID NO: 2085329 - RNA, 20 nt, Human
aguggggucucccucuccug

SEQ ID NO: 2085330 - RNA, 22 nt, Human
aguggggucucccucuccugcc

SEQ ID NO: 2085331 - RNA, 23 nt, Human
aguggggucucccucuccugccu

SEQ ID NO: 2085332 - RNA, 14 nt, Human
aguggauugcauuu

SEQ ID NO: 2085333 - RNA, 13 nt, Human
aguggaugauguu

SEQ ID NO: 2085334 - RNA, 15 nt, Human
aguggaugauguuuc

SEQ ID NO: 2085335 - RNA, 20 nt, Human
aguggaugauguuucgugaa

SEQ ID NO: 2085336 - RNA, 21 nt, Human
aguggcaagaccaaaaugaca

SEQ ID NO: 2085337 - RNA, 23 nt, Human
aguggcaagaccaaaaugacaau

SEQ ID NO: 2085338 - RNA, 19 nt, Human
aguggaccuugagaccaca

SEQ ID NO: 2085339 - RNA, 18 nt, Human
aguggaccuugagaccac

SEQ ID NO: 2085340 - RNA, 23 nt, Human
uguuacaggcaccgagaauguug

SEQ ID NO: 2085341 - RNA, 21 nt, Human
uguuacaggcaccgagaaugu

SEQ ID NO: 2085342 - RNA, 16 nt, Human
ugugucucuuuucucu

SEQ ID NO: 2085343 - RNA, 19 nt, Human
ugugucugcgucuguguug

SEQ ID NO: 2085344 - RNA, 14 nt, Human
ugugucucuuuucu

SEQ ID NO: 2085345 - RNA, 20 nt, Human
ugugucuugcaauggcagcc

SEQ ID NO: 2085346 - RNA, 17 nt, Human
ugugucuucaauuugua

SEQ ID NO: 2085347 - RNA, 22 nt, Human
uguguguugaucccaagacaau

SEQ ID NO: 2085348 - RNA, 14 nt, Human
uguguguugucuga

SEQ ID NO: 2085349 - RNA, 15 nt, Human
ugugucccucucucu

SEQ ID NO: 2085350 - RNA, 16 nt, Human
ugugucccucucucug

SEQ ID NO: 2085351 - RNA, 17 nt, Human
ugugucccucucucugg

SEQ ID NO: 2085352 - RNA, 14 nt, Human
uguguccuugcacc

SEQ ID NO: 2085353 - RNA, 18 nt, Human
uguguccuugcaccugca

SEQ ID NO: 2085354 - RNA, 19 nt, Human
uguguccuugcaccugcau

SEQ ID NO: 2085355 - RNA, 20 nt, Human
uguguccuugcaccugcauc

SEQ ID NO: 2085356 - RNA, 15 nt, Human
uguguccaacuccag

SEQ ID NO: 2085357 - RNA, 19 nt, Human
uguguccaagugugugugc

SEQ ID NO: 2085358 - RNA, 18 nt, Human
uguguccaugugugugca

SEQ ID NO: 2085359 - RNA, 15 nt, Human
uguguccaucccagc

SEQ ID NO: 2085360 - RNA, 16 nt, Human
uguguccaucccagcg

SEQ ID NO: 2085361 - RNA, 14 nt, Human
uguguccaugugug

SEQ ID NO: 2085362 - RNA, 16 nt, Human
uguguccaugugugug

SEQ ID NO: 2085363 - RNA, 17 nt, Human
uguguccaugugugugc

SEQ ID NO: 2085364 - RNA, 20 nt, Human
ugugucagguggggcagcuu

SEQ ID NO: 2085365 - RNA, 20 nt, Human
ugugguuuucuuuugccaug

SEQ ID NO: 2085366 - RNA, 21 nt, Human
uguguaaaguguaaauccuuu

SEQ ID NO: 2085367 - RNA, 12 nt, Human
ugugguuuguug

SEQ ID NO: 2085368 - RNA, 18 nt, Human
ugugguuuccaaggagcu

SEQ ID NO: 2085369 - RNA, 17 nt, Human
ugugguaguuaauaaaa

SEQ ID NO: 2085370 - RNA, 21 nt, Human
ugugguuuucuuuugccauga

SEQ ID NO: 2085371 - RNA, 19 nt, Human
ugugguuuucuuuugccau

SEQ ID NO: 2085372 - RNA, 22 nt, Human
agugccccugcugccuccccaa

SEQ ID NO: 2085373 - RNA, 20 nt, Human
agugccccugcugccucccc

SEQ ID NO: 2085374 - RNA, 21 nt, Human
agugccccugcugccucccca

SEQ ID NO: 2085375 - RNA, 16 nt, Human
agugcccuccacagcc

SEQ ID NO: 2085376 - RNA, 17 nt, Human
agugcccuccacagccg

SEQ ID NO: 2085377 - RNA, 21 nt, Human
agugcccuccacagccgcagc

SEQ ID NO: 2085378 - RNA, 11 nt, Human
agugccccugc

SEQ ID NO: 2085379 - RNA, 15 nt, Human
agugcccaacuguua

SEQ ID NO: 2085380 - RNA, 12 nt, Human
agugccccugcu

SEQ ID NO: 2085381 - RNA, 13 nt, Human
agugccccugcug

SEQ ID NO: 2085382 - RNA, 14 nt, Human
agugccccugcugc

SEQ ID NO: 2085383 - RNA, 19 nt, Human
agugccccugcugccuccc

SEQ ID NO: 2085384 - RNA, 20 nt, Human
agugccagucuugugucugc

SEQ ID NO: 2085385 - RNA, 14 nt, Human
agugccauugucuu

SEQ ID NO: 2085386 - RNA, 15 nt, Human
agugccauugucuuu

SEQ ID NO: 2085387 - RNA, 16 nt, Human
agugccauugucuuua

SEQ ID NO: 2085388 - RNA, 17 nt, Human
agugccauugucuuuau

SEQ ID NO: 2085389 - RNA, 18 nt, Human
agugccauugucuuuaua

SEQ ID NO: 2085390 - RNA, 21 nt, Human
agugccauugucuuuauauga

SEQ ID NO: 2085391 - RNA, 14 nt, Human
agugcccaacuguu

SEQ ID NO: 2085392 - RNA, 22 nt, Human
ugugguagggacuuaaaaaacu

SEQ ID NO: 2085393 - RNA, 14 nt, Human
agugguauagaaau

SEQ ID NO: 2085394 - RNA, 15 nt, Human
agugguauagaaaug

SEQ ID NO: 2085395 - RNA, 16 nt, Human
agugguauagaaaugc

SEQ ID NO: 2085396 - RNA, 18 nt, Human
agugguauagaaaugcug

SEQ ID NO: 2085397 - RNA, 12 nt, Human
agugugagaauc

SEQ ID NO: 2085398 - RNA, 22 nt, Human
aguggucgcuuacuuugaguga

SEQ ID NO: 2085399 - RNA, 20 nt, Human
agugugccugaagucccaga

SEQ ID NO: 2085400 - RNA, 12 nt, Human
agugugaguaag

SEQ ID NO: 2085401 - RNA, 15 nt, Human
agugugggaagggag

SEQ ID NO: 2085402 - RNA, 17 nt, Human
agugugggaagggagag

SEQ ID NO: 2085403 - RNA, 14 nt, Human
agugugggaaugcg

SEQ ID NO: 2085404 - RNA, 14 nt, Human
aguguggcuccccu

SEQ ID NO: 2085405 - RNA, 16 nt, Human
aguguggcuccccucu

SEQ ID NO: 2085406 - RNA, 17 nt, Human
aguguggcuccccucua

SEQ ID NO: 2085407 - RNA, 21 nt, Human
aguguggcuccccucuauuua

SEQ ID NO: 2085408 - RNA, 21 nt, Human
agugugccugaagucccagau

SEQ ID NO: 2085409 - RNA, 16 nt, Human
agugugaguaagagcu

SEQ ID NO: 2085410 - RNA, 17 nt, Human
agugugaguaagagcug

SEQ ID NO: 2085411 - RNA, 18 nt, Human
agugugaguaagagcugg

SEQ ID NO: 2085412 - RNA, 19 nt, Human
agugugaguaagagcuggu

SEQ ID NO: 2085413 - RNA, 20 nt, Human
uguuccaagacauugucaau

SEQ ID NO: 2085414 - RNA, 19 nt, Human
uguuccacaaguuaaauaa

SEQ ID NO: 2085415 - RNA, 11 nt, Human
uguuccaagac

SEQ ID NO: 2085416 - RNA, 14 nt, Human
uguuccaagacauu

SEQ ID NO: 2085417 - RNA, 15 nt, Human
uguuccaagacauug

SEQ ID NO: 2085418 - RNA, 18 nt, Human
uguuccaagacauuguca

SEQ ID NO: 2085419 - RNA, 19 nt, Human
uguuccaagacauugucaa

SEQ ID NO: 2085420 - RNA, 21 nt, Human
uguuccaagacauugucaaua

SEQ ID NO: 2085421 - RNA, 19 nt, Human
uguucguucuuguucuguu

SEQ ID NO: 2085422 - RNA, 14 nt, Human
uguuccuggcaaua

SEQ ID NO: 2085423 - RNA, 21 nt, Human
uguuccuggcaauaguguguu

SEQ ID NO: 2085424 - RNA, 18 nt, Human
uguuccuucacauccugu

SEQ ID NO: 2085425 - RNA, 18 nt, Human
uguucauuuguuauucuu

SEQ ID NO: 2085426 - RNA, 19 nt, Human
uguucauuuguuauucuua

SEQ ID NO: 2085427 - RNA, 20 nt, Human
uguucauuuguuauucuuaa

SEQ ID NO: 2085428 - RNA, 11 nt, Human
aguguguaaag

SEQ ID NO: 2085429 - RNA, 16 nt, Human
aguguguaugugcgug

SEQ ID NO: 2085430 - RNA, 19 nt, Human
aguguguaugugcgugugu

SEQ ID NO: 2085431 - RNA, 20 nt, Human
aguguguaugugcgugugug

SEQ ID NO: 2085432 - RNA, 14 nt, Human
uguuaucuuggugu

SEQ ID NO: 2085433 - RNA, 12 nt, Human
agugugugugcg

SEQ ID NO: 2085434 - RNA, 18 nt, Human
aguguucccuuuccuacu

SEQ ID NO: 2085435 - RNA, 14 nt, Human
aguuagcucaggag

SEQ ID NO: 2085436 - RNA, 16 nt, Human
aguuagcucaggaggc

SEQ ID NO: 2085437 - RNA, 19 nt, Human
aguuagaggccagccuggc

SEQ ID NO: 2085438 - RNA, 14 nt, Human
aguuagagaugccu

SEQ ID NO: 2085439 - RNA, 18 nt, Human
aguuagagaugccucccu

SEQ ID NO: 2085440 - RNA, 23 nt, Human
aguuacuaucaugucaaacguga

SEQ ID NO: 2085441 - RNA, 15 nt, Human
aguuacuauccuggc

SEQ ID NO: 2085442 - RNA, 16 nt, Human
aguuacuauccuggcu

SEQ ID NO: 2085443 - RNA, 17 nt, Human
aguuacuauccuggcuu

SEQ ID NO: 2085444 - RNA, 12 nt, Human
aguuacucagcc

SEQ ID NO: 2085445 - RNA, 13 nt, Human
aguuacucagccc

SEQ ID NO: 2085446 - RNA, 14 nt, Human
aguuacucagcccu

SEQ ID NO: 2085447 - RNA, 19 nt, Human
aguuacucagcccugggcc

SEQ ID NO: 2085448 - RNA, 23 nt, Human
aguuacucagcccugggccccac

SEQ ID NO: 2085449 - RNA, 15 nt, Human
aguuacucagcccug

SEQ ID NO: 2085450 - RNA, 16 nt, Human
aguuacucagcccugg

SEQ ID NO: 2085451 - RNA, 17 nt, Human
aguuacucagcccuggg

SEQ ID NO: 2085452 - RNA, 18 nt, Human
aguuacucagcccugggc

SEQ ID NO: 2085453 - RNA, 13 nt, Human
aguguuguuugua

SEQ ID NO: 2085454 - RNA, 14 nt, Human
aguguuguuuguaa

SEQ ID NO: 2085455 - RNA, 15 nt, Human
uguugcccuuucugu

SEQ ID NO: 2085456 - RNA, 21 nt, Human
uguugcccuuucuguaccauu

SEQ ID NO: 2085457 - RNA, 22 nt, Human
agugugugcacaugugugcgug

SEQ ID NO: 2085458 - RNA, 14 nt, Human
agugugugcaugug

SEQ ID NO: 2085459 - RNA, 16 nt, Human
agugugugcaugugug

SEQ ID NO: 2085460 - RNA, 17 nt, Human
agugugugcaugugugc

SEQ ID NO: 2085461 - RNA, 23 nt, Human
agugugugcaugugugugcucag

SEQ ID NO: 2085462 - RNA, 21 nt, Human
aguguguggcuuucagagccu

SEQ ID NO: 2085463 - RNA, 17 nt, Human
agugugugcaugugugu

SEQ ID NO: 2085464 - RNA, 18 nt, Human
agugugugcaugugugug

SEQ ID NO: 2085465 - RNA, 20 nt, Human
uguugcccaggcuggcgugc

SEQ ID NO: 2085466 - RNA, 23 nt, Human
uguugcccaggcuggcgugcagu

SEQ ID NO: 2085467 - RNA, 12 nt, Human
uguugccagaga

SEQ ID NO: 2085468 - RNA, 19 nt, Human
agucucgcucuguugccca

SEQ ID NO: 2085469 - RNA, 19 nt, Human
agucucuucuccacuggau

SEQ ID NO: 2085470 - RNA, 16 nt, Human
agucucuagguucuga

SEQ ID NO: 2085471 - RNA, 14 nt, Human
agucuccuuccccu

SEQ ID NO: 2085472 - RNA, 21 nt, Human
agucucuucuccacuggaugg

SEQ ID NO: 2085473 - RNA, 15 nt, Human
agucucuuuaaucuu

SEQ ID NO: 2085474 - RNA, 17 nt, Human
agucucuuuaaucuuca

SEQ ID NO: 2085475 - RNA, 21 nt, Human
agucucuuuaaucuucaguuu

SEQ ID NO: 2085476 - RNA, 23 nt, Human
agucucuuuaaucuucaguuuua

SEQ ID NO: 2085477 - RNA, 22 nt, Human
agucucuuuaaucuucaguuuu

SEQ ID NO: 2085478 - RNA, 21 nt, Human
agucugaagcagaugcaaaga

SEQ ID NO: 2085479 - RNA, 14 nt, Human
agucugaagcagau

SEQ ID NO: 2085480 - RNA, 13 nt, Human
agucuuagaugua

SEQ ID NO: 2085481 - RNA, 14 nt, Human
agucuuagauguau

SEQ ID NO: 2085482 - RNA, 16 nt, Human
agucuuagauguauau

SEQ ID NO: 2085483 - RNA, 23 nt, Human
agucuuagauguauauauuuccu

SEQ ID NO: 2085484 - RNA, 14 nt, Human
ugugagaaaacguu

SEQ ID NO: 2085485 - RNA, 19 nt, Human
ugugacuucagcucuguuu

SEQ ID NO: 2085486 - RNA, 18 nt, Human
ugugacuucagcucuguu

SEQ ID NO: 2085487 - RNA, 20 nt, Human
ugugacugauguuaggcugg

SEQ ID NO: 2085488 - RNA, 23 nt, Human
ugugacugauguuaggcugggcc

SEQ ID NO: 2085489 - RNA, 16 nt, Human
ugucuccuaccucugc

SEQ ID NO: 2085490 - RNA, 22 nt, Human
ugucuccagacccccaccccuu

SEQ ID NO: 2085491 - RNA, 23 nt, Human
ugucuccagacccccaccccuuc

SEQ ID NO: 2085492 - RNA, 21 nt, Human
ugucucccagggccuuaaaag

SEQ ID NO: 2085493 - RNA, 12 nt, Human
ugucuccccucu

SEQ ID NO: 2085494 - RNA, 14 nt, Human
ugucuccccucugc

SEQ ID NO: 2085495 - RNA, 20 nt, Human
ugucucccuauaaugcugga

SEQ ID NO: 2085496 - RNA, 23 nt, Human
ugucucccuauaaugcuggagcg

SEQ ID NO: 2085497 - RNA, 11 nt, Human
ugucuccagac

SEQ ID NO: 2085498 - RNA, 12 nt, Human
ugucuccagacc

SEQ ID NO: 2085499 - RNA, 14 nt, Human
ugucuccagacccc

SEQ ID NO: 2085500 - RNA, 16 nt, Human
ugucuccagaccccca

SEQ ID NO: 2085501 - RNA, 17 nt, Human
ugucuccagacccccac

SEQ ID NO: 2085502 - RNA, 19 nt, Human
ugucuccagacccccaccc

SEQ ID NO: 2085503 - RNA, 20 nt, Human
ugucuccagacccccacccc

SEQ ID NO: 2085504 - RNA, 14 nt, Human
ugugagaaucaaaa

SEQ ID NO: 2085505 - RNA, 13 nt, Human
ugugagaccccca

SEQ ID NO: 2085506 - RNA, 14 nt, Human
ugugagacccccac

SEQ ID NO: 2085507 - RNA, 13 nt, Human
ugugagagaaagu

SEQ ID NO: 2085508 - RNA, 15 nt, Human
ugugagacccccaca

SEQ ID NO: 2085509 - RNA, 16 nt, Human
ugugagacccccacac

SEQ ID NO: 2085510 - RNA, 18 nt, Human
ugugagacccccacaccu

SEQ ID NO: 2085511 - RNA, 19 nt, Human
ugugagacccccacaccuc

SEQ ID NO: 2085512 - RNA, 22 nt, Human
ugugaugaugaaaugaggucag

SEQ ID NO: 2085513 - RNA, 15 nt, Human
ugugaugccacacag

SEQ ID NO: 2085514 - RNA, 17 nt, Human
ugugaugccacacagag

SEQ ID NO: 2085515 - RNA, 14 nt, Human
ugugaugaggggag

SEQ ID NO: 2085516 - RNA, 23 nt, Human
agugagcugagaucgugccguua

SEQ ID NO: 2085517 - RNA, 19 nt, Human
agugagccgcaucuucucc

SEQ ID NO: 2085518 - RNA, 24 nt, Human
agugagccgcaucuucuccaucug

SEQ ID NO: 2085519 - RNA, 20 nt, Human
agugagccgcaucuucucca

SEQ ID NO: 2085520 - RNA, 22 nt, Human
agugagccgcaucuucuccauc

SEQ ID NO: 2085521 - RNA, 12 nt, Human
agugagcugguu

SEQ ID NO: 2085522 - RNA, 15 nt, Human
agugacuguaucugu

SEQ ID NO: 2085523 - RNA, 16 nt, Human
agugacuguaucugug

SEQ ID NO: 2085524 - RNA, 17 nt, Human
agugacuguaucugugu

SEQ ID NO: 2085525 - RNA, 18 nt, Human
agugacuguaucugugua

SEQ ID NO: 2085526 - RNA, 20 nt, Human
agugacuguaucuguguaga

SEQ ID NO: 2085527 - RNA, 20 nt, Human
agugacuguggccauggucc

SEQ ID NO: 2085528 - RNA, 22 nt, Human
agugagagggcaugcgcacaag

SEQ ID NO: 2085529 - RNA, 14 nt, Human
agugagagggcaug

SEQ ID NO: 2085530 - RNA, 13 nt, Human
agugagagggcau

SEQ ID NO: 2085531 - RNA, 12 nt, Human
agugagaagaau

SEQ ID NO: 2085532 - RNA, 14 nt, Human
agugagaagaauau

SEQ ID NO: 2085533 - RNA, 17 nt, Human
agugagaagaauauugu

SEQ ID NO: 2085534 - RNA, 19 nt, Human
agugagaagaauauuguuc

SEQ ID NO: 2085535 - RNA, 23 nt, Human
agugagaagaauauuguuccuaa

SEQ ID NO: 2085536 - RNA, 22 nt, Human
agugagcacuaaggugugcucu

SEQ ID NO: 2085537 - RNA, 14 nt, Human
agugagcacuaagg

SEQ ID NO: 2085538 - RNA, 17 nt, Human
agucuugugacuagugc

SEQ ID NO: 2085539 - RNA, 20 nt, Human
agucuugugacuagugcuga

SEQ ID NO: 2085540 - RNA, 21 nt, Human
agucuugugacuagugcugaa

SEQ ID NO: 2085541 - RNA, 23 nt, Human
agucuugugacuagugcugaagc

SEQ ID NO: 2085542 - RNA, 22 nt, Human
agucuugugacuagugcugaag

SEQ ID NO: 2085543 - RNA, 21 nt, Human
agugacugauggcuaauguac

SEQ ID NO: 2085544 - RNA, 13 nt, Human
agugaaccaucau

SEQ ID NO: 2085545 - RNA, 21 nt, Human
agugaaccaucauuauaaacg

SEQ ID NO: 2085546 - RNA, 18 nt, Human
agugacucauccucuuga

SEQ ID NO: 2085547 - RNA, 23 nt, Human
agugacucauccucuugaagaug

SEQ ID NO: 2085548 - RNA, 20 nt, Human
agucuuucacaguaccaucu

SEQ ID NO: 2085549 - RNA, 18 nt, Human
agugaacacauuguguca

SEQ ID NO: 2085550 - RNA, 18 nt, Human
agugaacauuuggguaaa

SEQ ID NO: 2085551 - RNA, 16 nt, Human
agugaacuugggccac

SEQ ID NO: 2085552 - RNA, 17 nt, Human
ugugccuauagucccag

SEQ ID NO: 2085553 - RNA, 20 nt, Human
ugugccuauagucccagcua

SEQ ID NO: 2085554 - RNA, 22 nt, Human
ugugcucaugcauugcuugugu

SEQ ID NO: 2085555 - RNA, 17 nt, Human
ugugcuccccuuugccu

SEQ ID NO: 2085556 - RNA, 20 nt, Human
ugugcugcccgucuucagcc

SEQ ID NO: 2085557 - RNA, 18 nt, Human
agugagcaaaccugcccc

SEQ ID NO: 2085558 - RNA, 23 nt, Human
agugagcugguuuuuagcggaga

SEQ ID NO: 2085559 - RNA, 14 nt, Human
uguggaugauaaaa

SEQ ID NO: 2085560 - RNA, 17 nt, Human
ugugcugugguuccugg

SEQ ID NO: 2085561 - RNA, 12 nt, Human
ugugcugugacu

SEQ ID NO: 2085562 - RNA, 21 nt, Human
agugcagcccguguggccccu

SEQ ID NO: 2085563 - RNA, 23 nt, Human
agugcaguggugcgaucauggcu

SEQ ID NO: 2085564 - RNA, 15 nt, Human
agugcagcaaccaga

SEQ ID NO: 2085565 - RNA, 18 nt, Human
agugcagcaaccagagca

SEQ ID NO: 2085566 - RNA, 19 nt, Human
agugcagcaaccagagcac

SEQ ID NO: 2085567 - RNA, 20 nt, Human
agugcagcaaccagagcacu

SEQ ID NO: 2085568 - RNA, 21 nt, Human
agugcagcaaccagagcacug

SEQ ID NO: 2085569 - RNA, 22 nt, Human
agugcagcaaccagagcacugu

SEQ ID NO: 2085570 - RNA, 17 nt, Human
agugcagugagccgaga

SEQ ID NO: 2085571 - RNA, 15 nt, Human
agugcauuuucccag

SEQ ID NO: 2085572 - RNA, 17 nt, Human
agugcauuuucccagau

SEQ ID NO: 2085573 - RNA, 17 nt, Human
agugagcuguaggugug

SEQ ID NO: 2085574 - RNA, 21 nt, Human
agugagcuuggaaaggaccag

SEQ ID NO: 2085575 - RNA, 13 nt, Human
agugaggcccagg

SEQ ID NO: 2085576 - RNA, 15 nt, Human
agugaggcccaggga

SEQ ID NO: 2085577 - RNA, 23 nt, Human
agugauuuuuauccaaucuuguu

SEQ ID NO: 2085578 - RNA, 21 nt, Human
agugcaaagauuugcuuuaau

SEQ ID NO: 2085579 - RNA, 17 nt, Human
agugcaacacugaagcu

SEQ ID NO: 2085580 - RNA, 18 nt, Human
agugcaaauuugauacau

SEQ ID NO: 2085581 - RNA, 15 nt, Human
agugcaacaguagca

SEQ ID NO: 2085582 - RNA, 19 nt, Human
agugauaauuucuggaauu

SEQ ID NO: 2085583 - RNA, 23 nt, Human
agugauacaacuucaagugcaug

SEQ ID NO: 2085584 - RNA, 17 nt, Human
agugauacaacuucaag

SEQ ID NO: 2085585 - RNA, 13 nt, Human
auagaaaugcugg

SEQ ID NO: 2085586 - RNA, 16 nt, Human
auacuguacuuaauaa

SEQ ID NO: 2085587 - RNA, 17 nt, Human
auacuguacuuaauaaa

SEQ ID NO: 2085588 - RNA, 19 nt, Human
auagaaaugcugguuuuuc

SEQ ID NO: 2085589 - RNA, 22 nt, Human
auagaaaugcugguuuuucagu

SEQ ID NO: 2085590 - RNA, 21 nt, Human
auagaacucaguuuuaacuag

SEQ ID NO: 2085591 - RNA, 14 nt, Human
auagaaguuuagau

SEQ ID NO: 2085592 - RNA, 19 nt, Human
auagaagaacugcaaaggu

SEQ ID NO: 2085593 - RNA, 20 nt, Human
auagaagaauacaaacauau

SEQ ID NO: 2085594 - RNA, 13 nt, Human
auagaagaaaaaa

SEQ ID NO: 2085595 - RNA, 14 nt, Human
auagaagaaaaaag

SEQ ID NO: 2085596 - RNA, 17 nt, Human
auagaagaaaaaagaau

SEQ ID NO: 2085597 - RNA, 19 nt, Human
auagaagaaaaaagaaugu

SEQ ID NO: 2085598 - RNA, 23 nt, Human
auagaagaaaaaagaaugucaga

SEQ ID NO: 2085599 - RNA, 15 nt, Human
auagaagaacugcaa

SEQ ID NO: 2085600 - RNA, 15 nt, Human
auagaacucugggcu

SEQ ID NO: 2085601 - RNA, 14 nt, Human
auagaagauguuug

SEQ ID NO: 2085602 - RNA, 12 nt, Human
auagaaggaaac

SEQ ID NO: 2085603 - RNA, 14 nt, Human
auagaaggaaacua

SEQ ID NO: 2085604 - RNA, 17 nt, Human
auagaaggaaacuagcu

SEQ ID NO: 2085605 - RNA, 18 nt, Human
auagaaggaaacuagcuu

SEQ ID NO: 2085606 - RNA, 10 nt, Human
auagaaggag

SEQ ID NO: 2085607 - RNA, 15 nt, Human
auagaaggaggagag

SEQ ID NO: 2085608 - RNA, 16 nt, Human
auagaaggaggagagg

SEQ ID NO: 2085609 - RNA, 19 nt, Human
auagaaggauguacauuuc

SEQ ID NO: 2085610 - RNA, 19 nt, Human
auagaauauaauuaucgga

SEQ ID NO: 2085611 - RNA, 18 nt, Human
auagaaugguaucaauaa

SEQ ID NO: 2085612 - RNA, 22 nt, Human
auagaauauuuauuaccucuga

SEQ ID NO: 2085613 - RNA, 19 nt, Human
auagaauauuuauuaccuc

SEQ ID NO: 2085614 - RNA, 13 nt, Human
auagaauauuuau

SEQ ID NO: 2085615 - RNA, 12 nt, Human
auagaauauuua

SEQ ID NO: 2085616 - RNA, 20 nt, Human
auagacaguauauuuauagu

SEQ ID NO: 2085617 - RNA, 18 nt, Human
auagaauugcaauuuuaa

SEQ ID NO: 2085618 - RNA, 20 nt, Human
auagaauugcaauuuuaaca

SEQ ID NO: 2085619 - RNA, 13 nt, Human
auagaauuuuuaa

SEQ ID NO: 2085620 - RNA, 17 nt, Human
auagaauuuuuaauguu

SEQ ID NO: 2085621 - RNA, 19 nt, Human
auagaauuuuuaauguuuu

SEQ ID NO: 2085622 - RNA, 14 nt, Human
auagaugcccugcu

SEQ ID NO: 2085623 - RNA, 22 nt, Human
auagauguagauaaacucagaa

SEQ ID NO: 2085624 - RNA, 19 nt, Human
auagaugucccuuucuugg

SEQ ID NO: 2085625 - RNA, 22 nt, Human
auagaugucccuuucuuggcca

SEQ ID NO: 2085626 - RNA, 23 nt, Human
auagaugucccuuucuuggccag

SEQ ID NO: 2085627 - RNA, 15 nt, Human
auagauaacucuuug

SEQ ID NO: 2085628 - RNA, 17 nt, Human
auagauaacucuuugga

SEQ ID NO: 2085629 - RNA, 15 nt, Human
auagaucacauaaca

SEQ ID NO: 2085630 - RNA, 17 nt, Human
auagaucacauaacaga

SEQ ID NO: 2085631 - RNA, 19 nt, Human
auagaucacauaacagaau

SEQ ID NO: 2085632 - RNA, 21 nt, Human
auagaucacauaacagaaugc

SEQ ID NO: 2085633 - RNA, 14 nt, Human
auagauuucugauu

SEQ ID NO: 2085634 - RNA, 15 nt, Human
auagauuucugauuu

SEQ ID NO: 2085635 - RNA, 16 nt, Human
auagauuucugauuuu

SEQ ID NO: 2085636 - RNA, 19 nt, Human
auagauuucugauuuuaug

SEQ ID NO: 2085637 - RNA, 21 nt, Human
auagauuucugauuuuaugua

SEQ ID NO: 2085638 - RNA, 23 nt, Human
auagauuggagccaccaugccca

SEQ ID NO: 2085639 - RNA, 13 nt, Human
auagauucaccug

SEQ ID NO: 2085640 - RNA, 15 nt, Human
auagauucaccugua

SEQ ID NO: 2085641 - RNA, 18 nt, Human
auagauucaccuguaaaa

SEQ ID NO: 2085642 - RNA, 19 nt, Human
auagauucaccuguaaaac

SEQ ID NO: 2085643 - RNA, 21 nt, Human
auagauucaccuguaaaacuu

SEQ ID NO: 2085644 - RNA, 22 nt, Human
auagauucaccuguaaaacuuu

SEQ ID NO: 2085645 - RNA, 23 nt, Human
auagauucaccuguaaaacuuua

SEQ ID NO: 2085646 - RNA, 15 nt, Human
auagauuagauuaua

SEQ ID NO: 2085647 - RNA, 23 nt, Human
auagauuagauuauauugagaca

SEQ ID NO: 2085648 - RNA, 14 nt, Human
auagaguauaugca

SEQ ID NO: 2085649 - RNA, 15 nt, Human
auagaguauaugcac

SEQ ID NO: 2085650 - RNA, 15 nt, Human
auagaggugagggaa

SEQ ID NO: 2085651 - RNA, 22 nt, Human
auagaggugagggaagccugaa

SEQ ID NO: 2085652 - RNA, 16 nt, Human
auagacauuuguaaau

SEQ ID NO: 2085653 - RNA, 15 nt, Human
auagacuagagaaac

SEQ ID NO: 2085654 - RNA, 17 nt, Human
auagacuagagaaaccg

SEQ ID NO: 2085655 - RNA, 14 nt, Human
auagagagagacca

SEQ ID NO: 2085656 - RNA, 14 nt, Human
auagagacuguaga

SEQ ID NO: 2085657 - RNA, 23 nt, Human
auagagacuguagauugcuucug

SEQ ID NO: 2085658 - RNA, 19 nt, Human
uuauuaugcauaacugaca

SEQ ID NO: 2085659 - RNA, 20 nt, Human
uuauuaugcauaacugacaa

SEQ ID NO: 2085660 - RNA, 15 nt, Human
uuauguuacaucugu

SEQ ID NO: 2085661 - RNA, 18 nt, Human
uuauguuauugaaaaaaa

SEQ ID NO: 2085662 - RNA, 16 nt, Human
uuauucaguuaagaaa

SEQ ID NO: 2085663 - RNA, 17 nt, Human
uuauucaguuaagaaaa

SEQ ID NO: 2085664 - RNA, 18 nt, Human
uuauucaguuaagaaaaa

SEQ ID NO: 2085665 - RNA, 12 nt, Human
uuauucauugug

SEQ ID NO: 2085666 - RNA, 19 nt, Human
uuauucaccauguaaaaca

SEQ ID NO: 2085667 - RNA, 20 nt, Human
uuauucaccauguaaaacaa

SEQ ID NO: 2085668 - RNA, 21 nt, Human
uuauucacugaaguucuccug

SEQ ID NO: 2085669 - RNA, 19 nt, Human
uuauucaauuccucuggga

SEQ ID NO: 2085670 - RNA, 18 nt, Human
uuauucaauuccucuggg

SEQ ID NO: 2085671 - RNA, 16 nt, Human
uuauuauuuucaccug

SEQ ID NO: 2085672 - RNA, 11 nt, Human
uuauucaaggu

SEQ ID NO: 2085673 - RNA, 15 nt, Human
uuauucaagguaaaa

SEQ ID NO: 2085674 - RNA, 22 nt, Human
uuauuccuauauaguuuauuga

SEQ ID NO: 2085675 - RNA, 16 nt, Human
uuauucccuguacaau

SEQ ID NO: 2085676 - RNA, 19 nt, Human
uuauucccuuucacaaaau

SEQ ID NO: 2085677 - RNA, 20 nt, Human
uuauuccuauauaguuuauu

SEQ ID NO: 2085678 - RNA, 22 nt, Human
auacucuuaggaagagaaacca

SEQ ID NO: 2085679 - RNA, 21 nt, Human
auacucuuaggaagagaaacc

SEQ ID NO: 2085680 - RNA, 16 nt, Human
auacucugcuuagaau

SEQ ID NO: 2085681 - RNA, 19 nt, Human
auacucuuaggaagagaaa

SEQ ID NO: 2085682 - RNA, 15 nt, Human
auacucugucagaug

SEQ ID NO: 2085683 - RNA, 16 nt, Human
auacucugucagaugg

SEQ ID NO: 2085684 - RNA, 12 nt, Human
auacucugucag

SEQ ID NO: 2085685 - RNA, 13 nt, Human
auacucugucaga

SEQ ID NO: 2085686 - RNA, 14 nt, Human
auacucugucagau

SEQ ID NO: 2085687 - RNA, 13 nt, Human
auacucuaauucu

SEQ ID NO: 2085688 - RNA, 14 nt, Human
auacucuaauucua

SEQ ID NO: 2085689 - RNA, 15 nt, Human
auacucuaauucuaa

SEQ ID NO: 2085690 - RNA, 16 nt, Human
auacucuaauucuaac

SEQ ID NO: 2085691 - RNA, 18 nt, Human
auacucuaauucuaacca

SEQ ID NO: 2085692 - RNA, 22 nt, Human
auacuccaaccauauggauauu

SEQ ID NO: 2085693 - RNA, 22 nt, Human
auacugagggaccaacugggcc

SEQ ID NO: 2085694 - RNA, 14 nt, Human
auacugagggacca

SEQ ID NO: 2085695 - RNA, 22 nt, Human
auacugcccggggcagcugcca

SEQ ID NO: 2085696 - RNA, 14 nt, Human
auacucugucuccc

SEQ ID NO: 2085697 - RNA, 13 nt, Human
auacuggaaguuu

SEQ ID NO: 2085698 - RNA, 19 nt, Human
auacuggaaguuuugcauu

SEQ ID NO: 2085699 - RNA, 20 nt, Human
auacuggaaguuuugcauuu

SEQ ID NO: 2085700 - RNA, 14 nt, Human
auacuggaaguuuu

SEQ ID NO: 2085701 - RNA, 16 nt, Human
auacuggaaguuuugc

SEQ ID NO: 2085702 - RNA, 17 nt, Human
auacuggaaguuuugca

SEQ ID NO: 2085703 - RNA, 18 nt, Human
auacuggaaguuuugcau

SEQ ID NO: 2085704 - RNA, 21 nt, Human
auacuggugcagucauuauga

SEQ ID NO: 2085705 - RNA, 13 nt, Human
auacgauaaauaa

SEQ ID NO: 2085706 - RNA, 17 nt, Human
auacgacuuuauuuucu

SEQ ID NO: 2085707 - RNA, 20 nt, Human
auacgccagaacugcuuuau

SEQ ID NO: 2085708 - RNA, 21 nt, Human
auacgccuguaguccuagcca

SEQ ID NO: 2085709 - RNA, 13 nt, Human
auacgacuuuauu

SEQ ID NO: 2085710 - RNA, 14 nt, Human
auacaugguuguga

SEQ ID NO: 2085711 - RNA, 20 nt, Human
auacaugguugugaccugag

SEQ ID NO: 2085712 - RNA, 12 nt, Human
auacauuaaagc

SEQ ID NO: 2085713 - RNA, 13 nt, Human
auacauuaaagca

SEQ ID NO: 2085714 - RNA, 14 nt, Human
auacauuaaagcag

SEQ ID NO: 2085715 - RNA, 15 nt, Human
auacauuaaagcagu

SEQ ID NO: 2085716 - RNA, 16 nt, Human
auacauuaaagcaguc

SEQ ID NO: 2085717 - RNA, 19 nt, Human
uuauauuuuacuacugugg

SEQ ID NO: 2085718 - RNA, 17 nt, Human
uuauauuuuuaauaaaa

SEQ ID NO: 2085719 - RNA, 19 nt, Human
uuauauuuuuaauaaaagu

SEQ ID NO: 2085720 - RNA, 15 nt, Human
uuauauuuuuauaga

SEQ ID NO: 2085721 - RNA, 12 nt, Human
uuauauuuucaa

SEQ ID NO: 2085722 - RNA, 19 nt, Human
uuaucaauuacaacaguga

SEQ ID NO: 2085723 - RNA, 14 nt, Human
uuaucaauuuguca

SEQ ID NO: 2085724 - RNA, 15 nt, Human
uuaucaauuugucau

SEQ ID NO: 2085725 - RNA, 20 nt, Human
uuaucaauuugucauuuuga

SEQ ID NO: 2085726 - RNA, 21 nt, Human
uuaucaauuugucauuuugaa

SEQ ID NO: 2085727 - RNA, 23 nt, Human
uuaucaauuugucauuuugaagc

SEQ ID NO: 2085728 - RNA, 19 nt, Human
uuaucacacaaagcagaau

SEQ ID NO: 2085729 - RNA, 13 nt, Human
uuaucacacaaag

SEQ ID NO: 2085730 - RNA, 18 nt, Human
uuaucacauuauuugcau

SEQ ID NO: 2085731 - RNA, 13 nt, Human
auacuaaaaauca

SEQ ID NO: 2085732 - RNA, 18 nt, Human
auacuaaaaaucaugaga

SEQ ID NO: 2085733 - RNA, 21 nt, Human
uuaguagaaauuuuacaauag

SEQ ID NO: 2085734 - RNA, 16 nt, Human
auacagaggcaacugc

SEQ ID NO: 2085735 - RNA, 17 nt, Human
auacagaggcaacugca

SEQ ID NO: 2085736 - RNA, 14 nt, Human
auacaauaacauaa

SEQ ID NO: 2085737 - RNA, 22 nt, Human
auacaagccauucuaaggaaau

SEQ ID NO: 2085738 - RNA, 10 nt, Human
auacaauaaa

SEQ ID NO: 2085739 - RNA, 12 nt, Human
auacaauaaacu

SEQ ID NO: 2085740 - RNA, 20 nt, Human
auacaauaaacuauuggaaa

SEQ ID NO: 2085741 - RNA, 21 nt, Human
auacaauaaacuauuggaaag

SEQ ID NO: 2085742 - RNA, 17 nt, Human
auacaaguucuauuuaa

SEQ ID NO: 2085743 - RNA, 12 nt, Human
auacaagauaag

SEQ ID NO: 2085744 - RNA, 15 nt, Human
auacaagauaagcuu

SEQ ID NO: 2085745 - RNA, 18 nt, Human
auacaagauaagcuucca

SEQ ID NO: 2085746 - RNA, 16 nt, Human
auacaacuuaaauaau

SEQ ID NO: 2085747 - RNA, 14 nt, Human
auacaguguuauuu

SEQ ID NO: 2085748 - RNA, 15 nt, Human
auacaguguuauuuu

SEQ ID NO: 2085749 - RNA, 13 nt, Human
auacauacacaua

SEQ ID NO: 2085750 - RNA, 16 nt, Human
auacauacacauauau

SEQ ID NO: 2085751 - RNA, 17 nt, Human
auacauacacauauaua

SEQ ID NO: 2085752 - RNA, 12 nt, Human
auacauaacagg

SEQ ID NO: 2085753 - RNA, 22 nt, Human
auacauaacaggguaaauuauu

SEQ ID NO: 2085754 - RNA, 23 nt, Human
auacaguguuauuuucuuugaaa

SEQ ID NO: 2085755 - RNA, 14 nt, Human
auacauggauaaca

SEQ ID NO: 2085756 - RNA, 24 nt, Human
auacauggguagcuucugaccuca

SEQ ID NO: 2085757 - RNA, 23 nt, Human
auacaggaaaagcugcugacagu

SEQ ID NO: 2085758 - RNA, 23 nt, Human
auacagauagauauaugcucugc

SEQ ID NO: 2085759 - RNA, 14 nt, Human
uuauccaaucuugu

SEQ ID NO: 2085760 - RNA, 17 nt, Human
uuauccaaucuuguuuc

SEQ ID NO: 2085761 - RNA, 22 nt, Human
uuauccaagguguaacucuaau

SEQ ID NO: 2085762 - RNA, 22 nt, Human
uuaucccacggaaaaugccaau

SEQ ID NO: 2085763 - RNA, 15 nt, Human
uuaugaacugcaugu

SEQ ID NO: 2085764 - RNA, 22 nt, Human
uuaugaacugcauguauaaaug

SEQ ID NO: 2085765 - RNA, 23 nt, Human
uuaugaacugcauguauaaauga

SEQ ID NO: 2085766 - RNA, 18 nt, Human
uuaugaagaaaaaauaca

SEQ ID NO: 2085767 - RNA, 23 nt, Human
uuaugaagaaaaaauacauuuua

SEQ ID NO: 2085768 - RNA, 18 nt, Human
uuaugaaagguuuacauu

SEQ ID NO: 2085769 - RNA, 17 nt, Human
uuaugaauauuuauaac

SEQ ID NO: 2085770 - RNA, 19 nt, Human
uuaugaauauuuauaacag

SEQ ID NO: 2085771 - RNA, 22 nt, Human
uuaugaauauuuauaacagcau

SEQ ID NO: 2085772 - RNA, 14 nt, Human
uuaugaaugaaaaa

SEQ ID NO: 2085773 - RNA, 14 nt, Human
uuaugacaguuaua

SEQ ID NO: 2085774 - RNA, 18 nt, Human
uuaugauauuuuuuuaag

SEQ ID NO: 2085775 - RNA, 21 nt, Human
uuaugauauuuuuuuaagucu

SEQ ID NO: 2085776 - RNA, 13 nt, Human
uuaugauaaaaaa

SEQ ID NO: 2085777 - RNA, 19 nt, Human
uuaugauaaaaaauuuugu

SEQ ID NO: 2085778 - RNA, 21 nt, Human
uuaugauaaaaaauuuuguaa

SEQ ID NO: 2085779 - RNA, 13 nt, Human
uuaugaguuuuug

SEQ ID NO: 2085780 - RNA, 15 nt, Human
uuaugaguuuuugau

SEQ ID NO: 2085781 - RNA, 21 nt, Human
uuaugaguuuuugauagcuuu

SEQ ID NO: 2085782 - RNA, 23 nt, Human
uuaugaguuuuugauagcuuuau

SEQ ID NO: 2085783 - RNA, 18 nt, Human
uuaugagcucauguagca

SEQ ID NO: 2085784 - RNA, 18 nt, Human
uuaugaggagugaacauu

SEQ ID NO: 2085785 - RNA, 20 nt, Human
uuaugaugugggucaaggaa

SEQ ID NO: 2085786 - RNA, 21 nt, Human
uuaugaugugggucaaggaau

SEQ ID NO: 2085787 - RNA, 11 nt, Human
uuaugguuuug

SEQ ID NO: 2085788 - RNA, 17 nt, Human
uuaugguuuugugaugu

SEQ ID NO: 2085789 - RNA, 18 nt, Human
uuaugucuaaaauccugc

SEQ ID NO: 2085790 - RNA, 19 nt, Human
uuauguauguuuacacugu

SEQ ID NO: 2085791 - RNA, 19 nt, Human
uuaugucugcugaauaaua

SEQ ID NO: 2085792 - RNA, 21 nt, Human
uuaugucugcugaauaauaaa

SEQ ID NO: 2085793 - RNA, 16 nt, Human
uuauguaauaauguga

SEQ ID NO: 2085794 - RNA, 17 nt, Human
uuauguaauaaugugaa

SEQ ID NO: 2085795 - RNA, 15 nt, Human
uuauguagaugugca

SEQ ID NO: 2085796 - RNA, 21 nt, Human
uuauguaauaaugugaaucau

SEQ ID NO: 2085797 - RNA, 21 nt, Human
uuauguauauuuaaaagaaag

SEQ ID NO: 2085798 - RNA, 16 nt, Human
uuauguagaugugcau

SEQ ID NO: 2085799 - RNA, 23 nt, Human
uuaugugaaugaucucucugaau

SEQ ID NO: 2085800 - RNA, 13 nt, Human
uuaugugagagaa

SEQ ID NO: 2085801 - RNA, 18 nt, Human
uuauguguaugugccauu

SEQ ID NO: 2085802 - RNA, 19 nt, Human
uuaugugugaggagcugcu

SEQ ID NO: 2085803 - RNA, 18 nt, Human
uuaugugccguguuauug

SEQ ID NO: 2085804 - RNA, 19 nt, Human
uuauguguaugugccauuu

SEQ ID NO: 2085805 - RNA, 12 nt, Human
uuauguguguau

SEQ ID NO: 2085806 - RNA, 18 nt, Human
uuauguguguauauguau

SEQ ID NO: 2085807 - RNA, 22 nt, Human
uuauguguguauauguaugugu

SEQ ID NO: 2085808 - RNA, 20 nt, Human
aguuuuuauugcuuguugga

SEQ ID NO: 2085809 - RNA, 18 nt, Human
aguuuuguuuuaaaauua

SEQ ID NO: 2085810 - RNA, 21 nt, Human
aguuuguuuauuacuuauuug

SEQ ID NO: 2085811 - RNA, 16 nt, Human
aguuuuugauagcuuu

SEQ ID NO: 2085812 - RNA, 16 nt, Human
aguuuuuguaauuuau

SEQ ID NO: 2085813 - RNA, 17 nt, Human
aguuuuuucucuugggc

SEQ ID NO: 2085814 - RNA, 18 nt, Human
aguuuuuucucuugggcu

SEQ ID NO: 2085815 - RNA, 21 nt, Human
aguuuuaguugcagaaacauu

SEQ ID NO: 2085816 - RNA, 15 nt, Human
aguuuuaguugcaga

SEQ ID NO: 2085817 - RNA, 21 nt, Human
uuaagaaaaaauaacacacau

SEQ ID NO: 2085818 - RNA, 20 nt, Human
uuaagaaaaaauaacacaca

SEQ ID NO: 2085819 - RNA, 14 nt, Human
uuaagaaaaaaaua

SEQ ID NO: 2085820 - RNA, 15 nt, Human
uuaagaaaaaaauaa

SEQ ID NO: 2085821 - RNA, 16 nt, Human
uuaagaaaaaaauaau

SEQ ID NO: 2085822 - RNA, 17 nt, Human
uuaagaaaaaaauaauu

SEQ ID NO: 2085823 - RNA, 23 nt, Human
uuaagaaaaaaauaauuuuauga

SEQ ID NO: 2085824 - RNA, 19 nt, Human
uuaagaccaccucaaauuu

SEQ ID NO: 2085825 - RNA, 14 nt, Human
uuaagaccagccug

SEQ ID NO: 2085826 - RNA, 15 nt, Human
uuaagaccagccugg

SEQ ID NO: 2085827 - RNA, 16 nt, Human
uuaauaaaaguacaug

SEQ ID NO: 2085828 - RNA, 16 nt, Human
uuaauaaaacacuauu

SEQ ID NO: 2085829 - RNA, 18 nt, Human
uuaauaaaacacuauuuu

SEQ ID NO: 2085830 - RNA, 11 nt, Human
uuaauaaaaag

SEQ ID NO: 2085831 - RNA, 14 nt, Human
uuaauaaaaaggca

SEQ ID NO: 2085832 - RNA, 15 nt, Human
uuaauaaaaaggcac

SEQ ID NO: 2085833 - RNA, 17 nt, Human
uuaauccacacaucagu

SEQ ID NO: 2085834 - RNA, 21 nt, Human
uuaauccuagcugugugcagu

SEQ ID NO: 2085835 - RNA, 18 nt, Human
uuaauuugaugaaagcug

SEQ ID NO: 2085836 - RNA, 20 nt, Human
uuaauuuaugaguuuuugau

SEQ ID NO: 2085837 - RNA, 15 nt, Human
uuaauuuaugaguuu

SEQ ID NO: 2085838 - RNA, 18 nt, Human
uuaauuuaugaguuuuug

SEQ ID NO: 2085839 - RNA, 22 nt, Human
uuaaucuucaguuuuaucuuua

SEQ ID NO: 2085840 - RNA, 15 nt, Human
uuaaucuucaguuuu

SEQ ID NO: 2085841 - RNA, 17 nt, Human
uuaaucuucaguuuuau

SEQ ID NO: 2085842 - RNA, 13 nt, Human
uuaauuuucagua

SEQ ID NO: 2085843 - RNA, 23 nt, Human
uuaauuuuguaaaggugaaaaaa

SEQ ID NO: 2085844 - RNA, 13 nt, Human
uuaauuugccaaa

SEQ ID NO: 2085845 - RNA, 18 nt, Human
uuaauuugccaaaauaau

SEQ ID NO: 2085846 - RNA, 20 nt, Human
uuaauuugccaaaauaaugu

SEQ ID NO: 2085847 - RNA, 14 nt, Human
aguuuagaggaaaa

SEQ ID NO: 2085848 - RNA, 16 nt, Human
aguuuacuauuuuacu

SEQ ID NO: 2085849 - RNA, 14 nt, Human
aguuuacuauuuua

SEQ ID NO: 2085850 - RNA, 15 nt, Human
aguuuacuauuuuac

SEQ ID NO: 2085851 - RNA, 13 nt, Human
aguuuaccauuug

SEQ ID NO: 2085852 - RNA, 14 nt, Human
aguuuaccauuugu

SEQ ID NO: 2085853 - RNA, 16 nt, Human
aguuuaccauuuguaa

SEQ ID NO: 2085854 - RNA, 17 nt, Human
aguuuaccauuuguaau

SEQ ID NO: 2085855 - RNA, 18 nt, Human
aguuuaccauuuguaaua

SEQ ID NO: 2085856 - RNA, 19 nt, Human
aguuuaccauuuguaauaa

SEQ ID NO: 2085857 - RNA, 21 nt, Human
aguuuaccauuuguaauaaag

SEQ ID NO: 2085858 - RNA, 22 nt, Human
aguuuaccauuuguaauaaagu

SEQ ID NO: 2085859 - RNA, 21 nt, Human
aguuuagaggaaaaaaaugac

SEQ ID NO: 2085860 - RNA, 19 nt, Human
aguuuagaggaaaaaaaug

SEQ ID NO: 2085861 - RNA, 12 nt, Human
uuaaaaaaguuu

SEQ ID NO: 2085862 - RNA, 15 nt, Human
uuaaaaaaguuuaaa

SEQ ID NO: 2085863 - RNA, 18 nt, Human
uuaaaaaaguuuaaaaug

SEQ ID NO: 2085864 - RNA, 20 nt, Human
uuaaaaaaguuuaaaaugua

SEQ ID NO: 2085865 - RNA, 13 nt, Human
aguuaggaaauaa

SEQ ID NO: 2085866 - RNA, 14 nt, Human
aguuaggaaauaaa

SEQ ID NO: 2085867 - RNA, 12 nt, Human
aguuaggaaaua

SEQ ID NO: 2085868 - RNA, 19 nt, Human
aguuagcucaggaggcuug

SEQ ID NO: 2085869 - RNA, 22 nt, Human
aguuagcucaggaggcuuggaa

SEQ ID NO: 2085870 - RNA, 15 nt, Human
aguuaggaaauaaaa

SEQ ID NO: 2085871 - RNA, 12 nt, Human
uuaaaaaauguc

SEQ ID NO: 2085872 - RNA, 11 nt, Human
uuaaaaucuua

SEQ ID NO: 2085873 - RNA, 14 nt, Human
uuaaaaucuuaaac

SEQ ID NO: 2085874 - RNA, 12 nt, Human
uuaaaaauggua

SEQ ID NO: 2085875 - RNA, 13 nt, Human
uuaaaaaugguaa

SEQ ID NO: 2085876 - RNA, 14 nt, Human
uuaaaaaugguaaa

SEQ ID NO: 2085877 - RNA, 22 nt, Human
uuaaaaaugguaaaauugcaug

SEQ ID NO: 2085878 - RNA, 22 nt, Human
uuaaaauguauaaguugaggca

SEQ ID NO: 2085879 - RNA, 22 nt, Human
aguuuauugacaauaauuucag

SEQ ID NO: 2085880 - RNA, 13 nt, Human
aguuucucagcuc

SEQ ID NO: 2085881 - RNA, 14 nt, Human
aguuucucuuuuca

SEQ ID NO: 2085882 - RNA, 16 nt, Human
aguuuuaauccagaau

SEQ ID NO: 2085883 - RNA, 18 nt, Human
aguuuuaacuagaauuua

SEQ ID NO: 2085884 - RNA, 19 nt, Human
uuaacacugcuuguguuuu

SEQ ID NO: 2085885 - RNA, 12 nt, Human
uuaaauuuuucc

SEQ ID NO: 2085886 - RNA, 11 nt, Human
uuaaauaaaag

SEQ ID NO: 2085887 - RNA, 13 nt, Human
uuaaaguucugug

SEQ ID NO: 2085888 - RNA, 15 nt, Human
uuaaaguucugugua

SEQ ID NO: 2085889 - RNA, 18 nt, Human
uuaaaguucuguguauuu

SEQ ID NO: 2085890 - RNA, 19 nt, Human
uuaaaguucuguguauuua

SEQ ID NO: 2085891 - RNA, 15 nt, Human
uuaaauuuucuucag

SEQ ID NO: 2085892 - RNA, 16 nt, Human
uuaaauuuucuucagu

SEQ ID NO: 2085893 - RNA, 17 nt, Human
uuaaauuuucuucaguu

SEQ ID NO: 2085894 - RNA, 11 nt, Human
uuaaaguucug

SEQ ID NO: 2085895 - RNA, 20 nt, Human
uuacagggaugagccaccgc

SEQ ID NO: 2085896 - RNA, 14 nt, Human
uuacaggugugaac

SEQ ID NO: 2085897 - RNA, 18 nt, Human
uuacagguggacacacaa

SEQ ID NO: 2085898 - RNA, 18 nt, Human
uuacagggagcugggaca

SEQ ID NO: 2085899 - RNA, 15 nt, Human
auaacuauguugaua

SEQ ID NO: 2085900 - RNA, 19 nt, Human
auaacuaguguugcuugga

SEQ ID NO: 2085901 - RNA, 18 nt, Human
auaaauugcuccuugaca

SEQ ID NO: 2085902 - RNA, 15 nt, Human
auaacucaucauaaa

SEQ ID NO: 2085903 - RNA, 16 nt, Human
auaacucaucauaaaa

SEQ ID NO: 2085904 - RNA, 17 nt, Human
auaacucaucauaaaau

SEQ ID NO: 2085905 - RNA, 15 nt, Human
auaacuccucauugu

SEQ ID NO: 2085906 - RNA, 17 nt, Human
auaacuccucauuguaa

SEQ ID NO: 2085907 - RNA, 18 nt, Human
auaacucaucauaaaaua

SEQ ID NO: 2085908 - RNA, 19 nt, Human
auaacucaucauaaaauaa

SEQ ID NO: 2085909 - RNA, 14 nt, Human
uuacauaaauaaau

SEQ ID NO: 2085910 - RNA, 22 nt, Human
uuaccagccuccguauuucaga

SEQ ID NO: 2085911 - RNA, 20 nt, Human
uuaccagccuccguauuuca

SEQ ID NO: 2085912 - RNA, 21 nt, Human
uuaccagccuccguauuucag

SEQ ID NO: 2085913 - RNA, 23 nt, Human
uuaccagccuccguauuucagac

SEQ ID NO: 2085914 - RNA, 17 nt, Human
auaaaugcaauauguau

SEQ ID NO: 2085915 - RNA, 18 nt, Human
auaaaugcaauauguauu

SEQ ID NO: 2085916 - RNA, 20 nt, Human
auaaaugcaauauguauuaa

SEQ ID NO: 2085917 - RNA, 22 nt, Human
auaaaugcaauauguauuaaua

SEQ ID NO: 2085918 - RNA, 16 nt, Human
auaaauugcuccuuga

SEQ ID NO: 2085919 - RNA, 13 nt, Human
auaaauugcuccu

SEQ ID NO: 2085920 - RNA, 13 nt, Human
auaaauugaaaua

SEQ ID NO: 2085921 - RNA, 14 nt, Human
auaaauugaaauau

SEQ ID NO: 2085922 - RNA, 22 nt, Human
auaaauugaaauauaaugcaaa

SEQ ID NO: 2085923 - RNA, 12 nt, Human
auaaauugcaug

SEQ ID NO: 2085924 - RNA, 19 nt, Human
auaaauugcaugcugcuuu

SEQ ID NO: 2085925 - RNA, 20 nt, Human
auaaauugcaugcugcuuua

SEQ ID NO: 2085926 - RNA, 16 nt, Human
auaaauucuauaggaa

SEQ ID NO: 2085927 - RNA, 21 nt, Human
auaaauucuauaggaacauau

SEQ ID NO: 2085928 - RNA, 15 nt, Human
uuacaaacauguggu

SEQ ID NO: 2085929 - RNA, 12 nt, Human
uuacaaacaugu

SEQ ID NO: 2085930 - RNA, 12 nt, Human
uuacaaacugca

SEQ ID NO: 2085931 - RNA, 13 nt, Human
uuacaaacugcaa

SEQ ID NO: 2085932 - RNA, 14 nt, Human
uuacaaacugcaau

SEQ ID NO: 2085933 - RNA, 15 nt, Human
uuacaaacugcaaua

SEQ ID NO: 2085934 - RNA, 21 nt, Human
uuacaaacugcaauagagacu

SEQ ID NO: 2085935 - RNA, 22 nt, Human
uuacaaacugcaauagagacug

SEQ ID NO: 2085936 - RNA, 23 nt, Human
uuacaaacugcaauagagacugu

SEQ ID NO: 2085937 - RNA, 18 nt, Human
auaacuuuuuuuuaaguu

SEQ ID NO: 2085938 - RNA, 14 nt, Human
auaagauucauauu

SEQ ID NO: 2085939 - RNA, 16 nt, Human
uuagaagucacacagu

SEQ ID NO: 2085940 - RNA, 13 nt, Human
uuagaaguguuaa

SEQ ID NO: 2085941 - RNA, 11 nt, Human
uuacugucuua

SEQ ID NO: 2085942 - RNA, 12 nt, Human
uuacugucuuaa

SEQ ID NO: 2085943 - RNA, 13 nt, Human
uuacugucuuaau

SEQ ID NO: 2085944 - RNA, 15 nt, Human
uuacugucuuaauua

SEQ ID NO: 2085945 - RNA, 18 nt, Human
uuacugucuuaauuaagu

SEQ ID NO: 2085946 - RNA, 19 nt, Human
uuacugucuuaauuaagua

SEQ ID NO: 2085947 - RNA, 13 nt, Human
uuacugucaauaa

SEQ ID NO: 2085948 - RNA, 14 nt, Human
uuacugucaauaaa

SEQ ID NO: 2085949 - RNA, 15 nt, Human
uuacugucaauaaac

SEQ ID NO: 2085950 - RNA, 17 nt, Human
uuacugucaauaaacag

SEQ ID NO: 2085951 - RNA, 18 nt, Human
uuacugucaauaaacagc

SEQ ID NO: 2085952 - RNA, 20 nt, Human
uuacugucaauaaacagcuu

SEQ ID NO: 2085953 - RNA, 16 nt, Human
uuagaauguuuuccuu

SEQ ID NO: 2085954 - RNA, 21 nt, Human
uuagaaucagccuugaaacau

SEQ ID NO: 2085955 - RNA, 11 nt, Human
uuacuccccuu

SEQ ID NO: 2085956 - RNA, 20 nt, Human
uuacuccccuugagcugaga

SEQ ID NO: 2085957 - RNA, 15 nt, Human
uuacugcagcuuugu

SEQ ID NO: 2085958 - RNA, 21 nt, Human
uuacugccaaagggaaauauc

SEQ ID NO: 2085959 - RNA, 16 nt, Human
uuaccaguaaagugua

SEQ ID NO: 2085960 - RNA, 20 nt, Human
uuaccaguaaaguguaacau

SEQ ID NO: 2085961 - RNA, 22 nt, Human
uuaccaguaaaguguaacauau

SEQ ID NO: 2085962 - RNA, 15 nt, Human
uuaccauaugugcuu

SEQ ID NO: 2085963 - RNA, 13 nt, Human
uuacucagcccug

SEQ ID NO: 2085964 - RNA, 14 nt, Human
uuacucagcccugg

SEQ ID NO: 2085965 - RNA, 22 nt, Human
uuacucagcccugggccccacc

SEQ ID NO: 2085966 - RNA, 17 nt, Human
uuacucaugaucuugug

SEQ ID NO: 2085967 - RNA, 20 nt, Human
uuacucauuaaaaauaauag

SEQ ID NO: 2085968 - RNA, 17 nt, Human
uuacucauuaucgccuu

SEQ ID NO: 2085969 - RNA, 22 nt, Human
uuacugcuuuuaacuucugaua

SEQ ID NO: 2085970 - RNA, 18 nt, Human
uuaguuuuugugaaguuu

SEQ ID NO: 2085971 - RNA, 14 nt, Human
uuaguagagacagg

SEQ ID NO: 2085972 - RNA, 21 nt, Human
uuaguuuuugugaaguuuaau

SEQ ID NO: 2085973 - RNA, 19 nt, Human
uuauaaaaaaaaugaaaug

SEQ ID NO: 2085974 - RNA, 22 nt, Human
uuauaaaaaaaaugaaauguuu

SEQ ID NO: 2085975 - RNA, 13 nt, Human
uuaguagagacag

SEQ ID NO: 2085976 - RNA, 14 nt, Human
uuaguacccaccug

SEQ ID NO: 2085977 - RNA, 15 nt, Human
uuaguacccaccuga

SEQ ID NO: 2085978 - RNA, 18 nt, Human
uuaguacccaccugagcu

SEQ ID NO: 2085979 - RNA, 15 nt, Human
uuaguacuauaucug

SEQ ID NO: 2085980 - RNA, 18 nt, Human
uuaguacuauaucuguuu

SEQ ID NO: 2085981 - RNA, 19 nt, Human
uuaguacuauaucuguuuu

SEQ ID NO: 2085982 - RNA, 20 nt, Human
uuaguacuauaucuguuuua

SEQ ID NO: 2085983 - RNA, 16 nt, Human
uuauaaaauuaagcaa

SEQ ID NO: 2085984 - RNA, 10 nt, Human
uuauaaaauu

SEQ ID NO: 2085985 - RNA, 14 nt, Human
uuauaaaauuaaag

SEQ ID NO: 2085986 - RNA, 17 nt, Human
uuauaaaauuaaagaaa

SEQ ID NO: 2085987 - RNA, 20 nt, Human
uuauaaaauuaaagaaaaua

SEQ ID NO: 2085988 - RNA, 22 nt, Human
uuauaaaauuaaagaaaauaaa

SEQ ID NO: 2085989 - RNA, 12 nt, Human
uuagggaggggu

SEQ ID NO: 2085990 - RNA, 19 nt, Human
uuaggugugggggaagcac

SEQ ID NO: 2085991 - RNA, 13 nt, Human
uuaggucaagaag

SEQ ID NO: 2085992 - RNA, 14 nt, Human
uuagguuaggacuu

SEQ ID NO: 2085993 - RNA, 13 nt, Human
uuagguuaacuau

SEQ ID NO: 2085994 - RNA, 18 nt, Human
uuagguuaacuauguaca

SEQ ID NO: 2085995 - RNA, 19 nt, Human
uuagguuaacuauguacaa

SEQ ID NO: 2085996 - RNA, 18 nt, Human
uuagguuggcaaaaaggc

SEQ ID NO: 2085997 - RNA, 22 nt, Human
auaauauauguuuuaaauauag

SEQ ID NO: 2085998 - RNA, 21 nt, Human
auaagauucauauuuacuucu

SEQ ID NO: 2085999 - RNA, 16 nt, Human
auaagcaucaaacucu

SEQ ID NO: 2086000 - RNA, 17 nt, Human
auaagcaucaaacucuu

SEQ ID NO: 2086001 - RNA, 23 nt, Human
auaagcauggagaacagugauuu

SEQ ID NO: 2086002 - RNA, 22 nt, Human
auaaucuggacuccucugucca

SEQ ID NO: 2086003 - RNA, 20 nt, Human
auaauauuuuuaauuaaaua

SEQ ID NO: 2086004 - RNA, 12 nt, Human
auaauaugagaa

SEQ ID NO: 2086005 - RNA, 15 nt, Human
auaauaugagaauca

SEQ ID NO: 2086006 - RNA, 12 nt, Human
auaauaugcaca

SEQ ID NO: 2086007 - RNA, 20 nt, Human
auaauaugcacacagugcuu

SEQ ID NO: 2086008 - RNA, 21 nt, Human
auaauaugcugccaaauuuug

SEQ ID NO: 2086009 - RNA, 14 nt, Human
auaauauuuuuaau

SEQ ID NO: 2086010 - RNA, 18 nt, Human
auaauuauguuauugaaa

SEQ ID NO: 2086011 - RNA, 20 nt, Human
auaauuauguuauugaaaaa

SEQ ID NO: 2086012 - RNA, 22 nt, Human
auaauuauguuauugaaaaaaa

SEQ ID NO: 2086013 - RNA, 23 nt, Human
auaauuauguuauugaaaaaaau

SEQ ID NO: 2086014 - RNA, 19 nt, Human
auaauuaugacaguuauac

SEQ ID NO: 2086015 - RNA, 20 nt, Human
auaauuaugacaguuauacu

SEQ ID NO: 2086016 - RNA, 18 nt, Human
auaauuaugacaguuaua

SEQ ID NO: 2086017 - RNA, 19 nt, Human
auaauuuguacauauguaa

SEQ ID NO: 2086018 - RNA, 22 nt, Human
auaauuuguacauauguaaaau

SEQ ID NO: 2086019 - RNA, 21 nt, Human
auaauuucccaauuaggaagu

SEQ ID NO: 2086020 - RNA, 11 nt, Human
auaauuuccca

SEQ ID NO: 2086021 - RNA, 18 nt, Human
auaauuucccaauuagga

SEQ ID NO: 2086022 - RNA, 22 nt, Human
auaauuucccaauuaggaagug

SEQ ID NO: 2086023 - RNA, 13 nt, Human
aucuuucugcaga

SEQ ID NO: 2086024 - RNA, 11 nt, Human
aucuuucuucu

SEQ ID NO: 2086025 - RNA, 19 nt, Human
aucuuucuucuauuuuauu

SEQ ID NO: 2086026 - RNA, 22 nt, Human
aucuuucuucuauuuuauuccc

SEQ ID NO: 2086027 - RNA, 18 nt, Human
augaaagggcccagagag

SEQ ID NO: 2086028 - RNA, 12 nt, Human
aucuuuucuaca

SEQ ID NO: 2086029 - RNA, 13 nt, Human
aucuuuucuacag

SEQ ID NO: 2086030 - RNA, 14 nt, Human
aucuuuucuacagc

SEQ ID NO: 2086031 - RNA, 15 nt, Human
aucuuuucuacagca

SEQ ID NO: 2086032 - RNA, 17 nt, Human
aucuuuucuacagcaaa

SEQ ID NO: 2086033 - RNA, 20 nt, Human
aucuuuucuacagcaaauuu

SEQ ID NO: 2086034 - RNA, 22 nt, Human
aucuuuucuacagcaaauuuau

SEQ ID NO: 2086035 - RNA, 11 nt, Human
aucuuuugaac

SEQ ID NO: 2086036 - RNA, 17 nt, Human
aucuuugcagacaggca

SEQ ID NO: 2086037 - RNA, 12 nt, Human
uuggccucagaa

SEQ ID NO: 2086038 - RNA, 19 nt, Human
uuggcccccgagcuggggg

SEQ ID NO: 2086039 - RNA, 23 nt, Human
uuggcuauuagagaucaaccccu

SEQ ID NO: 2086040 - RNA, 13 nt, Human
uuggcucaauccu

SEQ ID NO: 2086041 - RNA, 14 nt, Human
uuggcucaauccuc

SEQ ID NO: 2086042 - RNA, 18 nt, Human
uuggccccugcccggcug

SEQ ID NO: 2086043 - RNA, 20 nt, Human
uuggagugaguguggcuccc

SEQ ID NO: 2086044 - RNA, 22 nt, Human
uuggagugaguguggcuccccu

SEQ ID NO: 2086045 - RNA, 15 nt, Human
uuggcccccgagcug

SEQ ID NO: 2086046 - RNA, 16 nt, Human
uuggcccccgagcugg

SEQ ID NO: 2086047 - RNA, 16 nt, Human
uuggagggugucccaa

SEQ ID NO: 2086048 - RNA, 18 nt, Human
uugcuugagcccaggagu

SEQ ID NO: 2086049 - RNA, 16 nt, Human
uugcuugagcccagga

SEQ ID NO: 2086050 - RNA, 17 nt, Human
uugcuugagcccaggag

SEQ ID NO: 2086051 - RNA, 22 nt, Human
uugcuugaaagaaaauaugcau

SEQ ID NO: 2086052 - RNA, 14 nt, Human
uugcuugagcccag

SEQ ID NO: 2086053 - RNA, 12 nt, Human
uugcuugaaaga

SEQ ID NO: 2086054 - RNA, 15 nt, Human
uugcuugaaagaaaa

SEQ ID NO: 2086055 - RNA, 13 nt, Human
uugcuugaacaca

SEQ ID NO: 2086056 - RNA, 15 nt, Human
uugcuugaacacagu

SEQ ID NO: 2086057 - RNA, 16 nt, Human
uugcuugaacacagua

SEQ ID NO: 2086058 - RNA, 17 nt, Human
uugcuugaacacaguau

SEQ ID NO: 2086059 - RNA, 18 nt, Human
uugcuugaacacaguauu

SEQ ID NO: 2086060 - RNA, 19 nt, Human
uugcuugaacacaguauuu

SEQ ID NO: 2086061 - RNA, 21 nt, Human
uugcuugaacacaguauuuuc

SEQ ID NO: 2086062 - RNA, 22 nt, Human
uuggagggcccacuuguauccu

SEQ ID NO: 2086063 - RNA, 17 nt, Human
uuggaggccuuucaucc

SEQ ID NO: 2086064 - RNA, 22 nt, Human
uuggagggugggagagcccagc

SEQ ID NO: 2086065 - RNA, 23 nt, Human
uuggagggugggagagcccagcc

SEQ ID NO: 2086066 - RNA, 18 nt, Human
uuggagaguaaaaacuga

SEQ ID NO: 2086067 - RNA, 20 nt, Human
uuggagaguaaaaacugaau

SEQ ID NO: 2086068 - RNA, 13 nt, Human
uuggagaguaaaa

SEQ ID NO: 2086069 - RNA, 17 nt, Human
uuggagaguaaaaacug

SEQ ID NO: 2086070 - RNA, 20 nt, Human
uuggagacucuguggggccu

SEQ ID NO: 2086071 - RNA, 13 nt, Human
uuggagacucugu

SEQ ID NO: 2086072 - RNA, 15 nt, Human
uuggagacucugugg

SEQ ID NO: 2086073 - RNA, 13 nt, Human
uuggggaggggcg

SEQ ID NO: 2086074 - RNA, 16 nt, Human
uuggugcaacccuuac

SEQ ID NO: 2086075 - RNA, 21 nt, Human
uuggugcaacccuuaccccuu

SEQ ID NO: 2086076 - RNA, 12 nt, Human
augaauauuuau

SEQ ID NO: 2086077 - RNA, 15 nt, Human
augaauauuuauaac

SEQ ID NO: 2086078 - RNA, 18 nt, Human
augaauauuuauaacagc

SEQ ID NO: 2086079 - RNA, 23 nt, Human
augaauggacucaaacugccuug

SEQ ID NO: 2086080 - RNA, 21 nt, Human
augaaugggcugagcugccug

SEQ ID NO: 2086081 - RNA, 21 nt, Human
augaaugguauggaacucucu

SEQ ID NO: 2086082 - RNA, 13 nt, Human
augaauguaucag

SEQ ID NO: 2086083 - RNA, 18 nt, Human
augaagagugagagggca

SEQ ID NO: 2086084 - RNA, 19 nt, Human
augaagagugagagggcau

SEQ ID NO: 2086085 - RNA, 18 nt, Human
augaagauaccaucagca

SEQ ID NO: 2086086 - RNA, 21 nt, Human
augaagauaccaucagcaaag

SEQ ID NO: 2086087 - RNA, 16 nt, Human
augaagacaggacagu

SEQ ID NO: 2086088 - RNA, 21 nt, Human
augaagacaggacagugcuuc

SEQ ID NO: 2086089 - RNA, 21 nt, Human
augaaagguuuacauugucaa

SEQ ID NO: 2086090 - RNA, 13 nt, Human
aucuuuugagaac

SEQ ID NO: 2086091 - RNA, 16 nt, Human
augaaaugguuaagaa

SEQ ID NO: 2086092 - RNA, 19 nt, Human
augaaagggcccagagagg

SEQ ID NO: 2086093 - RNA, 16 nt, Human
augaaagguuuacauu

SEQ ID NO: 2086094 - RNA, 20 nt, Human
augaaauugucuagcagagc

SEQ ID NO: 2086095 - RNA, 22 nt, Human
augaaauugucuagcagagcag

SEQ ID NO: 2086096 - RNA, 12 nt, Human
augaaauguuuu

SEQ ID NO: 2086097 - RNA, 23 nt, Human
augaaauugucuagcagagcagg

SEQ ID NO: 2086098 - RNA, 17 nt, Human
augaaauuuaauauagc

SEQ ID NO: 2086099 - RNA, 20 nt, Human
aucugcuagggaauaucaau

SEQ ID NO: 2086100 - RNA, 14 nt, Human
aucugcuaauaaaa

SEQ ID NO: 2086101 - RNA, 17 nt, Human
aucugccccucccccaa

SEQ ID NO: 2086102 - RNA, 13 nt, Human
uugccaaaauaau

SEQ ID NO: 2086103 - RNA, 15 nt, Human
uugccaaaauaaugu

SEQ ID NO: 2086104 - RNA, 19 nt, Human
uugccaaaauaaugucuug

SEQ ID NO: 2086105 - RNA, 22 nt, Human
uugccaaaauaaugucuuguua

SEQ ID NO: 2086106 - RNA, 23 nt, Human
uugccaaaauaaugucuuguuaa

SEQ ID NO: 2086107 - RNA, 11 nt, Human
aucugccccuc

SEQ ID NO: 2086108 - RNA, 12 nt, Human
aucugccccucc

SEQ ID NO: 2086109 - RNA, 15 nt, Human
aucugccccuccccc

SEQ ID NO: 2086110 - RNA, 16 nt, Human
aucugccccuccccca

SEQ ID NO: 2086111 - RNA, 18 nt, Human
uugcauuuuuuaaaacaa

SEQ ID NO: 2086112 - RNA, 15 nt, Human
uugcauuuaugguca

SEQ ID NO: 2086113 - RNA, 15 nt, Human
uugcauuuggucaag

SEQ ID NO: 2086114 - RNA, 14 nt, Human
aucuguauauacaa

SEQ ID NO: 2086115 - RNA, 20 nt, Human
aucuguauauacaauaacau

SEQ ID NO: 2086116 - RNA, 13 nt, Human
aucugcuaugcuu

SEQ ID NO: 2086117 - RNA, 16 nt, Human
aucugcuaugcuugaa

SEQ ID NO: 2086118 - RNA, 14 nt, Human
aucugucuggaggg

SEQ ID NO: 2086119 - RNA, 15 nt, Human
aucugucuggagggg

SEQ ID NO: 2086120 - RNA, 22 nt, Human
aucugucuggaggggagcucug

SEQ ID NO: 2086121 - RNA, 21 nt, Human
aucuguauauacaauaacaua

SEQ ID NO: 2086122 - RNA, 18 nt, Human
aucuguccaaaggaggcu

SEQ ID NO: 2086123 - RNA, 19 nt, Human
aucuguccaaaggaggcug

SEQ ID NO: 2086124 - RNA, 21 nt, Human
aucuguccaaaggaggcuggc

SEQ ID NO: 2086125 - RNA, 23 nt, Human
aucuguccaaaggaggcuggcag

SEQ ID NO: 2086126 - RNA, 17 nt, Human
aucuugaugucuuuguu

SEQ ID NO: 2086127 - RNA, 19 nt, Human
aucuugcccgcucaggcug

SEQ ID NO: 2086128 - RNA, 17 nt, Human
aucuugccggucauuuu

SEQ ID NO: 2086129 - RNA, 22 nt, Human
aucuugguacuacuagaugucu

SEQ ID NO: 2086130 - RNA, 16 nt, Human
aucuugcucuaucuca

SEQ ID NO: 2086131 - RNA, 20 nt, Human
aucuugcucuaucucacagc

SEQ ID NO: 2086132 - RNA, 21 nt, Human
aucuugcucuaucucacagca

SEQ ID NO: 2086133 - RNA, 23 nt, Human
aucuugcucuaucucacagcaca

SEQ ID NO: 2086134 - RNA, 15 nt, Human
aucuugguguguuaa

SEQ ID NO: 2086135 - RNA, 18 nt, Human
aucuugguguguuaagag

SEQ ID NO: 2086136 - RNA, 19 nt, Human
aucuugguguguuaagagu

SEQ ID NO: 2086137 - RNA, 13 nt, Human
aucuugcucugcu

SEQ ID NO: 2086138 - RNA, 20 nt, Human
aucuuggucagauuugaacu

SEQ ID NO: 2086139 - RNA, 14 nt, Human
aucuguuuuaaauu

SEQ ID NO: 2086140 - RNA, 14 nt, Human
aucuguuuuacugc

SEQ ID NO: 2086141 - RNA, 17 nt, Human
aucuguuuuacugcuuu

SEQ ID NO: 2086142 - RNA, 18 nt, Human
aucuguuuuacugcuuuu

SEQ ID NO: 2086143 - RNA, 22 nt, Human
aucuguuuuaaauuuauuucaa

SEQ ID NO: 2086144 - RNA, 18 nt, Human
aucuguuuuuaaaaauca

SEQ ID NO: 2086145 - RNA, 19 nt, Human
aucuguuuuuaaaaaucau

SEQ ID NO: 2086146 - RNA, 20 nt, Human
aucuguuuuuaaaaaucaua

SEQ ID NO: 2086147 - RNA, 16 nt, Human
aucuuaguauuugcau

SEQ ID NO: 2086148 - RNA, 18 nt, Human
aucuuagugccugagagu

SEQ ID NO: 2086149 - RNA, 21 nt, Human
aucuuagugccugagaguauu

SEQ ID NO: 2086150 - RNA, 15 nt, Human
uugcucacagcugua

SEQ ID NO: 2086151 - RNA, 21 nt, Human
uugcucaaguucauugaugac

SEQ ID NO: 2086152 - RNA, 22 nt, Human
uugcucaaguucauugaugacc

SEQ ID NO: 2086153 - RNA, 18 nt, Human
uugcucaaaaaaugagcu

SEQ ID NO: 2086154 - RNA, 13 nt, Human
uugcucaccuggg

SEQ ID NO: 2086155 - RNA, 15 nt, Human
uugcucaccuggggu

SEQ ID NO: 2086156 - RNA, 23 nt, Human
uugcucuaucucacagcacacuc

SEQ ID NO: 2086157 - RNA, 21 nt, Human
uugcucuccccugcccugcug

SEQ ID NO: 2086158 - RNA, 12 nt, Human
uugcuccuugac

SEQ ID NO: 2086159 - RNA, 21 nt, Human
uugcuucuucccuuaaaauuu

SEQ ID NO: 2086160 - RNA, 23 nt, Human
uugcuucuucccuuaaaauuuau

SEQ ID NO: 2086161 - RNA, 14 nt, Human
uugcuucuguagua

SEQ ID NO: 2086162 - RNA, 21 nt, Human
uugcuucuguaguacuccuua

SEQ ID NO: 2086163 - RNA, 17 nt, Human
uugcucaaaaaaugagc

SEQ ID NO: 2086164 - RNA, 15 nt, Human
aucuugucucugggc

SEQ ID NO: 2086165 - RNA, 14 nt, Human
aucuugucucuggg

SEQ ID NO: 2086166 - RNA, 17 nt, Human
aucuuguccccaacacc

SEQ ID NO: 2086167 - RNA, 14 nt, Human
aucuuguccccaac

SEQ ID NO: 2086168 - RNA, 14 nt, Human
aucguucucugccu

SEQ ID NO: 2086169 - RNA, 14 nt, Human
aucguuaugugugu

SEQ ID NO: 2086170 - RNA, 15 nt, Human
aucguuaugugugua

SEQ ID NO: 2086171 - RNA, 16 nt, Human
aucguuauguguguau

SEQ ID NO: 2086172 - RNA, 18 nt, Human
aucguuauguguguauau

SEQ ID NO: 2086173 - RNA, 16 nt, Human
aucguucuuucuagcu

SEQ ID NO: 2086174 - RNA, 21 nt, Human
aucguuauguguguauaugua

SEQ ID NO: 2086175 - RNA, 15 nt, Human
aucguuccaguuccc

SEQ ID NO: 2086176 - RNA, 23 nt, Human
uugaagccaagucagcuuugccu

SEQ ID NO: 2086177 - RNA, 13 nt, Human
uugaagccacuga

SEQ ID NO: 2086178 - RNA, 17 nt, Human
uugaagccacugaagcu

SEQ ID NO: 2086179 - RNA, 21 nt, Human
uugaagccacugaagcuggga

SEQ ID NO: 2086180 - RNA, 14 nt, Human
auccucgcucccgg

SEQ ID NO: 2086181 - RNA, 16 nt, Human
auccucgcucccggga

SEQ ID NO: 2086182 - RNA, 10 nt, Human
auccucuggc

SEQ ID NO: 2086183 - RNA, 19 nt, Human
auccucugguucuucauuu

SEQ ID NO: 2086184 - RNA, 19 nt, Human
aucgugccguuacucucca

SEQ ID NO: 2086185 - RNA, 14 nt, Human
auccucuggcuggc

SEQ ID NO: 2086186 - RNA, 23 nt, Human
aucgugccguuacucuccaaccu

SEQ ID NO: 2086187 - RNA, 12 nt, Human
aucgugcuaaau

SEQ ID NO: 2086188 - RNA, 15 nt, Human
aucgugcuaaauuuu

SEQ ID NO: 2086189 - RNA, 17 nt, Human
aucgugcuaaauuuuca

SEQ ID NO: 2086190 - RNA, 16 nt, Human
aucgugcuaaauuuuc

SEQ ID NO: 2086191 - RNA, 22 nt, Human
aucguuaguaucuaacauguau

SEQ ID NO: 2086192 - RNA, 19 nt, Human
uugaauaaaguugaagcua

SEQ ID NO: 2086193 - RNA, 21 nt, Human
uugaauaaagccugcuuuuua

SEQ ID NO: 2086194 - RNA, 14 nt, Human
uugaagcuaagauu

SEQ ID NO: 2086195 - RNA, 15 nt, Human
uugaagcuaauuauu

SEQ ID NO: 2086196 - RNA, 16 nt, Human
uugaagcuaauuauuu

SEQ ID NO: 2086197 - RNA, 17 nt, Human
uugaagcuaauuauuuu

SEQ ID NO: 2086198 - RNA, 19 nt, Human
uugaagcuaauuauuuuaa

SEQ ID NO: 2086199 - RNA, 13 nt, Human
uugaagcucuggu

SEQ ID NO: 2086200 - RNA, 23 nt, Human
uugaagcucuggugacaccagcc

SEQ ID NO: 2086201 - RNA, 13 nt, Human
uugaaucacagua

SEQ ID NO: 2086202 - RNA, 12 nt, Human
uugaauaaauaa

SEQ ID NO: 2086203 - RNA, 17 nt, Human
uugaauccaugcuuggg

SEQ ID NO: 2086204 - RNA, 19 nt, Human
uugaauccaugcuugggug

SEQ ID NO: 2086205 - RNA, 22 nt, Human
uugaauauuugucgauauuucc

SEQ ID NO: 2086206 - RNA, 21 nt, Human
uugaaucuauugggauuuucu

SEQ ID NO: 2086207 - RNA, 14 nt, Human
uugacagaacacug

SEQ ID NO: 2086208 - RNA, 15 nt, Human
uugacagaacacugu

SEQ ID NO: 2086209 - RNA, 16 nt, Human
uugacagaacacuguc

SEQ ID NO: 2086210 - RNA, 17 nt, Human
uugacagaacacugucu

SEQ ID NO: 2086211 - RNA, 18 nt, Human
aucuaauauguaacaagc

SEQ ID NO: 2086212 - RNA, 22 nt, Human
uugaguuuccucaggcugcugg

SEQ ID NO: 2086213 - RNA, 19 nt, Human
uugaguuuccucaggcugc

SEQ ID NO: 2086214 - RNA, 16 nt, Human
uugaguucagguagcu

SEQ ID NO: 2086215 - RNA, 20 nt, Human
uugaguugauucagcucugc

SEQ ID NO: 2086216 - RNA, 20 nt, Human
uugaguagagagcaagggaa

SEQ ID NO: 2086217 - RNA, 15 nt, Human
uugagucccuuccag

SEQ ID NO: 2086218 - RNA, 14 nt, Human
uugagaccucagcc

SEQ ID NO: 2086219 - RNA, 15 nt, Human
uugagaccucagcca

SEQ ID NO: 2086220 - RNA, 14 nt, Human
uugagacuaguuuu

SEQ ID NO: 2086221 - RNA, 15 nt, Human
uugagaucagccugg

SEQ ID NO: 2086222 - RNA, 16 nt, Human
uugagaucagccuggg

SEQ ID NO: 2086223 - RNA, 17 nt, Human
uugagaccucagccaug

SEQ ID NO: 2086224 - RNA, 16 nt, Human
uugagacuucaagcuu

SEQ ID NO: 2086225 - RNA, 12 nt, Human
uugagacuuuuu

SEQ ID NO: 2086226 - RNA, 15 nt, Human
uugagacuuuuuggu

SEQ ID NO: 2086227 - RNA, 16 nt, Human
uugagacuuuuuggug

SEQ ID NO: 2086228 - RNA, 23 nt, Human
uugagacuuuuugguggauguaa

SEQ ID NO: 2086229 - RNA, 12 nt, Human
uugagacagagu

SEQ ID NO: 2086230 - RNA, 13 nt, Human
uugacuuucaggu

SEQ ID NO: 2086231 - RNA, 14 nt, Human
uugacuuucaggua

SEQ ID NO: 2086232 - RNA, 15 nt, Human
uugacuuucagguac

SEQ ID NO: 2086233 - RNA, 21 nt, Human
uugacuuucagguacuaaaua

SEQ ID NO: 2086234 - RNA, 13 nt, Human
uugagacauucca

SEQ ID NO: 2086235 - RNA, 13 nt, Human
uugagaccagccu

SEQ ID NO: 2086236 - RNA, 15 nt, Human
uugagaccagccugg

SEQ ID NO: 2086237 - RNA, 19 nt, Human
uugacuugacagaacacug

SEQ ID NO: 2086238 - RNA, 20 nt, Human
uugacuugacagaacacugu

SEQ ID NO: 2086239 - RNA, 21 nt, Human
uugacuugacagaacacuguc

SEQ ID NO: 2086240 - RNA, 16 nt, Human
uugacuugauuagugc

SEQ ID NO: 2086241 - RNA, 12 nt, Human
uugacuuucagg

SEQ ID NO: 2086242 - RNA, 21 nt, Human
uugcaaguauguuuuagcaug

SEQ ID NO: 2086243 - RNA, 22 nt, Human
uugcaaguauguuuuagcaugu

SEQ ID NO: 2086244 - RNA, 14 nt, Human
uugcauauauacau

SEQ ID NO: 2086245 - RNA, 14 nt, Human
uugcauauguauga

SEQ ID NO: 2086246 - RNA, 13 nt, Human
uugcaucagaaau

SEQ ID NO: 2086247 - RNA, 14 nt, Human
uugcaucagaaaug

SEQ ID NO: 2086248 - RNA, 15 nt, Human
uugcaucagaaaugu

SEQ ID NO: 2086249 - RNA, 22 nt, Human
uugcaucagaaaugucuggaga

SEQ ID NO: 2086250 - RNA, 14 nt, Human
uugcauugaauaua

SEQ ID NO: 2086251 - RNA, 17 nt, Human
uugcauugaauauauua

SEQ ID NO: 2086252 - RNA, 19 nt, Human
uugcaauggcagccuuggc

SEQ ID NO: 2086253 - RNA, 17 nt, Human
uugcaauggcagccuug

SEQ ID NO: 2086254 - RNA, 16 nt, Human
aucucauucaguauua

SEQ ID NO: 2086255 - RNA, 22 nt, Human
uugcaagggccagaucuguuaa

SEQ ID NO: 2086256 - RNA, 16 nt, Human
uugcaauggcagccuu

SEQ ID NO: 2086257 - RNA, 14 nt, Human
uugcaccacugcac

SEQ ID NO: 2086258 - RNA, 15 nt, Human
uugcaccacugcacu

SEQ ID NO: 2086259 - RNA, 16 nt, Human
uugcaccacugcacuc

SEQ ID NO: 2086260 - RNA, 18 nt, Human
uugcaccacugcacucca

SEQ ID NO: 2086261 - RNA, 16 nt, Human
uugauuauuagccagg

SEQ ID NO: 2086262 - RNA, 14 nt, Human
uugcaaggccgcug

SEQ ID NO: 2086263 - RNA, 17 nt, Human
uugcaaggccgcuguuc

SEQ ID NO: 2086264 - RNA, 23 nt, Human
uugcaaggccgcuguucacccac

SEQ ID NO: 2086265 - RNA, 12 nt, Human
uugcaaggaagc

SEQ ID NO: 2086266 - RNA, 13 nt, Human
uugcaaggaagcc

SEQ ID NO: 2086267 - RNA, 22 nt, Human
uugauguuuguggccucagaau

SEQ ID NO: 2086268 - RNA, 15 nt, Human
aucugaauguaauuu

SEQ ID NO: 2086269 - RNA, 17 nt, Human
aucugaauguaauuugu

SEQ ID NO: 2086270 - RNA, 18 nt, Human
aucugaauguaauuugug

SEQ ID NO: 2086271 - RNA, 13 nt, Human
aucugacacaaaa

SEQ ID NO: 2086272 - RNA, 23 nt, Human
aucugaaaauguauguguaagua

SEQ ID NO: 2086273 - RNA, 12 nt, Human
aucugaaaaugu

SEQ ID NO: 2086274 - RNA, 12 nt, Human
aucuagaagaaa

SEQ ID NO: 2086275 - RNA, 14 nt, Human
aucuagaagaaaug

SEQ ID NO: 2086276 - RNA, 15 nt, Human
aucuagaagaaauga

SEQ ID NO: 2086277 - RNA, 16 nt, Human
aucuagaagaaaugaa

SEQ ID NO: 2086278 - RNA, 17 nt, Human
aucuagaagaaaugaaa

SEQ ID NO: 2086279 - RNA, 18 nt, Human
aucuagaagaaaugaaau

SEQ ID NO: 2086280 - RNA, 20 nt, Human
aucuagaagaaaugaaauuu

SEQ ID NO: 2086281 - RNA, 21 nt, Human
aucuagaagaaaugaaauuuu

SEQ ID NO: 2086282 - RNA, 22 nt, Human
aucuagaagaaaugaaauuuua

SEQ ID NO: 2086283 - RNA, 12 nt, Human
aucuagaagacu

SEQ ID NO: 2086284 - RNA, 16 nt, Human
aucucagggccugguc

SEQ ID NO: 2086285 - RNA, 13 nt, Human
aucuccaaagcuu

SEQ ID NO: 2086286 - RNA, 22 nt, Human
aucuccaaagcuuuccuggaga

SEQ ID NO: 2086287 - RNA, 16 nt, Human
aucugaaaauguaugu

SEQ ID NO: 2086288 - RNA, 19 nt, Human
aucugaaaauguaugugua

SEQ ID NO: 2086289 - RNA, 20 nt, Human
aucugaaaauguauguguaa

SEQ ID NO: 2086290 - RNA, 22 nt, Human
aucugaaaauguauguguaagu

SEQ ID NO: 2086291 - RNA, 18 nt, Human
aucucuugagccugggag

SEQ ID NO: 2086292 - RNA, 14 nt, Human
aucugaaaauguau

SEQ ID NO: 2086293 - RNA, 15 nt, Human
aucucuugagccugg

SEQ ID NO: 2086294 - RNA, 23 nt, Human
uucccguggaacguuuuuccugu

SEQ ID NO: 2086295 - RNA, 15 nt, Human
uucccuauuagagaa

SEQ ID NO: 2086296 - RNA, 20 nt, Human
uucccucaccuuucccaucu

SEQ ID NO: 2086297 - RNA, 22 nt, Human
uucccucaaagcuuccauucca

SEQ ID NO: 2086298 - RNA, 23 nt, Human
uucccucaaagcuuccauuccac

SEQ ID NO: 2086299 - RNA, 22 nt, Human
uucccgcucagcccucccugcc

SEQ ID NO: 2086300 - RNA, 21 nt, Human
uucccgcucagcccucccugc

SEQ ID NO: 2086301 - RNA, 18 nt, Human
uucccgcucagcccuccc

SEQ ID NO: 2086302 - RNA, 16 nt, Human
uucccgcucagcccuc

SEQ ID NO: 2086303 - RNA, 20 nt, Human
uuccuacaagagcagccugu

SEQ ID NO: 2086304 - RNA, 22 nt, Human
uuccuacaagagcagccugugg

SEQ ID NO: 2086305 - RNA, 23 nt, Human
uuccuacaagagcagccuguggc

SEQ ID NO: 2086306 - RNA, 16 nt, Human
uuccuacaaagauguu

SEQ ID NO: 2086307 - RNA, 14 nt, Human
uuccuacaauauau

SEQ ID NO: 2086308 - RNA, 13 nt, Human
uuccguuuacauu

SEQ ID NO: 2086309 - RNA, 14 nt, Human
uuccugaaccgaug

SEQ ID NO: 2086310 - RNA, 13 nt, Human
uuccucuuuccau

SEQ ID NO: 2086311 - RNA, 17 nt, Human
uuccucuuuccaucuac

SEQ ID NO: 2086312 - RNA, 22 nt, Human
uuccucuuuccaucuacccucc

SEQ ID NO: 2086313 - RNA, 20 nt, Human
aucaauccagcgguucucaa

SEQ ID NO: 2086314 - RNA, 15 nt, Human
aucaagcuaauaaaa

SEQ ID NO: 2086315 - RNA, 13 nt, Human
aucaagcuaauaa

SEQ ID NO: 2086316 - RNA, 15 nt, Human
aucaccuuaggcagg

SEQ ID NO: 2086317 - RNA, 14 nt, Human
aucaaugaguaaca

SEQ ID NO: 2086318 - RNA, 23 nt, Human
aucaauccugugugguuuagugu

SEQ ID NO: 2086319 - RNA, 15 nt, Human
aucacggcucacugc

SEQ ID NO: 2086320 - RNA, 14 nt, Human
aucacgccacugca

SEQ ID NO: 2086321 - RNA, 13 nt, Human
aucacgccacugc

SEQ ID NO: 2086322 - RNA, 20 nt, Human
aucacgaggucaggaguuca

SEQ ID NO: 2086323 - RNA, 20 nt, Human
aucaccuuaggcagggaagu

SEQ ID NO: 2086324 - RNA, 16 nt, Human
aucaccuuaggcaggg

SEQ ID NO: 2086325 - RNA, 17 nt, Human
aucaccuuaggcaggga

SEQ ID NO: 2086326 - RNA, 18 nt, Human
aucaccuuaggcagggaa

SEQ ID NO: 2086327 - RNA, 19 nt, Human
aucacggcucacugcagcc

SEQ ID NO: 2086328 - RNA, 18 nt, Human
aucacggcucacugcagc

SEQ ID NO: 2086329 - RNA, 11 nt, Human
uuccugugucu

SEQ ID NO: 2086330 - RNA, 23 nt, Human
uuccuguccuucucucaccuccu

SEQ ID NO: 2086331 - RNA, 24 nt, Human
uuccuguccuucucucaccuccua

SEQ ID NO: 2086332 - RNA, 18 nt, Human
uuccuguccgcccucuuc

SEQ ID NO: 2086333 - RNA, 14 nt, Human
uuccugucuuccug

SEQ ID NO: 2086334 - RNA, 21 nt, Human
aucaaauuuguaggguuucua

SEQ ID NO: 2086335 - RNA, 22 nt, Human
aucaaauuucacgucgucuucu

SEQ ID NO: 2086336 - RNA, 16 nt, Human
aucaagcacagaagga

SEQ ID NO: 2086337 - RNA, 12 nt, Human
aucaacagggca

SEQ ID NO: 2086338 - RNA, 18 nt, Human
auauuuuuucagaaauau

SEQ ID NO: 2086339 - RNA, 16 nt, Human
auauuuuuauuuuauu

SEQ ID NO: 2086340 - RNA, 20 nt, Human
auauuuuuuaauuugaugaa

SEQ ID NO: 2086341 - RNA, 18 nt, Human
aucaaauucuacaacuuu

SEQ ID NO: 2086342 - RNA, 20 nt, Human
aucaaauuucacgucgucuu

SEQ ID NO: 2086343 - RNA, 21 nt, Human
uucggcauugguucccuuugc

SEQ ID NO: 2086344 - RNA, 14 nt, Human
uucuaaaugaagug

SEQ ID NO: 2086345 - RNA, 13 nt, Human
uucuaaaugcaua

SEQ ID NO: 2086346 - RNA, 23 nt, Human
uucuaaaugcauauccugagcca

SEQ ID NO: 2086347 - RNA, 12 nt, Human
uucgcugcaacc

SEQ ID NO: 2086348 - RNA, 16 nt, Human
aucacuggcaaugaaa

SEQ ID NO: 2086349 - RNA, 16 nt, Human
aucacuggagcccagg

SEQ ID NO: 2086350 - RNA, 17 nt, Human
aucacuggagcccagga

SEQ ID NO: 2086351 - RNA, 19 nt, Human
uucgcuccugugucuugca

SEQ ID NO: 2086352 - RNA, 15 nt, Human
uucgcuccugugucu

SEQ ID NO: 2086353 - RNA, 16 nt, Human
aucacugcucacacug

SEQ ID NO: 2086354 - RNA, 10 nt, Human
aucacuggag

SEQ ID NO: 2086355 - RNA, 17 nt, Human
aucacuggagcaccagg

SEQ ID NO: 2086356 - RNA, 19 nt, Human
aucacuggagcaccaggca

SEQ ID NO: 2086357 - RNA, 23 nt, Human
aucacuggagcaccaggcacgaa

SEQ ID NO: 2086358 - RNA, 12 nt, Human
aucacuggagcc

SEQ ID NO: 2086359 - RNA, 13 nt, Human
aucacuggagccc

SEQ ID NO: 2086360 - RNA, 14 nt, Human
aucacuggagccca

SEQ ID NO: 2086361 - RNA, 15 nt, Human
aucacuggagcccag

SEQ ID NO: 2086362 - RNA, 21 nt, Human
uucuagcuguugagcuguuuu

SEQ ID NO: 2086363 - RNA, 20 nt, Human
uucuagcuguugagcuguuu

SEQ ID NO: 2086364 - RNA, 12 nt, Human
uucuagcuguug

SEQ ID NO: 2086365 - RNA, 22 nt, Human
uucuagcuaauggaaaaugauu

SEQ ID NO: 2086366 - RNA, 19 nt, Human
uucuagcaugaagacagag

SEQ ID NO: 2086367 - RNA, 20 nt, Human
uucuaaaugcauauccugag

SEQ ID NO: 2086368 - RNA, 21 nt, Human
aucagggcaaucccaacacau

SEQ ID NO: 2086369 - RNA, 16 nt, Human
aucaggccugccagac

SEQ ID NO: 2086370 - RNA, 15 nt, Human
aucaggcuauguaug

SEQ ID NO: 2086371 - RNA, 12 nt, Human
aucagaauucuc

SEQ ID NO: 2086372 - RNA, 13 nt, Human
aucagcaaagaau

SEQ ID NO: 2086373 - RNA, 18 nt, Human
uucucacuccuaccuggu

SEQ ID NO: 2086374 - RNA, 16 nt, Human
uucucacuccuaccug

SEQ ID NO: 2086375 - RNA, 14 nt, Human
uucucacuccacca

SEQ ID NO: 2086376 - RNA, 15 nt, Human
uucucacuccaccac

SEQ ID NO: 2086377 - RNA, 16 nt, Human
uucucacuccaccacc

SEQ ID NO: 2086378 - RNA, 22 nt, Human
uucucacagugggagccagggc

SEQ ID NO: 2086379 - RNA, 21 nt, Human
uucucacagugggagccaggg

SEQ ID NO: 2086380 - RNA, 19 nt, Human
uucucacagugggagccag

SEQ ID NO: 2086381 - RNA, 18 nt, Human
aucagaaguuucucagcu

SEQ ID NO: 2086382 - RNA, 11 nt, Human
aucagaauucu

SEQ ID NO: 2086383 - RNA, 19 nt, Human
aucacuugaggucaggagu

SEQ ID NO: 2086384 - RNA, 20 nt, Human
uucucaggcucugcccugcc

SEQ ID NO: 2086385 - RNA, 21 nt, Human
uucuuaagacgugauuuugcu

SEQ ID NO: 2086386 - RNA, 23 nt, Human
uucuuaagacgugauuuugcugu

SEQ ID NO: 2086387 - RNA, 22 nt, Human
uucuuaaguauguuauuuucug

SEQ ID NO: 2086388 - RNA, 22 nt, Human
uucuuaagaccaccucaaauuu

SEQ ID NO: 2086389 - RNA, 20 nt, Human
uucuuaaggauugugauauu

SEQ ID NO: 2086390 - RNA, 22 nt, Human
uucuuaaggauugugauauuuu

SEQ ID NO: 2086391 - RNA, 13 nt, Human
uucuucucccuca

SEQ ID NO: 2086392 - RNA, 15 nt, Human
uucuucugcuucagc

SEQ ID NO: 2086393 - RNA, 13 nt, Human
uucuucugcuuca

SEQ ID NO: 2086394 - RNA, 14 nt, Human
uucuucucccucag

SEQ ID NO: 2086395 - RNA, 18 nt, Human
uucuuaagacauguauca

SEQ ID NO: 2086396 - RNA, 13 nt, Human
aucccaugagccu

SEQ ID NO: 2086397 - RNA, 11 nt, Human
aucccauccca

SEQ ID NO: 2086398 - RNA, 13 nt, Human
aucccaucccauc

SEQ ID NO: 2086399 - RNA, 14 nt, Human
aucccaucccaucc

SEQ ID NO: 2086400 - RNA, 15 nt, Human
aucccaucccauccc

SEQ ID NO: 2086401 - RNA, 16 nt, Human
aucccaucccauccca

SEQ ID NO: 2086402 - RNA, 18 nt, Human
aucccaucccaucccauc

SEQ ID NO: 2086403 - RNA, 19 nt, Human
aucccaucccaucccaucc

SEQ ID NO: 2086404 - RNA, 15 nt, Human
aucccaucccgcucu

SEQ ID NO: 2086405 - RNA, 20 nt, Human
aucccaucccgcucuuuucc

SEQ ID NO: 2086406 - RNA, 17 nt, Human
uucuucuuuuugcuuca

SEQ ID NO: 2086407 - RNA, 21 nt, Human
uucuucuuuuugcuucaaaaa

SEQ ID NO: 2086408 - RNA, 15 nt, Human
uucuugaaagcugug

SEQ ID NO: 2086409 - RNA, 14 nt, Human
uucuugaaagcugu

SEQ ID NO: 2086410 - RNA, 13 nt, Human
uucuugaaagcug

SEQ ID NO: 2086411 - RNA, 16 nt, Human
uucuuugcuugaacac

SEQ ID NO: 2086412 - RNA, 17 nt, Human
uucuuugcuugaacaca

SEQ ID NO: 2086413 - RNA, 21 nt, Human
uucuuugcuugaacacaguau

SEQ ID NO: 2086414 - RNA, 22 nt, Human
uucuuugcuugaacacaguauu

SEQ ID NO: 2086415 - RNA, 22 nt, Human
uucuucuuccaacguggcccag

SEQ ID NO: 2086416 - RNA, 13 nt, Human
uucuucuucagaa

SEQ ID NO: 2086417 - RNA, 15 nt, Human
uucuucuucagaaga

SEQ ID NO: 2086418 - RNA, 20 nt, Human
uucuucugcuucagccuccc

SEQ ID NO: 2086419 - RNA, 19 nt, Human
uucuuuuuuaaauuuucuu

SEQ ID NO: 2086420 - RNA, 23 nt, Human
uucuuuuuuaaauuuucuucagu

SEQ ID NO: 2086421 - RNA, 17 nt, Human
uugaaagagaaccaguu

SEQ ID NO: 2086422 - RNA, 20 nt, Human
uugaaagagaaccaguuuca

SEQ ID NO: 2086423 - RNA, 14 nt, Human
uugaaagaguccua

SEQ ID NO: 2086424 - RNA, 14 nt, Human
uugaaagaguuaag

SEQ ID NO: 2086425 - RNA, 19 nt, Human
uugaaagaguuaagaaugu

SEQ ID NO: 2086426 - RNA, 14 nt, Human
uucuuuuuuuguga

SEQ ID NO: 2086427 - RNA, 13 nt, Human
uugaaagaccuuc

SEQ ID NO: 2086428 - RNA, 14 nt, Human
uucuuuggugccuu

SEQ ID NO: 2086429 - RNA, 15 nt, Human
uucuuuggugccuuu

SEQ ID NO: 2086430 - RNA, 18 nt, Human
uucuuuggugccuuuccu

SEQ ID NO: 2086431 - RNA, 19 nt, Human
uucuuuggugccuuuccug

SEQ ID NO: 2086432 - RNA, 21 nt, Human
uucuuuggugccuuuccuguu

SEQ ID NO: 2086433 - RNA, 22 nt, Human
uucuuuggugccuuuccuguuc

SEQ ID NO: 2086434 - RNA, 22 nt, Human
uucuuugguggagauaaagauu

SEQ ID NO: 2086435 - RNA, 22 nt, Human
auccuaccacaaugcagugccu

SEQ ID NO: 2086436 - RNA, 21 nt, Human
auccuaccacaaugcagugcc

SEQ ID NO: 2086437 - RNA, 14 nt, Human
auccuaccaaccuc

SEQ ID NO: 2086438 - RNA, 15 nt, Human
auccuaccaaccucu

SEQ ID NO: 2086439 - RNA, 13 nt, Human
auccuagcugugu

SEQ ID NO: 2086440 - RNA, 14 nt, Human
auccuagcugugug

SEQ ID NO: 2086441 - RNA, 15 nt, Human
auccuagcugugugc

SEQ ID NO: 2086442 - RNA, 19 nt, Human
auccuagcugugugcaguc

SEQ ID NO: 2086443 - RNA, 16 nt, Human
auccuaggcauuugcu

SEQ ID NO: 2086444 - RNA, 21 nt, Human
auccuaagcuauucaguaaua

SEQ ID NO: 2086445 - RNA, 14 nt, Human
auccuaaaacaaau

SEQ ID NO: 2086446 - RNA, 12 nt, Human
auccuaagcuau

SEQ ID NO: 2086447 - RNA, 16 nt, Human
auccguaguucccuga

SEQ ID NO: 2086448 - RNA, 14 nt, Human
auccggaggagaag

SEQ ID NO: 2086449 - RNA, 22 nt, Human
auccggaggagaagaaggaaau

SEQ ID NO: 2086450 - RNA, 15 nt, Human
auccggcagccugga

SEQ ID NO: 2086451 - RNA, 17 nt, Human
auccguaguucccugaa

SEQ ID NO: 2086452 - RNA, 22 nt, Human
auccgugagcagugugucuccu

SEQ ID NO: 2086453 - RNA, 13 nt, Human
auccgaggcaggg

SEQ ID NO: 2086454 - RNA, 19 nt, Human
uugaaauuguuuaaguguu

SEQ ID NO: 2086455 - RNA, 12 nt, Human
auccgaggcagg

SEQ ID NO: 2086456 - RNA, 22 nt, Human
uugaaagcuguggccagcuugu

SEQ ID NO: 2086457 - RNA, 19 nt, Human
uugaaaggcauucucugaa

SEQ ID NO: 2086458 - RNA, 20 nt, Human
uugaaaggcauucucugaag

SEQ ID NO: 2086459 - RNA, 21 nt, Human
uugaaaggcauucucugaaga

SEQ ID NO: 2086460 - RNA, 12 nt, Human
uugaaagcugug

SEQ ID NO: 2086461 - RNA, 16 nt, Human
uugaaagcauccaugu

SEQ ID NO: 2086462 - RNA, 18 nt, Human
aucaguagccagcaucug

SEQ ID NO: 2086463 - RNA, 13 nt, Human
aucagguggggag

SEQ ID NO: 2086464 - RNA, 15 nt, Human
uucuccuuagucuuc

SEQ ID NO: 2086465 - RNA, 15 nt, Human
uucuccugccugugc

SEQ ID NO: 2086466 - RNA, 21 nt, Human
uucuccugccugugcugugac

SEQ ID NO: 2086467 - RNA, 20 nt, Human
uucucuagggaaggccaccu

SEQ ID NO: 2086468 - RNA, 16 nt, Human
uucucuucauuuuccc

SEQ ID NO: 2086469 - RNA, 17 nt, Human
uucuccuugauaacagc

SEQ ID NO: 2086470 - RNA, 18 nt, Human
uucuccuugauaacagcu

SEQ ID NO: 2086471 - RNA, 23 nt, Human
uucuccuugauaacagcuaccau

SEQ ID NO: 2086472 - RNA, 20 nt, Human
uucuccuuagucuucucaua

SEQ ID NO: 2086473 - RNA, 22 nt, Human
uucuccuuccaacugcugcccc

SEQ ID NO: 2086474 - RNA, 17 nt, Human
uucugggaaauggcuug

SEQ ID NO: 2086475 - RNA, 23 nt, Human
uucugggaaauggcuugaagcca

SEQ ID NO: 2086476 - RNA, 12 nt, Human
uucugaacucgc

SEQ ID NO: 2086477 - RNA, 19 nt, Human
uucuggcugaacacuggca

SEQ ID NO: 2086478 - RNA, 18 nt, Human
uucugccugcccaggccc

SEQ ID NO: 2086479 - RNA, 17 nt, Human
uucugccugcccaggcc

SEQ ID NO: 2086480 - RNA, 21 nt, Human
uucugccugcccaggccccug

SEQ ID NO: 2086481 - RNA, 15 nt, Human
uucugccauauucug

SEQ ID NO: 2086482 - RNA, 20 nt, Human
uucugcccauccugucuguu

SEQ ID NO: 2086483 - RNA, 15 nt, Human
uucugcccugcccac

SEQ ID NO: 2086484 - RNA, 15 nt, Human
uucugccagggagcu

SEQ ID NO: 2086485 - RNA, 16 nt, Human
uucugccagggagcuu

SEQ ID NO: 2086486 - RNA, 19 nt, Human
uucugcccacauuggaccc

SEQ ID NO: 2086487 - RNA, 16 nt, Human
uucucuuggcuggcuu

SEQ ID NO: 2086488 - RNA, 15 nt, Human
uucucuugggcugag

SEQ ID NO: 2086489 - RNA, 21 nt, Human
uucuggggccccuuuuuacuc

SEQ ID NO: 2086490 - RNA, 15 nt, Human
uucuggggccccacc

SEQ ID NO: 2086491 - RNA, 14 nt, Human
uucuggggccccuu

SEQ ID NO: 2086492 - RNA, 23 nt, Human
uucuggggccccuuuuuacuccc

SEQ ID NO: 2086493 - RNA, 17 nt, Human
aucauuuuccccccacu

SEQ ID NO: 2086494 - RNA, 13 nt, Human
aucauuuuccccc

SEQ ID NO: 2086495 - RNA, 14 nt, Human
aucauuuucccccc

SEQ ID NO: 2086496 - RNA, 15 nt, Human
aucauuuucccccca

SEQ ID NO: 2086497 - RNA, 21 nt, Human
auccaagcuggucccacucag

SEQ ID NO: 2086498 - RNA, 18 nt, Human
auccaagcuggucccacu

SEQ ID NO: 2086499 - RNA, 16 nt, Human
auccacccaccucagc

SEQ ID NO: 2086500 - RNA, 15 nt, Human
auccacccaccucag

SEQ ID NO: 2086501 - RNA, 13 nt, Human
auccacccaccuc

SEQ ID NO: 2086502 - RNA, 13 nt, Human
auccaucaggcca

SEQ ID NO: 2086503 - RNA, 13 nt, Human
aucccagcucacg

SEQ ID NO: 2086504 - RNA, 22 nt, Human
aucccagcuacuugggaggcug

SEQ ID NO: 2086505 - RNA, 20 nt, Human
aucccagcuacucaggaggc

SEQ ID NO: 2086506 - RNA, 23 nt, Human
aucccagcuacucaagaggcuga

SEQ ID NO: 2086507 - RNA, 17 nt, Human
aucccagcuacucagga

SEQ ID NO: 2086508 - RNA, 18 nt, Human
aucccagcuacucaggag

SEQ ID NO: 2086509 - RNA, 23 nt, Human
aucccagcccuuugggaggcuga

SEQ ID NO: 2086510 - RNA, 18 nt, Human
aucccagcggcuggugca

SEQ ID NO: 2086511 - RNA, 23 nt, Human
aucccagcggcuggugcagggcc

SEQ ID NO: 2086512 - RNA, 20 nt, Human
aucccagcuacucaagaggc

SEQ ID NO: 2086513 - RNA, 19 nt, Human
auguaugaggaauuucugu

SEQ ID NO: 2086514 - RNA, 20 nt, Human
uuuggcaucuguuuaaagua

SEQ ID NO: 2086515 - RNA, 22 nt, Human
uuuggcaggggcagaaaacucu

SEQ ID NO: 2086516 - RNA, 15 nt, Human
auguauguguaagua

SEQ ID NO: 2086517 - RNA, 14 nt, Human
auguaugauuacau

SEQ ID NO: 2086518 - RNA, 15 nt, Human
auguauguguguaug

SEQ ID NO: 2086519 - RNA, 14 nt, Human
auguauguguguau

SEQ ID NO: 2086520 - RNA, 16 nt, Human
auguauguguaaguau

SEQ ID NO: 2086521 - RNA, 17 nt, Human
auguauguuuacacugu

SEQ ID NO: 2086522 - RNA, 19 nt, Human
auguauguuuacacuguca

SEQ ID NO: 2086523 - RNA, 20 nt, Human
auguauguuuacacugucaa

SEQ ID NO: 2086524 - RNA, 21 nt, Human
auguauguuuacacugucaaa

SEQ ID NO: 2086525 - RNA, 16 nt, Human
auguauuaauauucau

SEQ ID NO: 2086526 - RNA, 17 nt, Human
auguauuaauauucauu

SEQ ID NO: 2086527 - RNA, 13 nt, Human
auguauuauucug

SEQ ID NO: 2086528 - RNA, 14 nt, Human
auguauuauucugc

SEQ ID NO: 2086529 - RNA, 16 nt, Human
auguauuauucugcag

SEQ ID NO: 2086530 - RNA, 17 nt, Human
auguauuauucugcagc

SEQ ID NO: 2086531 - RNA, 19 nt, Human
augucucgugguaggacug

SEQ ID NO: 2086532 - RNA, 13 nt, Human
augucucucagaa

SEQ ID NO: 2086533 - RNA, 16 nt, Human
augucucucagaauuc

SEQ ID NO: 2086534 - RNA, 17 nt, Human
augucucucagaauucu

SEQ ID NO: 2086535 - RNA, 21 nt, Human
augucucucagaauucuucag

SEQ ID NO: 2086536 - RNA, 15 nt, Human
augucucgugguagg

SEQ ID NO: 2086537 - RNA, 16 nt, Human
augucucgugguagga

SEQ ID NO: 2086538 - RNA, 22 nt, Human
augucucaggucccugcagggc

SEQ ID NO: 2086539 - RNA, 17 nt, Human
augucucaggucccugc

SEQ ID NO: 2086540 - RNA, 14 nt, Human
augucgauuaaaau

SEQ ID NO: 2086541 - RNA, 14 nt, Human
augucgccucugca

SEQ ID NO: 2086542 - RNA, 13 nt, Human
augucgccucugc

SEQ ID NO: 2086543 - RNA, 21 nt, Human
uuugucuuguguuucuuuagu

SEQ ID NO: 2086544 - RNA, 19 nt, Human
uuugucuuuggugaacauu

SEQ ID NO: 2086545 - RNA, 22 nt, Human
uuugugaaaugauggugaaagu

SEQ ID NO: 2086546 - RNA, 18 nt, Human
uuuguaaucguuaugugu

SEQ ID NO: 2086547 - RNA, 21 nt, Human
uuuguaaucguuaugugugua

SEQ ID NO: 2086548 - RNA, 23 nt, Human
uuuguaaugucaccaccuuccca

SEQ ID NO: 2086549 - RNA, 15 nt, Human
augugauuuuucuga

SEQ ID NO: 2086550 - RNA, 16 nt, Human
augugcaaguguaugc

SEQ ID NO: 2086551 - RNA, 15 nt, Human
augugcaaaaauuuu

SEQ ID NO: 2086552 - RNA, 16 nt, Human
augugcaaaaauuuuu

SEQ ID NO: 2086553 - RNA, 17 nt, Human
augugcaaaaauuuuug

SEQ ID NO: 2086554 - RNA, 23 nt, Human
augugcaaaaauuuuuggauuga

SEQ ID NO: 2086555 - RNA, 14 nt, Human
augugauuuuucug

SEQ ID NO: 2086556 - RNA, 23 nt, Human
augugcacaugcacgugugugca

SEQ ID NO: 2086557 - RNA, 23 nt, Human
augucucuuuaaugucacaggca

SEQ ID NO: 2086558 - RNA, 20 nt, Human
auguauuauucugcagcaug

SEQ ID NO: 2086559 - RNA, 21 nt, Human
uuugacuagggauucaggcug

SEQ ID NO: 2086560 - RNA, 17 nt, Human
uuugacauguggaaagu

SEQ ID NO: 2086561 - RNA, 13 nt, Human
uuugcucuuucuu

SEQ ID NO: 2086562 - RNA, 10 nt, Human
uuugcugcca

SEQ ID NO: 2086563 - RNA, 22 nt, Human
uuugccuaauacauuaaagcag

SEQ ID NO: 2086564 - RNA, 12 nt, Human
uuugcuccaccc

SEQ ID NO: 2086565 - RNA, 19 nt, Human
uuugcuccaccccacucac

SEQ ID NO: 2086566 - RNA, 11 nt, Human
uuugccugugc

SEQ ID NO: 2086567 - RNA, 13 nt, Human
uuugccucugccu

SEQ ID NO: 2086568 - RNA, 14 nt, Human
uuugccugagggcg

SEQ ID NO: 2086569 - RNA, 12 nt, Human
uuugcaaggaag

SEQ ID NO: 2086570 - RNA, 14 nt, Human
uuugcaaggaagcc

SEQ ID NO: 2086571 - RNA, 21 nt, Human
uuugcaaggaagccacagcug

SEQ ID NO: 2086572 - RNA, 17 nt, Human
uuugauguuuguggccu

SEQ ID NO: 2086573 - RNA, 19 nt, Human
uuugauguuuguggccuca

SEQ ID NO: 2086574 - RNA, 18 nt, Human
auguaccaugaaacaaag

SEQ ID NO: 2086575 - RNA, 14 nt, Human
auguaccucuuuua

SEQ ID NO: 2086576 - RNA, 15 nt, Human
auguaccucuuuuag

SEQ ID NO: 2086577 - RNA, 21 nt, Human
auguaccucuuuuagucauuu

SEQ ID NO: 2086578 - RNA, 20 nt, Human
auguacuccucuuuacacug

SEQ ID NO: 2086579 - RNA, 17 nt, Human
auguacuccucuuuaca

SEQ ID NO: 2086580 - RNA, 16 nt, Human
auguacuguaguuuuu

SEQ ID NO: 2086581 - RNA, 19 nt, Human
auguacuguaguuuuucuu

SEQ ID NO: 2086582 - RNA, 12 nt, Human
auguagaaagcu

SEQ ID NO: 2086583 - RNA, 18 nt, Human
auguagauaaacucagaa

SEQ ID NO: 2086584 - RNA, 19 nt, Human
auguagauaaacucagaaa

SEQ ID NO: 2086585 - RNA, 22 nt, Human
auguagauauugugaaguacau

SEQ ID NO: 2086586 - RNA, 23 nt, Human
auguagauauugugaaguacaua

SEQ ID NO: 2086587 - RNA, 14 nt, Human
auguagcugguuuc

SEQ ID NO: 2086588 - RNA, 15 nt, Human
auguagcugguuucc

SEQ ID NO: 2086589 - RNA, 17 nt, Human
auguagaugugcauuuu

SEQ ID NO: 2086590 - RNA, 17 nt, Human
auguagcaaaacgcaug

SEQ ID NO: 2086591 - RNA, 20 nt, Human
auguagcaaaacgcauggag

SEQ ID NO: 2086592 - RNA, 18 nt, Human
auguagcaaucagauuuu

SEQ ID NO: 2086593 - RNA, 21 nt, Human
auguagcaaucagauuuuccu

SEQ ID NO: 2086594 - RNA, 19 nt, Human
auguaguauaaagaaaagu

SEQ ID NO: 2086595 - RNA, 13 nt, Human
uuugacaugugga

SEQ ID NO: 2086596 - RNA, 16 nt, Human
auguaguauaaagaaa

SEQ ID NO: 2086597 - RNA, 17 nt, Human
auguaguauaaagaaaa

SEQ ID NO: 2086598 - RNA, 18 nt, Human
auguaggguaaggugccu

SEQ ID NO: 2086599 - RNA, 16 nt, Human
auguagguaugaauaa

SEQ ID NO: 2086600 - RNA, 17 nt, Human
auguagguaugaauaag

SEQ ID NO: 2086601 - RNA, 17 nt, Human
auguaaaagacuuuuuu

SEQ ID NO: 2086602 - RNA, 21 nt, Human
auguaaaagagucaucuggua

SEQ ID NO: 2086603 - RNA, 14 nt, Human
auguaaaauuuugc

SEQ ID NO: 2086604 - RNA, 19 nt, Human
auguaaaauuuugccuaau

SEQ ID NO: 2086605 - RNA, 13 nt, Human
auguaaagacaaa

SEQ ID NO: 2086606 - RNA, 19 nt, Human
auguaaagacaaaaaacua

SEQ ID NO: 2086607 - RNA, 15 nt, Human
auguaaacagugccu

SEQ ID NO: 2086608 - RNA, 16 nt, Human
auguaaacagugccug

SEQ ID NO: 2086609 - RNA, 17 nt, Human
auguaaacagugccugc

SEQ ID NO: 2086610 - RNA, 20 nt, Human
auguaaacagugccugcuga

SEQ ID NO: 2086611 - RNA, 22 nt, Human
auguaaacagugccugcugaau

SEQ ID NO: 2086612 - RNA, 23 nt, Human
auguaaacauaauucuuguauau

SEQ ID NO: 2086613 - RNA, 20 nt, Human
auguacauuuccaaauucac

SEQ ID NO: 2086614 - RNA, 19 nt, Human
auguacauuucugaaauga

SEQ ID NO: 2086615 - RNA, 15 nt, Human
auguaaauuaccagu

SEQ ID NO: 2086616 - RNA, 20 nt, Human
auguaaauuaccaguaaagu

SEQ ID NO: 2086617 - RNA, 23 nt, Human
auguaaauuaccaguaaagugua

SEQ ID NO: 2086618 - RNA, 12 nt, Human
auguaaaugaag

SEQ ID NO: 2086619 - RNA, 13 nt, Human
auguaaaugaagu

SEQ ID NO: 2086620 - RNA, 21 nt, Human
auguaaauaaaggauuucuag

SEQ ID NO: 2086621 - RNA, 21 nt, Human
auguaaauaaccccauucuuu

SEQ ID NO: 2086622 - RNA, 22 nt, Human
auguaaauaaccccauucuuug

SEQ ID NO: 2086623 - RNA, 23 nt, Human
auguaaauaaccccauucuuugc

SEQ ID NO: 2086624 - RNA, 21 nt, Human
augguuugaauauaaacacua

SEQ ID NO: 2086625 - RNA, 20 nt, Human
augguuccccuguucacucu

SEQ ID NO: 2086626 - RNA, 19 nt, Human
augguuccccuguucacuc

SEQ ID NO: 2086627 - RNA, 19 nt, Human
augguugagaaaugaauaa

SEQ ID NO: 2086628 - RNA, 16 nt, Human
augguugagaaaugaa

SEQ ID NO: 2086629 - RNA, 11 nt, Human
auguaaaacaa

SEQ ID NO: 2086630 - RNA, 12 nt, Human
auguaaaacaaa

SEQ ID NO: 2086631 - RNA, 13 nt, Human
auguaaaacaaaa

SEQ ID NO: 2086632 - RNA, 14 nt, Human
auguaaaacaaaaa

SEQ ID NO: 2086633 - RNA, 15 nt, Human
auguaaaacaaaaaa

SEQ ID NO: 2086634 - RNA, 20 nt, Human
auguaaaacaaaaaacaaua

SEQ ID NO: 2086635 - RNA, 16 nt, Human
augguuuucaaaauaa

SEQ ID NO: 2086636 - RNA, 14 nt, Human
augguuuucaaaau

SEQ ID NO: 2086637 - RNA, 15 nt, Human
augguuuucaaaaua

SEQ ID NO: 2086638 - RNA, 22 nt, Human
augguuugaauauaaacacuau

SEQ ID NO: 2086639 - RNA, 16 nt, Human
augguuugcaaggaag

SEQ ID NO: 2086640 - RNA, 17 nt, Human
augguuugcaaggaagc

SEQ ID NO: 2086641 - RNA, 18 nt, Human
augguuugcaaggaagcc

SEQ ID NO: 2086642 - RNA, 17 nt, Human
augguggcuggguugga

SEQ ID NO: 2086643 - RNA, 16 nt, Human
augguggcgcgcaccu

SEQ ID NO: 2086644 - RNA, 15 nt, Human
augguggcuggguug

SEQ ID NO: 2086645 - RNA, 13 nt, Human
augguggcugggu

SEQ ID NO: 2086646 - RNA, 12 nt, Human
augguggcuggg

SEQ ID NO: 2086647 - RNA, 16 nt, Human
auggugcucauuucau

SEQ ID NO: 2086648 - RNA, 13 nt, Human
augguuaacuaau

SEQ ID NO: 2086649 - RNA, 16 nt, Human
augguguuuucaugua

SEQ ID NO: 2086650 - RNA, 21 nt, Human
augguguuuucauguaaauaa

SEQ ID NO: 2086651 - RNA, 13 nt, Human
augguuacacugu

SEQ ID NO: 2086652 - RNA, 15 nt, Human
augguuacacuguua

SEQ ID NO: 2086653 - RNA, 16 nt, Human
augguuacacuguuag

SEQ ID NO: 2086654 - RNA, 17 nt, Human
augguuacacuguuaga

SEQ ID NO: 2086655 - RNA, 23 nt, Human
augguuacacuguuagaacacua

SEQ ID NO: 2086656 - RNA, 19 nt, Human
auggugguuguuucuucca

SEQ ID NO: 2086657 - RNA, 15 nt, Human
augggggguauauuu

SEQ ID NO: 2086658 - RNA, 18 nt, Human
auggugugaaagucagau

SEQ ID NO: 2086659 - RNA, 22 nt, Human
auggugugaaagucagaugccc

SEQ ID NO: 2086660 - RNA, 14 nt, Human
auggugaugaaaug

SEQ ID NO: 2086661 - RNA, 22 nt, Human
augggugaagggagagccagcu

SEQ ID NO: 2086662 - RNA, 17 nt, Human
auggugaugaaauguaa

SEQ ID NO: 2086663 - RNA, 16 nt, Human
auggugaugaaaugua

SEQ ID NO: 2086664 - RNA, 15 nt, Human
auggugagcagcgga

SEQ ID NO: 2086665 - RNA, 20 nt, Human
auggugaggcuuaacaaugu

SEQ ID NO: 2086666 - RNA, 12 nt, Human
auggugccucug

SEQ ID NO: 2086667 - RNA, 13 nt, Human
auggugccucugg

SEQ ID NO: 2086668 - RNA, 14 nt, Human
auggugccucugga

SEQ ID NO: 2086669 - RNA, 15 nt, Human
auggugccucuggag

SEQ ID NO: 2086670 - RNA, 14 nt, Human
uuucugcagaaaca

SEQ ID NO: 2086671 - RNA, 23 nt, Human
augggauucagugcuucuuaaag

SEQ ID NO: 2086672 - RNA, 13 nt, Human
uuucucccccugg

SEQ ID NO: 2086673 - RNA, 14 nt, Human
uuucucccccuggg

SEQ ID NO: 2086674 - RNA, 15 nt, Human
uuucucccccugggc

SEQ ID NO: 2086675 - RNA, 23 nt, Human
uuucuguccuuuuggcacugaga

SEQ ID NO: 2086676 - RNA, 15 nt, Human
uuucugguagauaga

SEQ ID NO: 2086677 - RNA, 17 nt, Human
uuucugguagauagaaa

SEQ ID NO: 2086678 - RNA, 13 nt, Human
uuucuguaccauu

SEQ ID NO: 2086679 - RNA, 19 nt, Human
uuucugguagauagaaaua

SEQ ID NO: 2086680 - RNA, 22 nt, Human
uuucugguucuuguguuggcug

SEQ ID NO: 2086681 - RNA, 17 nt, Human
auggguagagaaacacu

SEQ ID NO: 2086682 - RNA, 14 nt, Human
auggguagcuucug

SEQ ID NO: 2086683 - RNA, 15 nt, Human
auggguagcuucuga

SEQ ID NO: 2086684 - RNA, 23 nt, Human
auggguagcuucugaccucagca

SEQ ID NO: 2086685 - RNA, 16 nt, Human
auggguaucaaacagc

SEQ ID NO: 2086686 - RNA, 19 nt, Human
auggggugggguagggcug

SEQ ID NO: 2086687 - RNA, 18 nt, Human
augggguuggcugggccc

SEQ ID NO: 2086688 - RNA, 21 nt, Human
augggguuggcugggcccaga

SEQ ID NO: 2086689 - RNA, 16 nt, Human
auggggggccaacacc

SEQ ID NO: 2086690 - RNA, 22 nt, Human
auggggggccaacaccagggau

SEQ ID NO: 2086691 - RNA, 17 nt, Human
augggggcacugaggac

SEQ ID NO: 2086692 - RNA, 16 nt, Human
augggggccucagggc

SEQ ID NO: 2086693 - RNA, 19 nt, Human
augggggagucugaagcag

SEQ ID NO: 2086694 - RNA, 20 nt, Human
augggggagucugaagcaga

SEQ ID NO: 2086695 - RNA, 14 nt, Human
augggggaugcuuc

SEQ ID NO: 2086696 - RNA, 16 nt, Human
augggggaugcuucau

SEQ ID NO: 2086697 - RNA, 21 nt, Human
augggggagucugaagcagau

SEQ ID NO: 2086698 - RNA, 14 nt, Human
uuugaaaacuacau

SEQ ID NO: 2086699 - RNA, 18 nt, Human
uuugaaaacuacauuuua

SEQ ID NO: 2086700 - RNA, 23 nt, Human
uuugaaaacuacauuuuaacaug

SEQ ID NO: 2086701 - RNA, 16 nt, Human
uuucuuuggugccuuu

SEQ ID NO: 2086702 - RNA, 17 nt, Human
uuucuuuggugccuuuc

SEQ ID NO: 2086703 - RNA, 19 nt, Human
uuucuuuggugccuuuccu

SEQ ID NO: 2086704 - RNA, 21 nt, Human
uuucuuuggugccuuuccugu

SEQ ID NO: 2086705 - RNA, 17 nt, Human
uuucuuuuuauuuuuua

SEQ ID NO: 2086706 - RNA, 12 nt, Human
auggggaugcag

SEQ ID NO: 2086707 - RNA, 12 nt, Human
auggggccacag

SEQ ID NO: 2086708 - RNA, 13 nt, Human
auggggccacagc

SEQ ID NO: 2086709 - RNA, 17 nt, Human
auggggccacagccaga

SEQ ID NO: 2086710 - RNA, 20 nt, Human
uuugaaaaagcagacagaag

SEQ ID NO: 2086711 - RNA, 18 nt, Human
augggccuccugugugug

SEQ ID NO: 2086712 - RNA, 16 nt, Human
auggcagcaggccugu

SEQ ID NO: 2086713 - RNA, 19 nt, Human
auggcagcaggccuguugc

SEQ ID NO: 2086714 - RNA, 18 nt, Human
auggagacugucucaaga

SEQ ID NO: 2086715 - RNA, 20 nt, Human
auggagacuccaugagaagc

SEQ ID NO: 2086716 - RNA, 15 nt, Human
auggcagugucuuuc

SEQ ID NO: 2086717 - RNA, 23 nt, Human
auggcuccccuuuuucuuccuca

SEQ ID NO: 2086718 - RNA, 23 nt, Human
auggcuccagucugcugcccucc

SEQ ID NO: 2086719 - RNA, 13 nt, Human
auggcuccagucu

SEQ ID NO: 2086720 - RNA, 20 nt, Human
auggcuccagucugcugccc

SEQ ID NO: 2086721 - RNA, 22 nt, Human
auggcuccagucugcugcccuc

SEQ ID NO: 2086722 - RNA, 23 nt, Human
auggcuccgaacacccucgaagc

SEQ ID NO: 2086723 - RNA, 14 nt, Human
augggacugggagg

SEQ ID NO: 2086724 - RNA, 15 nt, Human
augggacugggaggg

SEQ ID NO: 2086725 - RNA, 16 nt, Human
augggacugggagggc

SEQ ID NO: 2086726 - RNA, 17 nt, Human
augggacugggagggcc

SEQ ID NO: 2086727 - RNA, 18 nt, Human
auggcuaauguacugcau

SEQ ID NO: 2086728 - RNA, 21 nt, Human
auggcuaagcuuaaaaaaaac

SEQ ID NO: 2086729 - RNA, 15 nt, Human
auggcuaaggcacca

SEQ ID NO: 2086730 - RNA, 17 nt, Human
auggcuaaggcaccagc

SEQ ID NO: 2086731 - RNA, 18 nt, Human
auggcuaaggcaccagcc

SEQ ID NO: 2086732 - RNA, 16 nt, Human
auggcucacugcagcc

SEQ ID NO: 2086733 - RNA, 19 nt, Human
auggcucacugcagccucg

SEQ ID NO: 2086734 - RNA, 20 nt, Human
auggcucacugcagccucga

SEQ ID NO: 2086735 - RNA, 20 nt, Human
auggcguagagggugcugcc

SEQ ID NO: 2086736 - RNA, 21 nt, Human
auggcguagagggugcugccc

SEQ ID NO: 2086737 - RNA, 20 nt, Human
auggcgugucccucucggaa

SEQ ID NO: 2086738 - RNA, 13 nt, Human
auggcccucuggu

SEQ ID NO: 2086739 - RNA, 14 nt, Human
auggagaaacccug

SEQ ID NO: 2086740 - RNA, 14 nt, Human
auggacucuacacu

SEQ ID NO: 2086741 - RNA, 16 nt, Human
auggacucuacacugu

SEQ ID NO: 2086742 - RNA, 18 nt, Human
auggacucuacacuguga

SEQ ID NO: 2086743 - RNA, 16 nt, Human
uuucaaauugagagaa

SEQ ID NO: 2086744 - RNA, 14 nt, Human
uuucaaauuguauc

SEQ ID NO: 2086745 - RNA, 17 nt, Human
uuucaaagggagagaga

SEQ ID NO: 2086746 - RNA, 15 nt, Human
uuucaaaguacauaa

SEQ ID NO: 2086747 - RNA, 14 nt, Human
uuucaaagaaggaa

SEQ ID NO: 2086748 - RNA, 14 nt, Human
uuucaaauuucaca

SEQ ID NO: 2086749 - RNA, 14 nt, Human
uuuccaucauaauu

SEQ ID NO: 2086750 - RNA, 16 nt, Human
uuuccaucauaauucu

SEQ ID NO: 2086751 - RNA, 23 nt, Human
uuuccaucauuaaauuuuuccuu

SEQ ID NO: 2086752 - RNA, 18 nt, Human
uuuccccggucccuugag

SEQ ID NO: 2086753 - RNA, 20 nt, Human
uuuccccugcccccagaccu

SEQ ID NO: 2086754 - RNA, 23 nt, Human
uuuccccccacucuccccacacu

SEQ ID NO: 2086755 - RNA, 16 nt, Human
uuuccaugaaaacguu

SEQ ID NO: 2086756 - RNA, 17 nt, Human
uuuccaugaaaaugcaa

SEQ ID NO: 2086757 - RNA, 23 nt, Human
uuuccaugcacccucauacacag

SEQ ID NO: 2086758 - RNA, 19 nt, Human
uuuccaugacugcauuuua

SEQ ID NO: 2086759 - RNA, 20 nt, Human
uuuccaugacugcauuuuac

SEQ ID NO: 2086760 - RNA, 14 nt, Human
uuuauauuuaaaug

SEQ ID NO: 2086761 - RNA, 16 nt, Human
uuuauauuagaagugu

SEQ ID NO: 2086762 - RNA, 19 nt, Human
augcuaacaguucacuugc

SEQ ID NO: 2086763 - RNA, 22 nt, Human
augcuaacaguucacuugcagu

SEQ ID NO: 2086764 - RNA, 23 nt, Human
augcuaacaguucacuugcagug

SEQ ID NO: 2086765 - RNA, 21 nt, Human
augcuaaauguaagaaucauu

SEQ ID NO: 2086766 - RNA, 20 nt, Human
augcuaagggcaggcccaaa

SEQ ID NO: 2086767 - RNA, 13 nt, Human
uuuauauuuucaa

SEQ ID NO: 2086768 - RNA, 14 nt, Human
uuuauauuuucaau

SEQ ID NO: 2086769 - RNA, 19 nt, Human
uuuauauuuucaauucaaa

SEQ ID NO: 2086770 - RNA, 22 nt, Human
uuuauauuuucaauucaaaaau

SEQ ID NO: 2086771 - RNA, 23 nt, Human
uuuauauuuucaauucaaaaaug

SEQ ID NO: 2086772 - RNA, 12 nt, Human
uuuauauuuuua

SEQ ID NO: 2086773 - RNA, 15 nt, Human
uuuaucacacuucug

SEQ ID NO: 2086774 - RNA, 17 nt, Human
uuuaucacacuucugug

SEQ ID NO: 2086775 - RNA, 18 nt, Human
uuuaucacacuucuguga

SEQ ID NO: 2086776 - RNA, 22 nt, Human
uuuauuaagauggauucucaga

SEQ ID NO: 2086777 - RNA, 12 nt, Human
augcuccagcca

SEQ ID NO: 2086778 - RNA, 17 nt, Human
augcuccagccaacccc

SEQ ID NO: 2086779 - RNA, 18 nt, Human
augcuccagccaaccccu

SEQ ID NO: 2086780 - RNA, 19 nt, Human
augcuccagccaaccccug

SEQ ID NO: 2086781 - RNA, 20 nt, Human
augcuccagccaaccccugu

SEQ ID NO: 2086782 - RNA, 21 nt, Human
augcuccagccaaccccugug

SEQ ID NO: 2086783 - RNA, 15 nt, Human
uuucaaaaauuugga

SEQ ID NO: 2086784 - RNA, 22 nt, Human
uuucaaaaauuuggaauucugu

SEQ ID NO: 2086785 - RNA, 20 nt, Human
uuucaaaacucauuuccuau

SEQ ID NO: 2086786 - RNA, 15 nt, Human
uuuauuuuguuaaaa

SEQ ID NO: 2086787 - RNA, 20 nt, Human
uuuauuuuguuaaaaucucu

SEQ ID NO: 2086788 - RNA, 20 nt, Human
uuucaaaauaaaaaccaaga

SEQ ID NO: 2086789 - RNA, 18 nt, Human
augcugugcuaugaauuu

SEQ ID NO: 2086790 - RNA, 17 nt, Human
augcugugcuaugaauu

SEQ ID NO: 2086791 - RNA, 12 nt, Human
augcugcuuuaa

SEQ ID NO: 2086792 - RNA, 19 nt, Human
augcugcuuuaauugugaa

SEQ ID NO: 2086793 - RNA, 20 nt, Human
augcugcuuuaauugugaau

SEQ ID NO: 2086794 - RNA, 21 nt, Human
augcugcuuuaauugugaauu

SEQ ID NO: 2086795 - RNA, 16 nt, Human
augcucccuccccugc

SEQ ID NO: 2086796 - RNA, 14 nt, Human
augcucccuccccu

SEQ ID NO: 2086797 - RNA, 23 nt, Human
augcucccccauccuccccuucc

SEQ ID NO: 2086798 - RNA, 21 nt, Human
augcucccccauccuccccuu

SEQ ID NO: 2086799 - RNA, 22 nt, Human
augcucccccauccuccccuuc

SEQ ID NO: 2086800 - RNA, 15 nt, Human
augcucccccauccu

SEQ ID NO: 2086801 - RNA, 18 nt, Human
augcucccccauccuccc

SEQ ID NO: 2086802 - RNA, 20 nt, Human
augcucccccauccuccccu

SEQ ID NO: 2086803 - RNA, 13 nt, Human
augcuucucacug

SEQ ID NO: 2086804 - RNA, 18 nt, Human
auggaaccgcaggaagcu

SEQ ID NO: 2086805 - RNA, 19 nt, Human
auggaaccgcaggaagcug

SEQ ID NO: 2086806 - RNA, 20 nt, Human
auggaaccgcaggaagcugc

SEQ ID NO: 2086807 - RNA, 15 nt, Human
augcuuccugacaau

SEQ ID NO: 2086808 - RNA, 16 nt, Human
augcuuccugacaauc

SEQ ID NO: 2086809 - RNA, 20 nt, Human
augcuuccugacaaucaacu

SEQ ID NO: 2086810 - RNA, 22 nt, Human
augcuuccugacaaucaacucu

SEQ ID NO: 2086811 - RNA, 17 nt, Human
augcuauggucagguua

SEQ ID NO: 2086812 - RNA, 22 nt, Human
augcuucaugaaaauccuacca

SEQ ID NO: 2086813 - RNA, 12 nt, Human
augcuucaugug

SEQ ID NO: 2086814 - RNA, 11 nt, Human
uuuaaaacaaa

SEQ ID NO: 2086815 - RNA, 15 nt, Human
uuuaaaacaagaaag

SEQ ID NO: 2086816 - RNA, 12 nt, Human
uuuaaaaaucau

SEQ ID NO: 2086817 - RNA, 13 nt, Human
uuuaaaaaucaua

SEQ ID NO: 2086818 - RNA, 15 nt, Human
uuuaaaaaucauaaa

SEQ ID NO: 2086819 - RNA, 16 nt, Human
uuuaaaaaucauaaac

SEQ ID NO: 2086820 - RNA, 19 nt, Human
uuuaaaaaucauaaacugu

SEQ ID NO: 2086821 - RNA, 24 nt, Human
augcaccugaauguuagauaguua

SEQ ID NO: 2086822 - RNA, 18 nt, Human
uuguuuucuucuguaugu

SEQ ID NO: 2086823 - RNA, 20 nt, Human
uuguuuucuucuguauguua

SEQ ID NO: 2086824 - RNA, 23 nt, Human
uuguuuugauguuuguggccuca

SEQ ID NO: 2086825 - RNA, 16 nt, Human
uuuaaaguagauuaga

SEQ ID NO: 2086826 - RNA, 16 nt, Human
uuuaaaggggcagaaa

SEQ ID NO: 2086827 - RNA, 22 nt, Human
uuuaaaggggcagaaaaacucu

SEQ ID NO: 2086828 - RNA, 15 nt, Human
uuuaaagucuugcug

SEQ ID NO: 2086829 - RNA, 17 nt, Human
uuuaaaguguauuauaa

SEQ ID NO: 2086830 - RNA, 12 nt, Human
uuuaaaguucug

SEQ ID NO: 2086831 - RNA, 13 nt, Human
uuuaaaguucugu

SEQ ID NO: 2086832 - RNA, 15 nt, Human
uuuaaaguucugugu

SEQ ID NO: 2086833 - RNA, 21 nt, Human
uuuaaaguucuguguauuuaa

SEQ ID NO: 2086834 - RNA, 19 nt, Human
uuuaaauaaaagugaucaa

SEQ ID NO: 2086835 - RNA, 17 nt, Human
uuuaaagagaauguaga

SEQ ID NO: 2086836 - RNA, 13 nt, Human
uuuaaagaaugcu

SEQ ID NO: 2086837 - RNA, 17 nt, Human
uuuaaagaaucauuauu

SEQ ID NO: 2086838 - RNA, 18 nt, Human
uuuaaagaaucauuauuu

SEQ ID NO: 2086839 - RNA, 23 nt, Human
uuuaaagaaucauuauuuauuaa

SEQ ID NO: 2086840 - RNA, 22 nt, Human
augcaccagcccuuagcaggga

SEQ ID NO: 2086841 - RNA, 18 nt, Human
augcaaggaaggaaagaa

SEQ ID NO: 2086842 - RNA, 20 nt, Human
augcaaggaaggaaagaaag

SEQ ID NO: 2086843 - RNA, 14 nt, Human
augcaaggaccagg

SEQ ID NO: 2086844 - RNA, 15 nt, Human
augcaaggaccagga

SEQ ID NO: 2086845 - RNA, 20 nt, Human
augcacccucauacacagaa

SEQ ID NO: 2086846 - RNA, 22 nt, Human
augcaaggaccaggacucccuc

SEQ ID NO: 2086847 - RNA, 13 nt, Human
augcaaggaagga

SEQ ID NO: 2086848 - RNA, 14 nt, Human
augcaaggaaggaa

SEQ ID NO: 2086849 - RNA, 15 nt, Human
augcaaggaaggaaa

SEQ ID NO: 2086850 - RNA, 16 nt, Human
augcaaggaaggaaag

SEQ ID NO: 2086851 - RNA, 20 nt, Human
augauucuuuguuacaggca

SEQ ID NO: 2086852 - RNA, 23 nt, Human
augauucuaauuuuuaagcaaaa

SEQ ID NO: 2086853 - RNA, 23 nt, Human
augauucgcccaaagccagacag

SEQ ID NO: 2086854 - RNA, 13 nt, Human
augauauguaaac

SEQ ID NO: 2086855 - RNA, 21 nt, Human
augauauguaaacauaauucu

SEQ ID NO: 2086856 - RNA, 18 nt, Human
augauauuaaaaauuggc

SEQ ID NO: 2086857 - RNA, 14 nt, Human
augauauuccauag

SEQ ID NO: 2086858 - RNA, 16 nt, Human
augauauuccauagua

SEQ ID NO: 2086859 - RNA, 22 nt, Human
augauauguaaacauaauucuu

SEQ ID NO: 2086860 - RNA, 22 nt, Human
augauacccugaauuuggccug

SEQ ID NO: 2086861 - RNA, 21 nt, Human
augauccaugaguuugcccug

SEQ ID NO: 2086862 - RNA, 22 nt, Human
augauccaugaguuugcccugg

SEQ ID NO: 2086863 - RNA, 16 nt, Human
augauuaauucaccuu

SEQ ID NO: 2086864 - RNA, 15 nt, Human
augaucucccugccg

SEQ ID NO: 2086865 - RNA, 14 nt, Human
augaucucucugaa

SEQ ID NO: 2086866 - RNA, 19 nt, Human
augauuacucuuugagaua

SEQ ID NO: 2086867 - RNA, 12 nt, Human
augaucucccug

SEQ ID NO: 2086868 - RNA, 14 nt, Human
augaucucccugcc

SEQ ID NO: 2086869 - RNA, 14 nt, Human
uuggugccuuuccu

SEQ ID NO: 2086870 - RNA, 16 nt, Human
uuggugccuuuccugu

SEQ ID NO: 2086871 - RNA, 17 nt, Human
uuggugccuuuccuguu

SEQ ID NO: 2086872 - RNA, 18 nt, Human
uuggugccuuuccuguuc

SEQ ID NO: 2086873 - RNA, 21 nt, Human
uuggugccuuuccuguucagc

SEQ ID NO: 2086874 - RNA, 20 nt, Human
uuggugcgggcacaauaaau

SEQ ID NO: 2086875 - RNA, 13 nt, Human
uuguguucaccuu

SEQ ID NO: 2086876 - RNA, 16 nt, Human
uugguggagauaaaga

SEQ ID NO: 2086877 - RNA, 16 nt, Human
uuguuccaagacauug

SEQ ID NO: 2086878 - RNA, 17 nt, Human
uuguuccaagacauugu

SEQ ID NO: 2086879 - RNA, 21 nt, Human
uuguuccacaaguuaaauaaa

SEQ ID NO: 2086880 - RNA, 12 nt, Human
uuguuccagcuc

SEQ ID NO: 2086881 - RNA, 21 nt, Human
uuguuccaagacauugucaau

SEQ ID NO: 2086882 - RNA, 22 nt, Human
uuguuccaagacauugucaaua

SEQ ID NO: 2086883 - RNA, 11 nt, Human
uuguucccagu

SEQ ID NO: 2086884 - RNA, 14 nt, Human
uuguucuuuaaagu

SEQ ID NO: 2086885 - RNA, 12 nt, Human
uuguucuuuucc

SEQ ID NO: 2086886 - RNA, 15 nt, Human
augcccuuaaaucau

SEQ ID NO: 2086887 - RNA, 22 nt, Human
augcccuuucuugaauugcauu

SEQ ID NO: 2086888 - RNA, 14 nt, Human
augcccuggaucca

SEQ ID NO: 2086889 - RNA, 23 nt, Human
augcccugcucugaacacgaagc

SEQ ID NO: 2086890 - RNA, 22 nt, Human
augcccugcuagaugagaauuc

SEQ ID NO: 2086891 - RNA, 19 nt, Human
augccacccuguuuucagc

SEQ ID NO: 2086892 - RNA, 21 nt, Human
augcguacguuuccugagaag

SEQ ID NO: 2086893 - RNA, 23 nt, Human
augcuaaagguuguauugcauau

SEQ ID NO: 2086894 - RNA, 19 nt, Human
augcgggcugggcagcugu

SEQ ID NO: 2086895 - RNA, 23 nt, Human
augccauuugcacuuacacaaga

SEQ ID NO: 2086896 - RNA, 20 nt, Human
augccuccaccccccagaac

SEQ ID NO: 2086897 - RNA, 12 nt, Human
augccuccaccg

SEQ ID NO: 2086898 - RNA, 13 nt, Human
augccuccaccgc

SEQ ID NO: 2086899 - RNA, 17 nt, Human
augccuccaccgcugcc

SEQ ID NO: 2086900 - RNA, 21 nt, Human
augccuccaccgcugccuaag

SEQ ID NO: 2086901 - RNA, 14 nt, Human
augccucccugacc

SEQ ID NO: 2086902 - RNA, 18 nt, Human
augccucccugacccugc

SEQ ID NO: 2086903 - RNA, 22 nt, Human
augccucccugacccugcagag

SEQ ID NO: 2086904 - RNA, 17 nt, Human
augcgggcugggcagcu

SEQ ID NO: 2086905 - RNA, 18 nt, Human
augcgggcugggcagcug

SEQ ID NO: 2086906 - RNA, 17 nt, Human
augcccaagcccugaga

SEQ ID NO: 2086907 - RNA, 18 nt, Human
augccauggacagaagaa

SEQ ID NO: 2086908 - RNA, 19 nt, Human
augccauggacagaagaag

SEQ ID NO: 2086909 - RNA, 12 nt, Human
augccauuuguu

SEQ ID NO: 2086910 - RNA, 14 nt, Human
augccauuuguuua

SEQ ID NO: 2086911 - RNA, 15 nt, Human
augccauuuguuuau

SEQ ID NO: 2086912 - RNA, 16 nt, Human
augccauuuguuuauu

SEQ ID NO: 2086913 - RNA, 15 nt, Human
augccacacagagug

SEQ ID NO: 2086914 - RNA, 16 nt, Human
augccacacagagugg

SEQ ID NO: 2086915 - RNA, 18 nt, Human
augccacacagagugguc

SEQ ID NO: 2086916 - RNA, 17 nt, Human
augccauggacagaaga

SEQ ID NO: 2086917 - RNA, 23 nt, Human
augcagugguaugaucacggcuc

SEQ ID NO: 2086918 - RNA, 13 nt, Human
augcagugcuucc

SEQ ID NO: 2086919 - RNA, 22 nt, Human
augcauuuuaaaguuaaacauu

SEQ ID NO: 2086920 - RNA, 12 nt, Human
augcauuuugca

SEQ ID NO: 2086921 - RNA, 13 nt, Human
augcauuuugcag

SEQ ID NO: 2086922 - RNA, 18 nt, Human
augcauuuugcagcagug

SEQ ID NO: 2086923 - RNA, 19 nt, Human
augcauuuugcagcaguga

SEQ ID NO: 2086924 - RNA, 18 nt, Human
augccaaagcuagggugg

SEQ ID NO: 2086925 - RNA, 13 nt, Human
uuuaauuauuguu

SEQ ID NO: 2086926 - RNA, 18 nt, Human
uuuaauuguuaagauaug

SEQ ID NO: 2086927 - RNA, 19 nt, Human
uuuaauuagguuaacuaug

SEQ ID NO: 2086928 - RNA, 21 nt, Human
uuuaauuagggguugcuaaga

SEQ ID NO: 2086929 - RNA, 13 nt, Human
uuuaauuaaauaa

SEQ ID NO: 2086930 - RNA, 16 nt, Human
uuuaaguauucaagaa

SEQ ID NO: 2086931 - RNA, 13 nt, Human
uuuaaguauuuau

SEQ ID NO: 2086932 - RNA, 14 nt, Human
uuuaaguauuuaua

SEQ ID NO: 2086933 - RNA, 15 nt, Human
uuuaaguauuuauau

SEQ ID NO: 2086934 - RNA, 20 nt, Human
uuuaaguauuuauauauuua

SEQ ID NO: 2086935 - RNA, 16 nt, Human
uuuaagguuuuuacug

SEQ ID NO: 2086936 - RNA, 12 nt, Human
uuuaaguauuua

SEQ ID NO: 2086937 - RNA, 19 nt, Human
uuuaauuuauuuauuaaga

SEQ ID NO: 2086938 - RNA, 20 nt, Human
uuuaauuuauuuauuaagau

SEQ ID NO: 2086939 - RNA, 19 nt, Human
uuuaauuuuuuugagacag

SEQ ID NO: 2086940 - RNA, 16 nt, Human
uuuaauuuauuuauua

SEQ ID NO: 2086941 - RNA, 16 nt, Human
uuuaauuuaugaguuu

SEQ ID NO: 2086942 - RNA, 13 nt, Human
uuuacaaaagaug

SEQ ID NO: 2086943 - RNA, 12 nt, Human
uuuacaagaaaa

SEQ ID NO: 2086944 - RNA, 12 nt, Human
augcagaugcca

SEQ ID NO: 2086945 - RNA, 14 nt, Human
augcagaugccaga

SEQ ID NO: 2086946 - RNA, 15 nt, Human
augcagaugccagag

SEQ ID NO: 2086947 - RNA, 16 nt, Human
augcagaugccagagc

SEQ ID NO: 2086948 - RNA, 11 nt, Human
uuuacaaaaga

SEQ ID NO: 2086949 - RNA, 13 nt, Human
uuuacaaaaagac

SEQ ID NO: 2086950 - RNA, 15 nt, Human
augcagcccaugccc

SEQ ID NO: 2086951 - RNA, 21 nt, Human
augcagcccaugcccaccugc

SEQ ID NO: 2086952 - RNA, 23 nt, Human
augcagcccaugcccaccugccc

SEQ ID NO: 2086953 - RNA, 17 nt, Human
augcagcaucuaaguaa

SEQ ID NO: 2086954 - RNA, 11 nt, Human
augcagcagcu

SEQ ID NO: 2086955 - RNA, 13 nt, Human
augcagcagcuug

SEQ ID NO: 2086956 - RNA, 19 nt, Human
augcagcagcuugcugcac

SEQ ID NO: 2086957 - RNA, 22 nt, Human
augcagcccaugcccaccugcc

SEQ ID NO: 2086958 - RNA, 20 nt, Human
augcagcgaaccaauauuug

SEQ ID NO: 2086959 - RNA, 22 nt, Human
augcagcgaaccaauauuugua

SEQ ID NO: 2086960 - RNA, 19 nt, Human
auuaucuaaaaucugcuag

SEQ ID NO: 2086961 - RNA, 13 nt, Human
auuaucaagcuaa

SEQ ID NO: 2086962 - RNA, 14 nt, Human
auuaucaagcuaau

SEQ ID NO: 2086963 - RNA, 14 nt, Human
auuauguuauugaa

SEQ ID NO: 2086964 - RNA, 16 nt, Human
auuauguuauugaaaa

SEQ ID NO: 2086965 - RNA, 18 nt, Human
auuauguuauugaaaaaa

SEQ ID NO: 2086966 - RNA, 19 nt, Human
auuauguuauugaaaaaaa

SEQ ID NO: 2086967 - RNA, 22 nt, Human
auuauguuauugaaaaaaauug

SEQ ID NO: 2086968 - RNA, 22 nt, Human
auuauuagccagguaaugugaa

SEQ ID NO: 2086969 - RNA, 21 nt, Human
auuauuaguaagaaaacauca

SEQ ID NO: 2086970 - RNA, 11 nt, Human
auuauuucaga

SEQ ID NO: 2086971 - RNA, 19 nt, Human
auuccagagcguguaguga

SEQ ID NO: 2086972 - RNA, 19 nt, Human
auuccagagaguggcuccu

SEQ ID NO: 2086973 - RNA, 21 nt, Human
auuccagagaguggcuccucc

SEQ ID NO: 2086974 - RNA, 23 nt, Human
auucccauuuugcaaaauuucca

SEQ ID NO: 2086975 - RNA, 18 nt, Human
auucccauuuugcaaaau

SEQ ID NO: 2086976 - RNA, 20 nt, Human
auucccauuuugcaaaauuu

SEQ ID NO: 2086977 - RNA, 14 nt, Human
auucccauugaaaa

SEQ ID NO: 2086978 - RNA, 18 nt, Human
auucccauugaaaaugua

SEQ ID NO: 2086979 - RNA, 22 nt, Human
auucccauugaaaauguaagua

SEQ ID NO: 2086980 - RNA, 15 nt, Human
auucccauuuugcaa

SEQ ID NO: 2086981 - RNA, 14 nt, Human
auucccagcugucu

SEQ ID NO: 2086982 - RNA, 16 nt, Human
auucccagcugucugu

SEQ ID NO: 2086983 - RNA, 17 nt, Human
auucccagcugucugug

SEQ ID NO: 2086984 - RNA, 18 nt, Human
auucccagauuugaagac

SEQ ID NO: 2086985 - RNA, 12 nt, Human
auucccagccca

SEQ ID NO: 2086986 - RNA, 16 nt, Human
auucccagagacagga

SEQ ID NO: 2086987 - RNA, 19 nt, Human
auucccagagacaggaaaa

SEQ ID NO: 2086988 - RNA, 23 nt, Human
auucccagagacaggaaaauccu

SEQ ID NO: 2086989 - RNA, 21 nt, Human
auuccccuaucucuagaauuu

SEQ ID NO: 2086990 - RNA, 12 nt, Human
auucuaaccaga

SEQ ID NO: 2086991 - RNA, 17 nt, Human
auucuaaccagagcaag

SEQ ID NO: 2086992 - RNA, 19 nt, Human
auucuaaccagagcaagcu

SEQ ID NO: 2086993 - RNA, 20 nt, Human
auucuaaccagagcaagcuu

SEQ ID NO: 2086994 - RNA, 21 nt, Human
auucccuaucuuuuaguuuua

SEQ ID NO: 2086995 - RNA, 19 nt, Human
auucuaacuuuuuugcuau

SEQ ID NO: 2086996 - RNA, 19 nt, Human
auucagaacaccaagacuu

SEQ ID NO: 2086997 - RNA, 15 nt, Human
auucaccauguaaaa

SEQ ID NO: 2086998 - RNA, 18 nt, Human
auucaccauguaaaacaa

SEQ ID NO: 2086999 - RNA, 11 nt, Human
auucagcugcc

SEQ ID NO: 2087000 - RNA, 12 nt, Human
auucagcugccc

SEQ ID NO: 2087001 - RNA, 13 nt, Human
auucagcugcccc

SEQ ID NO: 2087002 - RNA, 22 nt, Human
auucaggaaaacugacagagga

SEQ ID NO: 2087003 - RNA, 18 nt, Human
auucaggaaccuggacca

SEQ ID NO: 2087004 - RNA, 19 nt, Human
auucaggaaccuggaccaa

SEQ ID NO: 2087005 - RNA, 16 nt, Human
auucuaguuuugucaa

SEQ ID NO: 2087006 - RNA, 21 nt, Human
auuauacauggguagcuucug

SEQ ID NO: 2087007 - RNA, 15 nt, Human
auuauacuaagaaaa

SEQ ID NO: 2087008 - RNA, 17 nt, Human
auuauacuaagaaaaga

SEQ ID NO: 2087009 - RNA, 19 nt, Human
auuauacuaagaaaagaua

SEQ ID NO: 2087010 - RNA, 18 nt, Human
auuauauuguuaaucaau

SEQ ID NO: 2087011 - RNA, 14 nt, Human
auuauauugagaca

SEQ ID NO: 2087012 - RNA, 17 nt, Human
auuauauugagacaaaa

SEQ ID NO: 2087013 - RNA, 21 nt, Human
auuauauugagacaaaaauua

SEQ ID NO: 2087014 - RNA, 14 nt, Human
auuauauugcaaug

SEQ ID NO: 2087015 - RNA, 15 nt, Human
auuauauugcaauga

SEQ ID NO: 2087016 - RNA, 11 nt, Human
uuuguggaaaa

SEQ ID NO: 2087017 - RNA, 20 nt, Human
uuuguggcagaaguguuuca

SEQ ID NO: 2087018 - RNA, 22 nt, Human
uuuguggcagaaguguuucaug

SEQ ID NO: 2087019 - RNA, 12 nt, Human
uuuguggccuca

SEQ ID NO: 2087020 - RNA, 14 nt, Human
uuuguggccucaga

SEQ ID NO: 2087021 - RNA, 15 nt, Human
uuuguggccucagaa

SEQ ID NO: 2087022 - RNA, 20 nt, Human
auuaguuguguacucuggcc

SEQ ID NO: 2087023 - RNA, 17 nt, Human
auuaguucuauuucuau

SEQ ID NO: 2087024 - RNA, 17 nt, Human
auuauaauuuaaugcau

SEQ ID NO: 2087025 - RNA, 23 nt, Human
auuauaauuuuuuucaauauuua

SEQ ID NO: 2087026 - RNA, 22 nt, Human
auuauaauuuuuuucaauauuu

SEQ ID NO: 2087027 - RNA, 13 nt, Human
auucuaaucuaac

SEQ ID NO: 2087028 - RNA, 15 nt, Human
auucuagcuuugagc

SEQ ID NO: 2087029 - RNA, 13 nt, Human
auucuaggcaucc

SEQ ID NO: 2087030 - RNA, 16 nt, Human
auucuaggcaucccag

SEQ ID NO: 2087031 - RNA, 20 nt, Human
auucuaggcaucccagggga

SEQ ID NO: 2087032 - RNA, 17 nt, Human
auucucauuugucacac

SEQ ID NO: 2087033 - RNA, 19 nt, Human
auucugccugcccaggccc

SEQ ID NO: 2087034 - RNA, 18 nt, Human
auucugccugcccaggcc

SEQ ID NO: 2087035 - RNA, 17 nt, Human
auucugccugcccaggc

SEQ ID NO: 2087036 - RNA, 16 nt, Human
auucugccugcccagg

SEQ ID NO: 2087037 - RNA, 15 nt, Human
auucugccugcccag

SEQ ID NO: 2087038 - RNA, 14 nt, Human
auucugccugccca

SEQ ID NO: 2087039 - RNA, 13 nt, Human
auucugccugccc

SEQ ID NO: 2087040 - RNA, 11 nt, Human
auucugccugc

SEQ ID NO: 2087041 - RNA, 14 nt, Human
auucuguuggccag

SEQ ID NO: 2087042 - RNA, 21 nt, Human
auucuguuggccagugugaca

SEQ ID NO: 2087043 - RNA, 19 nt, Human
auucuguuggccaguguga

SEQ ID NO: 2087044 - RNA, 14 nt, Human
auucuguaaaaugu

SEQ ID NO: 2087045 - RNA, 20 nt, Human
auucuguaaaaugucuguua

SEQ ID NO: 2087046 - RNA, 19 nt, Human
auucugcuaccucacuggg

SEQ ID NO: 2087047 - RNA, 15 nt, Human
auucugcuaccucac

SEQ ID NO: 2087048 - RNA, 22 nt, Human
auucugcucacauaucugucau

SEQ ID NO: 2087049 - RNA, 21 nt, Human
auucugcucacauaucuguca

SEQ ID NO: 2087050 - RNA, 20 nt, Human
auucugcucacauaucuguc

SEQ ID NO: 2087051 - RNA, 19 nt, Human
auucugcucacauaucugu

SEQ ID NO: 2087052 - RNA, 21 nt, Human
auucugccugcccaggccccu

SEQ ID NO: 2087053 - RNA, 20 nt, Human
auucugccugcccaggcccc

SEQ ID NO: 2087054 - RNA, 18 nt, Human
auucugcucacauaucug

SEQ ID NO: 2087055 - RNA, 20 nt, Human
auucugccuuugcagaaaca

SEQ ID NO: 2087056 - RNA, 21 nt, Human
auucugccuuugcagaaacag

SEQ ID NO: 2087057 - RNA, 22 nt, Human
auucugccuuugcagaaacaga

SEQ ID NO: 2087058 - RNA, 22 nt, Human
auucugccgugugcccucgggc

SEQ ID NO: 2087059 - RNA, 19 nt, Human
auugaacuuaaauaaaugu

SEQ ID NO: 2087060 - RNA, 18 nt, Human
auugaagagagagcugag

SEQ ID NO: 2087061 - RNA, 15 nt, Human
auugacaagucauuu

SEQ ID NO: 2087062 - RNA, 17 nt, Human
auugacaauaauuucag

SEQ ID NO: 2087063 - RNA, 18 nt, Human
auugacaauaauuucagg

SEQ ID NO: 2087064 - RNA, 20 nt, Human
auugacaauaauuucagguu

SEQ ID NO: 2087065 - RNA, 18 nt, Human
auugacuaucaaacugaa

SEQ ID NO: 2087066 - RNA, 21 nt, Human
auugacuaucaaacugaagcc

SEQ ID NO: 2087067 - RNA, 14 nt, Human
auugaaaaaaauug

SEQ ID NO: 2087068 - RNA, 16 nt, Human
auugaaaaaaauuggc

SEQ ID NO: 2087069 - RNA, 19 nt, Human
auugaaaaaaauuggcauu

SEQ ID NO: 2087070 - RNA, 22 nt, Human
auugaaaaaaauuggcauuaaa

SEQ ID NO: 2087071 - RNA, 17 nt, Human
auucuuuuuuaaauuuu

SEQ ID NO: 2087072 - RNA, 19 nt, Human
auucuuuuuuaaauuuucu

SEQ ID NO: 2087073 - RNA, 16 nt, Human
auugaaaugacuaaaa

SEQ ID NO: 2087074 - RNA, 17 nt, Human
auucuuacaaacaugug

SEQ ID NO: 2087075 - RNA, 16 nt, Human
auucuuacaaacaugu

SEQ ID NO: 2087076 - RNA, 21 nt, Human
auucuuacaaacaugugguua

SEQ ID NO: 2087077 - RNA, 12 nt, Human
auugaaggaaag

SEQ ID NO: 2087078 - RNA, 13 nt, Human
auugaaggaaaga

SEQ ID NO: 2087079 - RNA, 15 nt, Human
auugaaggaaagauu

SEQ ID NO: 2087080 - RNA, 14 nt, Human
auuuuugucuugug

SEQ ID NO: 2087081 - RNA, 22 nt, Human
auuuuuguuggagccacucugu

SEQ ID NO: 2087082 - RNA, 17 nt, Human
auuuuuguuucuuccaa

SEQ ID NO: 2087083 - RNA, 20 nt, Human
auuuuugugaaaugaaaaca

SEQ ID NO: 2087084 - RNA, 19 nt, Human
auuuuuguagagccagggu

SEQ ID NO: 2087085 - RNA, 20 nt, Human
auuuuuuaaaguuacuuugu

SEQ ID NO: 2087086 - RNA, 11 nt, Human
auuuuuuaagu

SEQ ID NO: 2087087 - RNA, 15 nt, Human
auuuuuuaaaaagca

SEQ ID NO: 2087088 - RNA, 16 nt, Human
auuuuuuaaaaagcaa

SEQ ID NO: 2087089 - RNA, 18 nt, Human
auuuuuuaaaaagcaaaa

SEQ ID NO: 2087090 - RNA, 15 nt, Human
auuuuuuaaaacaag

SEQ ID NO: 2087091 - RNA, 17 nt, Human
auuuuuuaaaacaagaa

SEQ ID NO: 2087092 - RNA, 22 nt, Human
auuuuuguuucuuccaaagcac

SEQ ID NO: 2087093 - RNA, 13 nt, Human
auuuuuguuuguu

SEQ ID NO: 2087094 - RNA, 14 nt, Human
auuuuuguuuguuu

SEQ ID NO: 2087095 - RNA, 17 nt, Human
auuuuuguuuguuuugu

SEQ ID NO: 2087096 - RNA, 15 nt, Human
auuuuuuaauaaccc

SEQ ID NO: 2087097 - RNA, 15 nt, Human
auuuuuuauucuugu

SEQ ID NO: 2087098 - RNA, 16 nt, Human
auuuuuuauucuugug

SEQ ID NO: 2087099 - RNA, 17 nt, Human
auuuuuuauucuuguga

SEQ ID NO: 2087100 - RNA, 13 nt, Human
auuuuuucagaaa

SEQ ID NO: 2087101 - RNA, 22 nt, Human
auuuuuucagaaauaugugguu

SEQ ID NO: 2087102 - RNA, 12 nt, Human
auuuuuuaauua

SEQ ID NO: 2087103 - RNA, 14 nt, Human
auuuuuuaauuauu

SEQ ID NO: 2087104 - RNA, 20 nt, Human
auuuuuuaaguauuuauaua

SEQ ID NO: 2087105 - RNA, 22 nt, Human
auuuuuuaaguauuuauauauu

SEQ ID NO: 2087106 - RNA, 16 nt, Human
auuuuuuaaguauuua

SEQ ID NO: 2087107 - RNA, 17 nt, Human
auuuuuuaaguauuuau

SEQ ID NO: 2087108 - RNA, 18 nt, Human
auuuuuuaaguauuuaua

SEQ ID NO: 2087109 - RNA, 19 nt, Human
auuuuuuaaguauuuauau

SEQ ID NO: 2087110 - RNA, 19 nt, Human
auuuuuuacagcugccugc

SEQ ID NO: 2087111 - RNA, 13 nt, Human
auuuuuuauacag

SEQ ID NO: 2087112 - RNA, 15 nt, Human
auuuuuuaauuauug

SEQ ID NO: 2087113 - RNA, 16 nt, Human
auuuuuuaauuauugu

SEQ ID NO: 2087114 - RNA, 21 nt, Human
auuuuuuaauuugaugaaagc

SEQ ID NO: 2087115 - RNA, 22 nt, Human
auuuuuuaauuugaugaaagcu

SEQ ID NO: 2087116 - RNA, 15 nt, Human
auuuuuuuaaaauca

SEQ ID NO: 2087117 - RNA, 18 nt, Human
auuuuuuuaaaaucacua

SEQ ID NO: 2087118 - RNA, 22 nt, Human
auuuuuuuaaaaucacuaacau

SEQ ID NO: 2087119 - RNA, 16 nt, Human
auuuuucagauauaaa

SEQ ID NO: 2087120 - RNA, 15 nt, Human
auuuuucacuucaaa

SEQ ID NO: 2087121 - RNA, 14 nt, Human
auuuuucagaugcu

SEQ ID NO: 2087122 - RNA, 15 nt, Human
auuuuucagaugcuu

SEQ ID NO: 2087123 - RNA, 18 nt, Human
auuuuucagaugcuucug

SEQ ID NO: 2087124 - RNA, 19 nt, Human
auuuuucauugauaugaaa

SEQ ID NO: 2087125 - RNA, 22 nt, Human
auuuuucauugauaugaaaaau

SEQ ID NO: 2087126 - RNA, 21 nt, Human
auuuuguuuuugucuuaaaaa

SEQ ID NO: 2087127 - RNA, 14 nt, Human
auuuuguuuuuaaa

SEQ ID NO: 2087128 - RNA, 15 nt, Human
auuuuuggauugaca

SEQ ID NO: 2087129 - RNA, 17 nt, Human
auuuuuggauugacagu

SEQ ID NO: 2087130 - RNA, 18 nt, Human
auuuuuggauugacagua

SEQ ID NO: 2087131 - RNA, 19 nt, Human
auuuuuggauugacaguaa

SEQ ID NO: 2087132 - RNA, 21 nt, Human
auuuuuggauugacaguaacu

SEQ ID NO: 2087133 - RNA, 22 nt, Human
auuuuuggauugacaguaacuu

SEQ ID NO: 2087134 - RNA, 11 nt, Human
auuuuucuucc

SEQ ID NO: 2087135 - RNA, 14 nt, Human
auuuuugaaaaggc

SEQ ID NO: 2087136 - RNA, 12 nt, Human
auuuugucuuua

SEQ ID NO: 2087137 - RNA, 23 nt, Human
auuuugucauauaagauucauau

SEQ ID NO: 2087138 - RNA, 20 nt, Human
auuuuguggcuuucuuucuu

SEQ ID NO: 2087139 - RNA, 19 nt, Human
auuuugugcccccauguaa

SEQ ID NO: 2087140 - RNA, 18 nt, Human
auuuuguauauuuguauu

SEQ ID NO: 2087141 - RNA, 12 nt, Human
auuuuguaauuu

SEQ ID NO: 2087142 - RNA, 15 nt, Human
auuuuguaauuuucu

SEQ ID NO: 2087143 - RNA, 16 nt, Human
auuuuguaauuuucuu

SEQ ID NO: 2087144 - RNA, 18 nt, Human
auuuuguaauuuucuuga

SEQ ID NO: 2087145 - RNA, 20 nt, Human
auuuuguaauuuucuugaug

SEQ ID NO: 2087146 - RNA, 20 nt, Human
auuuuguacaaauuuguuau

SEQ ID NO: 2087147 - RNA, 16 nt, Human
auuuuguaucuugaug

SEQ ID NO: 2087148 - RNA, 13 nt, Human
auuuuguaaaggu

SEQ ID NO: 2087149 - RNA, 17 nt, Human
auuuuguaaaggugaaa

SEQ ID NO: 2087150 - RNA, 20 nt, Human
auuuuggaaguuuucaggac

SEQ ID NO: 2087151 - RNA, 20 nt, Human
auuuugcuguagaagauggc

SEQ ID NO: 2087152 - RNA, 14 nt, Human
auuuuggaaaauaa

SEQ ID NO: 2087153 - RNA, 19 nt, Human
auuuuggaaaauaaauuau

SEQ ID NO: 2087154 - RNA, 20 nt, Human
auuuuggaaaauaaauuauu

SEQ ID NO: 2087155 - RNA, 16 nt, Human
auuuuccugccaggca

SEQ ID NO: 2087156 - RNA, 19 nt, Human
auuuucccuauuagagaag

SEQ ID NO: 2087157 - RNA, 15 nt, Human
auuuuaacuuuauca

SEQ ID NO: 2087158 - RNA, 17 nt, Human
auuuuaacuuuaucaca

SEQ ID NO: 2087159 - RNA, 19 nt, Human
auuuuaacuuuaucacauu

SEQ ID NO: 2087160 - RNA, 22 nt, Human
auuuuccccccacucuccccac

SEQ ID NO: 2087161 - RNA, 20 nt, Human
auuuuccccccacucucccc

SEQ ID NO: 2087162 - RNA, 21 nt, Human
auuuuccccccacucucccca

SEQ ID NO: 2087163 - RNA, 14 nt, Human
auuuuccccccacu

SEQ ID NO: 2087164 - RNA, 15 nt, Human
auuuuccccccacuc

SEQ ID NO: 2087165 - RNA, 15 nt, Human
auuuuccaugaaaau

SEQ ID NO: 2087166 - RNA, 21 nt, Human
auuuuccauuuuuauuucaaa

SEQ ID NO: 2087167 - RNA, 20 nt, Human
auuuucccaauagcacuuuc

SEQ ID NO: 2087168 - RNA, 22 nt, Human
auuuucccaauagcacuuucau

SEQ ID NO: 2087169 - RNA, 19 nt, Human
auuuugauccaagcugguc

SEQ ID NO: 2087170 - RNA, 14 nt, Human
auuuugcaaaauuu

SEQ ID NO: 2087171 - RNA, 15 nt, Human
auuuugcaaaauuuc

SEQ ID NO: 2087172 - RNA, 18 nt, Human
auuuugcaaaauuuccag

SEQ ID NO: 2087173 - RNA, 19 nt, Human
auuuugcaaaauuuccagu

SEQ ID NO: 2087174 - RNA, 18 nt, Human
auuuugccagugggaacu

SEQ ID NO: 2087175 - RNA, 16 nt, Human
auuuugcauuugaaua

SEQ ID NO: 2087176 - RNA, 12 nt, Human
auuuugcagcag

SEQ ID NO: 2087177 - RNA, 14 nt, Human
auuuugcagcagug

SEQ ID NO: 2087178 - RNA, 15 nt, Human
auuuugcagcaguga

SEQ ID NO: 2087179 - RNA, 16 nt, Human
auuuugcagcagugag

SEQ ID NO: 2087180 - RNA, 22 nt, Human
auuuugcccuuccauagccuaa

SEQ ID NO: 2087181 - RNA, 12 nt, Human
auuuugcauaaa

SEQ ID NO: 2087182 - RNA, 22 nt, Human
auuuugccuaauacauuaaagc

SEQ ID NO: 2087183 - RNA, 23 nt, Human
auuuugccuaauacauuaaagca

SEQ ID NO: 2087184 - RNA, 20 nt, Human
auuuugcuaaaugugaauga

SEQ ID NO: 2087185 - RNA, 14 nt, Human
auuguacaguuuuu

SEQ ID NO: 2087186 - RNA, 15 nt, Human
auuguacaguuuuua

SEQ ID NO: 2087187 - RNA, 21 nt, Human
auuguacaguuuuuauugcuu

SEQ ID NO: 2087188 - RNA, 12 nt, Human
auuguaccucuc

SEQ ID NO: 2087189 - RNA, 19 nt, Human
auuguaccucucuuauaga

SEQ ID NO: 2087190 - RNA, 18 nt, Human
auuguaccucucuuauag

SEQ ID NO: 2087191 - RNA, 14 nt, Human
auugucagauauuu

SEQ ID NO: 2087192 - RNA, 23 nt, Human
auugucagauauuuuuucagaaa

SEQ ID NO: 2087193 - RNA, 13 nt, Human
auugucagcuacu

SEQ ID NO: 2087194 - RNA, 17 nt, Human
auuguggcugucagcag

SEQ ID NO: 2087195 - RNA, 18 nt, Human
auuguggcugucagcagg

SEQ ID NO: 2087196 - RNA, 19 nt, Human
auuguggcugucagcagga

SEQ ID NO: 2087197 - RNA, 14 nt, Human
auugucucagagca

SEQ ID NO: 2087198 - RNA, 19 nt, Human
auugucagcuacuaaugau

SEQ ID NO: 2087199 - RNA, 12 nt, Human
auugucucagag

SEQ ID NO: 2087200 - RNA, 16 nt, Human
auuuaaagacaaagac

SEQ ID NO: 2087201 - RNA, 21 nt, Human
auuguuuggggaugagaaagg

SEQ ID NO: 2087202 - RNA, 20 nt, Human
auuguuugucugucuucaua

SEQ ID NO: 2087203 - RNA, 16 nt, Human
auuggauuugucuuug

SEQ ID NO: 2087204 - RNA, 18 nt, Human
auugauuucccuucuucu

SEQ ID NO: 2087205 - RNA, 19 nt, Human
auuggcaaagaugugggga

SEQ ID NO: 2087206 - RNA, 21 nt, Human
auugguuuuaauugaaggaaa

SEQ ID NO: 2087207 - RNA, 22 nt, Human
auugguuuuaauugaaggaaag

SEQ ID NO: 2087208 - RNA, 16 nt, Human
auugguucccuuugcu

SEQ ID NO: 2087209 - RNA, 17 nt, Human
auugguucccuuugcuc

SEQ ID NO: 2087210 - RNA, 18 nt, Human
auugguucccuuugcucc

SEQ ID NO: 2087211 - RNA, 14 nt, Human
auugguccagcuug

SEQ ID NO: 2087212 - RNA, 15 nt, Human
auugguccagcuugc

SEQ ID NO: 2087213 - RNA, 17 nt, Human
auugguccagcuugcuc

SEQ ID NO: 2087214 - RNA, 18 nt, Human
auugguaaagaauggaag

SEQ ID NO: 2087215 - RNA, 13 nt, Human
auuggguucauua

SEQ ID NO: 2087216 - RNA, 18 nt, Human
auuggguggguaaauuca

SEQ ID NO: 2087217 - RNA, 13 nt, Human
auugggaaaucuu

SEQ ID NO: 2087218 - RNA, 22 nt, Human
auuggaggaccaaaaaaauaag

SEQ ID NO: 2087219 - RNA, 23 nt, Human
auuggagggugggagagcccagc

SEQ ID NO: 2087220 - RNA, 22 nt, Human
auuggagggugggagagcccag

SEQ ID NO: 2087221 - RNA, 19 nt, Human
auuggacauuaagcaucac

SEQ ID NO: 2087222 - RNA, 22 nt, Human
auuggacauuaagcaucacaaa

SEQ ID NO: 2087223 - RNA, 14 nt, Human
auuggaauuaaccu

SEQ ID NO: 2087224 - RNA, 12 nt, Human
auuggaauuaac

SEQ ID NO: 2087225 - RNA, 15 nt, Human
auuggaauuaaccug

SEQ ID NO: 2087226 - RNA, 16 nt, Human
auuggaauuaaccugg

SEQ ID NO: 2087227 - RNA, 19 nt, Human
auuggaauuaaccuggugc

SEQ ID NO: 2087228 - RNA, 20 nt, Human
auuggaauuaaccuggugcu

SEQ ID NO: 2087229 - RNA, 13 nt, Human
auugauuucaaga

SEQ ID NO: 2087230 - RNA, 16 nt, Human
auugauuucaagaccu

SEQ ID NO: 2087231 - RNA, 13 nt, Human
auugauugcugug

SEQ ID NO: 2087232 - RNA, 15 nt, Human
auugauugcuguguc

SEQ ID NO: 2087233 - RNA, 23 nt, Human
auugauugcuguguccaacucca

SEQ ID NO: 2087234 - RNA, 16 nt, Human
auugacuucgacugug

SEQ ID NO: 2087235 - RNA, 16 nt, Human
auuuccacucaggucu

SEQ ID NO: 2087236 - RNA, 16 nt, Human
auuuccaagagcugag

SEQ ID NO: 2087237 - RNA, 15 nt, Human
auuuccaagagcuga

SEQ ID NO: 2087238 - RNA, 17 nt, Human
auuuccaaauucacaag

SEQ ID NO: 2087239 - RNA, 14 nt, Human
auuucccaagcugg

SEQ ID NO: 2087240 - RNA, 17 nt, Human
auuucccaauuaggaag

SEQ ID NO: 2087241 - RNA, 18 nt, Human
auuucccaauuaggaagu

SEQ ID NO: 2087242 - RNA, 15 nt, Human
auuucccaggguuaa

SEQ ID NO: 2087243 - RNA, 16 nt, Human
auuuccaaagagaaaa

SEQ ID NO: 2087244 - RNA, 14 nt, Human
auuuauuucaaaaa

SEQ ID NO: 2087245 - RNA, 12 nt, Human
auuuauuuaaau

SEQ ID NO: 2087246 - RNA, 14 nt, Human
auuuauuuaaauuu

SEQ ID NO: 2087247 - RNA, 13 nt, Human
auuucuucucaaa

SEQ ID NO: 2087248 - RNA, 15 nt, Human
auuugucaacaaagu

SEQ ID NO: 2087249 - RNA, 13 nt, Human
auuugucaacaaa

SEQ ID NO: 2087250 - RNA, 14 nt, Human
auuugucaaugaca

SEQ ID NO: 2087251 - RNA, 17 nt, Human
auuugucaaugacaguu

SEQ ID NO: 2087252 - RNA, 16 nt, Human
auuuggccugcacuaa

SEQ ID NO: 2087253 - RNA, 19 nt, Human
auuuggccugcacuaauuu

SEQ ID NO: 2087254 - RNA, 14 nt, Human
auuugucauuuuga

SEQ ID NO: 2087255 - RNA, 15 nt, Human
auuugucauuuugaa

SEQ ID NO: 2087256 - RNA, 16 nt, Human
auuugucauuuugaag

SEQ ID NO: 2087257 - RNA, 21 nt, Human
auuugucauuuugaagcuaau

SEQ ID NO: 2087258 - RNA, 18 nt, Human
auuugucgauauuuccau

SEQ ID NO: 2087259 - RNA, 23 nt, Human
auuugugaaaugauggugaaagu

SEQ ID NO: 2087260 - RNA, 22 nt, Human
auuuuaaaaauacagauagaua

SEQ ID NO: 2087261 - RNA, 14 nt, Human
auuuuaacaauaac

SEQ ID NO: 2087262 - RNA, 15 nt, Human
auuuuaacaauaacu

SEQ ID NO: 2087263 - RNA, 16 nt, Human
auuuuaacaauaacua

SEQ ID NO: 2087264 - RNA, 22 nt, Human
auuuuaacaauaacuacugugu

SEQ ID NO: 2087265 - RNA, 14 nt, Human
auuuuaacacacau

SEQ ID NO: 2087266 - RNA, 15 nt, Human
auuuuaacacacaua

SEQ ID NO: 2087267 - RNA, 17 nt, Human
auuuuaacacacauaaa

SEQ ID NO: 2087268 - RNA, 18 nt, Human
auuuuaacacacauaaag

SEQ ID NO: 2087269 - RNA, 20 nt, Human
auuuuaacacacauaaagga

SEQ ID NO: 2087270 - RNA, 21 nt, Human
auuuuaacacacauaaaggau

SEQ ID NO: 2087271 - RNA, 22 nt, Human
auuuuaacacacauaaaggaua

SEQ ID NO: 2087272 - RNA, 13 nt, Human
auuuuaacaugga

SEQ ID NO: 2087273 - RNA, 21 nt, Human
auuuuaacauggaacucuagg

SEQ ID NO: 2087274 - RNA, 14 nt, Human
caaugacacagucu

SEQ ID NO: 2087275 - RNA, 19 nt, Human
caauccuggcucuguggcu

SEQ ID NO: 2087276 - RNA, 19 nt, Human
caaugacacagucuuggcu

SEQ ID NO: 2087277 - RNA, 21 nt, Human
caaugacacagucuuggcuca

SEQ ID NO: 2087278 - RNA, 16 nt, Human
caaugaacggccuugc

SEQ ID NO: 2087279 - RNA, 20 nt, Human
caaugaaggaaauaaaaaag

SEQ ID NO: 2087280 - RNA, 19 nt, Human
caaugaggucugaaaugga

SEQ ID NO: 2087281 - RNA, 15 nt, Human
caaugacaucuucaa

SEQ ID NO: 2087282 - RNA, 19 nt, Human
caaugacaucuucaaagcu

SEQ ID NO: 2087283 - RNA, 16 nt, Human
caaugcagugccuuuc

SEQ ID NO: 2087284 - RNA, 14 nt, Human
caaugcagaugcca

SEQ ID NO: 2087285 - RNA, 16 nt, Human
caaugcagaugccaga

SEQ ID NO: 2087286 - RNA, 17 nt, Human
caaugcagaugccagag

SEQ ID NO: 2087287 - RNA, 18 nt, Human
caaugcagaugccagagc

SEQ ID NO: 2087288 - RNA, 19 nt, Human
caaugcagaugccagagca

SEQ ID NO: 2087289 - RNA, 19 nt, Human
caaugaugaugauaaugau

SEQ ID NO: 2087290 - RNA, 23 nt, Human
caauaggcaaaggggggaaggga

SEQ ID NO: 2087291 - RNA, 11 nt, Human
caagugugugu

SEQ ID NO: 2087292 - RNA, 18 nt, Human
caaguuaaagugaauaac

SEQ ID NO: 2087293 - RNA, 16 nt, Human
caauaggaaugcuaac

SEQ ID NO: 2087294 - RNA, 18 nt, Human
caauaggaaugcuaacag

SEQ ID NO: 2087295 - RNA, 20 nt, Human
caagugugugcaugugugcg

SEQ ID NO: 2087296 - RNA, 17 nt, Human
caagugugugugcgugu

SEQ ID NO: 2087297 - RNA, 22 nt, Human
caagugugguagggacuuaaaa

SEQ ID NO: 2087298 - RNA, 23 nt, Human
caagugugguagggacuuaaaaa

SEQ ID NO: 2087299 - RNA, 23 nt, Human
caaguguguaugugcgugugugc

SEQ ID NO: 2087300 - RNA, 11 nt, Human
caagugugugc

SEQ ID NO: 2087301 - RNA, 14 nt, Human
caagugugugcaca

SEQ ID NO: 2087302 - RNA, 19 nt, Human
caagugugugcacaugugu

SEQ ID NO: 2087303 - RNA, 20 nt, Human
caagugugugcacaugugug

SEQ ID NO: 2087304 - RNA, 21 nt, Human
caagugugugcacaugugugc

SEQ ID NO: 2087305 - RNA, 22 nt, Human
caagugugugcacaugugugcg

SEQ ID NO: 2087306 - RNA, 16 nt, Human
caagugugugcaugug

SEQ ID NO: 2087307 - RNA, 17 nt, Human
caagugugugcaugugu

SEQ ID NO: 2087308 - RNA, 16 nt, Human
caauauguauuaauau

SEQ ID NO: 2087309 - RNA, 22 nt, Human
caauauguauuaauauucauug

SEQ ID NO: 2087310 - RNA, 12 nt, Human
caauccuggcuc

SEQ ID NO: 2087311 - RNA, 19 nt, Human
caaugaaaugcucuccuuu

SEQ ID NO: 2087312 - RNA, 21 nt, Human
caaugaaaugcucuccuuucc

SEQ ID NO: 2087313 - RNA, 14 nt, Human
caauccucacuggg

SEQ ID NO: 2087314 - RNA, 16 nt, Human
caauccucacugggug

SEQ ID NO: 2087315 - RNA, 17 nt, Human
caauccucacugggugg

SEQ ID NO: 2087316 - RNA, 13 nt, Human
caauccuccugag

SEQ ID NO: 2087317 - RNA, 13 nt, Human
caauccucuaagc

SEQ ID NO: 2087318 - RNA, 18 nt, Human
caauccucacuggguggg

SEQ ID NO: 2087319 - RNA, 18 nt, Human
cacaaaaguuucucuuuu

SEQ ID NO: 2087320 - RNA, 16 nt, Human
cacaaaaguuucucuu

SEQ ID NO: 2087321 - RNA, 12 nt, Human
cacaaaaaugaa

SEQ ID NO: 2087322 - RNA, 22 nt, Human
cacaaaaaaaguugaaggccuu

SEQ ID NO: 2087323 - RNA, 14 nt, Human
cacaaaagccucuc

SEQ ID NO: 2087324 - RNA, 12 nt, Human
cacaaagagagu

SEQ ID NO: 2087325 - RNA, 22 nt, Human
cacaaagagaguuaaucaacug

SEQ ID NO: 2087326 - RNA, 20 nt, Human
cacaacccaucuaccccugg

SEQ ID NO: 2087327 - RNA, 21 nt, Human
cacaacccaucuaccccugga

SEQ ID NO: 2087328 - RNA, 23 nt, Human
cacaaccuucuguggcucacaga

SEQ ID NO: 2087329 - RNA, 19 nt, Human
cacaaccuucuguggcuca

SEQ ID NO: 2087330 - RNA, 18 nt, Human
cacaaccuucuguggcuc

SEQ ID NO: 2087331 - RNA, 17 nt, Human
cacaaccuucuguggcu

SEQ ID NO: 2087332 - RNA, 11 nt, Human
cacaacaaaaa

SEQ ID NO: 2087333 - RNA, 12 nt, Human
cacaacaaaaau

SEQ ID NO: 2087334 - RNA, 17 nt, Human
cacaacaaaaauuugaa

SEQ ID NO: 2087335 - RNA, 22 nt, Human
cacaacaaaaauuugaaccaaa

SEQ ID NO: 2087336 - RNA, 16 nt, Human
cacaacacacacacuc

SEQ ID NO: 2087337 - RNA, 15 nt, Human
cacaaauuaucuuaa

SEQ ID NO: 2087338 - RNA, 12 nt, Human
caauuaaaugua

SEQ ID NO: 2087339 - RNA, 13 nt, Human
caauuaaauguag

SEQ ID NO: 2087340 - RNA, 14 nt, Human
caauuaaauguagg

SEQ ID NO: 2087341 - RNA, 19 nt, Human
caaugucuugguacuugcu

SEQ ID NO: 2087342 - RNA, 23 nt, Human
caaugucuugguacuugcugcua

SEQ ID NO: 2087343 - RNA, 21 nt, Human
caaugucaggaacagaaggau

SEQ ID NO: 2087344 - RNA, 20 nt, Human
caauuuuaacacacauaaag

SEQ ID NO: 2087345 - RNA, 22 nt, Human
caauuuuaacacacauaaagga

SEQ ID NO: 2087346 - RNA, 21 nt, Human
caauucagugcuguacuugau

SEQ ID NO: 2087347 - RNA, 18 nt, Human
caauucauccucacucag

SEQ ID NO: 2087348 - RNA, 14 nt, Human
caauucaacccuuu

SEQ ID NO: 2087349 - RNA, 20 nt, Human
caauucauauuuaugaaucu

SEQ ID NO: 2087350 - RNA, 15 nt, Human
caauuccaaaggaau

SEQ ID NO: 2087351 - RNA, 17 nt, Human
caauucaacccuuugcc

SEQ ID NO: 2087352 - RNA, 22 nt, Human
caauuaaauguagguaugaaua

SEQ ID NO: 2087353 - RNA, 19 nt, Human
caaugugaaaagaaaaaug

SEQ ID NO: 2087354 - RNA, 18 nt, Human
cacacccucucccaggac

SEQ ID NO: 2087355 - RNA, 14 nt, Human
cacacccuguuuua

SEQ ID NO: 2087356 - RNA, 17 nt, Human
cacacccucucccagga

SEQ ID NO: 2087357 - RNA, 17 nt, Human
cacaccgggcacucaga

SEQ ID NO: 2087358 - RNA, 22 nt, Human
cacaccuguaaucccagcacuu

SEQ ID NO: 2087359 - RNA, 12 nt, Human
cacaccuggccc

SEQ ID NO: 2087360 - RNA, 13 nt, Human
cacaccuggcccu

SEQ ID NO: 2087361 - RNA, 14 nt, Human
cacaccuggcccug

SEQ ID NO: 2087362 - RNA, 17 nt, Human
cacaccuggcccugggg

SEQ ID NO: 2087363 - RNA, 19 nt, Human
cacaccuggcccuggggcc

SEQ ID NO: 2087364 - RNA, 16 nt, Human
cacaccuguaguccca

SEQ ID NO: 2087365 - RNA, 19 nt, Human
cacaccuguagucccagcu

SEQ ID NO: 2087366 - RNA, 14 nt, Human
cacacgcacacaca

SEQ ID NO: 2087367 - RNA, 20 nt, Human
cacaccuguagucccagcua

SEQ ID NO: 2087368 - RNA, 15 nt, Human
cacacgcacacacac

SEQ ID NO: 2087369 - RNA, 16 nt, Human
cacacgcacacacaca

SEQ ID NO: 2087370 - RNA, 13 nt, Human
cacaccagagccc

SEQ ID NO: 2087371 - RNA, 12 nt, Human
cacaccagagcc

SEQ ID NO: 2087372 - RNA, 15 nt, Human
cacaccagagcccac

SEQ ID NO: 2087373 - RNA, 21 nt, Human
cacaccaggcugugggccuca

SEQ ID NO: 2087374 - RNA, 13 nt, Human
cacacccagccca

SEQ ID NO: 2087375 - RNA, 21 nt, Human
cacaccaggcuugccugcagg

SEQ ID NO: 2087376 - RNA, 22 nt, Human
cacaccaggcuugccugcaggc

SEQ ID NO: 2087377 - RNA, 22 nt, Human
cacaccaggcugugggccucaa

SEQ ID NO: 2087378 - RNA, 14 nt, Human
cacacaccagagcc

SEQ ID NO: 2087379 - RNA, 13 nt, Human
cacacacaggcaa

SEQ ID NO: 2087380 - RNA, 21 nt, Human
cacacacaggcaacugaggca

SEQ ID NO: 2087381 - RNA, 17 nt, Human
cacaacccuguuuuaua

SEQ ID NO: 2087382 - RNA, 12 nt, Human
cacacacagcuu

SEQ ID NO: 2087383 - RNA, 12 nt, Human
cacacacaggag

SEQ ID NO: 2087384 - RNA, 12 nt, Human
cacacagcucug

SEQ ID NO: 2087385 - RNA, 19 nt, Human
cacacagaggcugccucuc

SEQ ID NO: 2087386 - RNA, 12 nt, Human
cacacagaggaa

SEQ ID NO: 2087387 - RNA, 18 nt, Human
cacacagaggaagagcag

SEQ ID NO: 2087388 - RNA, 22 nt, Human
cacacagaggaagagcaggcac

SEQ ID NO: 2087389 - RNA, 19 nt, Human
cacagacgccuuacuggca

SEQ ID NO: 2087390 - RNA, 23 nt, Human
cacagacuauugacaucagcauc

SEQ ID NO: 2087391 - RNA, 16 nt, Human
cacagacgucccucca

SEQ ID NO: 2087392 - RNA, 23 nt, Human
cacagagaacuagugguggcucu

SEQ ID NO: 2087393 - RNA, 20 nt, Human
cacagacuggagacaaugca

SEQ ID NO: 2087394 - RNA, 14 nt, Human
cacagagacacagg

SEQ ID NO: 2087395 - RNA, 18 nt, Human
cacagagacacagggcau

SEQ ID NO: 2087396 - RNA, 14 nt, Human
cacagagacccccg

SEQ ID NO: 2087397 - RNA, 10 nt, Human
cacagagaga

SEQ ID NO: 2087398 - RNA, 12 nt, Human
cacagagagaaa

SEQ ID NO: 2087399 - RNA, 18 nt, Human
cacagagagacagacuug

SEQ ID NO: 2087400 - RNA, 20 nt, Human
cacagagagacagacuugag

SEQ ID NO: 2087401 - RNA, 22 nt, Human
cacagagagacagacuugagaa

SEQ ID NO: 2087402 - RNA, 22 nt, Human
cacagagacccccggaacaagc

SEQ ID NO: 2087403 - RNA, 23 nt, Human
cacagagacccccggaacaagcc

SEQ ID NO: 2087404 - RNA, 22 nt, Human
cacagagagggggccaccuccc

SEQ ID NO: 2087405 - RNA, 13 nt, Human
cacacuugugugu

SEQ ID NO: 2087406 - RNA, 19 nt, Human
cacacuugugugugggcug

SEQ ID NO: 2087407 - RNA, 21 nt, Human
cacacuugugugugggcugug

SEQ ID NO: 2087408 - RNA, 23 nt, Human
cacacuugugugugggcugugag

SEQ ID NO: 2087409 - RNA, 15 nt, Human
cacacuuguuccagc

SEQ ID NO: 2087410 - RNA, 10 nt, Human
cacacuuguc

SEQ ID NO: 2087411 - RNA, 22 nt, Human
cacacuugguuggguccucaca

SEQ ID NO: 2087412 - RNA, 16 nt, Human
cacacuuguuccagcu

SEQ ID NO: 2087413 - RNA, 17 nt, Human
cacacuuguuccagcuc

SEQ ID NO: 2087414 - RNA, 18 nt, Human
cacacuuguuccagcucu

SEQ ID NO: 2087415 - RNA, 15 nt, Human
cacacuucugugaga

SEQ ID NO: 2087416 - RNA, 22 nt, Human
cacacuucugugagacccccac

SEQ ID NO: 2087417 - RNA, 16 nt, Human
cacacuuccaccagcc

SEQ ID NO: 2087418 - RNA, 18 nt, Human
cacacuuccaccagccug

SEQ ID NO: 2087419 - RNA, 19 nt, Human
cacacuuccaccagccugc

SEQ ID NO: 2087420 - RNA, 23 nt, Human
cacacuuccuguccagagagaga

SEQ ID NO: 2087421 - RNA, 19 nt, Human
cacacuuccuguccagaga

SEQ ID NO: 2087422 - RNA, 20 nt, Human
cacacuuccuguccagagag

SEQ ID NO: 2087423 - RNA, 13 nt, Human
cacacuuccuguc

SEQ ID NO: 2087424 - RNA, 14 nt, Human
cacacuuccugucc

SEQ ID NO: 2087425 - RNA, 15 nt, Human
cacacuuccugucca

SEQ ID NO: 2087426 - RNA, 16 nt, Human
cacacuuccuguccag

SEQ ID NO: 2087427 - RNA, 17 nt, Human
cacacuucaggcucuuc

SEQ ID NO: 2087428 - RNA, 14 nt, Human
cacacuucaggcuc

SEQ ID NO: 2087429 - RNA, 22 nt, Human
cacacuucaggcucuucuccuu

SEQ ID NO: 2087430 - RNA, 21 nt, Human
cacacuucaggcucuucuccu

SEQ ID NO: 2087431 - RNA, 20 nt, Human
cacacuucaggcucuucucc

SEQ ID NO: 2087432 - RNA, 18 nt, Human
cacacuucaggcucuucu

SEQ ID NO: 2087433 - RNA, 23 nt, Human
cacacugcuaggugggccagccc

SEQ ID NO: 2087434 - RNA, 23 nt, Human
cacacuguagcauuacagugggu

SEQ ID NO: 2087435 - RNA, 13 nt, Human
cacacugaggcag

SEQ ID NO: 2087436 - RNA, 14 nt, Human
cacacugaggcagg

SEQ ID NO: 2087437 - RNA, 17 nt, Human
cacacucagcacccccu

SEQ ID NO: 2087438 - RNA, 20 nt, Human
cacacucagcacccccuucu

SEQ ID NO: 2087439 - RNA, 22 nt, Human
cacacucagcacccccuucucu

SEQ ID NO: 2087440 - RNA, 15 nt, Human
cacacugaggcaggg

SEQ ID NO: 2087441 - RNA, 16 nt, Human
cacacugaggcaggga

SEQ ID NO: 2087442 - RNA, 17 nt, Human
cacacugaggcagggaa

SEQ ID NO: 2087443 - RNA, 18 nt, Human
cacacugaggcagggaag

SEQ ID NO: 2087444 - RNA, 21 nt, Human
cacacugcaagagccuuggug

SEQ ID NO: 2087445 - RNA, 19 nt, Human
cacacugcaagagccuugg

SEQ ID NO: 2087446 - RNA, 20 nt, Human
cacacugcaagagccuuggu

SEQ ID NO: 2087447 - RNA, 14 nt, Human
cacacugcaacagg

SEQ ID NO: 2087448 - RNA, 17 nt, Human
cacacugcaacaggaac

SEQ ID NO: 2087449 - RNA, 16 nt, Human
cacacugcaagagccu

SEQ ID NO: 2087450 - RNA, 17 nt, Human
cacacugcaagagccuu

SEQ ID NO: 2087451 - RNA, 18 nt, Human
cacacugcaagagccuug

SEQ ID NO: 2087452 - RNA, 17 nt, Human
cacacuagccucuccag

SEQ ID NO: 2087453 - RNA, 18 nt, Human
cacacuagccucuccagg

SEQ ID NO: 2087454 - RNA, 19 nt, Human
cacacuagccucuccagga

SEQ ID NO: 2087455 - RNA, 16 nt, Human
cacauguguccauccc

SEQ ID NO: 2087456 - RNA, 19 nt, Human
cacauguguccaucccagc

SEQ ID NO: 2087457 - RNA, 11 nt, Human
cacaugugugc

SEQ ID NO: 2087458 - RNA, 17 nt, Human
cacaugugcacaugcac

SEQ ID NO: 2087459 - RNA, 15 nt, Human
cacaugugcacaugc

SEQ ID NO: 2087460 - RNA, 14 nt, Human
cacaugugcacaug

SEQ ID NO: 2087461 - RNA, 15 nt, Human
cacauuauuugcaug

SEQ ID NO: 2087462 - RNA, 16 nt, Human
cacauucaauaagcau

SEQ ID NO: 2087463 - RNA, 13 nt, Human
cacauuauuugca

SEQ ID NO: 2087464 - RNA, 14 nt, Human
cacauuauuugcau

SEQ ID NO: 2087465 - RNA, 23 nt, Human
cacauuaucgggagcagugucuu

SEQ ID NO: 2087466 - RNA, 22 nt, Human
cacauuaucgggagcagugucu

SEQ ID NO: 2087467 - RNA, 19 nt, Human
cacauuaauauuugcugac

SEQ ID NO: 2087468 - RNA, 23 nt, Human
cacauuaagccuuccacacucac

SEQ ID NO: 2087469 - RNA, 18 nt, Human
cacauuaauauuugcuga

SEQ ID NO: 2087470 - RNA, 19 nt, Human
cacauuaggcauugagacu

SEQ ID NO: 2087471 - RNA, 16 nt, Human
cacauuaucgggagca

SEQ ID NO: 2087472 - RNA, 17 nt, Human
cacauuaucgggagcag

SEQ ID NO: 2087473 - RNA, 20 nt, Human
cacauuaucgggagcagugu

SEQ ID NO: 2087474 - RNA, 21 nt, Human
cacaugcuugaugguuuaugu

SEQ ID NO: 2087475 - RNA, 18 nt, Human
cacauggcuauguuuuag

SEQ ID NO: 2087476 - RNA, 18 nt, Human
cacaugggugaacacuca

SEQ ID NO: 2087477 - RNA, 14 nt, Human
cacauaucugucau

SEQ ID NO: 2087478 - RNA, 12 nt, Human
cacauaucuguc

SEQ ID NO: 2087479 - RNA, 20 nt, Human
caccacuaggacucugaggc

SEQ ID NO: 2087480 - RNA, 15 nt, Human
caccacguccagcug

SEQ ID NO: 2087481 - RNA, 23 nt, Human
caccacccgcuuucuugcugguu

SEQ ID NO: 2087482 - RNA, 22 nt, Human
caccacccuagucccuuccccu

SEQ ID NO: 2087483 - RNA, 22 nt, Human
caccaccuaggccacuccucca

SEQ ID NO: 2087484 - RNA, 23 nt, Human
caccaccuaggccacuccuccaa

SEQ ID NO: 2087485 - RNA, 12 nt, Human
caccaccucucc

SEQ ID NO: 2087486 - RNA, 13 nt, Human
caccaccaggucu

SEQ ID NO: 2087487 - RNA, 14 nt, Human
caccaccaggucuc

SEQ ID NO: 2087488 - RNA, 15 nt, Human
caccaccaggucucc

SEQ ID NO: 2087489 - RNA, 11 nt, Human
caccacccaaa

SEQ ID NO: 2087490 - RNA, 14 nt, Human
caccaccccagcug

SEQ ID NO: 2087491 - RNA, 21 nt, Human
caccaccccagcugcuccccu

SEQ ID NO: 2087492 - RNA, 18 nt, Human
caccacaugugcacaugc

SEQ ID NO: 2087493 - RNA, 15 nt, Human
caccacaugugcaca

SEQ ID NO: 2087494 - RNA, 19 nt, Human
caccacaugugcacaugca

SEQ ID NO: 2087495 - RNA, 15 nt, Human
caccaagcccaguua

SEQ ID NO: 2087496 - RNA, 21 nt, Human
cacauugccagugacaugaga

SEQ ID NO: 2087497 - RNA, 20 nt, Human
cacauugugucacaucauga

SEQ ID NO: 2087498 - RNA, 17 nt, Human
caccacacccagcccac

SEQ ID NO: 2087499 - RNA, 20 nt, Human
caccaagcucacaguuccuc

SEQ ID NO: 2087500 - RNA, 13 nt, Human
caccacagcaggu

SEQ ID NO: 2087501 - RNA, 18 nt, Human
caccacauccuccgucca

SEQ ID NO: 2087502 - RNA, 21 nt, Human
caccacauccuccguccagcc

SEQ ID NO: 2087503 - RNA, 15 nt, Human
caccacacccagccc

SEQ ID NO: 2087504 - RNA, 13 nt, Human
caccacacccagc

SEQ ID NO: 2087505 - RNA, 14 nt, Human
caccaagcucacag

SEQ ID NO: 2087506 - RNA, 15 nt, Human
caccaagcucacagu

SEQ ID NO: 2087507 - RNA, 19 nt, Human
caccaagcucacaguuccu

SEQ ID NO: 2087508 - RNA, 16 nt, Human
caccaccccagcugcu

SEQ ID NO: 2087509 - RNA, 16 nt, Human
cacagcagccccugca

SEQ ID NO: 2087510 - RNA, 20 nt, Human
cacagauggauuugccugug

SEQ ID NO: 2087511 - RNA, 23 nt, Human
cacagauggauuugccugugcca

SEQ ID NO: 2087512 - RNA, 22 nt, Human
cacagaguggucuuucuggaga

SEQ ID NO: 2087513 - RNA, 13 nt, Human
cacagcaugugua

SEQ ID NO: 2087514 - RNA, 18 nt, Human
cacagcagccucugaagu

SEQ ID NO: 2087515 - RNA, 14 nt, Human
cacagccgcagccu

SEQ ID NO: 2087516 - RNA, 23 nt, Human
cacagccgcagccucccucugac

SEQ ID NO: 2087517 - RNA, 21 nt, Human
cacagccgcagccucccucug

SEQ ID NO: 2087518 - RNA, 22 nt, Human
cacagccgcagccucccucuga

SEQ ID NO: 2087519 - RNA, 18 nt, Human
cacagccggggccugccu

SEQ ID NO: 2087520 - RNA, 19 nt, Human
cacagccggggccugccua

SEQ ID NO: 2087521 - RNA, 20 nt, Human
cacagccggggccugccuag

SEQ ID NO: 2087522 - RNA, 22 nt, Human
cacagccggggccugccuagca

SEQ ID NO: 2087523 - RNA, 16 nt, Human
cacaggaucagucuga

SEQ ID NO: 2087524 - RNA, 15 nt, Human
cacaggaucagucug

SEQ ID NO: 2087525 - RNA, 12 nt, Human
cacaggaucagu

SEQ ID NO: 2087526 - RNA, 19 nt, Human
cacaggcccggcuccaggc

SEQ ID NO: 2087527 - RNA, 18 nt, Human
cacaggcccggcuccagg

SEQ ID NO: 2087528 - RNA, 17 nt, Human
cacaggcccggcuccag

SEQ ID NO: 2087529 - RNA, 16 nt, Human
cacaggcccggcucca

SEQ ID NO: 2087530 - RNA, 10 nt, Human
cacaggcagg

SEQ ID NO: 2087531 - RNA, 22 nt, Human
cacaggcaacugaggcagacag

SEQ ID NO: 2087532 - RNA, 23 nt, Human
cacaggcaacugaggcagacagc

SEQ ID NO: 2087533 - RNA, 14 nt, Human
cacaggcagcauuu

SEQ ID NO: 2087534 - RNA, 14 nt, Human
cacaggauagauaa

SEQ ID NO: 2087535 - RNA, 15 nt, Human
cacaggcagcauuua

SEQ ID NO: 2087536 - RNA, 14 nt, Human
cacauaaaggauaa

SEQ ID NO: 2087537 - RNA, 18 nt, Human
cacauaaaggauaaacuu

SEQ ID NO: 2087538 - RNA, 13 nt, Human
cacauaacagaau

SEQ ID NO: 2087539 - RNA, 21 nt, Human
cacauauaaacaucacacaca

SEQ ID NO: 2087540 - RNA, 21 nt, Human
cacauagugaugguuccccug

SEQ ID NO: 2087541 - RNA, 17 nt, Human
cacauacacacacacgc

SEQ ID NO: 2087542 - RNA, 23 nt, Human
cacaggcccggcuccaggcuccu

SEQ ID NO: 2087543 - RNA, 20 nt, Human
cacaggcccggcuccaggcu

SEQ ID NO: 2087544 - RNA, 15 nt, Human
cacaggcccuuccuc

SEQ ID NO: 2087545 - RNA, 18 nt, Human
cacagugagucgaggaca

SEQ ID NO: 2087546 - RNA, 20 nt, Human
cacagugagucgaggacagg

SEQ ID NO: 2087547 - RNA, 19 nt, Human
cacagugagucgaggacag

SEQ ID NO: 2087548 - RNA, 16 nt, Human
caagugauucuccugc

SEQ ID NO: 2087549 - RNA, 17 nt, Human
caagugauucuccugcc

SEQ ID NO: 2087550 - RNA, 19 nt, Human
caagugaaaaaggaggaag

SEQ ID NO: 2087551 - RNA, 14 nt, Human
caaggaucuuucac

SEQ ID NO: 2087552 - RNA, 14 nt, Human
caagucugugccug

SEQ ID NO: 2087553 - RNA, 16 nt, Human
caagucugugccugga

SEQ ID NO: 2087554 - RNA, 17 nt, Human
caagucugugccuggag

SEQ ID NO: 2087555 - RNA, 18 nt, Human
caagucugugccuggagc

SEQ ID NO: 2087556 - RNA, 19 nt, Human
caagucugugccuggagcu

SEQ ID NO: 2087557 - RNA, 23 nt, Human
caagucugugccuggagcuccug

SEQ ID NO: 2087558 - RNA, 14 nt, Human
caagucuucccuga

SEQ ID NO: 2087559 - RNA, 15 nt, Human
caagucuucccugau

SEQ ID NO: 2087560 - RNA, 23 nt, Human
caagucucugcuggcccagccaa

SEQ ID NO: 2087561 - RNA, 13 nt, Human
caagucuggaucu

SEQ ID NO: 2087562 - RNA, 18 nt, Human
caagucuggaucugggac

SEQ ID NO: 2087563 - RNA, 19 nt, Human
caagucuggaucugggacc

SEQ ID NO: 2087564 - RNA, 14 nt, Human
caagucuccuuccc

SEQ ID NO: 2087565 - RNA, 17 nt, Human
caagucuccuuccccuu

SEQ ID NO: 2087566 - RNA, 18 nt, Human
caagucucugcuggccca

SEQ ID NO: 2087567 - RNA, 19 nt, Human
caagucucugcuggcccag

SEQ ID NO: 2087568 - RNA, 22 nt, Human
caagucucugcuggcccagcca

SEQ ID NO: 2087569 - RNA, 22 nt, Human
caagugauucuccugccucagc

SEQ ID NO: 2087570 - RNA, 21 nt, Human
caagugauucuccugccucag

SEQ ID NO: 2087571 - RNA, 14 nt, Human
caagugauucuccu

SEQ ID NO: 2087572 - RNA, 17 nt, Human
caagugcaugcucucug

SEQ ID NO: 2087573 - RNA, 13 nt, Human
caagugcaggcug

SEQ ID NO: 2087574 - RNA, 22 nt, Human
caagugugguagagugugccug

SEQ ID NO: 2087575 - RNA, 14 nt, Human
caagugggggcaga

SEQ ID NO: 2087576 - RNA, 20 nt, Human
caagugggggcagagggcag

SEQ ID NO: 2087577 - RNA, 14 nt, Human
caagugcaggcugg

SEQ ID NO: 2087578 - RNA, 20 nt, Human
caagugcaggcuggcaccgc

SEQ ID NO: 2087579 - RNA, 13 nt, Human
caagugggggcag

SEQ ID NO: 2087580 - RNA, 23 nt, Human
caaggugaagaugggaacgcaga

SEQ ID NO: 2087581 - RNA, 15 nt, Human
caaggugcaaaucaa

SEQ ID NO: 2087582 - RNA, 19 nt, Human
caagggcugcuucaaacuc

SEQ ID NO: 2087583 - RNA, 14 nt, Human
caagggcuguaggu

SEQ ID NO: 2087584 - RNA, 21 nt, Human
caagggcuuacacguggagga

SEQ ID NO: 2087585 - RNA, 22 nt, Human
caagggcuuacacguggaggaa

SEQ ID NO: 2087586 - RNA, 15 nt, Human
caaggauugcuacug

SEQ ID NO: 2087587 - RNA, 17 nt, Human
caaggugcuguugucau

SEQ ID NO: 2087588 - RNA, 23 nt, Human
caaggugcuguugucauugcuuu

SEQ ID NO: 2087589 - RNA, 13 nt, Human
caagguggagugg

SEQ ID NO: 2087590 - RNA, 14 nt, Human
caagguggagugga

SEQ ID NO: 2087591 - RNA, 15 nt, Human
caagguggaguggau

SEQ ID NO: 2087592 - RNA, 18 nt, Human
caagguggaguggaugcc

SEQ ID NO: 2087593 - RNA, 21 nt, Human
caagguggaguggaugccuca

SEQ ID NO: 2087594 - RNA, 12 nt, Human
caaggugggagg

SEQ ID NO: 2087595 - RNA, 23 nt, Human
caaggugggaggauugcuugagc

SEQ ID NO: 2087596 - RNA, 21 nt, Human
caaggugggcagggaggcacc

SEQ ID NO: 2087597 - RNA, 22 nt, Human
caaggugggccuugcuaccuca

SEQ ID NO: 2087598 - RNA, 12 nt, Human
caaggugggcug

SEQ ID NO: 2087599 - RNA, 16 nt, Human
caaggugggcugagcc

SEQ ID NO: 2087600 - RNA, 17 nt, Human
caaggugggcugagccc

SEQ ID NO: 2087601 - RNA, 18 nt, Human
caaguccugccucuuaaa

SEQ ID NO: 2087602 - RNA, 15 nt, Human
caaguccuuaccucu

SEQ ID NO: 2087603 - RNA, 18 nt, Human
caaguccuuaccucuucc

SEQ ID NO: 2087604 - RNA, 23 nt, Human
caaguccuuaccucuuccggaga

SEQ ID NO: 2087605 - RNA, 22 nt, Human
caaguccuuaccucuuccggag

SEQ ID NO: 2087606 - RNA, 18 nt, Human
caaggugggcugagcccu

SEQ ID NO: 2087607 - RNA, 19 nt, Human
caaggugggcugagcccug

SEQ ID NO: 2087608 - RNA, 20 nt, Human
caaggugggcugagcccugg

SEQ ID NO: 2087609 - RNA, 21 nt, Human
caaggugggcugagcccuggc

SEQ ID NO: 2087610 - RNA, 23 nt, Human
caaggugggcugagcccuggcag

SEQ ID NO: 2087611 - RNA, 24 nt, Human
caaggugggcugagcccuggcagg

SEQ ID NO: 2087612 - RNA, 19 nt, Human
caagccaagcagccaagcu

SEQ ID NO: 2087613 - RNA, 21 nt, Human
caagccaagcagccaagcucc

SEQ ID NO: 2087614 - RNA, 12 nt, Human
caagaaaggaga

SEQ ID NO: 2087615 - RNA, 13 nt, Human
caagaaaggagag

SEQ ID NO: 2087616 - RNA, 14 nt, Human
caagaaaggagagu

SEQ ID NO: 2087617 - RNA, 21 nt, Human
caagaaaggagagucuugcag

SEQ ID NO: 2087618 - RNA, 15 nt, Human
caagaaagaaacccg

SEQ ID NO: 2087619 - RNA, 12 nt, Human
caagaaaacaua

SEQ ID NO: 2087620 - RNA, 15 nt, Human
caagaaacucacccc

SEQ ID NO: 2087621 - RNA, 17 nt, Human
caagaaacucaccccca

SEQ ID NO: 2087622 - RNA, 18 nt, Human
caagcaccuccugccucg

SEQ ID NO: 2087623 - RNA, 22 nt, Human
caagaaagaaacccgacagagg

SEQ ID NO: 2087624 - RNA, 15 nt, Human
caagaaagccagucu

SEQ ID NO: 2087625 - RNA, 16 nt, Human
caagaaagccagucuu

SEQ ID NO: 2087626 - RNA, 19 nt, Human
caagaaagccagucuuaac

SEQ ID NO: 2087627 - RNA, 16 nt, Human
caagccguggcuuccc

SEQ ID NO: 2087628 - RNA, 15 nt, Human
caagccguggcuucc

SEQ ID NO: 2087629 - RNA, 14 nt, Human
caagccguggcuuc

SEQ ID NO: 2087630 - RNA, 14 nt, Human
caagcccugagagu

SEQ ID NO: 2087631 - RNA, 16 nt, Human
caagcgugagccacug

SEQ ID NO: 2087632 - RNA, 16 nt, Human
caaggaagccacagcu

SEQ ID NO: 2087633 - RNA, 20 nt, Human
caaggaaagccccagcacua

SEQ ID NO: 2087634 - RNA, 18 nt, Human
caaggaccaacaagggca

SEQ ID NO: 2087635 - RNA, 20 nt, Human
caaggaccaacaagggcagu

SEQ ID NO: 2087636 - RNA, 21 nt, Human
caaggaccaacaagggcagug

SEQ ID NO: 2087637 - RNA, 23 nt, Human
caaggaccaacaagggcagugga

SEQ ID NO: 2087638 - RNA, 13 nt, Human
caaggaccaggac

SEQ ID NO: 2087639 - RNA, 14 nt, Human
caaggaccaggacu

SEQ ID NO: 2087640 - RNA, 15 nt, Human
caaggaccaggacuc

SEQ ID NO: 2087641 - RNA, 16 nt, Human
caaggaccaggacucc

SEQ ID NO: 2087642 - RNA, 18 nt, Human
caaggaccaggacucccu

SEQ ID NO: 2087643 - RNA, 20 nt, Human
caaggaccaggacucccucc

SEQ ID NO: 2087644 - RNA, 21 nt, Human
caaggaccaggacucccuccu

SEQ ID NO: 2087645 - RNA, 18 nt, Human
caagcgugagccacugca

SEQ ID NO: 2087646 - RNA, 17 nt, Human
caagcgugagccacugc

SEQ ID NO: 2087647 - RNA, 17 nt, Human
caaggaaagccccagca

SEQ ID NO: 2087648 - RNA, 13 nt, Human
caaggaccccuca

SEQ ID NO: 2087649 - RNA, 14 nt, Human
caaggaccccucac

SEQ ID NO: 2087650 - RNA, 15 nt, Human
caaggaccccucacc

SEQ ID NO: 2087651 - RNA, 17 nt, Human
caaggaccccucaccuu

SEQ ID NO: 2087652 - RNA, 20 nt, Human
caaggaccccucaccuugca

SEQ ID NO: 2087653 - RNA, 16 nt, Human
caaggggaaaaucuca

SEQ ID NO: 2087654 - RNA, 14 nt, Human
caaauuuaaaacaa

SEQ ID NO: 2087655 - RNA, 15 nt, Human
caaauuuaaaacaaa

SEQ ID NO: 2087656 - RNA, 16 nt, Human
caaauucgcaaacuuu

SEQ ID NO: 2087657 - RNA, 20 nt, Human
caaauucuacaacuuuuccu

SEQ ID NO: 2087658 - RNA, 24 nt, Human
caacaggcugggcuucaguggcag

SEQ ID NO: 2087659 - RNA, 23 nt, Human
caacaggcugggcuucaguggca

SEQ ID NO: 2087660 - RNA, 15 nt, Human
caacaucccauugcc

SEQ ID NO: 2087661 - RNA, 17 nt, Human
caacaucccauugcccu

SEQ ID NO: 2087662 - RNA, 22 nt, Human
caacaucuuggucagauuugaa

SEQ ID NO: 2087663 - RNA, 18 nt, Human
caacagucaaaacagaga

SEQ ID NO: 2087664 - RNA, 20 nt, Human
caacaguagcauaggacccu

SEQ ID NO: 2087665 - RNA, 14 nt, Human
caacagucaaaaca

SEQ ID NO: 2087666 - RNA, 18 nt, Human
caacaucaauguucauug

SEQ ID NO: 2087667 - RNA, 22 nt, Human
caacaucaauguucauuguaau

SEQ ID NO: 2087668 - RNA, 15 nt, Human
caacaucaauguuca

SEQ ID NO: 2087669 - RNA, 16 nt, Human
caacaucaauguucau

SEQ ID NO: 2087670 - RNA, 17 nt, Human
caacaucaauguucauu

SEQ ID NO: 2087671 - RNA, 19 nt, Human
caaccccuucgcuccugug

SEQ ID NO: 2087672 - RNA, 18 nt, Human
caaccccuucgcuccugu

SEQ ID NO: 2087673 - RNA, 18 nt, Human
caacccucagagccaccc

SEQ ID NO: 2087674 - RNA, 21 nt, Human
caacccucagagccaccccua

SEQ ID NO: 2087675 - RNA, 21 nt, Human
caaccccuucgcuccuguguc

SEQ ID NO: 2087676 - RNA, 20 nt, Human
caaccaagucaugugcauuu

SEQ ID NO: 2087677 - RNA, 18 nt, Human
caaccaagucaugugcau

SEQ ID NO: 2087678 - RNA, 16 nt, Human
caaccaauguagaaag

SEQ ID NO: 2087679 - RNA, 23 nt, Human
caacauggagaaacccugucucu

SEQ ID NO: 2087680 - RNA, 22 nt, Human
caacauggagaaacccugucuc

SEQ ID NO: 2087681 - RNA, 23 nt, Human
caacaugccugccccaaacaaau

SEQ ID NO: 2087682 - RNA, 20 nt, Human
caacaugccugcuuuagaau

SEQ ID NO: 2087683 - RNA, 22 nt, Human
caacaugcuucaugaaaauccu

SEQ ID NO: 2087684 - RNA, 13 nt, Human
caacauggagaaa

SEQ ID NO: 2087685 - RNA, 18 nt, Human
caacauggugaaaccccg

SEQ ID NO: 2087686 - RNA, 21 nt, Human
caacauggugaaaccccaucu

SEQ ID NO: 2087687 - RNA, 13 nt, Human
caacauguauaau

SEQ ID NO: 2087688 - RNA, 13 nt, Human
caacaucuagcaa

SEQ ID NO: 2087689 - RNA, 18 nt, Human
caacaucccauugcccug

SEQ ID NO: 2087690 - RNA, 19 nt, Human
caacaucccauugcccugg

SEQ ID NO: 2087691 - RNA, 20 nt, Human
caacaucccauugcccuggu

SEQ ID NO: 2087692 - RNA, 15 nt, Human
caacauuaaacacaa

SEQ ID NO: 2087693 - RNA, 20 nt, Human
caacauuaaaacaauauugu

SEQ ID NO: 2087694 - RNA, 17 nt, Human
caacauguauaauauuu

SEQ ID NO: 2087695 - RNA, 18 nt, Human
caacauguauaauauuuu

SEQ ID NO: 2087696 - RNA, 19 nt, Human
caacauguauaauauuuuu

SEQ ID NO: 2087697 - RNA, 23 nt, Human
caacauguauaauauuuuuaauu

SEQ ID NO: 2087698 - RNA, 17 nt, Human
caacauguuacugacca

SEQ ID NO: 2087699 - RNA, 18 nt, Human
caacauguuacugaccag

SEQ ID NO: 2087700 - RNA, 20 nt, Human
caacauguuacugaccagca

SEQ ID NO: 2087701 - RNA, 15 nt, Human
caacuuucucuugua

SEQ ID NO: 2087702 - RNA, 16 nt, Human
caacuucaagugcaug

SEQ ID NO: 2087703 - RNA, 17 nt, Human
caacuucaagugcaugc

SEQ ID NO: 2087704 - RNA, 18 nt, Human
caacuucaagugcaugcu

SEQ ID NO: 2087705 - RNA, 22 nt, Human
caacuucaagugcaugcucucu

SEQ ID NO: 2087706 - RNA, 19 nt, Human
caacuuuagcagaaucaaa

SEQ ID NO: 2087707 - RNA, 14 nt, Human
caacuucuaauugc

SEQ ID NO: 2087708 - RNA, 23 nt, Human
caacuucccaguucaggaguccc

SEQ ID NO: 2087709 - RNA, 21 nt, Human
caacucuucccccucucccag

SEQ ID NO: 2087710 - RNA, 16 nt, Human
caacugcauuggcuuu

SEQ ID NO: 2087711 - RNA, 19 nt, Human
caacuguugauugcaggaa

SEQ ID NO: 2087712 - RNA, 15 nt, Human
caacuuaaaaagucu

SEQ ID NO: 2087713 - RNA, 19 nt, Human
caacuuaaaaagucugcau

SEQ ID NO: 2087714 - RNA, 14 nt, Human
caacuggaagcaca

SEQ ID NO: 2087715 - RNA, 19 nt, Human
caacuggacauugucugcg

SEQ ID NO: 2087716 - RNA, 17 nt, Human
caacugcugaugcucau

SEQ ID NO: 2087717 - RNA, 20 nt, Human
caacugcugaugcucauggu

SEQ ID NO: 2087718 - RNA, 21 nt, Human
caacugcugaugcucaugguc

SEQ ID NO: 2087719 - RNA, 13 nt, Human
caacugcugcccc

SEQ ID NO: 2087720 - RNA, 14 nt, Human
caacugcugcccca

SEQ ID NO: 2087721 - RNA, 21 nt, Human
caacugcugccccaaaggaag

SEQ ID NO: 2087722 - RNA, 17 nt, Human
caacccucccucagccc

SEQ ID NO: 2087723 - RNA, 18 nt, Human
caacccucccucagcccc

SEQ ID NO: 2087724 - RNA, 14 nt, Human
caaccaccgcuccc

SEQ ID NO: 2087725 - RNA, 14 nt, Human
caacccucccucag

SEQ ID NO: 2087726 - RNA, 22 nt, Human
caacccuuaccccuuagccucc

SEQ ID NO: 2087727 - RNA, 19 nt, Human
caacccuguuuuauacugu

SEQ ID NO: 2087728 - RNA, 17 nt, Human
caacccuguuuuauacu

SEQ ID NO: 2087729 - RNA, 15 nt, Human
caacccuuaccccuu

SEQ ID NO: 2087730 - RNA, 19 nt, Human
caacccuuaccccuuagcc

SEQ ID NO: 2087731 - RNA, 20 nt, Human
caacccuuaccccuuagccu

SEQ ID NO: 2087732 - RNA, 15 nt, Human
caacgcagcccugcu

SEQ ID NO: 2087733 - RNA, 13 nt, Human
caacgcagcccug

SEQ ID NO: 2087734 - RNA, 15 nt, Human
caacgaggaagcccu

SEQ ID NO: 2087735 - RNA, 12 nt, Human
caacgcagcccu

SEQ ID NO: 2087736 - RNA, 18 nt, Human
caacgcagcccugcuuug

SEQ ID NO: 2087737 - RNA, 21 nt, Human
caaccugaccaacauggagaa

SEQ ID NO: 2087738 - RNA, 12 nt, Human
caacgaggaagc

SEQ ID NO: 2087739 - RNA, 13 nt, Human
caacgaggaagcc

SEQ ID NO: 2087740 - RNA, 20 nt, Human
caaccugaccaacauggaga

SEQ ID NO: 2087741 - RNA, 23 nt, Human
caaccugaccaacauggagaaac

SEQ ID NO: 2087742 - RNA, 15 nt, Human
caaccugaccaacau

SEQ ID NO: 2087743 - RNA, 20 nt, Human
caaauaguuuauaaauguga

SEQ ID NO: 2087744 - RNA, 20 nt, Human
caaauaauuuuucacuucaa

SEQ ID NO: 2087745 - RNA, 15 nt, Human
caaauacuuauucau

SEQ ID NO: 2087746 - RNA, 17 nt, Human
caaauacuuauucauug

SEQ ID NO: 2087747 - RNA, 18 nt, Human
caaauacuuauucauugu

SEQ ID NO: 2087748 - RNA, 21 nt, Human
caaauacuuauucauuguggu

SEQ ID NO: 2087749 - RNA, 12 nt, Human
caaauagaaaac

SEQ ID NO: 2087750 - RNA, 13 nt, Human
caaauagaaaaca

SEQ ID NO: 2087751 - RNA, 14 nt, Human
caaauagaaaacag

SEQ ID NO: 2087752 - RNA, 17 nt, Human
caaauagaaaacaggaa

SEQ ID NO: 2087753 - RNA, 14 nt, Human
caaauaauaagcaa

SEQ ID NO: 2087754 - RNA, 22 nt, Human
caaaggauagugcgauguuuca

SEQ ID NO: 2087755 - RNA, 17 nt, Human
caaaguuggggcaggcu

SEQ ID NO: 2087756 - RNA, 22 nt, Human
caaauucugcuugcuugcuuuu

SEQ ID NO: 2087757 - RNA, 20 nt, Human
caaauucccagauuugaaga

SEQ ID NO: 2087758 - RNA, 21 nt, Human
caaauucccagauuugaagac

SEQ ID NO: 2087759 - RNA, 18 nt, Human
caaauucccuccucccuu

SEQ ID NO: 2087760 - RNA, 14 nt, Human
caaauguggcuccu

SEQ ID NO: 2087761 - RNA, 20 nt, Human
caaauguguaucggaugcuu

SEQ ID NO: 2087762 - RNA, 17 nt, Human
caaaugugaccuguguc

SEQ ID NO: 2087763 - RNA, 17 nt, Human
caaauguggcauuugug

SEQ ID NO: 2087764 - RNA, 19 nt, Human
caaauguggcauuugugau

SEQ ID NO: 2087765 - RNA, 14 nt, Human
caaaugugaccugu

SEQ ID NO: 2087766 - RNA, 13 nt, Human
caaaucagcugcu

SEQ ID NO: 2087767 - RNA, 16 nt, Human
caaaucagcugcuacu

SEQ ID NO: 2087768 - RNA, 13 nt, Human
auuuuuuuaaguc

SEQ ID NO: 2087769 - RNA, 15 nt, Human
auuuuuuuaagucuu

SEQ ID NO: 2087770 - RNA, 15 nt, Human
auuuuuuucaauauu

SEQ ID NO: 2087771 - RNA, 12 nt, Human
caaaaaacaaua

SEQ ID NO: 2087772 - RNA, 18 nt, Human
caaaaaacaauauuuauu

SEQ ID NO: 2087773 - RNA, 22 nt, Human
caaaaaacaauauuuauuguau

SEQ ID NO: 2087774 - RNA, 23 nt, Human
caaaaaacaauauuuauuguauu

SEQ ID NO: 2087775 - RNA, 14 nt, Human
caaaaaaauuaaau

SEQ ID NO: 2087776 - RNA, 23 nt, Human
caaacuuccagugcaacacugaa

SEQ ID NO: 2087777 - RNA, 12 nt, Human
caaaaaaugagc

SEQ ID NO: 2087778 - RNA, 15 nt, Human
caaagaggcaagagg

SEQ ID NO: 2087779 - RNA, 20 nt, Human
caaagaggcaagaggcugga

SEQ ID NO: 2087780 - RNA, 15 nt, Human
caaacuucagacuga

SEQ ID NO: 2087781 - RNA, 13 nt, Human
caaagaaacccaa

SEQ ID NO: 2087782 - RNA, 13 nt, Human
caaagaggcaaga

SEQ ID NO: 2087783 - RNA, 14 nt, Human
caaagaggcaagag

SEQ ID NO: 2087784 - RNA, 16 nt, Human
caaagcugcuaaaucu

SEQ ID NO: 2087785 - RNA, 17 nt, Human
caaagcugcuaaaucuc

SEQ ID NO: 2087786 - RNA, 23 nt, Human
caaagcugcuaaaucuccuauuu

SEQ ID NO: 2087787 - RNA, 18 nt, Human
caaagcuaggccuggcca

SEQ ID NO: 2087788 - RNA, 17 nt, Human
caaagcuaggccuggcc

SEQ ID NO: 2087789 - RNA, 16 nt, Human
caaagcuaggccuggc

SEQ ID NO: 2087790 - RNA, 15 nt, Human
caaagcuaggccugg

SEQ ID NO: 2087791 - RNA, 21 nt, Human
caaagccaaagcuaggccugg

SEQ ID NO: 2087792 - RNA, 17 nt, Human
caaagcauugagcaaag

SEQ ID NO: 2087793 - RNA, 17 nt, Human
caaagccaaacucugcc

SEQ ID NO: 2087794 - RNA, 18 nt, Human
caaagccaaacucugcca

SEQ ID NO: 2087795 - RNA, 22 nt, Human
caaagccaaacucugccagcca

SEQ ID NO: 2087796 - RNA, 20 nt, Human
caaagccaaagcuaggccug

SEQ ID NO: 2087797 - RNA, 14 nt, Human
caaagcuugaagau

SEQ ID NO: 2087798 - RNA, 19 nt, Human
caaagcuugaagaucguua

SEQ ID NO: 2087799 - RNA, 15 nt, Human
caaagcuuccauucc

SEQ ID NO: 2087800 - RNA, 16 nt, Human
caaagcuuccauucca

SEQ ID NO: 2087801 - RNA, 20 nt, Human
caaagcuuccauuccacauc

SEQ ID NO: 2087802 - RNA, 16 nt, Human
caaagcuuguuaagau

SEQ ID NO: 2087803 - RNA, 17 nt, Human
caaaggaggcuggcagg

SEQ ID NO: 2087804 - RNA, 16 nt, Human
caaaggaguagaaaga

SEQ ID NO: 2087805 - RNA, 20 nt, Human
caaaggagggucaggaagga

SEQ ID NO: 2087806 - RNA, 19 nt, Human
caaaggaaaaaguaucaug

SEQ ID NO: 2087807 - RNA, 22 nt, Human
caaaggaaaauaguaauguuuu

SEQ ID NO: 2087808 - RNA, 15 nt, Human
caaagcuuuccugga

SEQ ID NO: 2087809 - RNA, 16 nt, Human
caaagcuuuccuggag

SEQ ID NO: 2087810 - RNA, 17 nt, Human
caaagcuuuccuggaga

SEQ ID NO: 2087811 - RNA, 16 nt, Human
caacuucuaauugcca

SEQ ID NO: 2087812 - RNA, 17 nt, Human
caacuucuacuucugcc

SEQ ID NO: 2087813 - RNA, 15 nt, Human
caccccuaaagagau

SEQ ID NO: 2087814 - RNA, 15 nt, Human
cacccacagaaagag

SEQ ID NO: 2087815 - RNA, 17 nt, Human
cacccacagaaagagag

SEQ ID NO: 2087816 - RNA, 13 nt, Human
cacccacagggcu

SEQ ID NO: 2087817 - RNA, 15 nt, Human
cacccaccagggcga

SEQ ID NO: 2087818 - RNA, 16 nt, Human
caccacuucuuuuaua

SEQ ID NO: 2087819 - RNA, 20 nt, Human
cacccacaagugccacugcc

SEQ ID NO: 2087820 - RNA, 13 nt, Human
caccacugcacuc

SEQ ID NO: 2087821 - RNA, 18 nt, Human
caccacugcacuccagcc

SEQ ID NO: 2087822 - RNA, 22 nt, Human
cacccaccaucaugucuggcua

SEQ ID NO: 2087823 - RNA, 20 nt, Human
cacccaccaucaugucuggc

SEQ ID NO: 2087824 - RNA, 22 nt, Human
cacccaccaguugaauuucauc

SEQ ID NO: 2087825 - RNA, 14 nt, Human
cacccacccagcac

SEQ ID NO: 2087826 - RNA, 16 nt, Human
cacccaccucagccuc

SEQ ID NO: 2087827 - RNA, 14 nt, Human
cacccaccucagcc

SEQ ID NO: 2087828 - RNA, 13 nt, Human
cacccaccucagc

SEQ ID NO: 2087829 - RNA, 12 nt, Human
cacccaccucag

SEQ ID NO: 2087830 - RNA, 22 nt, Human
caccccauagugaccggcugcu

SEQ ID NO: 2087831 - RNA, 12 nt, Human
caccccaugcca

SEQ ID NO: 2087832 - RNA, 15 nt, Human
caccccaugccaaag

SEQ ID NO: 2087833 - RNA, 17 nt, Human
caccccaugccaaagcu

SEQ ID NO: 2087834 - RNA, 17 nt, Human
caccccagugcacccac

SEQ ID NO: 2087835 - RNA, 18 nt, Human
caccccagugcacccacu

SEQ ID NO: 2087836 - RNA, 20 nt, Human
caccccagugcacccacucu

SEQ ID NO: 2087837 - RNA, 12 nt, Human
caccccauccca

SEQ ID NO: 2087838 - RNA, 15 nt, Human
caccccaucccacac

SEQ ID NO: 2087839 - RNA, 21 nt, Human
caccccaucccacacccugga

SEQ ID NO: 2087840 - RNA, 22 nt, Human
caccccagcugcuccccucccu

SEQ ID NO: 2087841 - RNA, 11 nt, Human
caccccagccu

SEQ ID NO: 2087842 - RNA, 19 nt, Human
caccccagccuaagaugaa

SEQ ID NO: 2087843 - RNA, 13 nt, Human
caccccagcugcu

SEQ ID NO: 2087844 - RNA, 16 nt, Human
caccccagcugcuccc

SEQ ID NO: 2087845 - RNA, 18 nt, Human
caccccagcugcuccccu

SEQ ID NO: 2087846 - RNA, 19 nt, Human
caccccagcugcuccccuc

SEQ ID NO: 2087847 - RNA, 20 nt, Human
caccccagcugcuccccucc

SEQ ID NO: 2087848 - RNA, 12 nt, Human
cacccccaaggg

SEQ ID NO: 2087849 - RNA, 19 nt, Human
cacccccaaggggcagucu

SEQ ID NO: 2087850 - RNA, 11 nt, Human
cacccccaccc

SEQ ID NO: 2087851 - RNA, 13 nt, Human
caccccccagaac

SEQ ID NO: 2087852 - RNA, 18 nt, Human
caccccccagaaccuguc

SEQ ID NO: 2087853 - RNA, 19 nt, Human
caccccccagaaccugucc

SEQ ID NO: 2087854 - RNA, 20 nt, Human
caccccccagaaccuguccu

SEQ ID NO: 2087855 - RNA, 21 nt, Human
caccccccagaaccuguccuu

SEQ ID NO: 2087856 - RNA, 13 nt, Human
caccccccugggc

SEQ ID NO: 2087857 - RNA, 12 nt, Human
caccccccucau

SEQ ID NO: 2087858 - RNA, 16 nt, Human
cacccccgccucccuc

SEQ ID NO: 2087859 - RNA, 17 nt, Human
cacccccaucucucccu

SEQ ID NO: 2087860 - RNA, 13 nt, Human
cacccccaucucu

SEQ ID NO: 2087861 - RNA, 18 nt, Human
cacccccuccccagggga

SEQ ID NO: 2087862 - RNA, 13 nt, Human
cacccccucccug

SEQ ID NO: 2087863 - RNA, 14 nt, Human
cacccccuccccag

SEQ ID NO: 2087864 - RNA, 15 nt, Human
cacccccuccccagg

SEQ ID NO: 2087865 - RNA, 16 nt, Human
cacccccuccccaggg

SEQ ID NO: 2087866 - RNA, 17 nt, Human
cacccccuccccagggg

SEQ ID NO: 2087867 - RNA, 11 nt, Human
cacccccuccc

SEQ ID NO: 2087868 - RNA, 14 nt, Human
cacccccucccugg

SEQ ID NO: 2087869 - RNA, 16 nt, Human
cacccccucccuggcc

SEQ ID NO: 2087870 - RNA, 23 nt, Human
cacccccucccuggccuguucug

SEQ ID NO: 2087871 - RNA, 16 nt, Human
cacccccuucagugcc

SEQ ID NO: 2087872 - RNA, 13 nt, Human
cacccccuucucu

SEQ ID NO: 2087873 - RNA, 17 nt, Human
cacccccuucagugccc

SEQ ID NO: 2087874 - RNA, 20 nt, Human
cacccccuucagugcccacc

SEQ ID NO: 2087875 - RNA, 21 nt, Human
cacccccuucagugcccacca

SEQ ID NO: 2087876 - RNA, 22 nt, Human
cacccccuucucugcccauucc

SEQ ID NO: 2087877 - RNA, 23 nt, Human
cacccccuucucugcccauuccc

SEQ ID NO: 2087878 - RNA, 16 nt, Human
cacccccuucucugcu

SEQ ID NO: 2087879 - RNA, 17 nt, Human
cacccccuucucugcuc

SEQ ID NO: 2087880 - RNA, 18 nt, Human
cacccccuucucugcucc

SEQ ID NO: 2087881 - RNA, 22 nt, Human
cacccccuucucugcuccacca

SEQ ID NO: 2087882 - RNA, 14 nt, Human
caccccuaaagaga

SEQ ID NO: 2087883 - RNA, 23 nt, Human
caccccgucugggguucagcccc

SEQ ID NO: 2087884 - RNA, 15 nt, Human
caccccgggcucucu

SEQ ID NO: 2087885 - RNA, 18 nt, Human
caccccgggcucucugcu

SEQ ID NO: 2087886 - RNA, 22 nt, Human
caccccgucugggguucagccc

SEQ ID NO: 2087887 - RNA, 14 nt, Human
ccaggcuggucuca

SEQ ID NO: 2087888 - RNA, 16 nt, Human
ccaggccccugccacc

SEQ ID NO: 2087889 - RNA, 15 nt, Human
ccaggccccugccac

SEQ ID NO: 2087890 - RNA, 14 nt, Human
ccaggccccugcca

SEQ ID NO: 2087891 - RNA, 12 nt, Human
ccaggccagagg

SEQ ID NO: 2087892 - RNA, 17 nt, Human
ccagcucuagacaaccc

SEQ ID NO: 2087893 - RNA, 18 nt, Human
ccagcucuagacaacccu

SEQ ID NO: 2087894 - RNA, 22 nt, Human
ccagcucuagacaacccugcaa

SEQ ID NO: 2087895 - RNA, 19 nt, Human
ccagcucuagacaacccug

SEQ ID NO: 2087896 - RNA, 21 nt, Human
ccagcucuagacaacccugca

SEQ ID NO: 2087897 - RNA, 15 nt, Human
ccaggaggcugaggu

SEQ ID NO: 2087898 - RNA, 16 nt, Human
ccaggaggcugaggug

SEQ ID NO: 2087899 - RNA, 23 nt, Human
ccagugcccacaggaucagucug

SEQ ID NO: 2087900 - RNA, 15 nt, Human
ccagggcccugagcu

SEQ ID NO: 2087901 - RNA, 18 nt, Human
ccagggcccugagcucgg

SEQ ID NO: 2087902 - RNA, 17 nt, Human
ccagggauggggccaca

SEQ ID NO: 2087903 - RNA, 18 nt, Human
ccagggauggggccacag

SEQ ID NO: 2087904 - RNA, 19 nt, Human
ccagggauggggccacagc

SEQ ID NO: 2087905 - RNA, 20 nt, Human
ccagggauggggccacagcc

SEQ ID NO: 2087906 - RNA, 21 nt, Human
ccagggauggggccacagcca

SEQ ID NO: 2087907 - RNA, 22 nt, Human
ccagggauggggccacagccag

SEQ ID NO: 2087908 - RNA, 22 nt, Human
ccagggauuuguccuuggggac

SEQ ID NO: 2087909 - RNA, 15 nt, Human
ccagggcaccaagcc

SEQ ID NO: 2087910 - RNA, 19 nt, Human
ccagggcaccaagcccaca

SEQ ID NO: 2087911 - RNA, 22 nt, Human
ccagggcaccaagcccacaggu

SEQ ID NO: 2087912 - RNA, 22 nt, Human
ccagggagcuugaaaguuuuca

SEQ ID NO: 2087913 - RNA, 18 nt, Human
ccagggagcggaaagcag

SEQ ID NO: 2087914 - RNA, 19 nt, Human
ccagggagcggaaagcagc

SEQ ID NO: 2087915 - RNA, 20 nt, Human
ccagggagcggaaagcagcu

SEQ ID NO: 2087916 - RNA, 23 nt, Human
ccagggagcggaaagcagcucaa

SEQ ID NO: 2087917 - RNA, 23 nt, Human
ccagggaugccaucugugggcac

SEQ ID NO: 2087918 - RNA, 14 nt, Human
ccagggucuucccu

SEQ ID NO: 2087919 - RNA, 23 nt, Human
ccagggucuucccuaccucaggc

SEQ ID NO: 2087920 - RNA, 14 nt, Human
ccagggcccugcag

SEQ ID NO: 2087921 - RNA, 15 nt, Human
ccagggcccugcaga

SEQ ID NO: 2087922 - RNA, 14 nt, Human
ccagguagaacaca

SEQ ID NO: 2087923 - RNA, 19 nt, Human
ccaggugcacagacguccc

SEQ ID NO: 2087924 - RNA, 13 nt, Human
ccaggugcacaga

SEQ ID NO: 2087925 - RNA, 16 nt, Human
ccaggugcacagacgu

SEQ ID NO: 2087926 - RNA, 21 nt, Human
ccagguggccacuccagaccc

SEQ ID NO: 2087927 - RNA, 16 nt, Human
ccagguggccacucca

SEQ ID NO: 2087928 - RNA, 22 nt, Human
ccaggugcaguggcucacgccu

SEQ ID NO: 2087929 - RNA, 14 nt, Human
ccaggugcaguggc

SEQ ID NO: 2087930 - RNA, 16 nt, Human
ccagguggcugaccca

SEQ ID NO: 2087931 - RNA, 17 nt, Human
ccagguggcugacccag

SEQ ID NO: 2087932 - RNA, 19 nt, Human
ccagguggcugacccaguc

SEQ ID NO: 2087933 - RNA, 20 nt, Human
ccagguggcugacccagucc

SEQ ID NO: 2087934 - RNA, 21 nt, Human
ccagguggcugacccaguccc

SEQ ID NO: 2087935 - RNA, 22 nt, Human
ccagguggcugacccagucccu

SEQ ID NO: 2087936 - RNA, 23 nt, Human
ccagguggcugacccagucccug

SEQ ID NO: 2087937 - RNA, 16 nt, Human
ccagguuucuaugugu

SEQ ID NO: 2087938 - RNA, 13 nt, Human
ccagguuuaagcu

SEQ ID NO: 2087939 - RNA, 24 nt, Human
ccaguaaaguguaacauaugcaaa

SEQ ID NO: 2087940 - RNA, 17 nt, Human
ccagugaccugaggaag

SEQ ID NO: 2087941 - RNA, 18 nt, Human
ccagugaccugaggaagc

SEQ ID NO: 2087942 - RNA, 19 nt, Human
ccagugaccugaggaagcg

SEQ ID NO: 2087943 - RNA, 16 nt, Human
ccagugaccaaccuuu

SEQ ID NO: 2087944 - RNA, 17 nt, Human
ccagugaccccugaccu

SEQ ID NO: 2087945 - RNA, 15 nt, Human
ccagugaccugagga

SEQ ID NO: 2087946 - RNA, 11 nt, Human
ccagugacacu

SEQ ID NO: 2087947 - RNA, 24 nt, Human
ccagugacacuucagagagcuggu

SEQ ID NO: 2087948 - RNA, 16 nt, Human
ccagugacacuucaga

SEQ ID NO: 2087949 - RNA, 19 nt, Human
ccagugacacuucagagag

SEQ ID NO: 2087950 - RNA, 20 nt, Human
ccagugacacuucagagagc

SEQ ID NO: 2087951 - RNA, 23 nt, Human
ccagugacacuucagagagcugg

SEQ ID NO: 2087952 - RNA, 24 nt, Human
ccaguggccucaacccucccucag

SEQ ID NO: 2087953 - RNA, 14 nt, Human
ccaguggccuggcu

SEQ ID NO: 2087954 - RNA, 15 nt, Human
ccaguggccuggcuc

SEQ ID NO: 2087955 - RNA, 16 nt, Human
ccaguggccuggcucc

SEQ ID NO: 2087956 - RNA, 16 nt, Human
ccaguggccucaaccc

SEQ ID NO: 2087957 - RNA, 17 nt, Human
ccaguggccucaacccu

SEQ ID NO: 2087958 - RNA, 23 nt, Human
ccaguggccucaacccucccuca

SEQ ID NO: 2087959 - RNA, 14 nt, Human
ccagugcacccacu

SEQ ID NO: 2087960 - RNA, 14 nt, Human
ccagugcaacacug

SEQ ID NO: 2087961 - RNA, 21 nt, Human
ccagugaugcuaaagguugua

SEQ ID NO: 2087962 - RNA, 19 nt, Human
ccagugauucgagcuauau

SEQ ID NO: 2087963 - RNA, 23 nt, Human
ccagugugacaaggauugcuacu

SEQ ID NO: 2087964 - RNA, 14 nt, Human
ccagugugacaagg

SEQ ID NO: 2087965 - RNA, 12 nt, Human
ccagugucuuuc

SEQ ID NO: 2087966 - RNA, 13 nt, Human
ccagugucuuucu

SEQ ID NO: 2087967 - RNA, 14 nt, Human
ccagugucuuucuu

SEQ ID NO: 2087968 - RNA, 15 nt, Human
ccagugucuuucuuu

SEQ ID NO: 2087969 - RNA, 16 nt, Human
ccagugucuuucuuug

SEQ ID NO: 2087970 - RNA, 15 nt, Human
ccagugugaucccaa

SEQ ID NO: 2087971 - RNA, 22 nt, Human
ccagugugaucccaagugccag

SEQ ID NO: 2087972 - RNA, 22 nt, Human
ccagugugggaaugcggcaaga

SEQ ID NO: 2087973 - RNA, 12 nt, Human
ccauaugugcuu

SEQ ID NO: 2087974 - RNA, 14 nt, Human
ccauauguuacacu

SEQ ID NO: 2087975 - RNA, 12 nt, Human
ccauaugcuguu

SEQ ID NO: 2087976 - RNA, 13 nt, Human
ccauauggauauu

SEQ ID NO: 2087977 - RNA, 13 nt, Human
ccaucaugucugg

SEQ ID NO: 2087978 - RNA, 12 nt, Human
ccaucaugucug

SEQ ID NO: 2087979 - RNA, 17 nt, Human
ccaucucucccuccccu

SEQ ID NO: 2087980 - RNA, 23 nt, Human
ccaucucucccuccccugccauu

SEQ ID NO: 2087981 - RNA, 20 nt, Human
ccaucuaugucccuugcugu

SEQ ID NO: 2087982 - RNA, 22 nt, Human
ccaucuaugucccuugcuguga

SEQ ID NO: 2087983 - RNA, 18 nt, Human
cccacaugaggacaugau

SEQ ID NO: 2087984 - RNA, 17 nt, Human
cccaccgguugcuucug

SEQ ID NO: 2087985 - RNA, 18 nt, Human
cccaccgguugcuucugg

SEQ ID NO: 2087986 - RNA, 19 nt, Human
cccaccgguugcuucuggg

SEQ ID NO: 2087987 - RNA, 20 nt, Human
cccaccgguugcuucuggga

SEQ ID NO: 2087988 - RNA, 23 nt, Human
cccaccgguugcuucugggaagg

SEQ ID NO: 2087989 - RNA, 22 nt, Human
cccaccguaaagugagcaugcu

SEQ ID NO: 2087990 - RNA, 15 nt, Human
cccaccucagccucc

SEQ ID NO: 2087991 - RNA, 14 nt, Human
cccaccucagccuc

SEQ ID NO: 2087992 - RNA, 12 nt, Human
cccaccucagcc

SEQ ID NO: 2087993 - RNA, 14 nt, Human
cccaccuaccuuca

SEQ ID NO: 2087994 - RNA, 20 nt, Human
cccaccuaccuucaaagcug

SEQ ID NO: 2087995 - RNA, 21 nt, Human
cccaccucaaaugggucuggg

SEQ ID NO: 2087996 - RNA, 21 nt, Human
cccaccucagccucccaaagu

SEQ ID NO: 2087997 - RNA, 12 nt, Human
cccaccuuggcu

SEQ ID NO: 2087998 - RNA, 22 nt, Human
cccaccugucaaacaaagccag

SEQ ID NO: 2087999 - RNA, 23 nt, Human
cccaccugucaaacaaagccaga

SEQ ID NO: 2088000 - RNA, 19 nt, Human
cccaccuucaauuccuggg

SEQ ID NO: 2088001 - RNA, 20 nt, Human
cccaccuucaauuccugggc

SEQ ID NO: 2088002 - RNA, 21 nt, Human
cccaccuucaauuccugggcc

SEQ ID NO: 2088003 - RNA, 20 nt, Human
cccaccugguggccucugcc

SEQ ID NO: 2088004 - RNA, 15 nt, Human
cccaccuuggcugca

SEQ ID NO: 2088005 - RNA, 14 nt, Human
cccaccuuggcugc

SEQ ID NO: 2088006 - RNA, 22 nt, Human
cccaccuuggcucaaguccucu

SEQ ID NO: 2088007 - RNA, 15 nt, Human
cccaccuuggcucaa

SEQ ID NO: 2088008 - RNA, 22 nt, Human
cccaccuucaauuccugggccc

SEQ ID NO: 2088009 - RNA, 22 nt, Human
cccacgcccucauuacggcucc

SEQ ID NO: 2088010 - RNA, 14 nt, Human
cccacgcuggagug

SEQ ID NO: 2088011 - RNA, 22 nt, Human
cccacggaaaaugccaaucucu

SEQ ID NO: 2088012 - RNA, 18 nt, Human
cccacaggcccuuccucu

SEQ ID NO: 2088013 - RNA, 16 nt, Human
cccacaggcccuuccu

SEQ ID NO: 2088014 - RNA, 22 nt, Human
cccacagguguccccagcccac

SEQ ID NO: 2088015 - RNA, 19 nt, Human
cccacauagugaugguucc

SEQ ID NO: 2088016 - RNA, 14 nt, Human
cccacagcccgcau

SEQ ID NO: 2088017 - RNA, 14 nt, Human
cccacagccucugc

SEQ ID NO: 2088018 - RNA, 17 nt, Human
cccacagccucugccug

SEQ ID NO: 2088019 - RNA, 18 nt, Human
cccacagccucugccugu

SEQ ID NO: 2088020 - RNA, 13 nt, Human
cccacaggaucag

SEQ ID NO: 2088021 - RNA, 17 nt, Human
cccacaggaucagucug

SEQ ID NO: 2088022 - RNA, 17 nt, Human
cccaagggguuucuguu

SEQ ID NO: 2088023 - RNA, 15 nt, Human
cccaaggggcagucu

SEQ ID NO: 2088024 - RNA, 21 nt, Human
cccaaggggcagucuggaggg

SEQ ID NO: 2088025 - RNA, 21 nt, Human
cccaaguccaggucgggcuca

SEQ ID NO: 2088026 - RNA, 13 nt, Human
cccacagaaagag

SEQ ID NO: 2088027 - RNA, 16 nt, Human
cccacagaaagagagc

SEQ ID NO: 2088028 - RNA, 23 nt, Human
cccacagaaagacugagcucaag

SEQ ID NO: 2088029 - RNA, 19 nt, Human
cccacacuuguuccagcuc

SEQ ID NO: 2088030 - RNA, 12 nt, Human
cccacagaaaga

SEQ ID NO: 2088031 - RNA, 21 nt, Human
cccacagaaagacugagcuca

SEQ ID NO: 2088032 - RNA, 17 nt, Human
cccacacuuguuccagc

SEQ ID NO: 2088033 - RNA, 15 nt, Human
cccaagugccagucu

SEQ ID NO: 2088034 - RNA, 18 nt, Human
cccaagugccagucuugu

SEQ ID NO: 2088035 - RNA, 14 nt, Human
cccaagugggggca

SEQ ID NO: 2088036 - RNA, 19 nt, Human
cccaagugggggcagaggg

SEQ ID NO: 2088037 - RNA, 14 nt, Human
ccauuuucugguuc

SEQ ID NO: 2088038 - RNA, 14 nt, Human
ccauuuugcaaaau

SEQ ID NO: 2088039 - RNA, 17 nt, Human
ccauuuugcaaaauuuc

SEQ ID NO: 2088040 - RNA, 21 nt, Human
ccauuuugcaaaauuuccagu

SEQ ID NO: 2088041 - RNA, 16 nt, Human
ccauuuugcccuucca

SEQ ID NO: 2088042 - RNA, 19 nt, Human
ccauuuugcccuuccauag

SEQ ID NO: 2088043 - RNA, 12 nt, Human
cccaacccccac

SEQ ID NO: 2088044 - RNA, 13 nt, Human
cccaacccccacc

SEQ ID NO: 2088045 - RNA, 14 nt, Human
cccaacccccaccc

SEQ ID NO: 2088046 - RNA, 18 nt, Human
ccaucucugaacuucagc

SEQ ID NO: 2088047 - RNA, 19 nt, Human
ccaucucugaacuucagcu

SEQ ID NO: 2088048 - RNA, 20 nt, Human
ccaucucucuacuccuaccu

SEQ ID NO: 2088049 - RNA, 22 nt, Human
ccaucugugggcacgcuguggg

SEQ ID NO: 2088050 - RNA, 11 nt, Human
ccaugugugag

SEQ ID NO: 2088051 - RNA, 17 nt, Human
ccaugugugagugugug

SEQ ID NO: 2088052 - RNA, 18 nt, Human
ccaugugugagugugugc

SEQ ID NO: 2088053 - RNA, 15 nt, Human
ccauguguggacuca

SEQ ID NO: 2088054 - RNA, 10 nt, Human
ccaugugugu

SEQ ID NO: 2088055 - RNA, 12 nt, Human
ccaugugugugc

SEQ ID NO: 2088056 - RNA, 21 nt, Human
ccaucuugcccgcucaggcug

SEQ ID NO: 2088057 - RNA, 13 nt, Human
ccaucuugccucc

SEQ ID NO: 2088058 - RNA, 19 nt, Human
ccaucuugcccgcucaggc

SEQ ID NO: 2088059 - RNA, 15 nt, Human
ccaucuguguccugg

SEQ ID NO: 2088060 - RNA, 15 nt, Human
ccauuaaaguucuca

SEQ ID NO: 2088061 - RNA, 23 nt, Human
ccauuaaccagggcaccaagccc

SEQ ID NO: 2088062 - RNA, 14 nt, Human
ccauuaccauggag

SEQ ID NO: 2088063 - RNA, 18 nt, Human
ccauguuuuguuuacggu

SEQ ID NO: 2088064 - RNA, 18 nt, Human
ccauguuaguuuuuacuu

SEQ ID NO: 2088065 - RNA, 19 nt, Human
ccaugugugugcaagugug

SEQ ID NO: 2088066 - RNA, 20 nt, Human
ccauucugccuccauucuga

SEQ ID NO: 2088067 - RNA, 15 nt, Human
ccauuucucucucca

SEQ ID NO: 2088068 - RNA, 15 nt, Human
ccauucugccugccc

SEQ ID NO: 2088069 - RNA, 17 nt, Human
ccauucugaccauuuca

SEQ ID NO: 2088070 - RNA, 12 nt, Human
ccauuuguuuau

SEQ ID NO: 2088071 - RNA, 13 nt, Human
ccauuuguuuauu

SEQ ID NO: 2088072 - RNA, 17 nt, Human
ccauuaugaagaagaga

SEQ ID NO: 2088073 - RNA, 16 nt, Human
ccauuagagucagccu

SEQ ID NO: 2088074 - RNA, 18 nt, Human
ccauucucaagcccugca

SEQ ID NO: 2088075 - RNA, 17 nt, Human
ccauucucaagcccugc

SEQ ID NO: 2088076 - RNA, 14 nt, Human
ccauucucucuccu

SEQ ID NO: 2088077 - RNA, 16 nt, Human
ccauucucucuccugu

SEQ ID NO: 2088078 - RNA, 19 nt, Human
ccauucucucuccugucca

SEQ ID NO: 2088079 - RNA, 20 nt, Human
ccauucucucuccuguccaa

SEQ ID NO: 2088080 - RNA, 16 nt, Human
ccauucugaccauuuc

SEQ ID NO: 2088081 - RNA, 23 nt, Human
cccaagugggggcagagggcaga

SEQ ID NO: 2088082 - RNA, 20 nt, Human
ccagagccucaaaugagaaa

SEQ ID NO: 2088083 - RNA, 23 nt, Human
ccagagccucaaaugagaaaaug

SEQ ID NO: 2088084 - RNA, 14 nt, Human
ccagagccccacac

SEQ ID NO: 2088085 - RNA, 18 nt, Human
ccagagccccacacggag

SEQ ID NO: 2088086 - RNA, 19 nt, Human
ccagagccccacacggagg

SEQ ID NO: 2088087 - RNA, 14 nt, Human
ccagagcccaccuu

SEQ ID NO: 2088088 - RNA, 21 nt, Human
ccagagccauggacucuacac

SEQ ID NO: 2088089 - RNA, 13 nt, Human
ccagagccaugga

SEQ ID NO: 2088090 - RNA, 15 nt, Human
ccagagccauggacu

SEQ ID NO: 2088091 - RNA, 16 nt, Human
ccagauugcaacaggc

SEQ ID NO: 2088092 - RNA, 14 nt, Human
ccagauugcaacag

SEQ ID NO: 2088093 - RNA, 22 nt, Human
ccagauugcaacaggcugggcu

SEQ ID NO: 2088094 - RNA, 18 nt, Human
ccagauugcaacaggcug

SEQ ID NO: 2088095 - RNA, 23 nt, Human
ccagauugcaacaggcugggcuu

SEQ ID NO: 2088096 - RNA, 14 nt, Human
ccagcacccagcaa

SEQ ID NO: 2088097 - RNA, 13 nt, Human
ccagcacccccac

SEQ ID NO: 2088098 - RNA, 15 nt, Human
ccagcacccccacgc

SEQ ID NO: 2088099 - RNA, 16 nt, Human
ccagcacccccacgcc

SEQ ID NO: 2088100 - RNA, 18 nt, Human
ccagcacccccacgcccu

SEQ ID NO: 2088101 - RNA, 20 nt, Human
ccagcacccccacgcccuca

SEQ ID NO: 2088102 - RNA, 18 nt, Human
ccagcacccagcaacucc

SEQ ID NO: 2088103 - RNA, 17 nt, Human
ccagcacuaaagcagug

SEQ ID NO: 2088104 - RNA, 19 nt, Human
ccagcaagugagagcuggg

SEQ ID NO: 2088105 - RNA, 18 nt, Human
ccagcaagugagagcugg

SEQ ID NO: 2088106 - RNA, 17 nt, Human
ccagcaagugagagcug

SEQ ID NO: 2088107 - RNA, 17 nt, Human
ccagcaccaccaggucu

SEQ ID NO: 2088108 - RNA, 18 nt, Human
ccagcaccaccaggucuc

SEQ ID NO: 2088109 - RNA, 19 nt, Human
ccagcaccaccaggucucc

SEQ ID NO: 2088110 - RNA, 23 nt, Human
ccagcaccaccaggucucccggg

SEQ ID NO: 2088111 - RNA, 17 nt, Human
ccagcaacccuccuauc

SEQ ID NO: 2088112 - RNA, 15 nt, Human
ccagcaacccuccua

SEQ ID NO: 2088113 - RNA, 18 nt, Human
ccagcaacccuccuauca

SEQ ID NO: 2088114 - RNA, 24 nt, Human
ccagauuuuuuacagcugccugca

SEQ ID NO: 2088115 - RNA, 23 nt, Human
ccagauuugaagacaaaaauacu

SEQ ID NO: 2088116 - RNA, 12 nt, Human
ccagcccacugg

SEQ ID NO: 2088117 - RNA, 20 nt, Human
ccagccgccauugccaccag

SEQ ID NO: 2088118 - RNA, 23 nt, Human
ccagccgccauugccaccaggag

SEQ ID NO: 2088119 - RNA, 22 nt, Human
ccagcccauucucucuccuguc

SEQ ID NO: 2088120 - RNA, 17 nt, Human
ccagcccauucucucuc

SEQ ID NO: 2088121 - RNA, 19 nt, Human
ccagcccauucucucuccu

SEQ ID NO: 2088122 - RNA, 21 nt, Human
ccagcccauucucucuccugu

SEQ ID NO: 2088123 - RNA, 18 nt, Human
ccagcccagcccagcugg

SEQ ID NO: 2088124 - RNA, 12 nt, Human
ccagcccagggu

SEQ ID NO: 2088125 - RNA, 18 nt, Human
ccagcccaucuugccucc

SEQ ID NO: 2088126 - RNA, 19 nt, Human
ccagcccaucuugccucca

SEQ ID NO: 2088127 - RNA, 22 nt, Human
ccagcccaucuugccuccaugg

SEQ ID NO: 2088128 - RNA, 18 nt, Human
ccagcccaggguuccccc

SEQ ID NO: 2088129 - RNA, 21 nt, Human
ccagcccaggguucccccagc

SEQ ID NO: 2088130 - RNA, 17 nt, Human
ccagcccacuucugcca

SEQ ID NO: 2088131 - RNA, 16 nt, Human
ccagcccacuucugcc

SEQ ID NO: 2088132 - RNA, 12 nt, Human
ccagcccagccc

SEQ ID NO: 2088133 - RNA, 14 nt, Human
ccagcccagcccag

SEQ ID NO: 2088134 - RNA, 12 nt, Human
ccagcccagcug

SEQ ID NO: 2088135 - RNA, 14 nt, Human
ccagcccagcugcu

SEQ ID NO: 2088136 - RNA, 16 nt, Human
ccagcccagcugcucu

SEQ ID NO: 2088137 - RNA, 17 nt, Human
ccagcccagcugcucug

SEQ ID NO: 2088138 - RNA, 18 nt, Human
ccagcccagcugcucugc

SEQ ID NO: 2088139 - RNA, 19 nt, Human
ccagcccagcugcucugcc

SEQ ID NO: 2088140 - RNA, 22 nt, Human
ccagcccagcugcucugcccag

SEQ ID NO: 2088141 - RNA, 23 nt, Human
ccagcccagcugcucugcccaga

SEQ ID NO: 2088142 - RNA, 13 nt, Human
ccagcccagcugg

SEQ ID NO: 2088143 - RNA, 15 nt, Human
ccagcccagcccagc

SEQ ID NO: 2088144 - RNA, 16 nt, Human
ccagcccagcccagcu

SEQ ID NO: 2088145 - RNA, 21 nt, Human
ccagccauuaccauggagaca

SEQ ID NO: 2088146 - RNA, 19 nt, Human
ccagccauuaccauggaga

SEQ ID NO: 2088147 - RNA, 13 nt, Human
ccagcgagcccug

SEQ ID NO: 2088148 - RNA, 20 nt, Human
ccagccuuugaucagguggg

SEQ ID NO: 2088149 - RNA, 15 nt, Human
ccagccuuucuccca

SEQ ID NO: 2088150 - RNA, 18 nt, Human
ccagccuuucucccaggc

SEQ ID NO: 2088151 - RNA, 19 nt, Human
ccagccuuucucccaggcc

SEQ ID NO: 2088152 - RNA, 20 nt, Human
ccagccuuucucccaggcca

SEQ ID NO: 2088153 - RNA, 21 nt, Human
ccagccuuucucccaggccag

SEQ ID NO: 2088154 - RNA, 16 nt, Human
ccagccugggcgacag

SEQ ID NO: 2088155 - RNA, 21 nt, Human
ccagccuggcuucuggagccc

SEQ ID NO: 2088156 - RNA, 19 nt, Human
ccagccuggcuucuggagc

SEQ ID NO: 2088157 - RNA, 20 nt, Human
ccagccuggcuucuggagcc

SEQ ID NO: 2088158 - RNA, 13 nt, Human
ccagccuggcuuc

SEQ ID NO: 2088159 - RNA, 15 nt, Human
ccagccuggcuucug

SEQ ID NO: 2088160 - RNA, 17 nt, Human
ccagccuggcuucugga

SEQ ID NO: 2088161 - RNA, 18 nt, Human
ccagccuggcuucuggag

SEQ ID NO: 2088162 - RNA, 19 nt, Human
ccagccugggcaacagagc

SEQ ID NO: 2088163 - RNA, 16 nt, Human
ccagccugggcagcca

SEQ ID NO: 2088164 - RNA, 18 nt, Human
ccagccugggcagccagg

SEQ ID NO: 2088165 - RNA, 22 nt, Human
ccagccugggcagccaggcugc

SEQ ID NO: 2088166 - RNA, 23 nt, Human
ccagccugggcagccaggcugcc

SEQ ID NO: 2088167 - RNA, 13 nt, Human
ccagccuggguga

SEQ ID NO: 2088168 - RNA, 19 nt, Human
ccagccugggcgacagagc

SEQ ID NO: 2088169 - RNA, 17 nt, Human
ccagccuaagaugaaga

SEQ ID NO: 2088170 - RNA, 16 nt, Human
ccacuuaaaaaauguc

SEQ ID NO: 2088171 - RNA, 14 nt, Human
ccacuguuuauuca

SEQ ID NO: 2088172 - RNA, 16 nt, Human
ccacugugccaugugc

SEQ ID NO: 2088173 - RNA, 15 nt, Human
ccacugugccaugug

SEQ ID NO: 2088174 - RNA, 19 nt, Human
ccacugugccaugugccag

SEQ ID NO: 2088175 - RNA, 14 nt, Human
ccagaaccccgagc

SEQ ID NO: 2088176 - RNA, 14 nt, Human
ccagaaccuguccu

SEQ ID NO: 2088177 - RNA, 15 nt, Human
ccagaaaaccccagc

SEQ ID NO: 2088178 - RNA, 16 nt, Human
ccagaaaaccccagca

SEQ ID NO: 2088179 - RNA, 12 nt, Human
ccagaacuggac

SEQ ID NO: 2088180 - RNA, 15 nt, Human
ccagaaccuguccuu

SEQ ID NO: 2088181 - RNA, 22 nt, Human
ccacugcuuuuggucuguguga

SEQ ID NO: 2088182 - RNA, 21 nt, Human
ccacugccuucgauacaccgg

SEQ ID NO: 2088183 - RNA, 20 nt, Human
ccacugcuuuuggucugugu

SEQ ID NO: 2088184 - RNA, 15 nt, Human
ccacugcucugguua

SEQ ID NO: 2088185 - RNA, 13 nt, Human
ccacugcucuggu

SEQ ID NO: 2088186 - RNA, 12 nt, Human
ccacugcucugg

SEQ ID NO: 2088187 - RNA, 11 nt, Human
ccacugcucug

SEQ ID NO: 2088188 - RNA, 14 nt, Human
ccacugugaagaga

SEQ ID NO: 2088189 - RNA, 15 nt, Human
ccacugugaagagaa

SEQ ID NO: 2088190 - RNA, 23 nt, Human
ccacugucacuguuucucugcug

SEQ ID NO: 2088191 - RNA, 24 nt, Human
ccacugucacuguuucucugcugu

SEQ ID NO: 2088192 - RNA, 14 nt, Human
ccacuguaaaauga

SEQ ID NO: 2088193 - RNA, 19 nt, Human
ccacugucacuguuucucu

SEQ ID NO: 2088194 - RNA, 22 nt, Human
ccacugucacuguuucucugcu

SEQ ID NO: 2088195 - RNA, 16 nt, Human
ccacugccucuuccuc

SEQ ID NO: 2088196 - RNA, 20 nt, Human
ccacugccucuggaauugcu

SEQ ID NO: 2088197 - RNA, 11 nt, Human
ccacugccugc

SEQ ID NO: 2088198 - RNA, 12 nt, Human
ccacugccugcc

SEQ ID NO: 2088199 - RNA, 17 nt, Human
ccacugccugcccaccc

SEQ ID NO: 2088200 - RNA, 23 nt, Human
ccacugccugcccacccguggag

SEQ ID NO: 2088201 - RNA, 13 nt, Human
ccacugccugccc

SEQ ID NO: 2088202 - RNA, 14 nt, Human
ccacugccugccca

SEQ ID NO: 2088203 - RNA, 15 nt, Human
ccacugccugcccac

SEQ ID NO: 2088204 - RNA, 16 nt, Human
ccacugccugcccacc

SEQ ID NO: 2088205 - RNA, 13 nt, Human
ccacugccucuuc

SEQ ID NO: 2088206 - RNA, 19 nt, Human
ccacugcauaccaaccugg

SEQ ID NO: 2088207 - RNA, 23 nt, Human
ccacugccacacgucugacccuc

SEQ ID NO: 2088208 - RNA, 14 nt, Human
ccaccuucccaugc

SEQ ID NO: 2088209 - RNA, 18 nt, Human
ccacugcauaccaaccug

SEQ ID NO: 2088210 - RNA, 21 nt, Human
ccaccuucccagcucucccuc

SEQ ID NO: 2088211 - RNA, 11 nt, Human
ccaccuuccca

SEQ ID NO: 2088212 - RNA, 12 nt, Human
ccaccuucccag

SEQ ID NO: 2088213 - RNA, 13 nt, Human
ccaccuucccagc

SEQ ID NO: 2088214 - RNA, 14 nt, Human
ccaccuucccagcu

SEQ ID NO: 2088215 - RNA, 15 nt, Human
ccaccuucccagcuc

SEQ ID NO: 2088216 - RNA, 16 nt, Human
ccaccuucccagcucu

SEQ ID NO: 2088217 - RNA, 19 nt, Human
ccaccuucccagcucuccc

SEQ ID NO: 2088218 - RNA, 21 nt, Human
ccacugcaucguuucaucuuc

SEQ ID NO: 2088219 - RNA, 23 nt, Human
ccacugcaucguuucaucuucca

SEQ ID NO: 2088220 - RNA, 15 nt, Human
ccagaagggggccau

SEQ ID NO: 2088221 - RNA, 12 nt, Human
ccagaaggcagg

SEQ ID NO: 2088222 - RNA, 20 nt, Human
ccagaagcugagcaccaggg

SEQ ID NO: 2088223 - RNA, 15 nt, Human
ccagaagccucuggc

SEQ ID NO: 2088224 - RNA, 16 nt, Human
ccagaagccucuggcu

SEQ ID NO: 2088225 - RNA, 19 nt, Human
ccagaagccucuggcuaga

SEQ ID NO: 2088226 - RNA, 20 nt, Human
ccagaagccucuggcuagag

SEQ ID NO: 2088227 - RNA, 18 nt, Human
ccagaccccuggcuuuuc

SEQ ID NO: 2088228 - RNA, 24 nt, Human
ccagaccccuggcuuuucacugcu

SEQ ID NO: 2088229 - RNA, 20 nt, Human
ccagaaacaccuagaucaga

SEQ ID NO: 2088230 - RNA, 13 nt, Human
ccagaccagagcu

SEQ ID NO: 2088231 - RNA, 14 nt, Human
ccagaccagagcuc

SEQ ID NO: 2088232 - RNA, 16 nt, Human
ccagaccagagcucug

SEQ ID NO: 2088233 - RNA, 17 nt, Human
ccagaccagagcucugg

SEQ ID NO: 2088234 - RNA, 19 nt, Human
ccagacauguggugggaca

SEQ ID NO: 2088235 - RNA, 23 nt, Human
ccagacauguggugggacaggga

SEQ ID NO: 2088236 - RNA, 13 nt, Human
ccagacagcuccc

SEQ ID NO: 2088237 - RNA, 20 nt, Human
ccagacagcucccucugccu

SEQ ID NO: 2088238 - RNA, 15 nt, Human
ccagacccggcugcg

SEQ ID NO: 2088239 - RNA, 14 nt, Human
ccagacccggcugc

SEQ ID NO: 2088240 - RNA, 16 nt, Human
ccagagaguggcuccu

SEQ ID NO: 2088241 - RNA, 15 nt, Human
ccagagaguggcucc

SEQ ID NO: 2088242 - RNA, 14 nt, Human
ccagagaguggcuc

SEQ ID NO: 2088243 - RNA, 22 nt, Human
ccagagaguggcuccucccggu

SEQ ID NO: 2088244 - RNA, 18 nt, Human
ccagagaguggcuccucc

SEQ ID NO: 2088245 - RNA, 12 nt, Human
ccacccugcucu

SEQ ID NO: 2088246 - RNA, 11 nt, Human
ccacccugcuc

SEQ ID NO: 2088247 - RNA, 15 nt, Human
ccaccucucuuuuuc

SEQ ID NO: 2088248 - RNA, 14 nt, Human
ccaccuggggcagu

SEQ ID NO: 2088249 - RNA, 20 nt, Human
ccaccuggggcagucaccug

SEQ ID NO: 2088250 - RNA, 15 nt, Human
ccaccuggggcaguc

SEQ ID NO: 2088251 - RNA, 16 nt, Human
ccaccuggggcaguca

SEQ ID NO: 2088252 - RNA, 14 nt, Human
ccaccuuaaauuaa

SEQ ID NO: 2088253 - RNA, 15 nt, Human
ccaccuuaaauuaaa

SEQ ID NO: 2088254 - RNA, 16 nt, Human
ccaccuuaaauuaaac

SEQ ID NO: 2088255 - RNA, 18 nt, Human
ccaccuuaaauuaaacaa

SEQ ID NO: 2088256 - RNA, 20 nt, Human
ccaccuuaaauuaaacaauu

SEQ ID NO: 2088257 - RNA, 22 nt, Human
ccaccuuaaauuaaacaauuua

SEQ ID NO: 2088258 - RNA, 17 nt, Human
ccaccuucaauuccugg

SEQ ID NO: 2088259 - RNA, 18 nt, Human
ccaccuucaauuccuggg

SEQ ID NO: 2088260 - RNA, 19 nt, Human
ccaccuucaauuccugggc

SEQ ID NO: 2088261 - RNA, 20 nt, Human
ccaccuucaauuccugggcc

SEQ ID NO: 2088262 - RNA, 21 nt, Human
ccaccuggccccaugucucuc

SEQ ID NO: 2088263 - RNA, 22 nt, Human
ccaccuggccccaugucucuca

SEQ ID NO: 2088264 - RNA, 12 nt, Human
ccaccuggcccc

SEQ ID NO: 2088265 - RNA, 14 nt, Human
ccaccuggaagccc

SEQ ID NO: 2088266 - RNA, 20 nt, Human
ccaccuggaagcccucucug

SEQ ID NO: 2088267 - RNA, 22 nt, Human
ccaccugcugagagacccaagg

SEQ ID NO: 2088268 - RNA, 23 nt, Human
ccaccugcugagagacccaagga

SEQ ID NO: 2088269 - RNA, 15 nt, Human
ccaccugcugagaga

SEQ ID NO: 2088270 - RNA, 14 nt, Human
ccacccuccuuuca

SEQ ID NO: 2088271 - RNA, 15 nt, Human
ccaccccuccuuccu

SEQ ID NO: 2088272 - RNA, 16 nt, Human
ccaccccuccuuccuu

SEQ ID NO: 2088273 - RNA, 13 nt, Human
ccaccccuucccc

SEQ ID NO: 2088274 - RNA, 15 nt, Human
ccaccccuuccccac

SEQ ID NO: 2088275 - RNA, 16 nt, Human
ccaccccuuccccacu

SEQ ID NO: 2088276 - RNA, 22 nt, Human
ccaccccccagaaccuguccuu

SEQ ID NO: 2088277 - RNA, 21 nt, Human
ccaccccccagaaccuguccu

SEQ ID NO: 2088278 - RNA, 13 nt, Human
ccaccccccucau

SEQ ID NO: 2088279 - RNA, 16 nt, Human
ccacccccuccccagg

SEQ ID NO: 2088280 - RNA, 17 nt, Human
ccacccccuccccaggg

SEQ ID NO: 2088281 - RNA, 18 nt, Human
ccacccccuccccagggg

SEQ ID NO: 2088282 - RNA, 19 nt, Human
ccacccccuccccagggga

SEQ ID NO: 2088283 - RNA, 22 nt, Human
ccacccccucccuggccuguuc

SEQ ID NO: 2088284 - RNA, 12 nt, Human
ccacccccuuca

SEQ ID NO: 2088285 - RNA, 17 nt, Human
ccacccccuucagugcc

SEQ ID NO: 2088286 - RNA, 18 nt, Human
ccacccccuucagugccc

SEQ ID NO: 2088287 - RNA, 20 nt, Human
ccacccccuucagugcccac

SEQ ID NO: 2088288 - RNA, 22 nt, Human
ccacccccuucagugcccacca

SEQ ID NO: 2088289 - RNA, 13 nt, Human
ccacccccuucuc

SEQ ID NO: 2088290 - RNA, 18 nt, Human
ccacccccuucucugcuc

SEQ ID NO: 2088291 - RNA, 19 nt, Human
ccacccccuucucugcucc

SEQ ID NO: 2088292 - RNA, 13 nt, Human
ccaccuuggcuca

SEQ ID NO: 2088293 - RNA, 16 nt, Human
ccuacaguguacaguc

SEQ ID NO: 2088294 - RNA, 20 nt, Human
ccuacaguguacagucuugu

SEQ ID NO: 2088295 - RNA, 21 nt, Human
ccuacaguugaaaaacagcug

SEQ ID NO: 2088296 - RNA, 17 nt, Human
ccuaccgagucucuucu

SEQ ID NO: 2088297 - RNA, 16 nt, Human
ccuaccgagucucuuc

SEQ ID NO: 2088298 - RNA, 15 nt, Human
ccuacaguggcuguc

SEQ ID NO: 2088299 - RNA, 17 nt, Human
ccuaacauucgaucuca

SEQ ID NO: 2088300 - RNA, 20 nt, Human
ccuaccgagucucuucucca

SEQ ID NO: 2088301 - RNA, 19 nt, Human
ccuaccgagucucuucucc

SEQ ID NO: 2088302 - RNA, 21 nt, Human
ccuaccgagucucuucuccac

SEQ ID NO: 2088303 - RNA, 20 nt, Human
ccuacgucaaacaugaagug

SEQ ID NO: 2088304 - RNA, 20 nt, Human
ccuacuacaucgcccuccac

SEQ ID NO: 2088305 - RNA, 17 nt, Human
ccuacuagggaccuggg

SEQ ID NO: 2088306 - RNA, 20 nt, Human
ccuacuagggaccuggggaa

SEQ ID NO: 2088307 - RNA, 21 nt, Human
ccuacgucaaacaugaagugu

SEQ ID NO: 2088308 - RNA, 17 nt, Human
ccuacuacaucgcccuc

SEQ ID NO: 2088309 - RNA, 18 nt, Human
ccuacuacaucgcccucc

SEQ ID NO: 2088310 - RNA, 14 nt, Human
ccuagucagccaca

SEQ ID NO: 2088311 - RNA, 16 nt, Human
ccuagucagccacaug

SEQ ID NO: 2088312 - RNA, 18 nt, Human
ccuaggugacagagugag

SEQ ID NO: 2088313 - RNA, 13 nt, Human
ccuaggccuggca

SEQ ID NO: 2088314 - RNA, 23 nt, Human
ccuaggcauuugcugaauacaga

SEQ ID NO: 2088315 - RNA, 23 nt, Human
ccuaggccacaccaucuccuuuc

SEQ ID NO: 2088316 - RNA, 13 nt, Human
ccuacugaaugcu

SEQ ID NO: 2088317 - RNA, 14 nt, Human
ccuaggccacuccu

SEQ ID NO: 2088318 - RNA, 15 nt, Human
ccuaggccacuccuc

SEQ ID NO: 2088319 - RNA, 16 nt, Human
ccuaggccacuccucc

SEQ ID NO: 2088320 - RNA, 17 nt, Human
ccuaggccacuccucca

SEQ ID NO: 2088321 - RNA, 18 nt, Human
ccuaggccacuccuccaa

SEQ ID NO: 2088322 - RNA, 19 nt, Human
ccuaggccacuccuccaaa

SEQ ID NO: 2088323 - RNA, 20 nt, Human
ccuaggccacuccuccaaag

SEQ ID NO: 2088324 - RNA, 15 nt, Human
ccuacaguguacagu

SEQ ID NO: 2088325 - RNA, 18 nt, Human
ccuacaggagugagcacu

SEQ ID NO: 2088326 - RNA, 23 nt, Human
ccguuggaaacauaaccauuaca

SEQ ID NO: 2088327 - RNA, 20 nt, Human
ccguuggggauuggggaaga

SEQ ID NO: 2088328 - RNA, 15 nt, Human
ccuaaccccuuuccu

SEQ ID NO: 2088329 - RNA, 12 nt, Human
ccuaaccccuuu

SEQ ID NO: 2088330 - RNA, 11 nt, Human
ccguggcuucc

SEQ ID NO: 2088331 - RNA, 14 nt, Human
ccguggcugcggca

SEQ ID NO: 2088332 - RNA, 23 nt, Human
ccgugauguaggguaaggugccu

SEQ ID NO: 2088333 - RNA, 13 nt, Human
ccgugcagacugg

SEQ ID NO: 2088334 - RNA, 14 nt, Human
ccgugcagacugga

SEQ ID NO: 2088335 - RNA, 17 nt, Human
ccgugcagacuggaggg

SEQ ID NO: 2088336 - RNA, 19 nt, Human
ccgugcagacuggagggga

SEQ ID NO: 2088337 - RNA, 14 nt, Human
ccguggcuucccgc

SEQ ID NO: 2088338 - RNA, 23 nt, Human
ccgacggugggcauuugugaggc

SEQ ID NO: 2088339 - RNA, 23 nt, Human
ccgaccucguccucccccugcca

SEQ ID NO: 2088340 - RNA, 21 nt, Human
ccgagauugcaccacugcacu

SEQ ID NO: 2088341 - RNA, 11 nt, Human
ccgagcugggg

SEQ ID NO: 2088342 - RNA, 16 nt, Human
ccgagcugggggccau

SEQ ID NO: 2088343 - RNA, 18 nt, Human
ccgagcugggggccauga

SEQ ID NO: 2088344 - RNA, 19 nt, Human
ccgagcugggggccaugag

SEQ ID NO: 2088345 - RNA, 21 nt, Human
ccgagcugggggccaugagcu

SEQ ID NO: 2088346 - RNA, 15 nt, Human
ccgagauugcaccac

SEQ ID NO: 2088347 - RNA, 19 nt, Human
ccgagauugcaccacugca

SEQ ID NO: 2088348 - RNA, 21 nt, Human
ccgagaucacgccacugcacu

SEQ ID NO: 2088349 - RNA, 16 nt, Human
ccgagaguagccgaga

SEQ ID NO: 2088350 - RNA, 20 nt, Human
ccgagaguagccgagagccu

SEQ ID NO: 2088351 - RNA, 21 nt, Human
ccgagaguagccgagagccug

SEQ ID NO: 2088352 - RNA, 22 nt, Human
ccgagaguagccgagagccugc

SEQ ID NO: 2088353 - RNA, 14 nt, Human
ccgagagccugcuc

SEQ ID NO: 2088354 - RNA, 15 nt, Human
ccgagagccugcucc

SEQ ID NO: 2088355 - RNA, 20 nt, Human
ccgagagccugcucccccac

SEQ ID NO: 2088356 - RNA, 19 nt, Human
ccgagcuuugaaaauucag

SEQ ID NO: 2088357 - RNA, 14 nt, Human
ccgaggaaacucag

SEQ ID NO: 2088358 - RNA, 16 nt, Human
ccgagcuggugcauua

SEQ ID NO: 2088359 - RNA, 17 nt, Human
ccgagcuggugcauuac

SEQ ID NO: 2088360 - RNA, 20 nt, Human
ccgagcuggugcauuacaga

SEQ ID NO: 2088361 - RNA, 19 nt, Human
ccgaggguccuggcuccug

SEQ ID NO: 2088362 - RNA, 21 nt, Human
ccgaggguccuggcuccugag

SEQ ID NO: 2088363 - RNA, 23 nt, Human
ccgaggguccuggcuccugaggg

SEQ ID NO: 2088364 - RNA, 16 nt, Human
ccgagguggcugccug

SEQ ID NO: 2088365 - RNA, 21 nt, Human
ccgagguggcugccuggagcc

SEQ ID NO: 2088366 - RNA, 18 nt, Human
ccgagucucuucuccacu

SEQ ID NO: 2088367 - RNA, 16 nt, Human
ccgagucucuucucca

SEQ ID NO: 2088368 - RNA, 14 nt, Human
ccgagucucuucuc

SEQ ID NO: 2088369 - RNA, 16 nt, Human
ccgaguagcugggacu

SEQ ID NO: 2088370 - RNA, 14 nt, Human
ccgaguagcuggga

SEQ ID NO: 2088371 - RNA, 18 nt, Human
ccgccggccagcugggau

SEQ ID NO: 2088372 - RNA, 14 nt, Human
ccgccucccagccu

SEQ ID NO: 2088373 - RNA, 20 nt, Human
ccgagucucuucuccacugg

SEQ ID NO: 2088374 - RNA, 19 nt, Human
ccgagucucuucuccacug

SEQ ID NO: 2088375 - RNA, 13 nt, Human
ccgggccacagag

SEQ ID NO: 2088376 - RNA, 22 nt, Human
ccgggcaugguggcgcaagccu

SEQ ID NO: 2088377 - RNA, 16 nt, Human
ccggcucuggcucucc

SEQ ID NO: 2088378 - RNA, 22 nt, Human
ccgggcacucagaagacacuga

SEQ ID NO: 2088379 - RNA, 21 nt, Human
ccggcuccaggcuccuuuagc

SEQ ID NO: 2088380 - RNA, 16 nt, Human
ccggcuccaggcuccu

SEQ ID NO: 2088381 - RNA, 23 nt, Human
ccggcucgagcaguccugccuca

SEQ ID NO: 2088382 - RNA, 19 nt, Human
ccggggcuggcggcuacuc

SEQ ID NO: 2088383 - RNA, 14 nt, Human
ccggaggggccugg

SEQ ID NO: 2088384 - RNA, 15 nt, Human
ccggagcuuucaaag

SEQ ID NO: 2088385 - RNA, 21 nt, Human
ccggagcuuucaaagaaggaa

SEQ ID NO: 2088386 - RNA, 16 nt, Human
ccggaggggccuggca

SEQ ID NO: 2088387 - RNA, 15 nt, Human
ccggaggggccuggc

SEQ ID NO: 2088388 - RNA, 16 nt, Human
ccggagcuaacacugg

SEQ ID NO: 2088389 - RNA, 17 nt, Human
ccggagcuaacacuggc

SEQ ID NO: 2088390 - RNA, 19 nt, Human
ccggagcuaacacuggccc

SEQ ID NO: 2088391 - RNA, 20 nt, Human
ccggagcuaacacuggcccc

SEQ ID NO: 2088392 - RNA, 22 nt, Human
ccggagcuaacacuggccccua

SEQ ID NO: 2088393 - RNA, 12 nt, Human
ccgcuggcuggg

SEQ ID NO: 2088394 - RNA, 15 nt, Human
ccgcuggcugggggc

SEQ ID NO: 2088395 - RNA, 18 nt, Human
ccgcuggcugggggccuc

SEQ ID NO: 2088396 - RNA, 22 nt, Human
ccgcuggcugggggccucacuc

SEQ ID NO: 2088397 - RNA, 20 nt, Human
ccgcugccuaaguggcugcu

SEQ ID NO: 2088398 - RNA, 19 nt, Human
ccgcugccuaaguggcugc

SEQ ID NO: 2088399 - RNA, 14 nt, Human
ccgccucugcuggc

SEQ ID NO: 2088400 - RNA, 11 nt, Human
ccgccucugcu

SEQ ID NO: 2088401 - RNA, 23 nt, Human
ccgccucaaugugguugcaaggc

SEQ ID NO: 2088402 - RNA, 15 nt, Human
ccgccucccagccug

SEQ ID NO: 2088403 - RNA, 21 nt, Human
ccgccucccuccccugcccuc

SEQ ID NO: 2088404 - RNA, 12 nt, Human
ccgccuggcaga

SEQ ID NO: 2088405 - RNA, 16 nt, Human
ccgccuggcagaacug

SEQ ID NO: 2088406 - RNA, 21 nt, Human
ccgccuggcagaacugagcuc

SEQ ID NO: 2088407 - RNA, 12 nt, Human
ccgcuccccagc

SEQ ID NO: 2088408 - RNA, 13 nt, Human
ccgcuccccagcc

SEQ ID NO: 2088409 - RNA, 14 nt, Human
ccgcuccccagccc

SEQ ID NO: 2088410 - RNA, 15 nt, Human
ccgcuccccagccca

SEQ ID NO: 2088411 - RNA, 14 nt, Human
ccgcuccugucugc

SEQ ID NO: 2088412 - RNA, 15 nt, Human
ccgcuccugucugcc

SEQ ID NO: 2088413 - RNA, 17 nt, Human
ccgcuccugucugccag

SEQ ID NO: 2088414 - RNA, 16 nt, Human
ccgcuccccagcccag

SEQ ID NO: 2088415 - RNA, 14 nt, Human
cccuguuuuauacu

SEQ ID NO: 2088416 - RNA, 13 nt, Human
cccuuaaaauuua

SEQ ID NO: 2088417 - RNA, 21 nt, Human
cccuguccaaacugccuaagc

SEQ ID NO: 2088418 - RNA, 22 nt, Human
cccugucagugcagcccgugug

SEQ ID NO: 2088419 - RNA, 14 nt, Human
cccugucagugcag

SEQ ID NO: 2088420 - RNA, 14 nt, Human
cccuguccaaacug

SEQ ID NO: 2088421 - RNA, 17 nt, Human
cccugucagugcagccc

SEQ ID NO: 2088422 - RNA, 21 nt, Human
cccugucagugcagcccgugu

SEQ ID NO: 2088423 - RNA, 23 nt, Human
cccuguauucccaccccuggacu

SEQ ID NO: 2088424 - RNA, 19 nt, Human
cccugucaccaagcucaca

SEQ ID NO: 2088425 - RNA, 14 nt, Human
cccugucaccaagc

SEQ ID NO: 2088426 - RNA, 15 nt, Human
cccuggugcugccac

SEQ ID NO: 2088427 - RNA, 13 nt, Human
cccugggcugaga

SEQ ID NO: 2088428 - RNA, 14 nt, Human
cccugguggcagug

SEQ ID NO: 2088429 - RNA, 21 nt, Human
cccuguagagugggagcugag

SEQ ID NO: 2088430 - RNA, 13 nt, Human
cccugguggcagu

SEQ ID NO: 2088431 - RNA, 14 nt, Human
cccuggugcugcca

SEQ ID NO: 2088432 - RNA, 13 nt, Human
cccuggugcugcc

SEQ ID NO: 2088433 - RNA, 14 nt, Human
cccuggugaggaag

SEQ ID NO: 2088434 - RNA, 21 nt, Human
cccuggugaggaagcuccagu

SEQ ID NO: 2088435 - RNA, 14 nt, Human
cccuuacuuagcau

SEQ ID NO: 2088436 - RNA, 14 nt, Human
cccuuagcagggaa

SEQ ID NO: 2088437 - RNA, 17 nt, Human
cccuuagccucccugaa

SEQ ID NO: 2088438 - RNA, 14 nt, Human
cccuuagccucccu

SEQ ID NO: 2088439 - RNA, 23 nt, Human
cccuuagcagggaaacagcuaau

SEQ ID NO: 2088440 - RNA, 20 nt, Human
cccuuccaugucgccucugc

SEQ ID NO: 2088441 - RNA, 17 nt, Human
cccuucacuucugacca

SEQ ID NO: 2088442 - RNA, 14 nt, Human
cccuuccaggccau

SEQ ID NO: 2088443 - RNA, 17 nt, Human
cccuuccaggccaucag

SEQ ID NO: 2088444 - RNA, 23 nt, Human
cccuuccaggccaucagaggccu

SEQ ID NO: 2088445 - RNA, 14 nt, Human
cccuucaaccauuc

SEQ ID NO: 2088446 - RNA, 18 nt, Human
cccuucaaccauucccca

SEQ ID NO: 2088447 - RNA, 19 nt, Human
cccuucacaccauaacuag

SEQ ID NO: 2088448 - RNA, 16 nt, Human
cccuucacaguguuuc

SEQ ID NO: 2088449 - RNA, 22 nt, Human
cccuucacuucugaccacacuu

SEQ ID NO: 2088450 - RNA, 23 nt, Human
cccuugcccagggcucagccugg

SEQ ID NO: 2088451 - RNA, 21 nt, Human
cccuugcccagggcucagccu

SEQ ID NO: 2088452 - RNA, 22 nt, Human
cccuugcccagggcucagccug

SEQ ID NO: 2088453 - RNA, 14 nt, Human
cccuugcccagggc

SEQ ID NO: 2088454 - RNA, 15 nt, Human
cccuugcccagggcu

SEQ ID NO: 2088455 - RNA, 19 nt, Human
cccuugcccagggcucagc

SEQ ID NO: 2088456 - RNA, 20 nt, Human
cccuugcccagggcucagcc

SEQ ID NO: 2088457 - RNA, 12 nt, Human
cccuugcccagg

SEQ ID NO: 2088458 - RNA, 15 nt, Human
cccuugccagacaug

SEQ ID NO: 2088459 - RNA, 20 nt, Human
cccuugagcuccccaaaaac

SEQ ID NO: 2088460 - RNA, 13 nt, Human
cccuugccagaca

SEQ ID NO: 2088461 - RNA, 18 nt, Human
cccuugcucuccccugcc

SEQ ID NO: 2088462 - RNA, 19 nt, Human
cccuugcucuccccugccc

SEQ ID NO: 2088463 - RNA, 19 nt, Human
cccuugagaccucagccau

SEQ ID NO: 2088464 - RNA, 18 nt, Human
cccuugagcuccccaaaa

SEQ ID NO: 2088465 - RNA, 17 nt, Human
cccuugagcccucuaug

SEQ ID NO: 2088466 - RNA, 17 nt, Human
cccuugagaccucagcc

SEQ ID NO: 2088467 - RNA, 18 nt, Human
cccuugagaccucagcca

SEQ ID NO: 2088468 - RNA, 22 nt, Human
cccuugagaaaccuuauuguac

SEQ ID NO: 2088469 - RNA, 14 nt, Human
cccuugagaaaccu

SEQ ID NO: 2088470 - RNA, 17 nt, Human
cccuucccuugagcccu

SEQ ID NO: 2088471 - RNA, 13 nt, Human
cccuugagaccuc

SEQ ID NO: 2088472 - RNA, 14 nt, Human
cccuugagaccuca

SEQ ID NO: 2088473 - RNA, 15 nt, Human
cccuugagaccucag

SEQ ID NO: 2088474 - RNA, 16 nt, Human
cccuugagaccucagc

SEQ ID NO: 2088475 - RNA, 20 nt, Human
cccuugagaccucagccaug

SEQ ID NO: 2088476 - RNA, 22 nt, Human
cccuuccccucccuggcuccca

SEQ ID NO: 2088477 - RNA, 13 nt, Human
cccuuccccuccu

SEQ ID NO: 2088478 - RNA, 15 nt, Human
cccuucccugcaaac

SEQ ID NO: 2088479 - RNA, 13 nt, Human
cccuucccugcaa

SEQ ID NO: 2088480 - RNA, 12 nt, Human
cccuuccccucc

SEQ ID NO: 2088481 - RNA, 14 nt, Human
cccuuccccucccu

SEQ ID NO: 2088482 - RNA, 15 nt, Human
cccuuccccucccug

SEQ ID NO: 2088483 - RNA, 16 nt, Human
cccuuccccucccugg

SEQ ID NO: 2088484 - RNA, 17 nt, Human
cccuuccccucccuggc

SEQ ID NO: 2088485 - RNA, 19 nt, Human
cccuuccccucccuggcuc

SEQ ID NO: 2088486 - RNA, 16 nt, Human
cccuggugcugccaca

SEQ ID NO: 2088487 - RNA, 19 nt, Human
cccugcugccgccucccag

SEQ ID NO: 2088488 - RNA, 14 nt, Human
cccugcugccuccc

SEQ ID NO: 2088489 - RNA, 16 nt, Human
cccugcugccucccca

SEQ ID NO: 2088490 - RNA, 20 nt, Human
cccugcugccgccucccagc

SEQ ID NO: 2088491 - RNA, 22 nt, Human
cccugcugccgccucccagccu

SEQ ID NO: 2088492 - RNA, 23 nt, Human
cccugcugccgccucccagccug

SEQ ID NO: 2088493 - RNA, 11 nt, Human
cccugcugccu

SEQ ID NO: 2088494 - RNA, 12 nt, Human
cccugcugccuc

SEQ ID NO: 2088495 - RNA, 21 nt, Human
cccugcucuccgaccagacac

SEQ ID NO: 2088496 - RNA, 22 nt, Human
cccugcucuccgaccagacacc

SEQ ID NO: 2088497 - RNA, 17 nt, Human
cccugcgaaggggcccu

SEQ ID NO: 2088498 - RNA, 21 nt, Human
cccugcgaaggggcccugguc

SEQ ID NO: 2088499 - RNA, 19 nt, Human
cccugcgaaggggcccugg

SEQ ID NO: 2088500 - RNA, 20 nt, Human
cccugcgaaggggcccuggu

SEQ ID NO: 2088501 - RNA, 22 nt, Human
cccugcuagaugagaauucagc

SEQ ID NO: 2088502 - RNA, 17 nt, Human
cccugcucccacagaac

SEQ ID NO: 2088503 - RNA, 14 nt, Human
cccugaaaacccag

SEQ ID NO: 2088504 - RNA, 15 nt, Human
cccugaaaacccaga

SEQ ID NO: 2088505 - RNA, 13 nt, Human
cccugccgccuca

SEQ ID NO: 2088506 - RNA, 19 nt, Human
cccugcccuucagcauccu

SEQ ID NO: 2088507 - RNA, 15 nt, Human
cccugccucaccucu

SEQ ID NO: 2088508 - RNA, 14 nt, Human
cccugccgccucaa

SEQ ID NO: 2088509 - RNA, 13 nt, Human
cccucucccagga

SEQ ID NO: 2088510 - RNA, 19 nt, Human
cccucuaaugcucacgcuc

SEQ ID NO: 2088511 - RNA, 22 nt, Human
cccucucaggcaugccugugug

SEQ ID NO: 2088512 - RNA, 15 nt, Human
cccucguggccuucc

SEQ ID NO: 2088513 - RNA, 16 nt, Human
cccucguggccuuccc

SEQ ID NO: 2088514 - RNA, 11 nt, Human
cccucuccugc

SEQ ID NO: 2088515 - RNA, 11 nt, Human
cccucucccug

SEQ ID NO: 2088516 - RNA, 12 nt, Human
cccucuuucccu

SEQ ID NO: 2088517 - RNA, 22 nt, Human
cccucuugccccccaccccagc

SEQ ID NO: 2088518 - RNA, 16 nt, Human
cccucuugccccccac

SEQ ID NO: 2088519 - RNA, 17 nt, Human
cccucuuucccucccuu

SEQ ID NO: 2088520 - RNA, 20 nt, Human
cccucuuucccucccuuccu

SEQ ID NO: 2088521 - RNA, 18 nt, Human
cccucuuauguaccucuu

SEQ ID NO: 2088522 - RNA, 20 nt, Human
cccucuuauguaccucuuuu

SEQ ID NO: 2088523 - RNA, 17 nt, Human
cccucuguucaguaaca

SEQ ID NO: 2088524 - RNA, 23 nt, Human
cccucuguucaguaacagggccu

SEQ ID NO: 2088525 - RNA, 12 nt, Human
cccucugccggc

SEQ ID NO: 2088526 - RNA, 14 nt, Human
cccucugccggcuc

SEQ ID NO: 2088527 - RNA, 21 nt, Human
cccucugccugaaccuuccau

SEQ ID NO: 2088528 - RNA, 13 nt, Human
cccucugccuguc

SEQ ID NO: 2088529 - RNA, 15 nt, Human
cccgcucagcccucc

SEQ ID NO: 2088530 - RNA, 13 nt, Human
cccgcucagcccu

SEQ ID NO: 2088531 - RNA, 12 nt, Human
cccgcucagccc

SEQ ID NO: 2088532 - RNA, 14 nt, Human
cccgcucagcccuc

SEQ ID NO: 2088533 - RNA, 12 nt, Human
cccucccaccac

SEQ ID NO: 2088534 - RNA, 14 nt, Human
cccucccaccacag

SEQ ID NO: 2088535 - RNA, 17 nt, Human
cccucccaccacagcag

SEQ ID NO: 2088536 - RNA, 12 nt, Human
cccucccacccc

SEQ ID NO: 2088537 - RNA, 13 nt, Human
cccucccaccccc

SEQ ID NO: 2088538 - RNA, 13 nt, Human
cccuccccugcca

SEQ ID NO: 2088539 - RNA, 13 nt, Human
cccucccagcucu

SEQ ID NO: 2088540 - RNA, 14 nt, Human
cccucccagcucug

SEQ ID NO: 2088541 - RNA, 15 nt, Human
cccucccagcucuga

SEQ ID NO: 2088542 - RNA, 13 nt, Human
cccuccccugccc

SEQ ID NO: 2088543 - RNA, 14 nt, Human
cccuccccugcccu

SEQ ID NO: 2088544 - RNA, 16 nt, Human
cccuccccugcccuag

SEQ ID NO: 2088545 - RNA, 16 nt, Human
cccucccuggcuccca

SEQ ID NO: 2088546 - RNA, 19 nt, Human
cccucccuggcucccauga

SEQ ID NO: 2088547 - RNA, 15 nt, Human
cccucccuggccugu

SEQ ID NO: 2088548 - RNA, 17 nt, Human
cccucccuggccuguuc

SEQ ID NO: 2088549 - RNA, 14 nt, Human
cccucccuggcucc

SEQ ID NO: 2088550 - RNA, 14 nt, Human
cccucccugccccu

SEQ ID NO: 2088551 - RNA, 16 nt, Human
cccucccucagccccu

SEQ ID NO: 2088552 - RNA, 12 nt, Human
cccucccugcca

SEQ ID NO: 2088553 - RNA, 12 nt, Human
cccucccuaccu

SEQ ID NO: 2088554 - RNA, 13 nt, Human
cccucccuaccuc

SEQ ID NO: 2088555 - RNA, 14 nt, Human
cccucccuaccuca

SEQ ID NO: 2088556 - RNA, 15 nt, Human
cccucccuaccucaa

SEQ ID NO: 2088557 - RNA, 20 nt, Human
cccucccuaccucaaccugu

SEQ ID NO: 2088558 - RNA, 13 nt, Human
cccucccucagcc

SEQ ID NO: 2088559 - RNA, 23 nt, Human
cccucccucuuucccucccuucc

SEQ ID NO: 2088560 - RNA, 15 nt, Human
ccccuguucacucua

SEQ ID NO: 2088561 - RNA, 13 nt, Human
ccccuuccccacu

SEQ ID NO: 2088562 - RNA, 15 nt, Human
ccccuuccccacugc

SEQ ID NO: 2088563 - RNA, 19 nt, Human
ccccuuccccacugccugc

SEQ ID NO: 2088564 - RNA, 21 nt, Human
ccccuuccccacugccugccc

SEQ ID NO: 2088565 - RNA, 14 nt, Human
cccgacagccuggc

SEQ ID NO: 2088566 - RNA, 22 nt, Human
cccgaauagcugggacuacagg

SEQ ID NO: 2088567 - RNA, 20 nt, Human
ccccuggcuuuucacugcug

SEQ ID NO: 2088568 - RNA, 18 nt, Human
ccccuggcuuuucacugc

SEQ ID NO: 2088569 - RNA, 23 nt, Human
ccccugguggacaguccugggag

SEQ ID NO: 2088570 - RNA, 21 nt, Human
ccccugguggacaguccuggg

SEQ ID NO: 2088571 - RNA, 22 nt, Human
ccccugguggacaguccuggga

SEQ ID NO: 2088572 - RNA, 15 nt, Human
ccccugguggacagu

SEQ ID NO: 2088573 - RNA, 19 nt, Human
ccccugguggacaguccug

SEQ ID NO: 2088574 - RNA, 20 nt, Human
ccccugguggacaguccugg

SEQ ID NO: 2088575 - RNA, 12 nt, Human
cccgacuccuca

SEQ ID NO: 2088576 - RNA, 14 nt, Human
cccgacuccucaaa

SEQ ID NO: 2088577 - RNA, 18 nt, Human
cccgacagccuggcacag

SEQ ID NO: 2088578 - RNA, 15 nt, Human
cccgacagccuggca

SEQ ID NO: 2088579 - RNA, 20 nt, Human
cccgacauggacccggagcu

SEQ ID NO: 2088580 - RNA, 12 nt, Human
cccgacagaggg

SEQ ID NO: 2088581 - RNA, 15 nt, Human
cccgacagagggaag

SEQ ID NO: 2088582 - RNA, 23 nt, Human
cccgacauggacccggagcuaac

SEQ ID NO: 2088583 - RNA, 11 nt, Human
cccgagcuggg

SEQ ID NO: 2088584 - RNA, 20 nt, Human
cccgagcugggggccaugag

SEQ ID NO: 2088585 - RNA, 22 nt, Human
cccgagcugggggccaugagcu

SEQ ID NO: 2088586 - RNA, 23 nt, Human
cccgagcugggggccaugagcuc

SEQ ID NO: 2088587 - RNA, 12 nt, Human
cccgagcuggug

SEQ ID NO: 2088588 - RNA, 14 nt, Human
cccgagcuggugca

SEQ ID NO: 2088589 - RNA, 22 nt, Human
cccgagcuggugcauuacagag

SEQ ID NO: 2088590 - RNA, 16 nt, Human
cccgcaugcagcagcu

SEQ ID NO: 2088591 - RNA, 19 nt, Human
cccgcaugcagcagcuugc

SEQ ID NO: 2088592 - RNA, 20 nt, Human
cccgcaugcagcagcuugcu

SEQ ID NO: 2088593 - RNA, 22 nt, Human
cccgcaugcagcagcuugcugc

SEQ ID NO: 2088594 - RNA, 15 nt, Human
cccgcauuccaggcu

SEQ ID NO: 2088595 - RNA, 16 nt, Human
cccgcauuccaggcuc

SEQ ID NO: 2088596 - RNA, 13 nt, Human
cccgcccagcugc

SEQ ID NO: 2088597 - RNA, 22 nt, Human
cccgcagguaccccagcucugc

SEQ ID NO: 2088598 - RNA, 14 nt, Human
ccccuggaugaagu

SEQ ID NO: 2088599 - RNA, 23 nt, Human
ccccugccccuucuacacucucc

SEQ ID NO: 2088600 - RNA, 20 nt, Human
ccccugcugguucaggguug

SEQ ID NO: 2088601 - RNA, 15 nt, Human
ccccugcugguucag

SEQ ID NO: 2088602 - RNA, 13 nt, Human
ccccugcugguuc

SEQ ID NO: 2088603 - RNA, 11 nt, Human
ccccugcuggu

SEQ ID NO: 2088604 - RNA, 12 nt, Human
ccccugcugccu

SEQ ID NO: 2088605 - RNA, 13 nt, Human
ccccugcugccuc

SEQ ID NO: 2088606 - RNA, 14 nt, Human
ccccugcugccucc

SEQ ID NO: 2088607 - RNA, 18 nt, Human
ccccugcugccuccccaa

SEQ ID NO: 2088608 - RNA, 20 nt, Human
ccccugcugccuccccaacc

SEQ ID NO: 2088609 - RNA, 19 nt, Human
ccccucuaaugcucacgcu

SEQ ID NO: 2088610 - RNA, 14 nt, Human
ccccugccccguca

SEQ ID NO: 2088611 - RNA, 15 nt, Human
ccccugccccgucac

SEQ ID NO: 2088612 - RNA, 22 nt, Human
ccccugccccgucaccaucuca

SEQ ID NO: 2088613 - RNA, 19 nt, Human
ccccugcccggcugcggaa

SEQ ID NO: 2088614 - RNA, 17 nt, Human
ccccugcccggcugcgg

SEQ ID NO: 2088615 - RNA, 13 nt, Human
ccccugcccugcu

SEQ ID NO: 2088616 - RNA, 13 nt, Human
ccccugcccuggg

SEQ ID NO: 2088617 - RNA, 14 nt, Human
ccccugcccugcug

SEQ ID NO: 2088618 - RNA, 15 nt, Human
ccccugcccugcugc

SEQ ID NO: 2088619 - RNA, 13 nt, Human
ccccugcccuggu

SEQ ID NO: 2088620 - RNA, 17 nt, Human
ccccugcccugguccag

SEQ ID NO: 2088621 - RNA, 13 nt, Human
ccccuccucugcc

SEQ ID NO: 2088622 - RNA, 11 nt, Human
ccccuccucug

SEQ ID NO: 2088623 - RNA, 12 nt, Human
ccccucucuccu

SEQ ID NO: 2088624 - RNA, 17 nt, Human
ccccucucccaguuguc

SEQ ID NO: 2088625 - RNA, 20 nt, Human
ccccuccuuccuugaccagc

SEQ ID NO: 2088626 - RNA, 15 nt, Human
ccccuccuugccucc

SEQ ID NO: 2088627 - RNA, 18 nt, Human
ccccuccuugccuccugu

SEQ ID NO: 2088628 - RNA, 20 nt, Human
ccccuccuugccuccugugu

SEQ ID NO: 2088629 - RNA, 14 nt, Human
ccccuccucugcca

SEQ ID NO: 2088630 - RNA, 16 nt, Human
ccccuccuucccagcu

SEQ ID NO: 2088631 - RNA, 17 nt, Human
ccccuccuucccagcug

SEQ ID NO: 2088632 - RNA, 20 nt, Human
ccccuccuucccagcugccc

SEQ ID NO: 2088633 - RNA, 15 nt, Human
ccccuccuuccuuga

SEQ ID NO: 2088634 - RNA, 17 nt, Human
ccccuccuuccuugacc

SEQ ID NO: 2088635 - RNA, 12 nt, Human
ccccuccuucuc

SEQ ID NO: 2088636 - RNA, 12 nt, Human
ccccuccaugug

SEQ ID NO: 2088637 - RNA, 11 nt, Human
ccccucccacc

SEQ ID NO: 2088638 - RNA, 12 nt, Human
ccccucccaggg

SEQ ID NO: 2088639 - RNA, 16 nt, Human
ccccucccaccacagc

SEQ ID NO: 2088640 - RNA, 12 nt, Human
ccccucccacca

SEQ ID NO: 2088641 - RNA, 11 nt, Human
ccccucccaga

SEQ ID NO: 2088642 - RNA, 12 nt, Human
ccccucccagaa

SEQ ID NO: 2088643 - RNA, 13 nt, Human
ccccucccagaac

SEQ ID NO: 2088644 - RNA, 17 nt, Human
ccccucccuaccucaac

SEQ ID NO: 2088645 - RNA, 12 nt, Human
ccccucccuggc

SEQ ID NO: 2088646 - RNA, 15 nt, Human
ccccucccuggccug

SEQ ID NO: 2088647 - RNA, 16 nt, Human
ccccucccuggccugu

SEQ ID NO: 2088648 - RNA, 17 nt, Human
ccccucccuggccuguu

SEQ ID NO: 2088649 - RNA, 13 nt, Human
ccccucccuggcu

SEQ ID NO: 2088650 - RNA, 14 nt, Human
ccccucccuggcuc

SEQ ID NO: 2088651 - RNA, 15 nt, Human
ccccucccuggcucc

SEQ ID NO: 2088652 - RNA, 15 nt, Human
ccccucccuucaacc

SEQ ID NO: 2088653 - RNA, 22 nt, Human
ccccucccuggcucccaugacc

SEQ ID NO: 2088654 - RNA, 14 nt, Human
ccccucaggacccu

SEQ ID NO: 2088655 - RNA, 18 nt, Human
ccccucaggacccucgcu

SEQ ID NO: 2088656 - RNA, 19 nt, Human
ccccucaggacccucgcug

SEQ ID NO: 2088657 - RNA, 22 nt, Human
ccccucaggacccucgcuggcc

SEQ ID NO: 2088658 - RNA, 15 nt, Human
ccccucaccugggca

SEQ ID NO: 2088659 - RNA, 13 nt, Human
ccccucaccuugc

SEQ ID NO: 2088660 - RNA, 14 nt, Human
ccccucaccuugca

SEQ ID NO: 2088661 - RNA, 15 nt, Human
ccccucaccuugcaa

SEQ ID NO: 2088662 - RNA, 23 nt, Human
ccccuccaaucccaccaacccuc

SEQ ID NO: 2088663 - RNA, 14 nt, Human
cccccucccuggcc

SEQ ID NO: 2088664 - RNA, 14 nt, Human
cccccugccagugc

SEQ ID NO: 2088665 - RNA, 12 nt, Human
cccccagccugc

SEQ ID NO: 2088666 - RNA, 16 nt, Human
cccccagcaacccucc

SEQ ID NO: 2088667 - RNA, 13 nt, Human
cccccuccccagg

SEQ ID NO: 2088668 - RNA, 13 nt, Human
cccccucccaggg

SEQ ID NO: 2088669 - RNA, 18 nt, Human
cccccucaggacccucgc

SEQ ID NO: 2088670 - RNA, 19 nt, Human
cccccucaggacccucgcu

SEQ ID NO: 2088671 - RNA, 20 nt, Human
cccccucaggacccucgcug

SEQ ID NO: 2088672 - RNA, 22 nt, Human
cccccucaggacccucgcuggc

SEQ ID NO: 2088673 - RNA, 24 nt, Human
cccccggguuuggcgggccaagga

SEQ ID NO: 2088674 - RNA, 16 nt, Human
ccccucaacaccucug

SEQ ID NO: 2088675 - RNA, 23 nt, Human
ccccucaaggacaaagucuccag

SEQ ID NO: 2088676 - RNA, 21 nt, Human
ccccuauccacccagcccauu

SEQ ID NO: 2088677 - RNA, 15 nt, Human
ccccucaacaccucu

SEQ ID NO: 2088678 - RNA, 14 nt, Human
ccccuauccaccca

SEQ ID NO: 2088679 - RNA, 16 nt, Human
ccccuauccacccagc

SEQ ID NO: 2088680 - RNA, 17 nt, Human
ccccuauccacccagcc

SEQ ID NO: 2088681 - RNA, 19 nt, Human
ccccuauccacccagccca

SEQ ID NO: 2088682 - RNA, 20 nt, Human
ccccuauccacccagcccau

SEQ ID NO: 2088683 - RNA, 15 nt, Human
ccccggucccuugag

SEQ ID NO: 2088684 - RNA, 16 nt, Human
ccccggucccuugaga

SEQ ID NO: 2088685 - RNA, 24 nt, Human
ccccggucccuugagaccucagcc

SEQ ID NO: 2088686 - RNA, 21 nt, Human
cccccugguggacaguccugg

SEQ ID NO: 2088687 - RNA, 23 nt, Human
cccccugguggacaguccuggga

SEQ ID NO: 2088688 - RNA, 13 nt, Human
cccccugggcucu

SEQ ID NO: 2088689 - RNA, 16 nt, Human
cccccugccagugccu

SEQ ID NO: 2088690 - RNA, 19 nt, Human
cccccugguggacaguccu

SEQ ID NO: 2088691 - RNA, 20 nt, Human
cccccugguggacaguccug

SEQ ID NO: 2088692 - RNA, 15 nt, Human
ccccgggcucucugc

SEQ ID NO: 2088693 - RNA, 16 nt, Human
ccccgggcucucugcu

SEQ ID NO: 2088694 - RNA, 17 nt, Human
ccccgggcucucugcug

SEQ ID NO: 2088695 - RNA, 18 nt, Human
ccccgggcucucugcugu

SEQ ID NO: 2088696 - RNA, 18 nt, Human
ccccggguuuggcgggcc

SEQ ID NO: 2088697 - RNA, 19 nt, Human
ccccggguuuggcgggcca

SEQ ID NO: 2088698 - RNA, 23 nt, Human
ccccggguuuggcgggccaagga

SEQ ID NO: 2088699 - RNA, 22 nt, Human
ccccauaauuuuuuuuuuccuu

SEQ ID NO: 2088700 - RNA, 15 nt, Human
ccccauacucugucu

SEQ ID NO: 2088701 - RNA, 12 nt, Human
ccccauagccac

SEQ ID NO: 2088702 - RNA, 14 nt, Human
ccccauagccaccc

SEQ ID NO: 2088703 - RNA, 18 nt, Human
ccccaucacaaacuuaaa

SEQ ID NO: 2088704 - RNA, 16 nt, Human
ccccagugcacccacu

SEQ ID NO: 2088705 - RNA, 23 nt, Human
ccccaguuugcagaaaagcaccu

SEQ ID NO: 2088706 - RNA, 20 nt, Human
ccccagugcccacaggauca

SEQ ID NO: 2088707 - RNA, 16 nt, Human
ccccagugcccacagg

SEQ ID NO: 2088708 - RNA, 15 nt, Human
ccccagugcccacag

SEQ ID NO: 2088709 - RNA, 14 nt, Human
ccccagugcccaca

SEQ ID NO: 2088710 - RNA, 16 nt, Human
ccccaguaagccacug

SEQ ID NO: 2088711 - RNA, 18 nt, Human
ccccaguaagccacugcc

SEQ ID NO: 2088712 - RNA, 15 nt, Human
ccccagaccugagcu

SEQ ID NO: 2088713 - RNA, 19 nt, Human
ccccagaccugagcucccc

SEQ ID NO: 2088714 - RNA, 12 nt, Human
ccccaggcccca

SEQ ID NO: 2088715 - RNA, 18 nt, Human
ccccaggccccaggaagc

SEQ ID NO: 2088716 - RNA, 19 nt, Human
ccccaggccccaggaagcc

SEQ ID NO: 2088717 - RNA, 15 nt, Human
cccccagaaccuguc

SEQ ID NO: 2088718 - RNA, 22 nt, Human
cccccagaaccuguccuugcac

SEQ ID NO: 2088719 - RNA, 14 nt, Human
cccccacugcaggc

SEQ ID NO: 2088720 - RNA, 21 nt, Human
cccccacucucauuccccagg

SEQ ID NO: 2088721 - RNA, 13 nt, Human
cccccacuggcug

SEQ ID NO: 2088722 - RNA, 14 nt, Human
cccccacuggcugu

SEQ ID NO: 2088723 - RNA, 15 nt, Human
cccccacuggcugug

SEQ ID NO: 2088724 - RNA, 21 nt, Human
cccccacuggcugugggcucc

SEQ ID NO: 2088725 - RNA, 12 nt, Human
cccccacccccu

SEQ ID NO: 2088726 - RNA, 15 nt, Human
cccccaccccuuccc

SEQ ID NO: 2088727 - RNA, 17 nt, Human
cccccaccccuucccca

SEQ ID NO: 2088728 - RNA, 12 nt, Human
cccccacccuuu

SEQ ID NO: 2088729 - RNA, 16 nt, Human
ccccaucccacacccu

SEQ ID NO: 2088730 - RNA, 13 nt, Human
ccccauccucccc

SEQ ID NO: 2088731 - RNA, 17 nt, Human
ccccauccuccccuucc

SEQ ID NO: 2088732 - RNA, 15 nt, Human
cccccaccacuagga

SEQ ID NO: 2088733 - RNA, 18 nt, Human
ccccauccuccccuuccc

SEQ ID NO: 2088734 - RNA, 19 nt, Human
ccccauccuccccuucccu

SEQ ID NO: 2088735 - RNA, 17 nt, Human
cccccacaccucaguuc

SEQ ID NO: 2088736 - RNA, 14 nt, Human
cccccacaccuggc

SEQ ID NO: 2088737 - RNA, 16 nt, Human
cccccacaccuggccc

SEQ ID NO: 2088738 - RNA, 18 nt, Human
cccccacaccuggcccug

SEQ ID NO: 2088739 - RNA, 14 nt, Human
cccaugagccucag

SEQ ID NO: 2088740 - RNA, 19 nt, Human
cccaugaccauacugaggg

SEQ ID NO: 2088741 - RNA, 22 nt, Human
cccaugagccucagcauccugg

SEQ ID NO: 2088742 - RNA, 21 nt, Human
cccaugccaaagcuagggugg

SEQ ID NO: 2088743 - RNA, 14 nt, Human
cccaugcccaccug

SEQ ID NO: 2088744 - RNA, 15 nt, Human
cccaugcccaccugc

SEQ ID NO: 2088745 - RNA, 18 nt, Human
cccaugcccaccugccca

SEQ ID NO: 2088746 - RNA, 23 nt, Human
cccaucucucccuccccugccau

SEQ ID NO: 2088747 - RNA, 13 nt, Human
cccaucucucccu

SEQ ID NO: 2088748 - RNA, 18 nt, Human
cccaucucucccuccccu

SEQ ID NO: 2088749 - RNA, 21 nt, Human
cccaucucucccuccccugcc

SEQ ID NO: 2088750 - RNA, 21 nt, Human
cccaucugcaccccccugggc

SEQ ID NO: 2088751 - RNA, 22 nt, Human
cccaucugcaccccccugggcu

SEQ ID NO: 2088752 - RNA, 19 nt, Human
cccaucucuacaaaaagca

SEQ ID NO: 2088753 - RNA, 14 nt, Human
cccaguugggugga

SEQ ID NO: 2088754 - RNA, 16 nt, Human
cccaguucucuaggga

SEQ ID NO: 2088755 - RNA, 23 nt, Human
cccaguucucuagggaaggccac

SEQ ID NO: 2088756 - RNA, 13 nt, Human
cccagagaagcca

SEQ ID NO: 2088757 - RNA, 13 nt, Human
cccagagacagga

SEQ ID NO: 2088758 - RNA, 14 nt, Human
cccagagacaggaa

SEQ ID NO: 2088759 - RNA, 15 nt, Human
cccagagacaggaaa

SEQ ID NO: 2088760 - RNA, 16 nt, Human
cccagagacaggaaaa

SEQ ID NO: 2088761 - RNA, 17 nt, Human
cccagagacaggaaaau

SEQ ID NO: 2088762 - RNA, 16 nt, Human
ccccagaaggcaggga

SEQ ID NO: 2088763 - RNA, 21 nt, Human
ccccagaaccuguccuugcac

SEQ ID NO: 2088764 - RNA, 15 nt, Human
ccccagaaccugucc

SEQ ID NO: 2088765 - RNA, 20 nt, Human
ccccagaaccuguccuugca

SEQ ID NO: 2088766 - RNA, 15 nt, Human
ccccacucucauucc

SEQ ID NO: 2088767 - RNA, 20 nt, Human
ccccacucucauuccccagg

SEQ ID NO: 2088768 - RNA, 12 nt, Human
ccccacucuccc

SEQ ID NO: 2088769 - RNA, 15 nt, Human
ccccacucuccccac

SEQ ID NO: 2088770 - RNA, 18 nt, Human
ccccacucuccccacacu

SEQ ID NO: 2088771 - RNA, 23 nt, Human
ccccacucccuggcucucagaag

SEQ ID NO: 2088772 - RNA, 14 nt, Human
ccccacuccccacc

SEQ ID NO: 2088773 - RNA, 13 nt, Human
ccccacucacaga

SEQ ID NO: 2088774 - RNA, 21 nt, Human
ccccacucacagagacacagg

SEQ ID NO: 2088775 - RNA, 19 nt, Human
ccccacgugacagugccug

SEQ ID NO: 2088776 - RNA, 14 nt, Human
ccccacccuuuggg

SEQ ID NO: 2088777 - RNA, 22 nt, Human
ccccaauauccucgcucccggg

SEQ ID NO: 2088778 - RNA, 13 nt, Human
ccccaccuccugc

SEQ ID NO: 2088779 - RNA, 13 nt, Human
ccccaccugccac

SEQ ID NO: 2088780 - RNA, 14 nt, Human
ccccaccugccacu

SEQ ID NO: 2088781 - RNA, 17 nt, Human
ccccaccugccacuagg

SEQ ID NO: 2088782 - RNA, 22 nt, Human
ccccaccugccacuaggcuggg

SEQ ID NO: 2088783 - RNA, 11 nt, Human
ccccaccugcc

SEQ ID NO: 2088784 - RNA, 12 nt, Human
ccccaccugcca

SEQ ID NO: 2088785 - RNA, 14 nt, Human
ccccacgcccucau

SEQ ID NO: 2088786 - RNA, 21 nt, Human
ccccaccuucaauuccugggc

SEQ ID NO: 2088787 - RNA, 14 nt, Human
ccccaccccacacu

SEQ ID NO: 2088788 - RNA, 12 nt, Human
ccccacccagga

SEQ ID NO: 2088789 - RNA, 13 nt, Human
ccccacccaggag

SEQ ID NO: 2088790 - RNA, 13 nt, Human
ccccaccccagcc

SEQ ID NO: 2088791 - RNA, 16 nt, Human
ccccaccccacacuug

SEQ ID NO: 2088792 - RNA, 14 nt, Human
cccauuccccagcc

SEQ ID NO: 2088793 - RNA, 18 nt, Human
ccccaaggggcagucugg

SEQ ID NO: 2088794 - RNA, 22 nt, Human
ccccaaggggcagucuggaggg

SEQ ID NO: 2088795 - RNA, 14 nt, Human
ccccaaggggcagu

SEQ ID NO: 2088796 - RNA, 15 nt, Human
ccccaaggggcaguc

SEQ ID NO: 2088797 - RNA, 16 nt, Human
ccccaaggggcagucu

SEQ ID NO: 2088798 - RNA, 14 nt, Human
ccccacaccucagu

SEQ ID NO: 2088799 - RNA, 16 nt, Human
ccccacaccucaguuc

SEQ ID NO: 2088800 - RNA, 14 nt, Human
ccccacaccuggcc

SEQ ID NO: 2088801 - RNA, 16 nt, Human
ccccacaccuggcccu

SEQ ID NO: 2088802 - RNA, 17 nt, Human
ccccacaccuggcccug

SEQ ID NO: 2088803 - RNA, 13 nt, Human
cccaugccugucc

SEQ ID NO: 2088804 - RNA, 22 nt, Human
cuccaaguccacaguggaacca

SEQ ID NO: 2088805 - RNA, 15 nt, Human
cuccaaggugggguc

SEQ ID NO: 2088806 - RNA, 13 nt, Human
cuccaccacccaa

SEQ ID NO: 2088807 - RNA, 14 nt, Human
cuccaccacccaaa

SEQ ID NO: 2088808 - RNA, 12 nt, Human
cuccaccaccca

SEQ ID NO: 2088809 - RNA, 16 nt, Human
cuccaccacccaaaag

SEQ ID NO: 2088810 - RNA, 12 nt, Human
cuccaccccacu

SEQ ID NO: 2088811 - RNA, 14 nt, Human
cuccaccccacuca

SEQ ID NO: 2088812 - RNA, 15 nt, Human
cuccaccccacucac

SEQ ID NO: 2088813 - RNA, 18 nt, Human
cuccaccccacucacaga

SEQ ID NO: 2088814 - RNA, 20 nt, Human
cuccaccccacucacagaga

SEQ ID NO: 2088815 - RNA, 17 nt, Human
cuccacccuuggccugu

SEQ ID NO: 2088816 - RNA, 21 nt, Human
cuccacccuuggccugucuca

SEQ ID NO: 2088817 - RNA, 14 nt, Human
cuccacccuuggcc

SEQ ID NO: 2088818 - RNA, 15 nt, Human
cuccacccuuggccu

SEQ ID NO: 2088819 - RNA, 16 nt, Human
cuccacccuuggccug

SEQ ID NO: 2088820 - RNA, 13 nt, Human
cuccacuggaugg

SEQ ID NO: 2088821 - RNA, 16 nt, Human
cuccacugccuucgau

SEQ ID NO: 2088822 - RNA, 15 nt, Human
cuccacugccuucga

SEQ ID NO: 2088823 - RNA, 14 nt, Human
cuccacugccuucg

SEQ ID NO: 2088824 - RNA, 13 nt, Human
cuccacugccuuc

SEQ ID NO: 2088825 - RNA, 12 nt, Human
cuccacuccuuc

SEQ ID NO: 2088826 - RNA, 14 nt, Human
cuccacuccuuccu

SEQ ID NO: 2088827 - RNA, 15 nt, Human
cuccacuccuuccug

SEQ ID NO: 2088828 - RNA, 19 nt, Human
cuccacuccuuccugccac

SEQ ID NO: 2088829 - RNA, 13 nt, Human
cuccaccucagcc

SEQ ID NO: 2088830 - RNA, 14 nt, Human
cuccaccucagccu

SEQ ID NO: 2088831 - RNA, 14 nt, Human
cuccaccgcugccu

SEQ ID NO: 2088832 - RNA, 15 nt, Human
cuccaccgcugccua

SEQ ID NO: 2088833 - RNA, 16 nt, Human
cuccaccgcugccuaa

SEQ ID NO: 2088834 - RNA, 19 nt, Human
cuccaccgcugccuaagug

SEQ ID NO: 2088835 - RNA, 12 nt, Human
cuccaccucagc

SEQ ID NO: 2088836 - RNA, 21 nt, Human
cuccagauagcucauuucauu

SEQ ID NO: 2088837 - RNA, 14 nt, Human
cuccacuggaugga

SEQ ID NO: 2088838 - RNA, 21 nt, Human
cuccagaccccuggcuuuuca

SEQ ID NO: 2088839 - RNA, 22 nt, Human
cuccacuccuuccugccaccug

SEQ ID NO: 2088840 - RNA, 21 nt, Human
cuccagagaguaucugaggca

SEQ ID NO: 2088841 - RNA, 18 nt, Human
cuccagcucaccagcccc

SEQ ID NO: 2088842 - RNA, 16 nt, Human
cuccagcucaccagcc

SEQ ID NO: 2088843 - RNA, 15 nt, Human
cuccagcucaccagc

SEQ ID NO: 2088844 - RNA, 13 nt, Human
cuccagaucugca

SEQ ID NO: 2088845 - RNA, 14 nt, Human
cuccagaucugcac

SEQ ID NO: 2088846 - RNA, 13 nt, Human
cuccagcccacgu

SEQ ID NO: 2088847 - RNA, 13 nt, Human
cucaguuugucag

SEQ ID NO: 2088848 - RNA, 13 nt, Human
cucaguuucccua

SEQ ID NO: 2088849 - RNA, 16 nt, Human
cucaguuucccuaucu

SEQ ID NO: 2088850 - RNA, 12 nt, Human
cucaguuucccu

SEQ ID NO: 2088851 - RNA, 22 nt, Human
cucaguucccuuggccucagaa

SEQ ID NO: 2088852 - RNA, 21 nt, Human
cucaguuccugcagcagagcc

SEQ ID NO: 2088853 - RNA, 12 nt, Human
cucauucuucug

SEQ ID NO: 2088854 - RNA, 21 nt, Human
cucauuugucacacacuuugg

SEQ ID NO: 2088855 - RNA, 22 nt, Human
cuccaaaccuccuguuagcugu

SEQ ID NO: 2088856 - RNA, 18 nt, Human
cucauuuuaggcaaauau

SEQ ID NO: 2088857 - RNA, 23 nt, Human
cucauuuuuauaaugucccuuca

SEQ ID NO: 2088858 - RNA, 19 nt, Human
cucccaggcgccccuuccc

SEQ ID NO: 2088859 - RNA, 17 nt, Human
cucccaggcgccccuuc

SEQ ID NO: 2088860 - RNA, 15 nt, Human
cucccacacugcuag

SEQ ID NO: 2088861 - RNA, 13 nt, Human
cucccaauucauc

SEQ ID NO: 2088862 - RNA, 14 nt, Human
cucccacacugcua

SEQ ID NO: 2088863 - RNA, 22 nt, Human
cucccaggcgccccuucccccu

SEQ ID NO: 2088864 - RNA, 20 nt, Human
cucccaggcgccccuucccc

SEQ ID NO: 2088865 - RNA, 12 nt, Human
cucccagggcca

SEQ ID NO: 2088866 - RNA, 16 nt, Human
cucccagggccagggc

SEQ ID NO: 2088867 - RNA, 22 nt, Human
cucccaaaaguaucgggggcug

SEQ ID NO: 2088868 - RNA, 19 nt, Human
cucccagggccagggcccu

SEQ ID NO: 2088869 - RNA, 16 nt, Human
cucccaucacuucccu

SEQ ID NO: 2088870 - RNA, 19 nt, Human
cuccccaccaccccagcug

SEQ ID NO: 2088871 - RNA, 20 nt, Human
cuccccaccaccccagcugc

SEQ ID NO: 2088872 - RNA, 21 nt, Human
cuccccaccuucaauuccugg

SEQ ID NO: 2088873 - RNA, 23 nt, Human
cuccccaccuucaauuccugggc

SEQ ID NO: 2088874 - RNA, 14 nt, Human
cucccaaagagcug

SEQ ID NO: 2088875 - RNA, 17 nt, Human
cucccaaagagcugccu

SEQ ID NO: 2088876 - RNA, 21 nt, Human
cucccaaagagcugccuaaga

SEQ ID NO: 2088877 - RNA, 15 nt, Human
cuccauuuaguucuu

SEQ ID NO: 2088878 - RNA, 23 nt, Human
cucccaaagugcugggauuacag

SEQ ID NO: 2088879 - RNA, 16 nt, Human
cucccaaagugcuggg

SEQ ID NO: 2088880 - RNA, 15 nt, Human
cucccacaaaggaga

SEQ ID NO: 2088881 - RNA, 17 nt, Human
cuccaugcugccuccag

SEQ ID NO: 2088882 - RNA, 16 nt, Human
cuccaugcugccucca

SEQ ID NO: 2088883 - RNA, 15 nt, Human
cuccaugcugccucc

SEQ ID NO: 2088884 - RNA, 14 nt, Human
cuccaugcugccuc

SEQ ID NO: 2088885 - RNA, 13 nt, Human
cuccaugcugccu

SEQ ID NO: 2088886 - RNA, 20 nt, Human
cuccagcugcucugucuucu

SEQ ID NO: 2088887 - RNA, 16 nt, Human
cuccccuccuuuccca

SEQ ID NO: 2088888 - RNA, 15 nt, Human
cucccucaaagcaca

SEQ ID NO: 2088889 - RNA, 14 nt, Human
cucccucaacccca

SEQ ID NO: 2088890 - RNA, 23 nt, Human
cucccgaauagcugggacuacag

SEQ ID NO: 2088891 - RNA, 20 nt, Human
cucccgaauagcugggacua

SEQ ID NO: 2088892 - RNA, 21 nt, Human
cucccuucaaccauuccccau

SEQ ID NO: 2088893 - RNA, 12 nt, Human
cucccuggcccu

SEQ ID NO: 2088894 - RNA, 23 nt, Human
cucccuucaaccauuccccaugg

SEQ ID NO: 2088895 - RNA, 22 nt, Human
cucccuucaaccauuccccaug

SEQ ID NO: 2088896 - RNA, 18 nt, Human
cucccucagucuggcccu

SEQ ID NO: 2088897 - RNA, 12 nt, Human
cucccucagccc

SEQ ID NO: 2088898 - RNA, 13 nt, Human
cucccucagcccc

SEQ ID NO: 2088899 - RNA, 14 nt, Human
cucccucagccccu

SEQ ID NO: 2088900 - RNA, 15 nt, Human
cucccucagccccuc

SEQ ID NO: 2088901 - RNA, 16 nt, Human
cucccucagccccucu

SEQ ID NO: 2088902 - RNA, 18 nt, Human
cucccucagccccucuug

SEQ ID NO: 2088903 - RNA, 15 nt, Human
cuccccagcccaggg

SEQ ID NO: 2088904 - RNA, 16 nt, Human
cuccccagcccagggu

SEQ ID NO: 2088905 - RNA, 22 nt, Human
cuccccagcccaggguuccccc

SEQ ID NO: 2088906 - RNA, 19 nt, Human
cuccccuccuugccuccug

SEQ ID NO: 2088907 - RNA, 20 nt, Human
cuccccuccuugccuccugu

SEQ ID NO: 2088908 - RNA, 13 nt, Human
cuccccagcccag

SEQ ID NO: 2088909 - RNA, 22 nt, Human
cuccccuccuugccuccugugu

SEQ ID NO: 2088910 - RNA, 10 nt, Human
cuccccucua

SEQ ID NO: 2088911 - RNA, 21 nt, Human
cuccccucuauuuagcaugac

SEQ ID NO: 2088912 - RNA, 13 nt, Human
cuccccucugcug

SEQ ID NO: 2088913 - RNA, 14 nt, Human
cuccccucugcugg

SEQ ID NO: 2088914 - RNA, 15 nt, Human
cuccccucugcuggc

SEQ ID NO: 2088915 - RNA, 16 nt, Human
cuccccucugcuggcc

SEQ ID NO: 2088916 - RNA, 18 nt, Human
cuccccucuuauguaccu

SEQ ID NO: 2088917 - RNA, 21 nt, Human
cuccccugcacuggaguccag

SEQ ID NO: 2088918 - RNA, 15 nt, Human
cuccccugcacugga

SEQ ID NO: 2088919 - RNA, 12 nt, Human
cucagcugccuc

SEQ ID NO: 2088920 - RNA, 14 nt, Human
cucagcugccucac

SEQ ID NO: 2088921 - RNA, 16 nt, Human
cucagcugccucacuu

SEQ ID NO: 2088922 - RNA, 18 nt, Human
cucagcugccucacuucc

SEQ ID NO: 2088923 - RNA, 12 nt, Human
cucagcucuggc

SEQ ID NO: 2088924 - RNA, 13 nt, Human
cucagcucuggcu

SEQ ID NO: 2088925 - RNA, 14 nt, Human
cucagcucuggcuc

SEQ ID NO: 2088926 - RNA, 15 nt, Human
cucagcucuggcuca

SEQ ID NO: 2088927 - RNA, 17 nt, Human
cucagcucuggcucaca

SEQ ID NO: 2088928 - RNA, 18 nt, Human
cucagcucuggcucacag

SEQ ID NO: 2088929 - RNA, 19 nt, Human
cucagcucuggcucacaga

SEQ ID NO: 2088930 - RNA, 14 nt, Human
cucagcuuucuaag

SEQ ID NO: 2088931 - RNA, 17 nt, Human
cucagcuuuuugucuuu

SEQ ID NO: 2088932 - RNA, 21 nt, Human
cucagcuuuuugucuuuucug

SEQ ID NO: 2088933 - RNA, 15 nt, Human
cucaggaacuagacu

SEQ ID NO: 2088934 - RNA, 14 nt, Human
cucaggacuccagc

SEQ ID NO: 2088935 - RNA, 15 nt, Human
cucaggacuccagcc

SEQ ID NO: 2088936 - RNA, 16 nt, Human
cucaggacuccagccc

SEQ ID NO: 2088937 - RNA, 17 nt, Human
cucaggacuccagccca

SEQ ID NO: 2088938 - RNA, 15 nt, Human
cucaggacuccucuc

SEQ ID NO: 2088939 - RNA, 16 nt, Human
cucaggacuccucucc

SEQ ID NO: 2088940 - RNA, 13 nt, Human
cucaggacccucg

SEQ ID NO: 2088941 - RNA, 14 nt, Human
cucaggacccucgc

SEQ ID NO: 2088942 - RNA, 15 nt, Human
cucaggacccucgcu

SEQ ID NO: 2088943 - RNA, 17 nt, Human
cucaggacccucgcugg

SEQ ID NO: 2088944 - RNA, 19 nt, Human
cucaggacccucgcuggcc

SEQ ID NO: 2088945 - RNA, 20 nt, Human
cucaggacccucgcuggccc

SEQ ID NO: 2088946 - RNA, 21 nt, Human
cucaggacccucgcuggcccc

SEQ ID NO: 2088947 - RNA, 22 nt, Human
cucaggacccucgcuggccccc

SEQ ID NO: 2088948 - RNA, 12 nt, Human
cucaggaccuag

SEQ ID NO: 2088949 - RNA, 15 nt, Human
cucaggcagguggga

SEQ ID NO: 2088950 - RNA, 14 nt, Human
cucaggaggcugag

SEQ ID NO: 2088951 - RNA, 15 nt, Human
cucaggaggcugagg

SEQ ID NO: 2088952 - RNA, 17 nt, Human
cucaggaggcugaggca

SEQ ID NO: 2088953 - RNA, 18 nt, Human
cucaggcaggugggaugg

SEQ ID NO: 2088954 - RNA, 18 nt, Human
cucaggaggcugaggcag

SEQ ID NO: 2088955 - RNA, 13 nt, Human
cucaggaggcuga

SEQ ID NO: 2088956 - RNA, 19 nt, Human
cucaggaggcugaggcaga

SEQ ID NO: 2088957 - RNA, 16 nt, Human
cucaggcauaggccug

SEQ ID NO: 2088958 - RNA, 17 nt, Human
cucaggcauaggccugg

SEQ ID NO: 2088959 - RNA, 20 nt, Human
cucaggcauaggccugggug

SEQ ID NO: 2088960 - RNA, 21 nt, Human
cucaggcauaggccugggugc

SEQ ID NO: 2088961 - RNA, 18 nt, Human
cucagggccccagcacua

SEQ ID NO: 2088962 - RNA, 14 nt, Human
cucagggccccagc

SEQ ID NO: 2088963 - RNA, 16 nt, Human
cucagggccccagcac

SEQ ID NO: 2088964 - RNA, 18 nt, Human
cucaggcaugccugugug

SEQ ID NO: 2088965 - RNA, 22 nt, Human
cucaggcauaggccugggugcu

SEQ ID NO: 2088966 - RNA, 23 nt, Human
cucaggcauaggccugggugcug

SEQ ID NO: 2088967 - RNA, 17 nt, Human
cucaggcaucauuccac

SEQ ID NO: 2088968 - RNA, 18 nt, Human
cucaggcaucauuccacc

SEQ ID NO: 2088969 - RNA, 15 nt, Human
cucaggcaugccugu

SEQ ID NO: 2088970 - RNA, 16 nt, Human
cucaggcaugccugug

SEQ ID NO: 2088971 - RNA, 17 nt, Human
cucaggcaugccugugu

SEQ ID NO: 2088972 - RNA, 15 nt, Human
cucagggcagccugc

SEQ ID NO: 2088973 - RNA, 16 nt, Human
cucagggcagccugcc

SEQ ID NO: 2088974 - RNA, 19 nt, Human
cucagggcagccugccugg

SEQ ID NO: 2088975 - RNA, 20 nt, Human
cucagggcagccugccugga

SEQ ID NO: 2088976 - RNA, 12 nt, Human
cucagggcccca

SEQ ID NO: 2088977 - RNA, 13 nt, Human
cucagggccccag

SEQ ID NO: 2088978 - RNA, 23 nt, Human
cucaggugauccacccaccucag

SEQ ID NO: 2088979 - RNA, 22 nt, Human
cucaggugauccacccaccuca

SEQ ID NO: 2088980 - RNA, 20 nt, Human
cucaguucccuuggccucag

SEQ ID NO: 2088981 - RNA, 21 nt, Human
cucaguucccuuggccucaga

SEQ ID NO: 2088982 - RNA, 14 nt, Human
cucagggccugguc

SEQ ID NO: 2088983 - RNA, 15 nt, Human
cucagcucccaaggc

SEQ ID NO: 2088984 - RNA, 19 nt, Human
cucagcucccaaggcucug

SEQ ID NO: 2088985 - RNA, 23 nt, Human
cucagcggggacagcuccuucug

SEQ ID NO: 2088986 - RNA, 23 nt, Human
cucagcguuuuuuuguuuuuaau

SEQ ID NO: 2088987 - RNA, 21 nt, Human
cucagcggggacagcuccuuc

SEQ ID NO: 2088988 - RNA, 20 nt, Human
cucagcggggacagcuccuu

SEQ ID NO: 2088989 - RNA, 19 nt, Human
cucagcggggacagcuccu

SEQ ID NO: 2088990 - RNA, 18 nt, Human
cucagcggggacagcucc

SEQ ID NO: 2088991 - RNA, 16 nt, Human
cucagcggggacagcu

SEQ ID NO: 2088992 - RNA, 15 nt, Human
cucagcggggacagc

SEQ ID NO: 2088993 - RNA, 14 nt, Human
cucagcggggacag

SEQ ID NO: 2088994 - RNA, 11 nt, Human
cucagcccuga

SEQ ID NO: 2088995 - RNA, 22 nt, Human
cucagcauccuggcacccggcc

SEQ ID NO: 2088996 - RNA, 21 nt, Human
cucagcauccuggcacccggc

SEQ ID NO: 2088997 - RNA, 13 nt, Human
cucagcauccugg

SEQ ID NO: 2088998 - RNA, 14 nt, Human
cucagauuuuuccu

SEQ ID NO: 2088999 - RNA, 19 nt, Human
cucagcaaaagaugcuucu

SEQ ID NO: 2089000 - RNA, 20 nt, Human
cucagcaaaagaugcuucuc

SEQ ID NO: 2089001 - RNA, 21 nt, Human
cucagcaaaagaugcuucuca

SEQ ID NO: 2089002 - RNA, 21 nt, Human
cucagcccucccugccccucc

SEQ ID NO: 2089003 - RNA, 20 nt, Human
cucagcccucccugccccuc

SEQ ID NO: 2089004 - RNA, 19 nt, Human
cucagcccucccugccccu

SEQ ID NO: 2089005 - RNA, 14 nt, Human
cucagcccucccug

SEQ ID NO: 2089006 - RNA, 11 nt, Human
cucagccccuc

SEQ ID NO: 2089007 - RNA, 13 nt, Human
cucagccccucuu

SEQ ID NO: 2089008 - RNA, 16 nt, Human
cucagccccucuugcc

SEQ ID NO: 2089009 - RNA, 18 nt, Human
cucagccccucuugcccc

SEQ ID NO: 2089010 - RNA, 19 nt, Human
cucagccccucuugccccc

SEQ ID NO: 2089011 - RNA, 20 nt, Human
cucagccaaccuuacuuaca

SEQ ID NO: 2089012 - RNA, 22 nt, Human
cucagccaaccuuacuuacagc

SEQ ID NO: 2089013 - RNA, 15 nt, Human
cucagcauccuggca

SEQ ID NO: 2089014 - RNA, 11 nt, Human
cucagccccag

SEQ ID NO: 2089015 - RNA, 15 nt, Human
cucagccccagccca

SEQ ID NO: 2089016 - RNA, 16 nt, Human
cucagccccagcccag

SEQ ID NO: 2089017 - RNA, 18 nt, Human
cucagccccagcccagcc

SEQ ID NO: 2089018 - RNA, 23 nt, Human
cucagccccagcccagcccagcu

SEQ ID NO: 2089019 - RNA, 11 nt, Human
cucagcccacc

SEQ ID NO: 2089020 - RNA, 16 nt, Human
cucagcccaccccccu

SEQ ID NO: 2089021 - RNA, 17 nt, Human
cucagcccaccccccuc

SEQ ID NO: 2089022 - RNA, 19 nt, Human
cucagcccaccccccucau

SEQ ID NO: 2089023 - RNA, 19 nt, Human
cucacuguugcccaggcug

SEQ ID NO: 2089024 - RNA, 18 nt, Human
cucacuguugcccaggcu

SEQ ID NO: 2089025 - RNA, 17 nt, Human
cucacuguugcccaggc

SEQ ID NO: 2089026 - RNA, 16 nt, Human
cucacuguugcccagg

SEQ ID NO: 2089027 - RNA, 15 nt, Human
cucagagccaccccu

SEQ ID NO: 2089028 - RNA, 21 nt, Human
cucacuguugaauuuucucua

SEQ ID NO: 2089029 - RNA, 15 nt, Human
cucacuguugaauuu

SEQ ID NO: 2089030 - RNA, 21 nt, Human
cucagaugcacaugagcuggc

SEQ ID NO: 2089031 - RNA, 16 nt, Human
cucagauggaaccgca

SEQ ID NO: 2089032 - RNA, 20 nt, Human
cucagauggaaccgcaggaa

SEQ ID NO: 2089033 - RNA, 23 nt, Human
cucagauggaaccgcaggaagcu

SEQ ID NO: 2089034 - RNA, 21 nt, Human
cucagauggaaccgcaggaag

SEQ ID NO: 2089035 - RNA, 22 nt, Human
cucagauggaaccgcaggaagc

SEQ ID NO: 2089036 - RNA, 14 nt, Human
cucagagccccgca

SEQ ID NO: 2089037 - RNA, 18 nt, Human
cucagaggguuguucucc

SEQ ID NO: 2089038 - RNA, 21 nt, Human
cucagaggguuguucuccuag

SEQ ID NO: 2089039 - RNA, 19 nt, Human
cucagagguagggcugcca

SEQ ID NO: 2089040 - RNA, 14 nt, Human
cucagaguccaggc

SEQ ID NO: 2089041 - RNA, 23 nt, Human
cucacagacuggagacaaugcag

SEQ ID NO: 2089042 - RNA, 16 nt, Human
cucacagagacacagg

SEQ ID NO: 2089043 - RNA, 16 nt, Human
cucacugcagccucaa

SEQ ID NO: 2089044 - RNA, 15 nt, Human
cucacugcagccuca

SEQ ID NO: 2089045 - RNA, 14 nt, Human
cucacugcagccuc

SEQ ID NO: 2089046 - RNA, 17 nt, Human
cucacagcacacucagc

SEQ ID NO: 2089047 - RNA, 15 nt, Human
cucacugcagccucg

SEQ ID NO: 2089048 - RNA, 16 nt, Human
cucacugcagccucga

SEQ ID NO: 2089049 - RNA, 22 nt, Human
cucacugggguccuggggccuc

SEQ ID NO: 2089050 - RNA, 12 nt, Human
cucacugggugg

SEQ ID NO: 2089051 - RNA, 13 nt, Human
cucacuggguggg

SEQ ID NO: 2089052 - RNA, 15 nt, Human
cucacuguugcccag

SEQ ID NO: 2089053 - RNA, 14 nt, Human
cucacuguugccca

SEQ ID NO: 2089054 - RNA, 17 nt, Human
cucacugggguccuggg

SEQ ID NO: 2089055 - RNA, 20 nt, Human
cucacugggguccuggggcc

SEQ ID NO: 2089056 - RNA, 13 nt, Human
cucacuggcagcc

SEQ ID NO: 2089057 - RNA, 18 nt, Human
cucacuggcagccccagc

SEQ ID NO: 2089058 - RNA, 19 nt, Human
cucacuggcagccccagca

SEQ ID NO: 2089059 - RNA, 20 nt, Human
cucacuggcagccccagcac

SEQ ID NO: 2089060 - RNA, 16 nt, Human
cuacuuuuccuucccu

SEQ ID NO: 2089061 - RNA, 21 nt, Human
cuacuuuuccuucccucaaag

SEQ ID NO: 2089062 - RNA, 22 nt, Human
cuacuuagcaugucccuaccga

SEQ ID NO: 2089063 - RNA, 19 nt, Human
cuacuuaccauaugugcuu

SEQ ID NO: 2089064 - RNA, 17 nt, Human
cuacuuagcaugucccu

SEQ ID NO: 2089065 - RNA, 20 nt, Human
cuacuguccuacccacccuc

SEQ ID NO: 2089066 - RNA, 13 nt, Human
cuacuuacacauc

SEQ ID NO: 2089067 - RNA, 10 nt, Human
cuagagaaac

SEQ ID NO: 2089068 - RNA, 23 nt, Human
cuagaaagugaauaaaaauuaag

SEQ ID NO: 2089069 - RNA, 22 nt, Human
cuagaggcuugcauaauaagcu

SEQ ID NO: 2089070 - RNA, 13 nt, Human
cuagauaaaaaga

SEQ ID NO: 2089071 - RNA, 15 nt, Human
cuagauaaaaagaug

SEQ ID NO: 2089072 - RNA, 16 nt, Human
cuagauaaaaagaugg

SEQ ID NO: 2089073 - RNA, 23 nt, Human
cuagauaaaaagauggccuuugc

SEQ ID NO: 2089074 - RNA, 17 nt, Human
cuagagauauggcagcg

SEQ ID NO: 2089075 - RNA, 19 nt, Human
cuagagagggaauucucuu

SEQ ID NO: 2089076 - RNA, 23 nt, Human
cuagaggccagccccacccagga

SEQ ID NO: 2089077 - RNA, 22 nt, Human
cuagaggccagccccacccagg

SEQ ID NO: 2089078 - RNA, 23 nt, Human
cuaccucaggcaggaagggcagg

SEQ ID NO: 2089079 - RNA, 14 nt, Human
cuaccucaggcagg

SEQ ID NO: 2089080 - RNA, 20 nt, Human
cuaccucaggcaggaagggc

SEQ ID NO: 2089081 - RNA, 15 nt, Human
cuaccucaaccugua

SEQ ID NO: 2089082 - RNA, 18 nt, Human
cuaccucaaccuguaaau

SEQ ID NO: 2089083 - RNA, 21 nt, Human
cuaccucaaccuguaaauuau

SEQ ID NO: 2089084 - RNA, 17 nt, Human
cuaccucacuggggucc

SEQ ID NO: 2089085 - RNA, 11 nt, Human
cuaccucagcc

SEQ ID NO: 2089086 - RNA, 12 nt, Human
cuaccucagccu

SEQ ID NO: 2089087 - RNA, 14 nt, Human
cuaccucagccuag

SEQ ID NO: 2089088 - RNA, 15 nt, Human
cuaccucagccuaga

SEQ ID NO: 2089089 - RNA, 13 nt, Human
cuaccucaggcag

SEQ ID NO: 2089090 - RNA, 22 nt, Human
cuaccgagucucuucuccacug

SEQ ID NO: 2089091 - RNA, 21 nt, Human
cuaccgagucucuucuccacu

SEQ ID NO: 2089092 - RNA, 23 nt, Human
cuaccgagucucuucuccacugg

SEQ ID NO: 2089093 - RNA, 19 nt, Human
cuaccgagucucuucucca

SEQ ID NO: 2089094 - RNA, 17 nt, Human
cuaccgagucucuucuc

SEQ ID NO: 2089095 - RNA, 23 nt, Human
cuacuccggaggcugaggcagga

SEQ ID NO: 2089096 - RNA, 15 nt, Human
cuacuccuaccucag

SEQ ID NO: 2089097 - RNA, 16 nt, Human
cuacuccuaccucagc

SEQ ID NO: 2089098 - RNA, 17 nt, Human
cuacuccuaccucagcc

SEQ ID NO: 2089099 - RNA, 18 nt, Human
cuacuccuaccucagccu

SEQ ID NO: 2089100 - RNA, 21 nt, Human
cuacuccuaccucagccuaga

SEQ ID NO: 2089101 - RNA, 19 nt, Human
cuacuguccuacccacccu

SEQ ID NO: 2089102 - RNA, 12 nt, Human
cuacugcuucua

SEQ ID NO: 2089103 - RNA, 22 nt, Human
cuacugcuucuaccaacuggaa

SEQ ID NO: 2089104 - RNA, 13 nt, Human
cuacucuguguca

SEQ ID NO: 2089105 - RNA, 12 nt, Human
cuacucuguguc

SEQ ID NO: 2089106 - RNA, 16 nt, Human
cuacugauuguuucau

SEQ ID NO: 2089107 - RNA, 17 nt, Human
cuacugauuguuucauu

SEQ ID NO: 2089108 - RNA, 22 nt, Human
cuacucucaggaucaagaaagu

SEQ ID NO: 2089109 - RNA, 22 nt, Human
cuagcuaauggaaaaugauuuu

SEQ ID NO: 2089110 - RNA, 16 nt, Human
cuagcgcugccgcacc

SEQ ID NO: 2089111 - RNA, 12 nt, Human
cuagcgcugccg

SEQ ID NO: 2089112 - RNA, 22 nt, Human
cuagcgcugccgcaccccagag

SEQ ID NO: 2089113 - RNA, 23 nt, Human
cuagccuuagaagucacacagua

SEQ ID NO: 2089114 - RNA, 22 nt, Human
cuagccuuagaagucacacagu

SEQ ID NO: 2089115 - RNA, 15 nt, Human
cuagaucagaacagg

SEQ ID NO: 2089116 - RNA, 19 nt, Human
cuagccuugaggaguguga

SEQ ID NO: 2089117 - RNA, 21 nt, Human
cuagccuuagaagucacacag

SEQ ID NO: 2089118 - RNA, 22 nt, Human
cuagccugugccucugggacug

SEQ ID NO: 2089119 - RNA, 21 nt, Human
cuagccugugccucugggacu

SEQ ID NO: 2089120 - RNA, 19 nt, Human
cuagccugugccucuggga

SEQ ID NO: 2089121 - RNA, 20 nt, Human
cuagagguuuuaugauauuu

SEQ ID NO: 2089122 - RNA, 15 nt, Human
cuagcuaugugaccu

SEQ ID NO: 2089123 - RNA, 19 nt, Human
cuagcuagaagugggccag

SEQ ID NO: 2089124 - RNA, 23 nt, Human
cuagcuagaagugggccaggaca

SEQ ID NO: 2089125 - RNA, 22 nt, Human
cuagcuccacacccucucccag

SEQ ID NO: 2089126 - RNA, 19 nt, Human
cuagcuggaauuuuuuauu

SEQ ID NO: 2089127 - RNA, 21 nt, Human
cuagcuggaauuuuuuauucu

SEQ ID NO: 2089128 - RNA, 22 nt, Human
cuagcuggaauuuuuuauucuu

SEQ ID NO: 2089129 - RNA, 23 nt, Human
cuagcuggaauuuuuuauucuug

SEQ ID NO: 2089130 - RNA, 24 nt, Human
cuagcuggaauuuuuuauucuugu

SEQ ID NO: 2089131 - RNA, 20 nt, Human
cuagcuugggaggcuucccc

SEQ ID NO: 2089132 - RNA, 18 nt, Human
cuagcuguugagcuguuu

SEQ ID NO: 2089133 - RNA, 12 nt, Human
cuagcugugugc

SEQ ID NO: 2089134 - RNA, 20 nt, Human
cuagcuuacaugagaacaga

SEQ ID NO: 2089135 - RNA, 17 nt, Human
cuauugacaagucauuu

SEQ ID NO: 2089136 - RNA, 21 nt, Human
cuauugauauaaauaaaacau

SEQ ID NO: 2089137 - RNA, 16 nt, Human
cuauugacaagucauu

SEQ ID NO: 2089138 - RNA, 22 nt, Human
cuauugacaucagcaucaccua

SEQ ID NO: 2089139 - RNA, 23 nt, Human
cuauucaguaauaacucuacccu

SEQ ID NO: 2089140 - RNA, 14 nt, Human
cuauucucuccuca

SEQ ID NO: 2089141 - RNA, 16 nt, Human
cuauucucuccucaga

SEQ ID NO: 2089142 - RNA, 18 nt, Human
cuauucucuccucagacu

SEQ ID NO: 2089143 - RNA, 19 nt, Human
cuauucucuccucagacug

SEQ ID NO: 2089144 - RNA, 15 nt, Human
cuauguaacugcauu

SEQ ID NO: 2089145 - RNA, 15 nt, Human
cuauggggauggucc

SEQ ID NO: 2089146 - RNA, 18 nt, Human
cuauggggaugguccacu

SEQ ID NO: 2089147 - RNA, 21 nt, Human
cuauguaacugcauugagaac

SEQ ID NO: 2089148 - RNA, 15 nt, Human
cuauguacaauauuu

SEQ ID NO: 2089149 - RNA, 16 nt, Human
cuauguacaauauuuu

SEQ ID NO: 2089150 - RNA, 18 nt, Human
cuauguacaauauuuuaa

SEQ ID NO: 2089151 - RNA, 19 nt, Human
cuauguacaauauuuuaag

SEQ ID NO: 2089152 - RNA, 21 nt, Human
cuauguacaauauuuuaagca

SEQ ID NO: 2089153 - RNA, 22 nt, Human
cuauguacaauauuuuaagcau

SEQ ID NO: 2089154 - RNA, 19 nt, Human
cuaugggagccccaggguc

SEQ ID NO: 2089155 - RNA, 16 nt, Human
cuauggggacauucca

SEQ ID NO: 2089156 - RNA, 17 nt, Human
cuauggggagaaaagac

SEQ ID NO: 2089157 - RNA, 21 nt, Human
cuauggggagaaaagacauga

SEQ ID NO: 2089158 - RNA, 20 nt, Human
cuaugcucauaacuguguca

SEQ ID NO: 2089159 - RNA, 13 nt, Human
cuauguaucaaug

SEQ ID NO: 2089160 - RNA, 15 nt, Human
cuauuauaauuuaau

SEQ ID NO: 2089161 - RNA, 16 nt, Human
cuauguaucaaugagu

SEQ ID NO: 2089162 - RNA, 16 nt, Human
cuauuauaauuuaaug

SEQ ID NO: 2089163 - RNA, 17 nt, Human
cuauuauaauuuaaugc

SEQ ID NO: 2089164 - RNA, 21 nt, Human
cuauuauaauuuaaugcaugu

SEQ ID NO: 2089165 - RNA, 17 nt, Human
cuauucaguaauaacuc

SEQ ID NO: 2089166 - RNA, 15 nt, Human
cuaugauuuggaaaa

SEQ ID NO: 2089167 - RNA, 19 nt, Human
cuaugauuuggaaaauaaa

SEQ ID NO: 2089168 - RNA, 19 nt, Human
cuaugcauuuuaaaguuaa

SEQ ID NO: 2089169 - RNA, 19 nt, Human
cuaugccagcucaguccca

SEQ ID NO: 2089170 - RNA, 20 nt, Human
cuaugccagcucagucccau

SEQ ID NO: 2089171 - RNA, 13 nt, Human
cuauacugccucu

SEQ ID NO: 2089172 - RNA, 13 nt, Human
cuauagucccagc

SEQ ID NO: 2089173 - RNA, 14 nt, Human
cuauagucccagcu

SEQ ID NO: 2089174 - RNA, 15 nt, Human
cuauagucccagcua

SEQ ID NO: 2089175 - RNA, 19 nt, Human
cuauauaguaccuuugcuc

SEQ ID NO: 2089176 - RNA, 20 nt, Human
cuauauaguaccuuugcucu

SEQ ID NO: 2089177 - RNA, 20 nt, Human
cuauaauucccuaucuuuua

SEQ ID NO: 2089178 - RNA, 22 nt, Human
cuauaauucccuaucuuuuagu

SEQ ID NO: 2089179 - RNA, 16 nt, Human
cuauaauugccacuga

SEQ ID NO: 2089180 - RNA, 19 nt, Human
cuauaccccuuacuuagca

SEQ ID NO: 2089181 - RNA, 20 nt, Human
cuauaccccuuacuuagcau

SEQ ID NO: 2089182 - RNA, 21 nt, Human
cuauagccuaggugacagagu

SEQ ID NO: 2089183 - RNA, 20 nt, Human
cuauagccuaggugacagag

SEQ ID NO: 2089184 - RNA, 18 nt, Human
cuauagccuaggugacag

SEQ ID NO: 2089185 - RNA, 19 nt, Human
cuauagccuaggugacaga

SEQ ID NO: 2089186 - RNA, 18 nt, Human
cucaacccucccucagcc

SEQ ID NO: 2089187 - RNA, 19 nt, Human
cucaacccucccucagccc

SEQ ID NO: 2089188 - RNA, 21 nt, Human
cucaacccucccucagccccu

SEQ ID NO: 2089189 - RNA, 22 nt, Human
cucaacccucccucagccccuc

SEQ ID NO: 2089190 - RNA, 15 nt, Human
cucaaccauccccuc

SEQ ID NO: 2089191 - RNA, 20 nt, Human
cucaaccauccccuccgugg

SEQ ID NO: 2089192 - RNA, 18 nt, Human
cucaaccccaccacuucu

SEQ ID NO: 2089193 - RNA, 22 nt, Human
cucaacccccauuucuauuuau

SEQ ID NO: 2089194 - RNA, 19 nt, Human
cucaacccccauuucuauu

SEQ ID NO: 2089195 - RNA, 16 nt, Human
cucaacccucccucag

SEQ ID NO: 2089196 - RNA, 16 nt, Human
cucaacauguuacuga

SEQ ID NO: 2089197 - RNA, 20 nt, Human
cucaacauguuacugaccag

SEQ ID NO: 2089198 - RNA, 23 nt, Human
cuauuucugagaagguccuuaau

SEQ ID NO: 2089199 - RNA, 13 nt, Human
cuauuucugagaa

SEQ ID NO: 2089200 - RNA, 18 nt, Human
cuauuucaaaaauuugga

SEQ ID NO: 2089201 - RNA, 19 nt, Human
cuauuucaaaaauuuggaa

SEQ ID NO: 2089202 - RNA, 18 nt, Human
cuauuuauuuacugagcu

SEQ ID NO: 2089203 - RNA, 15 nt, Human
cuauuuauuuacuga

SEQ ID NO: 2089204 - RNA, 14 nt, Human
cuauuuauuuacug

SEQ ID NO: 2089205 - RNA, 17 nt, Human
cucaagcaauccuccug

SEQ ID NO: 2089206 - RNA, 18 nt, Human
cucaagcaauccuccuga

SEQ ID NO: 2089207 - RNA, 20 nt, Human
cucaagcaauccuccugagu

SEQ ID NO: 2089208 - RNA, 21 nt, Human
cucaagcaauccuccugagug

SEQ ID NO: 2089209 - RNA, 22 nt, Human
cucaagcaauccuccugaguga

SEQ ID NO: 2089210 - RNA, 17 nt, Human
cucaacucaccuaaugu

SEQ ID NO: 2089211 - RNA, 13 nt, Human
cucaagcccugca

SEQ ID NO: 2089212 - RNA, 12 nt, Human
cucaagcccugc

SEQ ID NO: 2089213 - RNA, 15 nt, Human
cucaaggcgugagga

SEQ ID NO: 2089214 - RNA, 16 nt, Human
cucaaggcgugaggau

SEQ ID NO: 2089215 - RNA, 14 nt, Human
cucaagcagucuac

SEQ ID NO: 2089216 - RNA, 23 nt, Human
cucaagcagucuacccaccucag

SEQ ID NO: 2089217 - RNA, 16 nt, Human
cucaagccaagcagcc

SEQ ID NO: 2089218 - RNA, 18 nt, Human
cucaagccaagcagccaa

SEQ ID NO: 2089219 - RNA, 21 nt, Human
cucaagccaagcagccaagcu

SEQ ID NO: 2089220 - RNA, 22 nt, Human
cucaagccaagcagccaagcuc

SEQ ID NO: 2089221 - RNA, 14 nt, Human
cucaaguccucuuu

SEQ ID NO: 2089222 - RNA, 18 nt, Human
cucaagggggacugucuu

SEQ ID NO: 2089223 - RNA, 19 nt, Human
cucaaggugggccuugcua

SEQ ID NO: 2089224 - RNA, 23 nt, Human
cucacacggacacucaaaagcug

SEQ ID NO: 2089225 - RNA, 21 nt, Human
cucacaccgcgucuggugaca

SEQ ID NO: 2089226 - RNA, 17 nt, Human
cucacagaacccuugga

SEQ ID NO: 2089227 - RNA, 13 nt, Human
cucacagaagaau

SEQ ID NO: 2089228 - RNA, 10 nt, Human
cucacacucc

SEQ ID NO: 2089229 - RNA, 11 nt, Human
cuauugguaaa

SEQ ID NO: 2089230 - RNA, 15 nt, Human
cuauuggguucauua

SEQ ID NO: 2089231 - RNA, 16 nt, Human
cuauuggguucauuau

SEQ ID NO: 2089232 - RNA, 23 nt, Human
cuauuggguucauuauuggaauu

SEQ ID NO: 2089233 - RNA, 13 nt, Human
cuauuuaaauucu

SEQ ID NO: 2089234 - RNA, 14 nt, Human
cuauuuaaauucuu

SEQ ID NO: 2089235 - RNA, 15 nt, Human
cuauuuaaauucuuu

SEQ ID NO: 2089236 - RNA, 22 nt, Human
cuauuuaacuggcuucagccuc

SEQ ID NO: 2089237 - RNA, 16 nt, Human
cuauugcugcuugagg

SEQ ID NO: 2089238 - RNA, 17 nt, Human
cuauugcagcugggaga

SEQ ID NO: 2089239 - RNA, 16 nt, Human
cuaacaaccaaagacu

SEQ ID NO: 2089240 - RNA, 13 nt, Human
cuaaaugaagugc

SEQ ID NO: 2089241 - RNA, 15 nt, Human
cuaacaggggcuggu

SEQ ID NO: 2089242 - RNA, 19 nt, Human
cuaacaggggcuggugggc

SEQ ID NO: 2089243 - RNA, 20 nt, Human
cuaacaggggcuggugggca

SEQ ID NO: 2089244 - RNA, 17 nt, Human
cuaacaguucacuugca

SEQ ID NO: 2089245 - RNA, 19 nt, Human
cuaacaguucacuugcagu

SEQ ID NO: 2089246 - RNA, 17 nt, Human
cuaacacuggccccuag

SEQ ID NO: 2089247 - RNA, 18 nt, Human
cuaacagauaagcaagag

SEQ ID NO: 2089248 - RNA, 17 nt, Human
cuaacagauaagcaaga

SEQ ID NO: 2089249 - RNA, 14 nt, Human
cuaaccacacagcc

SEQ ID NO: 2089250 - RNA, 15 nt, Human
cuaaccacacagccu

SEQ ID NO: 2089251 - RNA, 13 nt, Human
cuaaccaaaugca

SEQ ID NO: 2089252 - RNA, 14 nt, Human
cuaaccaaaugcau

SEQ ID NO: 2089253 - RNA, 14 nt, Human
cuaaccacgcugga

SEQ ID NO: 2089254 - RNA, 12 nt, Human
cuaaccacgcug

SEQ ID NO: 2089255 - RNA, 13 nt, Human
cuaaccccuuucc

SEQ ID NO: 2089256 - RNA, 14 nt, Human
cuaaccccuuuccu

SEQ ID NO: 2089257 - RNA, 16 nt, Human
cuaaccccuuuccugc

SEQ ID NO: 2089258 - RNA, 12 nt, Human
cuaaccuccuuu

SEQ ID NO: 2089259 - RNA, 13 nt, Human
cuaaccuccuuua

SEQ ID NO: 2089260 - RNA, 14 nt, Human
cuaaccuaagcaaa

SEQ ID NO: 2089261 - RNA, 22 nt, Human
cuaaccuaagcaaaaccacuga

SEQ ID NO: 2089262 - RNA, 19 nt, Human
cuaaccucuuuucugcauc

SEQ ID NO: 2089263 - RNA, 11 nt, Human
cuaagagccau

SEQ ID NO: 2089264 - RNA, 20 nt, Human
cuaagagccauuuaggggcc

SEQ ID NO: 2089265 - RNA, 16 nt, Human
cuaagagcuagcgcug

SEQ ID NO: 2089266 - RNA, 18 nt, Human
cuaagagcuagcgcugcc

SEQ ID NO: 2089267 - RNA, 19 nt, Human
cuaagagcuagcgcugccg

SEQ ID NO: 2089268 - RNA, 20 nt, Human
cuaagagcuagcgcugccgc

SEQ ID NO: 2089269 - RNA, 12 nt, Human
cuaagagugucc

SEQ ID NO: 2089270 - RNA, 18 nt, Human
cuaagaguguccuaggag

SEQ ID NO: 2089271 - RNA, 15 nt, Human
cuaaauaaaauauaa

SEQ ID NO: 2089272 - RNA, 17 nt, Human
cuaaauaaaauauaauu

SEQ ID NO: 2089273 - RNA, 18 nt, Human
cuaaauaaaauauaauug

SEQ ID NO: 2089274 - RNA, 19 nt, Human
cuaaauaaaauauaauugu

SEQ ID NO: 2089275 - RNA, 20 nt, Human
cuaaauaaaauauaauuguu

SEQ ID NO: 2089276 - RNA, 20 nt, Human
cuaaauaaacacauagauuc

SEQ ID NO: 2089277 - RNA, 22 nt, Human
cuaaauaaacacauagauucac

SEQ ID NO: 2089278 - RNA, 22 nt, Human
cuaaaugaaaaucgugacaaca

SEQ ID NO: 2089279 - RNA, 16 nt, Human
cuaaaucuccuauuuu

SEQ ID NO: 2089280 - RNA, 17 nt, Human
cuaaaucuccuauuuuu

SEQ ID NO: 2089281 - RNA, 18 nt, Human
cuaaaucuguaagcucuu

SEQ ID NO: 2089282 - RNA, 22 nt, Human
cuaaaucuguaagcucuuugaa

SEQ ID NO: 2089283 - RNA, 19 nt, Human
cuaaaauagccacuuaccu

SEQ ID NO: 2089284 - RNA, 13 nt, Human
cuaaaauagccac

SEQ ID NO: 2089285 - RNA, 13 nt, Human
cuaaaaauacaaa

SEQ ID NO: 2089286 - RNA, 20 nt, Human
cgggaggcagagguugcagu

SEQ ID NO: 2089287 - RNA, 20 nt, Human
cguuugcccaaaucugccua

SEQ ID NO: 2089288 - RNA, 9 nt, Human
cguuuguuu

SEQ ID NO: 2089289 - RNA, 12 nt, Human
cguuuguuuguu

SEQ ID NO: 2089290 - RNA, 13 nt, Human
cguuuguuuguuu

SEQ ID NO: 2089291 - RNA, 21 nt, Human
cgggacgagacccuacaggag

SEQ ID NO: 2089292 - RNA, 22 nt, Human
cgggaggcagagguugcagugu

SEQ ID NO: 2089293 - RNA, 21 nt, Human
cgggaggauguucugggacac

SEQ ID NO: 2089294 - RNA, 23 nt, Human
cgggaggauguucugggacacag

SEQ ID NO: 2089295 - RNA, 12 nt, Human
cuaaaaguucau

SEQ ID NO: 2089296 - RNA, 18 nt, Human
cuaaaaguucauaacagu

SEQ ID NO: 2089297 - RNA, 22 nt, Human
cuaaaaguucauaacagugcca

SEQ ID NO: 2089298 - RNA, 23 nt, Human
cuaaaaguucauaacagugccau

SEQ ID NO: 2089299 - RNA, 18 nt, Human
cuaaaaauaguggccaga

SEQ ID NO: 2089300 - RNA, 12 nt, Human
cguuuuauugug

SEQ ID NO: 2089301 - RNA, 15 nt, Human
cguuuguuuguuuug

SEQ ID NO: 2089302 - RNA, 16 nt, Human
cguuuguuuguuuugu

SEQ ID NO: 2089303 - RNA, 17 nt, Human
cguuuguuuguuuuguu

SEQ ID NO: 2089304 - RNA, 14 nt, Human
cguuuuauuguguu

SEQ ID NO: 2089305 - RNA, 18 nt, Human
cguuuuauuguguuuuua

SEQ ID NO: 2089306 - RNA, 11 nt, Human
cuaaaaaacag

SEQ ID NO: 2089307 - RNA, 17 nt, Human
cuaaaaaacagaggcca

SEQ ID NO: 2089308 - RNA, 17 nt, Human
cuaauauacaggguagc

SEQ ID NO: 2089309 - RNA, 20 nt, Human
cuaauagaacucaguuuuaa

SEQ ID NO: 2089310 - RNA, 13 nt, Human
cuaauagaacuca

SEQ ID NO: 2089311 - RNA, 16 nt, Human
cuaauacauuaaagca

SEQ ID NO: 2089312 - RNA, 17 nt, Human
cuaauacauuaaagcag

SEQ ID NO: 2089313 - RNA, 18 nt, Human
cuaauacauuaaagcagu

SEQ ID NO: 2089314 - RNA, 19 nt, Human
cuaauacauuaaagcaguc

SEQ ID NO: 2089315 - RNA, 12 nt, Human
cuaauacaccag

SEQ ID NO: 2089316 - RNA, 23 nt, Human
cuaaggaagaucacuuugcucug

SEQ ID NO: 2089317 - RNA, 16 nt, Human
cuaaggacauuuccca

SEQ ID NO: 2089318 - RNA, 17 nt, Human
cuaaggacauuucccag

SEQ ID NO: 2089319 - RNA, 19 nt, Human
cuaaggacauuucccaggg

SEQ ID NO: 2089320 - RNA, 19 nt, Human
cuaaggccgaagaaggguc

SEQ ID NO: 2089321 - RNA, 17 nt, Human
cuaagauguucacugug

SEQ ID NO: 2089322 - RNA, 22 nt, Human
cuaagcucaaggcgugaggaug

SEQ ID NO: 2089323 - RNA, 15 nt, Human
cuaagcuuaaaaaaa

SEQ ID NO: 2089324 - RNA, 17 nt, Human
cuaagcuuaaaaaaaac

SEQ ID NO: 2089325 - RNA, 22 nt, Human
cuaagcuauucaguaauaacuc

SEQ ID NO: 2089326 - RNA, 14 nt, Human
cuaaucaugaaacu

SEQ ID NO: 2089327 - RNA, 13 nt, Human
cuaauccaaccca

SEQ ID NO: 2089328 - RNA, 16 nt, Human
cuaaucauccaaugcu

SEQ ID NO: 2089329 - RNA, 15 nt, Human
cuaauccaacccaug

SEQ ID NO: 2089330 - RNA, 21 nt, Human
cuaaucagcauucucacuccu

SEQ ID NO: 2089331 - RNA, 20 nt, Human
cuaaucagcauucucacucc

SEQ ID NO: 2089332 - RNA, 18 nt, Human
cuaauauguaacaagcca

SEQ ID NO: 2089333 - RNA, 19 nt, Human
cuaauggguauuuaaacaa

SEQ ID NO: 2089334 - RNA, 14 nt, Human
cuaauuagagcaga

SEQ ID NO: 2089335 - RNA, 13 nt, Human
cuaauuauuuuaa

SEQ ID NO: 2089336 - RNA, 16 nt, Human
cuaauuauuuuaauua

SEQ ID NO: 2089337 - RNA, 22 nt, Human
cuaauuauuuuaauuagguuaa

SEQ ID NO: 2089338 - RNA, 13 nt, Human
cuaaugggacacu

SEQ ID NO: 2089339 - RNA, 12 nt, Human
cuaaugggacac

SEQ ID NO: 2089340 - RNA, 17 nt, Human
cuaauggaaaaugauuu

SEQ ID NO: 2089341 - RNA, 21 nt, Human
cuaauggaaaaugauuuuacu

SEQ ID NO: 2089342 - RNA, 14 nt, Human
cuacacuccagccu

SEQ ID NO: 2089343 - RNA, 22 nt, Human
cuacaccccuccccugcccuag

SEQ ID NO: 2089344 - RNA, 17 nt, Human
cuaauucccauuuugca

SEQ ID NO: 2089345 - RNA, 18 nt, Human
cuaauucccauuuugcaa

SEQ ID NO: 2089346 - RNA, 19 nt, Human
cuaauucccauuuugcaaa

SEQ ID NO: 2089347 - RNA, 20 nt, Human
cuaauucccauuuugcaaaa

SEQ ID NO: 2089348 - RNA, 21 nt, Human
cuaauucccauuuugcaaaau

SEQ ID NO: 2089349 - RNA, 21 nt, Human
cuacacauauguauuccugau

SEQ ID NO: 2089350 - RNA, 11 nt, Human
cuaauucuaac

SEQ ID NO: 2089351 - RNA, 13 nt, Human
cuaccacaguguc

SEQ ID NO: 2089352 - RNA, 14 nt, Human
cuaccacagugucu

SEQ ID NO: 2089353 - RNA, 15 nt, Human
cuaccacagugucug

SEQ ID NO: 2089354 - RNA, 18 nt, Human
cuaccauccccuguagag

SEQ ID NO: 2089355 - RNA, 11 nt, Human
cuaccaccucc

SEQ ID NO: 2089356 - RNA, 14 nt, Human
cuaccaccucccca

SEQ ID NO: 2089357 - RNA, 15 nt, Human
cuaccaccuccccag

SEQ ID NO: 2089358 - RNA, 16 nt, Human
cuaccaccuccccagc

SEQ ID NO: 2089359 - RNA, 17 nt, Human
cuaccaccuccccagcc

SEQ ID NO: 2089360 - RNA, 11 nt, Human
cuaccaucucc

SEQ ID NO: 2089361 - RNA, 13 nt, Human
cuaccaucucccu

SEQ ID NO: 2089362 - RNA, 16 nt, Human
cuacaugugggagcuu

SEQ ID NO: 2089363 - RNA, 22 nt, Human
cuacauuauaaaugucucuuua

SEQ ID NO: 2089364 - RNA, 17 nt, Human
cuacaugugggagcuuu

SEQ ID NO: 2089365 - RNA, 12 nt, Human
cuaccaacugga

SEQ ID NO: 2089366 - RNA, 14 nt, Human
cuaccaacuggaag

SEQ ID NO: 2089367 - RNA, 15 nt, Human
cuaccaacuggaagc

SEQ ID NO: 2089368 - RNA, 16 nt, Human
cuaccaacuggaagca

SEQ ID NO: 2089369 - RNA, 18 nt, Human
cuaccaacuggaagcaca

SEQ ID NO: 2089370 - RNA, 23 nt, Human
cuacauuucaccuacuuuguaag

SEQ ID NO: 2089371 - RNA, 11 nt, Human
cuacauuuuaa

SEQ ID NO: 2089372 - RNA, 12 nt, Human
cuacauuuuaac

SEQ ID NO: 2089373 - RNA, 13 nt, Human
cuacauuuuaaca

SEQ ID NO: 2089374 - RNA, 14 nt, Human
cuacauuuuaacau

SEQ ID NO: 2089375 - RNA, 15 nt, Human
cuacauuuuaacaug

SEQ ID NO: 2089376 - RNA, 17 nt, Human
cuacccagcgagcccug

SEQ ID NO: 2089377 - RNA, 15 nt, Human
cuacccagcgagccc

SEQ ID NO: 2089378 - RNA, 13 nt, Human
cuacccacccucc

SEQ ID NO: 2089379 - RNA, 18 nt, Human
cuacccagcgagcccugg

SEQ ID NO: 2089380 - RNA, 23 nt, Human
cuacccaucgguguccauuuaua

SEQ ID NO: 2089381 - RNA, 12 nt, Human
cuacccagccca

SEQ ID NO: 2089382 - RNA, 13 nt, Human
cuacccagcccau

SEQ ID NO: 2089383 - RNA, 15 nt, Human
cuacccagcccaucu

SEQ ID NO: 2089384 - RNA, 13 nt, Human
cuaccccaccacg

SEQ ID NO: 2089385 - RNA, 14 nt, Human
cuaccccaccacga

SEQ ID NO: 2089386 - RNA, 17 nt, Human
cuacccucuuagaaaaa

SEQ ID NO: 2089387 - RNA, 12 nt, Human
cuacccucccac

SEQ ID NO: 2089388 - RNA, 17 nt, Human
cuacccccuaagagcca

SEQ ID NO: 2089389 - RNA, 13 nt, Human
cuacccucccacc

SEQ ID NO: 2089390 - RNA, 14 nt, Human
cuacccucccaccc

SEQ ID NO: 2089391 - RNA, 16 nt, Human
cuacccucccaccccc

SEQ ID NO: 2089392 - RNA, 19 nt, Human
cuacccucccacccccuuc

SEQ ID NO: 2089393 - RNA, 14 nt, Human
cuacccucccccag

SEQ ID NO: 2089394 - RNA, 20 nt, Human
cuacagaggccaugggccuc

SEQ ID NO: 2089395 - RNA, 18 nt, Human
cuacagaggccaugggcc

SEQ ID NO: 2089396 - RNA, 22 nt, Human
cuacagaggccaugggccuccu

SEQ ID NO: 2089397 - RNA, 22 nt, Human
cuacacuguauuacauaaauaa

SEQ ID NO: 2089398 - RNA, 20 nt, Human
cuacacugugaacuugggga

SEQ ID NO: 2089399 - RNA, 16 nt, Human
cuacacuccagccuga

SEQ ID NO: 2089400 - RNA, 17 nt, Human
cuacagaggccaugggc

SEQ ID NO: 2089401 - RNA, 19 nt, Human
cuacagcuaaucagcauuc

SEQ ID NO: 2089402 - RNA, 18 nt, Human
cuacagcuaaucagcauu

SEQ ID NO: 2089403 - RNA, 13 nt, Human
cuacagauguccc

SEQ ID NO: 2089404 - RNA, 13 nt, Human
cuacagcaaauuu

SEQ ID NO: 2089405 - RNA, 15 nt, Human
cuacagcaaauuuau

SEQ ID NO: 2089406 - RNA, 16 nt, Human
cuacagcaaauuuaua

SEQ ID NO: 2089407 - RNA, 20 nt, Human
cuacagcaaauuuauaauuu

SEQ ID NO: 2089408 - RNA, 22 nt, Human
cuacagcaaauuuauaauuuua

SEQ ID NO: 2089409 - RNA, 22 nt, Human
cuacagcuaaucagcauucuca

SEQ ID NO: 2089410 - RNA, 21 nt, Human
cuacagcuaaucagcauucuc

SEQ ID NO: 2089411 - RNA, 18 nt, Human
cuacauggaguauauguc

SEQ ID NO: 2089412 - RNA, 20 nt, Human
cuacauggaguauaugucaa

SEQ ID NO: 2089413 - RNA, 16 nt, Human
cuacaggugugaguca

SEQ ID NO: 2089414 - RNA, 14 nt, Human
cuacaggugugagu

SEQ ID NO: 2089415 - RNA, 16 nt, Human
cuacaggagugagcac

SEQ ID NO: 2089416 - RNA, 15 nt, Human
cuacaggagugagca

SEQ ID NO: 2089417 - RNA, 14 nt, Human
cuacaggagugagc

SEQ ID NO: 2089418 - RNA, 18 nt, Human
cuacaggaagcaccccau

SEQ ID NO: 2089419 - RNA, 20 nt, Human
cuacaggaagcaccccaugc

SEQ ID NO: 2089420 - RNA, 22 nt, Human
cuacaggaagcaccccaugcca

SEQ ID NO: 2089421 - RNA, 18 nt, Human
cuacaggagagggaagag

SEQ ID NO: 2089422 - RNA, 17 nt, Human
cuacaggcacccaccau

SEQ ID NO: 2089423 - RNA, 15 nt, Human
cuacaggcacccacc

SEQ ID NO: 2089424 - RNA, 22 nt, Human
cuacagggcgagacucugucuc

SEQ ID NO: 2089425 - RNA, 20 nt, Human
cuacaggccucacacacaau

SEQ ID NO: 2089426 - RNA, 16 nt, Human
cuacaggccucacaca

SEQ ID NO: 2089427 - RNA, 12 nt, Human
cuacaggccuca

SEQ ID NO: 2089428 - RNA, 21 nt, Human
cuacaggagagggaagagugc

SEQ ID NO: 2089429 - RNA, 13 nt, Human
ccugccucagccu

SEQ ID NO: 2089430 - RNA, 14 nt, Human
ccugccucagccuc

SEQ ID NO: 2089431 - RNA, 12 nt, Human
ccugccucagcc

SEQ ID NO: 2089432 - RNA, 22 nt, Human
ccugccuguucccauucuugca

SEQ ID NO: 2089433 - RNA, 12 nt, Human
ccugccugugcu

SEQ ID NO: 2089434 - RNA, 21 nt, Human
ccugccgcccgagguggcugc

SEQ ID NO: 2089435 - RNA, 14 nt, Human
ccugccgccucaau

SEQ ID NO: 2089436 - RNA, 13 nt, Human
ccugccugucucc

SEQ ID NO: 2089437 - RNA, 14 nt, Human
ccugccugucuccu

SEQ ID NO: 2089438 - RNA, 15 nt, Human
ccugccugucuccuu

SEQ ID NO: 2089439 - RNA, 16 nt, Human
ccugccgacacgcucc

SEQ ID NO: 2089440 - RNA, 20 nt, Human
ccugccgacacgcucccucc

SEQ ID NO: 2089441 - RNA, 21 nt, Human
ccugccgacacgcucccuccc

SEQ ID NO: 2089442 - RNA, 18 nt, Human
ccugccgaccucguccuc

SEQ ID NO: 2089443 - RNA, 16 nt, Human
ccugcccuucagcauc

SEQ ID NO: 2089444 - RNA, 17 nt, Human
ccugcccuucagcaucc

SEQ ID NO: 2089445 - RNA, 15 nt, Human
ccugcccuuguccca

SEQ ID NO: 2089446 - RNA, 16 nt, Human
ccugcccuugucccac

SEQ ID NO: 2089447 - RNA, 19 nt, Human
ccugcccuugucccacuca

SEQ ID NO: 2089448 - RNA, 13 nt, Human
ccugcccugcugc

SEQ ID NO: 2089449 - RNA, 20 nt, Human
ccugcccugcugccgccucc

SEQ ID NO: 2089450 - RNA, 12 nt, Human
ccugcccugguc

SEQ ID NO: 2089451 - RNA, 15 nt, Human
ccugcccugguccag

SEQ ID NO: 2089452 - RNA, 19 nt, Human
ccugccccuucuacacucu

SEQ ID NO: 2089453 - RNA, 20 nt, Human
ccugccccuucuacacucuc

SEQ ID NO: 2089454 - RNA, 21 nt, Human
ccugccccuucuacacucucc

SEQ ID NO: 2089455 - RNA, 22 nt, Human
ccugccccuucuacacucuccu

SEQ ID NO: 2089456 - RNA, 23 nt, Human
ccugccccuucuacacucuccug

SEQ ID NO: 2089457 - RNA, 16 nt, Human
ccugcccggcugcgga

SEQ ID NO: 2089458 - RNA, 14 nt, Human
ccugcccggcugcg

SEQ ID NO: 2089459 - RNA, 18 nt, Human
ccugcccuagagcacacu

SEQ ID NO: 2089460 - RNA, 14 nt, Human
ccugcccuagcucc

SEQ ID NO: 2089461 - RNA, 19 nt, Human
ccugcccuagagcacacug

SEQ ID NO: 2089462 - RNA, 22 nt, Human
ccugcccuagagcacacuguag

SEQ ID NO: 2089463 - RNA, 24 nt, Human
ccugcccuagagcacacuguagca

SEQ ID NO: 2089464 - RNA, 16 nt, Human
ccugcccuagcuccac

SEQ ID NO: 2089465 - RNA, 14 nt, Human
ccugccccucccuu

SEQ ID NO: 2089466 - RNA, 12 nt, Human
ccugcccccuuc

SEQ ID NO: 2089467 - RNA, 13 nt, Human
ccugcccccuucu

SEQ ID NO: 2089468 - RNA, 16 nt, Human
ccugcccccuucuccc

SEQ ID NO: 2089469 - RNA, 13 nt, Human
ccugcccccuggu

SEQ ID NO: 2089470 - RNA, 14 nt, Human
ccugcccccuggug

SEQ ID NO: 2089471 - RNA, 15 nt, Human
ccugcccccuggugg

SEQ ID NO: 2089472 - RNA, 16 nt, Human
ccugcccccuggugga

SEQ ID NO: 2089473 - RNA, 18 nt, Human
ccugccccucccuucaac

SEQ ID NO: 2089474 - RNA, 16 nt, Human
ccugccccucccuuca

SEQ ID NO: 2089475 - RNA, 15 nt, Human
ccugccccucccuuc

SEQ ID NO: 2089476 - RNA, 11 nt, Human
ccugccccugc

SEQ ID NO: 2089477 - RNA, 17 nt, Human
ccugccccugccccguc

SEQ ID NO: 2089478 - RNA, 15 nt, Human
ccugccaggcauggu

SEQ ID NO: 2089479 - RNA, 13 nt, Human
ccugccagugccu

SEQ ID NO: 2089480 - RNA, 14 nt, Human
ccugccagugccuu

SEQ ID NO: 2089481 - RNA, 17 nt, Human
ccugccagugccuuacc

SEQ ID NO: 2089482 - RNA, 18 nt, Human
ccugccagugccuuaccu

SEQ ID NO: 2089483 - RNA, 20 nt, Human
ccugccagugccuuaccucc

SEQ ID NO: 2089484 - RNA, 21 nt, Human
ccugccagugccuuaccuccu

SEQ ID NO: 2089485 - RNA, 22 nt, Human
ccugccagugccuuaccuccug

SEQ ID NO: 2089486 - RNA, 12 nt, Human
ccugcccccugg

SEQ ID NO: 2089487 - RNA, 23 nt, Human
ccugccagugccuuaccuccugc

SEQ ID NO: 2089488 - RNA, 12 nt, Human
ccugccaggcau

SEQ ID NO: 2089489 - RNA, 17 nt, Human
ccugccacuaggcuggg

SEQ ID NO: 2089490 - RNA, 19 nt, Human
ccugccacuaggcugggug

SEQ ID NO: 2089491 - RNA, 20 nt, Human
ccugccacuaggcugggugc

SEQ ID NO: 2089492 - RNA, 16 nt, Human
ccugccaccuggggca

SEQ ID NO: 2089493 - RNA, 13 nt, Human
ccugccaccuggg

SEQ ID NO: 2089494 - RNA, 12 nt, Human
ccugcaccagga

SEQ ID NO: 2089495 - RNA, 14 nt, Human
ccugcaccaggaga

SEQ ID NO: 2089496 - RNA, 17 nt, Human
ccugcaccaggagacag

SEQ ID NO: 2089497 - RNA, 14 nt, Human
ccugcaccuccccc

SEQ ID NO: 2089498 - RNA, 17 nt, Human
ccugcaccuccccccac

SEQ ID NO: 2089499 - RNA, 18 nt, Human
ccugcaccuccccccacu

SEQ ID NO: 2089500 - RNA, 19 nt, Human
ccugcaccuccccccacug

SEQ ID NO: 2089501 - RNA, 20 nt, Human
ccugcaccuccccccacugc

SEQ ID NO: 2089502 - RNA, 15 nt, Human
ccugcacuggagucc

SEQ ID NO: 2089503 - RNA, 17 nt, Human
ccugcacuggaguccag

SEQ ID NO: 2089504 - RNA, 20 nt, Human
ccugcacuggaguccagucu

SEQ ID NO: 2089505 - RNA, 23 nt, Human
ccugcacuggaguccagucucuu

SEQ ID NO: 2089506 - RNA, 23 nt, Human
ccugcacaaagcccuuccauguc

SEQ ID NO: 2089507 - RNA, 20 nt, Human
ccugcacaaagcccuuccau

SEQ ID NO: 2089508 - RNA, 22 nt, Human
ccugcacaaagcccuuccaugu

SEQ ID NO: 2089509 - RNA, 14 nt, Human
ccugaucccacucc

SEQ ID NO: 2089510 - RNA, 18 nt, Human
ccugaucccacuccuagg

SEQ ID NO: 2089511 - RNA, 19 nt, Human
ccugaucccacuccuagga

SEQ ID NO: 2089512 - RNA, 22 nt, Human
ccugccacccuggggagaaagu

SEQ ID NO: 2089513 - RNA, 16 nt, Human
ccugccacccugggga

SEQ ID NO: 2089514 - RNA, 16 nt, Human
ccugccaccugcugcu

SEQ ID NO: 2089515 - RNA, 14 nt, Human
ccugccacccuggg

SEQ ID NO: 2089516 - RNA, 13 nt, Human
ccugccacccugg

SEQ ID NO: 2089517 - RNA, 12 nt, Human
ccugccacccug

SEQ ID NO: 2089518 - RNA, 23 nt, Human
ccugcauuugugaaaugauggug

SEQ ID NO: 2089519 - RNA, 21 nt, Human
ccugaggcugagacugcggga

SEQ ID NO: 2089520 - RNA, 17 nt, Human
ccugagcugccauccag

SEQ ID NO: 2089521 - RNA, 15 nt, Human
ccugaggcuggacuc

SEQ ID NO: 2089522 - RNA, 18 nt, Human
ccugaggcuggacuccag

SEQ ID NO: 2089523 - RNA, 19 nt, Human
ccugaggcuggacuccaga

SEQ ID NO: 2089524 - RNA, 20 nt, Human
ccugaucaagucaccggagc

SEQ ID NO: 2089525 - RNA, 15 nt, Human
ccugagcuccccacc

SEQ ID NO: 2089526 - RNA, 12 nt, Human
ccugagcucccc

SEQ ID NO: 2089527 - RNA, 15 nt, Human
ccugagcucggugga

SEQ ID NO: 2089528 - RNA, 16 nt, Human
ccugagcucgguggac

SEQ ID NO: 2089529 - RNA, 18 nt, Human
ccugagcucgguggaccc

SEQ ID NO: 2089530 - RNA, 19 nt, Human
ccugagcucgguggaccca

SEQ ID NO: 2089531 - RNA, 20 nt, Human
ccugagcucgguggacccag

SEQ ID NO: 2089532 - RNA, 21 nt, Human
ccugagcucgguggacccagg

SEQ ID NO: 2089533 - RNA, 22 nt, Human
ccugagcucgguggacccaggg

SEQ ID NO: 2089534 - RNA, 19 nt, Human
ccugaagucacacagugag

SEQ ID NO: 2089535 - RNA, 20 nt, Human
ccugaagucacacagugagu

SEQ ID NO: 2089536 - RNA, 19 nt, Human
ccugaaguaagcaaagacu

SEQ ID NO: 2089537 - RNA, 22 nt, Human
ccugaauagcucccagauuuca

SEQ ID NO: 2089538 - RNA, 18 nt, Human
ccugaaacuuacacacaa

SEQ ID NO: 2089539 - RNA, 13 nt, Human
ccugaaagcccug

SEQ ID NO: 2089540 - RNA, 14 nt, Human
ccugaaagcccuga

SEQ ID NO: 2089541 - RNA, 18 nt, Human
ccugaaauagugguucuu

SEQ ID NO: 2089542 - RNA, 18 nt, Human
ccugaaagcccugagcuu

SEQ ID NO: 2089543 - RNA, 16 nt, Human
ccucuuccuugcugug

SEQ ID NO: 2089544 - RNA, 13 nt, Human
ccucuuccccaga

SEQ ID NO: 2089545 - RNA, 14 nt, Human
ccucuuccccagaa

SEQ ID NO: 2089546 - RNA, 22 nt, Human
ccucuuccccagaaaggagacu

SEQ ID NO: 2089547 - RNA, 21 nt, Human
ccugaaaagauguugugucuu

SEQ ID NO: 2089548 - RNA, 13 nt, Human
ccugaaaacccag

SEQ ID NO: 2089549 - RNA, 16 nt, Human
ccugaaaacccagaga

SEQ ID NO: 2089550 - RNA, 17 nt, Human
ccugaaaacccagagag

SEQ ID NO: 2089551 - RNA, 23 nt, Human
ccugaaaauguuuuucugccagg

SEQ ID NO: 2089552 - RNA, 21 nt, Human
ccugaaaauguuuuucugcca

SEQ ID NO: 2089553 - RNA, 22 nt, Human
ccugaaaauguuuuucugccag

SEQ ID NO: 2089554 - RNA, 18 nt, Human
ccuaucuuuuaguuuuag

SEQ ID NO: 2089555 - RNA, 21 nt, Human
ccuagucccuuccccucccug

SEQ ID NO: 2089556 - RNA, 16 nt, Human
ccuagucccuuccccu

SEQ ID NO: 2089557 - RNA, 19 nt, Human
ccuagucccuuccccuccc

SEQ ID NO: 2089558 - RNA, 14 nt, Human
ccuaguagucauuu

SEQ ID NO: 2089559 - RNA, 14 nt, Human
ccuagucccuuccc

SEQ ID NO: 2089560 - RNA, 15 nt, Human
ccuagucccuucccc

SEQ ID NO: 2089561 - RNA, 11 nt, Human
ccucuucccca

SEQ ID NO: 2089562 - RNA, 12 nt, Human
ccucuuccccac

SEQ ID NO: 2089563 - RNA, 13 nt, Human
ccuaugaucccag

SEQ ID NO: 2089564 - RNA, 14 nt, Human
ccuaugaucccagc

SEQ ID NO: 2089565 - RNA, 15 nt, Human
ccuaugaucccagca

SEQ ID NO: 2089566 - RNA, 13 nt, Human
ccuggccaucucu

SEQ ID NO: 2089567 - RNA, 14 nt, Human
ccuggccaucucug

SEQ ID NO: 2089568 - RNA, 13 nt, Human
ccuggccaggagc

SEQ ID NO: 2089569 - RNA, 13 nt, Human
ccuggcccacugc

SEQ ID NO: 2089570 - RNA, 14 nt, Human
ccuggcccacugca

SEQ ID NO: 2089571 - RNA, 20 nt, Human
ccuggccagaugcaccagcc

SEQ ID NO: 2089572 - RNA, 23 nt, Human
ccuggccagaugcaccagcccuu

SEQ ID NO: 2089573 - RNA, 21 nt, Human
ccuggccagaugcaccagccc

SEQ ID NO: 2089574 - RNA, 15 nt, Human
ccuggcauggcaccu

SEQ ID NO: 2089575 - RNA, 17 nt, Human
ccuggcauggcaccugu

SEQ ID NO: 2089576 - RNA, 18 nt, Human
ccuggcauggcaccuguc

SEQ ID NO: 2089577 - RNA, 14 nt, Human
ccuggccaacaugg

SEQ ID NO: 2089578 - RNA, 21 nt, Human
ccuggcacccggccccugcug

SEQ ID NO: 2089579 - RNA, 20 nt, Human
ccuggcacccggccccugcu

SEQ ID NO: 2089580 - RNA, 13 nt, Human
ccuggagaacuag

SEQ ID NO: 2089581 - RNA, 12 nt, Human
ccuggagaacua

SEQ ID NO: 2089582 - RNA, 16 nt, Human
ccuggagaacuagaga

SEQ ID NO: 2089583 - RNA, 19 nt, Human
ccuggcacccggccccugc

SEQ ID NO: 2089584 - RNA, 16 nt, Human
ccugcuacucuguucc

SEQ ID NO: 2089585 - RNA, 13 nt, Human
ccugcuacucugu

SEQ ID NO: 2089586 - RNA, 13 nt, Human
ccugcuagaaaug

SEQ ID NO: 2089587 - RNA, 14 nt, Human
ccugcuagaaaugg

SEQ ID NO: 2089588 - RNA, 23 nt, Human
ccugcuagaugagaauucagcug

SEQ ID NO: 2089589 - RNA, 21 nt, Human
ccugcuaauuccccagauugc

SEQ ID NO: 2089590 - RNA, 20 nt, Human
ccugggaaccuuccugucuu

SEQ ID NO: 2089591 - RNA, 14 nt, Human
ccugggaauguauu

SEQ ID NO: 2089592 - RNA, 21 nt, Human
ccugggaaggcuacucaccuu

SEQ ID NO: 2089593 - RNA, 22 nt, Human
ccugggaaggcuacucaccuug

SEQ ID NO: 2089594 - RNA, 16 nt, Human
ccuggcuuuucacugc

SEQ ID NO: 2089595 - RNA, 15 nt, Human
ccuggcuuugcccaa

SEQ ID NO: 2089596 - RNA, 16 nt, Human
ccuggcuuugcccaac

SEQ ID NO: 2089597 - RNA, 17 nt, Human
ccuggcuuugcccaacc

SEQ ID NO: 2089598 - RNA, 18 nt, Human
ccuggcuuugcccaaccu

SEQ ID NO: 2089599 - RNA, 20 nt, Human
ccuggcuuugcccaaccuca

SEQ ID NO: 2089600 - RNA, 21 nt, Human
ccuggcuuugcccaaccucag

SEQ ID NO: 2089601 - RNA, 22 nt, Human
ccuggcuuugcccaaccucagc

SEQ ID NO: 2089602 - RNA, 23 nt, Human
ccuggcuuugcccaaccucagca

SEQ ID NO: 2089603 - RNA, 17 nt, Human
ccuggcuuuucacugcu

SEQ ID NO: 2089604 - RNA, 18 nt, Human
ccuggcuuguaacuccac

SEQ ID NO: 2089605 - RNA, 20 nt, Human
ccuggcuuguaacuccacca

SEQ ID NO: 2089606 - RNA, 22 nt, Human
ccuggcuuguaacuccaccaac

SEQ ID NO: 2089607 - RNA, 20 nt, Human
ccuggcuucuggagcccuug

SEQ ID NO: 2089608 - RNA, 21 nt, Human
ccuggcuucuggagcccuugg

SEQ ID NO: 2089609 - RNA, 22 nt, Human
ccuggcuucuggagcccuuggg

SEQ ID NO: 2089610 - RNA, 23 nt, Human
ccuggcuucuggagcccuugggu

SEQ ID NO: 2089611 - RNA, 12 nt, Human
ccuggcuccgcu

SEQ ID NO: 2089612 - RNA, 18 nt, Human
ccuggcuccgcugugugg

SEQ ID NO: 2089613 - RNA, 19 nt, Human
ccuggcuccgcugugugga

SEQ ID NO: 2089614 - RNA, 15 nt, Human
ccuggcuccugaggg

SEQ ID NO: 2089615 - RNA, 23 nt, Human
ccuggcuccugaggggcaucugc

SEQ ID NO: 2089616 - RNA, 21 nt, Human
ccuggcucccaugaccauacu

SEQ ID NO: 2089617 - RNA, 14 nt, Human
ccuggcucccauga

SEQ ID NO: 2089618 - RNA, 15 nt, Human
ccuggcucccaugac

SEQ ID NO: 2089619 - RNA, 22 nt, Human
ccuggcucccaugaccauacug

SEQ ID NO: 2089620 - RNA, 12 nt, Human
ccuggccccaug

SEQ ID NO: 2089621 - RNA, 16 nt, Human
ccuggcccacugcauc

SEQ ID NO: 2089622 - RNA, 18 nt, Human
ccugggagugagcugguu

SEQ ID NO: 2089623 - RNA, 23 nt, Human
ccugggagguggagguugcagug

SEQ ID NO: 2089624 - RNA, 17 nt, Human
ccugggcagccaggcug

SEQ ID NO: 2089625 - RNA, 18 nt, Human
ccugggcagccaggcugc

SEQ ID NO: 2089626 - RNA, 19 nt, Human
ccugggcagccaggcugcc

SEQ ID NO: 2089627 - RNA, 16 nt, Human
ccugggagugagcugg

SEQ ID NO: 2089628 - RNA, 22 nt, Human
ccugggaggucaaggcugcagu

SEQ ID NO: 2089629 - RNA, 19 nt, Human
ccugggaggaaauuugaau

SEQ ID NO: 2089630 - RNA, 18 nt, Human
ccugggagaaccucaggc

SEQ ID NO: 2089631 - RNA, 19 nt, Human
ccugggagaaccucaggcu

SEQ ID NO: 2089632 - RNA, 17 nt, Human
ccugggagaaccucagg

SEQ ID NO: 2089633 - RNA, 17 nt, Human
ccugggacugcugcuuc

SEQ ID NO: 2089634 - RNA, 23 nt, Human
ccugggcagccaggcugccaagg

SEQ ID NO: 2089635 - RNA, 15 nt, Human
ccuggggugcccucc

SEQ ID NO: 2089636 - RNA, 16 nt, Human
ccuggggugcccucca

SEQ ID NO: 2089637 - RNA, 22 nt, Human
ccuggggugcccuccacugccc

SEQ ID NO: 2089638 - RNA, 20 nt, Human
ccuggggugugggaggcccg

SEQ ID NO: 2089639 - RNA, 13 nt, Human
ccuguagcccuaa

SEQ ID NO: 2089640 - RNA, 15 nt, Human
ccuguagagugggag

SEQ ID NO: 2089641 - RNA, 16 nt, Human
ccuguagagugggagc

SEQ ID NO: 2089642 - RNA, 22 nt, Human
ccuguagaccuagggaggaccu

SEQ ID NO: 2089643 - RNA, 23 nt, Human
ccuguagaccuagggaggaccuu

SEQ ID NO: 2089644 - RNA, 14 nt, Human
ccugguggcagugg

SEQ ID NO: 2089645 - RNA, 13 nt, Human
ccugguggcagug

SEQ ID NO: 2089646 - RNA, 15 nt, Human
ccugguggcaguggg

SEQ ID NO: 2089647 - RNA, 16 nt, Human
ccuggucuugagaugu

SEQ ID NO: 2089648 - RNA, 12 nt, Human
ccuguacuuuuu

SEQ ID NO: 2089649 - RNA, 13 nt, Human
ccuguagaccuag

SEQ ID NO: 2089650 - RNA, 18 nt, Human
ccuguagaccuagggagg

SEQ ID NO: 2089651 - RNA, 12 nt, Human
ccugucccaccu

SEQ ID NO: 2089652 - RNA, 13 nt, Human
ccugucccaccuc

SEQ ID NO: 2089653 - RNA, 14 nt, Human
ccugucccaccuca

SEQ ID NO: 2089654 - RNA, 17 nt, Human
ccuguccaaacugccua

SEQ ID NO: 2089655 - RNA, 14 nt, Human
ccugucagugcagc

SEQ ID NO: 2089656 - RNA, 16 nt, Human
ccugucagugcagccc

SEQ ID NO: 2089657 - RNA, 19 nt, Human
ccugucagugcagcccgug

SEQ ID NO: 2089658 - RNA, 18 nt, Human
ccugguggcagcugcggu

SEQ ID NO: 2089659 - RNA, 17 nt, Human
ccugguggcagcugcgg

SEQ ID NO: 2089660 - RNA, 16 nt, Human
ccugguggcagcugcg

SEQ ID NO: 2089661 - RNA, 15 nt, Human
ccugguggcagcugc

SEQ ID NO: 2089662 - RNA, 14 nt, Human
ccugguggcagcug

SEQ ID NO: 2089663 - RNA, 19 nt, Human
ccugguccuuccaggcccc

SEQ ID NO: 2089664 - RNA, 13 nt, Human
ccuggucuccugc

SEQ ID NO: 2089665 - RNA, 16 nt, Human
ccuggucuccugcccc

SEQ ID NO: 2089666 - RNA, 18 nt, Human
ccuggucuccugccccca

SEQ ID NO: 2089667 - RNA, 19 nt, Human
ccuggucuccugcccccac

SEQ ID NO: 2089668 - RNA, 22 nt, Human
ccuggucuccugcccccacacc

SEQ ID NO: 2089669 - RNA, 18 nt, Human
ccuggguuccaauccugg

SEQ ID NO: 2089670 - RNA, 20 nt, Human
ccuggguuccaauccuggcu

SEQ ID NO: 2089671 - RNA, 16 nt, Human
ccuggucccugggagg

SEQ ID NO: 2089672 - RNA, 15 nt, Human
ccugguccuuccagg

SEQ ID NO: 2089673 - RNA, 18 nt, Human
ccugguccuuccaggccc

SEQ ID NO: 2089674 - RNA, 21 nt, Human
ccuggguggucugcaggcagg

SEQ ID NO: 2089675 - RNA, 14 nt, Human
ccuggguggucugc

SEQ ID NO: 2089676 - RNA, 18 nt, Human
ccuggguggucugcaggc

SEQ ID NO: 2089677 - RNA, 19 nt, Human
ccuggguggucugcaggca

SEQ ID NO: 2089678 - RNA, 20 nt, Human
ccuggguggucugcaggcag

SEQ ID NO: 2089679 - RNA, 22 nt, Human
ccuggguggucugcaggcaggg

SEQ ID NO: 2089680 - RNA, 19 nt, Human
ccuggguggggcugcuccu

SEQ ID NO: 2089681 - RNA, 20 nt, Human
ccuggguggggcugcuccuc

SEQ ID NO: 2089682 - RNA, 21 nt, Human
ccuggguggggcugcuccucc

SEQ ID NO: 2089683 - RNA, 22 nt, Human
ccuggguggggcugcuccucca

SEQ ID NO: 2089684 - RNA, 23 nt, Human
ccuggguggggcugcuccuccag

SEQ ID NO: 2089685 - RNA, 13 nt, Human
ccuggguucccuu

SEQ ID NO: 2089686 - RNA, 14 nt, Human
cgaugcuccagcca

SEQ ID NO: 2089687 - RNA, 18 nt, Human
cgaugcuccagccaaccc

SEQ ID NO: 2089688 - RNA, 20 nt, Human
cgaugcuccagccaaccccu

SEQ ID NO: 2089689 - RNA, 22 nt, Human
cgaugcuccagccaaccccugu

SEQ ID NO: 2089690 - RNA, 23 nt, Human
cgaugcuccagccaaccccugug

SEQ ID NO: 2089691 - RNA, 21 nt, Human
cgaugggcccaauucuuacaa

SEQ ID NO: 2089692 - RNA, 18 nt, Human
cgaugggggaugcuucau

SEQ ID NO: 2089693 - RNA, 19 nt, Human
cgaugggggaugcuucaug

SEQ ID NO: 2089694 - RNA, 21 nt, Human
cgaugggggaugcuucaugug

SEQ ID NO: 2089695 - RNA, 12 nt, Human
cgcaccucccau

SEQ ID NO: 2089696 - RNA, 16 nt, Human
cgcaccucccauccua

SEQ ID NO: 2089697 - RNA, 18 nt, Human
cgcacgugggucuucagg

SEQ ID NO: 2089698 - RNA, 18 nt, Human
cgcaccucccauccuaau

SEQ ID NO: 2089699 - RNA, 16 nt, Human
cgcaccugcccccugg

SEQ ID NO: 2089700 - RNA, 17 nt, Human
cgcaccugcccccuggu

SEQ ID NO: 2089701 - RNA, 23 nt, Human
cgcacuucgggaggucgaggcag

SEQ ID NO: 2089702 - RNA, 14 nt, Human
cgcagaugauccau

SEQ ID NO: 2089703 - RNA, 16 nt, Human
cgaggacagggaggug

SEQ ID NO: 2089704 - RNA, 14 nt, Human
cgaggcagggucag

SEQ ID NO: 2089705 - RNA, 22 nt, Human
cgaggcagggucaggagagggg

SEQ ID NO: 2089706 - RNA, 13 nt, Human
cgaggcccgcaug

SEQ ID NO: 2089707 - RNA, 23 nt, Human
cgaugaauuuggagacucugugg

SEQ ID NO: 2089708 - RNA, 20 nt, Human
cgaugaugcuuguaacaaga

SEQ ID NO: 2089709 - RNA, 21 nt, Human
cgaugaugcuuguaacaagaa

SEQ ID NO: 2089710 - RNA, 22 nt, Human
cgaugaugcuuguaacaagaaa

SEQ ID NO: 2089711 - RNA, 21 nt, Human
cgagagccugcucccccaccc

SEQ ID NO: 2089712 - RNA, 19 nt, Human
cgagcccugguggcagugg

SEQ ID NO: 2089713 - RNA, 21 nt, Human
cgagagacuuguggccuggga

SEQ ID NO: 2089714 - RNA, 15 nt, Human
cgagacucugucuca

SEQ ID NO: 2089715 - RNA, 13 nt, Human
cgagagccugcuc

SEQ ID NO: 2089716 - RNA, 14 nt, Human
cgagagccugcucc

SEQ ID NO: 2089717 - RNA, 15 nt, Human
cgagagccugcuccc

SEQ ID NO: 2089718 - RNA, 19 nt, Human
cgagagccugcucccccac

SEQ ID NO: 2089719 - RNA, 20 nt, Human
cgagagccugcucccccacc

SEQ ID NO: 2089720 - RNA, 18 nt, Human
cgagcccugguggcagug

SEQ ID NO: 2089721 - RNA, 14 nt, Human
cgaggacagggagg

SEQ ID NO: 2089722 - RNA, 14 nt, Human
cgcuguucacccac

SEQ ID NO: 2089723 - RNA, 13 nt, Human
cgcuucccccaua

SEQ ID NO: 2089724 - RNA, 16 nt, Human
cgcuucccccauagcc

SEQ ID NO: 2089725 - RNA, 14 nt, Human
cgcugugggcaggu

SEQ ID NO: 2089726 - RNA, 18 nt, Human
cgcuucccccauagccac

SEQ ID NO: 2089727 - RNA, 20 nt, Human
cgcuucccccauagccaccc

SEQ ID NO: 2089728 - RNA, 14 nt, Human
cgcuucugccugca

SEQ ID NO: 2089729 - RNA, 12 nt, Human
cgcuucugacug

SEQ ID NO: 2089730 - RNA, 20 nt, Human
cgcugucuccagacccccac

SEQ ID NO: 2089731 - RNA, 22 nt, Human
cgcugucuccagacccccaccc

SEQ ID NO: 2089732 - RNA, 14 nt, Human
cgcuccugucugcc

SEQ ID NO: 2089733 - RNA, 19 nt, Human
cgcucccaacacaaggugg

SEQ ID NO: 2089734 - RNA, 13 nt, Human
cgcucccgggacu

SEQ ID NO: 2089735 - RNA, 17 nt, Human
cggaauaguuggcuagg

SEQ ID NO: 2089736 - RNA, 16 nt, Human
cggaauaguuggcuag

SEQ ID NO: 2089737 - RNA, 15 nt, Human
cggaauccuguccuc

SEQ ID NO: 2089738 - RNA, 20 nt, Human
cggacagccacggccaggcc

SEQ ID NO: 2089739 - RNA, 14 nt, Human
cgcuuucuacccag

SEQ ID NO: 2089740 - RNA, 16 nt, Human
cgcuuucuacccagcg

SEQ ID NO: 2089741 - RNA, 22 nt, Human
cgcuuucuagcuguugagcugu

SEQ ID NO: 2089742 - RNA, 16 nt, Human
cgcuuucuagcuguug

SEQ ID NO: 2089743 - RNA, 12 nt, Human
cgcuucucugug

SEQ ID NO: 2089744 - RNA, 22 nt, Human
cggacagccacggccaggccag

SEQ ID NO: 2089745 - RNA, 21 nt, Human
cggacagccacggccaggcca

SEQ ID NO: 2089746 - RNA, 18 nt, Human
cggaauccuguccucagc

SEQ ID NO: 2089747 - RNA, 17 nt, Human
cggaauccuguccucag

SEQ ID NO: 2089748 - RNA, 12 nt, Human
cgccuuguucuu

SEQ ID NO: 2089749 - RNA, 19 nt, Human
cgcgguggcucacgccugu

SEQ ID NO: 2089750 - RNA, 17 nt, Human
cgcgguacaaaggaaaa

SEQ ID NO: 2089751 - RNA, 17 nt, Human
cgcccgagguggcugcc

SEQ ID NO: 2089752 - RNA, 13 nt, Human
cgccccuuccccc

SEQ ID NO: 2089753 - RNA, 21 nt, Human
cgcccagucuggaaugcagug

SEQ ID NO: 2089754 - RNA, 19 nt, Human
cgcccagucuggaaugcag

SEQ ID NO: 2089755 - RNA, 13 nt, Human
cgcccagucugga

SEQ ID NO: 2089756 - RNA, 17 nt, Human
cgcccaaagccagacag

SEQ ID NO: 2089757 - RNA, 24 nt, Human
cgcagcccugcuuugggcugcccu

SEQ ID NO: 2089758 - RNA, 15 nt, Human
cgcagcccugcuuug

SEQ ID NO: 2089759 - RNA, 13 nt, Human
cgcagcccugcuu

SEQ ID NO: 2089760 - RNA, 19 nt, Human
cgccauugcacuccagccu

SEQ ID NO: 2089761 - RNA, 18 nt, Human
cgccauugccaccaggag

SEQ ID NO: 2089762 - RNA, 16 nt, Human
cgccauugccaccagg

SEQ ID NO: 2089763 - RNA, 17 nt, Human
cgccauugccaccagga

SEQ ID NO: 2089764 - RNA, 12 nt, Human
cgcaggaagcug

SEQ ID NO: 2089765 - RNA, 18 nt, Human
cgccauucucaagcccug

SEQ ID NO: 2089766 - RNA, 15 nt, Human
cgccauugcacucca

SEQ ID NO: 2089767 - RNA, 14 nt, Human
cgccauugccacca

SEQ ID NO: 2089768 - RNA, 16 nt, Human
cgcagccucccucuga

SEQ ID NO: 2089769 - RNA, 20 nt, Human
cggccaggccagagggagug

SEQ ID NO: 2089770 - RNA, 12 nt, Human
cggccaggccag

SEQ ID NO: 2089771 - RNA, 17 nt, Human
cgcuuucuacacuguau

SEQ ID NO: 2089772 - RNA, 21 nt, Human
cggccagcugggaucugacug

SEQ ID NO: 2089773 - RNA, 11 nt, Human
cggccaggcca

SEQ ID NO: 2089774 - RNA, 15 nt, Human
cggagugacagagua

SEQ ID NO: 2089775 - RNA, 23 nt, Human
cggaguucggaaaccguccugug

SEQ ID NO: 2089776 - RNA, 18 nt, Human
cggaucaccgagaguagc

SEQ ID NO: 2089777 - RNA, 23 nt, Human
cggaucaccgagaguagccgaga

SEQ ID NO: 2089778 - RNA, 14 nt, Human
cggcuggcagccca

SEQ ID NO: 2089779 - RNA, 15 nt, Human
cggccugaugcuccc

SEQ ID NO: 2089780 - RNA, 16 nt, Human
cggccugaugcucccu

SEQ ID NO: 2089781 - RNA, 11 nt, Human
cggcccugggg

SEQ ID NO: 2089782 - RNA, 12 nt, Human
cggcccuggggc

SEQ ID NO: 2089783 - RNA, 16 nt, Human
cggccgcauucccuga

SEQ ID NO: 2089784 - RNA, 13 nt, Human
cggccgcauuccc

SEQ ID NO: 2089785 - RNA, 15 nt, Human
cggccgcauucccug

SEQ ID NO: 2089786 - RNA, 18 nt, Human
cggccgcauucccugagu

SEQ ID NO: 2089787 - RNA, 17 nt, Human
cggccugaugcucccuc

SEQ ID NO: 2089788 - RNA, 23 nt, Human
cggcuggcagcccaccccucaac

SEQ ID NO: 2089789 - RNA, 20 nt, Human
cgggaacaguguuucccaua

SEQ ID NO: 2089790 - RNA, 13 nt, Human
cgggaacaguguu

SEQ ID NO: 2089791 - RNA, 22 nt, Human
cgggaacaguguuucccauaau

SEQ ID NO: 2089792 - RNA, 15 nt, Human
cgggaacagacaaca

SEQ ID NO: 2089793 - RNA, 12 nt, Human
cgggaaggaggg

SEQ ID NO: 2089794 - RNA, 14 nt, Human
cgggaaggaggguu

SEQ ID NO: 2089795 - RNA, 23 nt, Human
cgggaaggaggguuagggagggg

SEQ ID NO: 2089796 - RNA, 16 nt, Human
cgggaagccacccucc

SEQ ID NO: 2089797 - RNA, 23 nt, Human
cgggaagccacccucccagcucu

SEQ ID NO: 2089798 - RNA, 12 nt, Human
cgggaagcggag

SEQ ID NO: 2089799 - RNA, 13 nt, Human
ccuuguauuuaaa

SEQ ID NO: 2089800 - RNA, 14 nt, Human
ccuuguauuuaaau

SEQ ID NO: 2089801 - RNA, 18 nt, Human
ccuugguucaucaguguu

SEQ ID NO: 2089802 - RNA, 17 nt, Human
ccuugguucccuugugu

SEQ ID NO: 2089803 - RNA, 18 nt, Human
ccuugggcugcuccucau

SEQ ID NO: 2089804 - RNA, 15 nt, Human
ccuugguguccaccu

SEQ ID NO: 2089805 - RNA, 16 nt, Human
ccuugguguccaccug

SEQ ID NO: 2089806 - RNA, 17 nt, Human
ccuugguguccaccugg

SEQ ID NO: 2089807 - RNA, 18 nt, Human
ccuugguguccaccuggc

SEQ ID NO: 2089808 - RNA, 19 nt, Human
ccuugguguccaccuggcc

SEQ ID NO: 2089809 - RNA, 20 nt, Human
ccuugguguccaccuggccc

SEQ ID NO: 2089810 - RNA, 21 nt, Human
ccuugguguccaccuggcccc

SEQ ID NO: 2089811 - RNA, 16 nt, Human
ccuuggcugcagggag

SEQ ID NO: 2089812 - RNA, 22 nt, Human
ccuuggccugucucauccccag

SEQ ID NO: 2089813 - RNA, 23 nt, Human
ccuuggccugucucauccccagg

SEQ ID NO: 2089814 - RNA, 14 nt, Human
ccuuggcugcaggg

SEQ ID NO: 2089815 - RNA, 20 nt, Human
ccuuggcuucaggggagucc

SEQ ID NO: 2089816 - RNA, 14 nt, Human
ccuugggcugcucc

SEQ ID NO: 2089817 - RNA, 15 nt, Human
ccuugggcugcuccu

SEQ ID NO: 2089818 - RNA, 17 nt, Human
ccuugggcugcuccuca

SEQ ID NO: 2089819 - RNA, 22 nt, Human
ccuuggcucaaguccucuuuuc

SEQ ID NO: 2089820 - RNA, 15 nt, Human
ccuuggccugucuca

SEQ ID NO: 2089821 - RNA, 19 nt, Human
ccuuggccugucucauccc

SEQ ID NO: 2089822 - RNA, 14 nt, Human
ccuuggccucagaa

SEQ ID NO: 2089823 - RNA, 11 nt, Human
ccuuggccuca

SEQ ID NO: 2089824 - RNA, 13 nt, Human
ccuuggccucaga

SEQ ID NO: 2089825 - RNA, 12 nt, Human
ccuuggaggcca

SEQ ID NO: 2089826 - RNA, 16 nt, Human
ccuuggaggccagcca

SEQ ID NO: 2089827 - RNA, 18 nt, Human
ccuuggaggcugucuucu

SEQ ID NO: 2089828 - RNA, 18 nt, Human
ccuuggauaaugcuguug

SEQ ID NO: 2089829 - RNA, 22 nt, Human
ccuuggauaaugcuguugccuc

SEQ ID NO: 2089830 - RNA, 23 nt, Human
ccuuggauaaugcuguugccuca

SEQ ID NO: 2089831 - RNA, 12 nt, Human
ccuugagcugag

SEQ ID NO: 2089832 - RNA, 14 nt, Human
ccuugagcugagau

SEQ ID NO: 2089833 - RNA, 21 nt, Human
ccuugacagggcacaccgggc

SEQ ID NO: 2089834 - RNA, 18 nt, Human
ccuugacagggcacaccg

SEQ ID NO: 2089835 - RNA, 23 nt, Human
ccuugacauuguagagcuucugg

SEQ ID NO: 2089836 - RNA, 12 nt, Human
ccuugaccagca

SEQ ID NO: 2089837 - RNA, 20 nt, Human
ccuugaccagcagaucccag

SEQ ID NO: 2089838 - RNA, 21 nt, Human
ccuugaccagcagaucccagc

SEQ ID NO: 2089839 - RNA, 19 nt, Human
ccuugagaaaccuuauugu

SEQ ID NO: 2089840 - RNA, 14 nt, Human
ccuugagaaaccuu

SEQ ID NO: 2089841 - RNA, 23 nt, Human
ccuugaccagcagaucccagcuc

SEQ ID NO: 2089842 - RNA, 11 nt, Human
ccuugagacca

SEQ ID NO: 2089843 - RNA, 16 nt, Human
ccuugagaccacaggg

SEQ ID NO: 2089844 - RNA, 14 nt, Human
ccuugagaccucag

SEQ ID NO: 2089845 - RNA, 16 nt, Human
ccuugagaccucagcc

SEQ ID NO: 2089846 - RNA, 17 nt, Human
ccuugagaccucagcca

SEQ ID NO: 2089847 - RNA, 18 nt, Human
ccuugagaccucagccau

SEQ ID NO: 2089848 - RNA, 19 nt, Human
ccuugagaccucagccaug

SEQ ID NO: 2089849 - RNA, 17 nt, Human
ccuugagcuccccaaaa

SEQ ID NO: 2089850 - RNA, 20 nt, Human
ccugugccucugggacugga

SEQ ID NO: 2089851 - RNA, 15 nt, Human
ccuguccgcccucuu

SEQ ID NO: 2089852 - RNA, 19 nt, Human
ccuguccgcccucuucccc

SEQ ID NO: 2089853 - RNA, 22 nt, Human
ccuguccgcccucuuccccucu

SEQ ID NO: 2089854 - RNA, 22 nt, Human
ccugucccucucaggcaugccu

SEQ ID NO: 2089855 - RNA, 14 nt, Human
ccugucccuggcca

SEQ ID NO: 2089856 - RNA, 15 nt, Human
ccugucccuggccau

SEQ ID NO: 2089857 - RNA, 17 nt, Human
ccugucccuggccaucu

SEQ ID NO: 2089858 - RNA, 19 nt, Human
ccugucccuggccaucucu

SEQ ID NO: 2089859 - RNA, 23 nt, Human
ccugucccuucucuuaauuuaau

SEQ ID NO: 2089860 - RNA, 15 nt, Human
ccugucccucucagg

SEQ ID NO: 2089861 - RNA, 16 nt, Human
ccugucccucucaggc

SEQ ID NO: 2089862 - RNA, 21 nt, Human
ccugugcugcccgucuucagc

SEQ ID NO: 2089863 - RNA, 15 nt, Human
ccuguggagcccgca

SEQ ID NO: 2089864 - RNA, 18 nt, Human
ccuguggagcccgcaccc

SEQ ID NO: 2089865 - RNA, 17 nt, Human
ccuguggagcccgcacc

SEQ ID NO: 2089866 - RNA, 20 nt, Human
ccuguggaugauaaaacaca

SEQ ID NO: 2089867 - RNA, 15 nt, Human
ccuguggcggugccu

SEQ ID NO: 2089868 - RNA, 16 nt, Human
ccuguggcggugccug

SEQ ID NO: 2089869 - RNA, 17 nt, Human
ccuguggcggugccugg

SEQ ID NO: 2089870 - RNA, 18 nt, Human
ccuguggcggugccuggg

SEQ ID NO: 2089871 - RNA, 19 nt, Human
ccuguggcggugccugggu

SEQ ID NO: 2089872 - RNA, 20 nt, Human
ccuguggcggugccugggug

SEQ ID NO: 2089873 - RNA, 16 nt, Human
ccuuccagcacccugc

SEQ ID NO: 2089874 - RNA, 17 nt, Human
ccuuccagcacccugca

SEQ ID NO: 2089875 - RNA, 15 nt, Human
ccuucauuucugaua

SEQ ID NO: 2089876 - RNA, 19 nt, Human
ccuucauuucugauauaga

SEQ ID NO: 2089877 - RNA, 22 nt, Human
ccuucauuucugauauagaauu

SEQ ID NO: 2089878 - RNA, 20 nt, Human
ccuucauugccuuaacugga

SEQ ID NO: 2089879 - RNA, 23 nt, Human
ccuucauugccuuaacuggagcc

SEQ ID NO: 2089880 - RNA, 20 nt, Human
ccugugguuuccaaggagcu

SEQ ID NO: 2089881 - RNA, 21 nt, Human
ccugugguuuccaaggagcug

SEQ ID NO: 2089882 - RNA, 19 nt, Human
ccuguggggauuucuccca

SEQ ID NO: 2089883 - RNA, 20 nt, Human
ccuguggggauuucucccag

SEQ ID NO: 2089884 - RNA, 22 nt, Human
ccuguggggauuucucccagcu

SEQ ID NO: 2089885 - RNA, 21 nt, Human
ccuguguaaucauuucuuggg

SEQ ID NO: 2089886 - RNA, 14 nt, Human
ccuuccuucccugg

SEQ ID NO: 2089887 - RNA, 19 nt, Human
ccuuccugucuuccugcau

SEQ ID NO: 2089888 - RNA, 12 nt, Human
ccuuccuguccg

SEQ ID NO: 2089889 - RNA, 16 nt, Human
ccuuccuguccgcccu

SEQ ID NO: 2089890 - RNA, 12 nt, Human
ccuuccugucuu

SEQ ID NO: 2089891 - RNA, 13 nt, Human
ccuuccugucuuc

SEQ ID NO: 2089892 - RNA, 17 nt, Human
ccuuccugucuuccugc

SEQ ID NO: 2089893 - RNA, 18 nt, Human
ccuuccaugucgccucug

SEQ ID NO: 2089894 - RNA, 17 nt, Human
ccuuccaucucgccacc

SEQ ID NO: 2089895 - RNA, 12 nt, Human
ccuuccaucccu

SEQ ID NO: 2089896 - RNA, 19 nt, Human
ccuuccaucccuacccccu

SEQ ID NO: 2089897 - RNA, 11 nt, Human
ccuuccauaau

SEQ ID NO: 2089898 - RNA, 12 nt, Human
ccuuccauaauu

SEQ ID NO: 2089899 - RNA, 15 nt, Human
ccuuccauaauuaug

SEQ ID NO: 2089900 - RNA, 23 nt, Human
ccuuccauagccuaaucccuggg

SEQ ID NO: 2089901 - RNA, 13 nt, Human
ccuuccaggccau

SEQ ID NO: 2089902 - RNA, 15 nt, Human
ccuuccaggccauca

SEQ ID NO: 2089903 - RNA, 13 nt, Human
ccuuccaggcccc

SEQ ID NO: 2089904 - RNA, 22 nt, Human
ccuucuaaucugcuaugcuuga

SEQ ID NO: 2089905 - RNA, 14 nt, Human
ccuucuacacucuc

SEQ ID NO: 2089906 - RNA, 17 nt, Human
ccuucguuaacugugua

SEQ ID NO: 2089907 - RNA, 15 nt, Human
ccuucuccaaaugag

SEQ ID NO: 2089908 - RNA, 14 nt, Human
ccuucucccacacu

SEQ ID NO: 2089909 - RNA, 16 nt, Human
ccuucucccacacugc

SEQ ID NO: 2089910 - RNA, 18 nt, Human
cgaaucagcuauuuacug

SEQ ID NO: 2089911 - RNA, 21 nt, Human
cgaaucacgaggucaggaguu

SEQ ID NO: 2089912 - RNA, 18 nt, Human
cgagacuugguuucaaaa

SEQ ID NO: 2089913 - RNA, 16 nt, Human
cgaaugguagucuaac

SEQ ID NO: 2089914 - RNA, 22 nt, Human
cgaaugguagucuaaccaaaug

SEQ ID NO: 2089915 - RNA, 15 nt, Human
cgaauagcugggacu

SEQ ID NO: 2089916 - RNA, 13 nt, Human
cgaaggggcccug

SEQ ID NO: 2089917 - RNA, 19 nt, Human
cgaagggggcaucuggccu

SEQ ID NO: 2089918 - RNA, 12 nt, Human
cgaaggccucug

SEQ ID NO: 2089919 - RNA, 23 nt, Human
cgaaggaaaagggcuuucucaau

SEQ ID NO: 2089920 - RNA, 18 nt, Human
cgaagcucagcccacccc

SEQ ID NO: 2089921 - RNA, 13 nt, Human
cgaagcucagccc

SEQ ID NO: 2089922 - RNA, 23 nt, Human
cgaagcgcgccacucgcuucccc

SEQ ID NO: 2089923 - RNA, 15 nt, Human
cgaagcucagcccac

SEQ ID NO: 2089924 - RNA, 16 nt, Human
cgaagcucagcccacc

SEQ ID NO: 2089925 - RNA, 17 nt, Human
cgaagcucagcccaccc

SEQ ID NO: 2089926 - RNA, 16 nt, Human
cgaauagcugggacua

SEQ ID NO: 2089927 - RNA, 21 nt, Human
cgaacauguuuuucuucuccc

SEQ ID NO: 2089928 - RNA, 23 nt, Human
cgaacauguuuuucuucucccuc

SEQ ID NO: 2089929 - RNA, 22 nt, Human
cgaacacccucgaagcgcgcca

SEQ ID NO: 2089930 - RNA, 18 nt, Human
cgaacacccucgaagcgc

SEQ ID NO: 2089931 - RNA, 21 nt, Human
cgaacacccucgaagcgcgcc

SEQ ID NO: 2089932 - RNA, 20 nt, Human
cgaacauggaacucauuccu

SEQ ID NO: 2089933 - RNA, 22 nt, Human
cgaacauggaacucauuccugc

SEQ ID NO: 2089934 - RNA, 11 nt, Human
cgaagcgcgcc

SEQ ID NO: 2089935 - RNA, 16 nt, Human
cgaagcgcgccacucg

SEQ ID NO: 2089936 - RNA, 23 nt, Human
cgaaagggacuuggaagcuccgc

SEQ ID NO: 2089937 - RNA, 19 nt, Human
ccuuuguuuuuuuuuccug

SEQ ID NO: 2089938 - RNA, 23 nt, Human
ccuuuguuuugauguuuguggcc

SEQ ID NO: 2089939 - RNA, 14 nt, Human
ccuuuguugcucag

SEQ ID NO: 2089940 - RNA, 19 nt, Human
ccuuuguuuuuaugaagaa

SEQ ID NO: 2089941 - RNA, 20 nt, Human
ccuuuguuuuuaugaagaaa

SEQ ID NO: 2089942 - RNA, 21 nt, Human
ccuuuuaaauccuguugaaaa

SEQ ID NO: 2089943 - RNA, 22 nt, Human
ccuuuuaaauccuguugaaaag

SEQ ID NO: 2089944 - RNA, 23 nt, Human
ccuuugucaucuuucuucuauuu

SEQ ID NO: 2089945 - RNA, 19 nt, Human
ccuuugggaggcugaggcg

SEQ ID NO: 2089946 - RNA, 18 nt, Human
ccuuuggggggggcccgc

SEQ ID NO: 2089947 - RNA, 16 nt, Human
ccuuguauuuaaauau

SEQ ID NO: 2089948 - RNA, 21 nt, Human
ccuuguauuuaaauauuaaau

SEQ ID NO: 2089949 - RNA, 15 nt, Human
ccuuguggcacauuu

SEQ ID NO: 2089950 - RNA, 22 nt, Human
ccuuugguccuaagucccugcc

SEQ ID NO: 2089951 - RNA, 18 nt, Human
ccuuugucaucuuucuuc

SEQ ID NO: 2089952 - RNA, 19 nt, Human
gaaaaguuuuguaaauuuc

SEQ ID NO: 2089953 - RNA, 12 nt, Human
gaaaaguucaua

SEQ ID NO: 2089954 - RNA, 14 nt, Human
gaaaauccucuggc

SEQ ID NO: 2089955 - RNA, 15 nt, Human
gaaaauccucuggcu

SEQ ID NO: 2089956 - RNA, 13 nt, Human
gaaaauccuacca

SEQ ID NO: 2089957 - RNA, 14 nt, Human
gaaaauccuaccaa

SEQ ID NO: 2089958 - RNA, 13 nt, Human
gaaaauccucugg

SEQ ID NO: 2089959 - RNA, 11 nt, Human
gaaaaucauau

SEQ ID NO: 2089960 - RNA, 20 nt, Human
gaaaaucagccugcuccagc

SEQ ID NO: 2089961 - RNA, 22 nt, Human
gaaaaucagccugcuccagcug

SEQ ID NO: 2089962 - RNA, 20 nt, Human
gaaaaggaagacuagaggcu

SEQ ID NO: 2089963 - RNA, 13 nt, Human
gaaaaggaagacu

SEQ ID NO: 2089964 - RNA, 15 nt, Human
gaaaaggaagacuag

SEQ ID NO: 2089965 - RNA, 19 nt, Human
gaaaacguuuuauuguguu

SEQ ID NO: 2089966 - RNA, 20 nt, Human
gaaaacguuuuauuguguuu

SEQ ID NO: 2089967 - RNA, 14 nt, Human
gaaaacuacauuuu

SEQ ID NO: 2089968 - RNA, 16 nt, Human
gaaaacuacauuuuaa

SEQ ID NO: 2089969 - RNA, 17 nt, Human
gaaaacuacauuuuaac

SEQ ID NO: 2089970 - RNA, 18 nt, Human
gaaaacuacauuuuaaca

SEQ ID NO: 2089971 - RNA, 19 nt, Human
gaaaacuacauuuuaacau

SEQ ID NO: 2089972 - RNA, 20 nt, Human
gaaaacuacauuuuaacaug

SEQ ID NO: 2089973 - RNA, 11 nt, Human
gaaaaggcagg

SEQ ID NO: 2089974 - RNA, 17 nt, Human
gaaaacguuuuguuuga

SEQ ID NO: 2089975 - RNA, 18 nt, Human
gaaaagggaacaggaaaa

SEQ ID NO: 2089976 - RNA, 18 nt, Human
gaaaaguggcaagaccaa

SEQ ID NO: 2089977 - RNA, 19 nt, Human
gaaaaguggcaagaccaaa

SEQ ID NO: 2089978 - RNA, 12 nt, Human
gaaaacauaaaa

SEQ ID NO: 2089979 - RNA, 22 nt, Human
gaaaacauaaaaaguuaaaaaa

SEQ ID NO: 2089980 - RNA, 19 nt, Human
gaaaacaucacugaaaugc

SEQ ID NO: 2089981 - RNA, 14 nt, Human
gaaaacguuuuauu

SEQ ID NO: 2089982 - RNA, 16 nt, Human
gaaaacguuuuauugu

SEQ ID NO: 2089983 - RNA, 18 nt, Human
gaaaacguuuuauugugu

SEQ ID NO: 2089984 - RNA, 19 nt, Human
gaaaagcugcugacagugu

SEQ ID NO: 2089985 - RNA, 11 nt, Human
gaaaacagaaa

SEQ ID NO: 2089986 - RNA, 14 nt, Human
gaaaacagaaaaaa

SEQ ID NO: 2089987 - RNA, 19 nt, Human
gaaaacaggaaaaaaacuu

SEQ ID NO: 2089988 - RNA, 21 nt, Human
gaaaacaggaaaaaaacuuuu

SEQ ID NO: 2089989 - RNA, 23 nt, Human
gaaaacaggaaaaaaacuuuuau

SEQ ID NO: 2089990 - RNA, 17 nt, Human
gaaaacagacucagguu

SEQ ID NO: 2089991 - RNA, 19 nt, Human
cuuuuuauugaugugcaaa

SEQ ID NO: 2089992 - RNA, 18 nt, Human
cuuuuucuuuauaaacuu

SEQ ID NO: 2089993 - RNA, 15 nt, Human
cuuuuugguggaugu

SEQ ID NO: 2089994 - RNA, 16 nt, Human
cuuuuugguggaugua

SEQ ID NO: 2089995 - RNA, 17 nt, Human
cuuuuugguggauguaa

SEQ ID NO: 2089996 - RNA, 19 nt, Human
cuuuuugguggauguaaau

SEQ ID NO: 2089997 - RNA, 15 nt, Human
gaaaaaggacaggca

SEQ ID NO: 2089998 - RNA, 18 nt, Human
gaaaaaggacaggcagaa

SEQ ID NO: 2089999 - RNA, 21 nt, Human
gaaaaaggacaggcagaaaga

SEQ ID NO: 2090000 - RNA, 18 nt, Human
gaaaaaggagcuuaccuc

SEQ ID NO: 2090001 - RNA, 21 nt, Human
gaaaaaggagcuuaccuccca

SEQ ID NO: 2090002 - RNA, 12 nt, Human
gaaaaaggagga

SEQ ID NO: 2090003 - RNA, 15 nt, Human
gaaaaaggaggaaga

SEQ ID NO: 2090004 - RNA, 13 nt, Human
cuuuuucuuccuc

SEQ ID NO: 2090005 - RNA, 14 nt, Human
cuuuuucuuccuca

SEQ ID NO: 2090006 - RNA, 12 nt, Human
cuuuuucuuuau

SEQ ID NO: 2090007 - RNA, 16 nt, Human
cuuuuucuuuauaaac

SEQ ID NO: 2090008 - RNA, 22 nt, Human
cuuuuucuggacugaagccugc

SEQ ID NO: 2090009 - RNA, 18 nt, Human
cuuuguuaagacugcuga

SEQ ID NO: 2090010 - RNA, 22 nt, Human
cuuuguuauuuuuguuucuucc

SEQ ID NO: 2090011 - RNA, 20 nt, Human
cuuuguuauuuuuguuucuu

SEQ ID NO: 2090012 - RNA, 22 nt, Human
cuuuuguucagggcugugaucg

SEQ ID NO: 2090013 - RNA, 15 nt, Human
cuuuguuacaggcac

SEQ ID NO: 2090014 - RNA, 20 nt, Human
gaaacuagcuuacaugagaa

SEQ ID NO: 2090015 - RNA, 24 nt, Human
gaaacuagcuuacaugagaacaga

SEQ ID NO: 2090016 - RNA, 22 nt, Human
gaaacuagacuugaggaaacca

SEQ ID NO: 2090017 - RNA, 15 nt, Human
gaaacgugcccucug

SEQ ID NO: 2090018 - RNA, 12 nt, Human
gaaacuaacaga

SEQ ID NO: 2090019 - RNA, 19 nt, Human
gaaaccuuauuguaccucu

SEQ ID NO: 2090020 - RNA, 17 nt, Human
gaaaccuuauuguaccu

SEQ ID NO: 2090021 - RNA, 20 nt, Human
gaaaccuuauuguaccucuc

SEQ ID NO: 2090022 - RNA, 15 nt, Human
gaaacuaacagauaa

SEQ ID NO: 2090023 - RNA, 17 nt, Human
gaaacccuugaaaagac

SEQ ID NO: 2090024 - RNA, 17 nt, Human
gaaaccguccucuuuuu

SEQ ID NO: 2090025 - RNA, 17 nt, Human
gaaaccuacagaauacu

SEQ ID NO: 2090026 - RNA, 16 nt, Human
gaaacccgacagaggg

SEQ ID NO: 2090027 - RNA, 17 nt, Human
gaaaccccaucucuacu

SEQ ID NO: 2090028 - RNA, 21 nt, Human
gaaaccauuaugaagaagaga

SEQ ID NO: 2090029 - RNA, 19 nt, Human
gaaaccaguguagccuugc

SEQ ID NO: 2090030 - RNA, 18 nt, Human
gaaaccaaucaagauaaa

SEQ ID NO: 2090031 - RNA, 21 nt, Human
gaaaccaaucaagauaaagga

SEQ ID NO: 2090032 - RNA, 23 nt, Human
gaaaccaaucaagauaaaggaca

SEQ ID NO: 2090033 - RNA, 21 nt, Human
gaaacacacugaggcagggaa

SEQ ID NO: 2090034 - RNA, 23 nt, Human
gaaacacacugaggcagggaagu

SEQ ID NO: 2090035 - RNA, 14 nt, Human
gaaacacaauauuu

SEQ ID NO: 2090036 - RNA, 15 nt, Human
gaaacacaauauuuu

SEQ ID NO: 2090037 - RNA, 16 nt, Human
gaaacacaccaggcug

SEQ ID NO: 2090038 - RNA, 17 nt, Human
gaaacacaccaggcugu

SEQ ID NO: 2090039 - RNA, 23 nt, Human
gaaacacaccaggcugugggccu

SEQ ID NO: 2090040 - RNA, 16 nt, Human
gaaacacacugaggca

SEQ ID NO: 2090041 - RNA, 19 nt, Human
gaaacacacugaggcaggg

SEQ ID NO: 2090042 - RNA, 20 nt, Human
gaaacacacugaggcaggga

SEQ ID NO: 2090043 - RNA, 18 nt, Human
gaaaaugcaacaacaugu

SEQ ID NO: 2090044 - RNA, 20 nt, Human
gaaaaugcaacaacauguau

SEQ ID NO: 2090045 - RNA, 23 nt, Human
gaaaaugaguuuuuauggggcug

SEQ ID NO: 2090046 - RNA, 12 nt, Human
gaaagcugauua

SEQ ID NO: 2090047 - RNA, 22 nt, Human
gaaagcugauuacugucaauaa

SEQ ID NO: 2090048 - RNA, 23 nt, Human
gaaagcugauuacugucaauaaa

SEQ ID NO: 2090049 - RNA, 16 nt, Human
gaaagcuagagauaug

SEQ ID NO: 2090050 - RNA, 13 nt, Human
gaaagcuagagau

SEQ ID NO: 2090051 - RNA, 15 nt, Human
gaaagccucugcugc

SEQ ID NO: 2090052 - RNA, 16 nt, Human
gaaagccucugcugcc

SEQ ID NO: 2090053 - RNA, 17 nt, Human
gaaagcccugagcuuuc

SEQ ID NO: 2090054 - RNA, 14 nt, Human
gaaagccccagcac

SEQ ID NO: 2090055 - RNA, 18 nt, Human
gaaagccccagcacuaac

SEQ ID NO: 2090056 - RNA, 21 nt, Human
gaaagcccugagcuuucugcu

SEQ ID NO: 2090057 - RNA, 22 nt, Human
gaaagcccugagcuuucugcua

SEQ ID NO: 2090058 - RNA, 20 nt, Human
gaaagcagcucaaaggcaca

SEQ ID NO: 2090059 - RNA, 16 nt, Human
gaaagcaucaccucag

SEQ ID NO: 2090060 - RNA, 17 nt, Human
gaaagcaucaccucagg

SEQ ID NO: 2090061 - RNA, 18 nt, Human
gaaagcaucaccucaggc

SEQ ID NO: 2090062 - RNA, 19 nt, Human
gaaagcaucaccucaggcc

SEQ ID NO: 2090063 - RNA, 15 nt, Human
gaaagcauccaugug

SEQ ID NO: 2090064 - RNA, 17 nt, Human
gaaagcauccaugugug

SEQ ID NO: 2090065 - RNA, 22 nt, Human
gaaacuccgucuuagaagugga

SEQ ID NO: 2090066 - RNA, 18 nt, Human
gaaacuccgucuuagaag

SEQ ID NO: 2090067 - RNA, 17 nt, Human
gaaagacuguacaaagu

SEQ ID NO: 2090068 - RNA, 14 nt, Human
gaaagcagaggcug

SEQ ID NO: 2090069 - RNA, 18 nt, Human
gaaagcagaggcuggccu

SEQ ID NO: 2090070 - RNA, 19 nt, Human
gaaagcagaggcuggccuc

SEQ ID NO: 2090071 - RNA, 19 nt, Human
gaaagcagcucaaaggcac

SEQ ID NO: 2090072 - RNA, 19 nt, Human
cuuuaucacauuauuugca

SEQ ID NO: 2090073 - RNA, 22 nt, Human
cuuuaugaaugaaaaaacaguc

SEQ ID NO: 2090074 - RNA, 15 nt, Human
cuuuaugcacaaaau

SEQ ID NO: 2090075 - RNA, 18 nt, Human
cuuuaugcagcuuccuuu

SEQ ID NO: 2090076 - RNA, 15 nt, Human
cuuuagcgcccaguu

SEQ ID NO: 2090077 - RNA, 14 nt, Human
cuuuagcgcccagu

SEQ ID NO: 2090078 - RNA, 13 nt, Human
cuuuauaauucua

SEQ ID NO: 2090079 - RNA, 19 nt, Human
cuuuauaauucuacuuuga

SEQ ID NO: 2090080 - RNA, 22 nt, Human
cuuguucucucuaugguaaaga

SEQ ID NO: 2090081 - RNA, 19 nt, Human
cuuuauaugaacauagacu

SEQ ID NO: 2090082 - RNA, 15 nt, Human
cuuuauagaucagcc

SEQ ID NO: 2090083 - RNA, 13 nt, Human
cuuuagcacguuu

SEQ ID NO: 2090084 - RNA, 17 nt, Human
cuuuagcacguuuaaag

SEQ ID NO: 2090085 - RNA, 19 nt, Human
cuuuagcacguuuaaaguu

SEQ ID NO: 2090086 - RNA, 20 nt, Human
cuuuagcacguuuaaaguuc

SEQ ID NO: 2090087 - RNA, 21 nt, Human
cuuuagcacguuuaaaguucu

SEQ ID NO: 2090088 - RNA, 23 nt, Human
cuuuagcacguuuaaaguucugu

SEQ ID NO: 2090089 - RNA, 18 nt, Human
cuuuagcagaaucaaaau

SEQ ID NO: 2090090 - RNA, 14 nt, Human
cuuuacguagugua

SEQ ID NO: 2090091 - RNA, 12 nt, Human
cuuuacuguuug

SEQ ID NO: 2090092 - RNA, 20 nt, Human
cuuguucaaaauauguucuu

SEQ ID NO: 2090093 - RNA, 15 nt, Human
cuuguuauuuauaac

SEQ ID NO: 2090094 - RNA, 13 nt, Human
cuuguuauuuaua

SEQ ID NO: 2090095 - RNA, 13 nt, Human
cuuguuccagcuc

SEQ ID NO: 2090096 - RNA, 14 nt, Human
cuuguucccucucc

SEQ ID NO: 2090097 - RNA, 16 nt, Human
cuuguuccagcucuuu

SEQ ID NO: 2090098 - RNA, 21 nt, Human
cuuguuccccacugacagccu

SEQ ID NO: 2090099 - RNA, 13 nt, Human
cuuguucuacuca

SEQ ID NO: 2090100 - RNA, 22 nt, Human
cuuguucuacucauauauaucu

SEQ ID NO: 2090101 - RNA, 20 nt, Human
cuuguccaacccgaggcccg

SEQ ID NO: 2090102 - RNA, 14 nt, Human
cuuguccagcgccu

SEQ ID NO: 2090103 - RNA, 18 nt, Human
cuuguccagcgccuagug

SEQ ID NO: 2090104 - RNA, 14 nt, Human
cuugucacaauaaa

SEQ ID NO: 2090105 - RNA, 15 nt, Human
cuugucacaauaaau

SEQ ID NO: 2090106 - RNA, 16 nt, Human
cuugucacaauaaaug

SEQ ID NO: 2090107 - RNA, 17 nt, Human
cuugucacaauaaaugu

SEQ ID NO: 2090108 - RNA, 16 nt, Human
cuugucccacucaagc

SEQ ID NO: 2090109 - RNA, 18 nt, Human
cuugucccacucaagcca

SEQ ID NO: 2090110 - RNA, 19 nt, Human
cuugucccacucaagccaa

SEQ ID NO: 2090111 - RNA, 21 nt, Human
cuugucccacucaagccaagc

SEQ ID NO: 2090112 - RNA, 18 nt, Human
cuuguaaauagcucaggu

SEQ ID NO: 2090113 - RNA, 17 nt, Human
cuuguaaauagcucagg

SEQ ID NO: 2090114 - RNA, 23 nt, Human
cuuggggggcugaggugggagga

SEQ ID NO: 2090115 - RNA, 16 nt, Human
cuuguaaauagcucag

SEQ ID NO: 2090116 - RNA, 14 nt, Human
cuuucugggccaag

SEQ ID NO: 2090117 - RNA, 11 nt, Human
cuuucuuccuc

SEQ ID NO: 2090118 - RNA, 17 nt, Human
cuuucuguaccauuuau

SEQ ID NO: 2090119 - RNA, 12 nt, Human
cuuucucugcuu

SEQ ID NO: 2090120 - RNA, 14 nt, Human
cuuucucugcuuca

SEQ ID NO: 2090121 - RNA, 16 nt, Human
cuuucucugcuucagc

SEQ ID NO: 2090122 - RNA, 17 nt, Human
cuuucucugcuucagcu

SEQ ID NO: 2090123 - RNA, 21 nt, Human
cuuucucugcuucagcuugcu

SEQ ID NO: 2090124 - RNA, 15 nt, Human
cuuucuggccugccu

SEQ ID NO: 2090125 - RNA, 17 nt, Human
cuuucuggccugccuuc

SEQ ID NO: 2090126 - RNA, 15 nt, Human
cuuuccaucuacccu

SEQ ID NO: 2090127 - RNA, 16 nt, Human
cuuuauguaauaaugu

SEQ ID NO: 2090128 - RNA, 13 nt, Human
cuuuaugguuucu

SEQ ID NO: 2090129 - RNA, 14 nt, Human
cuuuccauuucucu

SEQ ID NO: 2090130 - RNA, 15 nt, Human
cuuuccauuucucuc

SEQ ID NO: 2090131 - RNA, 17 nt, Human
cuuucccuaaagacccu

SEQ ID NO: 2090132 - RNA, 19 nt, Human
cuuucccugcuuaaugaaa

SEQ ID NO: 2090133 - RNA, 13 nt, Human
cuuucccuccacu

SEQ ID NO: 2090134 - RNA, 11 nt, Human
cuuucccuccc

SEQ ID NO: 2090135 - RNA, 13 nt, Human
cuuucccucccuu

SEQ ID NO: 2090136 - RNA, 14 nt, Human
cuuucccucccuuc

SEQ ID NO: 2090137 - RNA, 16 nt, Human
cuuucccucccuuccu

SEQ ID NO: 2090138 - RNA, 19 nt, Human
cuuuggcuauuagagauca

SEQ ID NO: 2090139 - RNA, 18 nt, Human
cuuugcuccaccccacuc

SEQ ID NO: 2090140 - RNA, 15 nt, Human
cuuugcggacgggcu

SEQ ID NO: 2090141 - RNA, 21 nt, Human
cuuugcuauggggacauucca

SEQ ID NO: 2090142 - RNA, 23 nt, Human
cuuugccuugggcugcuccucau

SEQ ID NO: 2090143 - RNA, 12 nt, Human
cuuugccuuugc

SEQ ID NO: 2090144 - RNA, 18 nt, Human
cuuugucaucuuucuucu

SEQ ID NO: 2090145 - RNA, 16 nt, Human
cuuugucaaaaggaag

SEQ ID NO: 2090146 - RNA, 20 nt, Human
cuuugugcuacaugacgaca

SEQ ID NO: 2090147 - RNA, 19 nt, Human
cuuugugagagugagcugu

SEQ ID NO: 2090148 - RNA, 14 nt, Human
cuuugucccacagc

SEQ ID NO: 2090149 - RNA, 15 nt, Human
cuuugucccacagcu

SEQ ID NO: 2090150 - RNA, 16 nt, Human
cuuugucccacagcuu

SEQ ID NO: 2090151 - RNA, 14 nt, Human
cuuugucccauuuc

SEQ ID NO: 2090152 - RNA, 20 nt, Human
cuuugcagacaggcaagcac

SEQ ID NO: 2090153 - RNA, 13 nt, Human
cuuugcaggcuca

SEQ ID NO: 2090154 - RNA, 16 nt, Human
cuuugcagacaggcaa

SEQ ID NO: 2090155 - RNA, 13 nt, Human
cuuugccuccccg

SEQ ID NO: 2090156 - RNA, 22 nt, Human
cuuugccuuccacgcugucucc

SEQ ID NO: 2090157 - RNA, 23 nt, Human
cuuugccuuccacgcugucucca

SEQ ID NO: 2090158 - RNA, 13 nt, Human
cuuugccuugggc

SEQ ID NO: 2090159 - RNA, 16 nt, Human
cuuugccuugggcugc

SEQ ID NO: 2090160 - RNA, 18 nt, Human
cuuugccuugggcugcuc

SEQ ID NO: 2090161 - RNA, 19 nt, Human
cuuugccuugggcugcucc

SEQ ID NO: 2090162 - RNA, 22 nt, Human
cuuugccuugggcugcuccuca

SEQ ID NO: 2090163 - RNA, 15 nt, Human
cuuucuuccucugcu

SEQ ID NO: 2090164 - RNA, 14 nt, Human
cuuucuuccucugc

SEQ ID NO: 2090165 - RNA, 13 nt, Human
cuuucuuccucug

SEQ ID NO: 2090166 - RNA, 12 nt, Human
cuuucuuccucu

SEQ ID NO: 2090167 - RNA, 20 nt, Human
cuucuccuuagaaguggaag

SEQ ID NO: 2090168 - RNA, 13 nt, Human
cuucucugaagga

SEQ ID NO: 2090169 - RNA, 14 nt, Human
cuucucuccagugc

SEQ ID NO: 2090170 - RNA, 18 nt, Human
cuucucucucuaaaauga

SEQ ID NO: 2090171 - RNA, 13 nt, Human
cuucuccaggcug

SEQ ID NO: 2090172 - RNA, 17 nt, Human
cuucuccacuggaugga

SEQ ID NO: 2090173 - RNA, 23 nt, Human
cuucuccagacaaaccagaagca

SEQ ID NO: 2090174 - RNA, 17 nt, Human
cuucuccagacaaacca

SEQ ID NO: 2090175 - RNA, 12 nt, Human
cuucuccaggcu

SEQ ID NO: 2090176 - RNA, 15 nt, Human
cuuccuguccagaga

SEQ ID NO: 2090177 - RNA, 16 nt, Human
cuuccuguccagagag

SEQ ID NO: 2090178 - RNA, 15 nt, Human
cuuccucccucauuc

SEQ ID NO: 2090179 - RNA, 15 nt, Human
cuucuccacuggaug

SEQ ID NO: 2090180 - RNA, 14 nt, Human
cuucuccacuggau

SEQ ID NO: 2090181 - RNA, 13 nt, Human
cuucuccacugga

SEQ ID NO: 2090182 - RNA, 17 nt, Human
cuuccuguccagagaga

SEQ ID NO: 2090183 - RNA, 19 nt, Human
cuuccuguccagagagaga

SEQ ID NO: 2090184 - RNA, 15 nt, Human
cuucugcuccacccu

SEQ ID NO: 2090185 - RNA, 17 nt, Human
cuucugcuccacccuug

SEQ ID NO: 2090186 - RNA, 12 nt, Human
cuucugccugca

SEQ ID NO: 2090187 - RNA, 15 nt, Human
cuucugcccuugcca

SEQ ID NO: 2090188 - RNA, 17 nt, Human
cuucugccggcccuggg

SEQ ID NO: 2090189 - RNA, 18 nt, Human
cuucugccggcccugggg

SEQ ID NO: 2090190 - RNA, 19 nt, Human
cuucugccggcccuggggc

SEQ ID NO: 2090191 - RNA, 18 nt, Human
cuucugcccucccuggag

SEQ ID NO: 2090192 - RNA, 13 nt, Human
cuucugcuucagc

SEQ ID NO: 2090193 - RNA, 19 nt, Human
cuucugcuccacccuuggc

SEQ ID NO: 2090194 - RNA, 21 nt, Human
cuucugcuccacccuuggccu

SEQ ID NO: 2090195 - RNA, 23 nt, Human
cuucugcuccacccuuggccugu

SEQ ID NO: 2090196 - RNA, 15 nt, Human
cuucugcuggauaaa

SEQ ID NO: 2090197 - RNA, 17 nt, Human
cuucugcuggauaaaau

SEQ ID NO: 2090198 - RNA, 19 nt, Human
cuucugcuggauaaaauga

SEQ ID NO: 2090199 - RNA, 21 nt, Human
cuucuguccuacucuguguca

SEQ ID NO: 2090200 - RNA, 19 nt, Human
cuucuguccuacucugugu

SEQ ID NO: 2090201 - RNA, 18 nt, Human
cuucuguccuacucugug

SEQ ID NO: 2090202 - RNA, 17 nt, Human
cuucuguccuacucugu

SEQ ID NO: 2090203 - RNA, 16 nt, Human
cuucuguccuacucug

SEQ ID NO: 2090204 - RNA, 20 nt, Human
cuucuguacgucugacaggc

SEQ ID NO: 2090205 - RNA, 18 nt, Human
cuucuguacgucugacag

SEQ ID NO: 2090206 - RNA, 15 nt, Human
cuucuguacgucuga

SEQ ID NO: 2090207 - RNA, 14 nt, Human
cuucuguacgucug

SEQ ID NO: 2090208 - RNA, 21 nt, Human
cuucuguacgucugacaggca

SEQ ID NO: 2090209 - RNA, 15 nt, Human
cuucuguaguacucc

SEQ ID NO: 2090210 - RNA, 18 nt, Human
cuucuguaguacuccuua

SEQ ID NO: 2090211 - RNA, 21 nt, Human
cuucuguaguacuccuuaaga

SEQ ID NO: 2090212 - RNA, 22 nt, Human
cuucugcccauccugucuguuc

SEQ ID NO: 2090213 - RNA, 16 nt, Human
cuucugucaucuaccu

SEQ ID NO: 2090214 - RNA, 18 nt, Human
cuucuguauacuguggag

SEQ ID NO: 2090215 - RNA, 14 nt, Human
cuucuuggcuuugu

SEQ ID NO: 2090216 - RNA, 13 nt, Human
cuucuuguucccc

SEQ ID NO: 2090217 - RNA, 20 nt, Human
cuucuuggucuuauuuauua

SEQ ID NO: 2090218 - RNA, 13 nt, Human
cuucuugcuucuc

SEQ ID NO: 2090219 - RNA, 16 nt, Human
cuucuuggucuuauuu

SEQ ID NO: 2090220 - RNA, 19 nt, Human
cuucugugagacccccaca

SEQ ID NO: 2090221 - RNA, 22 nt, Human
cuucugugagacccccacaccu

SEQ ID NO: 2090222 - RNA, 20 nt, Human
cuucugugagacccccacac

SEQ ID NO: 2090223 - RNA, 21 nt, Human
cuucugugagacccccacacc

SEQ ID NO: 2090224 - RNA, 12 nt, Human
cuucugugccca

SEQ ID NO: 2090225 - RNA, 13 nt, Human
cuucugugcccag

SEQ ID NO: 2090226 - RNA, 14 nt, Human
cuucugugcccagc

SEQ ID NO: 2090227 - RNA, 15 nt, Human
cuucugugcccagcu

SEQ ID NO: 2090228 - RNA, 16 nt, Human
cuucugugcccagcuc

SEQ ID NO: 2090229 - RNA, 17 nt, Human
cuucugugcccagcuca

SEQ ID NO: 2090230 - RNA, 18 nt, Human
cuucugugcccagcucag

SEQ ID NO: 2090231 - RNA, 13 nt, Human
cuucuguggcuca

SEQ ID NO: 2090232 - RNA, 22 nt, Human
cuucuguggcucacagaacccu

SEQ ID NO: 2090233 - RNA, 15 nt, Human
cuucuguggcucaca

SEQ ID NO: 2090234 - RNA, 17 nt, Human
cuucuuuuuuugugaug

SEQ ID NO: 2090235 - RNA, 15 nt, Human
cuucuugugaucuug

SEQ ID NO: 2090236 - RNA, 19 nt, Human
cuucuugugaucuugcucu

SEQ ID NO: 2090237 - RNA, 23 nt, Human
cuucuugugaucuugcucuaucu

SEQ ID NO: 2090238 - RNA, 16 nt, Human
cuucuuuuuuuucauu

SEQ ID NO: 2090239 - RNA, 22 nt, Human
cuucuuuauaauucuacuuuga

SEQ ID NO: 2090240 - RNA, 17 nt, Human
cuugaaagaaaggggca

SEQ ID NO: 2090241 - RNA, 23 nt, Human
cuugaaagaaaggggcaggagcu

SEQ ID NO: 2090242 - RNA, 13 nt, Human
cuugaaagaaaau

SEQ ID NO: 2090243 - RNA, 13 nt, Human
cuugaaagcugug

SEQ ID NO: 2090244 - RNA, 17 nt, Human
cuugaaagcauccaugu

SEQ ID NO: 2090245 - RNA, 18 nt, Human
cuugaaagcauccaugug

SEQ ID NO: 2090246 - RNA, 21 nt, Human
cuugaaagaagaaaagguucu

SEQ ID NO: 2090247 - RNA, 19 nt, Human
cuugaaagaagaaaagguu

SEQ ID NO: 2090248 - RNA, 16 nt, Human
cuugaaagcauccaug

SEQ ID NO: 2090249 - RNA, 17 nt, Human
cuugaaagucaugaaca

SEQ ID NO: 2090250 - RNA, 20 nt, Human
cuugaaagucaugaacacau

SEQ ID NO: 2090251 - RNA, 20 nt, Human
cuugaaagcauccaugugug

SEQ ID NO: 2090252 - RNA, 15 nt, Human
cuugaacacaguauu

SEQ ID NO: 2090253 - RNA, 16 nt, Human
cuugaacacaguauuu

SEQ ID NO: 2090254 - RNA, 17 nt, Human
cuugaacacaguauuuu

SEQ ID NO: 2090255 - RNA, 20 nt, Human
cuugaacacaguauuuuccc

SEQ ID NO: 2090256 - RNA, 15 nt, Human
cuugaacaccacgcu

SEQ ID NO: 2090257 - RNA, 13 nt, Human
cuugaacacuggg

SEQ ID NO: 2090258 - RNA, 15 nt, Human
cuugaacacuggggg

SEQ ID NO: 2090259 - RNA, 16 nt, Human
cuugaacacuggggga

SEQ ID NO: 2090260 - RNA, 13 nt, Human
cuugaacuccugg

SEQ ID NO: 2090261 - RNA, 15 nt, Human
cuugaacccaggaga

SEQ ID NO: 2090262 - RNA, 13 nt, Human
cuugaccucaggu

SEQ ID NO: 2090263 - RNA, 20 nt, Human
cuugaggguugggcuggugu

SEQ ID NO: 2090264 - RNA, 19 nt, Human
cuugaggguugggcuggug

SEQ ID NO: 2090265 - RNA, 21 nt, Human
cuugaggguugggcugguguc

SEQ ID NO: 2090266 - RNA, 21 nt, Human
cuugagcuuggcagcugaacu

SEQ ID NO: 2090267 - RNA, 12 nt, Human
cuugagcuuggc

SEQ ID NO: 2090268 - RNA, 20 nt, Human
cuugagcuuggcagcugaac

SEQ ID NO: 2090269 - RNA, 14 nt, Human
cuugagcuccccaa

SEQ ID NO: 2090270 - RNA, 10 nt, Human
cuugagcuga

SEQ ID NO: 2090271 - RNA, 16 nt, Human
cuugagcugagaugga

SEQ ID NO: 2090272 - RNA, 13 nt, Human
cuugagcugagau

SEQ ID NO: 2090273 - RNA, 15 nt, Human
cuugaacccaggagg

SEQ ID NO: 2090274 - RNA, 17 nt, Human
cuugacuugauuagugc

SEQ ID NO: 2090275 - RNA, 16 nt, Human
cuugacuauuggagga

SEQ ID NO: 2090276 - RNA, 16 nt, Human
cuugagccugggaggu

SEQ ID NO: 2090277 - RNA, 20 nt, Human
cuucaccuaagucucuguga

SEQ ID NO: 2090278 - RNA, 22 nt, Human
cuucaggcucuucuccuuucac

SEQ ID NO: 2090279 - RNA, 19 nt, Human
cuucaggcucuucuccuuu

SEQ ID NO: 2090280 - RNA, 15 nt, Human
cuucacccuggagcc

SEQ ID NO: 2090281 - RNA, 18 nt, Human
cuucaccuaagucucugu

SEQ ID NO: 2090282 - RNA, 19 nt, Human
cuucaccuaagucucugug

SEQ ID NO: 2090283 - RNA, 16 nt, Human
cuucagggcagggcuc

SEQ ID NO: 2090284 - RNA, 17 nt, Human
cuucagggcagggcucu

SEQ ID NO: 2090285 - RNA, 20 nt, Human
cuucagggcagggcucugau

SEQ ID NO: 2090286 - RNA, 19 nt, Human
cuucagggcacugcugcug

SEQ ID NO: 2090287 - RNA, 16 nt, Human
cuucaguaagccguga

SEQ ID NO: 2090288 - RNA, 23 nt, Human
cuucaguaagccgugauuuucau

SEQ ID NO: 2090289 - RNA, 16 nt, Human
cuucaguggcagcugc

SEQ ID NO: 2090290 - RNA, 15 nt, Human
cuucaguggcagcug

SEQ ID NO: 2090291 - RNA, 14 nt, Human
cuucaguggcagcu

SEQ ID NO: 2090292 - RNA, 13 nt, Human
cuucaguggcagc

SEQ ID NO: 2090293 - RNA, 18 nt, Human
cuucagggcagggcucug

SEQ ID NO: 2090294 - RNA, 19 nt, Human
cuucagggcagggcucuga

SEQ ID NO: 2090295 - RNA, 17 nt, Human
cuucaguggcagcugcu

SEQ ID NO: 2090296 - RNA, 20 nt, Human
cuucauucaacccaccugcg

SEQ ID NO: 2090297 - RNA, 21 nt, Human
cuucauucuugaaagcugugg

SEQ ID NO: 2090298 - RNA, 20 nt, Human
cuucauucuugaaagcugug

SEQ ID NO: 2090299 - RNA, 21 nt, Human
cuucauucaagucagcucuuc

SEQ ID NO: 2090300 - RNA, 19 nt, Human
cuucauugccuuaacugga

SEQ ID NO: 2090301 - RNA, 17 nt, Human
cuuccacgcugucucca

SEQ ID NO: 2090302 - RNA, 13 nt, Human
cuuccaccuggaa

SEQ ID NO: 2090303 - RNA, 16 nt, Human
cuuccacgcugucucc

SEQ ID NO: 2090304 - RNA, 18 nt, Human
cuuccacgcugucuccag

SEQ ID NO: 2090305 - RNA, 20 nt, Human
cuuccacgcugucuccagac

SEQ ID NO: 2090306 - RNA, 21 nt, Human
cuuccacgcugucuccagacc

SEQ ID NO: 2090307 - RNA, 22 nt, Human
cuuccacgcugucuccagaccc

SEQ ID NO: 2090308 - RNA, 21 nt, Human
cuuccaccagccugcacuacu

SEQ ID NO: 2090309 - RNA, 17 nt, Human
cuuccaccagccugcac

SEQ ID NO: 2090310 - RNA, 20 nt, Human
cuuccacguacugcagccuc

SEQ ID NO: 2090311 - RNA, 19 nt, Human
cuuccacguacugcagccu

SEQ ID NO: 2090312 - RNA, 18 nt, Human
cuuccccgcauuccaggc

SEQ ID NO: 2090313 - RNA, 15 nt, Human
cuucccuugagcccu

SEQ ID NO: 2090314 - RNA, 13 nt, Human
cuuccucccucau

SEQ ID NO: 2090315 - RNA, 16 nt, Human
cuucccuuaaaauuua

SEQ ID NO: 2090316 - RNA, 20 nt, Human
cuucccuuaaaauuuauaug

SEQ ID NO: 2090317 - RNA, 16 nt, Human
cuucccuugagcccuc

SEQ ID NO: 2090318 - RNA, 16 nt, Human
cuuccccuugcccagg

SEQ ID NO: 2090319 - RNA, 19 nt, Human
cuucccgcucagcccuccc

SEQ ID NO: 2090320 - RNA, 18 nt, Human
cuucccgcucagcccucc

SEQ ID NO: 2090321 - RNA, 23 nt, Human
cuucccgcucagcccucccugcc

SEQ ID NO: 2090322 - RNA, 17 nt, Human
cuucccuacaguugaaa

SEQ ID NO: 2090323 - RNA, 16 nt, Human
cuucccccucucccag

SEQ ID NO: 2090324 - RNA, 17 nt, Human
cuucccccucucccagu

SEQ ID NO: 2090325 - RNA, 18 nt, Human
cuucccccucucccaguu

SEQ ID NO: 2090326 - RNA, 12 nt, Human
cuuccccucacu

SEQ ID NO: 2090327 - RNA, 14 nt, Human
cuuccccucccugg

SEQ ID NO: 2090328 - RNA, 16 nt, Human
cuuccccucccuggcu

SEQ ID NO: 2090329 - RNA, 18 nt, Human
cuuccccucccuggcucc

SEQ ID NO: 2090330 - RNA, 20 nt, Human
cuuccccucccuggcuccca

SEQ ID NO: 2090331 - RNA, 19 nt, Human
cuuccccucuaaugcucac

SEQ ID NO: 2090332 - RNA, 21 nt, Human
cuuccccucuaaugcucacgc

SEQ ID NO: 2090333 - RNA, 20 nt, Human
cuuccccucucuccuccugc

SEQ ID NO: 2090334 - RNA, 21 nt, Human
cuuccaggggagguucaguga

SEQ ID NO: 2090335 - RNA, 22 nt, Human
cuucccaguucaggagucccaa

SEQ ID NO: 2090336 - RNA, 23 nt, Human
cuucccaguucaggagucccaag

SEQ ID NO: 2090337 - RNA, 11 nt, Human
cuucccaucac

SEQ ID NO: 2090338 - RNA, 16 nt, Human
cuucccaucacuggag

SEQ ID NO: 2090339 - RNA, 17 nt, Human
cuucccaucacuggagc

SEQ ID NO: 2090340 - RNA, 18 nt, Human
cuucccaucacuggagca

SEQ ID NO: 2090341 - RNA, 14 nt, Human
cuuccaggccauca

SEQ ID NO: 2090342 - RNA, 16 nt, Human
cuuccaggccaucaga

SEQ ID NO: 2090343 - RNA, 20 nt, Human
cuuccaggccaucagaggcc

SEQ ID NO: 2090344 - RNA, 16 nt, Human
cuuccaggcccccacc

SEQ ID NO: 2090345 - RNA, 19 nt, Human
cuuccacggacucaaguuu

SEQ ID NO: 2090346 - RNA, 21 nt, Human
cuuccaggcugcauagaagga

SEQ ID NO: 2090347 - RNA, 19 nt, Human
cuuccaggcccccaccacu

SEQ ID NO: 2090348 - RNA, 12 nt, Human
cuucaauaaagu

SEQ ID NO: 2090349 - RNA, 20 nt, Human
cuucaaguuagcucaggagg

SEQ ID NO: 2090350 - RNA, 14 nt, Human
cuucaauaaaguau

SEQ ID NO: 2090351 - RNA, 16 nt, Human
cuucaaguuagcucag

SEQ ID NO: 2090352 - RNA, 17 nt, Human
cuucaaguuagcucagg

SEQ ID NO: 2090353 - RNA, 18 nt, Human
cuucaaguuagcucagga

SEQ ID NO: 2090354 - RNA, 19 nt, Human
cuucaaguuagcucaggag

SEQ ID NO: 2090355 - RNA, 15 nt, Human
cuucaauuccugggc

SEQ ID NO: 2090356 - RNA, 16 nt, Human
cuucaauuccugggcc

SEQ ID NO: 2090357 - RNA, 21 nt, Human
cuucacacacaggcaacugag

SEQ ID NO: 2090358 - RNA, 22 nt, Human
cuucacacacaggcaacugagg

SEQ ID NO: 2090359 - RNA, 19 nt, Human
cuucacaccuacccuccuu

SEQ ID NO: 2090360 - RNA, 12 nt, Human
cuucacacugca

SEQ ID NO: 2090361 - RNA, 13 nt, Human
cuucacacugcaa

SEQ ID NO: 2090362 - RNA, 15 nt, Human
cuucacacugcaaga

SEQ ID NO: 2090363 - RNA, 18 nt, Human
cuucacacugcaagagcc

SEQ ID NO: 2090364 - RNA, 20 nt, Human
cuucacacugcaagagccuu

SEQ ID NO: 2090365 - RNA, 21 nt, Human
cuucacacugcaagagccuug

SEQ ID NO: 2090366 - RNA, 16 nt, Human
cuucacagcucugugu

SEQ ID NO: 2090367 - RNA, 16 nt, Human
cuucaaccauucccca

SEQ ID NO: 2090368 - RNA, 22 nt, Human
cuucaacaucaauguucauugu

SEQ ID NO: 2090369 - RNA, 20 nt, Human
cuucaaccauuccccauggg

SEQ ID NO: 2090370 - RNA, 14 nt, Human
cuucaagucugugc

SEQ ID NO: 2090371 - RNA, 15 nt, Human
cuucaagucugugcc

SEQ ID NO: 2090372 - RNA, 16 nt, Human
cuucaagucugugccu

SEQ ID NO: 2090373 - RNA, 17 nt, Human
cuucaagucugugccug

SEQ ID NO: 2090374 - RNA, 18 nt, Human
cuucaagucugugccugg

SEQ ID NO: 2090375 - RNA, 22 nt, Human
cuucaagucugugccuggagcu

SEQ ID NO: 2090376 - RNA, 23 nt, Human
cuucaagucugugccuggagcuc

SEQ ID NO: 2090377 - RNA, 22 nt, Human
cuucaagugcaugcucucugca

SEQ ID NO: 2090378 - RNA, 16 nt, Human
cuucaagggcugcuuc

SEQ ID NO: 2090379 - RNA, 17 nt, Human
cuucaagggcugcuuca

SEQ ID NO: 2090380 - RNA, 18 nt, Human
cuucaaguuaaagugaau

SEQ ID NO: 2090381 - RNA, 23 nt, Human
cuuaucuaaucaugaaacucccu

SEQ ID NO: 2090382 - RNA, 17 nt, Human
cuuauuuaaugaaagac

SEQ ID NO: 2090383 - RNA, 15 nt, Human
cuuaucgaaacucau

SEQ ID NO: 2090384 - RNA, 21 nt, Human
cuuauccuuccacggacucaa

SEQ ID NO: 2090385 - RNA, 13 nt, Human
cuuauuuauuauu

SEQ ID NO: 2090386 - RNA, 18 nt, Human
cuuauuuaaugaaagacu

SEQ ID NO: 2090387 - RNA, 23 nt, Human
cuuauuuuaaaauuuuaucucuu

SEQ ID NO: 2090388 - RNA, 15 nt, Human
cuuauuuccucauuu

SEQ ID NO: 2090389 - RNA, 16 nt, Human
cuucaacaucaauguu

SEQ ID NO: 2090390 - RNA, 18 nt, Human
cuucaacaucaauguuca

SEQ ID NO: 2090391 - RNA, 19 nt, Human
cuucaacaucaauguucau

SEQ ID NO: 2090392 - RNA, 20 nt, Human
cuucaacaucaauguucauu

SEQ ID NO: 2090393 - RNA, 19 nt, Human
cuucaaauauuaugcaggg

SEQ ID NO: 2090394 - RNA, 11 nt, Human
cuucaaagcug

SEQ ID NO: 2090395 - RNA, 16 nt, Human
cuucaaagcuugaaga

SEQ ID NO: 2090396 - RNA, 18 nt, Human
cuucaaagcuugaagauc

SEQ ID NO: 2090397 - RNA, 20 nt, Human
cuguucugggugcagcugag

SEQ ID NO: 2090398 - RNA, 19 nt, Human
cuuagauguauauauuucc

SEQ ID NO: 2090399 - RNA, 13 nt, Human
cuuagauguauau

SEQ ID NO: 2090400 - RNA, 22 nt, Human
cuuagugcggacaaguuuuaau

SEQ ID NO: 2090401 - RNA, 21 nt, Human
cuuagucuucucauagcauua

SEQ ID NO: 2090402 - RNA, 20 nt, Human
cuuagugcggacaaguuuua

SEQ ID NO: 2090403 - RNA, 19 nt, Human
cuuagugcggacaaguuuu

SEQ ID NO: 2090404 - RNA, 17 nt, Human
cuuagugaaauuacuuc

SEQ ID NO: 2090405 - RNA, 15 nt, Human
cuuagucuucucaua

SEQ ID NO: 2090406 - RNA, 16 nt, Human
cuuagucuucucauag

SEQ ID NO: 2090407 - RNA, 20 nt, Human
cuuagucuucucauagcauu

SEQ ID NO: 2090408 - RNA, 15 nt, Human
cuuaucaauuuguca

SEQ ID NO: 2090409 - RNA, 16 nt, Human
cuuaucaauuugucau

SEQ ID NO: 2090410 - RNA, 21 nt, Human
cuuaucaauuugucauuuuga

SEQ ID NO: 2090411 - RNA, 22 nt, Human
cuuaucaauuugucauuuugaa

SEQ ID NO: 2090412 - RNA, 19 nt, Human
cuuauauaguuuacuauuu

SEQ ID NO: 2090413 - RNA, 21 nt, Human
cuuauccuaaaacaaauaguu

SEQ ID NO: 2090414 - RNA, 20 nt, Human
cuuaucaugcugucuuuaca

SEQ ID NO: 2090415 - RNA, 18 nt, Human
cuuaucacugacacaaaa

SEQ ID NO: 2090416 - RNA, 23 nt, Human
cuuaguucaaguccugccucuua

SEQ ID NO: 2090417 - RNA, 16 nt, Human
cuuauagaauauuuau

SEQ ID NO: 2090418 - RNA, 15 nt, Human
cuuauagaauauuua

SEQ ID NO: 2090419 - RNA, 14 nt, Human
cuuauagaauauuu

SEQ ID NO: 2090420 - RNA, 13 nt, Human
cuuauagaauauu

SEQ ID NO: 2090421 - RNA, 18 nt, Human
cuuauauaguuuacuauu

SEQ ID NO: 2090422 - RNA, 20 nt, Human
cuuauauaguuuacuauuuu

SEQ ID NO: 2090423 - RNA, 20 nt, Human
cuuauagaauauuuauuacc

SEQ ID NO: 2090424 - RNA, 16 nt, Human
cuguggccaaguucuu

SEQ ID NO: 2090425 - RNA, 18 nt, Human
cuguggcaggccagcugu

SEQ ID NO: 2090426 - RNA, 17 nt, Human
cuguggcaucuuugccu

SEQ ID NO: 2090427 - RNA, 23 nt, Human
cuguggcaggccagcugugguuu

SEQ ID NO: 2090428 - RNA, 15 nt, Human
cuguggcaguaaaga

SEQ ID NO: 2090429 - RNA, 20 nt, Human
cuguggcaguaaagagaaac

SEQ ID NO: 2090430 - RNA, 21 nt, Human
cuguggcaguaaagagaaacu

SEQ ID NO: 2090431 - RNA, 23 nt, Human
cuguggcaguaaagagaaacuuu

SEQ ID NO: 2090432 - RNA, 17 nt, Human
cuguggaugauaaaaca

SEQ ID NO: 2090433 - RNA, 19 nt, Human
cuguggaaaaauauuuaag

SEQ ID NO: 2090434 - RNA, 18 nt, Human
cuguggccaaguucuuag

SEQ ID NO: 2090435 - RNA, 22 nt, Human
cuguggccagcuuguuauuuau

SEQ ID NO: 2090436 - RNA, 19 nt, Human
cuguggcaggccagcugug

SEQ ID NO: 2090437 - RNA, 23 nt, Human
cuguggccagcuuguuauuuaua

SEQ ID NO: 2090438 - RNA, 13 nt, Human
cuguggccaaagg

SEQ ID NO: 2090439 - RNA, 13 nt, Human
cuguggccugggc

SEQ ID NO: 2090440 - RNA, 14 nt, Human
cuguggccugggca

SEQ ID NO: 2090441 - RNA, 16 nt, Human
cuguggccugggcaag

SEQ ID NO: 2090442 - RNA, 15 nt, Human
cuguggccuuggucu

SEQ ID NO: 2090443 - RNA, 13 nt, Human
cuguggccuuguu

SEQ ID NO: 2090444 - RNA, 14 nt, Human
cuguggcggugccu

SEQ ID NO: 2090445 - RNA, 15 nt, Human
cuguggcggugccug

SEQ ID NO: 2090446 - RNA, 17 nt, Human
cuguggcugcuagcacu

SEQ ID NO: 2090447 - RNA, 14 nt, Human
cugugggccucaag

SEQ ID NO: 2090448 - RNA, 20 nt, Human
cugugggccucaaggacuug

SEQ ID NO: 2090449 - RNA, 18 nt, Human
cuguggcggugccugggu

SEQ ID NO: 2090450 - RNA, 11 nt, Human
cugugccucug

SEQ ID NO: 2090451 - RNA, 14 nt, Human
cugugccucuggga

SEQ ID NO: 2090452 - RNA, 16 nt, Human
cugugccucugggacu

SEQ ID NO: 2090453 - RNA, 17 nt, Human
cugugccucugggacug

SEQ ID NO: 2090454 - RNA, 18 nt, Human
cugugccucugggacugg

SEQ ID NO: 2090455 - RNA, 14 nt, Human
cuguggaaaaauau

SEQ ID NO: 2090456 - RNA, 18 nt, Human
cuguggaaaaauauuuaa

SEQ ID NO: 2090457 - RNA, 18 nt, Human
cugugccaugugccaggu

SEQ ID NO: 2090458 - RNA, 16 nt, Human
cugugccaugugccag

SEQ ID NO: 2090459 - RNA, 13 nt, Human
cugugccacccac

SEQ ID NO: 2090460 - RNA, 18 nt, Human
cugugccacccaccaggg

SEQ ID NO: 2090461 - RNA, 14 nt, Human
cugugcauggguga

SEQ ID NO: 2090462 - RNA, 17 nt, Human
cugugcaugggugaagg

SEQ ID NO: 2090463 - RNA, 20 nt, Human
cugugcaugggugaagggag

SEQ ID NO: 2090464 - RNA, 22 nt, Human
cugugcaugggugaagggagag

SEQ ID NO: 2090465 - RNA, 23 nt, Human
cugugcaguggcccccacagaaa

SEQ ID NO: 2090466 - RNA, 17 nt, Human
cugugaguuuaaagcaa

SEQ ID NO: 2090467 - RNA, 21 nt, Human
cugugaguguaagugugagua

SEQ ID NO: 2090468 - RNA, 19 nt, Human
cugugaguguaagugugag

SEQ ID NO: 2090469 - RNA, 20 nt, Human
cugugaguguaagugugagu

SEQ ID NO: 2090470 - RNA, 14 nt, Human
cugugaucaagcaa

SEQ ID NO: 2090471 - RNA, 17 nt, Human
cugucuccucucucugu

SEQ ID NO: 2090472 - RNA, 22 nt, Human
cugugaggugcagagugcccag

SEQ ID NO: 2090473 - RNA, 14 nt, Human
cugugaguguaagu

SEQ ID NO: 2090474 - RNA, 18 nt, Human
cugucuccauguuugaug

SEQ ID NO: 2090475 - RNA, 19 nt, Human
cugucuccagacccccacc

SEQ ID NO: 2090476 - RNA, 22 nt, Human
cugucuccagacccccaccccu

SEQ ID NO: 2090477 - RNA, 23 nt, Human
cugugaggugcagagugcccaga

SEQ ID NO: 2090478 - RNA, 13 nt, Human
cugucucaaaaaa

SEQ ID NO: 2090479 - RNA, 19 nt, Human
cugucuccuaccucugcuc

SEQ ID NO: 2090480 - RNA, 15 nt, Human
cugucuccccucugc

SEQ ID NO: 2090481 - RNA, 16 nt, Human
cugucuccccucugcu

SEQ ID NO: 2090482 - RNA, 18 nt, Human
cugucuccccucugcugg

SEQ ID NO: 2090483 - RNA, 20 nt, Human
cugucucccuauaaugcugg

SEQ ID NO: 2090484 - RNA, 23 nt, Human
cugucucaagagggcacuggugg

SEQ ID NO: 2090485 - RNA, 12 nt, Human
cugucucagccu

SEQ ID NO: 2090486 - RNA, 16 nt, Human
cugucucaguuucacu

SEQ ID NO: 2090487 - RNA, 13 nt, Human
cugucuccagacc

SEQ ID NO: 2090488 - RNA, 15 nt, Human
cugucuccagacccc

SEQ ID NO: 2090489 - RNA, 16 nt, Human
cugucuccagaccccc

SEQ ID NO: 2090490 - RNA, 18 nt, Human
cugucuccagacccccac

SEQ ID NO: 2090491 - RNA, 14 nt, Human
cugucucagccucc

SEQ ID NO: 2090492 - RNA, 15 nt, Human
cugucucagccuccc

SEQ ID NO: 2090493 - RNA, 16 nt, Human
cugucucagccuccca

SEQ ID NO: 2090494 - RNA, 17 nt, Human
cugucucagccucccag

SEQ ID NO: 2090495 - RNA, 13 nt, Human
cugugugcugugg

SEQ ID NO: 2090496 - RNA, 21 nt, Human
cugugugcugugguuccuggg

SEQ ID NO: 2090497 - RNA, 18 nt, Human
cuguguggacugugaugc

SEQ ID NO: 2090498 - RNA, 16 nt, Human
cuguguggacugugau

SEQ ID NO: 2090499 - RNA, 13 nt, Human
cugugggcucccu

SEQ ID NO: 2090500 - RNA, 14 nt, Human
cugugggcucccuu

SEQ ID NO: 2090501 - RNA, 15 nt, Human
cugugggcucccuuc

SEQ ID NO: 2090502 - RNA, 18 nt, Human
cugugggcucccuuccuc

SEQ ID NO: 2090503 - RNA, 19 nt, Human
cugugggccucaaggacuu

SEQ ID NO: 2090504 - RNA, 19 nt, Human
cuguggggccuugguuccc

SEQ ID NO: 2090505 - RNA, 20 nt, Human
cuguggggauuucucccagc

SEQ ID NO: 2090506 - RNA, 21 nt, Human
cuguggggauuucucccagcu

SEQ ID NO: 2090507 - RNA, 17 nt, Human
cuguggggauuucuccc

SEQ ID NO: 2090508 - RNA, 18 nt, Human
cuguggggauuucuccca

SEQ ID NO: 2090509 - RNA, 19 nt, Human
cuguggggauuucucccag

SEQ ID NO: 2090510 - RNA, 23 nt, Human
cugugucuugcaauggcagccuu

SEQ ID NO: 2090511 - RNA, 22 nt, Human
cugugucuugcaauggcagccu

SEQ ID NO: 2090512 - RNA, 21 nt, Human
cugugucuugcaauggcagcc

SEQ ID NO: 2090513 - RNA, 20 nt, Human
cugugugugcgccuacagga

SEQ ID NO: 2090514 - RNA, 17 nt, Human
cugugugggacuguaca

SEQ ID NO: 2090515 - RNA, 19 nt, Human
cugugugggacuguacaca

SEQ ID NO: 2090516 - RNA, 21 nt, Human
cugugugggacuguacacacu

SEQ ID NO: 2090517 - RNA, 22 nt, Human
cugugugggacuguacacacuu

SEQ ID NO: 2090518 - RNA, 20 nt, Human
cugugugguuuaguguaaaa

SEQ ID NO: 2090519 - RNA, 23 nt, Human
cugugugguuuaguguaaaaaug

SEQ ID NO: 2090520 - RNA, 18 nt, Human
cugugugugcgccuacag

SEQ ID NO: 2090521 - RNA, 11 nt, Human
cugugugguug

SEQ ID NO: 2090522 - RNA, 21 nt, Human
cuguuccuggcucagccucaa

SEQ ID NO: 2090523 - RNA, 15 nt, Human
cuguuccuucacauc

SEQ ID NO: 2090524 - RNA, 18 nt, Human
cuguuccuucacauccug

SEQ ID NO: 2090525 - RNA, 21 nt, Human
cuguuccuucacauccugugu

SEQ ID NO: 2090526 - RNA, 18 nt, Human
cuguucccauucuugcau

SEQ ID NO: 2090527 - RNA, 18 nt, Human
cuguucccaaauuuucua

SEQ ID NO: 2090528 - RNA, 14 nt, Human
cuguucauuuguua

SEQ ID NO: 2090529 - RNA, 19 nt, Human
cuguucauuuguuauucuu

SEQ ID NO: 2090530 - RNA, 12 nt, Human
cuguucauugua

SEQ ID NO: 2090531 - RNA, 13 nt, Human
cuguucauuguaa

SEQ ID NO: 2090532 - RNA, 14 nt, Human
cuguucauuguaag

SEQ ID NO: 2090533 - RNA, 13 nt, Human
cuguuacugucuu

SEQ ID NO: 2090534 - RNA, 16 nt, Human
cuguucaguaacaggg

SEQ ID NO: 2090535 - RNA, 18 nt, Human
cuguucagcugguugagg

SEQ ID NO: 2090536 - RNA, 19 nt, Human
cuguucagcugguugaggu

SEQ ID NO: 2090537 - RNA, 21 nt, Human
cuguucagcugguugagguuu

SEQ ID NO: 2090538 - RNA, 21 nt, Human
cuguacaauauuuaaaauuua

SEQ ID NO: 2090539 - RNA, 15 nt, Human
cuguacacacuuuau

SEQ ID NO: 2090540 - RNA, 16 nt, Human
cuguacacacuuuauu

SEQ ID NO: 2090541 - RNA, 20 nt, Human
cuguacacacuuuauuuacu

SEQ ID NO: 2090542 - RNA, 14 nt, Human
cuguacaauauuua

SEQ ID NO: 2090543 - RNA, 15 nt, Human
cuguacaauauuuaa

SEQ ID NO: 2090544 - RNA, 16 nt, Human
cuguacaauauuuaaa

SEQ ID NO: 2090545 - RNA, 17 nt, Human
cuguacaauauuuaaaa

SEQ ID NO: 2090546 - RNA, 18 nt, Human
cuguacaauauuuaaaau

SEQ ID NO: 2090547 - RNA, 19 nt, Human
cuguacacugaauauuuau

SEQ ID NO: 2090548 - RNA, 13 nt, Human
cuguaguuaggaa

SEQ ID NO: 2090549 - RNA, 14 nt, Human
cuguaguuaggaaa

SEQ ID NO: 2090550 - RNA, 15 nt, Human
cuguaguuaggaaau

SEQ ID NO: 2090551 - RNA, 23 nt, Human
cuguaguccuagccacucaggag

SEQ ID NO: 2090552 - RNA, 14 nt, Human
cuguagucucagga

SEQ ID NO: 2090553 - RNA, 15 nt, Human
cuguagucucaggac

SEQ ID NO: 2090554 - RNA, 20 nt, Human
cuguagucucaggaccuagg

SEQ ID NO: 2090555 - RNA, 15 nt, Human
cuguagucccagcua

SEQ ID NO: 2090556 - RNA, 18 nt, Human
cuguagucccagcuacuc

SEQ ID NO: 2090557 - RNA, 22 nt, Human
cuguagucccagcuacucagga

SEQ ID NO: 2090558 - RNA, 23 nt, Human
cuguagucccagcuacucaggag

SEQ ID NO: 2090559 - RNA, 22 nt, Human
cuguagucccagcuacucggga

SEQ ID NO: 2090560 - RNA, 20 nt, Human
cuguaguccuagccacucag

SEQ ID NO: 2090561 - RNA, 22 nt, Human
cuguaguccuagccacucagga

SEQ ID NO: 2090562 - RNA, 19 nt, Human
cuguaucaacccagaaaca

SEQ ID NO: 2090563 - RNA, 21 nt, Human
cuguauaccccgugaagcauc

SEQ ID NO: 2090564 - RNA, 17 nt, Human
cuguaguuaggaaauaa

SEQ ID NO: 2090565 - RNA, 18 nt, Human
cuguaguuaggaaauaaa

SEQ ID NO: 2090566 - RNA, 23 nt, Human
cuguaucccaugagccucagcau

SEQ ID NO: 2090567 - RNA, 17 nt, Human
cuguaucggagacagug

SEQ ID NO: 2090568 - RNA, 18 nt, Human
cuguaucggagacaguga

SEQ ID NO: 2090569 - RNA, 13 nt, Human
cuguaucugugua

SEQ ID NO: 2090570 - RNA, 14 nt, Human
cuguaucuguguag

SEQ ID NO: 2090571 - RNA, 18 nt, Human
cuguaucuguguagacua

SEQ ID NO: 2090572 - RNA, 18 nt, Human
cuguaucuuguuuuucca

SEQ ID NO: 2090573 - RNA, 18 nt, Human
cugucaaacaaagccaga

SEQ ID NO: 2090574 - RNA, 19 nt, Human
cugucaaacaaagccagaa

SEQ ID NO: 2090575 - RNA, 22 nt, Human
cugucaaacaaagccagaagcu

SEQ ID NO: 2090576 - RNA, 23 nt, Human
cuguccaggcacugcugcccagc

SEQ ID NO: 2090577 - RNA, 18 nt, Human
cuguccagccugggcagc

SEQ ID NO: 2090578 - RNA, 18 nt, Human
cuguccagagagagaagu

SEQ ID NO: 2090579 - RNA, 13 nt, Human
cuguccagccugg

SEQ ID NO: 2090580 - RNA, 15 nt, Human
cuguccagccugggc

SEQ ID NO: 2090581 - RNA, 17 nt, Human
cuguccagccugggcag

SEQ ID NO: 2090582 - RNA, 15 nt, Human
cugucaaagaaucaa

SEQ ID NO: 2090583 - RNA, 12 nt, Human
cugucaauaaac

SEQ ID NO: 2090584 - RNA, 13 nt, Human
cugucaauaaaca

SEQ ID NO: 2090585 - RNA, 18 nt, Human
cuguccagggcccugagc

SEQ ID NO: 2090586 - RNA, 19 nt, Human
cuguccagggcccugagcu

SEQ ID NO: 2090587 - RNA, 20 nt, Human
cuguccagggcccugagcuc

SEQ ID NO: 2090588 - RNA, 22 nt, Human
cuguccagggcccugagcucgg

SEQ ID NO: 2090589 - RNA, 23 nt, Human
cuguccagggcccugagcucggu

SEQ ID NO: 2090590 - RNA, 16 nt, Human
cugucccucucaggca

SEQ ID NO: 2090591 - RNA, 14 nt, Human
cugucccuggccau

SEQ ID NO: 2090592 - RNA, 16 nt, Human
cugucccuggccaucu

SEQ ID NO: 2090593 - RNA, 17 nt, Human
cugucccuggccaucuc

SEQ ID NO: 2090594 - RNA, 18 nt, Human
cugucccuggccaucucu

SEQ ID NO: 2090595 - RNA, 12 nt, Human
cugucccuguca

SEQ ID NO: 2090596 - RNA, 15 nt, Human
cugucccucucaggc

SEQ ID NO: 2090597 - RNA, 14 nt, Human
cuguccgagcuuug

SEQ ID NO: 2090598 - RNA, 15 nt, Human
cugucccugucacca

SEQ ID NO: 2090599 - RNA, 17 nt, Human
cuguccgcccucuuccc

SEQ ID NO: 2090600 - RNA, 15 nt, Human
cuguccgagcuuuga

SEQ ID NO: 2090601 - RNA, 14 nt, Human
cuguccuacccacc

SEQ ID NO: 2090602 - RNA, 17 nt, Human
cugucccugucaccaag

SEQ ID NO: 2090603 - RNA, 18 nt, Human
cuguccguuuacuccaag

SEQ ID NO: 2090604 - RNA, 17 nt, Human
cuguccucagcuucuua

SEQ ID NO: 2090605 - RNA, 15 nt, Human
cuguccucagcuucu

SEQ ID NO: 2090606 - RNA, 23 nt, Human
cugucucaaaaaaacacaaaagu

SEQ ID NO: 2090607 - RNA, 16 nt, Human
cugucucaaaaaaaga

SEQ ID NO: 2090608 - RNA, 22 nt, Human
cugucucaagagggcacuggug

SEQ ID NO: 2090609 - RNA, 18 nt, Human
cugucucaaaaaaagaaa

SEQ ID NO: 2090610 - RNA, 21 nt, Human
cugucuaggucaguacccacc

SEQ ID NO: 2090611 - RNA, 22 nt, Human
cugucuaggucaguacccaccu

SEQ ID NO: 2090612 - RNA, 23 nt, Human
cugucuaggucaguacccaccug

SEQ ID NO: 2090613 - RNA, 13 nt, Human
cugucuaccaucu

SEQ ID NO: 2090614 - RNA, 14 nt, Human
cugucuaccaucuc

SEQ ID NO: 2090615 - RNA, 15 nt, Human
cugucuaccaucucc

SEQ ID NO: 2090616 - RNA, 17 nt, Human
cugucuaccaucucccu

SEQ ID NO: 2090617 - RNA, 20 nt, Human
cuguaauccuagcacuuugg

SEQ ID NO: 2090618 - RNA, 13 nt, Human
cuguacaaaguag

SEQ ID NO: 2090619 - RNA, 15 nt, Human
cuguacaaaguagaa

SEQ ID NO: 2090620 - RNA, 20 nt, Human
cuguacaaaagggacaugaa

SEQ ID NO: 2090621 - RNA, 22 nt, Human
cuguacaaaagggacaugaaau

SEQ ID NO: 2090622 - RNA, 18 nt, Human
cugguuccggaauccugu

SEQ ID NO: 2090623 - RNA, 23 nt, Human
cuggugggaucugugcccagaga

SEQ ID NO: 2090624 - RNA, 17 nt, Human
cugguuccggaauccug

SEQ ID NO: 2090625 - RNA, 12 nt, Human
cuggugcugcug

SEQ ID NO: 2090626 - RNA, 14 nt, Human
cugguggccucugc

SEQ ID NO: 2090627 - RNA, 15 nt, Human
cugguggccucugcc

SEQ ID NO: 2090628 - RNA, 18 nt, Human
cugguuccugcuagaaau

SEQ ID NO: 2090629 - RNA, 20 nt, Human
cugguuccugcuagaaaugg

SEQ ID NO: 2090630 - RNA, 23 nt, Human
cugguggcccgacagccuggcac

SEQ ID NO: 2090631 - RNA, 22 nt, Human
cugguggcccgacagccuggca

SEQ ID NO: 2090632 - RNA, 21 nt, Human
cugguggcccgacagccuggc

SEQ ID NO: 2090633 - RNA, 20 nt, Human
cugguggcccgacagccugg

SEQ ID NO: 2090634 - RNA, 14 nt, Human
cugguggcagcugc

SEQ ID NO: 2090635 - RNA, 13 nt, Human
cugguggcagcug

SEQ ID NO: 2090636 - RNA, 22 nt, Human
cuggugcugccacacuucaggc

SEQ ID NO: 2090637 - RNA, 20 nt, Human
cuggugcugccacacuucag

SEQ ID NO: 2090638 - RNA, 13 nt, Human
cuggugcugccac

SEQ ID NO: 2090639 - RNA, 12 nt, Human
cuggugcugcca

SEQ ID NO: 2090640 - RNA, 18 nt, Human
cuggucacaggacucugc

SEQ ID NO: 2090641 - RNA, 15 nt, Human
cuggucccugggagg

SEQ ID NO: 2090642 - RNA, 19 nt, Human
cuggucaacuugagcaugu

SEQ ID NO: 2090643 - RNA, 20 nt, Human
cuggucaacuugagcauguu

SEQ ID NO: 2090644 - RNA, 12 nt, Human
cugguauuuccu

SEQ ID NO: 2090645 - RNA, 17 nt, Human
cuggucccuugcagcua

SEQ ID NO: 2090646 - RNA, 21 nt, Human
cuggucccuugcagcuaguuu

SEQ ID NO: 2090647 - RNA, 16 nt, Human
cugggggaagcccugg

SEQ ID NO: 2090648 - RNA, 20 nt, Human
cugggggcagccugcguggc

SEQ ID NO: 2090649 - RNA, 23 nt, Human
cugggggcagccugcguggcuga

SEQ ID NO: 2090650 - RNA, 12 nt, Human
cugggggcagga

SEQ ID NO: 2090651 - RNA, 14 nt, Human
cugggggcaggagg

SEQ ID NO: 2090652 - RNA, 19 nt, Human
cugggggcaggagggcccu

SEQ ID NO: 2090653 - RNA, 15 nt, Human
cugggggaagaagcu

SEQ ID NO: 2090654 - RNA, 17 nt, Human
cugggggaagcccugga

SEQ ID NO: 2090655 - RNA, 14 nt, Human
cugggggaagcccu

SEQ ID NO: 2090656 - RNA, 14 nt, Human
cugggggccaugag

SEQ ID NO: 2090657 - RNA, 16 nt, Human
cugggggccaugagcu

SEQ ID NO: 2090658 - RNA, 17 nt, Human
cugggggccaugagcuc

SEQ ID NO: 2090659 - RNA, 18 nt, Human
cugggggccaugagcucc

SEQ ID NO: 2090660 - RNA, 13 nt, Human
cugggggaagaag

SEQ ID NO: 2090661 - RNA, 24 nt, Human
cugggcuucaguggcagcugcuuu

SEQ ID NO: 2090662 - RNA, 13 nt, Human
cuggcugcaguga

SEQ ID NO: 2090663 - RNA, 12 nt, Human
cuggcugcccag

SEQ ID NO: 2090664 - RNA, 13 nt, Human
cuggcugcccaga

SEQ ID NO: 2090665 - RNA, 18 nt, Human
cuggcugcccagaccccu

SEQ ID NO: 2090666 - RNA, 22 nt, Human
cuggguaacuagggaagauaau

SEQ ID NO: 2090667 - RNA, 20 nt, Human
cuggguaacuagggaagaua

SEQ ID NO: 2090668 - RNA, 16 nt, Human
cuggguacgagggaug

SEQ ID NO: 2090669 - RNA, 14 nt, Human
cuggggugcccucc

SEQ ID NO: 2090670 - RNA, 19 nt, Human
cuggggugcccuccacugc

SEQ ID NO: 2090671 - RNA, 21 nt, Human
cuggggugcccuccacugccc

SEQ ID NO: 2090672 - RNA, 23 nt, Human
cuggggugcccuccacugcccuc

SEQ ID NO: 2090673 - RNA, 19 nt, Human
cugggguccuggggccucg

SEQ ID NO: 2090674 - RNA, 15 nt, Human
cugggguccuggggc

SEQ ID NO: 2090675 - RNA, 18 nt, Human
cugggguccuggggccuc

SEQ ID NO: 2090676 - RNA, 19 nt, Human
cuggcaguggaacuaagaa

SEQ ID NO: 2090677 - RNA, 15 nt, Human
cuggcaguuuuccau

SEQ ID NO: 2090678 - RNA, 14 nt, Human
cuggccagaugcac

SEQ ID NO: 2090679 - RNA, 13 nt, Human
cuggccagaggcu

SEQ ID NO: 2090680 - RNA, 15 nt, Human
cuggcccacugcauc

SEQ ID NO: 2090681 - RNA, 17 nt, Human
cuggccaguuggaacca

SEQ ID NO: 2090682 - RNA, 12 nt, Human
cuggccaucucu

SEQ ID NO: 2090683 - RNA, 13 nt, Human
cuggccaucucug

SEQ ID NO: 2090684 - RNA, 22 nt, Human
cuggccaucucugaacuucagc

SEQ ID NO: 2090685 - RNA, 13 nt, Human
cuggcccagccaa

SEQ ID NO: 2090686 - RNA, 17 nt, Human
cuggcccagccaaaccc

SEQ ID NO: 2090687 - RNA, 20 nt, Human
cuggcccagccaaacccugu

SEQ ID NO: 2090688 - RNA, 23 nt, Human
cuggcccagccaaacccugucug

SEQ ID NO: 2090689 - RNA, 21 nt, Human
cuggcacuuggagacuuguau

SEQ ID NO: 2090690 - RNA, 23 nt, Human
cuggcagaaagcaaaugugaccu

SEQ ID NO: 2090691 - RNA, 21 nt, Human
cuggcagaaagcaaaugugac

SEQ ID NO: 2090692 - RNA, 13 nt, Human
cuggcagaacuga

SEQ ID NO: 2090693 - RNA, 16 nt, Human
cuggcagaacugagcu

SEQ ID NO: 2090694 - RNA, 17 nt, Human
cuggcagaacugagcuc

SEQ ID NO: 2090695 - RNA, 18 nt, Human
cuggcagaacugagcucc

SEQ ID NO: 2090696 - RNA, 19 nt, Human
cuggcagaacugagcuccu

SEQ ID NO: 2090697 - RNA, 20 nt, Human
cuggcagaacugagcuccuc

SEQ ID NO: 2090698 - RNA, 21 nt, Human
cuggcagaacugagcuccucu

SEQ ID NO: 2090699 - RNA, 23 nt, Human
cuggacuccagaucugcaccgcc

SEQ ID NO: 2090700 - RNA, 14 nt, Human
cuggcacuuggaga

SEQ ID NO: 2090701 - RNA, 21 nt, Human
cuggcacuggaugcagaaaca

SEQ ID NO: 2090702 - RNA, 22 nt, Human
cuggcacccggccccugcuggu

SEQ ID NO: 2090703 - RNA, 17 nt, Human
cuggcacauuuccccag

SEQ ID NO: 2090704 - RNA, 19 nt, Human
cuggcacauuuccccagac

SEQ ID NO: 2090705 - RNA, 22 nt, Human
cuggcacauuuccccagaccug

SEQ ID NO: 2090706 - RNA, 23 nt, Human
cuggcacauuuccccagaccuga

SEQ ID NO: 2090707 - RNA, 20 nt, Human
cuggagugcagugagccgag

SEQ ID NO: 2090708 - RNA, 19 nt, Human
cuggcacccggccccugcu

SEQ ID NO: 2090709 - RNA, 21 nt, Human
cuggcacccggccccugcugg

SEQ ID NO: 2090710 - RNA, 20 nt, Human
cuggcacccggccccugcug

SEQ ID NO: 2090711 - RNA, 15 nt, Human
cuggcgugcaguggu

SEQ ID NO: 2090712 - RNA, 14 nt, Human
cuggcgugcagugg

SEQ ID NO: 2090713 - RNA, 13 nt, Human
cuggcgucugucu

SEQ ID NO: 2090714 - RNA, 14 nt, Human
cuggcgucugucuu

SEQ ID NO: 2090715 - RNA, 19 nt, Human
cuggccuugaaaccaccuu

SEQ ID NO: 2090716 - RNA, 16 nt, Human
cuggcggcuacucagc

SEQ ID NO: 2090717 - RNA, 17 nt, Human
cuggcggcuacucagca

SEQ ID NO: 2090718 - RNA, 18 nt, Human
cuggcggcuacucagcag

SEQ ID NO: 2090719 - RNA, 20 nt, Human
cuggcggcuacucagcagcc

SEQ ID NO: 2090720 - RNA, 22 nt, Human
cuggcggcuacucagcagcccu

SEQ ID NO: 2090721 - RNA, 23 nt, Human
cuggcggcuacucagcagcccuc

SEQ ID NO: 2090722 - RNA, 13 nt, Human
cuggcgugugggu

SEQ ID NO: 2090723 - RNA, 15 nt, Human
cuggcgucugucuuc

SEQ ID NO: 2090724 - RNA, 22 nt, Human
cuggcgucugucuucaagggcu

SEQ ID NO: 2090725 - RNA, 23 nt, Human
cuggcgucugucuucaagggcuu

SEQ ID NO: 2090726 - RNA, 16 nt, Human
cuggcuaacuggaagc

SEQ ID NO: 2090727 - RNA, 20 nt, Human
cuggcuagaggccagcccca

SEQ ID NO: 2090728 - RNA, 21 nt, Human
cuggcuagaggccagccccac

SEQ ID NO: 2090729 - RNA, 22 nt, Human
cuggcuagaggccagccccacc

SEQ ID NO: 2090730 - RNA, 23 nt, Human
cuggcuagaggccagccccaccc

SEQ ID NO: 2090731 - RNA, 17 nt, Human
cuggcuaacuggaagca

SEQ ID NO: 2090732 - RNA, 21 nt, Human
cuggcugaggauuucaagccu

SEQ ID NO: 2090733 - RNA, 22 nt, Human
cuggcugaggauuucaagccug

SEQ ID NO: 2090734 - RNA, 22 nt, Human
cugcuucccucugccugucccu

SEQ ID NO: 2090735 - RNA, 23 nt, Human
cugcuucccucugccugucccuc

SEQ ID NO: 2090736 - RNA, 14 nt, Human
cugcuucccucugc

SEQ ID NO: 2090737 - RNA, 18 nt, Human
cugcuucccucugccugu

SEQ ID NO: 2090738 - RNA, 20 nt, Human
cugcuucccucugccugucc

SEQ ID NO: 2090739 - RNA, 21 nt, Human
cugcuucccucugccuguccc

SEQ ID NO: 2090740 - RNA, 13 nt, Human
cuggaauuuuuau

SEQ ID NO: 2090741 - RNA, 20 nt, Human
cuggaauuuuuauuaugcau

SEQ ID NO: 2090742 - RNA, 15 nt, Human
cuggaauuuuuuauu

SEQ ID NO: 2090743 - RNA, 17 nt, Human
cuggaauuuuuuauucu

SEQ ID NO: 2090744 - RNA, 18 nt, Human
cuggaauuuuuuauucuu

SEQ ID NO: 2090745 - RNA, 20 nt, Human
cuggaauuuuuuauucuugu

SEQ ID NO: 2090746 - RNA, 21 nt, Human
cuggaauuuuuuauucuugug

SEQ ID NO: 2090747 - RNA, 13 nt, Human
cuggacaggucug

SEQ ID NO: 2090748 - RNA, 14 nt, Human
cuggacaggucugg

SEQ ID NO: 2090749 - RNA, 15 nt, Human
cuggacaggucuggg

SEQ ID NO: 2090750 - RNA, 16 nt, Human
cuggacaggucuggga

SEQ ID NO: 2090751 - RNA, 18 nt, Human
cuggacaggucugggaga

SEQ ID NO: 2090752 - RNA, 17 nt, Human
cuggacaggcauguucu

SEQ ID NO: 2090753 - RNA, 14 nt, Human
cuggacaggcaugu

SEQ ID NO: 2090754 - RNA, 23 nt, Human
cuggacaggcauguucucugagg

SEQ ID NO: 2090755 - RNA, 21 nt, Human
cuggaccuugaacuggguacu

SEQ ID NO: 2090756 - RNA, 20 nt, Human
cuggaccuugaacuggguac

SEQ ID NO: 2090757 - RNA, 17 nt, Human
cuggaccuugaacuggg

SEQ ID NO: 2090758 - RNA, 17 nt, Human
cuggacuccucugucca

SEQ ID NO: 2090759 - RNA, 14 nt, Human
cuggacuccucugu

SEQ ID NO: 2090760 - RNA, 19 nt, Human
cuggacuccucuguccagg

SEQ ID NO: 2090761 - RNA, 18 nt, Human
cuggacuccucuguccag

SEQ ID NO: 2090762 - RNA, 15 nt, Human
cuggagaucaccagu

SEQ ID NO: 2090763 - RNA, 15 nt, Human
cuggacccuguggau

SEQ ID NO: 2090764 - RNA, 16 nt, Human
cuggaccuugaacugg

SEQ ID NO: 2090765 - RNA, 13 nt, Human
cuggaccucacca

SEQ ID NO: 2090766 - RNA, 17 nt, Human
cuggagugcagugagcc

SEQ ID NO: 2090767 - RNA, 16 nt, Human
cuggagugcagugagc

SEQ ID NO: 2090768 - RNA, 15 nt, Human
cuggagugcagugag

SEQ ID NO: 2090769 - RNA, 14 nt, Human
cuggagugcaguga

SEQ ID NO: 2090770 - RNA, 15 nt, Human
cuggagucaaaacac

SEQ ID NO: 2090771 - RNA, 15 nt, Human
cuggaguccagucuc

SEQ ID NO: 2090772 - RNA, 14 nt, Human
cuggagucccugug

SEQ ID NO: 2090773 - RNA, 16 nt, Human
cuggaguccagucucu

SEQ ID NO: 2090774 - RNA, 16 nt, Human
cuggaggggagcucug

SEQ ID NO: 2090775 - RNA, 21 nt, Human
cuggaggggagcucugucugu

SEQ ID NO: 2090776 - RNA, 14 nt, Human
cuggaggggcaugg

SEQ ID NO: 2090777 - RNA, 22 nt, Human
cuggaggggcauggccagcagc

SEQ ID NO: 2090778 - RNA, 23 nt, Human
cuggaggggcauggccagcagcu

SEQ ID NO: 2090779 - RNA, 12 nt, Human
cuggaggcaggg

SEQ ID NO: 2090780 - RNA, 11 nt, Human
cuggagcuggc

SEQ ID NO: 2090781 - RNA, 13 nt, Human
cuggaggcagggc

SEQ ID NO: 2090782 - RNA, 14 nt, Human
cuggaggcagggcc

SEQ ID NO: 2090783 - RNA, 15 nt, Human
cuggaggcagggccu

SEQ ID NO: 2090784 - RNA, 15 nt, Human
cuggaggggacgcug

SEQ ID NO: 2090785 - RNA, 16 nt, Human
cuggaggggacgcugg

SEQ ID NO: 2090786 - RNA, 21 nt, Human
cuggaggggacgcugguagag

SEQ ID NO: 2090787 - RNA, 23 nt, Human
cuggaggcagggccuugcccaga

SEQ ID NO: 2090788 - RNA, 16 nt, Human
cuggaggcagggccuu

SEQ ID NO: 2090789 - RNA, 19 nt, Human
cuggaggcagggccuugcc

SEQ ID NO: 2090790 - RNA, 20 nt, Human
cuggaggcagggccuugccc

SEQ ID NO: 2090791 - RNA, 22 nt, Human
cuggaggcagggccuugcccag

SEQ ID NO: 2090792 - RNA, 15 nt, Human
cuggagauggggaga

SEQ ID NO: 2090793 - RNA, 18 nt, Human
cuggagauggggagaaac

SEQ ID NO: 2090794 - RNA, 12 nt, Human
cuggagcccagg

SEQ ID NO: 2090795 - RNA, 13 nt, Human
cuggagcccagga

SEQ ID NO: 2090796 - RNA, 13 nt, Human
cuggagccccauc

SEQ ID NO: 2090797 - RNA, 14 nt, Human
cuggagcccaggga

SEQ ID NO: 2090798 - RNA, 12 nt, Human
cuggagccccac

SEQ ID NO: 2090799 - RNA, 16 nt, Human
cuggagccccacugcc

SEQ ID NO: 2090800 - RNA, 23 nt, Human
cuggagccccacugcccuucuca

SEQ ID NO: 2090801 - RNA, 13 nt, Human
cuggagcccaggg

SEQ ID NO: 2090802 - RNA, 15 nt, Human
cuggagcccaggagu

SEQ ID NO: 2090803 - RNA, 15 nt, Human
cuggagcccuugggu

SEQ ID NO: 2090804 - RNA, 23 nt, Human
cuggagccuccacugccucugga

SEQ ID NO: 2090805 - RNA, 17 nt, Human
cuggagcccgaggcacc

SEQ ID NO: 2090806 - RNA, 20 nt, Human
cuggagcccgaggcaccagu

SEQ ID NO: 2090807 - RNA, 15 nt, Human
cugccgaccagagcc

SEQ ID NO: 2090808 - RNA, 16 nt, Human
cugccgaccagagccc

SEQ ID NO: 2090809 - RNA, 16 nt, Human
cugccgaccgaggcug

SEQ ID NO: 2090810 - RNA, 21 nt, Human
cugccgaccgaggcuggagcu

SEQ ID NO: 2090811 - RNA, 22 nt, Human
cugccgaccgaggcuggagcug

SEQ ID NO: 2090812 - RNA, 20 nt, Human
cugccgacacgcucccuccc

SEQ ID NO: 2090813 - RNA, 13 nt, Human
cugccgaccagag

SEQ ID NO: 2090814 - RNA, 23 nt, Human
cugcccuugucccacucaagcca

SEQ ID NO: 2090815 - RNA, 15 nt, Human
cugcccuugucccac

SEQ ID NO: 2090816 - RNA, 17 nt, Human
cugcccuugucccacuc

SEQ ID NO: 2090817 - RNA, 18 nt, Human
cugcccuugucccacuca

SEQ ID NO: 2090818 - RNA, 23 nt, Human
cugccgaccgaggcuggagcugg

SEQ ID NO: 2090819 - RNA, 15 nt, Human
cugccgaccucgucc

SEQ ID NO: 2090820 - RNA, 17 nt, Human
cugccgaccucguccuc

SEQ ID NO: 2090821 - RNA, 19 nt, Human
cugccgaccucguccuccc

SEQ ID NO: 2090822 - RNA, 14 nt, Human
cugccggcucuggc

SEQ ID NO: 2090823 - RNA, 17 nt, Human
cugccggcucuggcucu

SEQ ID NO: 2090824 - RNA, 23 nt, Human
cugccgguucuuaaauccauccu

SEQ ID NO: 2090825 - RNA, 11 nt, Human
cugcccugcug

SEQ ID NO: 2090826 - RNA, 21 nt, Human
cugcccugcugccgccuccca

SEQ ID NO: 2090827 - RNA, 22 nt, Human
cugcccugcugccgccucccag

SEQ ID NO: 2090828 - RNA, 21 nt, Human
cugcccuucagcauccucagu

SEQ ID NO: 2090829 - RNA, 18 nt, Human
cugcccuaggcuccguca

SEQ ID NO: 2090830 - RNA, 13 nt, Human
cucccuggccugu

SEQ ID NO: 2090831 - RNA, 19 nt, Human
cugcccuagagcacacugu

SEQ ID NO: 2090832 - RNA, 21 nt, Human
cugcccuagagcacacuguag

SEQ ID NO: 2090833 - RNA, 15 nt, Human
cugcccuagcuccac

SEQ ID NO: 2090834 - RNA, 16 nt, Human
cugcccuagcuccaca

SEQ ID NO: 2090835 - RNA, 22 nt, Human
cugcccuagcuccacacccucu

SEQ ID NO: 2090836 - RNA, 12 nt, Human
cugcccuaggcu

SEQ ID NO: 2090837 - RNA, 22 nt, Human
cugccuccccaacccugccccu

SEQ ID NO: 2090838 - RNA, 14 nt, Human
cugccucugccugc

SEQ ID NO: 2090839 - RNA, 17 nt, Human
cugccucugccugcauu

SEQ ID NO: 2090840 - RNA, 20 nt, Human
cugccucugccugcauucug

SEQ ID NO: 2090841 - RNA, 15 nt, Human
cugccucuucucuac

SEQ ID NO: 2090842 - RNA, 17 nt, Human
cugccugcccaggcccc

SEQ ID NO: 2090843 - RNA, 16 nt, Human
cugccugcccaggccc

SEQ ID NO: 2090844 - RNA, 15 nt, Human
cugccugaagucaca

SEQ ID NO: 2090845 - RNA, 20 nt, Human
cugccugcccaggccccugc

SEQ ID NO: 2090846 - RNA, 18 nt, Human
cugccucugccugcauuc

SEQ ID NO: 2090847 - RNA, 17 nt, Human
cugccugaaccuuccau

SEQ ID NO: 2090848 - RNA, 12 nt, Human
cugccuggccag

SEQ ID NO: 2090849 - RNA, 13 nt, Human
cugccuggccagg

SEQ ID NO: 2090850 - RNA, 15 nt, Human
cugccuggccaggca

SEQ ID NO: 2090851 - RNA, 21 nt, Human
cugccuggccaggcagaucug

SEQ ID NO: 2090852 - RNA, 16 nt, Human
cugccuggccaggcag

SEQ ID NO: 2090853 - RNA, 17 nt, Human
cugccuggccaggcaga

SEQ ID NO: 2090854 - RNA, 14 nt, Human
cugccuggccccca

SEQ ID NO: 2090855 - RNA, 16 nt, Human
cugccuggcccccagc

SEQ ID NO: 2090856 - RNA, 20 nt, Human
cugccuggcccccagcugug

SEQ ID NO: 2090857 - RNA, 23 nt, Human
cugccuuggacuguguuuuuccu

SEQ ID NO: 2090858 - RNA, 15 nt, Human
cugccuaagaggcaa

SEQ ID NO: 2090859 - RNA, 18 nt, Human
cugccuccauucugacca

SEQ ID NO: 2090860 - RNA, 12 nt, Human
cugccuccccaa

SEQ ID NO: 2090861 - RNA, 14 nt, Human
cugccuccccaacc

SEQ ID NO: 2090862 - RNA, 15 nt, Human
cugccuccccaaccc

SEQ ID NO: 2090863 - RNA, 16 nt, Human
cugccuccccaacccu

SEQ ID NO: 2090864 - RNA, 18 nt, Human
cugccuccccaacccugc

SEQ ID NO: 2090865 - RNA, 19 nt, Human
cugccuccccaacccugcc

SEQ ID NO: 2090866 - RNA, 23 nt, Human
cugccucugacacacagcucugu

SEQ ID NO: 2090867 - RNA, 22 nt, Human
cugccucugacacacagcucug

SEQ ID NO: 2090868 - RNA, 15 nt, Human
cugccucugacacac

SEQ ID NO: 2090869 - RNA, 14 nt, Human
cugccgugugcccu

SEQ ID NO: 2090870 - RNA, 13 nt, Human
cugccuaagcccu

SEQ ID NO: 2090871 - RNA, 20 nt, Human
cugccuuuagucgcugagga

SEQ ID NO: 2090872 - RNA, 19 nt, Human
cugcuccagcuguucagcu

SEQ ID NO: 2090873 - RNA, 20 nt, Human
cugcuccagcuguucagcug

SEQ ID NO: 2090874 - RNA, 20 nt, Human
cugcucuccucuugccacug

SEQ ID NO: 2090875 - RNA, 14 nt, Human
cugcucuccucuug

SEQ ID NO: 2090876 - RNA, 19 nt, Human
cugcucuccgaccagacac

SEQ ID NO: 2090877 - RNA, 12 nt, Human
cugcuccuccag

SEQ ID NO: 2090878 - RNA, 11 nt, Human
cugcuccucca

SEQ ID NO: 2090879 - RNA, 13 nt, Human
cugcuccucaugg

SEQ ID NO: 2090880 - RNA, 14 nt, Human
cugcuccucauggu

SEQ ID NO: 2090881 - RNA, 13 nt, Human
cugcuccuccagg

SEQ ID NO: 2090882 - RNA, 14 nt, Human
cugcuccuccaggg

SEQ ID NO: 2090883 - RNA, 16 nt, Human
cugcuccuccagggcc

SEQ ID NO: 2090884 - RNA, 17 nt, Human
cugcuccuccagggcca

SEQ ID NO: 2090885 - RNA, 22 nt, Human
cugcuccuccagggccacgugc

SEQ ID NO: 2090886 - RNA, 24 nt, Human
cugcuccuccagggccacgugcca

SEQ ID NO: 2090887 - RNA, 22 nt, Human
cugcugccauggcgugucccuc

SEQ ID NO: 2090888 - RNA, 16 nt, Human
cugcugcauggggugg

SEQ ID NO: 2090889 - RNA, 12 nt, Human
cugcugcccucc

SEQ ID NO: 2090890 - RNA, 17 nt, Human
cugcugcccuccauccc

SEQ ID NO: 2090891 - RNA, 13 nt, Human
cugcugcccucca

SEQ ID NO: 2090892 - RNA, 14 nt, Human
cugcugcccuccau

SEQ ID NO: 2090893 - RNA, 22 nt, Human
cugcugcccagccuccaagcuc

SEQ ID NO: 2090894 - RNA, 16 nt, Human
cugcugccccaaagga

SEQ ID NO: 2090895 - RNA, 18 nt, Human
cugcugccccaaaggaag

SEQ ID NO: 2090896 - RNA, 19 nt, Human
cugcugccccaaaggaagc

SEQ ID NO: 2090897 - RNA, 15 nt, Human
cugcugcccagccuc

SEQ ID NO: 2090898 - RNA, 12 nt, Human
cugcugcccagc

SEQ ID NO: 2090899 - RNA, 18 nt, Human
cugcugaaggaauaaauu

SEQ ID NO: 2090900 - RNA, 17 nt, Human
cugcugaaggaauaaau

SEQ ID NO: 2090901 - RNA, 21 nt, Human
cugcucuccucuugccacugc

SEQ ID NO: 2090902 - RNA, 23 nt, Human
cugcugguucaggguuggccccu

SEQ ID NO: 2090903 - RNA, 15 nt, Human
cugcugguucagggu

SEQ ID NO: 2090904 - RNA, 13 nt, Human
cugcugguucagg

SEQ ID NO: 2090905 - RNA, 16 nt, Human
cugcugggcucuccac

SEQ ID NO: 2090906 - RNA, 17 nt, Human
cugcugggcucuccacc

SEQ ID NO: 2090907 - RNA, 18 nt, Human
cugcugggcucuccaccu

SEQ ID NO: 2090908 - RNA, 19 nt, Human
cugcugggcucuccaccuc

SEQ ID NO: 2090909 - RNA, 21 nt, Human
cugcugggcucuccaccucag

SEQ ID NO: 2090910 - RNA, 22 nt, Human
cugcugggcucuccaccucagc

SEQ ID NO: 2090911 - RNA, 23 nt, Human
cugcugggcucuccaccucagcc

SEQ ID NO: 2090912 - RNA, 21 nt, Human
cugcugcuaaucuucagggca

SEQ ID NO: 2090913 - RNA, 14 nt, Human
cugcugccgccucc

SEQ ID NO: 2090914 - RNA, 17 nt, Human
cugcugccgccucccag

SEQ ID NO: 2090915 - RNA, 19 nt, Human
cugcugccgccucccagcc

SEQ ID NO: 2090916 - RNA, 20 nt, Human
cugcugccgccucccagccu

SEQ ID NO: 2090917 - RNA, 16 nt, Human
cugcuggccgggcaca

SEQ ID NO: 2090918 - RNA, 17 nt, Human
cugcuggccgggcacag

SEQ ID NO: 2090919 - RNA, 18 nt, Human
cugcuggccgggcacagc

SEQ ID NO: 2090920 - RNA, 19 nt, Human
cugcuggccgggcacagcu

SEQ ID NO: 2090921 - RNA, 20 nt, Human
cugcuggccgggcacagcug

SEQ ID NO: 2090922 - RNA, 21 nt, Human
cugcuggccgggcacagcugu

SEQ ID NO: 2090923 - RNA, 11 nt, Human
cugcuggcccc

SEQ ID NO: 2090924 - RNA, 14 nt, Human
cugcuggccccuca

SEQ ID NO: 2090925 - RNA, 15 nt, Human
cugcuggccccucac

SEQ ID NO: 2090926 - RNA, 16 nt, Human
cugcuggccccucacc

SEQ ID NO: 2090927 - RNA, 17 nt, Human
cugcuggccccucaccu

SEQ ID NO: 2090928 - RNA, 23 nt, Human
cugcuggccccucaccugggcac

SEQ ID NO: 2090929 - RNA, 15 nt, Human
cugcuggcccagcca

SEQ ID NO: 2090930 - RNA, 16 nt, Human
cugcuggcccagccaa

SEQ ID NO: 2090931 - RNA, 22 nt, Human
cugcuggcccagccaaacccug

SEQ ID NO: 2090932 - RNA, 13 nt, Human
cugcugcuucuua

SEQ ID NO: 2090933 - RNA, 19 nt, Human
cugcuggaucucccagggc

SEQ ID NO: 2090934 - RNA, 20 nt, Human
cugcuggaucucccagggcu

SEQ ID NO: 2090935 - RNA, 21 nt, Human
cugcuggcacauuuccccaga

SEQ ID NO: 2090936 - RNA, 11 nt, Human
cugcuggagga

SEQ ID NO: 2090937 - RNA, 21 nt, Human
gagccagcagccuggcucucc

SEQ ID NO: 2090938 - RNA, 14 nt, Human
gagccaaagagaau

SEQ ID NO: 2090939 - RNA, 12 nt, Human
gagccagcccuc

SEQ ID NO: 2090940 - RNA, 13 nt, Human
gagccagcccucc

SEQ ID NO: 2090941 - RNA, 14 nt, Human
gagccagcccuccc

SEQ ID NO: 2090942 - RNA, 14 nt, Human
gagccagggucuca

SEQ ID NO: 2090943 - RNA, 19 nt, Human
gagccagggucucacuaug

SEQ ID NO: 2090944 - RNA, 15 nt, Human
gagccagcccucccu

SEQ ID NO: 2090945 - RNA, 16 nt, Human
gagccagcccucccug

SEQ ID NO: 2090946 - RNA, 19 nt, Human
gagccagucuaguuccuga

SEQ ID NO: 2090947 - RNA, 23 nt, Human
gagcccaggaguucgaggcugca

SEQ ID NO: 2090948 - RNA, 18 nt, Human
gagcccugguggcagugg

SEQ ID NO: 2090949 - RNA, 20 nt, Human
gagcccagcccuguucuggg

SEQ ID NO: 2090950 - RNA, 11 nt, Human
gagcccaggag

SEQ ID NO: 2090951 - RNA, 12 nt, Human
gagcccaggagu

SEQ ID NO: 2090952 - RNA, 22 nt, Human
gagcccagccauuaccauggag

SEQ ID NO: 2090953 - RNA, 17 nt, Human
gagcccagcccuguucu

SEQ ID NO: 2090954 - RNA, 18 nt, Human
gagcccagcccuguucug

SEQ ID NO: 2090955 - RNA, 18 nt, Human
gagcagcggacuucaaaa

SEQ ID NO: 2090956 - RNA, 18 nt, Human
gagcagcgguuuggggag

SEQ ID NO: 2090957 - RNA, 16 nt, Human
gagcagagaauucucu

SEQ ID NO: 2090958 - RNA, 23 nt, Human
gagcagacuggugagcagacugg

SEQ ID NO: 2090959 - RNA, 15 nt, Human
gagcagacugguggg

SEQ ID NO: 2090960 - RNA, 12 nt, Human
gagcagagaagg

SEQ ID NO: 2090961 - RNA, 17 nt, Human
gagcagagaaggccagg

SEQ ID NO: 2090962 - RNA, 12 nt, Human
gagcagagacac

SEQ ID NO: 2090963 - RNA, 13 nt, Human
gagcagagacacu

SEQ ID NO: 2090964 - RNA, 21 nt, Human
gagcagagacacuaacgacuu

SEQ ID NO: 2090965 - RNA, 24 nt, Human
gagcagagacaugacucagccugu

SEQ ID NO: 2090966 - RNA, 19 nt, Human
gagccaauuuaaagaaaac

SEQ ID NO: 2090967 - RNA, 19 nt, Human
gagccaaggguucagagac

SEQ ID NO: 2090968 - RNA, 23 nt, Human
gagccaaggguucagagacucag

SEQ ID NO: 2090969 - RNA, 22 nt, Human
gagccaauggaguagaccccug

SEQ ID NO: 2090970 - RNA, 19 nt, Human
gagcauuguggcugucagc

SEQ ID NO: 2090971 - RNA, 17 nt, Human
gagcauuuagggcaagg

SEQ ID NO: 2090972 - RNA, 20 nt, Human
gagccaacagaagcuuccau

SEQ ID NO: 2090973 - RNA, 15 nt, Human
gagcacuaaggugug

SEQ ID NO: 2090974 - RNA, 21 nt, Human
gagcacuaaggugugcucuga

SEQ ID NO: 2090975 - RNA, 18 nt, Human
gagcagacuggugagcag

SEQ ID NO: 2090976 - RNA, 19 nt, Human
gagcagacuggugagcaga

SEQ ID NO: 2090977 - RNA, 20 nt, Human
gagcagacuggugagcagac

SEQ ID NO: 2090978 - RNA, 21 nt, Human
gagcacucugaguuuaccauu

SEQ ID NO: 2090979 - RNA, 18 nt, Human
gagcacaaaagccucuca

SEQ ID NO: 2090980 - RNA, 20 nt, Human
gagcaagcauuuauguuuau

SEQ ID NO: 2090981 - RNA, 13 nt, Human
gagcaagcuuuuu

SEQ ID NO: 2090982 - RNA, 17 nt, Human
gagcaagcuuuuuuauu

SEQ ID NO: 2090983 - RNA, 14 nt, Human
gagcaagacucugu

SEQ ID NO: 2090984 - RNA, 12 nt, Human
gagcaagacucu

SEQ ID NO: 2090985 - RNA, 18 nt, Human
gagcaagacccugucucu

SEQ ID NO: 2090986 - RNA, 20 nt, Human
gagcaacagagugagacccu

SEQ ID NO: 2090987 - RNA, 23 nt, Human
gagaucaaccccuucgcuccugu

SEQ ID NO: 2090988 - RNA, 16 nt, Human
gagauagaagaacugc

SEQ ID NO: 2090989 - RNA, 19 nt, Human
gagaucacgccacugcacu

SEQ ID NO: 2090990 - RNA, 20 nt, Human
gagaucacgccacugcacuc

SEQ ID NO: 2090991 - RNA, 18 nt, Human
gagaucacgccacugcac

SEQ ID NO: 2090992 - RNA, 21 nt, Human
gagaucaccaguguguggcuu

SEQ ID NO: 2090993 - RNA, 16 nt, Human
gagaucacgccacugc

SEQ ID NO: 2090994 - RNA, 21 nt, Human
gagaugacugaguccucguag

SEQ ID NO: 2090995 - RNA, 22 nt, Human
gagcaaaggggucccauagagg

SEQ ID NO: 2090996 - RNA, 20 nt, Human
gagcaaagugaagacacugg

SEQ ID NO: 2090997 - RNA, 20 nt, Human
gagaugaagcaaacacauua

SEQ ID NO: 2090998 - RNA, 16 nt, Human
gagaugaauuaaauuu

SEQ ID NO: 2090999 - RNA, 13 nt, Human
gagaugacugagu

SEQ ID NO: 2091000 - RNA, 16 nt, Human
gagaugacugaguccu

SEQ ID NO: 2091001 - RNA, 18 nt, Human
gagaugaagcaaacacau

SEQ ID NO: 2091002 - RNA, 15 nt, Human
gagaugaagcaaaca

SEQ ID NO: 2091003 - RNA, 12 nt, Human
gagaucaugaga

SEQ ID NO: 2091004 - RNA, 14 nt, Human
gagaucaugagaaa

SEQ ID NO: 2091005 - RNA, 17 nt, Human
gagaucccgccucuucu

SEQ ID NO: 2091006 - RNA, 18 nt, Human
gagauccagggcaaggcc

SEQ ID NO: 2091007 - RNA, 22 nt, Human
gagacaggguuuugccauguug

SEQ ID NO: 2091008 - RNA, 14 nt, Human
gagacaggguccug

SEQ ID NO: 2091009 - RNA, 17 nt, Human
gagacagugaucuccau

SEQ ID NO: 2091010 - RNA, 15 nt, Human
gagaauggaaaacag

SEQ ID NO: 2091011 - RNA, 19 nt, Human
gagaauggcuuuggucucu

SEQ ID NO: 2091012 - RNA, 20 nt, Human
gagaauggcgugaacccggg

SEQ ID NO: 2091013 - RNA, 16 nt, Human
gagaauguuauaguga

SEQ ID NO: 2091014 - RNA, 17 nt, Human
gagaauguuauagugaa

SEQ ID NO: 2091015 - RNA, 15 nt, Human
gagaauucagcugcc

SEQ ID NO: 2091016 - RNA, 16 nt, Human
gagaauucagcugccc

SEQ ID NO: 2091017 - RNA, 21 nt, Human
gagaauguagauauugugaag

SEQ ID NO: 2091018 - RNA, 19 nt, Human
gagacaggaaaauccucug

SEQ ID NO: 2091019 - RNA, 20 nt, Human
gagacaggaaaauccucugg

SEQ ID NO: 2091020 - RNA, 21 nt, Human
gagacaggaaaauccucuggc

SEQ ID NO: 2091021 - RNA, 16 nt, Human
gagacaggaccugacu

SEQ ID NO: 2091022 - RNA, 13 nt, Human
gagacuguagauu

SEQ ID NO: 2091023 - RNA, 23 nt, Human
gagacuguagauugcuucuguag

SEQ ID NO: 2091024 - RNA, 11 nt, Human
gagagaaagaa

SEQ ID NO: 2091025 - RNA, 22 nt, Human
gagagaaagugugagcaaacua

SEQ ID NO: 2091026 - RNA, 21 nt, Human
gagacugggaagauaggcucu

SEQ ID NO: 2091027 - RNA, 13 nt, Human
gagacugggaaga

SEQ ID NO: 2091028 - RNA, 13 nt, Human
gagacucugucuc

SEQ ID NO: 2091029 - RNA, 13 nt, Human
gagaguggcuccu

SEQ ID NO: 2091030 - RNA, 18 nt, Human
gagaguagccgagagccu

SEQ ID NO: 2091031 - RNA, 20 nt, Human
gagaguagccgagagccugc

SEQ ID NO: 2091032 - RNA, 21 nt, Human
gagaguagccgagagccugcu

SEQ ID NO: 2091033 - RNA, 22 nt, Human
gagaguagccgagagccugcuc

SEQ ID NO: 2091034 - RNA, 22 nt, Human
gagaguuaaucaacugaaagug

SEQ ID NO: 2091035 - RNA, 21 nt, Human
gagagugucuucacggcagga

SEQ ID NO: 2091036 - RNA, 20 nt, Human
gagagugugaaauagacauu

SEQ ID NO: 2091037 - RNA, 21 nt, Human
gagaguggcuccucccggugc

SEQ ID NO: 2091038 - RNA, 16 nt, Human
gagaguggcuccuccc

SEQ ID NO: 2091039 - RNA, 20 nt, Human
gagagagcugagugagcuga

SEQ ID NO: 2091040 - RNA, 18 nt, Human
gagagggggccaccuccc

SEQ ID NO: 2091041 - RNA, 13 nt, Human
gagagggucugga

SEQ ID NO: 2091042 - RNA, 18 nt, Human
gagagggucuggagaagc

SEQ ID NO: 2091043 - RNA, 19 nt, Human
gagaggggaacagacugga

SEQ ID NO: 2091044 - RNA, 22 nt, Human
gagagccugcucccccaccccc

SEQ ID NO: 2091045 - RNA, 21 nt, Human
gagaggggaauaauagaagaa

SEQ ID NO: 2091046 - RNA, 13 nt, Human
gagaggggcacag

SEQ ID NO: 2091047 - RNA, 16 nt, Human
gagagcccuucauuug

SEQ ID NO: 2091048 - RNA, 14 nt, Human
gagagccugcuccc

SEQ ID NO: 2091049 - RNA, 17 nt, Human
gagagccugcuccccca

SEQ ID NO: 2091050 - RNA, 21 nt, Human
gagagccugcucccccacccc

SEQ ID NO: 2091051 - RNA, 15 nt, Human
gagagaucaugagaa

SEQ ID NO: 2091052 - RNA, 13 nt, Human
gagagaucugcug

SEQ ID NO: 2091053 - RNA, 16 nt, Human
gagagaucugcuguca

SEQ ID NO: 2091054 - RNA, 22 nt, Human
gagagcaagggaagugguucuu

SEQ ID NO: 2091055 - RNA, 14 nt, Human
gagagacccaagga

SEQ ID NO: 2091056 - RNA, 15 nt, Human
gagagacccaaggag

SEQ ID NO: 2091057 - RNA, 19 nt, Human
gagagacccaaggaggaaa

SEQ ID NO: 2091058 - RNA, 20 nt, Human
gagagacccaaggaggaaaa

SEQ ID NO: 2091059 - RNA, 23 nt, Human
gagagagaagugccccugcugcc

SEQ ID NO: 2091060 - RNA, 13 nt, Human
gagagagagaggu

SEQ ID NO: 2091061 - RNA, 22 nt, Human
gacugaguccucguagccaucu

SEQ ID NO: 2091062 - RNA, 13 nt, Human
gacugcccggcag

SEQ ID NO: 2091063 - RNA, 17 nt, Human
gacugcaugguaauuua

SEQ ID NO: 2091064 - RNA, 18 nt, Human
gacugcaugguaauuuau

SEQ ID NO: 2091065 - RNA, 19 nt, Human
gacugcaugguaauuuaua

SEQ ID NO: 2091066 - RNA, 15 nt, Human
gacugcccggcaggg

SEQ ID NO: 2091067 - RNA, 17 nt, Human
gacugccccgugcagac

SEQ ID NO: 2091068 - RNA, 19 nt, Human
gacugccccgugcagacug

SEQ ID NO: 2091069 - RNA, 20 nt, Human
gacugccccgugcagacugg

SEQ ID NO: 2091070 - RNA, 21 nt, Human
gacugccccgugcagacugga

SEQ ID NO: 2091071 - RNA, 23 nt, Human
gacugccccgugcagacuggagg

SEQ ID NO: 2091072 - RNA, 16 nt, Human
gacugccgaccgaggc

SEQ ID NO: 2091073 - RNA, 19 nt, Human
gacugccgaccgaggcugg

SEQ ID NO: 2091074 - RNA, 20 nt, Human
gacugccgaccgaggcugga

SEQ ID NO: 2091075 - RNA, 22 nt, Human
gacucuccccucuuauguaccu

SEQ ID NO: 2091076 - RNA, 12 nt, Human
gacucucuguga

SEQ ID NO: 2091077 - RNA, 13 nt, Human
gacucucugugac

SEQ ID NO: 2091078 - RNA, 17 nt, Human
gacucuaggugcccuug

SEQ ID NO: 2091079 - RNA, 19 nt, Human
gacucuaggugcccuugga

SEQ ID NO: 2091080 - RNA, 19 nt, Human
gacucuaccucauaucagu

SEQ ID NO: 2091081 - RNA, 23 nt, Human
gacucuaccucauaucaguuugc

SEQ ID NO: 2091082 - RNA, 21 nt, Human
gacucauugcuucacaaccca

SEQ ID NO: 2091083 - RNA, 15 nt, Human
gacugggagggccca

SEQ ID NO: 2091084 - RNA, 18 nt, Human
gacuggaagcacagcuuc

SEQ ID NO: 2091085 - RNA, 14 nt, Human
gacuggaauuuuua

SEQ ID NO: 2091086 - RNA, 15 nt, Human
gacuggaauuuuuau

SEQ ID NO: 2091087 - RNA, 22 nt, Human
gacuggaauuuuuauuaugcau

SEQ ID NO: 2091088 - RNA, 22 nt, Human
gacuggauacugcccggggcag

SEQ ID NO: 2091089 - RNA, 15 nt, Human
gacuggagucccugu

SEQ ID NO: 2091090 - RNA, 15 nt, Human
gacuggauacugccc

SEQ ID NO: 2091091 - RNA, 16 nt, Human
gacuggauaguccguc

SEQ ID NO: 2091092 - RNA, 16 nt, Human
gacuggagacaaugca

SEQ ID NO: 2091093 - RNA, 23 nt, Human
gacuggagacaaugcagaugcca

SEQ ID NO: 2091094 - RNA, 20 nt, Human
gacuggaggaccacacucaa

SEQ ID NO: 2091095 - RNA, 19 nt, Human
gacugcugggacuggccag

SEQ ID NO: 2091096 - RNA, 23 nt, Human
gacugccgaccgaggcuggagcu

SEQ ID NO: 2091097 - RNA, 12 nt, Human
gacugcugggac

SEQ ID NO: 2091098 - RNA, 14 nt, Human
gacugcugggacug

SEQ ID NO: 2091099 - RNA, 16 nt, Human
gacuggaagcacagcu

SEQ ID NO: 2091100 - RNA, 15 nt, Human
gacuggaagcacagc

SEQ ID NO: 2091101 - RNA, 14 nt, Human
gacuggaagcacag

SEQ ID NO: 2091102 - RNA, 11 nt, Human
gacuccucugu

SEQ ID NO: 2091103 - RNA, 14 nt, Human
gacuccucugucca

SEQ ID NO: 2091104 - RNA, 16 nt, Human
gacuccugugcaacuu

SEQ ID NO: 2091105 - RNA, 14 nt, Human
gacuccuguggaga

SEQ ID NO: 2091106 - RNA, 22 nt, Human
gacuccuguggagaugacuugg

SEQ ID NO: 2091107 - RNA, 13 nt, Human
gaccuauguuugc

SEQ ID NO: 2091108 - RNA, 14 nt, Human
gaccuauguuugcu

SEQ ID NO: 2091109 - RNA, 22 nt, Human
gaccuauguuugcucagaacac

SEQ ID NO: 2091110 - RNA, 13 nt, Human
gacuacaggugug

SEQ ID NO: 2091111 - RNA, 23 nt, Human
gaccuagggauguucuggcccuc

SEQ ID NO: 2091112 - RNA, 21 nt, Human
gaccuagggaggaccuuaucu

SEQ ID NO: 2091113 - RNA, 20 nt, Human
gaccuagggauguucuggcc

SEQ ID NO: 2091114 - RNA, 21 nt, Human
gaccuagggauguucuggccc

SEQ ID NO: 2091115 - RNA, 22 nt, Human
gaccuagggauguucuggcccu

SEQ ID NO: 2091116 - RNA, 13 nt, Human
gaccuacucucau

SEQ ID NO: 2091117 - RNA, 17 nt, Human
gaccuagggaggaccuu

SEQ ID NO: 2091118 - RNA, 21 nt, Human
gacuacaggugugagucacca

SEQ ID NO: 2091119 - RNA, 18 nt, Human
gacuacaggugugaguca

SEQ ID NO: 2091120 - RNA, 13 nt, Human
gaccucaaccugu

SEQ ID NO: 2091121 - RNA, 15 nt, Human
gacuagaggcaggga

SEQ ID NO: 2091122 - RNA, 12 nt, Human
gacuagagaaac

SEQ ID NO: 2091123 - RNA, 22 nt, Human
gacuagagaaaccguccucuuu

SEQ ID NO: 2091124 - RNA, 16 nt, Human
gacuagaggcagggag

SEQ ID NO: 2091125 - RNA, 17 nt, Human
gacuagaggcagggagg

SEQ ID NO: 2091126 - RNA, 20 nt, Human
gacuagaggcagggagggga

SEQ ID NO: 2091127 - RNA, 22 nt, Human
gacuagaggcagggaggggacu

SEQ ID NO: 2091128 - RNA, 15 nt, Human
gacucauucuucugu

SEQ ID NO: 2091129 - RNA, 14 nt, Human
gacucauucuucug

SEQ ID NO: 2091130 - RNA, 15 nt, Human
gacucagcccugagg

SEQ ID NO: 2091131 - RNA, 16 nt, Human
gacucagcccugaggu

SEQ ID NO: 2091132 - RNA, 23 nt, Human
gaccuauaaaucauuaagacaac

SEQ ID NO: 2091133 - RNA, 16 nt, Human
gacuagaggcuugcau

SEQ ID NO: 2091134 - RNA, 16 nt, Human
gacucagacuccauuu

SEQ ID NO: 2091135 - RNA, 11 nt, Human
gacucagcccu

SEQ ID NO: 2091136 - RNA, 13 nt, Human
gacucagcccuga

SEQ ID NO: 2091137 - RNA, 17 nt, Human
gacucagacaggaaagg

SEQ ID NO: 2091138 - RNA, 23 nt, Human
gacucagacaggaaagggaaggc

SEQ ID NO: 2091139 - RNA, 14 nt, Human
gacuuggucugauu

SEQ ID NO: 2091140 - RNA, 23 nt, Human
gacuugguguccuuucccuccac

SEQ ID NO: 2091141 - RNA, 19 nt, Human
gacuugagaaacaaauaau

SEQ ID NO: 2091142 - RNA, 23 nt, Human
gacuugagaaacaaauaauuugu

SEQ ID NO: 2091143 - RNA, 13 nt, Human
gacuuggaagcuc

SEQ ID NO: 2091144 - RNA, 21 nt, Human
gacuucuuucaaauugagaga

SEQ ID NO: 2091145 - RNA, 22 nt, Human
gacuucuuucaaauugagagaa

SEQ ID NO: 2091146 - RNA, 16 nt, Human
gacuugaaagaaaggg

SEQ ID NO: 2091147 - RNA, 13 nt, Human
gacuugaaagcau

SEQ ID NO: 2091148 - RNA, 14 nt, Human
gacuugaaagcauc

SEQ ID NO: 2091149 - RNA, 16 nt, Human
gacuugaaagcaucca

SEQ ID NO: 2091150 - RNA, 16 nt, Human
gacuugacagaacacu

SEQ ID NO: 2091151 - RNA, 18 nt, Human
gacuugacagaacacugu

SEQ ID NO: 2091152 - RNA, 17 nt, Human
gacuugaaagcauccau

SEQ ID NO: 2091153 - RNA, 19 nt, Human
gacuugaaagcauccaugu

SEQ ID NO: 2091154 - RNA, 21 nt, Human
gacuugaaagcauccaugugu

SEQ ID NO: 2091155 - RNA, 18 nt, Human
gacuucgacugugaccug

SEQ ID NO: 2091156 - RNA, 13 nt, Human
gacuuaaagcaga

SEQ ID NO: 2091157 - RNA, 19 nt, Human
gacuuaaaauauuccugca

SEQ ID NO: 2091158 - RNA, 20 nt, Human
gacuuaacugcauuuuuaga

SEQ ID NO: 2091159 - RNA, 13 nt, Human
gagaaaagacaug

SEQ ID NO: 2091160 - RNA, 16 nt, Human
gagaaagguugaagca

SEQ ID NO: 2091161 - RNA, 22 nt, Human
gagaaaguacuucuccacccug

SEQ ID NO: 2091162 - RNA, 18 nt, Human
gagaaccuaaguuucagu

SEQ ID NO: 2091163 - RNA, 22 nt, Human
gagaaccucacgcaccucccau

SEQ ID NO: 2091164 - RNA, 14 nt, Human
gagaaccucaggcu

SEQ ID NO: 2091165 - RNA, 20 nt, Human
gagaagaauuuucagacccc

SEQ ID NO: 2091166 - RNA, 19 nt, Human
gagaacugcauauguuucg

SEQ ID NO: 2091167 - RNA, 23 nt, Human
gagaacugcauauguuucgcuga

SEQ ID NO: 2091168 - RNA, 20 nt, Human
gagaacuagugguggcucug

SEQ ID NO: 2091169 - RNA, 22 nt, Human
gagaacuagugguggcucugag

SEQ ID NO: 2091170 - RNA, 15 nt, Human
gagaacuccuagggu

SEQ ID NO: 2091171 - RNA, 18 nt, Human
gagaacugcauauguuuc

SEQ ID NO: 2091172 - RNA, 21 nt, Human
gagaagaauuuucagacccca

SEQ ID NO: 2091173 - RNA, 19 nt, Human
gagaagagagaaauagccu

SEQ ID NO: 2091174 - RNA, 16 nt, Human
gagaagcagaggaagg

SEQ ID NO: 2091175 - RNA, 14 nt, Human
gagaagcagugagc

SEQ ID NO: 2091176 - RNA, 18 nt, Human
gagaagcagugagccgca

SEQ ID NO: 2091177 - RNA, 18 nt, Human
gagaagcauauagaggca

SEQ ID NO: 2091178 - RNA, 19 nt, Human
gagaagcauauagaggcaa

SEQ ID NO: 2091179 - RNA, 21 nt, Human
gagaagcaucggagggaauug

SEQ ID NO: 2091180 - RNA, 18 nt, Human
gagaagccaaaagauugg

SEQ ID NO: 2091181 - RNA, 13 nt, Human
gagaagcaugaaa

SEQ ID NO: 2091182 - RNA, 16 nt, Human
gaccagaaaucaaaaa

SEQ ID NO: 2091183 - RNA, 21 nt, Human
gaccagaaaucaaaaagggaa

SEQ ID NO: 2091184 - RNA, 16 nt, Human
gaccagaagccaaaga

SEQ ID NO: 2091185 - RNA, 21 nt, Human
gaccacgcuuucuagcuguug

SEQ ID NO: 2091186 - RNA, 14 nt, Human
gaccacgcuuucua

SEQ ID NO: 2091187 - RNA, 14 nt, Human
gaccaccugcccaa

SEQ ID NO: 2091188 - RNA, 13 nt, Human
gaccaccugccca

SEQ ID NO: 2091189 - RNA, 22 nt, Human
gaccagccuggccaacauggua

SEQ ID NO: 2091190 - RNA, 13 nt, Human
gaccagccuggcc

SEQ ID NO: 2091191 - RNA, 12 nt, Human
gaccagccuggc

SEQ ID NO: 2091192 - RNA, 11 nt, Human
gaccagccugg

SEQ ID NO: 2091193 - RNA, 18 nt, Human
gaccaccucaaauuuaaa

SEQ ID NO: 2091194 - RNA, 11 nt, Human
gaccagagcuc

SEQ ID NO: 2091195 - RNA, 14 nt, Human
gaccagagcucugg

SEQ ID NO: 2091196 - RNA, 15 nt, Human
gaccagagcucugga

SEQ ID NO: 2091197 - RNA, 17 nt, Human
gaccagagcucuggagc

SEQ ID NO: 2091198 - RNA, 16 nt, Human
gaccauugucucagag

SEQ ID NO: 2091199 - RNA, 13 nt, Human
gaccauuuauaau

SEQ ID NO: 2091200 - RNA, 21 nt, Human
gaccauuuauaauguuaguag

SEQ ID NO: 2091201 - RNA, 15 nt, Human
gaccauuucaggggu

SEQ ID NO: 2091202 - RNA, 19 nt, Human
gaccagaagggaaacaguc

SEQ ID NO: 2091203 - RNA, 21 nt, Human
gaccagagccccacacggagg

SEQ ID NO: 2091204 - RNA, 20 nt, Human
gaccagccuccaugcugccu

SEQ ID NO: 2091205 - RNA, 22 nt, Human
gaccagccuccaugcugccucc

SEQ ID NO: 2091206 - RNA, 21 nt, Human
gaccagccuccaugcugccuc

SEQ ID NO: 2091207 - RNA, 21 nt, Human
gaccccuccaugugggcuagu

SEQ ID NO: 2091208 - RNA, 18 nt, Human
gaccccuccaugugggcu

SEQ ID NO: 2091209 - RNA, 14 nt, Human
gaccccuccaugug

SEQ ID NO: 2091210 - RNA, 15 nt, Human
gacccugcagagaug

SEQ ID NO: 2091211 - RNA, 20 nt, Human
gacccccagcaacccuccua

SEQ ID NO: 2091212 - RNA, 19 nt, Human
gaccccuccccuaaugccu

SEQ ID NO: 2091213 - RNA, 12 nt, Human
gacccccaacca

SEQ ID NO: 2091214 - RNA, 13 nt, Human
gacccaaggagga

SEQ ID NO: 2091215 - RNA, 21 nt, Human
gacccccaaccaaguggcucc

SEQ ID NO: 2091216 - RNA, 13 nt, Human
gacccccacaccu

SEQ ID NO: 2091217 - RNA, 15 nt, Human
gacccccacaccuca

SEQ ID NO: 2091218 - RNA, 14 nt, Human
gacccaaggaggaa

SEQ ID NO: 2091219 - RNA, 12 nt, Human
gacccccacccc

SEQ ID NO: 2091220 - RNA, 13 nt, Human
gacccccaccccu

SEQ ID NO: 2091221 - RNA, 14 nt, Human
gacccccaccccuu

SEQ ID NO: 2091222 - RNA, 15 nt, Human
gacccccaccccuuc

SEQ ID NO: 2091223 - RNA, 16 nt, Human
gacccccaccccuucc

SEQ ID NO: 2091224 - RNA, 17 nt, Human
gacccccaccccuuccc

SEQ ID NO: 2091225 - RNA, 18 nt, Human
gacccccaccccuucccc

SEQ ID NO: 2091226 - RNA, 19 nt, Human
gacccccaccccuucccca

SEQ ID NO: 2091227 - RNA, 21 nt, Human
gacccccaccccuuccccacu

SEQ ID NO: 2091228 - RNA, 22 nt, Human
gacccccaccccuuccccacug

SEQ ID NO: 2091229 - RNA, 18 nt, Human
gacccccacucucauucc

SEQ ID NO: 2091230 - RNA, 19 nt, Human
gacccccacucucauuccc

SEQ ID NO: 2091231 - RNA, 23 nt, Human
gacccccacucucauuccccagg

SEQ ID NO: 2091232 - RNA, 12 nt, Human
gacccugucuca

SEQ ID NO: 2091233 - RNA, 20 nt, Human
gaccagccuggccaacaugg

SEQ ID NO: 2091234 - RNA, 22 nt, Human
gacccugcgaaggggcccuggu

SEQ ID NO: 2091235 - RNA, 14 nt, Human
gacccuuuccuucc

SEQ ID NO: 2091236 - RNA, 20 nt, Human
gacccuuuccuuccuucccu

SEQ ID NO: 2091237 - RNA, 21 nt, Human
gacccuuuccuuccuucccug

SEQ ID NO: 2091238 - RNA, 17 nt, Human
gaccgaggcuggagcug

SEQ ID NO: 2091239 - RNA, 22 nt, Human
gacccuuuccuuccuucccugg

SEQ ID NO: 2091240 - RNA, 23 nt, Human
gacccuuuccuuccuucccuggc

SEQ ID NO: 2091241 - RNA, 18 nt, Human
gacccuuuuggguuucug

SEQ ID NO: 2091242 - RNA, 14 nt, Human
gaccggaagcuccu

SEQ ID NO: 2091243 - RNA, 16 nt, Human
gaccggaagcuccugg

SEQ ID NO: 2091244 - RNA, 17 nt, Human
gaccggaagcuccuggu

SEQ ID NO: 2091245 - RNA, 16 nt, Human
gacagggaggugaccc

SEQ ID NO: 2091246 - RNA, 23 nt, Human
gacagggcacaccgggcacucag

SEQ ID NO: 2091247 - RNA, 13 nt, Human
gacagggacccac

SEQ ID NO: 2091248 - RNA, 19 nt, Human
gacagggacccacuucaca

SEQ ID NO: 2091249 - RNA, 24 nt, Human
gacagggcacaccgggcacucaga

SEQ ID NO: 2091250 - RNA, 20 nt, Human
gacaguggauugcauuucuu

SEQ ID NO: 2091251 - RNA, 20 nt, Human
gacagugcuucagccugagg

SEQ ID NO: 2091252 - RNA, 18 nt, Human
gacagugcuucagccuga

SEQ ID NO: 2091253 - RNA, 19 nt, Human
gacagugcuucagccugag

SEQ ID NO: 2091254 - RNA, 19 nt, Human
gacaggaaaauccucuggc

SEQ ID NO: 2091255 - RNA, 12 nt, Human
gacaggaaaggg

SEQ ID NO: 2091256 - RNA, 17 nt, Human
gacaggaaagggaaggc

SEQ ID NO: 2091257 - RNA, 16 nt, Human
gacaggacagcauggu

SEQ ID NO: 2091258 - RNA, 14 nt, Human
gacaggacagugcu

SEQ ID NO: 2091259 - RNA, 22 nt, Human
gacaggacagugcuucagccug

SEQ ID NO: 2091260 - RNA, 23 nt, Human
gacaggacagugcuucagccuga

SEQ ID NO: 2091261 - RNA, 13 nt, Human
gacaggaccugac

SEQ ID NO: 2091262 - RNA, 14 nt, Human
gacaugaucuucuu

SEQ ID NO: 2091263 - RNA, 21 nt, Human
gacaugauggagcgcaccugc

SEQ ID NO: 2091264 - RNA, 18 nt, Human
gacaugcgggcugggcag

SEQ ID NO: 2091265 - RNA, 20 nt, Human
gacaugcgggcugggcagcu

SEQ ID NO: 2091266 - RNA, 21 nt, Human
gacaugcgggcugggcagcug

SEQ ID NO: 2091267 - RNA, 22 nt, Human
gacaugcgggcugggcagcugu

SEQ ID NO: 2091268 - RNA, 14 nt, Human
gacaugcgggcugg

SEQ ID NO: 2091269 - RNA, 15 nt, Human
gacaugcgggcuggg

SEQ ID NO: 2091270 - RNA, 22 nt, Human
gacauacuccuuccaucaaaua

SEQ ID NO: 2091271 - RNA, 16 nt, Human
gacauccguugugcuu

SEQ ID NO: 2091272 - RNA, 23 nt, Human
gacauccauguuccgagaagaac

SEQ ID NO: 2091273 - RNA, 14 nt, Human
gacagagucucacu

SEQ ID NO: 2091274 - RNA, 17 nt, Human
gacagaggcagccccau

SEQ ID NO: 2091275 - RNA, 19 nt, Human
gacagagccccacccucag

SEQ ID NO: 2091276 - RNA, 16 nt, Human
gacagaggcagcccca

SEQ ID NO: 2091277 - RNA, 14 nt, Human
gacagaggcagccc

SEQ ID NO: 2091278 - RNA, 21 nt, Human
gacagagcaagugagacccug

SEQ ID NO: 2091279 - RNA, 18 nt, Human
gacagagaggacgugggc

SEQ ID NO: 2091280 - RNA, 19 nt, Human
gacagagaggacgugggcg

SEQ ID NO: 2091281 - RNA, 14 nt, Human
gacacccaaagggu

SEQ ID NO: 2091282 - RNA, 22 nt, Human
gacaccagccuuucucccaggc

SEQ ID NO: 2091283 - RNA, 19 nt, Human
gacaccaggagucccuggu

SEQ ID NO: 2091284 - RNA, 20 nt, Human
gacaccaggagucccuggua

SEQ ID NO: 2091285 - RNA, 19 nt, Human
gacagccacggccaggcca

SEQ ID NO: 2091286 - RNA, 18 nt, Human
gacagccacggccaggcc

SEQ ID NO: 2091287 - RNA, 17 nt, Human
gacagccacggccaggc

SEQ ID NO: 2091288 - RNA, 14 nt, Human
gacagccacggcca

SEQ ID NO: 2091289 - RNA, 22 nt, Human
gacagagugagacucugucuca

SEQ ID NO: 2091290 - RNA, 20 nt, Human
gacagagugagacucugucu

SEQ ID NO: 2091291 - RNA, 13 nt, Human
gacagauaacucu

SEQ ID NO: 2091292 - RNA, 21 nt, Human
gacagaguucacuauaaaugg

SEQ ID NO: 2091293 - RNA, 21 nt, Human
gacagccacggccaggccaga

SEQ ID NO: 2091294 - RNA, 20 nt, Human
gacagccacggccaggccag

SEQ ID NO: 2091295 - RNA, 17 nt, Human
gacagcccacugagaag

SEQ ID NO: 2091296 - RNA, 18 nt, Human
gacaggaaaauccucugg

SEQ ID NO: 2091297 - RNA, 17 nt, Human
gaauggccugccuugaa

SEQ ID NO: 2091298 - RNA, 21 nt, Human
gaauggccugccuugaagcca

SEQ ID NO: 2091299 - RNA, 14 nt, Human
gaauguacucuguu

SEQ ID NO: 2091300 - RNA, 13 nt, Human
gaauguaauuugu

SEQ ID NO: 2091301 - RNA, 14 nt, Human
gaauguaauuugug

SEQ ID NO: 2091302 - RNA, 20 nt, Human
gaauguaauuuguguaauaa

SEQ ID NO: 2091303 - RNA, 23 nt, Human
gaauguaauuuguguaauaaagu

SEQ ID NO: 2091304 - RNA, 20 nt, Human
gaauguagcugguuuccuca

SEQ ID NO: 2091305 - RNA, 15 nt, Human
gaauguagcugguuu

SEQ ID NO: 2091306 - RNA, 15 nt, Human
gaauguaucaggaaa

SEQ ID NO: 2091307 - RNA, 17 nt, Human
gaauguaucaggaaaua

SEQ ID NO: 2091308 - RNA, 16 nt, Human
gaauguaucaggaaau

SEQ ID NO: 2091309 - RNA, 14 nt, Human
gaaugucagauucc

SEQ ID NO: 2091310 - RNA, 15 nt, Human
gaaugucagauuccu

SEQ ID NO: 2091311 - RNA, 19 nt, Human
gaaugucagauuccuuucc

SEQ ID NO: 2091312 - RNA, 22 nt, Human
gaaugucuuuguuggaaaagaa

SEQ ID NO: 2091313 - RNA, 16 nt, Human
gaauguuaaagucagu

SEQ ID NO: 2091314 - RNA, 21 nt, Human
gaauugcauuuuuuaaaacaa

SEQ ID NO: 2091315 - RNA, 18 nt, Human
gaauugacuucgacugug

SEQ ID NO: 2091316 - RNA, 23 nt, Human
gaauugcauuuuuuaaaacaaga

SEQ ID NO: 2091317 - RNA, 22 nt, Human
gaauugaaucgcugcgauacug

SEQ ID NO: 2091318 - RNA, 14 nt, Human
gaauugcagaguac

SEQ ID NO: 2091319 - RNA, 14 nt, Human
gaauucuguucauu

SEQ ID NO: 2091320 - RNA, 19 nt, Human
gaauucuguucauuuguua

SEQ ID NO: 2091321 - RNA, 19 nt, Human
gaauucuuacauguuuucu

SEQ ID NO: 2091322 - RNA, 22 nt, Human
gaauucuuacauguuuucuuug

SEQ ID NO: 2091323 - RNA, 11 nt, Human
gaauguucuga

SEQ ID NO: 2091324 - RNA, 15 nt, Human
gaauguucugacauu

SEQ ID NO: 2091325 - RNA, 16 nt, Human
gaauguucugacauua

SEQ ID NO: 2091326 - RNA, 17 nt, Human
gaauguucugacauuaa

SEQ ID NO: 2091327 - RNA, 19 nt, Human
gaauguucugacauuaaca

SEQ ID NO: 2091328 - RNA, 20 nt, Human
gaauguucugacauuaacag

SEQ ID NO: 2091329 - RNA, 17 nt, Human
gaauguuacauuguuug

SEQ ID NO: 2091330 - RNA, 20 nt, Human
gaauguuacauuguuugucu

SEQ ID NO: 2091331 - RNA, 18 nt, Human
gaauucuuacauguuuuc

SEQ ID NO: 2091332 - RNA, 20 nt, Human
gaauccagacccggcugcgu

SEQ ID NO: 2091333 - RNA, 18 nt, Human
gaauccagacccggcugc

SEQ ID NO: 2091334 - RNA, 13 nt, Human
gaauccaugcuug

SEQ ID NO: 2091335 - RNA, 14 nt, Human
gaauccaugcuugg

SEQ ID NO: 2091336 - RNA, 12 nt, Human
gaaucauugcuu

SEQ ID NO: 2091337 - RNA, 14 nt, Human
gaaucuagaagaaa

SEQ ID NO: 2091338 - RNA, 15 nt, Human
gaaucuagaagaaau

SEQ ID NO: 2091339 - RNA, 16 nt, Human
gaaucuagaagaaaug

SEQ ID NO: 2091340 - RNA, 17 nt, Human
gaaucuagaagaaauga

SEQ ID NO: 2091341 - RNA, 18 nt, Human
gaaucuagaagaaaugaa

SEQ ID NO: 2091342 - RNA, 19 nt, Human
gaaucuagaagaaaugaaa

SEQ ID NO: 2091343 - RNA, 20 nt, Human
gaaucuagaagaaaugaaau

SEQ ID NO: 2091344 - RNA, 21 nt, Human
gaaucuagaagaaaugaaauu

SEQ ID NO: 2091345 - RNA, 15 nt, Human
gaaucggaaucucug

SEQ ID NO: 2091346 - RNA, 14 nt, Human
gaaucgaggaacca

SEQ ID NO: 2091347 - RNA, 16 nt, Human
gaaucgaggaaccaga

SEQ ID NO: 2091348 - RNA, 21 nt, Human
gaaucgaugggggaugcuuca

SEQ ID NO: 2091349 - RNA, 22 nt, Human
gaaucgaugggggaugcuucau

SEQ ID NO: 2091350 - RNA, 18 nt, Human
gaaucgaggaaccagagc

SEQ ID NO: 2091351 - RNA, 19 nt, Human
gaaucgaggaaccagagcc

SEQ ID NO: 2091352 - RNA, 21 nt, Human
gaaaggcucagucucaggagc

SEQ ID NO: 2091353 - RNA, 22 nt, Human
gaaaggcucagucucaggagca

SEQ ID NO: 2091354 - RNA, 14 nt, Human
gaaaggcucagucu

SEQ ID NO: 2091355 - RNA, 18 nt, Human
gaaaggcucagucucagg

SEQ ID NO: 2091356 - RNA, 19 nt, Human
gaaaggcucagucucagga

SEQ ID NO: 2091357 - RNA, 19 nt, Human
gaaaggccagcuggcagca

SEQ ID NO: 2091358 - RNA, 21 nt, Human
gaaaggccagcuggcagcaga

SEQ ID NO: 2091359 - RNA, 22 nt, Human
gaaaggccagcuggcagcagag

SEQ ID NO: 2091360 - RNA, 17 nt, Human
gaaaggcauucucugaa

SEQ ID NO: 2091361 - RNA, 12 nt, Human
gaaaggccagcu

SEQ ID NO: 2091362 - RNA, 14 nt, Human
gaaaggccagcugg

SEQ ID NO: 2091363 - RNA, 16 nt, Human
gaaaggccagcuggca

SEQ ID NO: 2091364 - RNA, 13 nt, Human
gaaucauuauuua

SEQ ID NO: 2091365 - RNA, 16 nt, Human
gaaucauuauuuauua

SEQ ID NO: 2091366 - RNA, 17 nt, Human
gaaucauuauuuauuaa

SEQ ID NO: 2091367 - RNA, 21 nt, Human
gaaucauuauuuauuaaauuu

SEQ ID NO: 2091368 - RNA, 15 nt, Human
gaaucagugcaaaga

SEQ ID NO: 2091369 - RNA, 19 nt, Human
gaaucauacuuagcaaagu

SEQ ID NO: 2091370 - RNA, 20 nt, Human
gaaugaaagucuugugacua

SEQ ID NO: 2091371 - RNA, 21 nt, Human
gaaugaaagucuugugacuag

SEQ ID NO: 2091372 - RNA, 16 nt, Human
gaaugaaauugcugaa

SEQ ID NO: 2091373 - RNA, 23 nt, Human
gaaugaaagucuugugacuagug

SEQ ID NO: 2091374 - RNA, 13 nt, Human
gaaugaacaaccu

SEQ ID NO: 2091375 - RNA, 18 nt, Human
gaaugaacaaccucggcu

SEQ ID NO: 2091376 - RNA, 13 nt, Human
gaaucugaaugua

SEQ ID NO: 2091377 - RNA, 14 nt, Human
gaaucugaauguaa

SEQ ID NO: 2091378 - RNA, 21 nt, Human
gaaugaaagggcccagagagg

SEQ ID NO: 2091379 - RNA, 15 nt, Human
gaaugcuguauaugu

SEQ ID NO: 2091380 - RNA, 20 nt, Human
gaaugcacacuagccucucc

SEQ ID NO: 2091381 - RNA, 22 nt, Human
gaaugcacacuagccucuccag

SEQ ID NO: 2091382 - RNA, 22 nt, Human
gaauggcacagcccaaagaagg

SEQ ID NO: 2091383 - RNA, 13 nt, Human
gaaugcuuggaau

SEQ ID NO: 2091384 - RNA, 14 nt, Human
gaaugcuuggaaua

SEQ ID NO: 2091385 - RNA, 19 nt, Human
gaaugcuuggaauaucugc

SEQ ID NO: 2091386 - RNA, 17 nt, Human
gaauggcacagcccaaa

SEQ ID NO: 2091387 - RNA, 18 nt, Human
gaaugcuucugacuucau

SEQ ID NO: 2091388 - RNA, 21 nt, Human
gaaugcuucugacuucauaga

SEQ ID NO: 2091389 - RNA, 13 nt, Human
gacaagaagcaaa

SEQ ID NO: 2091390 - RNA, 19 nt, Human
gacaagaagcaaauuuuuu

SEQ ID NO: 2091391 - RNA, 21 nt, Human
gacaaggauugcuacuguccu

SEQ ID NO: 2091392 - RNA, 19 nt, Human
gacaaggauugcuacuguc

SEQ ID NO: 2091393 - RNA, 18 nt, Human
gacaaggauugcuacugu

SEQ ID NO: 2091394 - RNA, 16 nt, Human
gacaaugcagaugcca

SEQ ID NO: 2091395 - RNA, 19 nt, Human
gacaaugcagaugccagag

SEQ ID NO: 2091396 - RNA, 20 nt, Human
gacaaugcagaugccagagc

SEQ ID NO: 2091397 - RNA, 12 nt, Human
gacaaugugaaa

SEQ ID NO: 2091398 - RNA, 18 nt, Human
gacaaugugaaaagaaaa

SEQ ID NO: 2091399 - RNA, 16 nt, Human
gacacaaaaaguagau

SEQ ID NO: 2091400 - RNA, 21 nt, Human
gacaauuccuagauaaaaaga

SEQ ID NO: 2091401 - RNA, 23 nt, Human
gacaauuccuagauaaaaagaug

SEQ ID NO: 2091402 - RNA, 19 nt, Human
gacaaugugaaaagaaaaa

SEQ ID NO: 2091403 - RNA, 20 nt, Human
gacaaugugaaaagaaaaau

SEQ ID NO: 2091404 - RNA, 19 nt, Human
gacacaggcccggcuccag

SEQ ID NO: 2091405 - RNA, 21 nt, Human
gacacaggcccggcuccaggc

SEQ ID NO: 2091406 - RNA, 20 nt, Human
gacacaggcccggcuccagg

SEQ ID NO: 2091407 - RNA, 23 nt, Human
gacacaaacaaacaagcuaggug

SEQ ID NO: 2091408 - RNA, 20 nt, Human
gacaccagccuuucucccag

SEQ ID NO: 2091409 - RNA, 18 nt, Human
gacaaccaccgcucccca

SEQ ID NO: 2091410 - RNA, 19 nt, Human
gacaaccaccgcuccccag

SEQ ID NO: 2091411 - RNA, 22 nt, Human
gacaaccaccgcuccccagccc

SEQ ID NO: 2091412 - RNA, 17 nt, Human
gacaaccaccgcucccc

SEQ ID NO: 2091413 - RNA, 12 nt, Human
gacaacauuaaa

SEQ ID NO: 2091414 - RNA, 12 nt, Human
gacaaccaugac

SEQ ID NO: 2091415 - RNA, 23 nt, Human
gacaaccaccgcuccccagccca

SEQ ID NO: 2091416 - RNA, 13 nt, Human
gacaacccugcaa

SEQ ID NO: 2091417 - RNA, 20 nt, Human
gacaacccugcaaaggacug

SEQ ID NO: 2091418 - RNA, 18 nt, Human
gacaaccgaugcuccagc

SEQ ID NO: 2091419 - RNA, 19 nt, Human
gacaaccgaugcuccagcc

SEQ ID NO: 2091420 - RNA, 20 nt, Human
gacaaccgaugcuccagcca

SEQ ID NO: 2091421 - RNA, 14 nt, Human
gacaacgaggaagc

SEQ ID NO: 2091422 - RNA, 21 nt, Human
gacaaccgaugcuccagccaa

SEQ ID NO: 2091423 - RNA, 15 nt, Human
gacaacgaggaagcc

SEQ ID NO: 2091424 - RNA, 16 nt, Human
gacaacgaggaagccc

SEQ ID NO: 2091425 - RNA, 21 nt, Human
gacaacuucuaauugccaugu

SEQ ID NO: 2091426 - RNA, 20 nt, Human
gacaaauucuguuucuugag

SEQ ID NO: 2091427 - RNA, 16 nt, Human
gacaaauucuguuucu

SEQ ID NO: 2091428 - RNA, 17 nt, Human
gacaaauucuguuucuu

SEQ ID NO: 2091429 - RNA, 22 nt, Human
gacaaauguguaucggaugcuu

SEQ ID NO: 2091430 - RNA, 12 nt, Human
gacaaauucugu

SEQ ID NO: 2091431 - RNA, 14 nt, Human
gacaaauucuguuu

SEQ ID NO: 2091432 - RNA, 15 nt, Human
gacaaauucuguuuc

SEQ ID NO: 2091433 - RNA, 21 nt, Human
gacaaaugcugcgcccuuccc

SEQ ID NO: 2091434 - RNA, 22 nt, Human
gacaaaugcugcgcccuucccc

SEQ ID NO: 2091435 - RNA, 12 nt, Human
gacaaaucuaag

SEQ ID NO: 2091436 - RNA, 12 nt, Human
gacaaaucaagu

SEQ ID NO: 2091437 - RNA, 13 nt, Human
gacaaaucaaguu

SEQ ID NO: 2091438 - RNA, 14 nt, Human
gacaaaucaaguuu

SEQ ID NO: 2091439 - RNA, 15 nt, Human
gacaaaucaaguuuc

SEQ ID NO: 2091440 - RNA, 18 nt, Human
gacaaaucaaguuuccaa

SEQ ID NO: 2091441 - RNA, 19 nt, Human
gacaaaucaaguuuccaag

SEQ ID NO: 2091442 - RNA, 20 nt, Human
gacaaaucaaguuuccaagc

SEQ ID NO: 2091443 - RNA, 23 nt, Human
gacaaaucaaguuuccaagcaaa

SEQ ID NO: 2091444 - RNA, 21 nt, Human
gacaacaaauuagguuuugua

SEQ ID NO: 2091445 - RNA, 15 nt, Human
gacaaauuuaaaaca

SEQ ID NO: 2091446 - RNA, 17 nt, Human
gacaaauuuaaaacaaa

SEQ ID NO: 2091447 - RNA, 20 nt, Human
gacaaauuuaaaacaaacaa

SEQ ID NO: 2091448 - RNA, 23 nt, Human
gacaacaaauuagguuuuguaca

SEQ ID NO: 2091449 - RNA, 12 nt, Human
gacaacagaagu

SEQ ID NO: 2091450 - RNA, 14 nt, Human
gacaacagaaguca

SEQ ID NO: 2091451 - RNA, 17 nt, Human
gacaacagaagucauga

SEQ ID NO: 2091452 - RNA, 22 nt, Human
gacaacagaagucaugaagccc

SEQ ID NO: 2091453 - RNA, 22 nt, Human
gaauuggaccauccuauuuaac

SEQ ID NO: 2091454 - RNA, 24 nt, Human
gaauugcuuguuugcuucaacugu

SEQ ID NO: 2091455 - RNA, 17 nt, Human
gaauugcuugaaccugg

SEQ ID NO: 2091456 - RNA, 12 nt, Human
gaauuucuaaaa

SEQ ID NO: 2091457 - RNA, 16 nt, Human
gaauugcaauuuuaac

SEQ ID NO: 2091458 - RNA, 17 nt, Human
gaauuucuaaaaaacag

SEQ ID NO: 2091459 - RNA, 13 nt, Human
gaauuucucuaca

SEQ ID NO: 2091460 - RNA, 19 nt, Human
gaauuugaaugaaaaauuu

SEQ ID NO: 2091461 - RNA, 23 nt, Human
gaauuugaucguuccaguuccca

SEQ ID NO: 2091462 - RNA, 19 nt, Human
gaauuuggagacucugugg

SEQ ID NO: 2091463 - RNA, 19 nt, Human
gaauuuggccugcacuaau

SEQ ID NO: 2091464 - RNA, 19 nt, Human
gaauuugaagcugcaguga

SEQ ID NO: 2091465 - RNA, 14 nt, Human
gaauuugaaucuca

SEQ ID NO: 2091466 - RNA, 16 nt, Human
gaauuugaaucucaau

SEQ ID NO: 2091467 - RNA, 14 nt, Human
gaauuugaaugaaa

SEQ ID NO: 2091468 - RNA, 16 nt, Human
gaauuugaaugaaaaa

SEQ ID NO: 2091469 - RNA, 17 nt, Human
gaauuugaaugaaaaau

SEQ ID NO: 2091470 - RNA, 12 nt, Human
gaauuucuuggu

SEQ ID NO: 2091471 - RNA, 21 nt, Human
gaauuucuugguaagaagccg

SEQ ID NO: 2091472 - RNA, 18 nt, Human
gauuacagggaugagcca

SEQ ID NO: 2091473 - RNA, 20 nt, Human
gauuacagggaugagccacc

SEQ ID NO: 2091474 - RNA, 22 nt, Human
gauucacaaugaaaugcucucc

SEQ ID NO: 2091475 - RNA, 17 nt, Human
gauucaauuuucuuuaa

SEQ ID NO: 2091476 - RNA, 18 nt, Human
gauucacaaugaaaugcu

SEQ ID NO: 2091477 - RNA, 11 nt, Human
gauucucagau

SEQ ID NO: 2091478 - RNA, 14 nt, Human
gauucuccugccuc

SEQ ID NO: 2091479 - RNA, 15 nt, Human
gauugcaacaggcug

SEQ ID NO: 2091480 - RNA, 22 nt, Human
gauugcauuagaaauagacagu

SEQ ID NO: 2091481 - RNA, 12 nt, Human
gauuuaaaucag

SEQ ID NO: 2091482 - RNA, 20 nt, Human
gauuggggaagacuguggcu

SEQ ID NO: 2091483 - RNA, 22 nt, Human
gauugcguggaauugugcugag

SEQ ID NO: 2091484 - RNA, 16 nt, Human
gauugcgcaaaacuga

SEQ ID NO: 2091485 - RNA, 20 nt, Human
gauugguuuuaauugaagga

SEQ ID NO: 2091486 - RNA, 21 nt, Human
gauugguuuuaauugaaggaa

SEQ ID NO: 2091487 - RNA, 23 nt, Human
gauugguuuuaauugaaggaaag

SEQ ID NO: 2091488 - RNA, 16 nt, Human
gauuuugcuguagaag

SEQ ID NO: 2091489 - RNA, 21 nt, Human
gcaaacaugggguuggcuggg

SEQ ID NO: 2091490 - RNA, 12 nt, Human
gauuuugaaaac

SEQ ID NO: 2091491 - RNA, 13 nt, Human
gauuuugaaaacu

SEQ ID NO: 2091492 - RNA, 16 nt, Human
gauuuugaaaacuaca

SEQ ID NO: 2091493 - RNA, 21 nt, Human
gauuuugaaaacuacauuuua

SEQ ID NO: 2091494 - RNA, 19 nt, Human
gauuuugauccaagcuggu

SEQ ID NO: 2091495 - RNA, 21 nt, Human
gauuuugaaauuuuuauuaaa

SEQ ID NO: 2091496 - RNA, 17 nt, Human
gauuugaaggucuugau

SEQ ID NO: 2091497 - RNA, 19 nt, Human
gauuuuacaauugaaauga

SEQ ID NO: 2091498 - RNA, 15 nt, Human
gauuuuaauuuugaa

SEQ ID NO: 2091499 - RNA, 16 nt, Human
gauuuuacaaaagaug

SEQ ID NO: 2091500 - RNA, 17 nt, Human
gauuuuacaaaagaugu

SEQ ID NO: 2091501 - RNA, 18 nt, Human
gauuuuacaauugaaaug

SEQ ID NO: 2091502 - RNA, 18 nt, Human
gauuuuacauguggccca

SEQ ID NO: 2091503 - RNA, 13 nt, Human
gauuuuaauuuug

SEQ ID NO: 2091504 - RNA, 17 nt, Human
gcaaaggaguagaaaga

SEQ ID NO: 2091505 - RNA, 23 nt, Human
gcaaaggacuguuuuuuccugag

SEQ ID NO: 2091506 - RNA, 20 nt, Human
gcaaaggacuguuuuuuccu

SEQ ID NO: 2091507 - RNA, 15 nt, Human
gcaaauguggcuccu

SEQ ID NO: 2091508 - RNA, 16 nt, Human
gcaaagggccaggaag

SEQ ID NO: 2091509 - RNA, 16 nt, Human
gcaaaugugaccugug

SEQ ID NO: 2091510 - RNA, 18 nt, Human
gcaaagggagcacugggu

SEQ ID NO: 2091511 - RNA, 20 nt, Human
gcaaagggagcacuggguug

SEQ ID NO: 2091512 - RNA, 12 nt, Human
gcaaauguuaca

SEQ ID NO: 2091513 - RNA, 15 nt, Human
gcaaauguuacauag

SEQ ID NO: 2091514 - RNA, 21 nt, Human
gcaaauguuacauaguguagg

SEQ ID NO: 2091515 - RNA, 12 nt, Human
gcaaauucucaa

SEQ ID NO: 2091516 - RNA, 13 nt, Human
gcaaauuuauaau

SEQ ID NO: 2091517 - RNA, 16 nt, Human
gcaaauuuauaauuuu

SEQ ID NO: 2091518 - RNA, 21 nt, Human
gcaaauuuauaauuuuaagau

SEQ ID NO: 2091519 - RNA, 12 nt, Human
gcaacacacaga

SEQ ID NO: 2091520 - RNA, 18 nt, Human
gauuacaggcaugugcca

SEQ ID NO: 2091521 - RNA, 23 nt, Human
gauuacaagcgugagccacugca

SEQ ID NO: 2091522 - RNA, 15 nt, Human
gauuaaacugaguga

SEQ ID NO: 2091523 - RNA, 22 nt, Human
gauuacaagcgugagccacugc

SEQ ID NO: 2091524 - RNA, 23 nt, Human
gauguugaaugcccacaggcaaa

SEQ ID NO: 2091525 - RNA, 18 nt, Human
gauguucacuguggcauu

SEQ ID NO: 2091526 - RNA, 23 nt, Human
gauguuuacagguggacacacaa

SEQ ID NO: 2091527 - RNA, 21 nt, Human
gaugguuccccuguucacucu

SEQ ID NO: 2091528 - RNA, 18 nt, Human
gaugguuccccuguucac

SEQ ID NO: 2091529 - RNA, 13 nt, Human
gaugguuccccug

SEQ ID NO: 2091530 - RNA, 15 nt, Human
gaugguuacacuguu

SEQ ID NO: 2091531 - RNA, 17 nt, Human
gaugguuacacuguuag

SEQ ID NO: 2091532 - RNA, 18 nt, Human
gaugguuacacuguuaga

SEQ ID NO: 2091533 - RNA, 23 nt, Human
gaugguuacacuguuagaacacu

SEQ ID NO: 2091534 - RNA, 12 nt, Human
gauguggcccug

SEQ ID NO: 2091535 - RNA, 13 nt, Human
gauguggcccugg

SEQ ID NO: 2091536 - RNA, 14 nt, Human
gauguggcccuggc

SEQ ID NO: 2091537 - RNA, 21 nt, Human
gauguggcccuggccugcugg

SEQ ID NO: 2091538 - RNA, 20 nt, Human
gauguggcccuggccugcug

SEQ ID NO: 2091539 - RNA, 17 nt, Human
gaugugggucaaggaau

SEQ ID NO: 2091540 - RNA, 16 nt, Human
gauguuaggcugggcc

SEQ ID NO: 2091541 - RNA, 14 nt, Human
gauguuaaccagaa

SEQ ID NO: 2091542 - RNA, 13 nt, Human
gaugguccugggg

SEQ ID NO: 2091543 - RNA, 15 nt, Human
gaugguccuggggcu

SEQ ID NO: 2091544 - RNA, 21 nt, Human
gaugguccuggggcucugugc

SEQ ID NO: 2091545 - RNA, 24 nt, Human
gaugguccuggggcucugugcagg

SEQ ID NO: 2091546 - RNA, 22 nt, Human
gaugggucugguuugcagagcu

SEQ ID NO: 2091547 - RNA, 18 nt, Human
gauggguuugacaagguu

SEQ ID NO: 2091548 - RNA, 23 nt, Human
gaugggucugguuugcagagcuu

SEQ ID NO: 2091549 - RNA, 19 nt, Human
gaugcugaaagagaaaaga

SEQ ID NO: 2091550 - RNA, 22 nt, Human
gauggggugggguggagaacuc

SEQ ID NO: 2091551 - RNA, 21 nt, Human
gaugggcaacccccagccugc

SEQ ID NO: 2091552 - RNA, 20 nt, Human
gaugggcaacccccagccug

SEQ ID NO: 2091553 - RNA, 22 nt, Human
gauggccgggcgcgguggcuca

SEQ ID NO: 2091554 - RNA, 14 nt, Human
gauggcccucuggu

SEQ ID NO: 2091555 - RNA, 15 nt, Human
gauggcccucuggua

SEQ ID NO: 2091556 - RNA, 21 nt, Human
gaugcugaaacaggagagaaa

SEQ ID NO: 2091557 - RNA, 11 nt, Human
gaucagaacag

SEQ ID NO: 2091558 - RNA, 15 nt, Human
gaucagaacagcaga

SEQ ID NO: 2091559 - RNA, 18 nt, Human
gaugccaucugugggcac

SEQ ID NO: 2091560 - RNA, 15 nt, Human
gaugcccacugagga

SEQ ID NO: 2091561 - RNA, 21 nt, Human
gaugccaucuguguccugguu

SEQ ID NO: 2091562 - RNA, 16 nt, Human
gaugccaucugugucc

SEQ ID NO: 2091563 - RNA, 17 nt, Human
gaugccaucuguguccu

SEQ ID NO: 2091564 - RNA, 18 nt, Human
gaugccaucuguguccug

SEQ ID NO: 2091565 - RNA, 20 nt, Human
gaugccaucuguguccuggu

SEQ ID NO: 2091566 - RNA, 17 nt, Human
gaugcccacugaggaau

SEQ ID NO: 2091567 - RNA, 18 nt, Human
gaugcccagagggcccag

SEQ ID NO: 2091568 - RNA, 19 nt, Human
gaugcccagagggcccagg

SEQ ID NO: 2091569 - RNA, 20 nt, Human
gaugcccagagggcccaggc

SEQ ID NO: 2091570 - RNA, 20 nt, Human
gaugcccagggccacucugc

SEQ ID NO: 2091571 - RNA, 21 nt, Human
gaugcccagggccacucugcc

SEQ ID NO: 2091572 - RNA, 22 nt, Human
gaugcccagggccacucugccu

SEQ ID NO: 2091573 - RNA, 22 nt, Human
gaugcccagagggcccaggcag

SEQ ID NO: 2091574 - RNA, 23 nt, Human
gaugcccagagggcccaggcagg

SEQ ID NO: 2091575 - RNA, 20 nt, Human
gaugcugacuguacuccucc

SEQ ID NO: 2091576 - RNA, 17 nt, Human
gaugcugacuguacucc

SEQ ID NO: 2091577 - RNA, 20 nt, Human
gaugcugaaacaggagagaa

SEQ ID NO: 2091578 - RNA, 12 nt, Human
gaugccccagag

SEQ ID NO: 2091579 - RNA, 16 nt, Human
gaugccccagagcugu

SEQ ID NO: 2091580 - RNA, 20 nt, Human
gcacaccgggcacucagaag

SEQ ID NO: 2091581 - RNA, 17 nt, Human
gcacacgucauguuucu

SEQ ID NO: 2091582 - RNA, 21 nt, Human
gcacacucagcacccccuucu

SEQ ID NO: 2091583 - RNA, 23 nt, Human
gcacacucagcacccccuucucu

SEQ ID NO: 2091584 - RNA, 15 nt, Human
gcacacuccccugca

SEQ ID NO: 2091585 - RNA, 21 nt, Human
gcacacuccccugcacuggag

SEQ ID NO: 2091586 - RNA, 13 nt, Human
gcacagaaaacua

SEQ ID NO: 2091587 - RNA, 15 nt, Human
gcacagaaaacuaga

SEQ ID NO: 2091588 - RNA, 16 nt, Human
gcacagaaaacuagaa

SEQ ID NO: 2091589 - RNA, 13 nt, Human
gcacacugucugc

SEQ ID NO: 2091590 - RNA, 20 nt, Human
gcacacuccccugcacugga

SEQ ID NO: 2091591 - RNA, 12 nt, Human
gcacacuguagc

SEQ ID NO: 2091592 - RNA, 20 nt, Human
gcacagaaacacaauauuuu

SEQ ID NO: 2091593 - RNA, 12 nt, Human
gcacagaaggag

SEQ ID NO: 2091594 - RNA, 19 nt, Human
gcacagagagggggccacc

SEQ ID NO: 2091595 - RNA, 23 nt, Human
gcacagagagggggccaccuccc

SEQ ID NO: 2091596 - RNA, 18 nt, Human
gcacagacgucccuccac

SEQ ID NO: 2091597 - RNA, 15 nt, Human
gcacagagagggggc

SEQ ID NO: 2091598 - RNA, 17 nt, Human
gcacagagagggggcca

SEQ ID NO: 2091599 - RNA, 21 nt, Human
gcacaaaauauaaagcaucua

SEQ ID NO: 2091600 - RNA, 21 nt, Human
gcaauuuuaacacacauaaag

SEQ ID NO: 2091601 - RNA, 23 nt, Human
gcaauuuuaacacacauaaagga

SEQ ID NO: 2091602 - RNA, 18 nt, Human
gcaauuuugcauuugaau

SEQ ID NO: 2091603 - RNA, 18 nt, Human
gcaauugaauuaaauuag

SEQ ID NO: 2091604 - RNA, 17 nt, Human
gcaauuccgcauuuaau

SEQ ID NO: 2091605 - RNA, 14 nt, Human
gcaauugggauggc

SEQ ID NO: 2091606 - RNA, 19 nt, Human
gcaauuuauacaauaucau

SEQ ID NO: 2091607 - RNA, 16 nt, Human
gcaauuuauacaauau

SEQ ID NO: 2091608 - RNA, 14 nt, Human
gcaaugugauaaaa

SEQ ID NO: 2091609 - RNA, 20 nt, Human
gcaaugucaggaacagaagg

SEQ ID NO: 2091610 - RNA, 22 nt, Human
gcaaugucaggaacagaaggau

SEQ ID NO: 2091611 - RNA, 14 nt, Human
gcaaugugcuacug

SEQ ID NO: 2091612 - RNA, 14 nt, Human
gcaauguuaucuug

SEQ ID NO: 2091613 - RNA, 15 nt, Human
gcaauuccgcauuua

SEQ ID NO: 2091614 - RNA, 15 nt, Human
gcaauggcagccuug

SEQ ID NO: 2091615 - RNA, 13 nt, Human
gcaacacacagac

SEQ ID NO: 2091616 - RNA, 14 nt, Human
gcaacgaagaaaaa

SEQ ID NO: 2091617 - RNA, 23 nt, Human
gcaacgaagaaaaaaaauaacac

SEQ ID NO: 2091618 - RNA, 18 nt, Human
gcaacggggaggccaagu

SEQ ID NO: 2091619 - RNA, 14 nt, Human
gcaacucaucuuag

SEQ ID NO: 2091620 - RNA, 19 nt, Human
gcaccugucgcccagugcc

SEQ ID NO: 2091621 - RNA, 13 nt, Human
gcacccccacccu

SEQ ID NO: 2091622 - RNA, 14 nt, Human
gcacccccacccuu

SEQ ID NO: 2091623 - RNA, 15 nt, Human
gcacccccacccuuu

SEQ ID NO: 2091624 - RNA, 18 nt, Human
gcacccccacccuuuggg

SEQ ID NO: 2091625 - RNA, 15 nt, Human
gcacccccacgcccu

SEQ ID NO: 2091626 - RNA, 12 nt, Human
gcaccauaacuu

SEQ ID NO: 2091627 - RNA, 21 nt, Human
gcaccuguaaucccagcuacu

SEQ ID NO: 2091628 - RNA, 17 nt, Human
gcaccuggggaguggga

SEQ ID NO: 2091629 - RNA, 15 nt, Human
gcaccuggggagugg

SEQ ID NO: 2091630 - RNA, 19 nt, Human
gcaccuguacucaggaggc

SEQ ID NO: 2091631 - RNA, 21 nt, Human
gcaccuguacucaggaggcug

SEQ ID NO: 2091632 - RNA, 13 nt, Human
gcaccccccuggg

SEQ ID NO: 2091633 - RNA, 14 nt, Human
gcaccccccugggc

SEQ ID NO: 2091634 - RNA, 21 nt, Human
gcaccccccugggcugagaga

SEQ ID NO: 2091635 - RNA, 12 nt, Human
gcaccaggagac

SEQ ID NO: 2091636 - RNA, 13 nt, Human
gcaccaggagaca

SEQ ID NO: 2091637 - RNA, 20 nt, Human
gcaccaggcacgaacccacc

SEQ ID NO: 2091638 - RNA, 22 nt, Human
gcacauuuuuuuuuuuaauuuu

SEQ ID NO: 2091639 - RNA, 19 nt, Human
gcacauuuccccagaccug

SEQ ID NO: 2091640 - RNA, 22 nt, Human
gcacauuuccccagaccugagc

SEQ ID NO: 2091641 - RNA, 16 nt, Human
gcacauuuccccagac

SEQ ID NO: 2091642 - RNA, 13 nt, Human
gcaccagggaaga

SEQ ID NO: 2091643 - RNA, 19 nt, Human
gcaccaguguccuccccuc

SEQ ID NO: 2091644 - RNA, 20 nt, Human
gcaccaguguccuccccuca

SEQ ID NO: 2091645 - RNA, 21 nt, Human
gcaccaggcacgaacccaccu

SEQ ID NO: 2091646 - RNA, 23 nt, Human
gcaccaggcacgaacccaccugc

SEQ ID NO: 2091647 - RNA, 13 nt, Human
gcacagugcaucu

SEQ ID NO: 2091648 - RNA, 18 nt, Human
gcacagugcaucucagcc

SEQ ID NO: 2091649 - RNA, 15 nt, Human
gcacagugcaucuca

SEQ ID NO: 2091650 - RNA, 13 nt, Human
gcacagauggauu

SEQ ID NO: 2091651 - RNA, 15 nt, Human
gcacagauggauuug

SEQ ID NO: 2091652 - RNA, 24 nt, Human
gcacagauggauuugccugugcca

SEQ ID NO: 2091653 - RNA, 18 nt, Human
gcacagauggauuugccu

SEQ ID NO: 2091654 - RNA, 19 nt, Human
gcacagauggauuugccug

SEQ ID NO: 2091655 - RNA, 22 nt, Human
gcacagauggauuugccugugc

SEQ ID NO: 2091656 - RNA, 13 nt, Human
gcagacagcagcu

SEQ ID NO: 2091657 - RNA, 14 nt, Human
gcagacagcagcuc

SEQ ID NO: 2091658 - RNA, 16 nt, Human
gcagacagcagcucag

SEQ ID NO: 2091659 - RNA, 17 nt, Human
gcagacagcagcucagg

SEQ ID NO: 2091660 - RNA, 18 nt, Human
gcagacagcagcucaggc

SEQ ID NO: 2091661 - RNA, 19 nt, Human
gcagacagcagcucaggca

SEQ ID NO: 2091662 - RNA, 20 nt, Human
gcagacagcagcucaggcac

SEQ ID NO: 2091663 - RNA, 14 nt, Human
gcagacaggcaagc

SEQ ID NO: 2091664 - RNA, 13 nt, Human
gcagacaggcaag

SEQ ID NO: 2091665 - RNA, 12 nt, Human
gcagacaggcaa

SEQ ID NO: 2091666 - RNA, 21 nt, Human
gcagacagcagcucaggcaca

SEQ ID NO: 2091667 - RNA, 23 nt, Human
gcagaagggggucucuucuucca

SEQ ID NO: 2091668 - RNA, 13 nt, Human
gcacuguggccuu

SEQ ID NO: 2091669 - RNA, 14 nt, Human
gcacuguggccuug

SEQ ID NO: 2091670 - RNA, 20 nt, Human
gcacugucucaguuucacuu

SEQ ID NO: 2091671 - RNA, 19 nt, Human
gcacugucucaguuucacu

SEQ ID NO: 2091672 - RNA, 20 nt, Human
gcacugcugcccagccucca

SEQ ID NO: 2091673 - RNA, 18 nt, Human
gcacugcugcccagccuc

SEQ ID NO: 2091674 - RNA, 15 nt, Human
gcacugcugcccagc

SEQ ID NO: 2091675 - RNA, 14 nt, Human
gcacugcugcccag

SEQ ID NO: 2091676 - RNA, 15 nt, Human
gcacugagauauuua

SEQ ID NO: 2091677 - RNA, 21 nt, Human
gcacugagauauuuauuguuu

SEQ ID NO: 2091678 - RNA, 19 nt, Human
gcacugguggcccgacagc

SEQ ID NO: 2091679 - RNA, 14 nt, Human
gcacugguggcccg

SEQ ID NO: 2091680 - RNA, 18 nt, Human
gcacuggguugacuuuca

SEQ ID NO: 2091681 - RNA, 14 nt, Human
gcacuggaguccag

SEQ ID NO: 2091682 - RNA, 17 nt, Human
gcacuggaguccagucu

SEQ ID NO: 2091683 - RNA, 18 nt, Human
gcacuggaguccagucuc

SEQ ID NO: 2091684 - RNA, 20 nt, Human
gagguuucucaaagaaauuu

SEQ ID NO: 2091685 - RNA, 16 nt, Human
gagguuucaaaccucc

SEQ ID NO: 2091686 - RNA, 19 nt, Human
gagguugcagugagcugag

SEQ ID NO: 2091687 - RNA, 17 nt, Human
gagguugggguguacua

SEQ ID NO: 2091688 - RNA, 19 nt, Human
gagguuuaggucaagaaga

SEQ ID NO: 2091689 - RNA, 19 nt, Human
gagguugcagugagccaag

SEQ ID NO: 2091690 - RNA, 13 nt, Human
gagguugcagugu

SEQ ID NO: 2091691 - RNA, 19 nt, Human
gagguugcagggagccgag

SEQ ID NO: 2091692 - RNA, 13 nt, Human
gagguugcaguga

SEQ ID NO: 2091693 - RNA, 15 nt, Human
gagguugcagugagc

SEQ ID NO: 2091694 - RNA, 13 nt, Human
gagguugcaggga

SEQ ID NO: 2091695 - RNA, 20 nt, Human
gaggucagagccugcaguua

SEQ ID NO: 2091696 - RNA, 17 nt, Human
gaggucagagccugcag

SEQ ID NO: 2091697 - RNA, 16 nt, Human
gagguaguuaagggau

SEQ ID NO: 2091698 - RNA, 19 nt, Human
gagguggucugaauguucu

SEQ ID NO: 2091699 - RNA, 13 nt, Human
gagguggucugaa

SEQ ID NO: 2091700 - RNA, 16 nt, Human
gagguggucugaaugu

SEQ ID NO: 2091701 - RNA, 17 nt, Human
gagguggucugaauguu

SEQ ID NO: 2091702 - RNA, 20 nt, Human
gagguggucugaauguucug

SEQ ID NO: 2091703 - RNA, 22 nt, Human
gaguagcugggacuacaggcac

SEQ ID NO: 2091704 - RNA, 17 nt, Human
gaguagaccccuggcug

SEQ ID NO: 2091705 - RNA, 18 nt, Human
gaguagaccccuggcugg

SEQ ID NO: 2091706 - RNA, 23 nt, Human
gaguagccccaacccaaaccugg

SEQ ID NO: 2091707 - RNA, 17 nt, Human
gaguagccgagagccug

SEQ ID NO: 2091708 - RNA, 19 nt, Human
gaguagcugggacuacagg

SEQ ID NO: 2091709 - RNA, 22 nt, Human
gaguagaaagacagagcuggga

SEQ ID NO: 2091710 - RNA, 17 nt, Human
gaguagaaagacagagc

SEQ ID NO: 2091711 - RNA, 20 nt, Human
gaguagaaagacagagcugg

SEQ ID NO: 2091712 - RNA, 14 nt, Human
gaguaauuuauugu

SEQ ID NO: 2091713 - RNA, 16 nt, Human
gaguaauuuauuguuu

SEQ ID NO: 2091714 - RNA, 20 nt, Human
gaguaaucugaucguucuuu

SEQ ID NO: 2091715 - RNA, 12 nt, Human
gaguaagagcug

SEQ ID NO: 2091716 - RNA, 14 nt, Human
gaguaagcugcuuu

SEQ ID NO: 2091717 - RNA, 15 nt, Human
gaguaagcugcuuuu

SEQ ID NO: 2091718 - RNA, 19 nt, Human
gaguccgaaagggacuugg

SEQ ID NO: 2091719 - RNA, 14 nt, Human
gagucccuuccagg

SEQ ID NO: 2091720 - RNA, 22 nt, Human
gagucccuuccaggccaucaga

SEQ ID NO: 2091721 - RNA, 16 nt, Human
gaguccucacucccag

SEQ ID NO: 2091722 - RNA, 17 nt, Human
gaguccucacucccagu

SEQ ID NO: 2091723 - RNA, 14 nt, Human
gagucgaggacagg

SEQ ID NO: 2091724 - RNA, 16 nt, Human
gagucgaggacaggga

SEQ ID NO: 2091725 - RNA, 15 nt, Human
gagucgaggacaggg

SEQ ID NO: 2091726 - RNA, 21 nt, Human
gaguccuacaguggcugucac

SEQ ID NO: 2091727 - RNA, 18 nt, Human
gaguagccgagagccugc

SEQ ID NO: 2091728 - RNA, 21 nt, Human
gaguaguugauguugcauuuu

SEQ ID NO: 2091729 - RNA, 14 nt, Human
gaguauaugcacuu

SEQ ID NO: 2091730 - RNA, 12 nt, Human
gaguauaugcac

SEQ ID NO: 2091731 - RNA, 20 nt, Human
gaguaguugauguugcauuu

SEQ ID NO: 2091732 - RNA, 23 nt, Human
gaguaucuccucgcaagcugggu

SEQ ID NO: 2091733 - RNA, 16 nt, Human
gaguaucugggaacug

SEQ ID NO: 2091734 - RNA, 11 nt, Human
gaguauauguc

SEQ ID NO: 2091735 - RNA, 16 nt, Human
gagugacagaggcagc

SEQ ID NO: 2091736 - RNA, 15 nt, Human
gagugacagaggcag

SEQ ID NO: 2091737 - RNA, 14 nt, Human
gagugacagaggca

SEQ ID NO: 2091738 - RNA, 15 nt, Human
gagugaaccaucauu

SEQ ID NO: 2091739 - RNA, 23 nt, Human
gagucuuuguaaguaaacugccc

SEQ ID NO: 2091740 - RNA, 16 nt, Human
gagucuugcagugauu

SEQ ID NO: 2091741 - RNA, 23 nt, Human
gagucugaagcagaugcaaagag

SEQ ID NO: 2091742 - RNA, 12 nt, Human
gagucugucuca

SEQ ID NO: 2091743 - RNA, 15 nt, Human
gaguggguugauuuc

SEQ ID NO: 2091744 - RNA, 13 nt, Human
gagugggugaaua

SEQ ID NO: 2091745 - RNA, 17 nt, Human
gagugacagaggcagcc

SEQ ID NO: 2091746 - RNA, 11 nt, Human
gaguguaguga

SEQ ID NO: 2091747 - RNA, 23 nt, Human
gaguguccuaggaguauccucau

SEQ ID NO: 2091748 - RNA, 17 nt, Human
gaguguaagugugagua

SEQ ID NO: 2091749 - RNA, 20 nt, Human
gaguguaagugugaguaaga

SEQ ID NO: 2091750 - RNA, 21 nt, Human
gaguggucuuucuggagaggu

SEQ ID NO: 2091751 - RNA, 14 nt, Human
gaguggucuuucug

SEQ ID NO: 2091752 - RNA, 14 nt, Human
gaguguaacaagaa

SEQ ID NO: 2091753 - RNA, 18 nt, Human
gaguguaacaagaaagga

SEQ ID NO: 2091754 - RNA, 21 nt, Human
gaguguaacaagaaaggagag

SEQ ID NO: 2091755 - RNA, 14 nt, Human
gaguguaaguguga

SEQ ID NO: 2091756 - RNA, 22 nt, Human
gaguuaaauagaguauaugcac

SEQ ID NO: 2091757 - RNA, 17 nt, Human
gaguuaaaaagggcagg

SEQ ID NO: 2091758 - RNA, 20 nt, Human
gagugugccugaagucccag

SEQ ID NO: 2091759 - RNA, 12 nt, Human
gagugugggaag

SEQ ID NO: 2091760 - RNA, 18 nt, Human
gagugugggaagggagag

SEQ ID NO: 2091761 - RNA, 16 nt, Human
gaguguggcuccccuc

SEQ ID NO: 2091762 - RNA, 17 nt, Human
gaguguggcuccccucu

SEQ ID NO: 2091763 - RNA, 23 nt, Human
gaguugacuugacagaacacugu

SEQ ID NO: 2091764 - RNA, 18 nt, Human
gauaaaucagugguuauu

SEQ ID NO: 2091765 - RNA, 20 nt, Human
gaguucauacccuguuacca

SEQ ID NO: 2091766 - RNA, 17 nt, Human
gauaagaaugcugguuu

SEQ ID NO: 2091767 - RNA, 20 nt, Human
gauacaggaaaagcugcuga

SEQ ID NO: 2091768 - RNA, 11 nt, Human
gauaacucucc

SEQ ID NO: 2091769 - RNA, 13 nt, Human
gauaacucuuugg

SEQ ID NO: 2091770 - RNA, 14 nt, Human
gauaacucuuugga

SEQ ID NO: 2091771 - RNA, 15 nt, Human
gauaacucuuuggau

SEQ ID NO: 2091772 - RNA, 23 nt, Human
gauacaggaaaagcugcugacag

SEQ ID NO: 2091773 - RNA, 21 nt, Human
gauacaggaaaagcugcugac

SEQ ID NO: 2091774 - RNA, 22 nt, Human
gauaagaaugcugguuuuccua

SEQ ID NO: 2091775 - RNA, 20 nt, Human
gauagcaagugaauuuuucu

SEQ ID NO: 2091776 - RNA, 20 nt, Human
gauagcuuuauuuuuuaagu

SEQ ID NO: 2091777 - RNA, 14 nt, Human
gauagcguuggaau

SEQ ID NO: 2091778 - RNA, 15 nt, Human
gauagcguuggaauu

SEQ ID NO: 2091779 - RNA, 22 nt, Human
gauagcguuggaauuaaaacaa

SEQ ID NO: 2091780 - RNA, 23 nt, Human
gauagcguuggaauuaaaacaau

SEQ ID NO: 2091781 - RNA, 16 nt, Human
gaucacggcucacugc

SEQ ID NO: 2091782 - RNA, 15 nt, Human
gaucacggcucacug

SEQ ID NO: 2091783 - RNA, 13 nt, Human
gaucacagaggcu

SEQ ID NO: 2091784 - RNA, 18 nt, Human
gaucacuggagcccagga

SEQ ID NO: 2091785 - RNA, 15 nt, Human
gaucacuuugcucug

SEQ ID NO: 2091786 - RNA, 11 nt, Human
gaucagaaagu

SEQ ID NO: 2091787 - RNA, 12 nt, Human
gaucagaaagua

SEQ ID NO: 2091788 - RNA, 20 nt, Human
gaucagaaaguaauuucuuc

SEQ ID NO: 2091789 - RNA, 18 nt, Human
gaucacggcucacugcag

SEQ ID NO: 2091790 - RNA, 15 nt, Human
gauaucuugaaauga

SEQ ID NO: 2091791 - RNA, 15 nt, Human
gauaucuuuuuauug

SEQ ID NO: 2091792 - RNA, 16 nt, Human
gauaucuuuuuauuga

SEQ ID NO: 2091793 - RNA, 22 nt, Human
gauaucuuuuuauugaugugca

SEQ ID NO: 2091794 - RNA, 14 nt, Human
gauaugaaaaauau

SEQ ID NO: 2091795 - RNA, 17 nt, Human
gauaucuugaaaugaaa

SEQ ID NO: 2091796 - RNA, 15 nt, Human
gauaugaaaaauaug

SEQ ID NO: 2091797 - RNA, 21 nt, Human
gauaugaguuguuuucagacu

SEQ ID NO: 2091798 - RNA, 15 nt, Human
gagggagcuuagcca

SEQ ID NO: 2091799 - RNA, 13 nt, Human
gagggaggaaucg

SEQ ID NO: 2091800 - RNA, 12 nt, Human
gagggagaugga

SEQ ID NO: 2091801 - RNA, 14 nt, Human
gagggagaagcaug

SEQ ID NO: 2091802 - RNA, 20 nt, Human
gaggcugucuucucaggcuc

SEQ ID NO: 2091803 - RNA, 21 nt, Human
gaggcugucuucucaggcucu

SEQ ID NO: 2091804 - RNA, 22 nt, Human
gaggcugucuucucaggcucug

SEQ ID NO: 2091805 - RNA, 13 nt, Human
gagggagaaggga

SEQ ID NO: 2091806 - RNA, 18 nt, Human
gagggagugacagaggca

SEQ ID NO: 2091807 - RNA, 22 nt, Human
gagggagugacagaggcagccc

SEQ ID NO: 2091808 - RNA, 21 nt, Human
gagggagugacagaggcagcc

SEQ ID NO: 2091809 - RNA, 13 nt, Human
gagggagggggcu

SEQ ID NO: 2091810 - RNA, 16 nt, Human
gagggauaagcaaaag

SEQ ID NO: 2091811 - RNA, 14 nt, Human
gagggaucacaggg

SEQ ID NO: 2091812 - RNA, 15 nt, Human
gagggaucacagggc

SEQ ID NO: 2091813 - RNA, 23 nt, Human
gagggaucacagggccccagaag

SEQ ID NO: 2091814 - RNA, 18 nt, Human
gagggaugaggugcuggg

SEQ ID NO: 2091815 - RNA, 15 nt, Human
gagggaugcugccug

SEQ ID NO: 2091816 - RNA, 17 nt, Human
gagggaugcugccugag

SEQ ID NO: 2091817 - RNA, 18 nt, Human
gaggggucuccaggagga

SEQ ID NO: 2091818 - RNA, 14 nt, Human
gaggggugcucugc

SEQ ID NO: 2091819 - RNA, 21 nt, Human
gagggggcuauagcuacagga

SEQ ID NO: 2091820 - RNA, 22 nt, Human
gagggggccaccuccccaggcc

SEQ ID NO: 2091821 - RNA, 14 nt, Human
gagggggagggggu

SEQ ID NO: 2091822 - RNA, 18 nt, Human
gagggggccaccucccca

SEQ ID NO: 2091823 - RNA, 20 nt, Human
gagggggccaccuccccagg

SEQ ID NO: 2091824 - RNA, 15 nt, Human
gaggggguuacaaac

SEQ ID NO: 2091825 - RNA, 19 nt, Human
gaggggguuacaaacugca

SEQ ID NO: 2091826 - RNA, 20 nt, Human
gaggggguuacaaacugcaa

SEQ ID NO: 2091827 - RNA, 18 nt, Human
gagggcaugcgcacaagg

SEQ ID NO: 2091828 - RNA, 22 nt, Human
gagggcaugcgcacaaggcuga

SEQ ID NO: 2091829 - RNA, 17 nt, Human
gaggggcuuucuggaga

SEQ ID NO: 2091830 - RNA, 20 nt, Human
gagggaugcugccugaguca

SEQ ID NO: 2091831 - RNA, 22 nt, Human
gagggaugaggugcugggaggg

SEQ ID NO: 2091832 - RNA, 15 nt, Human
gagggauguggagca

SEQ ID NO: 2091833 - RNA, 14 nt, Human
gagggucugaggaa

SEQ ID NO: 2091834 - RNA, 13 nt, Human
gagggucugagga

SEQ ID NO: 2091835 - RNA, 24 nt, Human
gagggucuggagaagcagugagcc

SEQ ID NO: 2091836 - RNA, 17 nt, Human
gaggguccuggcuccug

SEQ ID NO: 2091837 - RNA, 15 nt, Human
gagggucuggagaag

SEQ ID NO: 2091838 - RNA, 21 nt, Human
gaggguccuggcuccugaggg

SEQ ID NO: 2091839 - RNA, 13 nt, Human
gagggucagagag

SEQ ID NO: 2091840 - RNA, 13 nt, Human
gagggucaggaag

SEQ ID NO: 2091841 - RNA, 15 nt, Human
gagggucaggaagga

SEQ ID NO: 2091842 - RNA, 15 nt, Human
gagggucagagagga

SEQ ID NO: 2091843 - RNA, 15 nt, Human
gaggguccuggcucc

SEQ ID NO: 2091844 - RNA, 16 nt, Human
gagggucaggaaggau

SEQ ID NO: 2091845 - RNA, 22 nt, Human
gagggugucccaaaaagaaagg

SEQ ID NO: 2091846 - RNA, 21 nt, Human
gaggguggugaccucugccug

SEQ ID NO: 2091847 - RNA, 14 nt, Human
gaggguggugaccu

SEQ ID NO: 2091848 - RNA, 12 nt, Human
gaggguggaaua

SEQ ID NO: 2091849 - RNA, 13 nt, Human
gaggguggcaggu

SEQ ID NO: 2091850 - RNA, 18 nt, Human
gagggugggagagcccag

SEQ ID NO: 2091851 - RNA, 19 nt, Human
gagggugggagagcccagc

SEQ ID NO: 2091852 - RNA, 13 nt, Human
gagggugcugccc

SEQ ID NO: 2091853 - RNA, 13 nt, Human
gaggucagagccu

SEQ ID NO: 2091854 - RNA, 12 nt, Human
gaggucagagcc

SEQ ID NO: 2091855 - RNA, 23 nt, Human
gaggucaacagagaaggcaggaa

SEQ ID NO: 2091856 - RNA, 15 nt, Human
gaggucaagcccagg

SEQ ID NO: 2091857 - RNA, 16 nt, Human
gaggucaagcccagga

SEQ ID NO: 2091858 - RNA, 17 nt, Human
gaggucaagcccaggag

SEQ ID NO: 2091859 - RNA, 19 nt, Human
gaggucaagcccaggagga

SEQ ID NO: 2091860 - RNA, 20 nt, Human
gaggucaagcccaggaggac

SEQ ID NO: 2091861 - RNA, 24 nt, Human
gaggucaagcccaggaggacugcc

SEQ ID NO: 2091862 - RNA, 16 nt, Human
gaggucaaguaagaag

SEQ ID NO: 2091863 - RNA, 17 nt, Human
gaggucaaggcugcagu

SEQ ID NO: 2091864 - RNA, 15 nt, Human
gaggucaacagagaa

SEQ ID NO: 2091865 - RNA, 16 nt, Human
gaggucaacagagaag

SEQ ID NO: 2091866 - RNA, 22 nt, Human
gaggucaacagagaaggcagga

SEQ ID NO: 2091867 - RNA, 21 nt, Human
gagguagguggaucaccugag

SEQ ID NO: 2091868 - RNA, 13 nt, Human
gagguaugagguc

SEQ ID NO: 2091869 - RNA, 12 nt, Human
gaggguuccugu

SEQ ID NO: 2091870 - RNA, 14 nt, Human
gaggguuggggagg

SEQ ID NO: 2091871 - RNA, 17 nt, Human
gaggguuggggaggggc

SEQ ID NO: 2091872 - RNA, 17 nt, Human
gaggguuguucuccuag

SEQ ID NO: 2091873 - RNA, 18 nt, Human
gaggguuguucuccuaga

SEQ ID NO: 2091874 - RNA, 15 nt, Human
gaggguugggcuggu

SEQ ID NO: 2091875 - RNA, 14 nt, Human
gaggguugggcugg

SEQ ID NO: 2091876 - RNA, 15 nt, Human
gaggguuagggaggg

SEQ ID NO: 2091877 - RNA, 19 nt, Human
gaggccuucucugaaggac

SEQ ID NO: 2091878 - RNA, 18 nt, Human
gaggccuucucugaagga

SEQ ID NO: 2091879 - RNA, 16 nt, Human
gaggccuucucugaag

SEQ ID NO: 2091880 - RNA, 21 nt, Human
gaggccucaguggacuuucca

SEQ ID NO: 2091881 - RNA, 13 nt, Human
gaggccucugggc

SEQ ID NO: 2091882 - RNA, 21 nt, Human
gaggccuagucagccacaugg

SEQ ID NO: 2091883 - RNA, 16 nt, Human
gaggccucaguggacu

SEQ ID NO: 2091884 - RNA, 15 nt, Human
gaggcuggccucaga

SEQ ID NO: 2091885 - RNA, 12 nt, Human
gaggcuggcagg

SEQ ID NO: 2091886 - RNA, 13 nt, Human
gaggcuggcaggu

SEQ ID NO: 2091887 - RNA, 16 nt, Human
gaggcuggaggcaggg

SEQ ID NO: 2091888 - RNA, 17 nt, Human
gaggcuggaggcagggc

SEQ ID NO: 2091889 - RNA, 18 nt, Human
gaggcuggaggcagggcc

SEQ ID NO: 2091890 - RNA, 19 nt, Human
gaggcuggaggcagggccu

SEQ ID NO: 2091891 - RNA, 19 nt, Human
gaggcuggacuccagaucu

SEQ ID NO: 2091892 - RNA, 20 nt, Human
gaggcuggacuccagaucug

SEQ ID NO: 2091893 - RNA, 21 nt, Human
gaggcuggacuccagaucugc

SEQ ID NO: 2091894 - RNA, 23 nt, Human
gaggcuggacuccagaucugcac

SEQ ID NO: 2091895 - RNA, 15 nt, Human
gaggcuggagcuggc

SEQ ID NO: 2091896 - RNA, 15 nt, Human
gaggcuggaggcagg

SEQ ID NO: 2091897 - RNA, 15 nt, Human
gaggcuggaggaagg

SEQ ID NO: 2091898 - RNA, 14 nt, Human
gaggcuggaggcag

SEQ ID NO: 2091899 - RNA, 20 nt, Human
gaggccaugauucgcccaaa

SEQ ID NO: 2091900 - RNA, 23 nt, Human
gaggccaugauucgcccaaagcc

SEQ ID NO: 2091901 - RNA, 14 nt, Human
gaggccccacuggg

SEQ ID NO: 2091902 - RNA, 13 nt, Human
gaggcccagggag

SEQ ID NO: 2091903 - RNA, 12 nt, Human
gaggcccaggga

SEQ ID NO: 2091904 - RNA, 22 nt, Human
gaggcagggccuugcccagaga

SEQ ID NO: 2091905 - RNA, 20 nt, Human
gaggcagggccuugcccaga

SEQ ID NO: 2091906 - RNA, 21 nt, Human
gaggcagggccuugcccagag

SEQ ID NO: 2091907 - RNA, 16 nt, Human
gaggcagggaggggac

SEQ ID NO: 2091908 - RNA, 15 nt, Human
gaggcagggccuugc

SEQ ID NO: 2091909 - RNA, 17 nt, Human
gaggcagggccuugccc

SEQ ID NO: 2091910 - RNA, 18 nt, Human
gaggcagggccuugccca

SEQ ID NO: 2091911 - RNA, 17 nt, Human
gaggccaugggccuccu

SEQ ID NO: 2091912 - RNA, 14 nt, Human
gaggccaugggccu

SEQ ID NO: 2091913 - RNA, 23 nt, Human
gaggccaugggccuccugugugu

SEQ ID NO: 2091914 - RNA, 21 nt, Human
gaggccaugggccuccugugu

SEQ ID NO: 2091915 - RNA, 20 nt, Human
gaggccaugggccuccugug

SEQ ID NO: 2091916 - RNA, 18 nt, Human
gaggccaugggccuccug

SEQ ID NO: 2091917 - RNA, 18 nt, Human
gaggcagccccauucugc

SEQ ID NO: 2091918 - RNA, 19 nt, Human
gaggcagccccauucugcc

SEQ ID NO: 2091919 - RNA, 9 nt, Human
gaggcaggg

SEQ ID NO: 2091920 - RNA, 20 nt, Human
gaggcagccccauucugccu

SEQ ID NO: 2091921 - RNA, 21 nt, Human
gaggcagccccauucugccug

SEQ ID NO: 2091922 - RNA, 22 nt, Human
gaggcagggaaguccccaggcc

SEQ ID NO: 2091923 - RNA, 14 nt, Human
gaggcagggaaguc

SEQ ID NO: 2091924 - RNA, 15 nt, Human
gaggcagggagggga

SEQ ID NO: 2091925 - RNA, 17 nt, Human
gaggcagggaggggacu

SEQ ID NO: 2091926 - RNA, 12 nt, Human
gagcccugucuc

SEQ ID NO: 2091927 - RNA, 13 nt, Human
gaggaucucuuga

SEQ ID NO: 2091928 - RNA, 22 nt, Human
gaggaucucuugagccugggag

SEQ ID NO: 2091929 - RNA, 20 nt, Human
gaggaucacuggagcccagg

SEQ ID NO: 2091930 - RNA, 14 nt, Human
gaggaucagaaagu

SEQ ID NO: 2091931 - RNA, 16 nt, Human
gaggaucagaaaguaa

SEQ ID NO: 2091932 - RNA, 16 nt, Human
gaggaucucuugagcc

SEQ ID NO: 2091933 - RNA, 19 nt, Human
gaggaucucuugagccugg

SEQ ID NO: 2091934 - RNA, 20 nt, Human
gaggauuuaagggauggaaa

SEQ ID NO: 2091935 - RNA, 22 nt, Human
gaggauuuaagggauggaaaag

SEQ ID NO: 2091936 - RNA, 20 nt, Human
gaggauugcuugagcucagg

SEQ ID NO: 2091937 - RNA, 21 nt, Human
gaggaugcagagucagcagaa

SEQ ID NO: 2091938 - RNA, 12 nt, Human
gaggauggagag

SEQ ID NO: 2091939 - RNA, 13 nt, Human
gaggauggagaga

SEQ ID NO: 2091940 - RNA, 14 nt, Human
gaggauggagagag

SEQ ID NO: 2091941 - RNA, 15 nt, Human
gaggauggagagagg

SEQ ID NO: 2091942 - RNA, 19 nt, Human
gaggcaaugucaggaacag

SEQ ID NO: 2091943 - RNA, 13 nt, Human
gaggcaagagaau

SEQ ID NO: 2091944 - RNA, 23 nt, Human
gaggcaaaaggcaguggggcugg

SEQ ID NO: 2091945 - RNA, 15 nt, Human
gaggauuucaagccu

SEQ ID NO: 2091946 - RNA, 17 nt, Human
gaggauuucaagccugc

SEQ ID NO: 2091947 - RNA, 22 nt, Human
gaggcagacuucccugaaugua

SEQ ID NO: 2091948 - RNA, 20 nt, Human
gaggcagacagcagcucagg

SEQ ID NO: 2091949 - RNA, 21 nt, Human
gaggcagacagcagcucaggc

SEQ ID NO: 2091950 - RNA, 22 nt, Human
gaggcagacagcagcucaggca

SEQ ID NO: 2091951 - RNA, 20 nt, Human
ggagugcaaugacacagucu

SEQ ID NO: 2091952 - RNA, 14 nt, Human
ggagugcagugagc

SEQ ID NO: 2091953 - RNA, 12 nt, Human
ggagugcaguga

SEQ ID NO: 2091954 - RNA, 21 nt, Human
ggauacgcaucagacagaugg

SEQ ID NO: 2091955 - RNA, 18 nt, Human
ggauacucugucagaugg

SEQ ID NO: 2091956 - RNA, 12 nt, Human
ggauagaggggu

SEQ ID NO: 2091957 - RNA, 17 nt, Human
ggauagauaacucuuug

SEQ ID NO: 2091958 - RNA, 19 nt, Human
ggauagauaacucuuugga

SEQ ID NO: 2091959 - RNA, 20 nt, Human
ggauagauaacucuuuggau

SEQ ID NO: 2091960 - RNA, 15 nt, Human
ggauagaugcccugc

SEQ ID NO: 2091961 - RNA, 15 nt, Human
ggauacuggcaaagc

SEQ ID NO: 2091962 - RNA, 16 nt, Human
ggauacugcccggggc

SEQ ID NO: 2091963 - RNA, 17 nt, Human
ggauagucaccuuuuaa

SEQ ID NO: 2091964 - RNA, 18 nt, Human
ggauagucaccuuuuaaa

SEQ ID NO: 2091965 - RNA, 18 nt, Human
ggauaguugcuccgccuc

SEQ ID NO: 2091966 - RNA, 13 nt, Human
ggauauguggaga

SEQ ID NO: 2091967 - RNA, 21 nt, Human
ggauauuagucauagaagaac

SEQ ID NO: 2091968 - RNA, 16 nt, Human
ggauauuuaagaaaau

SEQ ID NO: 2091969 - RNA, 22 nt, Human
ggauauuuaagaaaauacaaua

SEQ ID NO: 2091970 - RNA, 14 nt, Human
ggauaugaguagcc

SEQ ID NO: 2091971 - RNA, 13 nt, Human
ggauauuuucaaa

SEQ ID NO: 2091972 - RNA, 22 nt, Human
ggaucaaaccccgaccaccugc

SEQ ID NO: 2091973 - RNA, 19 nt, Human
ggauuacaagcgugagcca

SEQ ID NO: 2091974 - RNA, 16 nt, Human
ggauggagagagggga

SEQ ID NO: 2091975 - RNA, 21 nt, Human
ggaugcuccucccuucucuac

SEQ ID NO: 2091976 - RNA, 19 nt, Human
ggauggaaaaggaagacua

SEQ ID NO: 2091977 - RNA, 14 nt, Human
ggaugcugccugag

SEQ ID NO: 2091978 - RNA, 11 nt, Human
ggaugcuucau

SEQ ID NO: 2091979 - RNA, 22 nt, Human
ggaugcuucaugugaacguggg

SEQ ID NO: 2091980 - RNA, 21 nt, Human
ggaugcuugccuagggccugg

SEQ ID NO: 2091981 - RNA, 15 nt, Human
ggaugauuguacaga

SEQ ID NO: 2091982 - RNA, 16 nt, Human
ggaugcagagucagca

SEQ ID NO: 2091983 - RNA, 13 nt, Human
ggaugcagcauua

SEQ ID NO: 2091984 - RNA, 18 nt, Human
ggaugcagagucagcaga

SEQ ID NO: 2091985 - RNA, 14 nt, Human
ggcaccgagaaugu

SEQ ID NO: 2091986 - RNA, 22 nt, Human
ggcacccggccccugcugguuc

SEQ ID NO: 2091987 - RNA, 23 nt, Human
ggcacccaccaucaugucuggcu

SEQ ID NO: 2091988 - RNA, 18 nt, Human
ggcaaugucaggaacaga

SEQ ID NO: 2091989 - RNA, 16 nt, Human
ggcacccacccagcac

SEQ ID NO: 2091990 - RNA, 23 nt, Human
ggcaaugcuggcuguuggcuggg

SEQ ID NO: 2091991 - RNA, 15 nt, Human
ggcaaugcuggcugu

SEQ ID NO: 2091992 - RNA, 14 nt, Human
ggcaaugcuggcug

SEQ ID NO: 2091993 - RNA, 18 nt, Human
ggcaacccccagccugcu

SEQ ID NO: 2091994 - RNA, 18 nt, Human
ggcaauaguguguucuga

SEQ ID NO: 2091995 - RNA, 16 nt, Human
ggcaauauaaccaaug

SEQ ID NO: 2091996 - RNA, 21 nt, Human
ggcaauauaaccaauguuuaa

SEQ ID NO: 2091997 - RNA, 22 nt, Human
ggcaauauaaccaauguuuaaa

SEQ ID NO: 2091998 - RNA, 21 nt, Human
ggcaauauagcaagaucccau

SEQ ID NO: 2091999 - RNA, 23 nt, Human
ggauuacaagcgugagccacugc

SEQ ID NO: 2092000 - RNA, 16 nt, Human
ggauucuuccucccuc

SEQ ID NO: 2092001 - RNA, 17 nt, Human
ggcaacccccagccugc

SEQ ID NO: 2092002 - RNA, 16 nt, Human
ggcaacccccagccug

SEQ ID NO: 2092003 - RNA, 18 nt, Human
ggauuggggaagacugug

SEQ ID NO: 2092004 - RNA, 19 nt, Human
ggauuggggaagacugugg

SEQ ID NO: 2092005 - RNA, 17 nt, Human
ggauugcuacuguccua

SEQ ID NO: 2092006 - RNA, 16 nt, Human
ggauugcuaugaauga

SEQ ID NO: 2092007 - RNA, 17 nt, Human
ggauugcuugagcccag

SEQ ID NO: 2092008 - RNA, 12 nt, Human
ggauuggggaag

SEQ ID NO: 2092009 - RNA, 11 nt, Human
ggccacgugcc

SEQ ID NO: 2092010 - RNA, 12 nt, Human
ggccacgugcca

SEQ ID NO: 2092011 - RNA, 17 nt, Human
ggccacuccagaccccu

SEQ ID NO: 2092012 - RNA, 12 nt, Human
ggccacuccucc

SEQ ID NO: 2092013 - RNA, 18 nt, Human
ggccacgugccaggcccg

SEQ ID NO: 2092014 - RNA, 23 nt, Human
ggccacgugggcaaacaggcagu

SEQ ID NO: 2092015 - RNA, 16 nt, Human
ggccacgugccaggcc

SEQ ID NO: 2092016 - RNA, 17 nt, Human
ggccacgugccaggccc

SEQ ID NO: 2092017 - RNA, 13 nt, Human
ggccacuccucca

SEQ ID NO: 2092018 - RNA, 15 nt, Human
ggccacucugccucu

SEQ ID NO: 2092019 - RNA, 13 nt, Human
ggcauuccugcuu

SEQ ID NO: 2092020 - RNA, 18 nt, Human
ggccagcugugguuuucu

SEQ ID NO: 2092021 - RNA, 11 nt, Human
ggccaggcucc

SEQ ID NO: 2092022 - RNA, 16 nt, Human
ggccaugggccuccug

SEQ ID NO: 2092023 - RNA, 16 nt, Human
ggccaggcuccuuccu

SEQ ID NO: 2092024 - RNA, 20 nt, Human
ggccagcugcaucuacucag

SEQ ID NO: 2092025 - RNA, 23 nt, Human
ggccagcugcaucuacucaggcc

SEQ ID NO: 2092026 - RNA, 18 nt, Human
ggccagcuggcagcagag

SEQ ID NO: 2092027 - RNA, 20 nt, Human
ggccagcugggaucugacug

SEQ ID NO: 2092028 - RNA, 23 nt, Human
ggccagcugggaucugacugcac

SEQ ID NO: 2092029 - RNA, 14 nt, Human
ggccagcuggcagc

SEQ ID NO: 2092030 - RNA, 16 nt, Human
ggccagcuggcagcag

SEQ ID NO: 2092031 - RNA, 17 nt, Human
ggccagcuggcagcaga

SEQ ID NO: 2092032 - RNA, 17 nt, Human
ggcagcuugaggguugg

SEQ ID NO: 2092033 - RNA, 22 nt, Human
ggcagcugcuuuugucuauggg

SEQ ID NO: 2092034 - RNA, 21 nt, Human
ggcagcugaacuauuggaggg

SEQ ID NO: 2092035 - RNA, 21 nt, Human
ggcagcguacucaucaucaac

SEQ ID NO: 2092036 - RNA, 15 nt, Human
ggcacgggcccguga

SEQ ID NO: 2092037 - RNA, 17 nt, Human
ggcacgaacccaccugc

SEQ ID NO: 2092038 - RNA, 18 nt, Human
ggcacgaacccaccugcu

SEQ ID NO: 2092039 - RNA, 19 nt, Human
ggcacgaacccaccugcug

SEQ ID NO: 2092040 - RNA, 20 nt, Human
ggcacgaacccaccugcuga

SEQ ID NO: 2092041 - RNA, 20 nt, Human
ggcacgagcaaagugaagac

SEQ ID NO: 2092042 - RNA, 13 nt, Human
ggcacgcuguggg

SEQ ID NO: 2092043 - RNA, 18 nt, Human
ggcacgcugugggcaggu

SEQ ID NO: 2092044 - RNA, 17 nt, Human
ggcaccuggggaguggg

SEQ ID NO: 2092045 - RNA, 16 nt, Human
ggcacccauccuagag

SEQ ID NO: 2092046 - RNA, 16 nt, Human
ggcaccugucgcccag

SEQ ID NO: 2092047 - RNA, 14 nt, Human
ggcaccuggggagu

SEQ ID NO: 2092048 - RNA, 15 nt, Human
ggcaccgagaauguu

SEQ ID NO: 2092049 - RNA, 21 nt, Human
ggcagugggacagggcauggc

SEQ ID NO: 2092050 - RNA, 22 nt, Human
ggcaucuuugccuugggcugcu

SEQ ID NO: 2092051 - RNA, 23 nt, Human
ggcaucuuugccuugggcugcuc

SEQ ID NO: 2092052 - RNA, 16 nt, Human
ggcagugggagcugcc

SEQ ID NO: 2092053 - RNA, 14 nt, Human
ggcagugggagcug

SEQ ID NO: 2092054 - RNA, 13 nt, Human
ggcagugggagcu

SEQ ID NO: 2092055 - RNA, 20 nt, Human
ggcagggucucacucugucg

SEQ ID NO: 2092056 - RNA, 19 nt, Human
ggcagggucucacucuguc

SEQ ID NO: 2092057 - RNA, 23 nt, Human
ggcagggugggauggaggagaag

SEQ ID NO: 2092058 - RNA, 16 nt, Human
ggcagggugggaugga

SEQ ID NO: 2092059 - RNA, 21 nt, Human
ggcagggugggauggaggaga

SEQ ID NO: 2092060 - RNA, 20 nt, Human
ggcaggguuuuaucucuguc

SEQ ID NO: 2092061 - RNA, 18 nt, Human
ggcauggccagguggcca

SEQ ID NO: 2092062 - RNA, 17 nt, Human
ggcauggccagguggcc

SEQ ID NO: 2092063 - RNA, 16 nt, Human
ggcauggcuccagucu

SEQ ID NO: 2092064 - RNA, 22 nt, Human
ggcaugcuggcucccagggcca

SEQ ID NO: 2092065 - RNA, 12 nt, Human
ggcaugcugggg

SEQ ID NO: 2092066 - RNA, 16 nt, Human
ggcaugccugugugac

SEQ ID NO: 2092067 - RNA, 19 nt, Human
ggcaugcgcacaaggcuga

SEQ ID NO: 2092068 - RNA, 16 nt, Human
ggcaugcuggggcaag

SEQ ID NO: 2092069 - RNA, 13 nt, Human
ggcaugcuggggc

SEQ ID NO: 2092070 - RNA, 14 nt, Human
ggcaugcuggggca

SEQ ID NO: 2092071 - RNA, 20 nt, Human
ggcaucuuugcuauggggac

SEQ ID NO: 2092072 - RNA, 13 nt, Human
ggcaugccugugu

SEQ ID NO: 2092073 - RNA, 14 nt, Human
ggcaugccugugug

SEQ ID NO: 2092074 - RNA, 19 nt, Human
ggcucccacaggcccuucc

SEQ ID NO: 2092075 - RNA, 18 nt, Human
ggcucccacaggcccuuc

SEQ ID NO: 2092076 - RNA, 17 nt, Human
ggcucccacaggcccuu

SEQ ID NO: 2092077 - RNA, 24 nt, Human
ggcuccagucugcugcccuccauc

SEQ ID NO: 2092078 - RNA, 15 nt, Human
ggcuccagucugcug

SEQ ID NO: 2092079 - RNA, 18 nt, Human
ggcuccagucugcugccc

SEQ ID NO: 2092080 - RNA, 22 nt, Human
ggcuccagucugcugcccucca

SEQ ID NO: 2092081 - RNA, 16 nt, Human
ggcuccaggcuccuuu

SEQ ID NO: 2092082 - RNA, 11 nt, Human
ggcuccaggcu

SEQ ID NO: 2092083 - RNA, 15 nt, Human
ggcuccaggcuccuu

SEQ ID NO: 2092084 - RNA, 21 nt, Human
ggcucaaguccucuuuucuga

SEQ ID NO: 2092085 - RNA, 15 nt, Human
ggcucaaguccucuu

SEQ ID NO: 2092086 - RNA, 16 nt, Human
ggcucacaccuguaau

SEQ ID NO: 2092087 - RNA, 15 nt, Human
ggcuaguugggcuuc

SEQ ID NO: 2092088 - RNA, 16 nt, Human
ggcuaguugggcuucc

SEQ ID NO: 2092089 - RNA, 19 nt, Human
ggcuauagcuacaggaagc

SEQ ID NO: 2092090 - RNA, 20 nt, Human
ggcuauagcuacaggaagca

SEQ ID NO: 2092091 - RNA, 19 nt, Human
ggcuaugggggcacugagg

SEQ ID NO: 2092092 - RNA, 19 nt, Human
ggcuauuccauaauuccau

SEQ ID NO: 2092093 - RNA, 15 nt, Human
ggcuauuuaccaggg

SEQ ID NO: 2092094 - RNA, 14 nt, Human
ggcucaagcagucu

SEQ ID NO: 2092095 - RNA, 23 nt, Human
ggcucaagcagucuacccaccuc

SEQ ID NO: 2092096 - RNA, 22 nt, Human
ggcuauggauuuucuaaggaag

SEQ ID NO: 2092097 - RNA, 19 nt, Human
ggcuauguauggaauacag

SEQ ID NO: 2092098 - RNA, 13 nt, Human
ggcuauucacaac

SEQ ID NO: 2092099 - RNA, 16 nt, Human
ggcuaggaccccucca

SEQ ID NO: 2092100 - RNA, 15 nt, Human
ggcuagaucaugaag

SEQ ID NO: 2092101 - RNA, 20 nt, Human
ggcuagaguccucacuccca

SEQ ID NO: 2092102 - RNA, 22 nt, Human
ggcuaggaccccuccauguggg

SEQ ID NO: 2092103 - RNA, 13 nt, Human
ggcuagaguccuc

SEQ ID NO: 2092104 - RNA, 14 nt, Human
ggcuagaguccuca

SEQ ID NO: 2092105 - RNA, 18 nt, Human
ggcuagaguccucacucc

SEQ ID NO: 2092106 - RNA, 19 nt, Human
ggcuagaguccucacuccc

SEQ ID NO: 2092107 - RNA, 12 nt, Human
ggccuggcuccg

SEQ ID NO: 2092108 - RNA, 13 nt, Human
ggccuggcuccgc

SEQ ID NO: 2092109 - RNA, 14 nt, Human
ggccuggcuccgcu

SEQ ID NO: 2092110 - RNA, 18 nt, Human
ggccuggcuccgcugugu

SEQ ID NO: 2092111 - RNA, 19 nt, Human
ggccucuugggucccccac

SEQ ID NO: 2092112 - RNA, 17 nt, Human
ggccugucucaucccca

SEQ ID NO: 2092113 - RNA, 18 nt, Human
ggccugucucauccccag

SEQ ID NO: 2092114 - RNA, 19 nt, Human
ggccugucucauccccagg

SEQ ID NO: 2092115 - RNA, 20 nt, Human
ggccugucucauccccaggg

SEQ ID NO: 2092116 - RNA, 14 nt, Human
ggccugucccuggc

SEQ ID NO: 2092117 - RNA, 17 nt, Human
ggccugucccuggccau

SEQ ID NO: 2092118 - RNA, 21 nt, Human
ggccugucccuggccaucucu

SEQ ID NO: 2092119 - RNA, 23 nt, Human
ggccugucucauccccagggguc

SEQ ID NO: 2092120 - RNA, 22 nt, Human
ggcgcgcaccuguaaucccagc

SEQ ID NO: 2092121 - RNA, 20 nt, Human
ggcggagcuugcagugagcc

SEQ ID NO: 2092122 - RNA, 21 nt, Human
ggcggagcuugcagugagccg

SEQ ID NO: 2092123 - RNA, 20 nt, Human
ggcggcuacucagcagcccu

SEQ ID NO: 2092124 - RNA, 21 nt, Human
ggcggcuacucagcagcccuc

SEQ ID NO: 2092125 - RNA, 22 nt, Human
ggcggcuacucagcagcccucc

SEQ ID NO: 2092126 - RNA, 23 nt, Human
ggcggcuacucagcagcccuccu

SEQ ID NO: 2092127 - RNA, 19 nt, Human
ggccucaacccucccucag

SEQ ID NO: 2092128 - RNA, 21 nt, Human
ggccucaacccucccucagcc

SEQ ID NO: 2092129 - RNA, 15 nt, Human
ggccucaacccuccc

SEQ ID NO: 2092130 - RNA, 22 nt, Human
ggccucaaaguuggggcaggcu

SEQ ID NO: 2092131 - RNA, 16 nt, Human
ggccucaacccucccu

SEQ ID NO: 2092132 - RNA, 17 nt, Human
ggccucaacccucccuc

SEQ ID NO: 2092133 - RNA, 18 nt, Human
ggccucaacccucccuca

SEQ ID NO: 2092134 - RNA, 13 nt, Human
ggccucggagccu

SEQ ID NO: 2092135 - RNA, 15 nt, Human
ggccucggagccuca

SEQ ID NO: 2092136 - RNA, 19 nt, Human
ggccucggagccucauccg

SEQ ID NO: 2092137 - RNA, 22 nt, Human
ggccucggagccucauccgagg

SEQ ID NO: 2092138 - RNA, 15 nt, Human
ggccuagucagccac

SEQ ID NO: 2092139 - RNA, 20 nt, Human
ggccucgguguggagaagcg

SEQ ID NO: 2092140 - RNA, 20 nt, Human
ggccgucuucacucgccccc

SEQ ID NO: 2092141 - RNA, 12 nt, Human
ggccgucaggac

SEQ ID NO: 2092142 - RNA, 19 nt, Human
ggccgucaggacccaccau

SEQ ID NO: 2092143 - RNA, 15 nt, Human
ggccggugugggcug

SEQ ID NO: 2092144 - RNA, 14 nt, Human
ggcccuggggccug

SEQ ID NO: 2092145 - RNA, 11 nt, Human
ggcccuggggc

SEQ ID NO: 2092146 - RNA, 15 nt, Human
ggcccuggggccugu

SEQ ID NO: 2092147 - RNA, 12 nt, Human
ggcccugguccu

SEQ ID NO: 2092148 - RNA, 12 nt, Human
ggcccuggggcc

SEQ ID NO: 2092149 - RNA, 15 nt, Human
ggcccugguccuucc

SEQ ID NO: 2092150 - RNA, 17 nt, Human
ggcccugguccuuccag

SEQ ID NO: 2092151 - RNA, 19 nt, Human
ggcccaagagaugaagagu

SEQ ID NO: 2092152 - RNA, 14 nt, Human
ggcccaacauuaaa

SEQ ID NO: 2092153 - RNA, 23 nt, Human
ggcccaacacaauucuucuucca

SEQ ID NO: 2092154 - RNA, 21 nt, Human
ggcccaaauuaucaagcuaau

SEQ ID NO: 2092155 - RNA, 23 nt, Human
ggcccaaauuaucaagcuaauaa

SEQ ID NO: 2092156 - RNA, 22 nt, Human
ggcccacgccuguaaucccagc

SEQ ID NO: 2092157 - RNA, 12 nt, Human
ggcccagagagg

SEQ ID NO: 2092158 - RNA, 15 nt, Human
ggcccagagaagcca

SEQ ID NO: 2092159 - RNA, 11 nt, Human
ggcccagagag

SEQ ID NO: 2092160 - RNA, 19 nt, Human
ggcccucugguagacacag

SEQ ID NO: 2092161 - RNA, 14 nt, Human
ggcccugccuucuu

SEQ ID NO: 2092162 - RNA, 10 nt, Human
ggcccugccu

SEQ ID NO: 2092163 - RNA, 12 nt, Human
ggcccuggccug

SEQ ID NO: 2092164 - RNA, 13 nt, Human
ggcccuggcuccc

SEQ ID NO: 2092165 - RNA, 14 nt, Human
ggcccuggccugcu

SEQ ID NO: 2092166 - RNA, 15 nt, Human
ggcccuggccugcug

SEQ ID NO: 2092167 - RNA, 16 nt, Human
ggcccuggccugcugg

SEQ ID NO: 2092168 - RNA, 17 nt, Human
ggcccuggccugcuggg

SEQ ID NO: 2092169 - RNA, 22 nt, Human
ggcccuggcucccacaggcccu

SEQ ID NO: 2092170 - RNA, 22 nt, Human
ggcccuggccugcugggcucuc

SEQ ID NO: 2092171 - RNA, 14 nt, Human
ggcccugagcucgg

SEQ ID NO: 2092172 - RNA, 19 nt, Human
ggcccugagcucgguggac

SEQ ID NO: 2092173 - RNA, 21 nt, Human
ggcccugagcucgguggaccc

SEQ ID NO: 2092174 - RNA, 16 nt, Human
gcuugaggguugggcu

SEQ ID NO: 2092175 - RNA, 12 nt, Human
gcuucugccugc

SEQ ID NO: 2092176 - RNA, 13 nt, Human
gcuucugccugca

SEQ ID NO: 2092177 - RNA, 14 nt, Human
gcuucugcaccuua

SEQ ID NO: 2092178 - RNA, 16 nt, Human
gcuucugccacauaaa

SEQ ID NO: 2092179 - RNA, 22 nt, Human
gcuucucugugaacgauuuaga

SEQ ID NO: 2092180 - RNA, 19 nt, Human
gcuucucugugacugaugu

SEQ ID NO: 2092181 - RNA, 17 nt, Human
gcuucucuuuaacucag

SEQ ID NO: 2092182 - RNA, 19 nt, Human
gcuucucuuuaacucagga

SEQ ID NO: 2092183 - RNA, 21 nt, Human
gcuucucuuuaacucaggacu

SEQ ID NO: 2092184 - RNA, 23 nt, Human
gcuucucuuuaacucaggacucc

SEQ ID NO: 2092185 - RNA, 15 nt, Human
gcuucugaccucagc

SEQ ID NO: 2092186 - RNA, 16 nt, Human
gcuucugaccucagca

SEQ ID NO: 2092187 - RNA, 15 nt, Human
gcuucugaugaaucu

SEQ ID NO: 2092188 - RNA, 17 nt, Human
gcuucugaugaaucuug

SEQ ID NO: 2092189 - RNA, 18 nt, Human
gcuucugaugaaucuugc

SEQ ID NO: 2092190 - RNA, 20 nt, Human
gcuucugaugaaucuugcgu

SEQ ID NO: 2092191 - RNA, 14 nt, Human
gcuuccaggaaaaa

SEQ ID NO: 2092192 - RNA, 17 nt, Human
gcuucauuuccuguguc

SEQ ID NO: 2092193 - RNA, 22 nt, Human
gcuucucauccugcaggcagcu

SEQ ID NO: 2092194 - RNA, 16 nt, Human
gcuucauuuccugugu

SEQ ID NO: 2092195 - RNA, 13 nt, Human
gcuucauuuccug

SEQ ID NO: 2092196 - RNA, 18 nt, Human
gcuucaguggcagcugcu

SEQ ID NO: 2092197 - RNA, 17 nt, Human
gcuucaguggcagcugc

SEQ ID NO: 2092198 - RNA, 16 nt, Human
gcuuaugaauauuuau

SEQ ID NO: 2092199 - RNA, 21 nt, Human
gcuuaugaauauuuauaacag

SEQ ID NO: 2092200 - RNA, 16 nt, Human
gcuucaguggcagcug

SEQ ID NO: 2092201 - RNA, 12 nt, Human
gcuuauacacuu

SEQ ID NO: 2092202 - RNA, 20 nt, Human
gcuuauacacuuacacuuua

SEQ ID NO: 2092203 - RNA, 19 nt, Human
gcuuaucucaggggugugc

SEQ ID NO: 2092204 - RNA, 17 nt, Human
gcuguccuuacccaucu

SEQ ID NO: 2092205 - RNA, 22 nt, Human
gcuguccuuacccaucugcacc

SEQ ID NO: 2092206 - RNA, 13 nt, Human
gcugucuccagac

SEQ ID NO: 2092207 - RNA, 14 nt, Human
gcugucuccagacc

SEQ ID NO: 2092208 - RNA, 15 nt, Human
gcugucuccagaccc

SEQ ID NO: 2092209 - RNA, 22 nt, Human
gcugucuccagacccccacccc

SEQ ID NO: 2092210 - RNA, 13 nt, Human
gcugugguuccug

SEQ ID NO: 2092211 - RNA, 15 nt, Human
gcugugguuccuggg

SEQ ID NO: 2092212 - RNA, 18 nt, Human
gcuguggguacagagagg

SEQ ID NO: 2092213 - RNA, 13 nt, Human
gcuguggucucuu

SEQ ID NO: 2092214 - RNA, 16 nt, Human
gcuguggucucuuugu

SEQ ID NO: 2092215 - RNA, 12 nt, Human
gcugugggcucc

SEQ ID NO: 2092216 - RNA, 13 nt, Human
gcugugggcuccc

SEQ ID NO: 2092217 - RNA, 14 nt, Human
gcugugggcucccu

SEQ ID NO: 2092218 - RNA, 15 nt, Human
gcugugggcucccuu

SEQ ID NO: 2092219 - RNA, 16 nt, Human
gcugugggcucccuuc

SEQ ID NO: 2092220 - RNA, 18 nt, Human
gcugugggcucccuuccu

SEQ ID NO: 2092221 - RNA, 23 nt, Human
gcugugggcaggugggagcuuga

SEQ ID NO: 2092222 - RNA, 18 nt, Human
gcugugggccucaaggac

SEQ ID NO: 2092223 - RNA, 19 nt, Human
gcugugggccucaaggacu

SEQ ID NO: 2092224 - RNA, 14 nt, Human
gcuguucagcuggu

SEQ ID NO: 2092225 - RNA, 13 nt, Human
gcuguucagcugg

SEQ ID NO: 2092226 - RNA, 13 nt, Human
gcuguugccucau

SEQ ID NO: 2092227 - RNA, 15 nt, Human
gcuguugccucaucu

SEQ ID NO: 2092228 - RNA, 18 nt, Human
gcuguugagcuguuuucc

SEQ ID NO: 2092229 - RNA, 16 nt, Human
gcuguugagcuguuuu

SEQ ID NO: 2092230 - RNA, 15 nt, Human
gcuguugagcuguuu

SEQ ID NO: 2092231 - RNA, 12 nt, Human
gcuguugagcug

SEQ ID NO: 2092232 - RNA, 19 nt, Human
gcuuagaccucagccugug

SEQ ID NO: 2092233 - RNA, 23 nt, Human
gcuuagaccucagccugugcugc

SEQ ID NO: 2092234 - RNA, 13 nt, Human
ggaaccagagcca

SEQ ID NO: 2092235 - RNA, 12 nt, Human
ggaaccagagcc

SEQ ID NO: 2092236 - RNA, 19 nt, Human
ggaaccagagccauggacu

SEQ ID NO: 2092237 - RNA, 23 nt, Human
ggaacaguguuucccauaauuuu

SEQ ID NO: 2092238 - RNA, 18 nt, Human
ggaacaguguuucccaua

SEQ ID NO: 2092239 - RNA, 14 nt, Human
ggaaauaaaaaagu

SEQ ID NO: 2092240 - RNA, 15 nt, Human
ggaaauaaaaaaguc

SEQ ID NO: 2092241 - RNA, 19 nt, Human
ggaaauaaaaaagucucua

SEQ ID NO: 2092242 - RNA, 22 nt, Human
ggaaauaaaaaagucucuauuu

SEQ ID NO: 2092243 - RNA, 15 nt, Human
ggaaauaaaaccuuu

SEQ ID NO: 2092244 - RNA, 16 nt, Human
ggaaauaaaaccuuuc

SEQ ID NO: 2092245 - RNA, 18 nt, Human
ggaaauaaaaccuuucaa

SEQ ID NO: 2092246 - RNA, 19 nt, Human
ggaaauaaaaccuuucaaa

SEQ ID NO: 2092247 - RNA, 20 nt, Human
ggaaauaaaaccuuucaaau

SEQ ID NO: 2092248 - RNA, 22 nt, Human
ggaaauaaaaccuuucaaauuu

SEQ ID NO: 2092249 - RNA, 20 nt, Human
ggaaauaauaaagaugcucu

SEQ ID NO: 2092250 - RNA, 14 nt, Human
ggaaauauauaugu

SEQ ID NO: 2092251 - RNA, 16 nt, Human
ggaaauaucaguuacu

SEQ ID NO: 2092252 - RNA, 14 nt, Human
ggaaauauuaugca

SEQ ID NO: 2092253 - RNA, 22 nt, Human
ggaaauaucaguuacucagccc

SEQ ID NO: 2092254 - RNA, 23 nt, Human
ggaacagcuaugggagccccagg

SEQ ID NO: 2092255 - RNA, 23 nt, Human
ggaaaaucagccugcuccagcug

SEQ ID NO: 2092256 - RNA, 23 nt, Human
ggaaaaauggauccccagugaaa

SEQ ID NO: 2092257 - RNA, 21 nt, Human
ggaaaauguuuuguaagaaac

SEQ ID NO: 2092258 - RNA, 15 nt, Human
ggaaaaugccaaucu

SEQ ID NO: 2092259 - RNA, 17 nt, Human
ggaaaaugccaaucucu

SEQ ID NO: 2092260 - RNA, 19 nt, Human
ggaaaaucagccugcucca

SEQ ID NO: 2092261 - RNA, 20 nt, Human
ggaaaggcucagucucagga

SEQ ID NO: 2092262 - RNA, 23 nt, Human
ggaaagggauuuucagcccucag

SEQ ID NO: 2092263 - RNA, 23 nt, Human
ggaaaggcucagucucaggagca

SEQ ID NO: 2092264 - RNA, 15 nt, Human
ggaaaggcucugaaa

SEQ ID NO: 2092265 - RNA, 20 nt, Human
ggaaaggcucugaaagccag

SEQ ID NO: 2092266 - RNA, 15 nt, Human
gcuuuguaugcacuu

SEQ ID NO: 2092267 - RNA, 12 nt, Human
gcuuugucccac

SEQ ID NO: 2092268 - RNA, 15 nt, Human
gcuuugucccacagc

SEQ ID NO: 2092269 - RNA, 16 nt, Human
gcuuugucccacagcu

SEQ ID NO: 2092270 - RNA, 19 nt, Human
gcuuugucccacagcuugg

SEQ ID NO: 2092271 - RNA, 13 nt, Human
gcuuucagagccu

SEQ ID NO: 2092272 - RNA, 23 nt, Human
gcuuuauuuuuuaaguauuuaua

SEQ ID NO: 2092273 - RNA, 20 nt, Human
gcuuucaagaccccugucuu

SEQ ID NO: 2092274 - RNA, 19 nt, Human
gcuuuauuuuuuaaguauu

SEQ ID NO: 2092275 - RNA, 21 nt, Human
gcuuuauuuuuuaaguauuua

SEQ ID NO: 2092276 - RNA, 20 nt, Human
gcuugaggguugggcuggug

SEQ ID NO: 2092277 - RNA, 18 nt, Human
gcuugaggguugggcugg

SEQ ID NO: 2092278 - RNA, 18 nt, Human
gcuuuagaauguuuuccu

SEQ ID NO: 2092279 - RNA, 20 nt, Human
gcuuuagaauguuuuccuuc

SEQ ID NO: 2092280 - RNA, 16 nt, Human
gcuuuacuguuuguua

SEQ ID NO: 2092281 - RNA, 15 nt, Human
gcuuuacuuagcuua

SEQ ID NO: 2092282 - RNA, 16 nt, Human
gcuuuacuuagcuuau

SEQ ID NO: 2092283 - RNA, 18 nt, Human
gcuuuacuuagcuuauca

SEQ ID NO: 2092284 - RNA, 21 nt, Human
gcuuuacuuagcuuaucaauu

SEQ ID NO: 2092285 - RNA, 18 nt, Human
gcuuuucacugcuggcug

SEQ ID NO: 2092286 - RNA, 14 nt, Human
gcuuuucacugcug

SEQ ID NO: 2092287 - RNA, 13 nt, Human
gcuuuucacugcu

SEQ ID NO: 2092288 - RNA, 21 nt, Human
gcuuuguuuguugucagcuga

SEQ ID NO: 2092289 - RNA, 23 nt, Human
gcuuuucacugcuggcugccuua

SEQ ID NO: 2092290 - RNA, 22 nt, Human
gcuuuucacugcuggcugccuu

SEQ ID NO: 2092291 - RNA, 13 nt, Human
ggaaaaauauuua

SEQ ID NO: 2092292 - RNA, 14 nt, Human
ggaaaaauauuuaa

SEQ ID NO: 2092293 - RNA, 15 nt, Human
ggaaaaauauuuaag

SEQ ID NO: 2092294 - RNA, 15 nt, Human
ggaaaaauccagaaa

SEQ ID NO: 2092295 - RNA, 20 nt, Human
ggaaaagcugcugacagugu

SEQ ID NO: 2092296 - RNA, 18 nt, Human
ggaaaagcugcugacagu

SEQ ID NO: 2092297 - RNA, 20 nt, Human
ggaaaaggcagggagcgagg

SEQ ID NO: 2092298 - RNA, 14 nt, Human
ggaaaagcugcuga

SEQ ID NO: 2092299 - RNA, 18 nt, Human
ggaaaacagacucagguu

SEQ ID NO: 2092300 - RNA, 21 nt, Human
ggaaaaccaagccguggcuuc

SEQ ID NO: 2092301 - RNA, 23 nt, Human
ggagauauuuauggggggagaac

SEQ ID NO: 2092302 - RNA, 17 nt, Human
ggagaucggggccagag

SEQ ID NO: 2092303 - RNA, 18 nt, Human
ggagaucggggccagagg

SEQ ID NO: 2092304 - RNA, 19 nt, Human
ggagaucggggccagaggc

SEQ ID NO: 2092305 - RNA, 19 nt, Human
ggagaugaagcaaacacau

SEQ ID NO: 2092306 - RNA, 22 nt, Human
ggagauauuuauggggggagaa

SEQ ID NO: 2092307 - RNA, 23 nt, Human
ggagagggucuggagaagcagug

SEQ ID NO: 2092308 - RNA, 16 nt, Human
ggagaggcagagugcc

SEQ ID NO: 2092309 - RNA, 13 nt, Human
ggagaggccauga

SEQ ID NO: 2092310 - RNA, 11 nt, Human
ggagaggucuu

SEQ ID NO: 2092311 - RNA, 18 nt, Human
ggagaggucuuuuuuaaa

SEQ ID NO: 2092312 - RNA, 23 nt, Human
ggagaggucuuuuuuaaaaggaa

SEQ ID NO: 2092313 - RNA, 21 nt, Human
ggagagguuauaggucacucc

SEQ ID NO: 2092314 - RNA, 17 nt, Human
ggagagucuugcaguga

SEQ ID NO: 2092315 - RNA, 21 nt, Human
ggagaguccccugaaggucug

SEQ ID NO: 2092316 - RNA, 16 nt, Human
ggagagguugucugug

SEQ ID NO: 2092317 - RNA, 23 nt, Human
ggagagguuauaggucacuccug

SEQ ID NO: 2092318 - RNA, 20 nt, Human
ggagaaucgcuugaacccag

SEQ ID NO: 2092319 - RNA, 21 nt, Human
ggagacacauccagcaauugu

SEQ ID NO: 2092320 - RNA, 14 nt, Human
ggagacaccucaga

SEQ ID NO: 2092321 - RNA, 19 nt, Human
ggagacaaugcagaugcca

SEQ ID NO: 2092322 - RNA, 22 nt, Human
ggagacaaugcagaugccagag

SEQ ID NO: 2092323 - RNA, 23 nt, Human
ggagacaaugcagaugccagagc

SEQ ID NO: 2092324 - RNA, 23 nt, Human
ggacuggcuagaguccucacucc

SEQ ID NO: 2092325 - RNA, 15 nt, Human
ggacuggcuguccuu

SEQ ID NO: 2092326 - RNA, 21 nt, Human
ggacuggcuuugucccacagc

SEQ ID NO: 2092327 - RNA, 17 nt, Human
ggacuggagucccugug

SEQ ID NO: 2092328 - RNA, 19 nt, Human
ggacuggcuagaguccuca

SEQ ID NO: 2092329 - RNA, 20 nt, Human
ggacuggcuagaguccucac

SEQ ID NO: 2092330 - RNA, 22 nt, Human
ggacuggcuagaguccucacuc

SEQ ID NO: 2092331 - RNA, 17 nt, Human
ggagaagcggcuggcag

SEQ ID NO: 2092332 - RNA, 18 nt, Human
ggagaagcggcuggcagc

SEQ ID NO: 2092333 - RNA, 20 nt, Human
ggacauugcggacagccacg

SEQ ID NO: 2092334 - RNA, 16 nt, Human
ggacauguucccuucu

SEQ ID NO: 2092335 - RNA, 21 nt, Human
ggacauguucccuucuccuuc

SEQ ID NO: 2092336 - RNA, 20 nt, Human
ggacauuccaauuugcacuu

SEQ ID NO: 2092337 - RNA, 17 nt, Human
ggacagcauggugcaug

SEQ ID NO: 2092338 - RNA, 19 nt, Human
ggacagcauggugcaugcc

SEQ ID NO: 2092339 - RNA, 17 nt, Human
ggaccaaggagaugaag

SEQ ID NO: 2092340 - RNA, 15 nt, Human
ggaccaaggaccccu

SEQ ID NO: 2092341 - RNA, 13 nt, Human
ggaccaaagcuga

SEQ ID NO: 2092342 - RNA, 18 nt, Human
ggaccaacaagggcagug

SEQ ID NO: 2092343 - RNA, 22 nt, Human
ggaccaacaagggcaguggagg

SEQ ID NO: 2092344 - RNA, 21 nt, Human
ggacagccacggccaggccag

SEQ ID NO: 2092345 - RNA, 20 nt, Human
ggacagccacggccaggcca

SEQ ID NO: 2092346 - RNA, 19 nt, Human
ggacagccacggccaggcc

SEQ ID NO: 2092347 - RNA, 15 nt, Human
ggacagccacggcca

SEQ ID NO: 2092348 - RNA, 17 nt, Human
ggacacucaaaagcugg

SEQ ID NO: 2092349 - RNA, 22 nt, Human
ggacacucaaaagcugggcagg

SEQ ID NO: 2092350 - RNA, 13 nt, Human
ggacagaucauag

SEQ ID NO: 2092351 - RNA, 23 nt, Human
ggacagaucauagauuucugauu

SEQ ID NO: 2092352 - RNA, 15 nt, Human
ggacagcaaaaccau

SEQ ID NO: 2092353 - RNA, 20 nt, Human
ggacagcaaaaccauugcuu

SEQ ID NO: 2092354 - RNA, 21 nt, Human
ggacagcaaaaccauugcuuc

SEQ ID NO: 2092355 - RNA, 22 nt, Human
ggacagcaaaaccauugcuuca

SEQ ID NO: 2092356 - RNA, 17 nt, Human
ggaccuugaacugggua

SEQ ID NO: 2092357 - RNA, 15 nt, Human
ggaccuugaacuggg

SEQ ID NO: 2092358 - RNA, 14 nt, Human
ggaccuccugagcg

SEQ ID NO: 2092359 - RNA, 21 nt, Human
ggaccacaccucccugaacca

SEQ ID NO: 2092360 - RNA, 13 nt, Human
ggaccacaccucc

SEQ ID NO: 2092361 - RNA, 22 nt, Human
ggaccacaaaaaugaaagcaug

SEQ ID NO: 2092362 - RNA, 19 nt, Human
ggaccagaagccaaagacu

SEQ ID NO: 2092363 - RNA, 19 nt, Human
ggaccucaggugagaagca

SEQ ID NO: 2092364 - RNA, 23 nt, Human
ggaccucaggugagaagcagagg

SEQ ID NO: 2092365 - RNA, 13 nt, Human
ggaccuccugagc

SEQ ID NO: 2092366 - RNA, 18 nt, Human
ggaagguuuguauauugu

SEQ ID NO: 2092367 - RNA, 21 nt, Human
ggaaggggcccgugggaguca

SEQ ID NO: 2092368 - RNA, 18 nt, Human
ggaaggggcccgugggag

SEQ ID NO: 2092369 - RNA, 17 nt, Human
ggaaggggcuggacugg

SEQ ID NO: 2092370 - RNA, 20 nt, Human
ggaaggggcuggacuggcug

SEQ ID NO: 2092371 - RNA, 18 nt, Human
ggaaggguuuguggcugg

SEQ ID NO: 2092372 - RNA, 16 nt, Human
ggaaguguaacagcug

SEQ ID NO: 2092373 - RNA, 17 nt, Human
ggaaguguaacagcuga

SEQ ID NO: 2092374 - RNA, 18 nt, Human
ggaagugacaaggcccca

SEQ ID NO: 2092375 - RNA, 19 nt, Human
ggaagugacaaggccccag

SEQ ID NO: 2092376 - RNA, 22 nt, Human
ggaagugacaaggccccagaga

SEQ ID NO: 2092377 - RNA, 21 nt, Human
ggaagugacaaggccccagag

SEQ ID NO: 2092378 - RNA, 21 nt, Human
ggaagugagggucagagagga

SEQ ID NO: 2092379 - RNA, 18 nt, Human
ggaaguccccaggcccca

SEQ ID NO: 2092380 - RNA, 21 nt, Human
ggaaguccccaggccccagga

SEQ ID NO: 2092381 - RNA, 23 nt, Human
ggaaguccccaggccccaggaag

SEQ ID NO: 2092382 - RNA, 14 nt, Human
ggaagucuaggagc

SEQ ID NO: 2092383 - RNA, 23 nt, Human
ggaagugaagagggagaagggau

SEQ ID NO: 2092384 - RNA, 17 nt, Human
ggaagucuaggagcugg

SEQ ID NO: 2092385 - RNA, 17 nt, Human
ggaagugacaaggcccc

SEQ ID NO: 2092386 - RNA, 13 nt, Human
ggaacgcagauga

SEQ ID NO: 2092387 - RNA, 13 nt, Human
ggaaccuggacca

SEQ ID NO: 2092388 - RNA, 18 nt, Human
ggaaccuggaccaaagcu

SEQ ID NO: 2092389 - RNA, 19 nt, Human
ggaaccuggaccaaagcug

SEQ ID NO: 2092390 - RNA, 14 nt, Human
ggaaggccaccugc

SEQ ID NO: 2092391 - RNA, 17 nt, Human
ggaaggccaccugcagg

SEQ ID NO: 2092392 - RNA, 18 nt, Human
ggaaggccaccugcaggu

SEQ ID NO: 2092393 - RNA, 23 nt, Human
ggaaggccaccugcaggucacug

SEQ ID NO: 2092394 - RNA, 19 nt, Human
ggaaggcaugccuggacaa

SEQ ID NO: 2092395 - RNA, 17 nt, Human
ggaaggcugagaggaga

SEQ ID NO: 2092396 - RNA, 14 nt, Human
ggaaggcuggcugg

SEQ ID NO: 2092397 - RNA, 17 nt, Human
ggaaggcuggcugggca

SEQ ID NO: 2092398 - RNA, 21 nt, Human
ggaagggcaggaaggagagcc

SEQ ID NO: 2092399 - RNA, 16 nt, Human
ggaagggacuaggagc

SEQ ID NO: 2092400 - RNA, 14 nt, Human
ggaagggcaaaacc

SEQ ID NO: 2092401 - RNA, 12 nt, Human
ggaagggcagga

SEQ ID NO: 2092402 - RNA, 15 nt, Human
ggaagggcaggaagg

SEQ ID NO: 2092403 - RNA, 15 nt, Human
ggacaaacccuucuu

SEQ ID NO: 2092404 - RNA, 17 nt, Human
ggacaaauuuaaaacaa

SEQ ID NO: 2092405 - RNA, 15 nt, Human
ggacaaagucuccag

SEQ ID NO: 2092406 - RNA, 16 nt, Human
ggacaaagucuccagc

SEQ ID NO: 2092407 - RNA, 17 nt, Human
ggacaaagucuccagcc

SEQ ID NO: 2092408 - RNA, 18 nt, Human
ggacaaagucuccagccc

SEQ ID NO: 2092409 - RNA, 19 nt, Human
ggacaaagucuccagccca

SEQ ID NO: 2092410 - RNA, 20 nt, Human
ggacaaagucuccagcccac

SEQ ID NO: 2092411 - RNA, 21 nt, Human
ggacaaagucuccagcccacg

SEQ ID NO: 2092412 - RNA, 24 nt, Human
ggacaaagucuccagcccacguuc

SEQ ID NO: 2092413 - RNA, 15 nt, Human
ggaauuuuuuauucu

SEQ ID NO: 2092414 - RNA, 17 nt, Human
ggaauuuuuuauucuug

SEQ ID NO: 2092415 - RNA, 20 nt, Human
ggaauuuuuuauucuuguga

SEQ ID NO: 2092416 - RNA, 21 nt, Human
ggaauugguggcagauuuuac

SEQ ID NO: 2092417 - RNA, 23 nt, Human
ggaauugguggcagauuuuacaa

SEQ ID NO: 2092418 - RNA, 20 nt, Human
ggaauugcuuaccaaaggau

SEQ ID NO: 2092419 - RNA, 19 nt, Human
ggaauguuugccucugccu

SEQ ID NO: 2092420 - RNA, 16 nt, Human
ggaauguuaaagucag

SEQ ID NO: 2092421 - RNA, 13 nt, Human
ggaauuaaaacaa

SEQ ID NO: 2092422 - RNA, 14 nt, Human
ggaauuaaaacaau

SEQ ID NO: 2092423 - RNA, 17 nt, Human
ggaauuaaaacaauguc

SEQ ID NO: 2092424 - RNA, 14 nt, Human
ggaauuaaccuggu

SEQ ID NO: 2092425 - RNA, 16 nt, Human
ggaauuaaccuggugc

SEQ ID NO: 2092426 - RNA, 17 nt, Human
ggaauuaaccuggugcu

SEQ ID NO: 2092427 - RNA, 19 nt, Human
ggaauuacauguaaaacau

SEQ ID NO: 2092428 - RNA, 20 nt, Human
ggaauuaaccuggugcugga

SEQ ID NO: 2092429 - RNA, 20 nt, Human
ggaauucaucucucuuuaau

SEQ ID NO: 2092430 - RNA, 13 nt, Human
ggaauucucuugg

SEQ ID NO: 2092431 - RNA, 22 nt, Human
ggaauucucuuggcuggcuucc

SEQ ID NO: 2092432 - RNA, 20 nt, Human
ggaauugacuucgacuguga

SEQ ID NO: 2092433 - RNA, 12 nt, Human
ggaaugcagugg

SEQ ID NO: 2092434 - RNA, 19 nt, Human
ggaaguguaacagcugagg

SEQ ID NO: 2092435 - RNA, 21 nt, Human
ggaaguguaacagcugagguc

SEQ ID NO: 2092436 - RNA, 14 nt, Human
ggaaugcggcaaga

SEQ ID NO: 2092437 - RNA, 16 nt, Human
ggaaugcggcaagaag

SEQ ID NO: 2092438 - RNA, 22 nt, Human
ggaaugcggccgcauucccuga

SEQ ID NO: 2092439 - RNA, 23 nt, Human
ggaaugcggccgcauucccugag

SEQ ID NO: 2092440 - RNA, 13 nt, Human
ggaaugcuccccc

SEQ ID NO: 2092441 - RNA, 23 nt, Human
ggaaugcucccccauccuccccu

SEQ ID NO: 2092442 - RNA, 23 nt, Human
ggaaugcauuauuuauugcugug

SEQ ID NO: 2092443 - RNA, 14 nt, Human
ggaaugucuuuggu

SEQ ID NO: 2092444 - RNA, 15 nt, Human
ggaauggcacagccc

SEQ ID NO: 2092445 - RNA, 15 nt, Human
ggaaugcuuggaaua

SEQ ID NO: 2092446 - RNA, 16 nt, Human
gccucagccuccugag

SEQ ID NO: 2092447 - RNA, 18 nt, Human
gccucagccuccugagua

SEQ ID NO: 2092448 - RNA, 23 nt, Human
gccucagccucccaaagugcugg

SEQ ID NO: 2092449 - RNA, 23 nt, Human
gccucagaauugaucauuuuccc

SEQ ID NO: 2092450 - RNA, 22 nt, Human
gccucaacccucccucagcccc

SEQ ID NO: 2092451 - RNA, 23 nt, Human
gccucaacccucccucagccccu

SEQ ID NO: 2092452 - RNA, 18 nt, Human
gccucacuugaauguguc

SEQ ID NO: 2092453 - RNA, 20 nt, Human
gccucacuugaaugugucac

SEQ ID NO: 2092454 - RNA, 16 nt, Human
gccucacuugaaugug

SEQ ID NO: 2092455 - RNA, 16 nt, Human
gccucacuccaggaag

SEQ ID NO: 2092456 - RNA, 14 nt, Human
gccucagugccacu

SEQ ID NO: 2092457 - RNA, 12 nt, Human
gccucagugcca

SEQ ID NO: 2092458 - RNA, 20 nt, Human
gccucagcugccucacuucc

SEQ ID NO: 2092459 - RNA, 16 nt, Human
gccucagcugccucac

SEQ ID NO: 2092460 - RNA, 19 nt, Human
gccucagcugccucacuuc

SEQ ID NO: 2092461 - RNA, 14 nt, Human
gccucagcugccuc

SEQ ID NO: 2092462 - RNA, 15 nt, Human
gccucagcugccuca

SEQ ID NO: 2092463 - RNA, 18 nt, Human
gccucagggcagccugcc

SEQ ID NO: 2092464 - RNA, 21 nt, Human
gccucagggcagccugccugg

SEQ ID NO: 2092465 - RNA, 22 nt, Human
gccucagggcagccugccugga

SEQ ID NO: 2092466 - RNA, 23 nt, Human
gccucagggcagccugccuggag

SEQ ID NO: 2092467 - RNA, 21 nt, Human
gccucaagugauucuccugcc

SEQ ID NO: 2092468 - RNA, 20 nt, Human
gccucaagugauucuccugc

SEQ ID NO: 2092469 - RNA, 19 nt, Human
gccucaagugauucuccug

SEQ ID NO: 2092470 - RNA, 17 nt, Human
gccucaaccuccugggc

SEQ ID NO: 2092471 - RNA, 18 nt, Human
gccucaacccucccucag

SEQ ID NO: 2092472 - RNA, 19 nt, Human
gccucaacccucccucagc

SEQ ID NO: 2092473 - RNA, 21 nt, Human
gccucaacccucccucagccc

SEQ ID NO: 2092474 - RNA, 16 nt, Human
gccucaaccuccuggg

SEQ ID NO: 2092475 - RNA, 14 nt, Human
gccucaaccuccug

SEQ ID NO: 2092476 - RNA, 13 nt, Human
gccuauaguccca

SEQ ID NO: 2092477 - RNA, 16 nt, Human
gccgaggguccuggcu

SEQ ID NO: 2092478 - RNA, 16 nt, Human
gccuaaguggcugcug

SEQ ID NO: 2092479 - RNA, 17 nt, Human
gccuaaguggcugcuga

SEQ ID NO: 2092480 - RNA, 16 nt, Human
gccuaauacauuaaag

SEQ ID NO: 2092481 - RNA, 17 nt, Human
gccuaauacauuaaagc

SEQ ID NO: 2092482 - RNA, 18 nt, Human
gccuaauacauuaaagca

SEQ ID NO: 2092483 - RNA, 19 nt, Human
gccuaauacauuaaagcag

SEQ ID NO: 2092484 - RNA, 20 nt, Human
gccuaauacauuaaagcagu

SEQ ID NO: 2092485 - RNA, 21 nt, Human
gccuaauacauuaaagcaguc

SEQ ID NO: 2092486 - RNA, 21 nt, Human
gccucccacgacugcccggca

SEQ ID NO: 2092487 - RNA, 17 nt, Human
gccucccacccccaucu

SEQ ID NO: 2092488 - RNA, 14 nt, Human
gccucccacgacug

SEQ ID NO: 2092489 - RNA, 21 nt, Human
gccucccgaauagcugggacu

SEQ ID NO: 2092490 - RNA, 15 nt, Human
gccucagugccacua

SEQ ID NO: 2092491 - RNA, 11 nt, Human
gccucagugga

SEQ ID NO: 2092492 - RNA, 21 nt, Human
gccucaguggacuuuccaccc

SEQ ID NO: 2092493 - RNA, 22 nt, Human
gccucaguggacuuuccacccc

SEQ ID NO: 2092494 - RNA, 16 nt, Human
gccucauccgaggcag

SEQ ID NO: 2092495 - RNA, 17 nt, Human
gccucauccgaggcagg

SEQ ID NO: 2092496 - RNA, 12 nt, Human
gccucccacccc

SEQ ID NO: 2092497 - RNA, 22 nt, Human
gccucauccgaggcagggucag

SEQ ID NO: 2092498 - RNA, 18 nt, Human
gccucauccgaggcaggg

SEQ ID NO: 2092499 - RNA, 19 nt, Human
gccucauccgaggcagggu

SEQ ID NO: 2092500 - RNA, 15 nt, Human
gccucccgaguagcu

SEQ ID NO: 2092501 - RNA, 23 nt, Human
gccucccgaauagcugggacuac

SEQ ID NO: 2092502 - RNA, 17 nt, Human
gccucccgaguagcugg

SEQ ID NO: 2092503 - RNA, 14 nt, Human
gccucggagccuca

SEQ ID NO: 2092504 - RNA, 15 nt, Human
gccucggagccucau

SEQ ID NO: 2092505 - RNA, 17 nt, Human
gccucggagccucaucc

SEQ ID NO: 2092506 - RNA, 23 nt, Human
gccucggagccucauccgaggca

SEQ ID NO: 2092507 - RNA, 14 nt, Human
gccucucccuggcc

SEQ ID NO: 2092508 - RNA, 15 nt, Human
gccucucccuggccc

SEQ ID NO: 2092509 - RNA, 16 nt, Human
gccucucccuggcccu

SEQ ID NO: 2092510 - RNA, 17 nt, Human
gccuggcauggcaccug

SEQ ID NO: 2092511 - RNA, 22 nt, Human
gccuggaggccgggugcucagg

SEQ ID NO: 2092512 - RNA, 15 nt, Human
gccuggccagaugca

SEQ ID NO: 2092513 - RNA, 14 nt, Human
gccuggccagaugc

SEQ ID NO: 2092514 - RNA, 23 nt, Human
gccuggccaggcagaucugugcc

SEQ ID NO: 2092515 - RNA, 15 nt, Human
gccuggccaggcaga

SEQ ID NO: 2092516 - RNA, 17 nt, Human
gccuggccaggcagauc

SEQ ID NO: 2092517 - RNA, 14 nt, Human
gccuggccaggagc

SEQ ID NO: 2092518 - RNA, 15 nt, Human
gccuggccaggagcu

SEQ ID NO: 2092519 - RNA, 19 nt, Human
gccuggccaggagcucuuc

SEQ ID NO: 2092520 - RNA, 14 nt, Human
gccuggccaggcag

SEQ ID NO: 2092521 - RNA, 20 nt, Human
gccugggugacagagcaaga

SEQ ID NO: 2092522 - RNA, 12 nt, Human
gccugggugcug

SEQ ID NO: 2092523 - RNA, 14 nt, Human
gccugggugcuggc

SEQ ID NO: 2092524 - RNA, 14 nt, Human
gccugggucugugu

SEQ ID NO: 2092525 - RNA, 16 nt, Human
gccugggucugugucu

SEQ ID NO: 2092526 - RNA, 19 nt, Human
gccugggucugugucucuu

SEQ ID NO: 2092527 - RNA, 23 nt, Human
gccugggucugugucucuuuucu

SEQ ID NO: 2092528 - RNA, 23 nt, Human
gccugggugacaaagugagacuc

SEQ ID NO: 2092529 - RNA, 18 nt, Human
gccuggguggggcugcuc

SEQ ID NO: 2092530 - RNA, 19 nt, Human
gccuggguggggcugcucc

SEQ ID NO: 2092531 - RNA, 20 nt, Human
gccuggguggggcugcuccu

SEQ ID NO: 2092532 - RNA, 22 nt, Human
gccuggguggggcugcuccucc

SEQ ID NO: 2092533 - RNA, 15 nt, Human
gccugggugcuggcu

SEQ ID NO: 2092534 - RNA, 17 nt, Human
gccugggugcuggcugc

SEQ ID NO: 2092535 - RNA, 20 nt, Human
gccugggugcuggcugccca

SEQ ID NO: 2092536 - RNA, 21 nt, Human
gccugggugcuggcugcccag

SEQ ID NO: 2092537 - RNA, 15 nt, Human
gccuggguggggcug

SEQ ID NO: 2092538 - RNA, 16 nt, Human
gccuggguggggcugc

SEQ ID NO: 2092539 - RNA, 14 nt, Human
gccuguaguuagga

SEQ ID NO: 2092540 - RNA, 16 nt, Human
gccuguaguuaggaaa

SEQ ID NO: 2092541 - RNA, 17 nt, Human
gccuguaguuaggaaau

SEQ ID NO: 2092542 - RNA, 18 nt, Human
gccuguaguuaggaaaua

SEQ ID NO: 2092543 - RNA, 19 nt, Human
gccuguaguuaggaaauaa

SEQ ID NO: 2092544 - RNA, 22 nt, Human
gccuguaguuaggaaauaaaac

SEQ ID NO: 2092545 - RNA, 23 nt, Human
gccuguaguuaggaaauaaaacc

SEQ ID NO: 2092546 - RNA, 15 nt, Human
gccugcuccagcugu

SEQ ID NO: 2092547 - RNA, 12 nt, Human
gccugcaccagg

SEQ ID NO: 2092548 - RNA, 13 nt, Human
gccugcaccagga

SEQ ID NO: 2092549 - RNA, 14 nt, Human
gccugcaccaggag

SEQ ID NO: 2092550 - RNA, 15 nt, Human
gccugcaccaggaga

SEQ ID NO: 2092551 - RNA, 16 nt, Human
gccugcaccaggagac

SEQ ID NO: 2092552 - RNA, 21 nt, Human
gccugcaccaggagacagaca

SEQ ID NO: 2092553 - RNA, 20 nt, Human
gccugaugcucccuccccug

SEQ ID NO: 2092554 - RNA, 22 nt, Human
gccugcuuuagaauguuuuccu

SEQ ID NO: 2092555 - RNA, 16 nt, Human
gccugcuccagcuguu

SEQ ID NO: 2092556 - RNA, 18 nt, Human
gccugcuccagcuguuca

SEQ ID NO: 2092557 - RNA, 13 nt, Human
gccucugccuguc

SEQ ID NO: 2092558 - RNA, 19 nt, Human
gccucucgguggccagcag

SEQ ID NO: 2092559 - RNA, 13 nt, Human
gccucugccugug

SEQ ID NO: 2092560 - RNA, 16 nt, Human
gccucugccugugcac

SEQ ID NO: 2092561 - RNA, 11 nt, Human
gccucugcugc

SEQ ID NO: 2092562 - RNA, 18 nt, Human
gccugaaguuggagugag

SEQ ID NO: 2092563 - RNA, 22 nt, Human
gccugaagucacacagugaguc

SEQ ID NO: 2092564 - RNA, 12 nt, Human
gccucugccugu

SEQ ID NO: 2092565 - RNA, 14 nt, Human
gccugaugcucccu

SEQ ID NO: 2092566 - RNA, 16 nt, Human
gccugaugcucccucc

SEQ ID NO: 2092567 - RNA, 17 nt, Human
gccugaugcucccuccc

SEQ ID NO: 2092568 - RNA, 19 nt, Human
gccugaugcucccuccccu

SEQ ID NO: 2092569 - RNA, 21 nt, Human
gcccuuugggaggcugaggcg

SEQ ID NO: 2092570 - RNA, 16 nt, Human
gccgagaucacgccac

SEQ ID NO: 2092571 - RNA, 17 nt, Human
gcccuuugggaggcuga

SEQ ID NO: 2092572 - RNA, 16 nt, Human
gcccuuucuguaccau

SEQ ID NO: 2092573 - RNA, 22 nt, Human
gcccuuucuguaccauuuauuu

SEQ ID NO: 2092574 - RNA, 19 nt, Human
gccgagaucacgccacugc

SEQ ID NO: 2092575 - RNA, 18 nt, Human
gccgagaucacgccacug

SEQ ID NO: 2092576 - RNA, 18 nt, Human
gccgagauugcaccacug

SEQ ID NO: 2092577 - RNA, 17 nt, Human
gccgagauugcaccacu

SEQ ID NO: 2092578 - RNA, 20 nt, Human
gcccuuccucuccacugccu

SEQ ID NO: 2092579 - RNA, 19 nt, Human
gcccuuccucuccacugcc

SEQ ID NO: 2092580 - RNA, 18 nt, Human
gcccuuccucuccacugc

SEQ ID NO: 2092581 - RNA, 16 nt, Human
gcccuuccucuccacu

SEQ ID NO: 2092582 - RNA, 17 nt, Human
gcccuuccucuccacug

SEQ ID NO: 2092583 - RNA, 21 nt, Human
gcccuuccucuccacugccuu

SEQ ID NO: 2092584 - RNA, 16 nt, Human
gcccugguuucacugg

SEQ ID NO: 2092585 - RNA, 18 nt, Human
gcccugguuucacuggcc

SEQ ID NO: 2092586 - RNA, 20 nt, Human
gcccugguuucacuggccca

SEQ ID NO: 2092587 - RNA, 22 nt, Human
gcccugguuucacuggcccaag

SEQ ID NO: 2092588 - RNA, 14 nt, Human
gcccugucagugca

SEQ ID NO: 2092589 - RNA, 15 nt, Human
gcccugucagugcag

SEQ ID NO: 2092590 - RNA, 21 nt, Human
gcccuguaucaacccagaaac

SEQ ID NO: 2092591 - RNA, 22 nt, Human
gcccuguaucaacccagaaaca

SEQ ID NO: 2092592 - RNA, 23 nt, Human
gcccugguggcagugggagcugc

SEQ ID NO: 2092593 - RNA, 22 nt, Human
gcccugguggcagugggagcug

SEQ ID NO: 2092594 - RNA, 21 nt, Human
gcccugguggcagugggagcu

SEQ ID NO: 2092595 - RNA, 20 nt, Human
gcccugguggcagugggagc

SEQ ID NO: 2092596 - RNA, 19 nt, Human
gcccugguggcagugggag

SEQ ID NO: 2092597 - RNA, 18 nt, Human
gcccugguggcaguggga

SEQ ID NO: 2092598 - RNA, 17 nt, Human
gcccugguggcaguggg

SEQ ID NO: 2092599 - RNA, 14 nt, Human
gcccugguggcagu

SEQ ID NO: 2092600 - RNA, 16 nt, Human
gcccuggccagaggcu

SEQ ID NO: 2092601 - RNA, 13 nt, Human
gcccuggccagag

SEQ ID NO: 2092602 - RNA, 14 nt, Human
gcccuggccagagg

SEQ ID NO: 2092603 - RNA, 15 nt, Human
gcccuggccagaggc

SEQ ID NO: 2092604 - RNA, 19 nt, Human
gcccuggcaggaugacccu

SEQ ID NO: 2092605 - RNA, 12 nt, Human
gcccuggcagga

SEQ ID NO: 2092606 - RNA, 20 nt, Human
gcccuggcucccacaggccc

SEQ ID NO: 2092607 - RNA, 19 nt, Human
gcccuggcucccacaggcc

SEQ ID NO: 2092608 - RNA, 15 nt, Human
gcccuggcucccaca

SEQ ID NO: 2092609 - RNA, 17 nt, Human
gcccuggccugcugggc

SEQ ID NO: 2092610 - RNA, 15 nt, Human
gcccuggccugcugg

SEQ ID NO: 2092611 - RNA, 16 nt, Human
gcccuggccugcuggg

SEQ ID NO: 2092612 - RNA, 12 nt, Human
gcccuggccugc

SEQ ID NO: 2092613 - RNA, 13 nt, Human
gcccuggccugcu

SEQ ID NO: 2092614 - RNA, 14 nt, Human
gcccuggccugcug

SEQ ID NO: 2092615 - RNA, 21 nt, Human
gcccuggugcugccacacuuc

SEQ ID NO: 2092616 - RNA, 17 nt, Human
gcccuggugcugccaca

SEQ ID NO: 2092617 - RNA, 16 nt, Human
gcccuggugcugccac

SEQ ID NO: 2092618 - RNA, 15 nt, Human
gcccuggugcugcca

SEQ ID NO: 2092619 - RNA, 16 nt, Human
gcccugguccagggaa

SEQ ID NO: 2092620 - RNA, 17 nt, Human
gcccugguccagggaag

SEQ ID NO: 2092621 - RNA, 18 nt, Human
gcccugguccagggaagc

SEQ ID NO: 2092622 - RNA, 20 nt, Human
gcccugguccagggaagcug

SEQ ID NO: 2092623 - RNA, 23 nt, Human
gcccugguccagggaagcuggcc

SEQ ID NO: 2092624 - RNA, 15 nt, Human
gcccugguccuucca

SEQ ID NO: 2092625 - RNA, 18 nt, Human
gcccugguccuuccaggc

SEQ ID NO: 2092626 - RNA, 13 nt, Human
gcccuggggccug

SEQ ID NO: 2092627 - RNA, 14 nt, Human
gcccuggggccugu

SEQ ID NO: 2092628 - RNA, 15 nt, Human
gcccuggggccugua

SEQ ID NO: 2092629 - RNA, 17 nt, Human
gcccuggggccuguaca

SEQ ID NO: 2092630 - RNA, 15 nt, Human
gcccuggggcugauc

SEQ ID NO: 2092631 - RNA, 19 nt, Human
gcccuggggcugaucucag

SEQ ID NO: 2092632 - RNA, 20 nt, Human
gcccuggggcugaucucagg

SEQ ID NO: 2092633 - RNA, 21 nt, Human
gcccuggggcugaucucaggg

SEQ ID NO: 2092634 - RNA, 21 nt, Human
gcccugggucuaagggguugg

SEQ ID NO: 2092635 - RNA, 13 nt, Human
gcccugguccagg

SEQ ID NO: 2092636 - RNA, 14 nt, Human
gcccugguccaggg

SEQ ID NO: 2092637 - RNA, 20 nt, Human
gcccugggccccaccaccua

SEQ ID NO: 2092638 - RNA, 22 nt, Human
gcccugggccccaccaccuagg

SEQ ID NO: 2092639 - RNA, 15 nt, Human
gcccugggccccacc

SEQ ID NO: 2092640 - RNA, 18 nt, Human
gcccugggccccaccacc

SEQ ID NO: 2092641 - RNA, 19 nt, Human
gcccugggccccaccaccu

SEQ ID NO: 2092642 - RNA, 14 nt, Human
gcagaaguguuuca

SEQ ID NO: 2092643 - RNA, 16 nt, Human
gcccugagcuuucugc

SEQ ID NO: 2092644 - RNA, 18 nt, Human
gcccggcuccaggcuccu

SEQ ID NO: 2092645 - RNA, 17 nt, Human
gcccggcuccaggcucc

SEQ ID NO: 2092646 - RNA, 17 nt, Human
gcccucgugguggaaac

SEQ ID NO: 2092647 - RNA, 23 nt, Human
gcccucgugguggaaacuuuucu

SEQ ID NO: 2092648 - RNA, 18 nt, Human
gcccucgggcgagucacu

SEQ ID NO: 2092649 - RNA, 19 nt, Human
gcccugcuuugggcugccc

SEQ ID NO: 2092650 - RNA, 21 nt, Human
gcccugcuuugggcugcccug

SEQ ID NO: 2092651 - RNA, 20 nt, Human
gcccugcuuugggcugcccu

SEQ ID NO: 2092652 - RNA, 19 nt, Human
gcccugauugcgcaaaacu

SEQ ID NO: 2092653 - RNA, 21 nt, Human
gcccugaggugaaagggagcu

SEQ ID NO: 2092654 - RNA, 22 nt, Human
gcccugaggugaaagggagcua

SEQ ID NO: 2092655 - RNA, 23 nt, Human
gcccugcuuugggcugcccuggu

SEQ ID NO: 2092656 - RNA, 22 nt, Human
gcccugcuuugggcugcccugg

SEQ ID NO: 2092657 - RNA, 18 nt, Human
gcccuggauuucagaaag

SEQ ID NO: 2092658 - RNA, 19 nt, Human
gcccgcaugcggcccagga

SEQ ID NO: 2092659 - RNA, 17 nt, Human
gcccgcaugcggcccag

SEQ ID NO: 2092660 - RNA, 13 nt, Human
gcccgagcuggug

SEQ ID NO: 2092661 - RNA, 14 nt, Human
gcccgagcuggugc

SEQ ID NO: 2092662 - RNA, 15 nt, Human
gcccgagcuggugca

SEQ ID NO: 2092663 - RNA, 19 nt, Human
gcccgcaugcagcagcuug

SEQ ID NO: 2092664 - RNA, 22 nt, Human
gcccgcaugcagcagcuugcug

SEQ ID NO: 2092665 - RNA, 12 nt, Human
gcccgagcuggu

SEQ ID NO: 2092666 - RNA, 19 nt, Human
gcccgacagccuggcacag

SEQ ID NO: 2092667 - RNA, 17 nt, Human
gcccgacagccuggcac

SEQ ID NO: 2092668 - RNA, 16 nt, Human
gcccgacagccuggca

SEQ ID NO: 2092669 - RNA, 12 nt, Human
gccccuuccccc

SEQ ID NO: 2092670 - RNA, 20 nt, Human
gccccuucacuucugaccac

SEQ ID NO: 2092671 - RNA, 21 nt, Human
gccccuucacuucugaccaca

SEQ ID NO: 2092672 - RNA, 23 nt, Human
gccccuucacuucugaccacacu

SEQ ID NO: 2092673 - RNA, 16 nt, Human
gcccggcuccaggcuc

SEQ ID NO: 2092674 - RNA, 21 nt, Human
gcccggcgcgguggcucacgc

SEQ ID NO: 2092675 - RNA, 14 nt, Human
gcccggaugcuucu

SEQ ID NO: 2092676 - RNA, 14 nt, Human
gcccgccuggcaga

SEQ ID NO: 2092677 - RNA, 18 nt, Human
gcccgccuggcagaacug

SEQ ID NO: 2092678 - RNA, 17 nt, Human
gcccggauucugggagg

SEQ ID NO: 2092679 - RNA, 15 nt, Human
gcccggauucuggga

SEQ ID NO: 2092680 - RNA, 16 nt, Human
gcccggauucugggag

SEQ ID NO: 2092681 - RNA, 13 nt, Human
gcccgccuggcag

SEQ ID NO: 2092682 - RNA, 15 nt, Human
gccccugccacccug

SEQ ID NO: 2092683 - RNA, 14 nt, Human
gccccugccacccu

SEQ ID NO: 2092684 - RNA, 23 nt, Human
gccccuccucugccaccuccccu

SEQ ID NO: 2092685 - RNA, 22 nt, Human
gccccuccucugccaccucccc

SEQ ID NO: 2092686 - RNA, 13 nt, Human
gccccugccaccc

SEQ ID NO: 2092687 - RNA, 14 nt, Human
gccccucucuccau

SEQ ID NO: 2092688 - RNA, 18 nt, Human
gcagacucaguuugucag

SEQ ID NO: 2092689 - RNA, 12 nt, Human
gccccuccucug

SEQ ID NO: 2092690 - RNA, 13 nt, Human
gccccuccucugc

SEQ ID NO: 2092691 - RNA, 14 nt, Human
gccccuccucugcc

SEQ ID NO: 2092692 - RNA, 15 nt, Human
gccccuccucugcca

SEQ ID NO: 2092693 - RNA, 16 nt, Human
gccccuccucugccac

SEQ ID NO: 2092694 - RNA, 17 nt, Human
gccccuccucugccacc

SEQ ID NO: 2092695 - RNA, 18 nt, Human
gccccuccucugccaccu

SEQ ID NO: 2092696 - RNA, 20 nt, Human
gccccuccucugccaccucc

SEQ ID NO: 2092697 - RNA, 21 nt, Human
gccccuccucugccaccuccc

SEQ ID NO: 2092698 - RNA, 15 nt, Human
gccccucccuucaac

SEQ ID NO: 2092699 - RNA, 14 nt, Human
gccccucccuucaa

SEQ ID NO: 2092700 - RNA, 12 nt, Human
gccccucccuuc

SEQ ID NO: 2092701 - RNA, 15 nt, Human
gcagacucuacagag

SEQ ID NO: 2092702 - RNA, 17 nt, Human
gcagacucaguuuguca

SEQ ID NO: 2092703 - RNA, 20 nt, Human
gcagacucaauaaaaucaug

SEQ ID NO: 2092704 - RNA, 22 nt, Human
gcugccaaggccagaguggccu

SEQ ID NO: 2092705 - RNA, 23 nt, Human
gcugccaaggccagaguggccug

SEQ ID NO: 2092706 - RNA, 13 nt, Human
gcugcauagaagg

SEQ ID NO: 2092707 - RNA, 14 nt, Human
gcugcauagaagga

SEQ ID NO: 2092708 - RNA, 15 nt, Human
gcugcauagaaggag

SEQ ID NO: 2092709 - RNA, 18 nt, Human
gcugcauagaaggaggag

SEQ ID NO: 2092710 - RNA, 16 nt, Human
gcugcauccgugagca

SEQ ID NO: 2092711 - RNA, 21 nt, Human
gcugcauccgugagcagugug

SEQ ID NO: 2092712 - RNA, 15 nt, Human
gcugcaucuacucag

SEQ ID NO: 2092713 - RNA, 22 nt, Human
gcugcauggggugggguagggc

SEQ ID NO: 2092714 - RNA, 21 nt, Human
gcugcauugccugcggucaag

SEQ ID NO: 2092715 - RNA, 15 nt, Human
gcugaugcucauggu

SEQ ID NO: 2092716 - RNA, 13 nt, Human
gcugauaaaagau

SEQ ID NO: 2092717 - RNA, 21 nt, Human
gcugauaaaagauacauuugu

SEQ ID NO: 2092718 - RNA, 22 nt, Human
gcugagugggggaucacagccu

SEQ ID NO: 2092719 - RNA, 23 nt, Human
gcugagugggggaucacagccuc

SEQ ID NO: 2092720 - RNA, 13 nt, Human
gcugaguuggugu

SEQ ID NO: 2092721 - RNA, 21 nt, Human
gcugacuguacuccucccagg

SEQ ID NO: 2092722 - RNA, 18 nt, Human
gcugacugauguugaggg

SEQ ID NO: 2092723 - RNA, 12 nt, Human
gcugagugagcu

SEQ ID NO: 2092724 - RNA, 15 nt, Human
gcugagugagcugaa

SEQ ID NO: 2092725 - RNA, 12 nt, Human
gcucuucuccag

SEQ ID NO: 2092726 - RNA, 15 nt, Human
gcucuggaagagagg

SEQ ID NO: 2092727 - RNA, 16 nt, Human
gcucuucuccaggcug

SEQ ID NO: 2092728 - RNA, 14 nt, Human
gcucuucuccaggc

SEQ ID NO: 2092729 - RNA, 21 nt, Human
gcucuucuccuuucacaaccu

SEQ ID NO: 2092730 - RNA, 17 nt, Human
gcucuucuccuuucaca

SEQ ID NO: 2092731 - RNA, 13 nt, Human
gcucuucuccuuu

SEQ ID NO: 2092732 - RNA, 23 nt, Human
gcucuucuccuuucacaaccuuc

SEQ ID NO: 2092733 - RNA, 21 nt, Human
gcugacagacacaggcccggc

SEQ ID NO: 2092734 - RNA, 21 nt, Human
gcucuuuaugaaugaaaaaac

SEQ ID NO: 2092735 - RNA, 15 nt, Human
gcugacuagaagggc

SEQ ID NO: 2092736 - RNA, 23 nt, Human
gcugacuagaagggccaguccug

SEQ ID NO: 2092737 - RNA, 14 nt, Human
gcugaccuccacag

SEQ ID NO: 2092738 - RNA, 15 nt, Human
gcugaccuccacagc

SEQ ID NO: 2092739 - RNA, 16 nt, Human
gcugaccuccacagcu

SEQ ID NO: 2092740 - RNA, 17 nt, Human
gcugaccuccacagcuu

SEQ ID NO: 2092741 - RNA, 18 nt, Human
gcugaccucccagugacc

SEQ ID NO: 2092742 - RNA, 19 nt, Human
gcugacuguacuccuccca

SEQ ID NO: 2092743 - RNA, 18 nt, Human
gcugacuguacuccuccc

SEQ ID NO: 2092744 - RNA, 23 nt, Human
gcugacucuaggugcccuuggag

SEQ ID NO: 2092745 - RNA, 20 nt, Human
gcugacugauguugagggaa

SEQ ID NO: 2092746 - RNA, 13 nt, Human
gcugaccccccuc

SEQ ID NO: 2092747 - RNA, 19 nt, Human
gcugaccccccucaggacc

SEQ ID NO: 2092748 - RNA, 21 nt, Human
gcugaccccccucaggacccu

SEQ ID NO: 2092749 - RNA, 17 nt, Human
gcugacccagucccugg

SEQ ID NO: 2092750 - RNA, 19 nt, Human
gcugacccagucccugggg

SEQ ID NO: 2092751 - RNA, 13 nt, Human
gcugacccagucc

SEQ ID NO: 2092752 - RNA, 15 nt, Human
gcugacccagucccu

SEQ ID NO: 2092753 - RNA, 16 nt, Human
gcugacccagucccug

SEQ ID NO: 2092754 - RNA, 22 nt, Human
gcugacccagccccuugagaaa

SEQ ID NO: 2092755 - RNA, 20 nt, Human
gcucgagcaguccugccuca

SEQ ID NO: 2092756 - RNA, 21 nt, Human
gcucgagcaguccugccucag

SEQ ID NO: 2092757 - RNA, 13 nt, Human
gcucuccaccuca

SEQ ID NO: 2092758 - RNA, 14 nt, Human
gcucuccaccucag

SEQ ID NO: 2092759 - RNA, 15 nt, Human
gcucuccaccucagc

SEQ ID NO: 2092760 - RNA, 16 nt, Human
gcucuccaccucagcc

SEQ ID NO: 2092761 - RNA, 17 nt, Human
gcucuccaccucagccu

SEQ ID NO: 2092762 - RNA, 18 nt, Human
gcucuccaccucagccuu

SEQ ID NO: 2092763 - RNA, 19 nt, Human
gcucuccaccucagccuug

SEQ ID NO: 2092764 - RNA, 16 nt, Human
gcucuccccugcccug

SEQ ID NO: 2092765 - RNA, 21 nt, Human
gcucuccaccucagccuugga

SEQ ID NO: 2092766 - RNA, 20 nt, Human
gcucuccaccucagccuugg

SEQ ID NO: 2092767 - RNA, 21 nt, Human
gcuccuugggaggccccacug

SEQ ID NO: 2092768 - RNA, 22 nt, Human
gcuccuugggaggccccacugg

SEQ ID NO: 2092769 - RNA, 14 nt, Human
gcuccuugggaggc

SEQ ID NO: 2092770 - RNA, 17 nt, Human
gcucgagcaguccugcc

SEQ ID NO: 2092771 - RNA, 21 nt, Human
gcuccuucuguccuacucugu

SEQ ID NO: 2092772 - RNA, 13 nt, Human
gcuccuugggagg

SEQ ID NO: 2092773 - RNA, 15 nt, Human
gcuccuucuguccua

SEQ ID NO: 2092774 - RNA, 17 nt, Human
gcucuccgaccagacac

SEQ ID NO: 2092775 - RNA, 13 nt, Human
gcucuccgaccag

SEQ ID NO: 2092776 - RNA, 19 nt, Human
gcucuccccugcccugcug

SEQ ID NO: 2092777 - RNA, 11 nt, Human
gcucucccucu

SEQ ID NO: 2092778 - RNA, 14 nt, Human
gcucucccucuggc

SEQ ID NO: 2092779 - RNA, 15 nt, Human
gcucucccucuggcc

SEQ ID NO: 2092780 - RNA, 17 nt, Human
gcucucccucuggcccu

SEQ ID NO: 2092781 - RNA, 18 nt, Human
gcucucccucuggcccug

SEQ ID NO: 2092782 - RNA, 19 nt, Human
gcucucccucuggcccugc

SEQ ID NO: 2092783 - RNA, 20 nt, Human
gcucucccucuggcccugcc

SEQ ID NO: 2092784 - RNA, 21 nt, Human
gcucucccucuggcccugccu

SEQ ID NO: 2092785 - RNA, 23 nt, Human
gcucucccucuggcccugccuuc

SEQ ID NO: 2092786 - RNA, 15 nt, Human
gcucuccucuugcca

SEQ ID NO: 2092787 - RNA, 22 nt, Human
gcucuccucuugccacugccuc

SEQ ID NO: 2092788 - RNA, 19 nt, Human
gcucuccucuugccacugc

SEQ ID NO: 2092789 - RNA, 19 nt, Human
gcucuccgaccagacaccu

SEQ ID NO: 2092790 - RNA, 17 nt, Human
gcucucugcagccagcc

SEQ ID NO: 2092791 - RNA, 18 nt, Human
gcucucugcagccagccc

SEQ ID NO: 2092792 - RNA, 19 nt, Human
gcucucugcagccagccca

SEQ ID NO: 2092793 - RNA, 20 nt, Human
gcucucugcagccagcccag

SEQ ID NO: 2092794 - RNA, 21 nt, Human
gcucucugcagccagcccagc

SEQ ID NO: 2092795 - RNA, 22 nt, Human
gcucucugcagccagcccagcc

SEQ ID NO: 2092796 - RNA, 13 nt, Human
gcucucuacccag

SEQ ID NO: 2092797 - RNA, 17 nt, Human
gcucucuacccagccca

SEQ ID NO: 2092798 - RNA, 20 nt, Human
gcucucuacccagcccaucu

SEQ ID NO: 2092799 - RNA, 21 nt, Human
gcucucuacccagcccaucuu

SEQ ID NO: 2092800 - RNA, 13 nt, Human
gcucucugcagcc

SEQ ID NO: 2092801 - RNA, 14 nt, Human
gcucucugcagcca

SEQ ID NO: 2092802 - RNA, 15 nt, Human
gcucucugcagccag

SEQ ID NO: 2092803 - RNA, 16 nt, Human
gcucuccuuucuuucu

SEQ ID NO: 2092804 - RNA, 11 nt, Human
gcucucugcug

SEQ ID NO: 2092805 - RNA, 13 nt, Human
gcucucugcugua

SEQ ID NO: 2092806 - RNA, 13 nt, Human
gcucugccugugg

SEQ ID NO: 2092807 - RNA, 14 nt, Human
gcucugcuccucuc

SEQ ID NO: 2092808 - RNA, 13 nt, Human
gcucugcuccucu

SEQ ID NO: 2092809 - RNA, 23 nt, Human
gcucugcugacagacacaggccc

SEQ ID NO: 2092810 - RNA, 20 nt, Human
gcucugcugacagacacagg

SEQ ID NO: 2092811 - RNA, 19 nt, Human
gcucugcugacagacacag

SEQ ID NO: 2092812 - RNA, 18 nt, Human
gcucugcugacagacaca

SEQ ID NO: 2092813 - RNA, 14 nt, Human
gcucugcugacaga

SEQ ID NO: 2092814 - RNA, 13 nt, Human
gcucugcugacag

SEQ ID NO: 2092815 - RNA, 21 nt, Human
gcucugcuccucuccccagca

SEQ ID NO: 2092816 - RNA, 19 nt, Human
gcucugcuccucuccccag

SEQ ID NO: 2092817 - RNA, 22 nt, Human
gcucuggacaggcauguucucu

SEQ ID NO: 2092818 - RNA, 21 nt, Human
gcucuggacaggcauguucuc

SEQ ID NO: 2092819 - RNA, 16 nt, Human
gcucuggacaggcaug

SEQ ID NO: 2092820 - RNA, 15 nt, Human
gcucuggacaggcau

SEQ ID NO: 2092821 - RNA, 14 nt, Human
gcucuggacaggca

SEQ ID NO: 2092822 - RNA, 13 nt, Human
gcucugcuugccg

SEQ ID NO: 2092823 - RNA, 19 nt, Human
gcucugcuugccgaaacug

SEQ ID NO: 2092824 - RNA, 20 nt, Human
gcucugcuugccgaaacugg

SEQ ID NO: 2092825 - RNA, 14 nt, Human
gcucuggaagagag

SEQ ID NO: 2092826 - RNA, 13 nt, Human
gcucccucugccu

SEQ ID NO: 2092827 - RNA, 23 nt, Human
gcucccucugccugaaccuucca

SEQ ID NO: 2092828 - RNA, 23 nt, Human
gcucccuccccugcccuggucca

SEQ ID NO: 2092829 - RNA, 19 nt, Human
gcucccuccccugcccugg

SEQ ID NO: 2092830 - RNA, 20 nt, Human
gcucccuccccugcccuggu

SEQ ID NO: 2092831 - RNA, 13 nt, Human
gcucccucccccu

SEQ ID NO: 2092832 - RNA, 18 nt, Human
gcucccucccccugcccc

SEQ ID NO: 2092833 - RNA, 22 nt, Human
gcucccucccccugccccuucu

SEQ ID NO: 2092834 - RNA, 17 nt, Human
gcucccuccccugcccu

SEQ ID NO: 2092835 - RNA, 16 nt, Human
gcucccuaccaccucc

SEQ ID NO: 2092836 - RNA, 20 nt, Human
gcucccuaccaccuccccag

SEQ ID NO: 2092837 - RNA, 14 nt, Human
gcuccaucuccacu

SEQ ID NO: 2092838 - RNA, 21 nt, Human
gcuccagcugcucugucuucu

SEQ ID NO: 2092839 - RNA, 24 nt, Human
gcuccaggcuccuuuagcgcccag

SEQ ID NO: 2092840 - RNA, 20 nt, Human
gcuccagcuguucagcuggu

SEQ ID NO: 2092841 - RNA, 23 nt, Human
gcuccaggcuccuuuagcgccca

SEQ ID NO: 2092842 - RNA, 16 nt, Human
gcuccaggcuccuuua

SEQ ID NO: 2092843 - RNA, 13 nt, Human
gcuccaggcuccu

SEQ ID NO: 2092844 - RNA, 11 nt, Human
gcuccagcugu

SEQ ID NO: 2092845 - RNA, 16 nt, Human
gcuccacacccucucc

SEQ ID NO: 2092846 - RNA, 19 nt, Human
gcuccacacccucucccag

SEQ ID NO: 2092847 - RNA, 20 nt, Human
gcuccagcugcucugucuuc

SEQ ID NO: 2092848 - RNA, 18 nt, Human
gcucaggugucccugcac

SEQ ID NO: 2092849 - RNA, 19 nt, Human
gcucagccuggugggccuc

SEQ ID NO: 2092850 - RNA, 20 nt, Human
gcucagccuggugggccucc

SEQ ID NO: 2092851 - RNA, 22 nt, Human
gcucagcggggacagcuccuuc

SEQ ID NO: 2092852 - RNA, 21 nt, Human
gcucagcggggacagcuccuu

SEQ ID NO: 2092853 - RNA, 20 nt, Human
gcucagcggggacagcuccu

SEQ ID NO: 2092854 - RNA, 15 nt, Human
gcucagcggggacag

SEQ ID NO: 2092855 - RNA, 14 nt, Human
gcucagccuggugg

SEQ ID NO: 2092856 - RNA, 15 nt, Human
gcucagccugguggg

SEQ ID NO: 2092857 - RNA, 17 nt, Human
gcucagccuggugggcc

SEQ ID NO: 2092858 - RNA, 18 nt, Human
gcucagccuggugggccu

SEQ ID NO: 2092859 - RNA, 19 nt, Human
gcucaggugucccugcacu

SEQ ID NO: 2092860 - RNA, 12 nt, Human
gcucagucccau

SEQ ID NO: 2092861 - RNA, 21 nt, Human
gcucagucucaggagcauggg

SEQ ID NO: 2092862 - RNA, 23 nt, Human
gcucagucccaucagagagcgag

SEQ ID NO: 2092863 - RNA, 14 nt, Human
gcucagucucagga

SEQ ID NO: 2092864 - RNA, 17 nt, Human
gcucagucucaggagca

SEQ ID NO: 2092865 - RNA, 20 nt, Human
gcucagucucaggagcaugg

SEQ ID NO: 2092866 - RNA, 23 nt, Human
gcucagucuucccuagggcuggg

SEQ ID NO: 2092867 - RNA, 16 nt, Human
gcucauauuccugcag

SEQ ID NO: 2092868 - RNA, 19 nt, Human
gcucaccagccccagugcc

SEQ ID NO: 2092869 - RNA, 18 nt, Human
gcucaccagccccagugc

SEQ ID NO: 2092870 - RNA, 23 nt, Human
gcucaccagccccagugcccaca

SEQ ID NO: 2092871 - RNA, 20 nt, Human
gcucaccagccccagugccc

SEQ ID NO: 2092872 - RNA, 17 nt, Human
gcucagcaaaagaugcu

SEQ ID NO: 2092873 - RNA, 20 nt, Human
gcucagcaaaagaugcuucu

SEQ ID NO: 2092874 - RNA, 22 nt, Human
gcucagcaaaagaugcuucuca

SEQ ID NO: 2092875 - RNA, 23 nt, Human
gcucagcaaaagaugcuucucac

SEQ ID NO: 2092876 - RNA, 23 nt, Human
gcucagaggguuguucuccuaga

SEQ ID NO: 2092877 - RNA, 18 nt, Human
gcucagaugaagagaaau

SEQ ID NO: 2092878 - RNA, 19 nt, Human
gcucagcaaggggcucugc

SEQ ID NO: 2092879 - RNA, 17 nt, Human
gcucagcagugacugug

SEQ ID NO: 2092880 - RNA, 11 nt, Human
gcucagccugg

SEQ ID NO: 2092881 - RNA, 19 nt, Human
gccugugccacccaccagg

SEQ ID NO: 2092882 - RNA, 12 nt, Human
gccugugcagug

SEQ ID NO: 2092883 - RNA, 15 nt, Human
gccugugagccaguc

SEQ ID NO: 2092884 - RNA, 16 nt, Human
gccugugagccagucu

SEQ ID NO: 2092885 - RNA, 14 nt, Human
gccugugaggcagg

SEQ ID NO: 2092886 - RNA, 18 nt, Human
gccugugaggcaggggcg

SEQ ID NO: 2092887 - RNA, 17 nt, Human
gccugugaggugcagag

SEQ ID NO: 2092888 - RNA, 23 nt, Human
gccugugaggugcagagugccca

SEQ ID NO: 2092889 - RNA, 24 nt, Human
gccugugaggugcagagugcccag

SEQ ID NO: 2092890 - RNA, 16 nt, Human
gcgguccacccaggag

SEQ ID NO: 2092891 - RNA, 13 nt, Human
gcggggacagcuc

SEQ ID NO: 2092892 - RNA, 12 nt, Human
gcggggacagcu

SEQ ID NO: 2092893 - RNA, 19 nt, Human
gcgguccacccaggagccc

SEQ ID NO: 2092894 - RNA, 18 nt, Human
gcgguccacccaggagcc

SEQ ID NO: 2092895 - RNA, 14 nt, Human
gcgggcugggcagc

SEQ ID NO: 2092896 - RNA, 16 nt, Human
gcgggcugggcagcug

SEQ ID NO: 2092897 - RNA, 13 nt, Human
gcuaaaugugaau

SEQ ID NO: 2092898 - RNA, 19 nt, Human
gcuaaauggucgcccagga

SEQ ID NO: 2092899 - RNA, 23 nt, Human
gcuaaauggucgcccaggagaca

SEQ ID NO: 2092900 - RNA, 16 nt, Human
gcuaaaugugaaugau

SEQ ID NO: 2092901 - RNA, 16 nt, Human
gcuaaaucuccuauuu

SEQ ID NO: 2092902 - RNA, 18 nt, Human
gcuaaauguaagaaucau

SEQ ID NO: 2092903 - RNA, 15 nt, Human
gcuaacacuggcccc

SEQ ID NO: 2092904 - RNA, 16 nt, Human
gcuaacacuggccccu

SEQ ID NO: 2092905 - RNA, 17 nt, Human
gcuaacacuggccccua

SEQ ID NO: 2092906 - RNA, 23 nt, Human
gcgugagccacugcaccgggcca

SEQ ID NO: 2092907 - RNA, 16 nt, Human
gcgugaaggccgagaa

SEQ ID NO: 2092908 - RNA, 12 nt, Human
gcgugaaucugu

SEQ ID NO: 2092909 - RNA, 16 nt, Human
gcgugacucacccaag

SEQ ID NO: 2092910 - RNA, 13 nt, Human
gcgugacucaccc

SEQ ID NO: 2092911 - RNA, 14 nt, Human
gcgugacucaccca

SEQ ID NO: 2092912 - RNA, 18 nt, Human
gcgugaggaugggaagga

SEQ ID NO: 2092913 - RNA, 18 nt, Human
gcgugagccacugcaccg

SEQ ID NO: 2092914 - RNA, 11 nt, Human
gcgugaaacac

SEQ ID NO: 2092915 - RNA, 12 nt, Human
gcgugaaacaca

SEQ ID NO: 2092916 - RNA, 19 nt, Human
gcgugaaacacaccaggcu

SEQ ID NO: 2092917 - RNA, 20 nt, Human
gcgugaaacacaccaggcug

SEQ ID NO: 2092918 - RNA, 23 nt, Human
gcgugaaacacaccaggcugugg

SEQ ID NO: 2092919 - RNA, 23 nt, Human
gcgugaacccgggaggcggagcu

SEQ ID NO: 2092920 - RNA, 13 nt, Human
gcgugaaggccga

SEQ ID NO: 2092921 - RNA, 15 nt, Human
gcgugaaggccgaga

SEQ ID NO: 2092922 - RNA, 14 nt, Human
gcuagcgcugccgc

SEQ ID NO: 2092923 - RNA, 15 nt, Human
gcuagcgcugccgca

SEQ ID NO: 2092924 - RNA, 20 nt, Human
gcuagcgcugccgcacccca

SEQ ID NO: 2092925 - RNA, 21 nt, Human
gcuagcgcugccgcaccccag

SEQ ID NO: 2092926 - RNA, 22 nt, Human
gcuagcgcugccgcaccccaga

SEQ ID NO: 2092927 - RNA, 23 nt, Human
gcuagcgcugccgcaccccagag

SEQ ID NO: 2092928 - RNA, 18 nt, Human
gcuagaguccucacuccc

SEQ ID NO: 2092929 - RNA, 17 nt, Human
gcuacucacucaaguuc

SEQ ID NO: 2092930 - RNA, 20 nt, Human
gcuacucacucaaguucaag

SEQ ID NO: 2092931 - RNA, 22 nt, Human
gcuacucacucaaguucaagga

SEQ ID NO: 2092932 - RNA, 23 nt, Human
gcuacucacucaaguucaaggac

SEQ ID NO: 2092933 - RNA, 14 nt, Human
gcuacucagaagcc

SEQ ID NO: 2092934 - RNA, 13 nt, Human
gcuagaguccuca

SEQ ID NO: 2092935 - RNA, 16 nt, Human
gcuagaguccucacuc

SEQ ID NO: 2092936 - RNA, 23 nt, Human
gcuaucucucagugaacugugag

SEQ ID NO: 2092937 - RNA, 12 nt, Human
gcuaugaauuuu

SEQ ID NO: 2092938 - RNA, 19 nt, Human
gcuaagaguguccuaggag

SEQ ID NO: 2092939 - RNA, 19 nt, Human
gcuaacaguucacuugcag

SEQ ID NO: 2092940 - RNA, 20 nt, Human
gcuaaggacauuucccaggg

SEQ ID NO: 2092941 - RNA, 18 nt, Human
gcuaagcuuaaaaaaaac

SEQ ID NO: 2092942 - RNA, 16 nt, Human
gcuaaggacaggcagg

SEQ ID NO: 2092943 - RNA, 17 nt, Human
gcuaaggacauuuccca

SEQ ID NO: 2092944 - RNA, 14 nt, Human
gcuacuaaugaugu

SEQ ID NO: 2092945 - RNA, 16 nt, Human
gcuacuaaugauguuu

SEQ ID NO: 2092946 - RNA, 18 nt, Human
gcuacuaaugauguuuuc

SEQ ID NO: 2092947 - RNA, 16 nt, Human
gcuacucaagaggcug

SEQ ID NO: 2092948 - RNA, 17 nt, Human
gcuacucaagaggcuga

SEQ ID NO: 2092949 - RNA, 20 nt, Human
gcuacucaagaggcugaggc

SEQ ID NO: 2092950 - RNA, 21 nt, Human
gcuacucaagaggcugaggca

SEQ ID NO: 2092951 - RNA, 20 nt, Human
guagaaaagggaacugaaca

SEQ ID NO: 2092952 - RNA, 18 nt, Human
guagaaagacagagcugg

SEQ ID NO: 2092953 - RNA, 21 nt, Human
guagaaagacagagcugggau

SEQ ID NO: 2092954 - RNA, 22 nt, Human
guacuuuuggaaucuagaagaa

SEQ ID NO: 2092955 - RNA, 23 nt, Human
guagagcccuguaucaacccaga

SEQ ID NO: 2092956 - RNA, 16 nt, Human
guagagggugcugccc

SEQ ID NO: 2092957 - RNA, 21 nt, Human
guacuuguggacacagcucuu

SEQ ID NO: 2092958 - RNA, 19 nt, Human
guacuucuccacccugcuc

SEQ ID NO: 2092959 - RNA, 18 nt, Human
guacuucuccacccugcu

SEQ ID NO: 2092960 - RNA, 17 nt, Human
guacuucuccacccugc

SEQ ID NO: 2092961 - RNA, 16 nt, Human
guacuucuccacccug

SEQ ID NO: 2092962 - RNA, 21 nt, Human
guacuucuccacccugcucuc

SEQ ID NO: 2092963 - RNA, 20 nt, Human
guacuucuccacccugcucu

SEQ ID NO: 2092964 - RNA, 20 nt, Human
guacuuguggacacagcucu

SEQ ID NO: 2092965 - RNA, 16 nt, Human
guacuuguggacacag

SEQ ID NO: 2092966 - RNA, 18 nt, Human
guacuugcugcuauuuua

SEQ ID NO: 2092967 - RNA, 21 nt, Human
guacuugcugcuauuuuacug

SEQ ID NO: 2092968 - RNA, 16 nt, Human
guacccacugcucugg

SEQ ID NO: 2092969 - RNA, 14 nt, Human
guacauaggcagca

SEQ ID NO: 2092970 - RNA, 17 nt, Human
guaccccagcucugcuu

SEQ ID NO: 2092971 - RNA, 18 nt, Human
guaccccagcucugcuug

SEQ ID NO: 2092972 - RNA, 19 nt, Human
guaccccagcucugcuugc

SEQ ID NO: 2092973 - RNA, 19 nt, Human
guaccuucagauccuaccc

SEQ ID NO: 2092974 - RNA, 14 nt, Human
guaccuugaacacu

SEQ ID NO: 2092975 - RNA, 18 nt, Human
guaccuugaacacugggg

SEQ ID NO: 2092976 - RNA, 23 nt, Human
guaccuugaacacugggggaggg

SEQ ID NO: 2092977 - RNA, 15 nt, Human
guaccugauguaccu

SEQ ID NO: 2092978 - RNA, 23 nt, Human
guaccuuugcucuugcagagaag

SEQ ID NO: 2092979 - RNA, 13 nt, Human
guaccuuugucac

SEQ ID NO: 2092980 - RNA, 15 nt, Human
guacgucugacaggc

SEQ ID NO: 2092981 - RNA, 14 nt, Human
guacgucugacagg

SEQ ID NO: 2092982 - RNA, 17 nt, Human
guacgucugacaggcaa

SEQ ID NO: 2092983 - RNA, 15 nt, Human
guacuucuccacccu

SEQ ID NO: 2092984 - RNA, 14 nt, Human
guacuucuccaccc

SEQ ID NO: 2092985 - RNA, 14 nt, Human
guacuuccacugau

SEQ ID NO: 2092986 - RNA, 15 nt, Human
guacuacaauuuaaa

SEQ ID NO: 2092987 - RNA, 12 nt, Human
guacuacaauuu

SEQ ID NO: 2092988 - RNA, 15 nt, Human
guacguggagaggga

SEQ ID NO: 2092989 - RNA, 15 nt, Human
guacuaaggaaucuu

SEQ ID NO: 2092990 - RNA, 23 nt, Human
guacuaaggaaucuuucugcuuu

SEQ ID NO: 2092991 - RNA, 12 nt, Human
guacaguuuuua

SEQ ID NO: 2092992 - RNA, 13 nt, Human
guacaguuuuuau

SEQ ID NO: 2092993 - RNA, 22 nt, Human
guacauaaaggugguaugugug

SEQ ID NO: 2092994 - RNA, 23 nt, Human
guacauaaaggugguaugugugu

SEQ ID NO: 2092995 - RNA, 18 nt, Human
guacauauguaaaauaaa

SEQ ID NO: 2092996 - RNA, 15 nt, Human
guacccacugcucug

SEQ ID NO: 2092997 - RNA, 21 nt, Human
guacagugguucuacaaucua

SEQ ID NO: 2092998 - RNA, 16 nt, Human
guacagucuuguauua

SEQ ID NO: 2092999 - RNA, 13 nt, Human
guacagucuugua

SEQ ID NO: 2093000 - RNA, 14 nt, Human
guacagucuuguau

SEQ ID NO: 2093001 - RNA, 15 nt, Human
guacagguaagguga

SEQ ID NO: 2093002 - RNA, 15 nt, Human
guacaggcagcacag

SEQ ID NO: 2093003 - RNA, 17 nt, Human
guacaggcagcacagag

SEQ ID NO: 2093004 - RNA, 20 nt, Human
guacaguugggaaaauaugu

SEQ ID NO: 2093005 - RNA, 21 nt, Human
guacaguugggaaaauauguc

SEQ ID NO: 2093006 - RNA, 16 nt, Human
guacaguguguaaagu

SEQ ID NO: 2093007 - RNA, 17 nt, Human
guacagaaucauugcuu

SEQ ID NO: 2093008 - RNA, 18 nt, Human
guacagaaucauugcuua

SEQ ID NO: 2093009 - RNA, 21 nt, Human
guacagaaucauugcuuauga

SEQ ID NO: 2093010 - RNA, 20 nt, Human
guacagaauucugcuaccuc

SEQ ID NO: 2093011 - RNA, 17 nt, Human
guacagacguaugcuua

SEQ ID NO: 2093012 - RNA, 14 nt, Human
guaauugugaaaaa

SEQ ID NO: 2093013 - RNA, 13 nt, Human
guacagagaagga

SEQ ID NO: 2093014 - RNA, 14 nt, Human
guacagagaaggaa

SEQ ID NO: 2093015 - RNA, 17 nt, Human
guacagauugcugcuuc

SEQ ID NO: 2093016 - RNA, 19 nt, Human
guacagauugcugcuucug

SEQ ID NO: 2093017 - RNA, 20 nt, Human
guacagauugcugcuucugc

SEQ ID NO: 2093018 - RNA, 12 nt, Human
guacaggcagca

SEQ ID NO: 2093019 - RNA, 21 nt, Human
guaauuaucgggaacaguguu

SEQ ID NO: 2093020 - RNA, 13 nt, Human
guaauugugaaaa

SEQ ID NO: 2093021 - RNA, 16 nt, Human
guaauugaauaaaguu

SEQ ID NO: 2093022 - RNA, 15 nt, Human
guaauugaacuuauc

SEQ ID NO: 2093023 - RNA, 20 nt, Human
guaauuaucgggaacagugu

SEQ ID NO: 2093024 - RNA, 22 nt, Human
guaauuaucgggaacaguguuu

SEQ ID NO: 2093025 - RNA, 21 nt, Human
guaauuaaguacuauguauca

SEQ ID NO: 2093026 - RNA, 22 nt, Human
guaauguuacugaucaugcauu

SEQ ID NO: 2093027 - RNA, 23 nt, Human
guaauguuacugaucaugcauug

SEQ ID NO: 2093028 - RNA, 14 nt, Human
guaauuaaguacua

SEQ ID NO: 2093029 - RNA, 17 nt, Human
guaauuaaguacuaugu

SEQ ID NO: 2093030 - RNA, 20 nt, Human
guaauuaaguacuauguauc

SEQ ID NO: 2093031 - RNA, 12 nt, Human
guaaugucacca

SEQ ID NO: 2093032 - RNA, 19 nt, Human
guaaugucaccaccuuccc

SEQ ID NO: 2093033 - RNA, 20 nt, Human
guaaugucaccaccuuccca

SEQ ID NO: 2093034 - RNA, 22 nt, Human
guaaugucaccaccuucccagc

SEQ ID NO: 2093035 - RNA, 13 nt, Human
guaauguuacuga

SEQ ID NO: 2093036 - RNA, 14 nt, Human
guaauguuacugau

SEQ ID NO: 2093037 - RNA, 17 nt, Human
guaauguuacugaucau

SEQ ID NO: 2093038 - RNA, 20 nt, Human
guaauguuacugaucaugca

SEQ ID NO: 2093039 - RNA, 21 nt, Human
guaauguuacugaucaugcau

SEQ ID NO: 2093040 - RNA, 14 nt, Human
guaaugugaauaaa

SEQ ID NO: 2093041 - RNA, 16 nt, Human
guaaugugaauaaauu

SEQ ID NO: 2093042 - RNA, 18 nt, Human
guaaugaugucguuugaa

SEQ ID NO: 2093043 - RNA, 21 nt, Human
guaaugaauuuuuaugauauu

SEQ ID NO: 2093044 - RNA, 18 nt, Human
guaaucguuaugugugua

SEQ ID NO: 2093045 - RNA, 16 nt, Human
guaaucguuaugugug

SEQ ID NO: 2093046 - RNA, 17 nt, Human
guaaucugaucguucuu

SEQ ID NO: 2093047 - RNA, 21 nt, Human
guaaucugaucguucuuucua

SEQ ID NO: 2093048 - RNA, 24 nt, Human
guaaucugaucguucuuucuagcu

SEQ ID NO: 2093049 - RNA, 15 nt, Human
guaaaagacuuuuuu

SEQ ID NO: 2093050 - RNA, 17 nt, Human
guaaaagauaacaagau

SEQ ID NO: 2093051 - RNA, 13 nt, Human
guaaaacugaggc

SEQ ID NO: 2093052 - RNA, 15 nt, Human
guaaaacugaggcac

SEQ ID NO: 2093053 - RNA, 15 nt, Human
guaaaacuuuauuuu

SEQ ID NO: 2093054 - RNA, 18 nt, Human
guaaaacuuuauuuuaua

SEQ ID NO: 2093055 - RNA, 23 nt, Human
guaaaaacagcauugcuuucuga

SEQ ID NO: 2093056 - RNA, 19 nt, Human
guaaaaacagcauugcuuu

SEQ ID NO: 2093057 - RNA, 21 nt, Human
guaaaaacagcauugcuuucu

SEQ ID NO: 2093058 - RNA, 13 nt, Human
guaaaaauaaaau

SEQ ID NO: 2093059 - RNA, 12 nt, Human
guaaaacaaaaa

SEQ ID NO: 2093060 - RNA, 12 nt, Human
guaaaaaugaga

SEQ ID NO: 2093061 - RNA, 13 nt, Human
guaaaaaugagaa

SEQ ID NO: 2093062 - RNA, 16 nt, Human
guaaaaaugagaacau

SEQ ID NO: 2093063 - RNA, 14 nt, Human
guaaaaauaaaauu

SEQ ID NO: 2093064 - RNA, 12 nt, Human
guaaaaauacaa

SEQ ID NO: 2093065 - RNA, 15 nt, Human
gguuuuguagguacu

SEQ ID NO: 2093066 - RNA, 18 nt, Human
guaaaaacagcauugcuu

SEQ ID NO: 2093067 - RNA, 23 nt, Human
gguuuugccauguuggccaggcu

SEQ ID NO: 2093068 - RNA, 11 nt, Human
gguuuuguaca

SEQ ID NO: 2093069 - RNA, 13 nt, Human
gguuuuguacaau

SEQ ID NO: 2093070 - RNA, 14 nt, Human
gguuuucuucccau

SEQ ID NO: 2093071 - RNA, 23 nt, Human
gguuuacucuguggccaaaggag

SEQ ID NO: 2093072 - RNA, 19 nt, Human
gguuuucgaagcucagccc

SEQ ID NO: 2093073 - RNA, 19 nt, Human
gguuuacauucaucucauu

SEQ ID NO: 2093074 - RNA, 22 nt, Human
gguuuacauucaucucauucca

SEQ ID NO: 2093075 - RNA, 20 nt, Human
gguggcccgacagccuggca

SEQ ID NO: 2093076 - RNA, 19 nt, Human
gguggcccgacagccuggc

SEQ ID NO: 2093077 - RNA, 18 nt, Human
gguggcccgacagccugg

SEQ ID NO: 2093078 - RNA, 17 nt, Human
gguggcccgacagccug

SEQ ID NO: 2093079 - RNA, 16 nt, Human
gguggcccgacagccu

SEQ ID NO: 2093080 - RNA, 19 nt, Human
gguggcccacgccuguaau

SEQ ID NO: 2093081 - RNA, 21 nt, Human
gguucaagcgauucuucugcu

SEQ ID NO: 2093082 - RNA, 18 nt, Human
gguucuuucuuccucugc

SEQ ID NO: 2093083 - RNA, 21 nt, Human
gguucagccccuccucugcca

SEQ ID NO: 2093084 - RNA, 22 nt, Human
gguucagccccuccucugccac

SEQ ID NO: 2093085 - RNA, 14 nt, Human
gguugaagcaccaa

SEQ ID NO: 2093086 - RNA, 17 nt, Human
gguucuuucuuccucug

SEQ ID NO: 2093087 - RNA, 12 nt, Human
gguucagcuugu

SEQ ID NO: 2093088 - RNA, 16 nt, Human
gguucagagacucagg

SEQ ID NO: 2093089 - RNA, 14 nt, Human
gguucagccccucc

SEQ ID NO: 2093090 - RNA, 16 nt, Human
gguucagccccuccuc

SEQ ID NO: 2093091 - RNA, 17 nt, Human
gguucagccccuccucu

SEQ ID NO: 2093092 - RNA, 18 nt, Human
gguucagccccuccucug

SEQ ID NO: 2093093 - RNA, 19 nt, Human
gguucagccccuccucugc

SEQ ID NO: 2093094 - RNA, 20 nt, Human
gguucagccccuccucugcc

SEQ ID NO: 2093095 - RNA, 23 nt, Human
gguucaagcgauucuucugcuuc

SEQ ID NO: 2093096 - RNA, 22 nt, Human
gguucaagcgauucuucugcuu

SEQ ID NO: 2093097 - RNA, 20 nt, Human
gguucacugcaaccuccgcc

SEQ ID NO: 2093098 - RNA, 14 nt, Human
gguggccccugccu

SEQ ID NO: 2093099 - RNA, 13 nt, Human
gguuggugggggc

SEQ ID NO: 2093100 - RNA, 15 nt, Human
gguugucacucaaca

SEQ ID NO: 2093101 - RNA, 13 nt, Human
gguuuaagcuguu

SEQ ID NO: 2093102 - RNA, 18 nt, Human
gguuggcaaaaaggcagg

SEQ ID NO: 2093103 - RNA, 15 nt, Human
gguugcuucugggaa

SEQ ID NO: 2093104 - RNA, 22 nt, Human
gguuggaagugagggucagaga

SEQ ID NO: 2093105 - RNA, 14 nt, Human
gguugggcuggugu

SEQ ID NO: 2093106 - RNA, 17 nt, Human
gguugggcccagaucug

SEQ ID NO: 2093107 - RNA, 18 nt, Human
gguugcagugagccaaga

SEQ ID NO: 2093108 - RNA, 17 nt, Human
gguugcagugagcugag

SEQ ID NO: 2093109 - RNA, 14 nt, Human
gguugcaucagaaa

SEQ ID NO: 2093110 - RNA, 21 nt, Human
gguugcguccugacggcgccc

SEQ ID NO: 2093111 - RNA, 16 nt, Human
gguugcucacagcugu

SEQ ID NO: 2093112 - RNA, 19 nt, Human
guaagaucguucucugccu

SEQ ID NO: 2093113 - RNA, 14 nt, Human
guaagagcuggugu

SEQ ID NO: 2093114 - RNA, 16 nt, Human
guaagagcuggugucu

SEQ ID NO: 2093115 - RNA, 17 nt, Human
guaagagcuuuacaaaa

SEQ ID NO: 2093116 - RNA, 13 nt, Human
guaagagaauguu

SEQ ID NO: 2093117 - RNA, 15 nt, Human
guaagagaauguuau

SEQ ID NO: 2093118 - RNA, 19 nt, Human
guaagaccggaagcuccug

SEQ ID NO: 2093119 - RNA, 21 nt, Human
guaagaccggaagcuccuggu

SEQ ID NO: 2093120 - RNA, 15 nt, Human
guaagaagacaugaa

SEQ ID NO: 2093121 - RNA, 13 nt, Human
guaagaagagacu

SEQ ID NO: 2093122 - RNA, 11 nt, Human
guaagaagccg

SEQ ID NO: 2093123 - RNA, 15 nt, Human
guaagaagagacugg

SEQ ID NO: 2093124 - RNA, 13 nt, Human
guaagaaucauug

SEQ ID NO: 2093125 - RNA, 20 nt, Human
guaagaaagugaagcaaauc

SEQ ID NO: 2093126 - RNA, 20 nt, Human
guaagaaacacacugaggca

SEQ ID NO: 2093127 - RNA, 16 nt, Human
guaacuugguuauaca

SEQ ID NO: 2093128 - RNA, 17 nt, Human
guaacuugguuauacau

SEQ ID NO: 2093129 - RNA, 18 nt, Human
guaacuugguuauacaug

SEQ ID NO: 2093130 - RNA, 23 nt, Human
guaacuugguuauacaugacacu

SEQ ID NO: 2093131 - RNA, 14 nt, Human
guaacuugucuuaa

SEQ ID NO: 2093132 - RNA, 19 nt, Human
guaacuuuuguaaauacac

SEQ ID NO: 2093133 - RNA, 13 nt, Human
guaagauuuugaa

SEQ ID NO: 2093134 - RNA, 14 nt, Human
guaagauuuugaaa

SEQ ID NO: 2093135 - RNA, 16 nt, Human
guaagauuuugaaaac

SEQ ID NO: 2093136 - RNA, 17 nt, Human
guaagauuuugaaaacu

SEQ ID NO: 2093137 - RNA, 11 nt, Human
guaagcucuuu

SEQ ID NO: 2093138 - RNA, 20 nt, Human
guaagcucuuugaaacaacu

SEQ ID NO: 2093139 - RNA, 17 nt, Human
guaagcuuccaggaaaa

SEQ ID NO: 2093140 - RNA, 14 nt, Human
guaaggaaugcuug

SEQ ID NO: 2093141 - RNA, 15 nt, Human
guaaggaaugcuugg

SEQ ID NO: 2093142 - RNA, 14 nt, Human
guaaggugagggaa

SEQ ID NO: 2093143 - RNA, 12 nt, Human
guaaggugccuu

SEQ ID NO: 2093144 - RNA, 17 nt, Human
guaaguaaacugcccug

SEQ ID NO: 2093145 - RNA, 15 nt, Human
guaaguaaaugucug

SEQ ID NO: 2093146 - RNA, 17 nt, Human
guaaguaaaugucugug

SEQ ID NO: 2093147 - RNA, 13 nt, Human
guaaguaauuauc

SEQ ID NO: 2093148 - RNA, 23 nt, Human
guaaguaauuaucgggaacagug

SEQ ID NO: 2093149 - RNA, 16 nt, Human
guaagugagagagaca

SEQ ID NO: 2093150 - RNA, 18 nt, Human
guaaguaccacucaggcc

SEQ ID NO: 2093151 - RNA, 22 nt, Human
guaaguauucuuauuuaaugaa

SEQ ID NO: 2093152 - RNA, 15 nt, Human
guaaauccuuuuucu

SEQ ID NO: 2093153 - RNA, 16 nt, Human
guaaauccuuuuucuu

SEQ ID NO: 2093154 - RNA, 22 nt, Human
guaaauccuuuuucuuuauaaa

SEQ ID NO: 2093155 - RNA, 22 nt, Human
guaaaugaaguaacuugucuua

SEQ ID NO: 2093156 - RNA, 23 nt, Human
guaaaugaaguaacuugucuuaa

SEQ ID NO: 2093157 - RNA, 21 nt, Human
guaaaugucuguggccuuguu

SEQ ID NO: 2093158 - RNA, 22 nt, Human
guaaaugucuguggccuuguuc

SEQ ID NO: 2093159 - RNA, 17 nt, Human
guaaauguuuagguuuu

SEQ ID NO: 2093160 - RNA, 14 nt, Human
guaaaauaaaauua

SEQ ID NO: 2093161 - RNA, 17 nt, Human
guaaagugauaauuucu

SEQ ID NO: 2093162 - RNA, 18 nt, Human
guaaagugauaauuucug

SEQ ID NO: 2093163 - RNA, 23 nt, Human
guaaagugauaauuucuggaauu

SEQ ID NO: 2093164 - RNA, 15 nt, Human
guaaaguguaacaua

SEQ ID NO: 2093165 - RNA, 17 nt, Human
guaaaguguaacauaug

SEQ ID NO: 2093166 - RNA, 19 nt, Human
guaaaguguaacauaugca

SEQ ID NO: 2093167 - RNA, 20 nt, Human
guaaaguguaacauaugcaa

SEQ ID NO: 2093168 - RNA, 11 nt, Human
guaaauaagag

SEQ ID NO: 2093169 - RNA, 13 nt, Human
guaaauaagagau

SEQ ID NO: 2093170 - RNA, 16 nt, Human
guaaauaagagauuug

SEQ ID NO: 2093171 - RNA, 18 nt, Human
guaaauacaaguucuauu

SEQ ID NO: 2093172 - RNA, 20 nt, Human
guaaauacaaguucuauuua

SEQ ID NO: 2093173 - RNA, 20 nt, Human
guaaauaaccccauucuuug

SEQ ID NO: 2093174 - RNA, 21 nt, Human
guaaauaaccccauucuuugc

SEQ ID NO: 2093175 - RNA, 12 nt, Human
guaaauauuuau

SEQ ID NO: 2093176 - RNA, 11 nt, Human
guaaauauuua

SEQ ID NO: 2093177 - RNA, 19 nt, Human
guaaauacacaacacacac

SEQ ID NO: 2093178 - RNA, 18 nt, Human
guaaauagcaacaugcuu

SEQ ID NO: 2093179 - RNA, 14 nt, Human
ggugaacauugcaa

SEQ ID NO: 2093180 - RNA, 19 nt, Human
ggucugaggaauccagacc

SEQ ID NO: 2093181 - RNA, 19 nt, Human
ggugaagaugggaacgcag

SEQ ID NO: 2093182 - RNA, 17 nt, Human
ggugaagcuauuuaucu

SEQ ID NO: 2093183 - RNA, 18 nt, Human
ggugaagcuauuuaucug

SEQ ID NO: 2093184 - RNA, 16 nt, Human
ggugaagggagagcca

SEQ ID NO: 2093185 - RNA, 18 nt, Human
ggugaagggagagccagc

SEQ ID NO: 2093186 - RNA, 19 nt, Human
ggucuccucuuuguuuugu

SEQ ID NO: 2093187 - RNA, 15 nt, Human
ggucuccugccccca

SEQ ID NO: 2093188 - RNA, 16 nt, Human
ggucugacccacugcu

SEQ ID NO: 2093189 - RNA, 15 nt, Human
ggucugacccacugc

SEQ ID NO: 2093190 - RNA, 16 nt, Human
ggucucacucugucgc

SEQ ID NO: 2093191 - RNA, 12 nt, Human
ggucucacucug

SEQ ID NO: 2093192 - RNA, 19 nt, Human
ggucucccucuccugccua

SEQ ID NO: 2093193 - RNA, 17 nt, Human
ggucucccucuccugcc

SEQ ID NO: 2093194 - RNA, 18 nt, Human
ggucucccucuccugccu

SEQ ID NO: 2093195 - RNA, 21 nt, Human
ggucucacuauguugcccagg

SEQ ID NO: 2093196 - RNA, 22 nt, Human
ggucucccucuccugccuacuc

SEQ ID NO: 2093197 - RNA, 22 nt, Human
ggucucacuauguugcccaggc

SEQ ID NO: 2093198 - RNA, 23 nt, Human
gguccuagaaauuccccacccug

SEQ ID NO: 2093199 - RNA, 19 nt, Human
gguccuaagucccugcccc

SEQ ID NO: 2093200 - RNA, 23 nt, Human
ggucccuugcagcuaguuuucua

SEQ ID NO: 2093201 - RNA, 17 nt, Human
gguccgguguccuuuuc

SEQ ID NO: 2093202 - RNA, 13 nt, Human
ggucccugggagg

SEQ ID NO: 2093203 - RNA, 23 nt, Human
ggucccugggaggaaauuugaau

SEQ ID NO: 2093204 - RNA, 21 nt, Human
ggucccuucuuacucacacac

SEQ ID NO: 2093205 - RNA, 19 nt, Human
ggucccuugagaccucagc

SEQ ID NO: 2093206 - RNA, 20 nt, Human
ggucccuugagaccucagcc

SEQ ID NO: 2093207 - RNA, 21 nt, Human
ggucccuugagaccucagcca

SEQ ID NO: 2093208 - RNA, 17 nt, Human
ggugaggggcuggcacu

SEQ ID NO: 2093209 - RNA, 15 nt, Human
ggugaggcaauaaaa

SEQ ID NO: 2093210 - RNA, 16 nt, Human
ggugaccucugccuga

SEQ ID NO: 2093211 - RNA, 14 nt, Human
ggugaccucugccu

SEQ ID NO: 2093212 - RNA, 13 nt, Human
ggugacaccagcc

SEQ ID NO: 2093213 - RNA, 16 nt, Human
ggugacaccagccuuu

SEQ ID NO: 2093214 - RNA, 23 nt, Human
ggugaguggggagacaccucaga

SEQ ID NO: 2093215 - RNA, 22 nt, Human
ggugccccccuugccagacaug

SEQ ID NO: 2093216 - RNA, 13 nt, Human
ggugcccuccacu

SEQ ID NO: 2093217 - RNA, 16 nt, Human
ggugcccuccacugcc

SEQ ID NO: 2093218 - RNA, 17 nt, Human
ggugcccuuggaggcca

SEQ ID NO: 2093219 - RNA, 18 nt, Human
ggugcccuuggaggccag

SEQ ID NO: 2093220 - RNA, 22 nt, Human
ggugcccuuggaggccagccag

SEQ ID NO: 2093221 - RNA, 13 nt, Human
gguggcagcugcg

SEQ ID NO: 2093222 - RNA, 12 nt, Human
gguggcagcugc

SEQ ID NO: 2093223 - RNA, 11 nt, Human
gguggcagcug

SEQ ID NO: 2093224 - RNA, 23 nt, Human
gguggcagcugcgguccacccag

SEQ ID NO: 2093225 - RNA, 15 nt, Human
gguggcagcugcggu

SEQ ID NO: 2093226 - RNA, 16 nt, Human
gguggcagugggagcu

SEQ ID NO: 2093227 - RNA, 21 nt, Human
gguggcagugcagcaaccaga

SEQ ID NO: 2093228 - RNA, 16 nt, Human
ggugcucagggcugac

SEQ ID NO: 2093229 - RNA, 15 nt, Human
ggugcgaucuggguu

SEQ ID NO: 2093230 - RNA, 20 nt, Human
ggugcuaaauggucgcccag

SEQ ID NO: 2093231 - RNA, 17 nt, Human
ggugcuaauuaauaaag

SEQ ID NO: 2093232 - RNA, 15 nt, Human
ggugcucagggcuga

SEQ ID NO: 2093233 - RNA, 23 nt, Human
ggugcuaaauggucgcccaggag

SEQ ID NO: 2093234 - RNA, 21 nt, Human
ggugcuaaauggucgcccagg

SEQ ID NO: 2093235 - RNA, 22 nt, Human
ggugcuaaauggucgcccagga

SEQ ID NO: 2093236 - RNA, 20 nt, Human
ggguuucaccauguuggcca

SEQ ID NO: 2093237 - RNA, 17 nt, Human
gguacccacugcucugg

SEQ ID NO: 2093238 - RNA, 13 nt, Human
ggguuggcugggu

SEQ ID NO: 2093239 - RNA, 14 nt, Human
ggguuggcugggua

SEQ ID NO: 2093240 - RNA, 12 nt, Human
ggguugggccca

SEQ ID NO: 2093241 - RNA, 14 nt, Human
ggguugggcccaga

SEQ ID NO: 2093242 - RNA, 22 nt, Human
ggguugggcccagaucuggucc

SEQ ID NO: 2093243 - RNA, 15 nt, Human
ggguugggcuggugu

SEQ ID NO: 2093244 - RNA, 18 nt, Human
gguaccuugaacacuggg

SEQ ID NO: 2093245 - RNA, 12 nt, Human
gguaccuugaac

SEQ ID NO: 2093246 - RNA, 21 nt, Human
gguacuuguggacacagcucu

SEQ ID NO: 2093247 - RNA, 22 nt, Human
gguacuuguggacacagcucuu

SEQ ID NO: 2093248 - RNA, 14 nt, Human
ggguucuuucuucc

SEQ ID NO: 2093249 - RNA, 20 nt, Human
ggguuggcugggcccagaag

SEQ ID NO: 2093250 - RNA, 19 nt, Human
ggguuggccccugcccggc

SEQ ID NO: 2093251 - RNA, 16 nt, Human
ggguuggccccugccc

SEQ ID NO: 2093252 - RNA, 16 nt, Human
ggguucuccucucccc

SEQ ID NO: 2093253 - RNA, 18 nt, Human
ggguucuccucuccccuc

SEQ ID NO: 2093254 - RNA, 14 nt, Human
ggguucccccagcc

SEQ ID NO: 2093255 - RNA, 18 nt, Human
ggguucccuuuccuucca

SEQ ID NO: 2093256 - RNA, 21 nt, Human
ggguucccuuuccuuccaucc

SEQ ID NO: 2093257 - RNA, 15 nt, Human
ggguucucacagugg

SEQ ID NO: 2093258 - RNA, 14 nt, Human
ggguuccucuuccc

SEQ ID NO: 2093259 - RNA, 20 nt, Human
ggguggagaacuccuagggu

SEQ ID NO: 2093260 - RNA, 14 nt, Human
ggguggaggagagc

SEQ ID NO: 2093261 - RNA, 15 nt, Human
ggguggaggagagcc

SEQ ID NO: 2093262 - RNA, 19 nt, Human
ggguggaggagagccuggu

SEQ ID NO: 2093263 - RNA, 15 nt, Human
ggguucccccagccc

SEQ ID NO: 2093264 - RNA, 22 nt, Human
ggguagcagguaccacugauuu

SEQ ID NO: 2093265 - RNA, 21 nt, Human
ggguagccacuggacugacga

SEQ ID NO: 2093266 - RNA, 15 nt, Human
ggguagcuagaggaa

SEQ ID NO: 2093267 - RNA, 16 nt, Human
ggguagcuagaggaac

SEQ ID NO: 2093268 - RNA, 16 nt, Human
ggucagagccugcagu

SEQ ID NO: 2093269 - RNA, 15 nt, Human
ggucagagccugcag

SEQ ID NO: 2093270 - RNA, 14 nt, Human
ggucagagccugca

SEQ ID NO: 2093271 - RNA, 13 nt, Human
ggucagagccugc

SEQ ID NO: 2093272 - RNA, 12 nt, Human
ggucagagccug

SEQ ID NO: 2093273 - RNA, 20 nt, Human
ggucaaguaagaagacauga

SEQ ID NO: 2093274 - RNA, 22 nt, Human
ggucacaaauccuaaaagaagc

SEQ ID NO: 2093275 - RNA, 17 nt, Human
ggucaauccugugggug

SEQ ID NO: 2093276 - RNA, 18 nt, Human
ggucaaguuauuaauuuc

SEQ ID NO: 2093277 - RNA, 20 nt, Human
ggucaauacaguacaggcag

SEQ ID NO: 2093278 - RNA, 17 nt, Human
gguagagauggaggagg

SEQ ID NO: 2093279 - RNA, 20 nt, Human
ggucaagauuuugaaugcuu

SEQ ID NO: 2093280 - RNA, 13 nt, Human
ggucaagcccagg

SEQ ID NO: 2093281 - RNA, 15 nt, Human
ggucaagcccaggag

SEQ ID NO: 2093282 - RNA, 19 nt, Human
ggucaagcccaggaggacu

SEQ ID NO: 2093283 - RNA, 17 nt, Human
ggucaagcccaggagga

SEQ ID NO: 2093284 - RNA, 11 nt, Human
ggucaaggccu

SEQ ID NO: 2093285 - RNA, 18 nt, Human
ggucaaggccugucccug

SEQ ID NO: 2093286 - RNA, 20 nt, Human
gguagaaagagauacagagg

SEQ ID NO: 2093287 - RNA, 23 nt, Human
ggucaacuugagcauguuacuga

SEQ ID NO: 2093288 - RNA, 14 nt, Human
ggucccaggcagag

SEQ ID NO: 2093289 - RNA, 15 nt, Human
ggucccagccacccc

SEQ ID NO: 2093290 - RNA, 14 nt, Human
ggucccacucaguc

SEQ ID NO: 2093291 - RNA, 12 nt, Human
ggucccacucag

SEQ ID NO: 2093292 - RNA, 14 nt, Human
ggucccagccaccc

SEQ ID NO: 2093293 - RNA, 22 nt, Human
ggucccacucaguccauagcag

SEQ ID NO: 2093294 - RNA, 14 nt, Human
ggucagagggccca

SEQ ID NO: 2093295 - RNA, 19 nt, Human
ggucagaguaagcugcuuu

SEQ ID NO: 2093296 - RNA, 19 nt, Human
ggucacugaaacuucaagc

SEQ ID NO: 2093297 - RNA, 14 nt, Human
ggggcugccagggg

SEQ ID NO: 2093298 - RNA, 14 nt, Human
ggggcagucaccug

SEQ ID NO: 2093299 - RNA, 21 nt, Human
ggggcagggaaggggaggcag

SEQ ID NO: 2093300 - RNA, 11 nt, Human
ggggcagucug

SEQ ID NO: 2093301 - RNA, 20 nt, Human
ggggcugcuccuccagggcc

SEQ ID NO: 2093302 - RNA, 21 nt, Human
ggggcugcugaccuccacagc

SEQ ID NO: 2093303 - RNA, 14 nt, Human
ggggcugcuccucc

SEQ ID NO: 2093304 - RNA, 15 nt, Human
ggggcugcuccucca

SEQ ID NO: 2093305 - RNA, 16 nt, Human
ggggcugcuccuccag

SEQ ID NO: 2093306 - RNA, 19 nt, Human
ggggcagcugccagagaag

SEQ ID NO: 2093307 - RNA, 16 nt, Human
ggggcaggagcucaga

SEQ ID NO: 2093308 - RNA, 16 nt, Human
ggggcaggagggcccu

SEQ ID NO: 2093309 - RNA, 10 nt, Human
ggggcaggca

SEQ ID NO: 2093310 - RNA, 11 nt, Human
ggggcaggcag

SEQ ID NO: 2093311 - RNA, 12 nt, Human
ggggcaggcagu

SEQ ID NO: 2093312 - RNA, 17 nt, Human
ggggcuggcacugacug

SEQ ID NO: 2093313 - RNA, 15 nt, Human
ggggcuuucuggaga

SEQ ID NO: 2093314 - RNA, 19 nt, Human
ggggcuggcggcuacucag

SEQ ID NO: 2093315 - RNA, 12 nt, Human
ggggcuggggca

SEQ ID NO: 2093316 - RNA, 15 nt, Human
ggggcuggggcagga

SEQ ID NO: 2093317 - RNA, 16 nt, Human
ggggcuggggcaggag

SEQ ID NO: 2093318 - RNA, 17 nt, Human
ggggcuggggcaggagg

SEQ ID NO: 2093319 - RNA, 18 nt, Human
ggggcuggggcaggaggg

SEQ ID NO: 2093320 - RNA, 23 nt, Human
ggguacuuguggacacagcucuu

SEQ ID NO: 2093321 - RNA, 22 nt, Human
ggguacuuguggacacagcucu

SEQ ID NO: 2093322 - RNA, 19 nt, Human
ggguacuuguggacacagc

SEQ ID NO: 2093323 - RNA, 15 nt, Human
ggguacccacugcuc

SEQ ID NO: 2093324 - RNA, 13 nt, Human
ggguacccacugc

SEQ ID NO: 2093325 - RNA, 23 nt, Human
ggguaccuugaacacugggggag

SEQ ID NO: 2093326 - RNA, 18 nt, Human
ggguacccacugcucugg

SEQ ID NO: 2093327 - RNA, 23 nt, Human
gggguucagccccuccucugcca

SEQ ID NO: 2093328 - RNA, 17 nt, Human
gggguucagccccuccu

SEQ ID NO: 2093329 - RNA, 22 nt, Human
gggguucagccccuccucugcc

SEQ ID NO: 2093330 - RNA, 22 nt, Human
gggguucuuucuuccucugcug

SEQ ID NO: 2093331 - RNA, 20 nt, Human
gggguucuuucuuccucugc

SEQ ID NO: 2093332 - RNA, 21 nt, Human
ggggugcccuccacugcccuc

SEQ ID NO: 2093333 - RNA, 16 nt, Human
gggguuauuuucuggu

SEQ ID NO: 2093334 - RNA, 16 nt, Human
gggguucagccccucc

SEQ ID NO: 2093335 - RNA, 22 nt, Human
ggggucuuugugagagugagcu

SEQ ID NO: 2093336 - RNA, 13 nt, Human
ggggugaggacca

SEQ ID NO: 2093337 - RNA, 15 nt, Human
ggggugcagcaguga

SEQ ID NO: 2093338 - RNA, 16 nt, Human
ggggcagagggcagag

SEQ ID NO: 2093339 - RNA, 17 nt, Human
ggggcagccugcguggc

SEQ ID NO: 2093340 - RNA, 14 nt, Human
ggggcagcugccag

SEQ ID NO: 2093341 - RNA, 18 nt, Human
ggggcagagggcagaggc

SEQ ID NO: 2093342 - RNA, 22 nt, Human
ggggcagagggcagaggcugga

SEQ ID NO: 2093343 - RNA, 21 nt, Human
ggggcagccaaacccaugagg

SEQ ID NO: 2093344 - RNA, 17 nt, Human
ggggaucacagccucug

SEQ ID NO: 2093345 - RNA, 21 nt, Human
ggggaugacuagaggcaggga

SEQ ID NO: 2093346 - RNA, 13 nt, Human
ggggaugcuucau

SEQ ID NO: 2093347 - RNA, 20 nt, Human
ggggagugggacagagucug

SEQ ID NO: 2093348 - RNA, 19 nt, Human
ggggagaacuuacauugug

SEQ ID NO: 2093349 - RNA, 16 nt, Human
ggggagacaccucaga

SEQ ID NO: 2093350 - RNA, 17 nt, Human
ggggagacaccucagag

SEQ ID NO: 2093351 - RNA, 19 nt, Human
ggggagaucggggccagag

SEQ ID NO: 2093352 - RNA, 14 nt, Human
ggggagcagagaca

SEQ ID NO: 2093353 - RNA, 17 nt, Human
ggggagucugaagcaga

SEQ ID NO: 2093354 - RNA, 19 nt, Human
ggggagugggacagagucu

SEQ ID NO: 2093355 - RNA, 16 nt, Human
ggggagucugaagcag

SEQ ID NO: 2093356 - RNA, 12 nt, Human
ggggaggagggc

SEQ ID NO: 2093357 - RNA, 18 nt, Human
ggggaggaaacucaccug

SEQ ID NO: 2093358 - RNA, 16 nt, Human
ggggaggaccucuggg

SEQ ID NO: 2093359 - RNA, 18 nt, Human
gggcuucaguggcagcug

SEQ ID NO: 2093360 - RNA, 17 nt, Human
gggcuucaguggcagcu

SEQ ID NO: 2093361 - RNA, 16 nt, Human
gggcuucaguggcagc

SEQ ID NO: 2093362 - RNA, 15 nt, Human
gggcuucaguggcag

SEQ ID NO: 2093363 - RNA, 20 nt, Human
gggcuucaguggcagcugcu

SEQ ID NO: 2093364 - RNA, 19 nt, Human
gggcuucaguggcagcugc

SEQ ID NO: 2093365 - RNA, 23 nt, Human
gggcuuccauuugugugugugca

SEQ ID NO: 2093366 - RNA, 19 nt, Human
gggcuugcaaguauguuuu

SEQ ID NO: 2093367 - RNA, 10 nt, Human
gggccuggca

SEQ ID NO: 2093368 - RNA, 22 nt, Human
gggccuggcagccgugccuuca

SEQ ID NO: 2093369 - RNA, 18 nt, Human
gggccuggucguuuucaa

SEQ ID NO: 2093370 - RNA, 19 nt, Human
gggccuggucccugggagg

SEQ ID NO: 2093371 - RNA, 12 nt, Human
gggcccuccuga

SEQ ID NO: 2093372 - RNA, 23 nt, Human
gggcccuccugaaacuuacacac

SEQ ID NO: 2093373 - RNA, 21 nt, Human
ggcucccacaggcccuuccuc

SEQ ID NO: 2093374 - RNA, 20 nt, Human
ggcucccacaggcccuuccu

SEQ ID NO: 2093375 - RNA, 16 nt, Human
gggcgcgguggcucac

SEQ ID NO: 2093376 - RNA, 16 nt, Human
gggccuuaaaagccau

SEQ ID NO: 2093377 - RNA, 18 nt, Human
gggcgagucacugccucu

SEQ ID NO: 2093378 - RNA, 20 nt, Human
gggcgagacucugucucaaa

SEQ ID NO: 2093379 - RNA, 12 nt, Human
gggccuugccca

SEQ ID NO: 2093380 - RNA, 12 nt, Human
gggccuguugcc

SEQ ID NO: 2093381 - RNA, 14 nt, Human
gggccuguugcccu

SEQ ID NO: 2093382 - RNA, 14 nt, Human
gggccuugcccaga

SEQ ID NO: 2093383 - RNA, 15 nt, Human
gggccuugcccagag

SEQ ID NO: 2093384 - RNA, 17 nt, Human
gggccuugcccagagau

SEQ ID NO: 2093385 - RNA, 22 nt, Human
gggccuugcccagagaugccuc

SEQ ID NO: 2093386 - RNA, 23 nt, Human
gggccuugcuaccucaaggggga

SEQ ID NO: 2093387 - RNA, 20 nt, Human
gggccuguacaaaagggaca

SEQ ID NO: 2093388 - RNA, 23 nt, Human
gggccuguacaaaagggacauga

SEQ ID NO: 2093389 - RNA, 16 nt, Human
gggcugaggugggagg

SEQ ID NO: 2093390 - RNA, 14 nt, Human
gggcugaucucagg

SEQ ID NO: 2093391 - RNA, 16 nt, Human
gggcugaucucaggga

SEQ ID NO: 2093392 - RNA, 18 nt, Human
gggcugaucucagggaag

SEQ ID NO: 2093393 - RNA, 14 nt, Human
gggcuucaguggca

SEQ ID NO: 2093394 - RNA, 12 nt, Human
gggcugugaucg

SEQ ID NO: 2093395 - RNA, 10 nt, Human
gggcugagac

SEQ ID NO: 2093396 - RNA, 20 nt, Human
gggcugacuagaagggccag

SEQ ID NO: 2093397 - RNA, 18 nt, Human
gggcugaacggggagaaa

SEQ ID NO: 2093398 - RNA, 20 nt, Human
gggcucugccccagcucugg

SEQ ID NO: 2093399 - RNA, 21 nt, Human
gggcucugccccagcucuggc

SEQ ID NO: 2093400 - RNA, 16 nt, Human
gggcucugcccucccu

SEQ ID NO: 2093401 - RNA, 21 nt, Human
gggcucugcccucccuccuuc

SEQ ID NO: 2093402 - RNA, 22 nt, Human
gggcucugcccucccuccuucc

SEQ ID NO: 2093403 - RNA, 11 nt, Human
gggcugagggg

SEQ ID NO: 2093404 - RNA, 12 nt, Human
gggcugaggggc

SEQ ID NO: 2093405 - RNA, 18 nt, Human
gggcugaggggcaacgaa

SEQ ID NO: 2093406 - RNA, 16 nt, Human
gggcugagcugccugu

SEQ ID NO: 2093407 - RNA, 18 nt, Human
gggcugagcccuggcagg

SEQ ID NO: 2093408 - RNA, 16 nt, Human
gggcugagcccuggca

SEQ ID NO: 2093409 - RNA, 17 nt, Human
gggcugagcccuggcag

SEQ ID NO: 2093410 - RNA, 18 nt, Human
gggcugagagaaccucac

SEQ ID NO: 2093411 - RNA, 13 nt, Human
gggcugagcccug

SEQ ID NO: 2093412 - RNA, 15 nt, Human
gggcugagcccuggc

SEQ ID NO: 2093413 - RNA, 11 nt, Human
gggcucugccc

SEQ ID NO: 2093414 - RNA, 12 nt, Human
gggcucugcccc

SEQ ID NO: 2093415 - RNA, 19 nt, Human
gggcucugccccagcucug

SEQ ID NO: 2093416 - RNA, 19 nt, Human
gggcucucugcuguacaua

SEQ ID NO: 2093417 - RNA, 13 nt, Human
gggcucuccaccu

SEQ ID NO: 2093418 - RNA, 14 nt, Human
gggcucuccaccuc

SEQ ID NO: 2093419 - RNA, 17 nt, Human
gggcucuccaccucagc

SEQ ID NO: 2093420 - RNA, 18 nt, Human
gggcucuccaccucagcc

SEQ ID NO: 2093421 - RNA, 19 nt, Human
gggcucuccaccucagccu

SEQ ID NO: 2093422 - RNA, 21 nt, Human
gggcucuccaccucagccuug

SEQ ID NO: 2093423 - RNA, 13 nt, Human
gggcucccuuccu

SEQ ID NO: 2093424 - RNA, 11 nt, Human
gggcuccugga

SEQ ID NO: 2093425 - RNA, 12 nt, Human
gggcuccuggaa

SEQ ID NO: 2093426 - RNA, 20 nt, Human
gggcuccuggaaaggcucag

SEQ ID NO: 2093427 - RNA, 23 nt, Human
gggcuccuggaaaggcucagucu

SEQ ID NO: 2093428 - RNA, 22 nt, Human
gucauaacuagaacugaauuuu

SEQ ID NO: 2093429 - RNA, 14 nt, Human
gucagcuacuaaug

SEQ ID NO: 2093430 - RNA, 13 nt, Human
gucagccacaugg

SEQ ID NO: 2093431 - RNA, 16 nt, Human
gucauaccaacuuuag

SEQ ID NO: 2093432 - RNA, 16 nt, Human
gucauaccaggccgcc

SEQ ID NO: 2093433 - RNA, 17 nt, Human
gucauaacuagaacuga

SEQ ID NO: 2093434 - RNA, 22 nt, Human
gucagccuucccccucccaggg

SEQ ID NO: 2093435 - RNA, 23 nt, Human
gucaccugcccagaucccagaag

SEQ ID NO: 2093436 - RNA, 14 nt, Human
gucaccuuuuaaau

SEQ ID NO: 2093437 - RNA, 17 nt, Human
gucaccuuuuaaauccu

SEQ ID NO: 2093438 - RNA, 19 nt, Human
gucaccuuuuaaauccugu

SEQ ID NO: 2093439 - RNA, 21 nt, Human
gucaccuuuuaaauccuguug

SEQ ID NO: 2093440 - RNA, 16 nt, Human
gucacgcagccaccag

SEQ ID NO: 2093441 - RNA, 21 nt, Human
gucagcaaguccuaagccugu

SEQ ID NO: 2093442 - RNA, 13 nt, Human
gucagcaggaagc

SEQ ID NO: 2093443 - RNA, 15 nt, Human
gucagccaaauguaa

SEQ ID NO: 2093444 - RNA, 15 nt, Human
gucaugauggcacca

SEQ ID NO: 2093445 - RNA, 20 nt, Human
gucaugaucucccugccgcc

SEQ ID NO: 2093446 - RNA, 22 nt, Human
gucaugaucucccugccgccuc

SEQ ID NO: 2093447 - RNA, 16 nt, Human
gucaugaucucccugc

SEQ ID NO: 2093448 - RNA, 17 nt, Human
gucaugaucucccugcc

SEQ ID NO: 2093449 - RNA, 18 nt, Human
gucaugaucucccugccg

SEQ ID NO: 2093450 - RNA, 19 nt, Human
gucaugaucucccugccgc

SEQ ID NO: 2093451 - RNA, 18 nt, Human
gucaucuugaccaagcag

SEQ ID NO: 2093452 - RNA, 16 nt, Human
gucaucugguagauuu

SEQ ID NO: 2093453 - RNA, 20 nt, Human
gucaucuugaccaagcagga

SEQ ID NO: 2093454 - RNA, 22 nt, Human
gucaucuugaccaagcaggaag

SEQ ID NO: 2093455 - RNA, 18 nt, Human
gucaucuuuuucucuaaa

SEQ ID NO: 2093456 - RNA, 22 nt, Human
gucaucuuuuucucuaaaauag

SEQ ID NO: 2093457 - RNA, 14 nt, Human
gucaugaagcccaa

SEQ ID NO: 2093458 - RNA, 18 nt, Human
gucaugagcugagcaggg

SEQ ID NO: 2093459 - RNA, 16 nt, Human
gucaugagcugagcag

SEQ ID NO: 2093460 - RNA, 14 nt, Human
gucaugaucucccu

SEQ ID NO: 2093461 - RNA, 15 nt, Human
gucaugaucucccug

SEQ ID NO: 2093462 - RNA, 14 nt, Human
gucaucccauuguc

SEQ ID NO: 2093463 - RNA, 19 nt, Human
gucaucguaggugauuuga

SEQ ID NO: 2093464 - RNA, 18 nt, Human
gucaucuaccuuuucucu

SEQ ID NO: 2093465 - RNA, 16 nt, Human
gucaucucagcuggau

SEQ ID NO: 2093466 - RNA, 17 nt, Human
gucaucuccaucagcug

SEQ ID NO: 2093467 - RNA, 19 nt, Human
gucaucuccaucagcugua

SEQ ID NO: 2093468 - RNA, 13 nt, Human
gucauaucuucac

SEQ ID NO: 2093469 - RNA, 21 nt, Human
gucauauaagauucauauuua

SEQ ID NO: 2093470 - RNA, 13 nt, Human
gucauagaagaac

SEQ ID NO: 2093471 - RNA, 14 nt, Human
guccagcuugcucu

SEQ ID NO: 2093472 - RNA, 16 nt, Human
guccagcuugcucuuc

SEQ ID NO: 2093473 - RNA, 17 nt, Human
guccagcuugcucuuca

SEQ ID NO: 2093474 - RNA, 16 nt, Human
guccacccaggagccc

SEQ ID NO: 2093475 - RNA, 15 nt, Human
guccacccaggagcc

SEQ ID NO: 2093476 - RNA, 14 nt, Human
guccacccaggagc

SEQ ID NO: 2093477 - RNA, 21 nt, Human
gucaugguuucuuggagggcc

SEQ ID NO: 2093478 - RNA, 16 nt, Human
gucccacucaagccaa

SEQ ID NO: 2093479 - RNA, 18 nt, Human
gucccacucaagccaagc

SEQ ID NO: 2093480 - RNA, 21 nt, Human
gucccacucaagccaagcagc

SEQ ID NO: 2093481 - RNA, 22 nt, Human
gucccacucaagccaagcagcc

SEQ ID NO: 2093482 - RNA, 15 nt, Human
gucccacucagucca

SEQ ID NO: 2093483 - RNA, 14 nt, Human
gucccacucagucc

SEQ ID NO: 2093484 - RNA, 14 nt, Human
guccagggcccuga

SEQ ID NO: 2093485 - RNA, 15 nt, Human
guccagggcccugag

SEQ ID NO: 2093486 - RNA, 16 nt, Human
guccagggcccugagc

SEQ ID NO: 2093487 - RNA, 17 nt, Human
guccagggcccugagcu

SEQ ID NO: 2093488 - RNA, 12 nt, Human
gucccacucaag

SEQ ID NO: 2093489 - RNA, 17 nt, Human
guccaggccccaaaacc

SEQ ID NO: 2093490 - RNA, 20 nt, Human
guccagggaagcuggccgag

SEQ ID NO: 2093491 - RNA, 13 nt, Human
guccagggaagcu

SEQ ID NO: 2093492 - RNA, 15 nt, Human
guccagggaagcugg

SEQ ID NO: 2093493 - RNA, 14 nt, Human
gucccagccacccc

SEQ ID NO: 2093494 - RNA, 15 nt, Human
gucccagccaccccg

SEQ ID NO: 2093495 - RNA, 16 nt, Human
gucccagccaccccgg

SEQ ID NO: 2093496 - RNA, 18 nt, Human
gucccagccaccccgggc

SEQ ID NO: 2093497 - RNA, 21 nt, Human
gucccagccaccccgggcucu

SEQ ID NO: 2093498 - RNA, 14 nt, Human
gucccagcuacucg

SEQ ID NO: 2093499 - RNA, 23 nt, Human
gucccagccaccccgggcucucu

SEQ ID NO: 2093500 - RNA, 22 nt, Human
gucccagcuacucagaagccug

SEQ ID NO: 2093501 - RNA, 17 nt, Human
gucccagauacuugggg

SEQ ID NO: 2093502 - RNA, 19 nt, Human
gucaagugaaaaaggagga

SEQ ID NO: 2093503 - RNA, 16 nt, Human
gucaagugaaaaagga

SEQ ID NO: 2093504 - RNA, 18 nt, Human
gucaagugaaaaaggagg

SEQ ID NO: 2093505 - RNA, 17 nt, Human
gucaacuugagcauguu

SEQ ID NO: 2093506 - RNA, 17 nt, Human
gucaagaagaagaugga

SEQ ID NO: 2093507 - RNA, 14 nt, Human
gucaagcccaggag

SEQ ID NO: 2093508 - RNA, 14 nt, Human
gucaagauuuugaa

SEQ ID NO: 2093509 - RNA, 12 nt, Human
gucaaggccugu

SEQ ID NO: 2093510 - RNA, 21 nt, Human
gucaaggccugucccuggcca

SEQ ID NO: 2093511 - RNA, 11 nt, Human
gucaaggccag

SEQ ID NO: 2093512 - RNA, 12 nt, Human
gucaaggccagc

SEQ ID NO: 2093513 - RNA, 13 nt, Human
gucaaggccagca

SEQ ID NO: 2093514 - RNA, 14 nt, Human
gucaagcugcuugg

SEQ ID NO: 2093515 - RNA, 15 nt, Human
gucaaggaguggcuu

SEQ ID NO: 2093516 - RNA, 19 nt, Human
gucaagagggucugaggaa

SEQ ID NO: 2093517 - RNA, 18 nt, Human
gucaagagggucugagga

SEQ ID NO: 2093518 - RNA, 20 nt, Human
gucaacuugagcauguuacu

SEQ ID NO: 2093519 - RNA, 13 nt, Human
gucaacuuuaugc

SEQ ID NO: 2093520 - RNA, 14 nt, Human
guauuuguuaaugg

SEQ ID NO: 2093521 - RNA, 23 nt, Human
gucaccggauccuggguggucug

SEQ ID NO: 2093522 - RNA, 20 nt, Human
gucaccugaagacucauucu

SEQ ID NO: 2093523 - RNA, 16 nt, Human
gucaccaucucaggcc

SEQ ID NO: 2093524 - RNA, 17 nt, Human
gucaccaucucaggcca

SEQ ID NO: 2093525 - RNA, 20 nt, Human
gucaccaucucaggccaccu

SEQ ID NO: 2093526 - RNA, 21 nt, Human
gucaccaucucaggccaccug

SEQ ID NO: 2093527 - RNA, 16 nt, Human
gucaccggauccuggg

SEQ ID NO: 2093528 - RNA, 17 nt, Human
gucaccggauccugggu

SEQ ID NO: 2093529 - RNA, 19 nt, Human
gucaccggauccugggugg

SEQ ID NO: 2093530 - RNA, 11 nt, Human
gucaaguuauu

SEQ ID NO: 2093531 - RNA, 20 nt, Human
gucaaguuauuaauuucuuc

SEQ ID NO: 2093532 - RNA, 18 nt, Human
gucaaguuauuaauuucu

SEQ ID NO: 2093533 - RNA, 15 nt, Human
guauuugagacauuc

SEQ ID NO: 2093534 - RNA, 17 nt, Human
guauuugagacauucca

SEQ ID NO: 2093535 - RNA, 15 nt, Human
guauuugaaucagcc

SEQ ID NO: 2093536 - RNA, 16 nt, Human
guauuucagaugcuuu

SEQ ID NO: 2093537 - RNA, 16 nt, Human
guauuuccagugcaau

SEQ ID NO: 2093538 - RNA, 11 nt, Human
guauuucagac

SEQ ID NO: 2093539 - RNA, 23 nt, Human
guauuuauuuuccuccccagcag

SEQ ID NO: 2093540 - RNA, 17 nt, Human
guauuuauuuuccuccc

SEQ ID NO: 2093541 - RNA, 18 nt, Human
guauuuauuuuccucccc

SEQ ID NO: 2093542 - RNA, 19 nt, Human
guauuuauuuuccucccca

SEQ ID NO: 2093543 - RNA, 20 nt, Human
guauuuauuuuccuccccag

SEQ ID NO: 2093544 - RNA, 22 nt, Human
guauuuauuuuccuccccagca

SEQ ID NO: 2093545 - RNA, 22 nt, Human
guauucgugcagcauaugagga

SEQ ID NO: 2093546 - RNA, 14 nt, Human
guauuccaccuuaa

SEQ ID NO: 2093547 - RNA, 15 nt, Human
guauuccaccuuaaa

SEQ ID NO: 2093548 - RNA, 19 nt, Human
guauuccaccuuaaauuaa

SEQ ID NO: 2093549 - RNA, 20 nt, Human
guauuccaccuuaaauuaaa

SEQ ID NO: 2093550 - RNA, 22 nt, Human
guauuccaccuuaaauuaaaca

SEQ ID NO: 2093551 - RNA, 15 nt, Human
guauuccaguuuguu

SEQ ID NO: 2093552 - RNA, 18 nt, Human
guauuccaguuuguuuau

SEQ ID NO: 2093553 - RNA, 22 nt, Human
guauucagugagggucuucuua

SEQ ID NO: 2093554 - RNA, 20 nt, Human
guauuccuuuuguguacagu

SEQ ID NO: 2093555 - RNA, 23 nt, Human
guauuccuuuuguguacagugug

SEQ ID NO: 2093556 - RNA, 19 nt, Human
guauucccauuagaccaag

SEQ ID NO: 2093557 - RNA, 19 nt, Human
guauuauaggccaaacugg

SEQ ID NO: 2093558 - RNA, 15 nt, Human
guauuauucugcagc

SEQ ID NO: 2093559 - RNA, 13 nt, Human
guauucaagaaag

SEQ ID NO: 2093560 - RNA, 14 nt, Human
guauucaagaaagc

SEQ ID NO: 2093561 - RNA, 17 nt, Human
guauucaagaaagccag

SEQ ID NO: 2093562 - RNA, 18 nt, Human
guauucaagaaagccagu

SEQ ID NO: 2093563 - RNA, 16 nt, Human
guauuauucugcagca

SEQ ID NO: 2093564 - RNA, 15 nt, Human
guauuacuucugcua

SEQ ID NO: 2093565 - RNA, 14 nt, Human
guauuacuucugcu

SEQ ID NO: 2093566 - RNA, 13 nt, Human
guauuacuucugc

SEQ ID NO: 2093567 - RNA, 15 nt, Human
guauuacauaaauaa

SEQ ID NO: 2093568 - RNA, 15 nt, Human
guagagugggagcug

SEQ ID NO: 2093569 - RNA, 23 nt, Human
guagagucaucuccaucagcugu

SEQ ID NO: 2093570 - RNA, 15 nt, Human
guagagucaucucca

SEQ ID NO: 2093571 - RNA, 13 nt, Human
guagagugggagc

SEQ ID NO: 2093572 - RNA, 13 nt, Human
gucucgugguagg

SEQ ID NO: 2093573 - RNA, 17 nt, Human
gucucuaugccagcuca

SEQ ID NO: 2093574 - RNA, 23 nt, Human
gucucuaugccagcucaguccca

SEQ ID NO: 2093575 - RNA, 23 nt, Human
gucucggguggcuagucagagag

SEQ ID NO: 2093576 - RNA, 16 nt, Human
gucucgcuuuguugcc

SEQ ID NO: 2093577 - RNA, 17 nt, Human
gucucgcuuuguugccc

SEQ ID NO: 2093578 - RNA, 19 nt, Human
gucucgcuuuguugcccag

SEQ ID NO: 2093579 - RNA, 23 nt, Human
gucucgcuuuguugcccaggcug

SEQ ID NO: 2093580 - RNA, 11 nt, Human
gucucuauuua

SEQ ID NO: 2093581 - RNA, 13 nt, Human
gucucuauuuaaa

SEQ ID NO: 2093582 - RNA, 14 nt, Human
gucucuauuuaaau

SEQ ID NO: 2093583 - RNA, 17 nt, Human
gucucuauuuaaauucu

SEQ ID NO: 2093584 - RNA, 19 nt, Human
gucucuauuuaaauucuuu

SEQ ID NO: 2093585 - RNA, 20 nt, Human
gucucuauuuaaauucuuuu

SEQ ID NO: 2093586 - RNA, 21 nt, Human
gucucuauuuaaauucuuuuu

SEQ ID NO: 2093587 - RNA, 12 nt, Human
gucucucagaau

SEQ ID NO: 2093588 - RNA, 17 nt, Human
gucucuuaaaaaaauaa

SEQ ID NO: 2093589 - RNA, 23 nt, Human
gucucucuauuaccacugaagau

SEQ ID NO: 2093590 - RNA, 19 nt, Human
gucugaggaauccagaccc

SEQ ID NO: 2093591 - RNA, 18 nt, Human
gucugaggaauccagacc

SEQ ID NO: 2093592 - RNA, 14 nt, Human
gucugacccucucc

SEQ ID NO: 2093593 - RNA, 17 nt, Human
gucucuucuccacugga

SEQ ID NO: 2093594 - RNA, 15 nt, Human
gucugacccacugcu

SEQ ID NO: 2093595 - RNA, 14 nt, Human
gucucuucuccacu

SEQ ID NO: 2093596 - RNA, 11 nt, Human
gucucuucaga

SEQ ID NO: 2093597 - RNA, 16 nt, Human
gucucuucuccacugg

SEQ ID NO: 2093598 - RNA, 15 nt, Human
gucucuucuccacug

SEQ ID NO: 2093599 - RNA, 14 nt, Human
gucugacccacugc

SEQ ID NO: 2093600 - RNA, 13 nt, Human
gucugacccacug

SEQ ID NO: 2093601 - RNA, 18 nt, Human
gucugagccaaagagaau

SEQ ID NO: 2093602 - RNA, 21 nt, Human
gucugaggaauccagacccgg

SEQ ID NO: 2093603 - RNA, 19 nt, Human
gucugauucccaagcucug

SEQ ID NO: 2093604 - RNA, 18 nt, Human
gucugauucccaagcucu

SEQ ID NO: 2093605 - RNA, 17 nt, Human
gucugauucccaagcuc

SEQ ID NO: 2093606 - RNA, 21 nt, Human
gucugauucccaagcucugcu

SEQ ID NO: 2093607 - RNA, 20 nt, Human
gucugauucccaagcucugc

SEQ ID NO: 2093608 - RNA, 20 nt, Human
gucugauugguuuuaauuga

SEQ ID NO: 2093609 - RNA, 22 nt, Human
gucugauuucaggauacucugu

SEQ ID NO: 2093610 - RNA, 13 nt, Human
gucugcaggcagg

SEQ ID NO: 2093611 - RNA, 12 nt, Human
gucugcaggcag

SEQ ID NO: 2093612 - RNA, 15 nt, Human
gucugcauuuucuga

SEQ ID NO: 2093613 - RNA, 20 nt, Human
gucugcauuuucugaaacua

SEQ ID NO: 2093614 - RNA, 21 nt, Human
gucugcauuuucugaaacuaa

SEQ ID NO: 2093615 - RNA, 14 nt, Human
gucugcacuuaaau

SEQ ID NO: 2093616 - RNA, 16 nt, Human
gucucagaaucuuucc

SEQ ID NO: 2093617 - RNA, 17 nt, Human
gucucagaaucuuuccu

SEQ ID NO: 2093618 - RNA, 20 nt, Human
gucucagaaucuuuccuucc

SEQ ID NO: 2093619 - RNA, 23 nt, Human
gucucacuguugcccaggcuggc

SEQ ID NO: 2093620 - RNA, 22 nt, Human
gucucacuguugcccaggcugg

SEQ ID NO: 2093621 - RNA, 21 nt, Human
gucucacuguugcccaggcug

SEQ ID NO: 2093622 - RNA, 20 nt, Human
gucucacuguugcccaggcu

SEQ ID NO: 2093623 - RNA, 19 nt, Human
gucucacuguugcccaggc

SEQ ID NO: 2093624 - RNA, 18 nt, Human
gucucacuguugcccagg

SEQ ID NO: 2093625 - RNA, 17 nt, Human
gucucacuguugcccag

SEQ ID NO: 2093626 - RNA, 16 nt, Human
gucucacuguugccca

SEQ ID NO: 2093627 - RNA, 23 nt, Human
gucucacuauguugcccaggcag

SEQ ID NO: 2093628 - RNA, 13 nt, Human
gucucacuguugc

SEQ ID NO: 2093629 - RNA, 21 nt, Human
gucucacuauguugcccaggc

SEQ ID NO: 2093630 - RNA, 20 nt, Human
gucucacuauguugcccagg

SEQ ID NO: 2093631 - RNA, 16 nt, Human
guccugucuccccucu

SEQ ID NO: 2093632 - RNA, 17 nt, Human
guccugucuccccucug

SEQ ID NO: 2093633 - RNA, 18 nt, Human
guccugucuccccucugc

SEQ ID NO: 2093634 - RNA, 20 nt, Human
guccuuaaugauccguucca

SEQ ID NO: 2093635 - RNA, 14 nt, Human
gucgugggugugug

SEQ ID NO: 2093636 - RNA, 12 nt, Human
gucuaaaaacac

SEQ ID NO: 2093637 - RNA, 16 nt, Human
gucuaaaauccugcuu

SEQ ID NO: 2093638 - RNA, 13 nt, Human
gucuaccaucucc

SEQ ID NO: 2093639 - RNA, 14 nt, Human
gucuaccaucuccc

SEQ ID NO: 2093640 - RNA, 15 nt, Human
guccucccccugcca

SEQ ID NO: 2093641 - RNA, 16 nt, Human
guccucccccugccag

SEQ ID NO: 2093642 - RNA, 17 nt, Human
guccucccccugccagu

SEQ ID NO: 2093643 - RNA, 19 nt, Human
guccucccccugccagugc

SEQ ID NO: 2093644 - RNA, 20 nt, Human
guccucccccugccagugcc

SEQ ID NO: 2093645 - RNA, 21 nt, Human
guccucccccugccagugccu

SEQ ID NO: 2093646 - RNA, 22 nt, Human
guccucccccugccagugccuu

SEQ ID NO: 2093647 - RNA, 15 nt, Human
guccuccccucaagg

SEQ ID NO: 2093648 - RNA, 16 nt, Human
guccuccccucaagga

SEQ ID NO: 2093649 - RNA, 16 nt, Human
guccugggagugagcu

SEQ ID NO: 2093650 - RNA, 15 nt, Human
guccugggagugagc

SEQ ID NO: 2093651 - RNA, 11 nt, Human
guccuggcucc

SEQ ID NO: 2093652 - RNA, 14 nt, Human
guccuggcuccuga

SEQ ID NO: 2093653 - RNA, 17 nt, Human
guccuggcuccugaggg

SEQ ID NO: 2093654 - RNA, 19 nt, Human
guccuggcuccugaggggc

SEQ ID NO: 2093655 - RNA, 19 nt, Human
guccugggagaaccucagg

SEQ ID NO: 2093656 - RNA, 20 nt, Human
guccugggagaaccucaggc

SEQ ID NO: 2093657 - RNA, 21 nt, Human
guccugggagaaccucaggcu

SEQ ID NO: 2093658 - RNA, 18 nt, Human
guccugucggagcccugu

SEQ ID NO: 2093659 - RNA, 21 nt, Human
guccugucggagcccugucuc

SEQ ID NO: 2093660 - RNA, 20 nt, Human
guccugucggagcccugucu

SEQ ID NO: 2093661 - RNA, 14 nt, Human
guccuggggccucg

SEQ ID NO: 2093662 - RNA, 11 nt, Human
guccugggggc

SEQ ID NO: 2093663 - RNA, 14 nt, Human
guccugggggccug

SEQ ID NO: 2093664 - RNA, 15 nt, Human
guccugggggccuga

SEQ ID NO: 2093665 - RNA, 17 nt, Human
guccugggggccugacc

SEQ ID NO: 2093666 - RNA, 18 nt, Human
guccugggggccugaccu

SEQ ID NO: 2093667 - RNA, 22 nt, Human
guccuggggccucggagccuca

SEQ ID NO: 2093668 - RNA, 15 nt, Human
guccuggggcucugu

SEQ ID NO: 2093669 - RNA, 16 nt, Human
guccuggggcucugug

SEQ ID NO: 2093670 - RNA, 17 nt, Human
guccuggggcucugugc

SEQ ID NO: 2093671 - RNA, 18 nt, Human
guccugggagugagcugg

SEQ ID NO: 2093672 - RNA, 17 nt, Human
guccugggagugagcug

SEQ ID NO: 2093673 - RNA, 19 nt, Human
guccugggagugagcuggu

SEQ ID NO: 2093674 - RNA, 12 nt, Human
gucccagugccg

SEQ ID NO: 2093675 - RNA, 15 nt, Human
gucccuggccaucuc

SEQ ID NO: 2093676 - RNA, 13 nt, Human
guccuacucugug

SEQ ID NO: 2093677 - RNA, 19 nt, Human
gucccugggggaagcccug

SEQ ID NO: 2093678 - RNA, 20 nt, Human
gucccugggggaagcccugg

SEQ ID NO: 2093679 - RNA, 21 nt, Human
gucccugggggaagcccugga

SEQ ID NO: 2093680 - RNA, 22 nt, Human
gucccugggggaagcccuggau

SEQ ID NO: 2093681 - RNA, 23 nt, Human
gucccugggggaagcccuggauu

SEQ ID NO: 2093682 - RNA, 23 nt, Human
guccuacucugugucaggugggg

SEQ ID NO: 2093683 - RNA, 15 nt, Human
guccuacucuguguc

SEQ ID NO: 2093684 - RNA, 21 nt, Human
guccuacuuuacauaugcuuu

SEQ ID NO: 2093685 - RNA, 15 nt, Human
gucccugguaauaag

SEQ ID NO: 2093686 - RNA, 23 nt, Human
guccuagaaauuccccacccuga

SEQ ID NO: 2093687 - RNA, 18 nt, Human
guccucacaucuuucaca

SEQ ID NO: 2093688 - RNA, 14 nt, Human
guccucacucccag

SEQ ID NO: 2093689 - RNA, 16 nt, Human
guccucacucccaguc

SEQ ID NO: 2093690 - RNA, 17 nt, Human
guccucacucccagucc

SEQ ID NO: 2093691 - RNA, 22 nt, Human
guccuaggccacaccaucuccu

SEQ ID NO: 2093692 - RNA, 23 nt, Human
guccuagcuugggaggcuucccc

SEQ ID NO: 2093693 - RNA, 12 nt, Human
guccuaggagua

SEQ ID NO: 2093694 - RNA, 19 nt, Human
guccuaggaguauccucau

SEQ ID NO: 2093695 - RNA, 18 nt, Human
guccuagccacucaggag

SEQ ID NO: 2093696 - RNA, 19 nt, Human
guccuagccacucaggagg

SEQ ID NO: 2093697 - RNA, 17 nt, Human
guccucagcuucuuaau

SEQ ID NO: 2093698 - RNA, 13 nt, Human
guccucagcuucu

SEQ ID NO: 2093699 - RNA, 18 nt, Human
guccucacucccagucca

SEQ ID NO: 2093700 - RNA, 13 nt, Human
guccuccagaagc

SEQ ID NO: 2093701 - RNA, 14 nt, Human
guccuccagaagcc

SEQ ID NO: 2093702 - RNA, 18 nt, Human
guccuccagaagccucug

SEQ ID NO: 2093703 - RNA, 19 nt, Human
guccuccagaagccucugg

SEQ ID NO: 2093704 - RNA, 20 nt, Human
guccuccagaagccucuggc

SEQ ID NO: 2093705 - RNA, 21 nt, Human
guccuccagaagccucuggcu

SEQ ID NO: 2093706 - RNA, 22 nt, Human
guccuccagaagccucuggcua

SEQ ID NO: 2093707 - RNA, 13 nt, Human
gugauucuccugc

SEQ ID NO: 2093708 - RNA, 23 nt, Human
gugauucuccugccucagccucc

SEQ ID NO: 2093709 - RNA, 16 nt, Human
gugauuuugcuguaga

SEQ ID NO: 2093710 - RNA, 22 nt, Human
gugauucuccugccucagccuc

SEQ ID NO: 2093711 - RNA, 20 nt, Human
gugauucuccugccucagcc

SEQ ID NO: 2093712 - RNA, 19 nt, Human
gugauucuccugccucagc

SEQ ID NO: 2093713 - RNA, 18 nt, Human
gugauucuccugccucag

SEQ ID NO: 2093714 - RNA, 17 nt, Human
gugauucuccugccuca

SEQ ID NO: 2093715 - RNA, 16 nt, Human
gugauucuccugccuc

SEQ ID NO: 2093716 - RNA, 18 nt, Human
gugauucgagcuauauuu

SEQ ID NO: 2093717 - RNA, 14 nt, Human
gugauucuccugcc

SEQ ID NO: 2093718 - RNA, 20 nt, Human
gugauccacccaccucagcc

SEQ ID NO: 2093719 - RNA, 18 nt, Human
gugauccacccaccucag

SEQ ID NO: 2093720 - RNA, 15 nt, Human
gugauccacccaccu

SEQ ID NO: 2093721 - RNA, 16 nt, Human
gugaggaccacuccug

SEQ ID NO: 2093722 - RNA, 16 nt, Human
gugaggaagcuccagu

SEQ ID NO: 2093723 - RNA, 14 nt, Human
gugaggagcugcug

SEQ ID NO: 2093724 - RNA, 11 nt, Human
gugaggagcug

SEQ ID NO: 2093725 - RNA, 12 nt, Human
gugaggcagggg

SEQ ID NO: 2093726 - RNA, 17 nt, Human
gugaggcaggggcggag

SEQ ID NO: 2093727 - RNA, 16 nt, Human
gugaggcaggugacag

SEQ ID NO: 2093728 - RNA, 18 nt, Human
gugauccucccaccucag

SEQ ID NO: 2093729 - RNA, 15 nt, Human
gugauccucccaccu

SEQ ID NO: 2093730 - RNA, 14 nt, Human
gugauccucccacc

SEQ ID NO: 2093731 - RNA, 22 nt, Human
gugauccucccaccucagccuc

SEQ ID NO: 2093732 - RNA, 20 nt, Human
gugauccucccaccucagcc

SEQ ID NO: 2093733 - RNA, 20 nt, Human
gugauucacagugugaaucu

SEQ ID NO: 2093734 - RNA, 23 nt, Human
gugauccucccaccucagccucc

SEQ ID NO: 2093735 - RNA, 23 nt, Human
gugcccaagaauagaugcugacu

SEQ ID NO: 2093736 - RNA, 21 nt, Human
gugcaugcucucugcagccag

SEQ ID NO: 2093737 - RNA, 15 nt, Human
gugcaugcucucugc

SEQ ID NO: 2093738 - RNA, 16 nt, Human
gugcaugcucucugca

SEQ ID NO: 2093739 - RNA, 18 nt, Human
gugcaugcucucugcagc

SEQ ID NO: 2093740 - RNA, 19 nt, Human
gugcaugcucucugcagcc

SEQ ID NO: 2093741 - RNA, 18 nt, Human
gugccagucuugugucug

SEQ ID NO: 2093742 - RNA, 20 nt, Human
gugcccacaggaucagucug

SEQ ID NO: 2093743 - RNA, 12 nt, Human
gugcccacagcc

SEQ ID NO: 2093744 - RNA, 14 nt, Human
gugcccacagcccg

SEQ ID NO: 2093745 - RNA, 19 nt, Human
gugcccacagcccgcaugc

SEQ ID NO: 2093746 - RNA, 22 nt, Human
gugcccacagcccgcaugcagc

SEQ ID NO: 2093747 - RNA, 20 nt, Human
gugcccagagaugggacugg

SEQ ID NO: 2093748 - RNA, 21 nt, Human
gugcccacauguguccauccc

SEQ ID NO: 2093749 - RNA, 23 nt, Human
gugcccacauguguccaucccag

SEQ ID NO: 2093750 - RNA, 23 nt, Human
gugcccaccaacaucccauugcc

SEQ ID NO: 2093751 - RNA, 22 nt, Human
gugcccagaacuggacucagga

SEQ ID NO: 2093752 - RNA, 12 nt, Human
gugcccagcuca

SEQ ID NO: 2093753 - RNA, 13 nt, Human
gugcccagcucag

SEQ ID NO: 2093754 - RNA, 16 nt, Human
gugcccaguuaaucuu

SEQ ID NO: 2093755 - RNA, 17 nt, Human
gugcccaguuaaucuug

SEQ ID NO: 2093756 - RNA, 16 nt, Human
gugccccaugccuguc

SEQ ID NO: 2093757 - RNA, 18 nt, Human
gugccccaugccugucca

SEQ ID NO: 2093758 - RNA, 13 nt, Human
gugccccaccugc

SEQ ID NO: 2093759 - RNA, 14 nt, Human
gugccccaccugcc

SEQ ID NO: 2093760 - RNA, 15 nt, Human
gugccccaccugcca

SEQ ID NO: 2093761 - RNA, 21 nt, Human
gugccccaugccuguccagcc

SEQ ID NO: 2093762 - RNA, 12 nt, Human
gugcccccagac

SEQ ID NO: 2093763 - RNA, 19 nt, Human
gugcauaaguuaacuucca

SEQ ID NO: 2093764 - RNA, 19 nt, Human
gugcaguggcccccacaga

SEQ ID NO: 2093765 - RNA, 22 nt, Human
gugcaaaguucccuacuuccug

SEQ ID NO: 2093766 - RNA, 22 nt, Human
gugauuuuuauccaaucuuguu

SEQ ID NO: 2093767 - RNA, 13 nt, Human
gugcaacagacaa

SEQ ID NO: 2093768 - RNA, 14 nt, Human
gugcaacagacaag

SEQ ID NO: 2093769 - RNA, 15 nt, Human
gugcaacagacaagu

SEQ ID NO: 2093770 - RNA, 23 nt, Human
gugcagggaggagguggcagccc

SEQ ID NO: 2093771 - RNA, 22 nt, Human
gugccagguuuuuggucugacc

SEQ ID NO: 2093772 - RNA, 20 nt, Human
gugccagguuuuuggucuga

SEQ ID NO: 2093773 - RNA, 18 nt, Human
gugcaugcagcaucuaag

SEQ ID NO: 2093774 - RNA, 13 nt, Human
gugcaugcucucu

SEQ ID NO: 2093775 - RNA, 18 nt, Human
gugcaucucagcccacau

SEQ ID NO: 2093776 - RNA, 14 nt, Human
gugcaucucagccc

SEQ ID NO: 2093777 - RNA, 22 nt, Human
gugcaugaagguuucugaaaau

SEQ ID NO: 2093778 - RNA, 15 nt, Human
gugcaucucagccca

SEQ ID NO: 2093779 - RNA, 16 nt, Human
gugaaucacguaaagc

SEQ ID NO: 2093780 - RNA, 18 nt, Human
gugaaucacguaaagcua

SEQ ID NO: 2093781 - RNA, 14 nt, Human
gugaaucagagcac

SEQ ID NO: 2093782 - RNA, 19 nt, Human
gugaauuaucccuuuucuu

SEQ ID NO: 2093783 - RNA, 14 nt, Human
gugaauuuuucucu

SEQ ID NO: 2093784 - RNA, 15 nt, Human
gugaauuuuucucua

SEQ ID NO: 2093785 - RNA, 15 nt, Human
gugaaucagacccua

SEQ ID NO: 2093786 - RNA, 17 nt, Human
gugaaaucaaaggugcu

SEQ ID NO: 2093787 - RNA, 22 nt, Human
gugaaauaccaaccugaagaca

SEQ ID NO: 2093788 - RNA, 17 nt, Human
gugaaauaccagugugg

SEQ ID NO: 2093789 - RNA, 17 nt, Human
gugaaauaguucaaagc

SEQ ID NO: 2093790 - RNA, 21 nt, Human
gugaaauaguucaaagccaag

SEQ ID NO: 2093791 - RNA, 21 nt, Human
gugaaagggagcuaucaggaa

SEQ ID NO: 2093792 - RNA, 21 nt, Human
gugaaagucagaugcccagag

SEQ ID NO: 2093793 - RNA, 21 nt, Human
gugaaacacaccaggcugugg

SEQ ID NO: 2093794 - RNA, 19 nt, Human
gugaaaauagguauacagu

SEQ ID NO: 2093795 - RNA, 16 nt, Human
gugaaacacaccaggc

SEQ ID NO: 2093796 - RNA, 17 nt, Human
gugaaacacaccaggcu

SEQ ID NO: 2093797 - RNA, 18 nt, Human
gugaaacacaccaggcug

SEQ ID NO: 2093798 - RNA, 20 nt, Human
gugaaacacaccaggcugug

SEQ ID NO: 2093799 - RNA, 23 nt, Human
gugaaacacaccaggcugugggc

SEQ ID NO: 2093800 - RNA, 14 nt, Human
gugaaaagaaaaau

SEQ ID NO: 2093801 - RNA, 23 nt, Human
gugaaaagaaaaaugagccuggc

SEQ ID NO: 2093802 - RNA, 14 nt, Human
gucugccagccagc

SEQ ID NO: 2093803 - RNA, 15 nt, Human
gucugccagccagca

SEQ ID NO: 2093804 - RNA, 21 nt, Human
gugaaaauagguauacagugg

SEQ ID NO: 2093805 - RNA, 16 nt, Human
gucugccagccagcag

SEQ ID NO: 2093806 - RNA, 20 nt, Human
gugaaagcaucacuugggau

SEQ ID NO: 2093807 - RNA, 19 nt, Human
gugaaacuaacagauaagc

SEQ ID NO: 2093808 - RNA, 13 nt, Human
gugaaagaaauca

SEQ ID NO: 2093809 - RNA, 14 nt, Human
gugaaagaaaucau

SEQ ID NO: 2093810 - RNA, 15 nt, Human
gugaaagaaaucaug

SEQ ID NO: 2093811 - RNA, 16 nt, Human
gugaaagaaaucaugu

SEQ ID NO: 2093812 - RNA, 17 nt, Human
gugaaagaaaucauguu

SEQ ID NO: 2093813 - RNA, 19 nt, Human
gugaaagaaaucauguuau

SEQ ID NO: 2093814 - RNA, 20 nt, Human
gugaaagaaaucauguuaug

SEQ ID NO: 2093815 - RNA, 21 nt, Human
gugaaagaaaucauguuauga

SEQ ID NO: 2093816 - RNA, 16 nt, Human
gugagcuccuaagcca

SEQ ID NO: 2093817 - RNA, 22 nt, Human
gugagcauuguggcugucagca

SEQ ID NO: 2093818 - RNA, 14 nt, Human
gugagccacugcac

SEQ ID NO: 2093819 - RNA, 12 nt, Human
gugagcagugug

SEQ ID NO: 2093820 - RNA, 21 nt, Human
gugagcagugugucuccugca

SEQ ID NO: 2093821 - RNA, 13 nt, Human
gugagccacugca

SEQ ID NO: 2093822 - RNA, 20 nt, Human
gugacugccccaacuccugg

SEQ ID NO: 2093823 - RNA, 21 nt, Human
gugacugccccaacuccugga

SEQ ID NO: 2093824 - RNA, 23 nt, Human
gugacugccccaacuccuggaag

SEQ ID NO: 2093825 - RNA, 23 nt, Human
gugacugagcaagacccugucuc

SEQ ID NO: 2093826 - RNA, 19 nt, Human
gugacugauguuaggcugg

SEQ ID NO: 2093827 - RNA, 21 nt, Human
gugacugauguuaggcugggc

SEQ ID NO: 2093828 - RNA, 16 nt, Human
gugacugccccaacuc

SEQ ID NO: 2093829 - RNA, 14 nt, Human
gugaccugaggaag

SEQ ID NO: 2093830 - RNA, 16 nt, Human
gugaccugaggaagcg

SEQ ID NO: 2093831 - RNA, 23 nt, Human
gugaccugaggauuuaagggaug

SEQ ID NO: 2093832 - RNA, 18 nt, Human
gugaccuccacagcuacc

SEQ ID NO: 2093833 - RNA, 16 nt, Human
gugacaacacuugugu

SEQ ID NO: 2093834 - RNA, 16 nt, Human
gugaauuuuucucuaa

SEQ ID NO: 2093835 - RNA, 20 nt, Human
gugacucgagucacacucaa

SEQ ID NO: 2093836 - RNA, 23 nt, Human
gugaccugccccgcccagcugca

SEQ ID NO: 2093837 - RNA, 23 nt, Human
gugaccuguggggauuucuccca

SEQ ID NO: 2093838 - RNA, 22 nt, Human
guggaacguuuuuccuguucuu

SEQ ID NO: 2093839 - RNA, 15 nt, Human
guggaaccaggaacc

SEQ ID NO: 2093840 - RNA, 16 nt, Human
guggacuuuccacccc

SEQ ID NO: 2093841 - RNA, 17 nt, Human
guggacuuuccaccccc

SEQ ID NO: 2093842 - RNA, 20 nt, Human
guggacuuuccacccccucc

SEQ ID NO: 2093843 - RNA, 22 nt, Human
guggacuuuccacccccucccu

SEQ ID NO: 2093844 - RNA, 21 nt, Human
guggagaaacuguagucucag

SEQ ID NO: 2093845 - RNA, 22 nt, Human
guggagaaauuccuugauucac

SEQ ID NO: 2093846 - RNA, 20 nt, Human
guggagaagcggcuggcagc

SEQ ID NO: 2093847 - RNA, 16 nt, Human
guggagaacuccuagg

SEQ ID NO: 2093848 - RNA, 23 nt, Human
guggagcccgcacccccacccuu

SEQ ID NO: 2093849 - RNA, 12 nt, Human
gugcuuuaagug

SEQ ID NO: 2093850 - RNA, 15 nt, Human
guggagccagggagc

SEQ ID NO: 2093851 - RNA, 22 nt, Human
guggagagggacagcccacuga

SEQ ID NO: 2093852 - RNA, 22 nt, Human
guggagagggaugaggugcugg

SEQ ID NO: 2093853 - RNA, 17 nt, Human
guggagagcuggugccc

SEQ ID NO: 2093854 - RNA, 21 nt, Human
guggagcacaaaagccucuca

SEQ ID NO: 2093855 - RNA, 23 nt, Human
guggagcagccaacaagcagggg

SEQ ID NO: 2093856 - RNA, 12 nt, Human
guggagagcugg

SEQ ID NO: 2093857 - RNA, 14 nt, Human
guggagagcuggug

SEQ ID NO: 2093858 - RNA, 16 nt, Human
guggagagcuggugcc

SEQ ID NO: 2093859 - RNA, 14 nt, Human
guggaugccucaga

SEQ ID NO: 2093860 - RNA, 15 nt, Human
guggaugauguuucg

SEQ ID NO: 2093861 - RNA, 18 nt, Human
guggaugccugguggcag

SEQ ID NO: 2093862 - RNA, 16 nt, Human
guggaugccugguggc

SEQ ID NO: 2093863 - RNA, 19 nt, Human
guggaguuggcauugcauu

SEQ ID NO: 2093864 - RNA, 14 nt, Human
guggauagaugccc

SEQ ID NO: 2093865 - RNA, 20 nt, Human
guggauagaugcccugcuag

SEQ ID NO: 2093866 - RNA, 21 nt, Human
guggauagaugcccugcuaga

SEQ ID NO: 2093867 - RNA, 13 nt, Human
guggaucacagag

SEQ ID NO: 2093868 - RNA, 13 nt, Human
guggaguggaugc

SEQ ID NO: 2093869 - RNA, 14 nt, Human
guggaucacagagg

SEQ ID NO: 2093870 - RNA, 15 nt, Human
guggaucacagaggc

SEQ ID NO: 2093871 - RNA, 13 nt, Human
guggaucaccuga

SEQ ID NO: 2093872 - RNA, 15 nt, Human
guggaucaccugagg

SEQ ID NO: 2093873 - RNA, 16 nt, Human
guggaucacagaggcu

SEQ ID NO: 2093874 - RNA, 13 nt, Human
guggaggugcugc

SEQ ID NO: 2093875 - RNA, 22 nt, Human
guggagguuaaggcugaggaaa

SEQ ID NO: 2093876 - RNA, 22 nt, Human
guggagguugcagugagccaag

SEQ ID NO: 2093877 - RNA, 23 nt, Human
guggagguugcagugagccaaga

SEQ ID NO: 2093878 - RNA, 19 nt, Human
guggagguugcagugagcu

SEQ ID NO: 2093879 - RNA, 21 nt, Human
guggagguuaaggcugaggaa

SEQ ID NO: 2093880 - RNA, 16 nt, Human
guggaggagcucagga

SEQ ID NO: 2093881 - RNA, 23 nt, Human
guggaggaaugcucccccauccu

SEQ ID NO: 2093882 - RNA, 16 nt, Human
guggaggaaugcuccc

SEQ ID NO: 2093883 - RNA, 17 nt, Human
guggaggaaugcucccc

SEQ ID NO: 2093884 - RNA, 16 nt, Human
guggaggagagccugg

SEQ ID NO: 2093885 - RNA, 17 nt, Human
guggaggagagccuggu

SEQ ID NO: 2093886 - RNA, 16 nt, Human
guggaggcugcaguga

SEQ ID NO: 2093887 - RNA, 20 nt, Human
guggaggagcucaggacacu

SEQ ID NO: 2093888 - RNA, 23 nt, Human
guggaggagcucaggacacuaau

SEQ ID NO: 2093889 - RNA, 14 nt, Human
guggccaaguucuu

SEQ ID NO: 2093890 - RNA, 18 nt, Human
guggcaucuuugccuugg

SEQ ID NO: 2093891 - RNA, 20 nt, Human
guggcaucuuugccuugggc

SEQ ID NO: 2093892 - RNA, 21 nt, Human
guggcaucuuugccuugggcu

SEQ ID NO: 2093893 - RNA, 16 nt, Human
guggcaucccaguggc

SEQ ID NO: 2093894 - RNA, 16 nt, Human
guggcaugugcuguga

SEQ ID NO: 2093895 - RNA, 22 nt, Human
guggcauguucaucguauaaca

SEQ ID NO: 2093896 - RNA, 21 nt, Human
guggcagugggagcugccugu

SEQ ID NO: 2093897 - RNA, 19 nt, Human
guggcagugggagcugccu

SEQ ID NO: 2093898 - RNA, 14 nt, Human
guggcaguaaagag

SEQ ID NO: 2093899 - RNA, 17 nt, Human
guggcaguaaagagaaa

SEQ ID NO: 2093900 - RNA, 20 nt, Human
guggcaguaaagagaaacuu

SEQ ID NO: 2093901 - RNA, 17 nt, Human
guggcagugcagcaacc

SEQ ID NO: 2093902 - RNA, 22 nt, Human
guggcagugcagcaaccagagc

SEQ ID NO: 2093903 - RNA, 14 nt, Human
guggcaucaccuua

SEQ ID NO: 2093904 - RNA, 20 nt, Human
guggcaucaccuuaggcagg

SEQ ID NO: 2093905 - RNA, 22 nt, Human
guggcaucaccuuaggcaggga

SEQ ID NO: 2093906 - RNA, 21 nt, Human
guggccacuccagaccccugg

SEQ ID NO: 2093907 - RNA, 15 nt, Human
guggccagaccagag

SEQ ID NO: 2093908 - RNA, 17 nt, Human
guggccagaccagagcu

SEQ ID NO: 2093909 - RNA, 18 nt, Human
guggccagaccagagcuc

SEQ ID NO: 2093910 - RNA, 21 nt, Human
guggccagaccagagcucugg

SEQ ID NO: 2093911 - RNA, 11 nt, Human
guggcagcugu

SEQ ID NO: 2093912 - RNA, 19 nt, Human
guggcagcugcuuuugucu

SEQ ID NO: 2093913 - RNA, 13 nt, Human
guggcagcugcuu

SEQ ID NO: 2093914 - RNA, 12 nt, Human
guggcagcugcu

SEQ ID NO: 2093915 - RNA, 23 nt, Human
guggcagcugcgguccacccagg

SEQ ID NO: 2093916 - RNA, 22 nt, Human
guggcagcugcgguccacccag

SEQ ID NO: 2093917 - RNA, 21 nt, Human
guggcagcugcgguccaccca

SEQ ID NO: 2093918 - RNA, 20 nt, Human
guggaugccugguggcagcu

SEQ ID NO: 2093919 - RNA, 19 nt, Human
guggcagcugcgguccacc

SEQ ID NO: 2093920 - RNA, 21 nt, Human
guggcaggugaccuucuggga

SEQ ID NO: 2093921 - RNA, 17 nt, Human
guggcagugggagcugc

SEQ ID NO: 2093922 - RNA, 16 nt, Human
guggcagugggagcug

SEQ ID NO: 2093923 - RNA, 15 nt, Human
guggcagugggagcu

SEQ ID NO: 2093924 - RNA, 23 nt, Human
gugcugaaugguuuucaaaauaa

SEQ ID NO: 2093925 - RNA, 14 nt, Human
gugcugaagcuuau

SEQ ID NO: 2093926 - RNA, 15 nt, Human
gugcugaagcuuauu

SEQ ID NO: 2093927 - RNA, 21 nt, Human
gugcugaagcuuauuaaugcu

SEQ ID NO: 2093928 - RNA, 19 nt, Human
gugcugaaugguuuucaaa

SEQ ID NO: 2093929 - RNA, 20 nt, Human
gugcugaaugguuuucaaaa

SEQ ID NO: 2093930 - RNA, 18 nt, Human
gugcucuggacaggcaug

SEQ ID NO: 2093931 - RNA, 17 nt, Human
gugcucuggacaggcau

SEQ ID NO: 2093932 - RNA, 22 nt, Human
gugcugaacaaaaaauaaaaau

SEQ ID NO: 2093933 - RNA, 11 nt, Human
gugccuuuccu

SEQ ID NO: 2093934 - RNA, 17 nt, Human
gugccuuuccuguucag

SEQ ID NO: 2093935 - RNA, 18 nt, Human
gugccuuuccuguucagc

SEQ ID NO: 2093936 - RNA, 20 nt, Human
gugccuuuccuguucagcau

SEQ ID NO: 2093937 - RNA, 21 nt, Human
gugccuuuccuguucagcauu

SEQ ID NO: 2093938 - RNA, 22 nt, Human
gugccuuuccuguucagcauuc

SEQ ID NO: 2093939 - RNA, 21 nt, Human
gugccuuugaguuuccucagg

SEQ ID NO: 2093940 - RNA, 16 nt, Human
gugcucuggacaggca

SEQ ID NO: 2093941 - RNA, 15 nt, Human
gugcucuggacaggc

SEQ ID NO: 2093942 - RNA, 22 nt, Human
gugccgagaaggaagccuccca

SEQ ID NO: 2093943 - RNA, 16 nt, Human
gugcccuuggaggcca

SEQ ID NO: 2093944 - RNA, 12 nt, Human
gugcccugcccc

SEQ ID NO: 2093945 - RNA, 19 nt, Human
gugcugccauccagguuca

SEQ ID NO: 2093946 - RNA, 18 nt, Human
gugcugccauccagguuc

SEQ ID NO: 2093947 - RNA, 20 nt, Human
gugcugaucgugcuaaauuu

SEQ ID NO: 2093948 - RNA, 12 nt, Human
gugcugccacac

SEQ ID NO: 2093949 - RNA, 15 nt, Human
gugcugccauccagg

SEQ ID NO: 2093950 - RNA, 23 nt, Human
gugcugaguugguguugacaugu

SEQ ID NO: 2093951 - RNA, 22 nt, Human
gugcugaucgugcuaaauuuuc

SEQ ID NO: 2093952 - RNA, 19 nt, Human
gugcuguugucauugcuuu

SEQ ID NO: 2093953 - RNA, 20 nt, Human
gugcuguugucauugcuuua

SEQ ID NO: 2093954 - RNA, 15 nt, Human
gugcugugguuccug

SEQ ID NO: 2093955 - RNA, 21 nt, Human
gugcugccacacuucaggcuc

SEQ ID NO: 2093956 - RNA, 18 nt, Human
gugcugcccgucuucagc

SEQ ID NO: 2093957 - RNA, 19 nt, Human
gugcugcccgucuucagcc

SEQ ID NO: 2093958 - RNA, 22 nt, Human
gugcugccauccagguucagcu

SEQ ID NO: 2093959 - RNA, 21 nt, Human
gugcugcccgucuucagccua

SEQ ID NO: 2093960 - RNA, 19 nt, Human
gugcuuauucucaaagcag

SEQ ID NO: 2093961 - RNA, 21 nt, Human
gugcuuauucucaaagcagga

SEQ ID NO: 2093962 - RNA, 13 nt, Human
gugcuucagccug

SEQ ID NO: 2093963 - RNA, 15 nt, Human
gugcuucagccugag

SEQ ID NO: 2093964 - RNA, 18 nt, Human
gugcuucagccugaggcu

SEQ ID NO: 2093965 - RNA, 18 nt, Human
guggaaaaauagccugcc

SEQ ID NO: 2093966 - RNA, 12 nt, Human
guggaaaaauau

SEQ ID NO: 2093967 - RNA, 13 nt, Human
guggaaaaauauu

SEQ ID NO: 2093968 - RNA, 14 nt, Human
guggaaaaauauuu

SEQ ID NO: 2093969 - RNA, 15 nt, Human
guggaaaaauauuua

SEQ ID NO: 2093970 - RNA, 23 nt, Human
gugcuuucuucucccaauucauc

SEQ ID NO: 2093971 - RNA, 14 nt, Human
guggaaagccucug

SEQ ID NO: 2093972 - RNA, 15 nt, Human
guggaaagccucugc

SEQ ID NO: 2093973 - RNA, 13 nt, Human
guggaaagggugc

SEQ ID NO: 2093974 - RNA, 23 nt, Human
guggaaagccucugcugccaugg

SEQ ID NO: 2093975 - RNA, 20 nt, Human
guggaaagggugcugcuucc

SEQ ID NO: 2093976 - RNA, 22 nt, Human
guggaaagggugcugcuucccu

SEQ ID NO: 2093977 - RNA, 16 nt, Human
guggaaagugaauuug

SEQ ID NO: 2093978 - RNA, 19 nt, Human
guggaaagugaauuugaau

SEQ ID NO: 2093979 - RNA, 20 nt, Human
gugcuuguucccucucccug

SEQ ID NO: 2093980 - RNA, 23 nt, Human
gugcuuguuugcucaccuggggu

SEQ ID NO: 2093981 - RNA, 21 nt, Human
gugcuuguuugcucaccuggg

SEQ ID NO: 2093982 - RNA, 22 nt, Human
gugcuuguuugcucaccugggg

SEQ ID NO: 2093983 - RNA, 22 nt, Human
gugcuuuccguggcacugcaua

SEQ ID NO: 2093984 - RNA, 12 nt, Human
uaugaauaacau

SEQ ID NO: 2093985 - RNA, 14 nt, Human
uaucuucugauuug

SEQ ID NO: 2093986 - RNA, 12 nt, Human
uaugaauacagg

SEQ ID NO: 2093987 - RNA, 16 nt, Human
uaugaauacagggcau

SEQ ID NO: 2093988 - RNA, 21 nt, Human
uaugaaucucuacgcaaaaaa

SEQ ID NO: 2093989 - RNA, 15 nt, Human
uaugacaguuauacu

SEQ ID NO: 2093990 - RNA, 16 nt, Human
uaugacagcugucccu

SEQ ID NO: 2093991 - RNA, 20 nt, Human
uaugacagcugucccuguca

SEQ ID NO: 2093992 - RNA, 19 nt, Human
uaucugugaaaugcuggca

SEQ ID NO: 2093993 - RNA, 17 nt, Human
uaucugugcgugaaaca

SEQ ID NO: 2093994 - RNA, 18 nt, Human
uaucugugcgugaaacac

SEQ ID NO: 2093995 - RNA, 20 nt, Human
uaucuguguuuuugaaauau

SEQ ID NO: 2093996 - RNA, 19 nt, Human
uaucugugcgugaaacaca

SEQ ID NO: 2093997 - RNA, 20 nt, Human
uaucugugcgugaaacacac

SEQ ID NO: 2093998 - RNA, 23 nt, Human
uaucugucauuugagcagggcuc

SEQ ID NO: 2093999 - RNA, 21 nt, Human
uaucugucauuugagcagggc

SEQ ID NO: 2094000 - RNA, 18 nt, Human
uaucugggaacugugccu

SEQ ID NO: 2094001 - RNA, 20 nt, Human
uaucugucauuugagcaggg

SEQ ID NO: 2094002 - RNA, 12 nt, Human
uaucuucacaau

SEQ ID NO: 2094003 - RNA, 15 nt, Human
uaucuucguucuugu

SEQ ID NO: 2094004 - RNA, 17 nt, Human
uaucuucguucuuguua

SEQ ID NO: 2094005 - RNA, 18 nt, Human
uaugaauaaagacaccua

SEQ ID NO: 2094006 - RNA, 17 nt, Human
uaucuguguuuuugaaa

SEQ ID NO: 2094007 - RNA, 14 nt, Human
uaucuuaaagcacu

SEQ ID NO: 2094008 - RNA, 15 nt, Human
uaucuuaaagcacuu

SEQ ID NO: 2094009 - RNA, 14 nt, Human
uaucuguuuuacug

SEQ ID NO: 2094010 - RNA, 15 nt, Human
uaucuguuuuacugc

SEQ ID NO: 2094011 - RNA, 18 nt, Human
uaucuguuuuacugcuuu

SEQ ID NO: 2094012 - RNA, 19 nt, Human
uaucuguuuuacugcuuuu

SEQ ID NO: 2094013 - RNA, 20 nt, Human
uaucuguuuuacugcuuuua

SEQ ID NO: 2094014 - RNA, 19 nt, Human
uaucuuacaaaguguauuu

SEQ ID NO: 2094015 - RNA, 15 nt, Human
uaucugcuguauguc

SEQ ID NO: 2094016 - RNA, 23 nt, Human
uaucugggauuaugguuuuguga

SEQ ID NO: 2094017 - RNA, 21 nt, Human
uaucugaggcacaugucagca

SEQ ID NO: 2094018 - RNA, 13 nt, Human
uaucuaaucauga

SEQ ID NO: 2094019 - RNA, 21 nt, Human
uaucuaauauguaacaagcca

SEQ ID NO: 2094020 - RNA, 12 nt, Human
uaucuaaccagu

SEQ ID NO: 2094021 - RNA, 15 nt, Human
uaucuaaccagugau

SEQ ID NO: 2094022 - RNA, 16 nt, Human
uaucuaaccagugauu

SEQ ID NO: 2094023 - RNA, 19 nt, Human
uaucuaaccagugauucga

SEQ ID NO: 2094024 - RNA, 13 nt, Human
uauccugagccau

SEQ ID NO: 2094025 - RNA, 17 nt, Human
uaucgggaacaguguuu

SEQ ID NO: 2094026 - RNA, 17 nt, Human
uaucgggagcagugucu

SEQ ID NO: 2094027 - RNA, 12 nt, Human
uaucgggggcug

SEQ ID NO: 2094028 - RNA, 16 nt, Human
uaucgggggcuggggc

SEQ ID NO: 2094029 - RNA, 14 nt, Human
uaucgggagcagug

SEQ ID NO: 2094030 - RNA, 15 nt, Human
uaucgggagcagugu

SEQ ID NO: 2094031 - RNA, 18 nt, Human
uaucgggagcagugucuu

SEQ ID NO: 2094032 - RNA, 16 nt, Human
uaucuaaauguugaaa

SEQ ID NO: 2094033 - RNA, 13 nt, Human
uauauuaaaaaug

SEQ ID NO: 2094034 - RNA, 14 nt, Human
uauauuaaaaaugg

SEQ ID NO: 2094035 - RNA, 15 nt, Human
uauauuaaaaauggu

SEQ ID NO: 2094036 - RNA, 16 nt, Human
uauauuaaaaauggua

SEQ ID NO: 2094037 - RNA, 17 nt, Human
uauauuaaaaaugguaa

SEQ ID NO: 2094038 - RNA, 19 nt, Human
uauauuaaaaaugguaaaa

SEQ ID NO: 2094039 - RNA, 22 nt, Human
uauauuaaaaaugguaaaauug

SEQ ID NO: 2094040 - RNA, 11 nt, Human
uauauguuuua

SEQ ID NO: 2094041 - RNA, 12 nt, Human
uauauguuuuaa

SEQ ID NO: 2094042 - RNA, 19 nt, Human
uauauguuuuaagaggcag

SEQ ID NO: 2094043 - RNA, 18 nt, Human
uauauguguuuuucacau

SEQ ID NO: 2094044 - RNA, 16 nt, Human
uauccucgcucccggg

SEQ ID NO: 2094045 - RNA, 12 nt, Human
uaugauuuuuaa

SEQ ID NO: 2094046 - RNA, 18 nt, Human
uaugauuuggaaaauaaa

SEQ ID NO: 2094047 - RNA, 17 nt, Human
uaugauuuggaaaauaa

SEQ ID NO: 2094048 - RNA, 15 nt, Human
uaugauuuggaaaau

SEQ ID NO: 2094049 - RNA, 23 nt, Human
uaugauuuuuaaagaaaaguuuu

SEQ ID NO: 2094050 - RNA, 17 nt, Human
uaugcaaggaaggaaag

SEQ ID NO: 2094051 - RNA, 20 nt, Human
uaugcaaggaaggaaagaaa

SEQ ID NO: 2094052 - RNA, 14 nt, Human
uaugcaaauuccca

SEQ ID NO: 2094053 - RNA, 15 nt, Human
uaugcaaauucccag

SEQ ID NO: 2094054 - RNA, 18 nt, Human
uaugcaaucaaaucugcu

SEQ ID NO: 2094055 - RNA, 21 nt, Human
uaugcaaacauaacaaaauca

SEQ ID NO: 2094056 - RNA, 18 nt, Human
uaugacuaaagagagaau

SEQ ID NO: 2094057 - RNA, 19 nt, Human
uaugacuaaagagagaaug

SEQ ID NO: 2094058 - RNA, 20 nt, Human
uaugacuaaagagagaaugu

SEQ ID NO: 2094059 - RNA, 21 nt, Human
uaugacuaaagagagaaugua

SEQ ID NO: 2094060 - RNA, 18 nt, Human
uaugaccuucuaggaagc

SEQ ID NO: 2094061 - RNA, 16 nt, Human
uaugaccuucuaggaa

SEQ ID NO: 2094062 - RNA, 16 nt, Human
uaugacggaagaacau

SEQ ID NO: 2094063 - RNA, 19 nt, Human
uaugacggaagaacauaga

SEQ ID NO: 2094064 - RNA, 20 nt, Human
uaugacggaagaacauagaa

SEQ ID NO: 2094065 - RNA, 12 nt, Human
uaugacuaaaga

SEQ ID NO: 2094066 - RNA, 13 nt, Human
uaugacuaaagag

SEQ ID NO: 2094067 - RNA, 14 nt, Human
uaugacuaaagaga

SEQ ID NO: 2094068 - RNA, 15 nt, Human
uaugacuaaagagag

SEQ ID NO: 2094069 - RNA, 16 nt, Human
uaugacuaaagagaga

SEQ ID NO: 2094070 - RNA, 17 nt, Human
uaugacuaaagagagaa

SEQ ID NO: 2094071 - RNA, 16 nt, Human
uaugacucccaaauuu

SEQ ID NO: 2094072 - RNA, 16 nt, Human
uaugagccagacaaau

SEQ ID NO: 2094073 - RNA, 15 nt, Human
uaugagaggcaauga

SEQ ID NO: 2094074 - RNA, 17 nt, Human
uaugagcucauguagca

SEQ ID NO: 2094075 - RNA, 17 nt, Human
uaugagccagacaaaug

SEQ ID NO: 2094076 - RNA, 19 nt, Human
uaugagccagacaaaugga

SEQ ID NO: 2094077 - RNA, 16 nt, Human
uaugauuaguaaagaa

SEQ ID NO: 2094078 - RNA, 21 nt, Human
uaugcacaccucccacccccu

SEQ ID NO: 2094079 - RNA, 22 nt, Human
uaugcaggggcaaacaccugcu

SEQ ID NO: 2094080 - RNA, 14 nt, Human
uaugcauaaaguca

SEQ ID NO: 2094081 - RNA, 15 nt, Human
uaugcauaaagucag

SEQ ID NO: 2094082 - RNA, 20 nt, Human
uaugcauaacugacaaauca

SEQ ID NO: 2094083 - RNA, 23 nt, Human
uaugcauaacugacaaaucaagu

SEQ ID NO: 2094084 - RNA, 22 nt, Human
uaugcuuauacacuuacacuuu

SEQ ID NO: 2094085 - RNA, 13 nt, Human
uaugcuuauuuua

SEQ ID NO: 2094086 - RNA, 16 nt, Human
uaugcaucuaauaaaa

SEQ ID NO: 2094087 - RNA, 17 nt, Human
uaugcaucuaauaaaaa

SEQ ID NO: 2094088 - RNA, 14 nt, Human
uaugcuuauuuuaa

SEQ ID NO: 2094089 - RNA, 17 nt, Human
uaugcuuauuuuaaaau

SEQ ID NO: 2094090 - RNA, 19 nt, Human
uaugcuuauuuuaaaauuu

SEQ ID NO: 2094091 - RNA, 20 nt, Human
uauggaauuuuucauugaua

SEQ ID NO: 2094092 - RNA, 23 nt, Human
uauggaauacaguguuauuuucu

SEQ ID NO: 2094093 - RNA, 22 nt, Human
uauggaauuacauguaaaacau

SEQ ID NO: 2094094 - RNA, 18 nt, Human
uauggaauuacauguaaa

SEQ ID NO: 2094095 - RNA, 14 nt, Human
uauggaauuacaug

SEQ ID NO: 2094096 - RNA, 14 nt, Human
uauggaauacagug

SEQ ID NO: 2094097 - RNA, 17 nt, Human
uauggaauacaguguua

SEQ ID NO: 2094098 - RNA, 24 nt, Human
uauggaauacaguguuauuuucuu

SEQ ID NO: 2094099 - RNA, 22 nt, Human
uauggaaggguuuguggcuggg

SEQ ID NO: 2094100 - RNA, 22 nt, Human
uauggaagcauauuguuauuau

SEQ ID NO: 2094101 - RNA, 19 nt, Human
uauggaaggguuuguggcu

SEQ ID NO: 2094102 - RNA, 17 nt, Human
uauggaacucucuccac

SEQ ID NO: 2094103 - RNA, 13 nt, Human
uauggaacucucu

SEQ ID NO: 2094104 - RNA, 21 nt, Human
uauggaaacuguugccagaga

SEQ ID NO: 2094105 - RNA, 23 nt, Human
uauauaaauuuuuuuuguuucau

SEQ ID NO: 2094106 - RNA, 15 nt, Human
uauaucuaucuuaua

SEQ ID NO: 2094107 - RNA, 21 nt, Human
uauaugcucugcauguuacau

SEQ ID NO: 2094108 - RNA, 13 nt, Human
uauaugugugugu

SEQ ID NO: 2094109 - RNA, 19 nt, Human
uauauguguguguauguuu

SEQ ID NO: 2094110 - RNA, 22 nt, Human
uauauguguguguauguuugca

SEQ ID NO: 2094111 - RNA, 18 nt, Human
uauacgauaaauaacuuu

SEQ ID NO: 2094112 - RNA, 15 nt, Human
uauacuaagaaaaga

SEQ ID NO: 2094113 - RNA, 19 nt, Human
uauacuaagauguucacug

SEQ ID NO: 2094114 - RNA, 16 nt, Human
uauacuggagaagucu

SEQ ID NO: 2094115 - RNA, 16 nt, Human
uauaguuuacuauuuu

SEQ ID NO: 2094116 - RNA, 19 nt, Human
uauaguuuauugacaauaa

SEQ ID NO: 2094117 - RNA, 17 nt, Human
uauaguuuacuauuuua

SEQ ID NO: 2094118 - RNA, 14 nt, Human
uauaaagagaaaau

SEQ ID NO: 2094119 - RNA, 15 nt, Human
uauaaagagaaaauu

SEQ ID NO: 2094120 - RNA, 17 nt, Human
uauaaagagaaaauuga

SEQ ID NO: 2094121 - RNA, 18 nt, Human
uauaaagagaaaauugaa

SEQ ID NO: 2094122 - RNA, 21 nt, Human
uauaaagagaaaauugaauuu

SEQ ID NO: 2094123 - RNA, 22 nt, Human
uauaaagagaaaauugaauuua

SEQ ID NO: 2094124 - RNA, 17 nt, Human
uauaaagauggcugacu

SEQ ID NO: 2094125 - RNA, 20 nt, Human
uauaaaugaaguuuauacag

SEQ ID NO: 2094126 - RNA, 21 nt, Human
uauaaaugaaguuuauacagu

SEQ ID NO: 2094127 - RNA, 24 nt, Human
uauaaaugaaguuuauacaguaca

SEQ ID NO: 2094128 - RNA, 15 nt, Human
uauaaagcaucuaaa

SEQ ID NO: 2094129 - RNA, 16 nt, Human
uauaaagcaucuaaac

SEQ ID NO: 2094130 - RNA, 17 nt, Human
uauaaagcaucuaaacu

SEQ ID NO: 2094131 - RNA, 19 nt, Human
uauaaagcaucuaaacuuu

SEQ ID NO: 2094132 - RNA, 14 nt, Human
uaguugcaauugaa

SEQ ID NO: 2094133 - RNA, 16 nt, Human
uaguugcaauugaauu

SEQ ID NO: 2094134 - RNA, 17 nt, Human
uaguugcagaaacauuu

SEQ ID NO: 2094135 - RNA, 19 nt, Human
uaguugcagaaacauuuug

SEQ ID NO: 2094136 - RNA, 23 nt, Human
uaguugcagacucaguuugucag

SEQ ID NO: 2094137 - RNA, 18 nt, Human
uaguugcagacucaguuu

SEQ ID NO: 2094138 - RNA, 13 nt, Human
uauaaacuuuaga

SEQ ID NO: 2094139 - RNA, 15 nt, Human
uauaaacuuuagagu

SEQ ID NO: 2094140 - RNA, 22 nt, Human
uauaaacuuuagaguagcauga

SEQ ID NO: 2094141 - RNA, 21 nt, Human
uauaaacuuuagaguagcaug

SEQ ID NO: 2094142 - RNA, 15 nt, Human
uauaaagaacaaggu

SEQ ID NO: 2094143 - RNA, 22 nt, Human
uauaaagaacaagguaguuuuu

SEQ ID NO: 2094144 - RNA, 13 nt, Human
uauaauaaaguau

SEQ ID NO: 2094145 - RNA, 22 nt, Human
uauaauauuuuuaauuaaauaa

SEQ ID NO: 2094146 - RNA, 13 nt, Human
uauaauauauguu

SEQ ID NO: 2094147 - RNA, 17 nt, Human
uauaauauauguuuuaa

SEQ ID NO: 2094148 - RNA, 11 nt, Human
uauaaauuaaa

SEQ ID NO: 2094149 - RNA, 12 nt, Human
uauaaauuaaau

SEQ ID NO: 2094150 - RNA, 13 nt, Human
uauaaauuaaaua

SEQ ID NO: 2094151 - RNA, 14 nt, Human
uauaaauuaaauau

SEQ ID NO: 2094152 - RNA, 19 nt, Human
uauaaauuaaauauaugua

SEQ ID NO: 2094153 - RNA, 20 nt, Human
uauaaauuaaauauauguau

SEQ ID NO: 2094154 - RNA, 22 nt, Human
uauaaauuaaauauauguaugu

SEQ ID NO: 2094155 - RNA, 23 nt, Human
uauaaauuaaauauauguaugua

SEQ ID NO: 2094156 - RNA, 16 nt, Human
uauaaaugguguuuuu

SEQ ID NO: 2094157 - RNA, 15 nt, Human
uauaauguuugcuau

SEQ ID NO: 2094158 - RNA, 16 nt, Human
uauaauguuaguagaa

SEQ ID NO: 2094159 - RNA, 20 nt, Human
uauaaucuuccauacuucuu

SEQ ID NO: 2094160 - RNA, 17 nt, Human
uauaaugucauuaaaca

SEQ ID NO: 2094161 - RNA, 20 nt, Human
uauaaugucauuaaacauga

SEQ ID NO: 2094162 - RNA, 18 nt, Human
uauaauuacauauuugca

SEQ ID NO: 2094163 - RNA, 19 nt, Human
uauaauuaucggaagcagu

SEQ ID NO: 2094164 - RNA, 17 nt, Human
uauaauuauguuauuga

SEQ ID NO: 2094165 - RNA, 22 nt, Human
uauaauuauguuauugaaaaaa

SEQ ID NO: 2094166 - RNA, 13 nt, Human
uaggacccuuccc

SEQ ID NO: 2094167 - RNA, 18 nt, Human
uaggccuggccagaugca

SEQ ID NO: 2094168 - RNA, 16 nt, Human
uaggccugggugcugg

SEQ ID NO: 2094169 - RNA, 19 nt, Human
uaggccugggugcuggcug

SEQ ID NO: 2094170 - RNA, 13 nt, Human
uaggccugggugc

SEQ ID NO: 2094171 - RNA, 15 nt, Human
uaggccuggccagau

SEQ ID NO: 2094172 - RNA, 21 nt, Human
uaggaauucccagcccaaagc

SEQ ID NO: 2094173 - RNA, 20 nt, Human
uaggacauaaauuagagguc

SEQ ID NO: 2094174 - RNA, 20 nt, Human
uaggacauguucccuucucc

SEQ ID NO: 2094175 - RNA, 23 nt, Human
uaggacauguucccuucuccuuc

SEQ ID NO: 2094176 - RNA, 23 nt, Human
uaggaauagcaugucacuaaagc

SEQ ID NO: 2094177 - RNA, 15 nt, Human
uaggaauagcauguc

SEQ ID NO: 2094178 - RNA, 16 nt, Human
guggcugcccacacac

SEQ ID NO: 2094179 - RNA, 15 nt, Human
guggcugaccccccu

SEQ ID NO: 2094180 - RNA, 16 nt, Human
guggcugaccccccuc

SEQ ID NO: 2094181 - RNA, 16 nt, Human
guggcucugagaaggg

SEQ ID NO: 2094182 - RNA, 14 nt, Human
guggcugacccagu

SEQ ID NO: 2094183 - RNA, 15 nt, Human
guggcugacccaguc

SEQ ID NO: 2094184 - RNA, 17 nt, Human
guggcugacccaguccc

SEQ ID NO: 2094185 - RNA, 19 nt, Human
guggcugacccagucccug

SEQ ID NO: 2094186 - RNA, 18 nt, Human
uaggucaguacccaccug

SEQ ID NO: 2094187 - RNA, 22 nt, Human
uaggucaguacccaccugagcu

SEQ ID NO: 2094188 - RNA, 23 nt, Human
uaggucaguacccaccugagcuu

SEQ ID NO: 2094189 - RNA, 14 nt, Human
uaggucagugaggc

SEQ ID NO: 2094190 - RNA, 20 nt, Human
uaggcucugcacagauggau

SEQ ID NO: 2094191 - RNA, 13 nt, Human
uagguacuuuugg

SEQ ID NO: 2094192 - RNA, 14 nt, Human
uagguauacagugg

SEQ ID NO: 2094193 - RNA, 16 nt, Human
uaggucaagaagaaga

SEQ ID NO: 2094194 - RNA, 15 nt, Human
uagguaugaauaagu

SEQ ID NO: 2094195 - RNA, 21 nt, Human
uaggucaaggccugucccugg

SEQ ID NO: 2094196 - RNA, 15 nt, Human
uaggucacuccuggg

SEQ ID NO: 2094197 - RNA, 18 nt, Human
uaggucaagaagaagaug

SEQ ID NO: 2094198 - RNA, 15 nt, Human
uaggcucugcacaga

SEQ ID NO: 2094199 - RNA, 18 nt, Human
uaggcucugcacagaugg

SEQ ID NO: 2094200 - RNA, 21 nt, Human
uaggcucugcacagauggauu

SEQ ID NO: 2094201 - RNA, 19 nt, Human
uagggaaaaaccagcgugu

SEQ ID NO: 2094202 - RNA, 20 nt, Human
uagggaaaaaccagcgugug

SEQ ID NO: 2094203 - RNA, 21 nt, Human
uagggaaaaaccagcguguga

SEQ ID NO: 2094204 - RNA, 11 nt, Human
uaggcucugca

SEQ ID NO: 2094205 - RNA, 22 nt, Human
uaggcuccgucaguaucaggcc

SEQ ID NO: 2094206 - RNA, 15 nt, Human
uaggcuauucacaac

SEQ ID NO: 2094207 - RNA, 13 nt, Human
uaggccuucuugu

SEQ ID NO: 2094208 - RNA, 14 nt, Human
uaggccuucuugug

SEQ ID NO: 2094209 - RNA, 16 nt, Human
uaggccuucuugugau

SEQ ID NO: 2094210 - RNA, 19 nt, Human
uaggccuucuugugaucuu

SEQ ID NO: 2094211 - RNA, 20 nt, Human
uaggccugggugcuggcugc

SEQ ID NO: 2094212 - RNA, 14 nt, Human
uaggcuauucacaa

SEQ ID NO: 2094213 - RNA, 12 nt, Human
uagugcagcuga

SEQ ID NO: 2094214 - RNA, 13 nt, Human
uagugcagcugau

SEQ ID NO: 2094215 - RNA, 14 nt, Human
uagugcagcugauu

SEQ ID NO: 2094216 - RNA, 15 nt, Human
uagugcagcugauuu

SEQ ID NO: 2094217 - RNA, 17 nt, Human
uagugcagcugauuuua

SEQ ID NO: 2094218 - RNA, 18 nt, Human
uagugcagcugauuuuaa

SEQ ID NO: 2094219 - RNA, 19 nt, Human
uagugcagcugauuuuaac

SEQ ID NO: 2094220 - RNA, 20 nt, Human
uagugcagcugauuuuaaca

SEQ ID NO: 2094221 - RNA, 22 nt, Human
uagugcagcugauuuuaacaau

SEQ ID NO: 2094222 - RNA, 22 nt, Human
uaguagggugagggauaagcaa

SEQ ID NO: 2094223 - RNA, 20 nt, Human
uaguguguucugauuagaaa

SEQ ID NO: 2094224 - RNA, 19 nt, Human
uaguguguucugauuagaa

SEQ ID NO: 2094225 - RNA, 15 nt, Human
uaguguguucugauu

SEQ ID NO: 2094226 - RNA, 17 nt, Human
uagugcggacaaguuuu

SEQ ID NO: 2094227 - RNA, 19 nt, Human
uagugcggacaaguuuuaa

SEQ ID NO: 2094228 - RNA, 21 nt, Human
uagugcgauguuucaggaggc

SEQ ID NO: 2094229 - RNA, 14 nt, Human
uagugcggacaagu

SEQ ID NO: 2094230 - RNA, 23 nt, Human
uagugcccuccacagccgcagcc

SEQ ID NO: 2094231 - RNA, 22 nt, Human
uagugccugagaguauuuaggc

SEQ ID NO: 2094232 - RNA, 17 nt, Human
uagugcccuccacagcc

SEQ ID NO: 2094233 - RNA, 14 nt, Human
uaguaucuaacaug

SEQ ID NO: 2094234 - RNA, 15 nt, Human
uaguaucuaacaugu

SEQ ID NO: 2094235 - RNA, 23 nt, Human
uaggugacagagugagacucugu

SEQ ID NO: 2094236 - RNA, 19 nt, Human
uaggugcccuuggaggcca

SEQ ID NO: 2094237 - RNA, 14 nt, Human
uaggugauuugaag

SEQ ID NO: 2094238 - RNA, 14 nt, Human
uaguauaaagaaaa

SEQ ID NO: 2094239 - RNA, 16 nt, Human
uaguauaaagaaaagu

SEQ ID NO: 2094240 - RNA, 16 nt, Human
uaggugcuaauuaaua

SEQ ID NO: 2094241 - RNA, 19 nt, Human
uaggugcuaauuaauaaag

SEQ ID NO: 2094242 - RNA, 13 nt, Human
uaguauauuaaaa

SEQ ID NO: 2094243 - RNA, 16 nt, Human
uaguauauuaaaaaug

SEQ ID NO: 2094244 - RNA, 17 nt, Human
uaguauauuaaaaaugg

SEQ ID NO: 2094245 - RNA, 18 nt, Human
uaguauauuaaaaauggu

SEQ ID NO: 2094246 - RNA, 12 nt, Human
uaguauauuuau

SEQ ID NO: 2094247 - RNA, 18 nt, Human
uaguauauuuauauaauu

SEQ ID NO: 2094248 - RNA, 19 nt, Human
uaguauauuuauauaauua

SEQ ID NO: 2094249 - RNA, 18 nt, Human
uauguugguagauucuaa

SEQ ID NO: 2094250 - RNA, 15 nt, Human
uauguuguauagauu

SEQ ID NO: 2094251 - RNA, 21 nt, Human
uauguugcccaggcaggucuu

SEQ ID NO: 2094252 - RNA, 22 nt, Human
uauguucuuaguggauguucug

SEQ ID NO: 2094253 - RNA, 14 nt, Human
uauguuauugaaaa

SEQ ID NO: 2094254 - RNA, 16 nt, Human
uauguucaaagucaaa

SEQ ID NO: 2094255 - RNA, 16 nt, Human
uauuaagaaagacuau

SEQ ID NO: 2094256 - RNA, 18 nt, Human
uauuaacaaauuauguua

SEQ ID NO: 2094257 - RNA, 16 nt, Human
uauuaacaaauuaugu

SEQ ID NO: 2094258 - RNA, 15 nt, Human
uauuaaauagaaggu

SEQ ID NO: 2094259 - RNA, 15 nt, Human
uauguugugaagaug

SEQ ID NO: 2094260 - RNA, 16 nt, Human
uauguugugaagaugu

SEQ ID NO: 2094261 - RNA, 20 nt, Human
uauguugugaagauguuugc

SEQ ID NO: 2094262 - RNA, 16 nt, Human
uauguuguguucuaau

SEQ ID NO: 2094263 - RNA, 19 nt, Human
uauguuaaccucaguguca

SEQ ID NO: 2094264 - RNA, 20 nt, Human
uauguuaaccucagugucau

SEQ ID NO: 2094265 - RNA, 22 nt, Human
uauguuaaccucagugucauuu

SEQ ID NO: 2094266 - RNA, 15 nt, Human
uauguguuuuucaca

SEQ ID NO: 2094267 - RNA, 16 nt, Human
uauguguuuuucacau

SEQ ID NO: 2094268 - RNA, 17 nt, Human
uauguguuuuucacauu

SEQ ID NO: 2094269 - RNA, 19 nt, Human
uauguuacaucuguuuuaa

SEQ ID NO: 2094270 - RNA, 22 nt, Human
uauguuacaucuguuuuaaauu

SEQ ID NO: 2094271 - RNA, 15 nt, Human
uauggaggauggaga

SEQ ID NO: 2094272 - RNA, 15 nt, Human
uauuaaguuguuaau

SEQ ID NO: 2094273 - RNA, 14 nt, Human
uauuaagcaguaaa

SEQ ID NO: 2094274 - RNA, 19 nt, Human
uauuaagcaguaaaaacug

SEQ ID NO: 2094275 - RNA, 20 nt, Human
uauuaagcaguaaaaacugu

SEQ ID NO: 2094276 - RNA, 14 nt, Human
uauuaaggaagaca

SEQ ID NO: 2094277 - RNA, 15 nt, Human
uauuauaacuuaaaa

SEQ ID NO: 2094278 - RNA, 12 nt, Human
uauuauaauuua

SEQ ID NO: 2094279 - RNA, 15 nt, Human
uauuauaauuuaaug

SEQ ID NO: 2094280 - RNA, 16 nt, Human
uauuauaacuuaaaaa

SEQ ID NO: 2094281 - RNA, 19 nt, Human
uauuauaauuuuuuucaau

SEQ ID NO: 2094282 - RNA, 15 nt, Human
uauuauacuaagaaa

SEQ ID NO: 2094283 - RNA, 18 nt, Human
uauuauacuaagaaaaga

SEQ ID NO: 2094284 - RNA, 19 nt, Human
uauuauacuaagaaaagau

SEQ ID NO: 2094285 - RNA, 16 nt, Human
uauuaucaugcaaaug

SEQ ID NO: 2094286 - RNA, 18 nt, Human
uauuaucaugcaaaugcu

SEQ ID NO: 2094287 - RNA, 22 nt, Human
uauuaucaugcaaaugcuguau

SEQ ID NO: 2094288 - RNA, 13 nt, Human
uauuauccauuca

SEQ ID NO: 2094289 - RNA, 13 nt, Human
uauuaucuuugua

SEQ ID NO: 2094290 - RNA, 13 nt, Human
uauuaugcaaauu

SEQ ID NO: 2094291 - RNA, 15 nt, Human
uauuaugcaaauucc

SEQ ID NO: 2094292 - RNA, 16 nt, Human
uauuaugcaaauuccc

SEQ ID NO: 2094293 - RNA, 18 nt, Human
uauuaugcaaauucccag

SEQ ID NO: 2094294 - RNA, 19 nt, Human
uauuaugcaaauucccaga

SEQ ID NO: 2094295 - RNA, 14 nt, Human
uauuaugcauaacu

SEQ ID NO: 2094296 - RNA, 20 nt, Human
uauuaugcauaacugacaaa

SEQ ID NO: 2094297 - RNA, 21 nt, Human
uauuauggaagauuuuaaauu

SEQ ID NO: 2094298 - RNA, 16 nt, Human
uauuauuucaauguga

SEQ ID NO: 2094299 - RNA, 15 nt, Human
uauuauuuucaccug

SEQ ID NO: 2094300 - RNA, 16 nt, Human
uauuauuuucaccugu

SEQ ID NO: 2094301 - RNA, 15 nt, Human
uauuauuguguguua

SEQ ID NO: 2094302 - RNA, 22 nt, Human
uauugcagcgauuaauaacagg

SEQ ID NO: 2094303 - RNA, 17 nt, Human
uauugcaaugaaggaaa

SEQ ID NO: 2094304 - RNA, 15 nt, Human
uauugcauaugcaua

SEQ ID NO: 2094305 - RNA, 20 nt, Human
uauugauaugcuuauacacu

SEQ ID NO: 2094306 - RNA, 21 nt, Human
uauucauugugguuauuuuua

SEQ ID NO: 2094307 - RNA, 15 nt, Human
uauugcuugcacaaa

SEQ ID NO: 2094308 - RNA, 19 nt, Human
uauugcuguguaacacugu

SEQ ID NO: 2094309 - RNA, 21 nt, Human
uauugcuugauacuuuugaca

SEQ ID NO: 2094310 - RNA, 15 nt, Human
uauugcccacgcugg

SEQ ID NO: 2094311 - RNA, 14 nt, Human
uauugcccacgcug

SEQ ID NO: 2094312 - RNA, 13 nt, Human
uauugcccacgcu

SEQ ID NO: 2094313 - RNA, 13 nt, Human
uauuguucccagu

SEQ ID NO: 2094314 - RNA, 17 nt, Human
uauuguucccagugaca

SEQ ID NO: 2094315 - RNA, 21 nt, Human
uauuguucccagugacacuuc

SEQ ID NO: 2094316 - RNA, 13 nt, Human
uauuguuccuaag

SEQ ID NO: 2094317 - RNA, 14 nt, Human
uauuguuccuaagu

SEQ ID NO: 2094318 - RNA, 18 nt, Human
uauuguuccuaaguucuu

SEQ ID NO: 2094319 - RNA, 21 nt, Human
uauuguuccuaaguucuuaga

SEQ ID NO: 2094320 - RNA, 17 nt, Human
uauuguguguuauuuaa

SEQ ID NO: 2094321 - RNA, 19 nt, Human
uauuguguguuauuuaaau

SEQ ID NO: 2094322 - RNA, 14 nt, Human
uauuuaugugugag

SEQ ID NO: 2094323 - RNA, 19 nt, Human
uauuuauuauuuucaccug

SEQ ID NO: 2094324 - RNA, 16 nt, Human
uauuucuaucccaaac

SEQ ID NO: 2094325 - RNA, 13 nt, Human
uauuucuuguuug

SEQ ID NO: 2094326 - RNA, 14 nt, Human
uauuucuuguuugu

SEQ ID NO: 2094327 - RNA, 11 nt, Human
uauuguuucua

SEQ ID NO: 2094328 - RNA, 18 nt, Human
uauuuaaauguaaagaca

SEQ ID NO: 2094329 - RNA, 22 nt, Human
uauuuaaauauuaaauauguua

SEQ ID NO: 2094330 - RNA, 13 nt, Human
uauuuaaauucuu

SEQ ID NO: 2094331 - RNA, 14 nt, Human
uauuuaaauucuuu

SEQ ID NO: 2094332 - RNA, 15 nt, Human
uauuuaaauucuuuu

SEQ ID NO: 2094333 - RNA, 16 nt, Human
uauuuaaauucuuuuu

SEQ ID NO: 2094334 - RNA, 17 nt, Human
uauuuauauauuuauaa

SEQ ID NO: 2094335 - RNA, 18 nt, Human
uauuuauauauuuauaac

SEQ ID NO: 2094336 - RNA, 19 nt, Human
uauuuauauauuuauaacu

SEQ ID NO: 2094337 - RNA, 12 nt, Human
uauuuaaagaca

SEQ ID NO: 2094338 - RNA, 13 nt, Human
uauuuaaagacaa

SEQ ID NO: 2094339 - RNA, 17 nt, Human
uauuuaaagacaaagac

SEQ ID NO: 2094340 - RNA, 18 nt, Human
uauuuaaagacaaagaca

SEQ ID NO: 2094341 - RNA, 22 nt, Human
uauuuaucuguguuuuugaaau

SEQ ID NO: 2094342 - RNA, 21 nt, Human
uauuuaucuguaguaaacuau

SEQ ID NO: 2094343 - RNA, 20 nt, Human
uauuuaucugugcaaauccu

SEQ ID NO: 2094344 - RNA, 17 nt, Human
uauuuaucuauuguaag

SEQ ID NO: 2094345 - RNA, 19 nt, Human
uauuuaucuauuguaagau

SEQ ID NO: 2094346 - RNA, 14 nt, Human
uauuuauauuucac

SEQ ID NO: 2094347 - RNA, 15 nt, Human
uauuuauauuucacu

SEQ ID NO: 2094348 - RNA, 16 nt, Human
uauuuauauuucacua

SEQ ID NO: 2094349 - RNA, 13 nt, Human
uauuuaucacaua

SEQ ID NO: 2094350 - RNA, 13 nt, Human
uauuuaucaguga

SEQ ID NO: 2094351 - RNA, 21 nt, Human
uauuuauauuuuuauuuuauu

SEQ ID NO: 2094352 - RNA, 15 nt, Human
uauuuaucagugaca

SEQ ID NO: 2094353 - RNA, 18 nt, Human
uauuuaucagugacagag

SEQ ID NO: 2094354 - RNA, 18 nt, Human
ucaaggacuugaaagcau

SEQ ID NO: 2094355 - RNA, 19 nt, Human
ucaaggacuugaaagcauc

SEQ ID NO: 2094356 - RNA, 22 nt, Human
ucaaggaccaacaagggcagug

SEQ ID NO: 2094357 - RNA, 23 nt, Human
ucaaggaccaacaagggcagugg

SEQ ID NO: 2094358 - RNA, 18 nt, Human
ucaaggacaaagucucca

SEQ ID NO: 2094359 - RNA, 19 nt, Human
ucaaggacaaagucuccag

SEQ ID NO: 2094360 - RNA, 20 nt, Human
ucaaggacaaagucuccagc

SEQ ID NO: 2094361 - RNA, 21 nt, Human
ucaaggacaaagucuccagcc

SEQ ID NO: 2094362 - RNA, 22 nt, Human
ucaaggacaaagucuccagccc

SEQ ID NO: 2094363 - RNA, 23 nt, Human
ucaaggacaaagucuccagccca

SEQ ID NO: 2094364 - RNA, 19 nt, Human
ucaagcgauucuucugcuu

SEQ ID NO: 2094365 - RNA, 18 nt, Human
ucaagcgauucuucugcu

SEQ ID NO: 2094366 - RNA, 21 nt, Human
ucaagcgauucuucugcuuca

SEQ ID NO: 2094367 - RNA, 13 nt, Human
ucaagcccaggag

SEQ ID NO: 2094368 - RNA, 16 nt, Human
ucaagcccaggaggac

SEQ ID NO: 2094369 - RNA, 19 nt, Human
ucaaccccuucgcuccugu

SEQ ID NO: 2094370 - RNA, 18 nt, Human
ucaaccccuucgcuccug

SEQ ID NO: 2094371 - RNA, 15 nt, Human
ucaaccuccugggcu

SEQ ID NO: 2094372 - RNA, 20 nt, Human
ucaaccccuucgcuccugug

SEQ ID NO: 2094373 - RNA, 16 nt, Human
ucaaccuccugggcua

SEQ ID NO: 2094374 - RNA, 18 nt, Human
ucaacugaccagccucca

SEQ ID NO: 2094375 - RNA, 23 nt, Human
ucaacugaaaagacucaguguuc

SEQ ID NO: 2094376 - RNA, 24 nt, Human
ucaacugaccagccuccaugcugc

SEQ ID NO: 2094377 - RNA, 22 nt, Human
ucaacugaaaguguuuccuuca

SEQ ID NO: 2094378 - RNA, 20 nt, Human
ucaagccaagcagccaagcu

SEQ ID NO: 2094379 - RNA, 16 nt, Human
ucaaacaucuggaaaa

SEQ ID NO: 2094380 - RNA, 22 nt, Human
ucaaacaugaaguguguuuccu

SEQ ID NO: 2094381 - RNA, 15 nt, Human
uauuugcauguuacc

SEQ ID NO: 2094382 - RNA, 20 nt, Human
ucaaaccccgaccaccugcc

SEQ ID NO: 2094383 - RNA, 19 nt, Human
ucaaaccccgaccaccugc

SEQ ID NO: 2094384 - RNA, 21 nt, Human
ucaaaccaguauacaagauaa

SEQ ID NO: 2094385 - RNA, 22 nt, Human
ucaaaccaguauacaagauaag

SEQ ID NO: 2094386 - RNA, 23 nt, Human
ucaaaccccgaccaccugcccaa

SEQ ID NO: 2094387 - RNA, 15 nt, Human
uauuugcauauguau

SEQ ID NO: 2094388 - RNA, 16 nt, Human
uauuugcauguuaccu

SEQ ID NO: 2094389 - RNA, 16 nt, Human
uauuugcacuguagcc

SEQ ID NO: 2094390 - RNA, 12 nt, Human
ucaaagagguuu

SEQ ID NO: 2094391 - RNA, 23 nt, Human
ucaaagagguuuuaaaaaaaucc

SEQ ID NO: 2094392 - RNA, 22 nt, Human
ucaaacuuccagugcaacacug

SEQ ID NO: 2094393 - RNA, 20 nt, Human
ucaaacugccuuggcuucag

SEQ ID NO: 2094394 - RNA, 17 nt, Human
ucaaacuguagaaauga

SEQ ID NO: 2094395 - RNA, 14 nt, Human
ucaaacuuccaguc

SEQ ID NO: 2094396 - RNA, 14 nt, Human
ucaaacuguagaaa

SEQ ID NO: 2094397 - RNA, 20 nt, Human
ucaaacuguagaaaugauga

SEQ ID NO: 2094398 - RNA, 13 nt, Human
ucaauuaaaugua

SEQ ID NO: 2094399 - RNA, 12 nt, Human
ucaauuaaaugu

SEQ ID NO: 2094400 - RNA, 14 nt, Human
ucaauuaaauguag

SEQ ID NO: 2094401 - RNA, 24 nt, Human
ucaauguucauuguaauguuacug

SEQ ID NO: 2094402 - RNA, 13 nt, Human
ucaauaaaaucau

SEQ ID NO: 2094403 - RNA, 22 nt, Human
ucaauguuuaugcaaggaagga

SEQ ID NO: 2094404 - RNA, 23 nt, Human
ucaauguuuaugcaaggaaggaa

SEQ ID NO: 2094405 - RNA, 14 nt, Human
ucaauaaaaucaug

SEQ ID NO: 2094406 - RNA, 16 nt, Human
ucaauaaaaucaugua

SEQ ID NO: 2094407 - RNA, 18 nt, Human
ucaauaaaaucauguaca

SEQ ID NO: 2094408 - RNA, 21 nt, Human
ucaauaaaaucauguacauuu

SEQ ID NO: 2094409 - RNA, 18 nt, Human
ucaauguucauuguaaug

SEQ ID NO: 2094410 - RNA, 21 nt, Human
ucaauguuuaugcaaggaagg

SEQ ID NO: 2094411 - RNA, 14 nt, Human
ucaauuccucuggg

SEQ ID NO: 2094412 - RNA, 16 nt, Human
ucaauucauauuuaug

SEQ ID NO: 2094413 - RNA, 18 nt, Human
ucaauucauauuuaugaa

SEQ ID NO: 2094414 - RNA, 15 nt, Human
ucaauucaaaaaugu

SEQ ID NO: 2094415 - RNA, 17 nt, Human
ucaauucaaaaauguac

SEQ ID NO: 2094416 - RNA, 16 nt, Human
ucacaagugaaaaaca

SEQ ID NO: 2094417 - RNA, 22 nt, Human
ucacaagugaaaaacauccaga

SEQ ID NO: 2094418 - RNA, 20 nt, Human
ucacacacaggcaacugagg

SEQ ID NO: 2094419 - RNA, 21 nt, Human
ucacacacaggcaacugaggc

SEQ ID NO: 2094420 - RNA, 22 nt, Human
ucacaaggcauucaaguguaca

SEQ ID NO: 2094421 - RNA, 17 nt, Human
ucacaagagcccagcag

SEQ ID NO: 2094422 - RNA, 12 nt, Human
ucacaagcugcc

SEQ ID NO: 2094423 - RNA, 13 nt, Human
ucacaagcugccu

SEQ ID NO: 2094424 - RNA, 14 nt, Human
ucacaagcugccuc

SEQ ID NO: 2094425 - RNA, 15 nt, Human
ucacaagcugccucc

SEQ ID NO: 2094426 - RNA, 16 nt, Human
ucacaagcugccuccc

SEQ ID NO: 2094427 - RNA, 20 nt, Human
ucacaagcugccucccuguc

SEQ ID NO: 2094428 - RNA, 22 nt, Human
ucacaagcugccucccugucca

SEQ ID NO: 2094429 - RNA, 23 nt, Human
ucacaagcugccucccuguccac

SEQ ID NO: 2094430 - RNA, 15 nt, Human
ucacacacuuuggcu

SEQ ID NO: 2094431 - RNA, 18 nt, Human
ucacaggacucugccucc

SEQ ID NO: 2094432 - RNA, 17 nt, Human
ucacaggacucugccuc

SEQ ID NO: 2094433 - RNA, 16 nt, Human
ucacaggacucugccu

SEQ ID NO: 2094434 - RNA, 23 nt, Human
ucacaccaggcuugccugcaggc

SEQ ID NO: 2094435 - RNA, 21 nt, Human
ucacaccaggcuugccugcag

SEQ ID NO: 2094436 - RNA, 22 nt, Human
ucacaccaggcuugccugcagg

SEQ ID NO: 2094437 - RNA, 23 nt, Human
ucacagggccccagaaggcaggg

SEQ ID NO: 2094438 - RNA, 23 nt, Human
ucacaggacucugccuccucuuc

SEQ ID NO: 2094439 - RNA, 19 nt, Human
ucacaggacucugccuccu

SEQ ID NO: 2094440 - RNA, 23 nt, Human
ucacagguagacaguauauaacu

SEQ ID NO: 2094441 - RNA, 24 nt, Human
ucacaggguugggcccagaucugg

SEQ ID NO: 2094442 - RNA, 19 nt, Human
ucacaggguugggcccaga

SEQ ID NO: 2094443 - RNA, 23 nt, Human
ucacaggguugggcccagaucug

SEQ ID NO: 2094444 - RNA, 14 nt, Human
ucacaggguugggc

SEQ ID NO: 2094445 - RNA, 16 nt, Human
ucacaggguugggccc

SEQ ID NO: 2094446 - RNA, 17 nt, Human
ucacaggguugggccca

SEQ ID NO: 2094447 - RNA, 19 nt, Human
ucacagucacaugcuugau

SEQ ID NO: 2094448 - RNA, 14 nt, Human
ucacauuuauucug

SEQ ID NO: 2094449 - RNA, 21 nt, Human
ucaccaaaucagcugcuacua

SEQ ID NO: 2094450 - RNA, 16 nt, Human
ucaccacaugugcaca

SEQ ID NO: 2094451 - RNA, 13 nt, Human
ucaccaagcccag

SEQ ID NO: 2094452 - RNA, 21 nt, Human
ucaccacuucaauagaucaaa

SEQ ID NO: 2094453 - RNA, 13 nt, Human
ucaccaccucucc

SEQ ID NO: 2094454 - RNA, 14 nt, Human
ucaccaccuuccca

SEQ ID NO: 2094455 - RNA, 15 nt, Human
ucaccaccuucccag

SEQ ID NO: 2094456 - RNA, 16 nt, Human
ucaccaccuucccagc

SEQ ID NO: 2094457 - RNA, 18 nt, Human
ucaccaccuucccagcuc

SEQ ID NO: 2094458 - RNA, 19 nt, Human
ucacccgaggcugcccacu

SEQ ID NO: 2094459 - RNA, 16 nt, Human
ucacccgaggcugccc

SEQ ID NO: 2094460 - RNA, 20 nt, Human
ucaccgagaguagccgagag

SEQ ID NO: 2094461 - RNA, 23 nt, Human
ucaccgagaguagccgagagccu

SEQ ID NO: 2094462 - RNA, 13 nt, Human
ucacccuguccaa

SEQ ID NO: 2094463 - RNA, 21 nt, Human
ucacccuguccaaacugccua

SEQ ID NO: 2094464 - RNA, 14 nt, Human
uccuuagaagugga

SEQ ID NO: 2094465 - RNA, 19 nt, Human
uccuuagagacaucaaaau

SEQ ID NO: 2094466 - RNA, 22 nt, Human
uccugucugccagccagcagcc

SEQ ID NO: 2094467 - RNA, 17 nt, Human
uccugucugccagccag

SEQ ID NO: 2094468 - RNA, 21 nt, Human
uccugucugccagccagcagc

SEQ ID NO: 2094469 - RNA, 15 nt, Human
uccuuagcaacagcc

SEQ ID NO: 2094470 - RNA, 16 nt, Human
uccuuagcaacagccg

SEQ ID NO: 2094471 - RNA, 13 nt, Human
uccuuagcugcca

SEQ ID NO: 2094472 - RNA, 14 nt, Human
uccuuagcugccaa

SEQ ID NO: 2094473 - RNA, 16 nt, Human
uccuuagcugccaagc

SEQ ID NO: 2094474 - RNA, 18 nt, Human
uccuuagcuuagaccuca

SEQ ID NO: 2094475 - RNA, 19 nt, Human
uccuuagcuuagaccucag

SEQ ID NO: 2094476 - RNA, 20 nt, Human
uccuuagcuuagaccucagc

SEQ ID NO: 2094477 - RNA, 21 nt, Human
uccuuagcuuagaccucagcc

SEQ ID NO: 2094478 - RNA, 22 nt, Human
uccuuagcuuagaccucagccu

SEQ ID NO: 2094479 - RNA, 19 nt, Human
ucggcccacagcucccacc

SEQ ID NO: 2094480 - RNA, 12 nt, Human
ucggcccacagc

SEQ ID NO: 2094481 - RNA, 16 nt, Human
ucggcccacagcuccc

SEQ ID NO: 2094482 - RNA, 23 nt, Human
ucggcccacagcucccaccccac

SEQ ID NO: 2094483 - RNA, 19 nt, Human
ucgugaaguauacuguauu

SEQ ID NO: 2094484 - RNA, 17 nt, Human
ucgugaaguauacugua

SEQ ID NO: 2094485 - RNA, 13 nt, Human
ucgugacaacacu

SEQ ID NO: 2094486 - RNA, 14 nt, Human
ucggagacagugau

SEQ ID NO: 2094487 - RNA, 15 nt, Human
ucggagacagugauc

SEQ ID NO: 2094488 - RNA, 21 nt, Human
ucggagacagugaucuccaua

SEQ ID NO: 2094489 - RNA, 20 nt, Human
ucggagggaauugaggucug

SEQ ID NO: 2094490 - RNA, 22 nt, Human
ucggagggaauugaggucugcu

SEQ ID NO: 2094491 - RNA, 17 nt, Human
ucggaguaucugggaac

SEQ ID NO: 2094492 - RNA, 19 nt, Human
ucggaguaucugggaacug

SEQ ID NO: 2094493 - RNA, 22 nt, Human
ucggcauugguucccuuugcuc

SEQ ID NO: 2094494 - RNA, 10 nt, Human
ucggauuaga

SEQ ID NO: 2094495 - RNA, 20 nt, Human
ucggaucuggggcucuggga

SEQ ID NO: 2094496 - RNA, 14 nt, Human
ucgugguaggacug

SEQ ID NO: 2094497 - RNA, 15 nt, Human
ucgugggugugugua

SEQ ID NO: 2094498 - RNA, 22 nt, Human
ucguggguguguguagccaagg

SEQ ID NO: 2094499 - RNA, 20 nt, Human
ucguggcagauaaucagccu

SEQ ID NO: 2094500 - RNA, 21 nt, Human
ucguggcagauaaucagccuc

SEQ ID NO: 2094501 - RNA, 15 nt, Human
ucgugguaggacugu

SEQ ID NO: 2094502 - RNA, 20 nt, Human
ucgugguaggacuguagaaa

SEQ ID NO: 2094503 - RNA, 22 nt, Human
ucguggugaucaauuaaaugua

SEQ ID NO: 2094504 - RNA, 18 nt, Human
ucuaaagguggugaggca

SEQ ID NO: 2094505 - RNA, 14 nt, Human
ucuaucagagaaaa

SEQ ID NO: 2094506 - RNA, 20 nt, Human
ucuagugcccuccacagccg

SEQ ID NO: 2094507 - RNA, 22 nt, Human
ucuagugcagcugauuuuaaca

SEQ ID NO: 2094508 - RNA, 23 nt, Human
ucuagugcagcugauuuuaacaa

SEQ ID NO: 2094509 - RNA, 14 nt, Human
ucuagugcccucca

SEQ ID NO: 2094510 - RNA, 16 nt, Human
ucuacagaggccaugg

SEQ ID NO: 2094511 - RNA, 15 nt, Human
ucuacagaggccaug

SEQ ID NO: 2094512 - RNA, 16 nt, Human
ucuacagacuucucca

SEQ ID NO: 2094513 - RNA, 17 nt, Human
ucuacagacuucuccag

SEQ ID NO: 2094514 - RNA, 18 nt, Human
ucuacagacuucuccaga

SEQ ID NO: 2094515 - RNA, 19 nt, Human
ucuacaaguauucugccuu

SEQ ID NO: 2094516 - RNA, 15 nt, Human
ucuacaaucuauuua

SEQ ID NO: 2094517 - RNA, 16 nt, Human
ucuaccuugaggucuu

SEQ ID NO: 2094518 - RNA, 17 nt, Human
ucuaccuugaggucuuu

SEQ ID NO: 2094519 - RNA, 14 nt, Human
ucuaccuuuucucu

SEQ ID NO: 2094520 - RNA, 15 nt, Human
ucuacgcucuccuuu

SEQ ID NO: 2094521 - RNA, 16 nt, Human
ucuacgcucuccuuuc

SEQ ID NO: 2094522 - RNA, 17 nt, Human
ucuacgcucuccuuucu

SEQ ID NO: 2094523 - RNA, 19 nt, Human
ucuacuuacacaucuucca

SEQ ID NO: 2094524 - RNA, 20 nt, Human
ucuacuuacacaucuuccac

SEQ ID NO: 2094525 - RNA, 19 nt, Human
ucuacuucugcccuugcca

SEQ ID NO: 2094526 - RNA, 13 nt, Human
ucuaugggacuca

SEQ ID NO: 2094527 - RNA, 12 nt, Human
ucuaugggacuc

SEQ ID NO: 2094528 - RNA, 19 nt, Human
ucuaugggacucaaugcac

SEQ ID NO: 2094529 - RNA, 16 nt, Human
ucucauacucaccuca

SEQ ID NO: 2094530 - RNA, 18 nt, Human
ucucauacucaccucacc

SEQ ID NO: 2094531 - RNA, 13 nt, Human
ucucauagcauua

SEQ ID NO: 2094532 - RNA, 20 nt, Human
ucucauagcauuaacuaauc

SEQ ID NO: 2094533 - RNA, 24 nt, Human
ucucauagcauuaacuaaucuauu

SEQ ID NO: 2094534 - RNA, 13 nt, Human
ucucauccugcag

SEQ ID NO: 2094535 - RNA, 15 nt, Human
ucucauccugcaggc

SEQ ID NO: 2094536 - RNA, 17 nt, Human
ucucaucugugauuccc

SEQ ID NO: 2094537 - RNA, 13 nt, Human
ucucaucugugau

SEQ ID NO: 2094538 - RNA, 16 nt, Human
ucucauccuuuucucc

SEQ ID NO: 2094539 - RNA, 18 nt, Human
ucucauccuuuucuccua

SEQ ID NO: 2094540 - RNA, 21 nt, Human
ucucauccuuuucuccuaucu

SEQ ID NO: 2094541 - RNA, 16 nt, Human
ucuccacccugcucuc

SEQ ID NO: 2094542 - RNA, 14 nt, Human
ucuccacccugcuc

SEQ ID NO: 2094543 - RNA, 17 nt, Human
ucuccacccugcucucc

SEQ ID NO: 2094544 - RNA, 13 nt, Human
ucuccacccugcu

SEQ ID NO: 2094545 - RNA, 13 nt, Human
ucuccacuccaga

SEQ ID NO: 2094546 - RNA, 17 nt, Human
ucuccaccucagccuug

SEQ ID NO: 2094547 - RNA, 18 nt, Human
ucuccaccucagccuugg

SEQ ID NO: 2094548 - RNA, 19 nt, Human
ucuccaccucagccuugga

SEQ ID NO: 2094549 - RNA, 11 nt, Human
ucuccaccuca

SEQ ID NO: 2094550 - RNA, 12 nt, Human
ucuccaccucag

SEQ ID NO: 2094551 - RNA, 13 nt, Human
ucuccaccucagc

SEQ ID NO: 2094552 - RNA, 14 nt, Human
ucuccaccucagcc

SEQ ID NO: 2094553 - RNA, 15 nt, Human
ucuccaccucagccu

SEQ ID NO: 2094554 - RNA, 16 nt, Human
ucuccaccucagccuu

SEQ ID NO: 2094555 - RNA, 20 nt, Human
ucucccccugggcucugccc

SEQ ID NO: 2094556 - RNA, 11 nt, Human
ucuccaggcug

SEQ ID NO: 2094557 - RNA, 22 nt, Human
ucuccccaugugccugcaccag

SEQ ID NO: 2094558 - RNA, 18 nt, Human
ucucccucagucuggccc

SEQ ID NO: 2094559 - RNA, 23 nt, Human
ucucccucagucuggcccuuccu

SEQ ID NO: 2094560 - RNA, 12 nt, Human
ucuccccucugc

SEQ ID NO: 2094561 - RNA, 13 nt, Human
ucuccccucugcu

SEQ ID NO: 2094562 - RNA, 16 nt, Human
ucuccccucugcuggc

SEQ ID NO: 2094563 - RNA, 12 nt, Human
ucuccccucuua

SEQ ID NO: 2094564 - RNA, 15 nt, Human
ucuccccucuuaugu

SEQ ID NO: 2094565 - RNA, 12 nt, Human
ucucccuccccu

SEQ ID NO: 2094566 - RNA, 18 nt, Human
ucucccuccccugccauu

SEQ ID NO: 2094567 - RNA, 12 nt, Human
ucucccugccgc

SEQ ID NO: 2094568 - RNA, 13 nt, Human
ucucccugccgcc

SEQ ID NO: 2094569 - RNA, 14 nt, Human
ucucccugccgccu

SEQ ID NO: 2094570 - RNA, 15 nt, Human
ucucccugccgccuc

SEQ ID NO: 2094571 - RNA, 13 nt, Human
ucuccagcccacg

SEQ ID NO: 2094572 - RNA, 14 nt, Human
ucuccagcccacgu

SEQ ID NO: 2094573 - RNA, 14 nt, Human
ucuccacugccuuc

SEQ ID NO: 2094574 - RNA, 15 nt, Human
ucuccagacccccac

SEQ ID NO: 2094575 - RNA, 19 nt, Human
ucuccagacccccaccccu

SEQ ID NO: 2094576 - RNA, 20 nt, Human
ucuccagacccccaccccuu

SEQ ID NO: 2094577 - RNA, 23 nt, Human
uccugagccagugucaggaggaa

SEQ ID NO: 2094578 - RNA, 12 nt, Human
uccugagcuugg

SEQ ID NO: 2094579 - RNA, 15 nt, Human
uccugagcuuggcca

SEQ ID NO: 2094580 - RNA, 16 nt, Human
uccugagcuuggccag

SEQ ID NO: 2094581 - RNA, 19 nt, Human
uccugagcuuggccagaag

SEQ ID NO: 2094582 - RNA, 20 nt, Human
uccugagcuuggccagaagg

SEQ ID NO: 2094583 - RNA, 22 nt, Human
uccugagcuuggccagaagggg

SEQ ID NO: 2094584 - RNA, 22 nt, Human
uccugacggcgcccccagugug

SEQ ID NO: 2094585 - RNA, 20 nt, Human
uccucuuaaaaaauaaaaac

SEQ ID NO: 2094586 - RNA, 19 nt, Human
uccugacucaacauguuac

SEQ ID NO: 2094587 - RNA, 23 nt, Human
uccucuguccagggcccugagcu

SEQ ID NO: 2094588 - RNA, 14 nt, Human
uccucuguccaggg

SEQ ID NO: 2094589 - RNA, 16 nt, Human
uccucuguccagggcc

SEQ ID NO: 2094590 - RNA, 15 nt, Human
uccuccucccccaga

SEQ ID NO: 2094591 - RNA, 16 nt, Human
uccugcauuugugaaa

SEQ ID NO: 2094592 - RNA, 11 nt, Human
uccugccaaaa

SEQ ID NO: 2094593 - RNA, 13 nt, Human
uccugccaccugc

SEQ ID NO: 2094594 - RNA, 13 nt, Human
uccugccaggcau

SEQ ID NO: 2094595 - RNA, 14 nt, Human
uccugccaggcaug

SEQ ID NO: 2094596 - RNA, 18 nt, Human
uccugccaccuggggcag

SEQ ID NO: 2094597 - RNA, 20 nt, Human
uccugccaccuggggcaguc

SEQ ID NO: 2094598 - RNA, 12 nt, Human
uccugcccagga

SEQ ID NO: 2094599 - RNA, 13 nt, Human
uccugcccaggag

SEQ ID NO: 2094600 - RNA, 14 nt, Human
uccugcccaggaga

SEQ ID NO: 2094601 - RNA, 16 nt, Human
uccugcccaggagagc

SEQ ID NO: 2094602 - RNA, 18 nt, Human
uccugcccaggagagcca

SEQ ID NO: 2094603 - RNA, 19 nt, Human
uccugcccaggagagccag

SEQ ID NO: 2094604 - RNA, 22 nt, Human
uccugcccaggagagccagccc

SEQ ID NO: 2094605 - RNA, 23 nt, Human
uccugcccaggagagccagcccu

SEQ ID NO: 2094606 - RNA, 15 nt, Human
uccugcccccacacc

SEQ ID NO: 2094607 - RNA, 16 nt, Human
uccugcccccacaccu

SEQ ID NO: 2094608 - RNA, 19 nt, Human
uccugcccccacaccuggc

SEQ ID NO: 2094609 - RNA, 20 nt, Human
uccugcccccacaccuggcc

SEQ ID NO: 2094610 - RNA, 21 nt, Human
uccugcccccacaccuggccc

SEQ ID NO: 2094611 - RNA, 22 nt, Human
uccugcccccacaccuggcccu

SEQ ID NO: 2094612 - RNA, 23 nt, Human
uccugcccccacaccuggcccug

SEQ ID NO: 2094613 - RNA, 13 nt, Human
uccugcccagugu

SEQ ID NO: 2094614 - RNA, 14 nt, Human
uccugcccaguguu

SEQ ID NO: 2094615 - RNA, 17 nt, Human
uccugcccaguguuguu

SEQ ID NO: 2094616 - RNA, 19 nt, Human
uccugcccaguguuguuug

SEQ ID NO: 2094617 - RNA, 22 nt, Human
uccugcccaguguuguuuguaa

SEQ ID NO: 2094618 - RNA, 23 nt, Human
uccuggcacccggccccugcugg

SEQ ID NO: 2094619 - RNA, 12 nt, Human
uccuggccucaa

SEQ ID NO: 2094620 - RNA, 11 nt, Human
uccuguagccc

SEQ ID NO: 2094621 - RNA, 13 nt, Human
uccuguagcccua

SEQ ID NO: 2094622 - RNA, 20 nt, Human
uccuguagaccuagggagga

SEQ ID NO: 2094623 - RNA, 23 nt, Human
uccuguagaccuagggaggaccu

SEQ ID NO: 2094624 - RNA, 12 nt, Human
uccugucugcca

SEQ ID NO: 2094625 - RNA, 13 nt, Human
uccugucugccag

SEQ ID NO: 2094626 - RNA, 14 nt, Human
uccugucugccagc

SEQ ID NO: 2094627 - RNA, 16 nt, Human
uccugucugccagcca

SEQ ID NO: 2094628 - RNA, 11 nt, Human
uccugucuccc

SEQ ID NO: 2094629 - RNA, 12 nt, Human
uccugucucccc

SEQ ID NO: 2094630 - RNA, 13 nt, Human
uccugucuccccu

SEQ ID NO: 2094631 - RNA, 14 nt, Human
uccugucuccccuc

SEQ ID NO: 2094632 - RNA, 16 nt, Human
uccugucuccccucug

SEQ ID NO: 2094633 - RNA, 17 nt, Human
uccugucuccccucugc

SEQ ID NO: 2094634 - RNA, 18 nt, Human
uccugucuccccucugcu

SEQ ID NO: 2094635 - RNA, 19 nt, Human
uccugucuccccucugcug

SEQ ID NO: 2094636 - RNA, 14 nt, Human
uccuggacucauug

SEQ ID NO: 2094637 - RNA, 19 nt, Human
uccuggacucauugcuuca

SEQ ID NO: 2094638 - RNA, 14 nt, Human
uccuggagagucuc

SEQ ID NO: 2094639 - RNA, 18 nt, Human
uccuggagagucucacuc

SEQ ID NO: 2094640 - RNA, 19 nt, Human
uccuggagagucucacucc

SEQ ID NO: 2094641 - RNA, 13 nt, Human
uccuggagcccga

SEQ ID NO: 2094642 - RNA, 15 nt, Human
uccuggagcccgagg

SEQ ID NO: 2094643 - RNA, 20 nt, Human
uccuggagcccgaggcacca

SEQ ID NO: 2094644 - RNA, 21 nt, Human
uccuggagcccgaggcaccag

SEQ ID NO: 2094645 - RNA, 22 nt, Human
uccugccgcccgagguggcugc

SEQ ID NO: 2094646 - RNA, 23 nt, Human
uccugccgcccgagguggcugcc

SEQ ID NO: 2094647 - RNA, 20 nt, Human
uccuacaagagcagccugug

SEQ ID NO: 2094648 - RNA, 22 nt, Human
uccuacaagagcagccuguggc

SEQ ID NO: 2094649 - RNA, 23 nt, Human
uccuacaagagcagccuguggca

SEQ ID NO: 2094650 - RNA, 21 nt, Human
uccuaaggcacccacaaauaa

SEQ ID NO: 2094651 - RNA, 19 nt, Human
uccuacaagagcagccugu

SEQ ID NO: 2094652 - RNA, 23 nt, Human
uccuauauuguuuucaguguaca

SEQ ID NO: 2094653 - RNA, 20 nt, Human
uccuaucaagccaguacgug

SEQ ID NO: 2094654 - RNA, 14 nt, Human
uccuaucaccuccc

SEQ ID NO: 2094655 - RNA, 16 nt, Human
uccuaucaccuccccu

SEQ ID NO: 2094656 - RNA, 17 nt, Human
uccuaucaccuccccuc

SEQ ID NO: 2094657 - RNA, 19 nt, Human
uccuaucaccuccccuccu

SEQ ID NO: 2094658 - RNA, 15 nt, Human
uccuacaauauauau

SEQ ID NO: 2094659 - RNA, 19 nt, Human
uccucauuguaaacaaacu

SEQ ID NO: 2094660 - RNA, 14 nt, Human
uccucauuccugaa

SEQ ID NO: 2094661 - RNA, 19 nt, Human
uccucauuugggguagcua

SEQ ID NO: 2094662 - RNA, 22 nt, Human
uccucauuuuuauaaugucccu

SEQ ID NO: 2094663 - RNA, 21 nt, Human
uccucauuugggguagcuaga

SEQ ID NO: 2094664 - RNA, 23 nt, Human
uccucauuugggguagcuagagg

SEQ ID NO: 2094665 - RNA, 23 nt, Human
uccuccaaaggaagucuaggagc

SEQ ID NO: 2094666 - RNA, 17 nt, Human
uccuaucagaaguuucu

SEQ ID NO: 2094667 - RNA, 18 nt, Human
uccucauuagcauuuugc

SEQ ID NO: 2094668 - RNA, 13 nt, Human
uccuccagggcca

SEQ ID NO: 2094669 - RNA, 19 nt, Human
uccuccagggccacgugcc

SEQ ID NO: 2094670 - RNA, 20 nt, Human
uccuccagggccacgugcca

SEQ ID NO: 2094671 - RNA, 23 nt, Human
uccuccagggccacgugccaggc

SEQ ID NO: 2094672 - RNA, 21 nt, Human
uccuccagggaugaucaacag

SEQ ID NO: 2094673 - RNA, 12 nt, Human
uccucccaccuc

SEQ ID NO: 2094674 - RNA, 16 nt, Human
uccuccauacucagga

SEQ ID NO: 2094675 - RNA, 22 nt, Human
uccucccaaaaguaucgggggc

SEQ ID NO: 2094676 - RNA, 17 nt, Human
uccgccuucacuccggu

SEQ ID NO: 2094677 - RNA, 16 nt, Human
uccgcuuucuacccag

SEQ ID NO: 2094678 - RNA, 20 nt, Human
uccgcuuucuacccagcgag

SEQ ID NO: 2094679 - RNA, 18 nt, Human
uccgcuuucuacccagcg

SEQ ID NO: 2094680 - RNA, 20 nt, Human
uccuaagcuauucaguaaua

SEQ ID NO: 2094681 - RNA, 21 nt, Human
uccuaagcuauucaguaauaa

SEQ ID NO: 2094682 - RNA, 14 nt, Human
uccgccucuugggu

SEQ ID NO: 2094683 - RNA, 17 nt, Human
uccgccucugcuggcac

SEQ ID NO: 2094684 - RNA, 15 nt, Human
ucccuuccucuuucc

SEQ ID NO: 2094685 - RNA, 16 nt, Human
ucccuuccucuuucca

SEQ ID NO: 2094686 - RNA, 17 nt, Human
ucccuucccccauaagc

SEQ ID NO: 2094687 - RNA, 12 nt, Human
ucccuuccccuc

SEQ ID NO: 2094688 - RNA, 21 nt, Human
ucccuuccccucccuggcucc

SEQ ID NO: 2094689 - RNA, 20 nt, Human
ucccuuccccucccuggcuc

SEQ ID NO: 2094690 - RNA, 22 nt, Human
ucccuucaaccauuccccaugg

SEQ ID NO: 2094691 - RNA, 20 nt, Human
ucccuucacaaacccagugu

SEQ ID NO: 2094692 - RNA, 23 nt, Human
ucccccugggcucugccccagcu

SEQ ID NO: 2094693 - RNA, 12 nt, Human
uccccccacugc

SEQ ID NO: 2094694 - RNA, 13 nt, Human
uccccccacugca

SEQ ID NO: 2094695 - RNA, 18 nt, Human
uccccccacugcaggccc

SEQ ID NO: 2094696 - RNA, 19 nt, Human
uccccccacugcaggcccc

SEQ ID NO: 2094697 - RNA, 23 nt, Human
uccccccacugcaggccccgcuu

SEQ ID NO: 2094698 - RNA, 12 nt, Human
ucccccugggcu

SEQ ID NO: 2094699 - RNA, 14 nt, Human
ucccccugggcucu

SEQ ID NO: 2094700 - RNA, 15 nt, Human
ucccccugggcucug

SEQ ID NO: 2094701 - RNA, 20 nt, Human
ucccccugggcucugcccca

SEQ ID NO: 2094702 - RNA, 22 nt, Human
ucccccugggcucugccccagc

SEQ ID NO: 2094703 - RNA, 23 nt, Human
ucauuguuuauuaacaaauuaug

SEQ ID NO: 2094704 - RNA, 16 nt, Human
ucauuguuuggcauug

SEQ ID NO: 2094705 - RNA, 20 nt, Human
ucauuguaauguuacugauc

SEQ ID NO: 2094706 - RNA, 19 nt, Human
ucauuguaauguuacugau

SEQ ID NO: 2094707 - RNA, 14 nt, Human
ucauuguauaaaaa

SEQ ID NO: 2094708 - RNA, 15 nt, Human
ucauuguauaaaaau

SEQ ID NO: 2094709 - RNA, 16 nt, Human
ucauuguauaaaaaua

SEQ ID NO: 2094710 - RNA, 17 nt, Human
ucauuguauaaaaauag

SEQ ID NO: 2094711 - RNA, 18 nt, Human
ucaugguccccauggcau

SEQ ID NO: 2094712 - RNA, 15 nt, Human
ucauggugaggcuua

SEQ ID NO: 2094713 - RNA, 22 nt, Human
ucauggugaggcuuaacaaugu

SEQ ID NO: 2094714 - RNA, 23 nt, Human
ucaugguggguucaggggacuca

SEQ ID NO: 2094715 - RNA, 13 nt, Human
uccaaagagaaaa

SEQ ID NO: 2094716 - RNA, 21 nt, Human
uccaaaccuccuguuagcugu

SEQ ID NO: 2094717 - RNA, 19 nt, Human
ucauuucaaauacaucuuu

SEQ ID NO: 2094718 - RNA, 15 nt, Human
ucauuuaucccucaa

SEQ ID NO: 2094719 - RNA, 14 nt, Human
ucauuuaugaaaag

SEQ ID NO: 2094720 - RNA, 15 nt, Human
ucauuuaugaaaaga

SEQ ID NO: 2094721 - RNA, 11 nt, Human
ucauuuaugau

SEQ ID NO: 2094722 - RNA, 17 nt, Human
ucauuuaugauacaaaa

SEQ ID NO: 2094723 - RNA, 14 nt, Human
ucaucauuccuuga

SEQ ID NO: 2094724 - RNA, 17 nt, Human
ucaucauuccuugagaa

SEQ ID NO: 2094725 - RNA, 14 nt, Human
ucaucauccuaagc

SEQ ID NO: 2094726 - RNA, 18 nt, Human
ucauagcagauuuuaauu

SEQ ID NO: 2094727 - RNA, 14 nt, Human
ucauagauuucuga

SEQ ID NO: 2094728 - RNA, 16 nt, Human
ucauagauuucugauu

SEQ ID NO: 2094729 - RNA, 19 nt, Human
ucauagauuucugauuuua

SEQ ID NO: 2094730 - RNA, 23 nt, Human
ucauagauuucugauuuuaugua

SEQ ID NO: 2094731 - RNA, 12 nt, Human
ucauagaagaac

SEQ ID NO: 2094732 - RNA, 20 nt, Human
ucaguguacauggaauaaca

SEQ ID NO: 2094733 - RNA, 15 nt, Human
ucaguguagccccaa

SEQ ID NO: 2094734 - RNA, 19 nt, Human
ucaguguagccccaagaag

SEQ ID NO: 2094735 - RNA, 15 nt, Human
ucagugcagcccgug

SEQ ID NO: 2094736 - RNA, 17 nt, Human
ucauccacugugccaug

SEQ ID NO: 2094737 - RNA, 14 nt, Human
ucauccacugugcc

SEQ ID NO: 2094738 - RNA, 18 nt, Human
ucauccacugugccaugu

SEQ ID NO: 2094739 - RNA, 20 nt, Human
ucaucucaggccucccucaa

SEQ ID NO: 2094740 - RNA, 13 nt, Human
ucaucuccaucag

SEQ ID NO: 2094741 - RNA, 16 nt, Human
ucaucuugaccaagca

SEQ ID NO: 2094742 - RNA, 19 nt, Human
ucaucuugaccaagcagga

SEQ ID NO: 2094743 - RNA, 16 nt, Human
ucaucuccaucagcug

SEQ ID NO: 2094744 - RNA, 17 nt, Human
ucaucuccaucagcugu

SEQ ID NO: 2094745 - RNA, 21 nt, Human
ucaucuugaccaagcaggaag

SEQ ID NO: 2094746 - RNA, 22 nt, Human
ucaucuugaccaagcaggaagc

SEQ ID NO: 2094747 - RNA, 22 nt, Human
ucaucuugguacuacuagaugu

SEQ ID NO: 2094748 - RNA, 23 nt, Human
ucaucuugaccaagcaggaagcu

SEQ ID NO: 2094749 - RNA, 22 nt, Human
ucauggguuauguguaugugcc

SEQ ID NO: 2094750 - RNA, 17 nt, Human
ucauggguuauguguau

SEQ ID NO: 2094751 - RNA, 17 nt, Human
ucaugggccccucugac

SEQ ID NO: 2094752 - RNA, 13 nt, Human
ucauggaaauauu

SEQ ID NO: 2094753 - RNA, 15 nt, Human
ucauggaaauauuau

SEQ ID NO: 2094754 - RNA, 19 nt, Human
ucauggaaauauuaugcaa

SEQ ID NO: 2094755 - RNA, 18 nt, Human
ucaggccuauaaccccag

SEQ ID NO: 2094756 - RNA, 22 nt, Human
ucaggccuauaaccccagcucc

SEQ ID NO: 2094757 - RNA, 15 nt, Human
ucaggcucuucuccu

SEQ ID NO: 2094758 - RNA, 21 nt, Human
ucaggcgauccaccugucuca

SEQ ID NO: 2094759 - RNA, 20 nt, Human
ucaggcgauccaccugucuc

SEQ ID NO: 2094760 - RNA, 17 nt, Human
ucaggccucccucucuc

SEQ ID NO: 2094761 - RNA, 18 nt, Human
ucaggccucccucucucu

SEQ ID NO: 2094762 - RNA, 20 nt, Human
ucaggaucaaaccccgacca

SEQ ID NO: 2094763 - RNA, 18 nt, Human
ucaggauacucugucaga

SEQ ID NO: 2094764 - RNA, 12 nt, Human
ucaggaguuccu

SEQ ID NO: 2094765 - RNA, 20 nt, Human
ucaggaguuagaggccagcc

SEQ ID NO: 2094766 - RNA, 22 nt, Human
ucaggaguuagaggccagccug

SEQ ID NO: 2094767 - RNA, 17 nt, Human
ucaggaguuagaggcca

SEQ ID NO: 2094768 - RNA, 19 nt, Human
ucaggaguuagaggccagc

SEQ ID NO: 2094769 - RNA, 20 nt, Human
ucaggauacucugucagaug

SEQ ID NO: 2094770 - RNA, 16 nt, Human
ucaggaucaagaaagu

SEQ ID NO: 2094771 - RNA, 17 nt, Human
ucaggaucaagaaagug

SEQ ID NO: 2094772 - RNA, 20 nt, Human
ucaggaugauacacuaugaa

SEQ ID NO: 2094773 - RNA, 16 nt, Human
ucaggaaggaugagca

SEQ ID NO: 2094774 - RNA, 17 nt, Human
ucaggaaggaugagcau

SEQ ID NO: 2094775 - RNA, 18 nt, Human
ucaggaaggaugagcauu

SEQ ID NO: 2094776 - RNA, 20 nt, Human
ucaggaaggaugagcauuua

SEQ ID NO: 2094777 - RNA, 12 nt, Human
ucaggacacuaa

SEQ ID NO: 2094778 - RNA, 13 nt, Human
ucaggacacuaau

SEQ ID NO: 2094779 - RNA, 13 nt, Human
ucagcuccagcug

SEQ ID NO: 2094780 - RNA, 19 nt, Human
ucaccuaagucucugugaa

SEQ ID NO: 2094781 - RNA, 14 nt, Human
ucaccuaauguuua

SEQ ID NO: 2094782 - RNA, 21 nt, Human
ucaccuaauguuuaugagcca

SEQ ID NO: 2094783 - RNA, 22 nt, Human
ucaccuaauguuuaugagccag

SEQ ID NO: 2094784 - RNA, 24 nt, Human
ucagcuccagcucaccagccccag

SEQ ID NO: 2094785 - RNA, 23 nt, Human
ucagcuccagcucaccagcccca

SEQ ID NO: 2094786 - RNA, 17 nt, Human
ucaccuaagucucugug

SEQ ID NO: 2094787 - RNA, 23 nt, Human
ucaccggagcuuucaaagaagga

SEQ ID NO: 2094788 - RNA, 15 nt, Human
ucaccggauccuggg

SEQ ID NO: 2094789 - RNA, 14 nt, Human
ucaccggagcuuuc

SEQ ID NO: 2094790 - RNA, 23 nt, Human
ucagcucugcaagaauugaagca

SEQ ID NO: 2094791 - RNA, 23 nt, Human
ucagcuguaagaagagacuggga

SEQ ID NO: 2094792 - RNA, 22 nt, Human
ucagcucuucuccauccuacca

SEQ ID NO: 2094793 - RNA, 14 nt, Human
ucagcucuggcuca

SEQ ID NO: 2094794 - RNA, 16 nt, Human
ucagcucuggcucaca

SEQ ID NO: 2094795 - RNA, 17 nt, Human
ucagcucuggcucacag

SEQ ID NO: 2094796 - RNA, 20 nt, Human
ucagcucuggcucacagacu

SEQ ID NO: 2094797 - RNA, 18 nt, Human
ucagcuuaggggcugcug

SEQ ID NO: 2094798 - RNA, 15 nt, Human
ucagcuguuugucau

SEQ ID NO: 2094799 - RNA, 16 nt, Human
ucagcuguuugucaua

SEQ ID NO: 2094800 - RNA, 20 nt, Human
ucagguggggcagcuugagg

SEQ ID NO: 2094801 - RNA, 14 nt, Human
ucagucucaggagc

SEQ ID NO: 2094802 - RNA, 15 nt, Human
ucaguccuuugauca

SEQ ID NO: 2094803 - RNA, 12 nt, Human
ucagucuuuucc

SEQ ID NO: 2094804 - RNA, 11 nt, Human
ucagugacaga

SEQ ID NO: 2094805 - RNA, 15 nt, Human
ucagugacagaguuc

SEQ ID NO: 2094806 - RNA, 19 nt, Human
ucagugacagaguucacua

SEQ ID NO: 2094807 - RNA, 14 nt, Human
ucagugaggcccag

SEQ ID NO: 2094808 - RNA, 17 nt, Human
ucagugaggcccaggga

SEQ ID NO: 2094809 - RNA, 18 nt, Human
ucagugaggcccagggag

SEQ ID NO: 2094810 - RNA, 19 nt, Human
ucagugauguaccaugaaa

SEQ ID NO: 2094811 - RNA, 14 nt, Human
ucagugcaaagauu

SEQ ID NO: 2094812 - RNA, 23 nt, Human
ucagugcagcccguguggccccu

SEQ ID NO: 2094813 - RNA, 23 nt, Human
ucagucugauucccaagcucugc

SEQ ID NO: 2094814 - RNA, 22 nt, Human
ucagucugauucccaagcucug

SEQ ID NO: 2094815 - RNA, 21 nt, Human
ucagucugauucccaagcucu

SEQ ID NO: 2094816 - RNA, 19 nt, Human
ucagguggggcagcuugag

SEQ ID NO: 2094817 - RNA, 18 nt, Human
ucagguggggcagcuuga

SEQ ID NO: 2094818 - RNA, 23 nt, Human
ucaggugauccacccaccucagc

SEQ ID NO: 2094819 - RNA, 18 nt, Human
ucaggucagggugaggau

SEQ ID NO: 2094820 - RNA, 12 nt, Human
ucaggucccugc

SEQ ID NO: 2094821 - RNA, 15 nt, Human
ucaggucagggugag

SEQ ID NO: 2094822 - RNA, 16 nt, Human
ucaggugauccaccca

SEQ ID NO: 2094823 - RNA, 23 nt, Human
ucaggugagaagcagaggaagga

SEQ ID NO: 2094824 - RNA, 14 nt, Human
ucagggaagcccag

SEQ ID NO: 2094825 - RNA, 15 nt, Human
ucagggaagcccagc

SEQ ID NO: 2094826 - RNA, 16 nt, Human
ucagggaagcccagcu

SEQ ID NO: 2094827 - RNA, 17 nt, Human
ucagggaagcccagcuc

SEQ ID NO: 2094828 - RNA, 19 nt, Human
ucagggaagcccagcucca

SEQ ID NO: 2094829 - RNA, 20 nt, Human
ucagggaagcccagcuccag

SEQ ID NO: 2094830 - RNA, 21 nt, Human
ucagggaagcccagcuccagg

SEQ ID NO: 2094831 - RNA, 15 nt, Human
ucaggcugcuggagg

SEQ ID NO: 2094832 - RNA, 16 nt, Human
ucaggcugcuggagga

SEQ ID NO: 2094833 - RNA, 17 nt, Human
ucaggcugcuggaggaa

SEQ ID NO: 2094834 - RNA, 19 nt, Human
ucaggcugcuggaggaaaa

SEQ ID NO: 2094835 - RNA, 21 nt, Human
ucaggcucuucuccuuucaca

SEQ ID NO: 2094836 - RNA, 16 nt, Human
ucaggcucuucuccuu

SEQ ID NO: 2094837 - RNA, 12 nt, Human
ucagggaccccu

SEQ ID NO: 2094838 - RNA, 14 nt, Human
ucagggaccccugc

SEQ ID NO: 2094839 - RNA, 17 nt, Human
ucagggaccccugcccu

SEQ ID NO: 2094840 - RNA, 16 nt, Human
ucaggucaggaguucg

SEQ ID NO: 2094841 - RNA, 16 nt, Human
ucagggaccccugccc

SEQ ID NO: 2094842 - RNA, 22 nt, Human
ucagggaauuucaggaacuaga

SEQ ID NO: 2094843 - RNA, 18 nt, Human
ucagggacagagacaccu

SEQ ID NO: 2094844 - RNA, 21 nt, Human
ucagggacagagacaccugca

SEQ ID NO: 2094845 - RNA, 23 nt, Human
ucagggacagagacaccugcacc

SEQ ID NO: 2094846 - RNA, 14 nt, Human
ucagggaccaagga

SEQ ID NO: 2094847 - RNA, 15 nt, Human
ucagggaccaaggac

SEQ ID NO: 2094848 - RNA, 20 nt, Human
ucagggaccaaggaccccuc

SEQ ID NO: 2094849 - RNA, 23 nt, Human
ucagggaccaaggaccccucacc

SEQ ID NO: 2094850 - RNA, 15 nt, Human
ucccaggccaggcuc

SEQ ID NO: 2094851 - RNA, 21 nt, Human
ucccaggccaggcuccuuccu

SEQ ID NO: 2094852 - RNA, 22 nt, Human
ucccagcugugcucuggacagg

SEQ ID NO: 2094853 - RNA, 21 nt, Human
ucccagcugugcucuggacag

SEQ ID NO: 2094854 - RNA, 23 nt, Human
ucccagcugugcucuggacaggc

SEQ ID NO: 2094855 - RNA, 19 nt, Human
ucccaugagccucagcauc

SEQ ID NO: 2094856 - RNA, 18 nt, Human
ucccaugagccucagcau

SEQ ID NO: 2094857 - RNA, 19 nt, Human
ucccaucuuaacucuuugc

SEQ ID NO: 2094858 - RNA, 21 nt, Human
ucccaucuuaacucuuugccu

SEQ ID NO: 2094859 - RNA, 16 nt, Human
ucccaggcgccccuuc

SEQ ID NO: 2094860 - RNA, 15 nt, Human
ucccaucuuccaagg

SEQ ID NO: 2094861 - RNA, 18 nt, Human
ucccaccuuggcugcagg

SEQ ID NO: 2094862 - RNA, 20 nt, Human
ucccagcugugcucuggaca

SEQ ID NO: 2094863 - RNA, 17 nt, Human
ucccaccuuggcugcag

SEQ ID NO: 2094864 - RNA, 16 nt, Human
ucccaccuuggcugca

SEQ ID NO: 2094865 - RNA, 13 nt, Human
ucccaccuuggcu

SEQ ID NO: 2094866 - RNA, 15 nt, Human
uccauuauuuauauu

SEQ ID NO: 2094867 - RNA, 14 nt, Human
uccauuccacaucc

SEQ ID NO: 2094868 - RNA, 17 nt, Human
uccauguguggacucaa

SEQ ID NO: 2094869 - RNA, 11 nt, Human
uccaugugugu

SEQ ID NO: 2094870 - RNA, 13 nt, Human
uccaugugugugc

SEQ ID NO: 2094871 - RNA, 14 nt, Human
uccaugugugugca

SEQ ID NO: 2094872 - RNA, 18 nt, Human
uccaugugugugcaagug

SEQ ID NO: 2094873 - RNA, 18 nt, Human
uccauguuaguuuuuacu

SEQ ID NO: 2094874 - RNA, 19 nt, Human
uccauguuaguuuuuacuu

SEQ ID NO: 2094875 - RNA, 16 nt, Human
uccaugugcccaguua

SEQ ID NO: 2094876 - RNA, 20 nt, Human
uccaugugggcuaguugggc

SEQ ID NO: 2094877 - RNA, 15 nt, Human
uccauuaugauucuu

SEQ ID NO: 2094878 - RNA, 11 nt, Human
uccauuauuua

SEQ ID NO: 2094879 - RNA, 12 nt, Human
uccauuauuuau

SEQ ID NO: 2094880 - RNA, 14 nt, Human
uccauuauuuauau

SEQ ID NO: 2094881 - RNA, 22 nt, Human
uccauuaacuuagcauguguug

SEQ ID NO: 2094882 - RNA, 20 nt, Human
uccauuaacuuagcaugugu

SEQ ID NO: 2094883 - RNA, 18 nt, Human
uccccagauugcaacagg

SEQ ID NO: 2094884 - RNA, 13 nt, Human
uccccagauugca

SEQ ID NO: 2094885 - RNA, 20 nt, Human
ucccaugagccucagcaucc

SEQ ID NO: 2094886 - RNA, 22 nt, Human
uccccagcaagugagagcuggg

SEQ ID NO: 2094887 - RNA, 10 nt, Human
uccccagcag

SEQ ID NO: 2094888 - RNA, 21 nt, Human
uccccagcaagugagagcugg

SEQ ID NO: 2094889 - RNA, 20 nt, Human
uccccagcaagugagagcug

SEQ ID NO: 2094890 - RNA, 23 nt, Human
uccccagauugcaacaggcuggg

SEQ ID NO: 2094891 - RNA, 22 nt, Human
uccccagauugcaacaggcugg

SEQ ID NO: 2094892 - RNA, 20 nt, Human
uccccagauugcaacaggcu

SEQ ID NO: 2094893 - RNA, 19 nt, Human
uccccagauugcaacaggc

SEQ ID NO: 2094894 - RNA, 12 nt, Human
uccccccacucu

SEQ ID NO: 2094895 - RNA, 21 nt, Human
uccccccacucuccccacacu

SEQ ID NO: 2094896 - RNA, 12 nt, Human
uccccagccucu

SEQ ID NO: 2094897 - RNA, 13 nt, Human
uccccagcccacu

SEQ ID NO: 2094898 - RNA, 14 nt, Human
uccccagcccacug

SEQ ID NO: 2094899 - RNA, 19 nt, Human
uccccagcccacuggauca

SEQ ID NO: 2094900 - RNA, 14 nt, Human
uccccagcccaggg

SEQ ID NO: 2094901 - RNA, 15 nt, Human
uccccagcccagggu

SEQ ID NO: 2094902 - RNA, 22 nt, Human
uccccagcccaggguuccccca

SEQ ID NO: 2094903 - RNA, 23 nt, Human
uccccagcccaggguucccccag

SEQ ID NO: 2094904 - RNA, 15 nt, Human
uccccagcccuaaga

SEQ ID NO: 2094905 - RNA, 15 nt, Human
uccccagcagguggg

SEQ ID NO: 2094906 - RNA, 19 nt, Human
uccccagcagguggggagg

SEQ ID NO: 2094907 - RNA, 12 nt, Human
uccccagcccag

SEQ ID NO: 2094908 - RNA, 13 nt, Human
uccaguucccacu

SEQ ID NO: 2094909 - RNA, 22 nt, Human
uccauaaucuggacuccucugu

SEQ ID NO: 2094910 - RNA, 16 nt, Human
uccauaaggaauguag

SEQ ID NO: 2094911 - RNA, 20 nt, Human
uccagguuuaagcuguuacu

SEQ ID NO: 2094912 - RNA, 14 nt, Human
uccaggucgggcuc

SEQ ID NO: 2094913 - RNA, 16 nt, Human
uccaggucgggcucag

SEQ ID NO: 2094914 - RNA, 18 nt, Human
uccaggucgggcucagcu

SEQ ID NO: 2094915 - RNA, 19 nt, Human
uccaggucgggcucagcuc

SEQ ID NO: 2094916 - RNA, 20 nt, Human
uccaggucgggcucagcucu

SEQ ID NO: 2094917 - RNA, 22 nt, Human
uccaggucgggcucagcucugg

SEQ ID NO: 2094918 - RNA, 15 nt, Human
uccaugcugccucca

SEQ ID NO: 2094919 - RNA, 14 nt, Human
uccaugcugccucc

SEQ ID NO: 2094920 - RNA, 17 nt, Human
uccaugcuauaaaaacu

SEQ ID NO: 2094921 - RNA, 12 nt, Human
uccaguuuguuu

SEQ ID NO: 2094922 - RNA, 14 nt, Human
uccaucaggccacu

SEQ ID NO: 2094923 - RNA, 22 nt, Human
uccaucagcuuaggggcugcug

SEQ ID NO: 2094924 - RNA, 21 nt, Human
uccauaaucuggacuccucug

SEQ ID NO: 2094925 - RNA, 13 nt, Human
uccauacucagga

SEQ ID NO: 2094926 - RNA, 15 nt, Human
uccagcaauugugug

SEQ ID NO: 2094927 - RNA, 11 nt, Human
uccagaaagaa

SEQ ID NO: 2094928 - RNA, 14 nt, Human
uccagaaaggauau

SEQ ID NO: 2094929 - RNA, 17 nt, Human
uccagaaaggauauuua

SEQ ID NO: 2094930 - RNA, 18 nt, Human
uccagaaaggauauuuaa

SEQ ID NO: 2094931 - RNA, 19 nt, Human
uccagaaaggauauuuaag

SEQ ID NO: 2094932 - RNA, 22 nt, Human
uccagaaaggauauuuaagaaa

SEQ ID NO: 2094933 - RNA, 23 nt, Human
uccagaaaggauauuuaagaaaa

SEQ ID NO: 2094934 - RNA, 18 nt, Human
uccagaaaaccccagcau

SEQ ID NO: 2094935 - RNA, 12 nt, Human
ucuuguguuucu

SEQ ID NO: 2094936 - RNA, 13 nt, Human
ucuuguguuggcu

SEQ ID NO: 2094937 - RNA, 14 nt, Human
ucuuguuuucaguu

SEQ ID NO: 2094938 - RNA, 21 nt, Human
ucuuguugcucaaaaaaugag

SEQ ID NO: 2094939 - RNA, 13 nt, Human
ucuuguuaauauu

SEQ ID NO: 2094940 - RNA, 17 nt, Human
ucuuguuaauauucuuu

SEQ ID NO: 2094941 - RNA, 20 nt, Human
ucuuguuaauauucuuucaa

SEQ ID NO: 2094942 - RNA, 21 nt, Human
ucuuguuaauauucuuucaau

SEQ ID NO: 2094943 - RNA, 13 nt, Human
ucuuguucuguuu

SEQ ID NO: 2094944 - RNA, 16 nt, Human
ucuuguucuguuuugu

SEQ ID NO: 2094945 - RNA, 22 nt, Human
ucuuguugcucaaaaaaugagc

SEQ ID NO: 2094946 - RNA, 22 nt, Human
ucuuguuuuuccacuacugcua

SEQ ID NO: 2094947 - RNA, 21 nt, Human
ucuuguuuuuccacuacugcu

SEQ ID NO: 2094948 - RNA, 13 nt, Human
ucuuguuuuucca

SEQ ID NO: 2094949 - RNA, 20 nt, Human
ucuuguuuuuccacuacugc

SEQ ID NO: 2094950 - RNA, 18 nt, Human
ucuuucaaauugagagaa

SEQ ID NO: 2094951 - RNA, 19 nt, Human
ucuuucaaauugagagaau

SEQ ID NO: 2094952 - RNA, 22 nt, Human
ucuuucaaauugagagaaugga

SEQ ID NO: 2094953 - RNA, 20 nt, Human
ucuuucaaagguagccauca

SEQ ID NO: 2094954 - RNA, 22 nt, Human
ucuuucaaagguagccaucaug

SEQ ID NO: 2094955 - RNA, 16 nt, Human
ucuuucaagugaaucu

SEQ ID NO: 2094956 - RNA, 19 nt, Human
ucuuucaagugaaucuaaa

SEQ ID NO: 2094957 - RNA, 20 nt, Human
ucuuucaagugaaucuaaaa

SEQ ID NO: 2094958 - RNA, 19 nt, Human
ucuuucacccacagaaaga

SEQ ID NO: 2094959 - RNA, 20 nt, Human
ucuuucacccacagaaagag

SEQ ID NO: 2094960 - RNA, 23 nt, Human
ucuuucacccacagaaagagagc

SEQ ID NO: 2094961 - RNA, 13 nt, Human
ucuugcagugauu

SEQ ID NO: 2094962 - RNA, 14 nt, Human
ucuugcagugauua

SEQ ID NO: 2094963 - RNA, 22 nt, Human
ucuugcugguugucauuuuugc

SEQ ID NO: 2094964 - RNA, 13 nt, Human
ucuugcugugguc

SEQ ID NO: 2094965 - RNA, 14 nt, Human
ucuugcuguggucu

SEQ ID NO: 2094966 - RNA, 16 nt, Human
ucuccucuugccacug

SEQ ID NO: 2094967 - RNA, 13 nt, Human
ucuccucuugcca

SEQ ID NO: 2094968 - RNA, 13 nt, Human
ucucccuggcccu

SEQ ID NO: 2094969 - RNA, 12 nt, Human
ucuccucuuaaa

SEQ ID NO: 2094970 - RNA, 14 nt, Human
ucuccucuuaaaaa

SEQ ID NO: 2094971 - RNA, 17 nt, Human
ucuccucuugccacugc

SEQ ID NO: 2094972 - RNA, 22 nt, Human
ucuccucuuaaaaaauaaaaac

SEQ ID NO: 2094973 - RNA, 23 nt, Human
ucuccucuuaaaaaauaaaaacu

SEQ ID NO: 2094974 - RNA, 23 nt, Human
ucuugcaauggcagccuuggcaa

SEQ ID NO: 2094975 - RNA, 18 nt, Human
ucuugcagagaagccuug

SEQ ID NO: 2094976 - RNA, 14 nt, Human
ucuuugaaacaacu

SEQ ID NO: 2094977 - RNA, 16 nt, Human
ucuuugaaacaacuuu

SEQ ID NO: 2094978 - RNA, 22 nt, Human
ucuuugaaagaaggaagacuuu

SEQ ID NO: 2094979 - RNA, 21 nt, Human
ucuuugaaauagucuguguga

SEQ ID NO: 2094980 - RNA, 22 nt, Human
ucuuugaaauagucugugugaa

SEQ ID NO: 2094981 - RNA, 20 nt, Human
ucuuugauaaagaaaagaau

SEQ ID NO: 2094982 - RNA, 20 nt, Human
ucuuugauacuuguucaaaa

SEQ ID NO: 2094983 - RNA, 17 nt, Human
ucuuuggacacucacac

SEQ ID NO: 2094984 - RNA, 18 nt, Human
ucuuuuaguuuuaguugc

SEQ ID NO: 2094985 - RNA, 22 nt, Human
ucuuuuauaacuaguccuuuac

SEQ ID NO: 2094986 - RNA, 18 nt, Human
ucuuuuagucauuuugcu

SEQ ID NO: 2094987 - RNA, 16 nt, Human
ucuuuuaguuuuaguu

SEQ ID NO: 2094988 - RNA, 22 nt, Human
ucuuuuauaaaaaaaaugaaau

SEQ ID NO: 2094989 - RNA, 24 nt, Human
ucuuuuauaaaaaaaaugaaaugu

SEQ ID NO: 2094990 - RNA, 19 nt, Human
ucuuuuauaacuaguccuu

SEQ ID NO: 2094991 - RNA, 18 nt, Human
ucuuucuuuggugccuuu

SEQ ID NO: 2094992 - RNA, 19 nt, Human
ucuuucuuuggugccuuuc

SEQ ID NO: 2094993 - RNA, 21 nt, Human
ucuuucuuuggugccuuuccu

SEQ ID NO: 2094994 - RNA, 19 nt, Human
ucuuuccauuaugauucuu

SEQ ID NO: 2094995 - RNA, 14 nt, Human
ucuuucagaaaaca

SEQ ID NO: 2094996 - RNA, 15 nt, Human
ucuuucagaaaacag

SEQ ID NO: 2094997 - RNA, 16 nt, Human
ucuuucagaaaacaga

SEQ ID NO: 2094998 - RNA, 20 nt, Human
ucuuucagaaaacagaaaaa

SEQ ID NO: 2094999 - RNA, 18 nt, Human
ugaacauugcaauagaaa

SEQ ID NO: 2095000 - RNA, 19 nt, Human
ugaacauuuggguaaauca

SEQ ID NO: 2095001 - RNA, 19 nt, Human
ugaaccacaucuugcucug

SEQ ID NO: 2095002 - RNA, 16 nt, Human
ugaacuccuggccuca

SEQ ID NO: 2095003 - RNA, 20 nt, Human
ugaaccaccacacccagccc

SEQ ID NO: 2095004 - RNA, 17 nt, Human
ugaaccaccacacccag

SEQ ID NO: 2095005 - RNA, 23 nt, Human
ugaaccacaucuugcucugcuga

SEQ ID NO: 2095006 - RNA, 19 nt, Human
ugaacaaguuguuucauug

SEQ ID NO: 2095007 - RNA, 20 nt, Human
ugaacaaguuguuucauuga

SEQ ID NO: 2095008 - RNA, 22 nt, Human
ugaacaaguuguuucauugacu

SEQ ID NO: 2095009 - RNA, 16 nt, Human
ugaacaagugaacaca

SEQ ID NO: 2095010 - RNA, 20 nt, Human
ugaaauuacuacaaaauuug

SEQ ID NO: 2095011 - RNA, 23 nt, Human
ugaaauuacuacaaaauuugaaa

SEQ ID NO: 2095012 - RNA, 23 nt, Human
ugaaauuagggcccaauuaauaa

SEQ ID NO: 2095013 - RNA, 22 nt, Human
ugaaauuaaccauagauguaga

SEQ ID NO: 2095014 - RNA, 18 nt, Human
ugaaauguuuuaaggcuu

SEQ ID NO: 2095015 - RNA, 18 nt, Human
ugaaauuaaccauagaug

SEQ ID NO: 2095016 - RNA, 16 nt, Human
ugaaauggagguccuu

SEQ ID NO: 2095017 - RNA, 19 nt, Human
ugaaacacaccaggcugug

SEQ ID NO: 2095018 - RNA, 22 nt, Human
ugaaacacaccaggcugugggc

SEQ ID NO: 2095019 - RNA, 14 nt, Human
ugaaacauuuuguc

SEQ ID NO: 2095020 - RNA, 19 nt, Human
ugaaacaacuuucucuugu

SEQ ID NO: 2095021 - RNA, 16 nt, Human
ugaaacacaccaggcu

SEQ ID NO: 2095022 - RNA, 17 nt, Human
ugaaacacaccaggcug

SEQ ID NO: 2095023 - RNA, 18 nt, Human
ugaaacacaccaggcugu

SEQ ID NO: 2095024 - RNA, 14 nt, Human
ugaaacaaagcugc

SEQ ID NO: 2095025 - RNA, 15 nt, Human
ugaaaagccauguuu

SEQ ID NO: 2095026 - RNA, 16 nt, Human
ugaaaagccauguuua

SEQ ID NO: 2095027 - RNA, 17 nt, Human
ugaaaagccauguuuaa

SEQ ID NO: 2095028 - RNA, 19 nt, Human
ugaaaagccauguuuaaga

SEQ ID NO: 2095029 - RNA, 20 nt, Human
ugaaaagccauguuuaagau

SEQ ID NO: 2095030 - RNA, 22 nt, Human
ugaaaagccauguuuaagauuu

SEQ ID NO: 2095031 - RNA, 23 nt, Human
ugaaaagccauguuuaagauuua

SEQ ID NO: 2095032 - RNA, 16 nt, Human
ugaaaagauguugugu

SEQ ID NO: 2095033 - RNA, 17 nt, Human
ugaaaggcauucucuga

SEQ ID NO: 2095034 - RNA, 19 nt, Human
ugaaaggcauucucugaag

SEQ ID NO: 2095035 - RNA, 13 nt, Human
ugaaagcuagaga

SEQ ID NO: 2095036 - RNA, 18 nt, Human
ugaaagcugauuacuguc

SEQ ID NO: 2095037 - RNA, 21 nt, Human
ugaaagcugauuacugucaau

SEQ ID NO: 2095038 - RNA, 22 nt, Human
ugaaagcugauuacugucaaua

SEQ ID NO: 2095039 - RNA, 13 nt, Human
ugaaagggcccag

SEQ ID NO: 2095040 - RNA, 19 nt, Human
ugaaagguuacccuguaac

SEQ ID NO: 2095041 - RNA, 20 nt, Human
ugaaagggagcuaucaggaa

SEQ ID NO: 2095042 - RNA, 22 nt, Human
ugaaagggagcuaucaggaaca

SEQ ID NO: 2095043 - RNA, 16 nt, Human
ugaaagaguuaagaau

SEQ ID NO: 2095044 - RNA, 19 nt, Human
ugaaagaguuaagaauguc

SEQ ID NO: 2095045 - RNA, 18 nt, Human
ugaaagauggcugugccu

SEQ ID NO: 2095046 - RNA, 23 nt, Human
ugaaagccagcugccgaccagag

SEQ ID NO: 2095047 - RNA, 15 nt, Human
ugaaagcauccaugu

SEQ ID NO: 2095048 - RNA, 17 nt, Human
ugaaagcauccaugugu

SEQ ID NO: 2095049 - RNA, 19 nt, Human
ugaaagauggcugugccuc

SEQ ID NO: 2095050 - RNA, 18 nt, Human
ugaaagcccugagcuuuc

SEQ ID NO: 2095051 - RNA, 14 nt, Human
ugaauccaugcuug

SEQ ID NO: 2095052 - RNA, 17 nt, Human
ugaauccaugcuugggu

SEQ ID NO: 2095053 - RNA, 11 nt, Human
ugaaugaaaaa

SEQ ID NO: 2095054 - RNA, 16 nt, Human
ugaaugaaaaauuuaa

SEQ ID NO: 2095055 - RNA, 17 nt, Human
ugaaugaaaaauuuaag

SEQ ID NO: 2095056 - RNA, 18 nt, Human
ugaaugaaaaauuuaagc

SEQ ID NO: 2095057 - RNA, 19 nt, Human
ugaaugaaaaauuuaagca

SEQ ID NO: 2095058 - RNA, 20 nt, Human
ugaaugaaaaauuuaagcau

SEQ ID NO: 2095059 - RNA, 21 nt, Human
ugaaugaaaaauuuaagcauu

SEQ ID NO: 2095060 - RNA, 22 nt, Human
ugaaugaaaaauuuaagcauug

SEQ ID NO: 2095061 - RNA, 15 nt, Human
ugaauaaagacaccu

SEQ ID NO: 2095062 - RNA, 14 nt, Human
ugaauaaagacacc

SEQ ID NO: 2095063 - RNA, 17 nt, Human
ugaaugaggucccaggc

SEQ ID NO: 2095064 - RNA, 18 nt, Human
ugaaugaggucccaggca

SEQ ID NO: 2095065 - RNA, 19 nt, Human
ugaaugaggucccaggcag

SEQ ID NO: 2095066 - RNA, 20 nt, Human
ugaaugaaagucuugugacu

SEQ ID NO: 2095067 - RNA, 23 nt, Human
ugaaugaaagucuugugacuagu

SEQ ID NO: 2095068 - RNA, 14 nt, Human
ugaaugaaauauca

SEQ ID NO: 2095069 - RNA, 21 nt, Human
ugaaugaaagucuugugacua

SEQ ID NO: 2095070 - RNA, 14 nt, Human
ugaaugaacaaccu

SEQ ID NO: 2095071 - RNA, 22 nt, Human
ugaaugaggucccaggcagaga

SEQ ID NO: 2095072 - RNA, 15 nt, Human
ugaaugaucucucug

SEQ ID NO: 2095073 - RNA, 18 nt, Human
ugaaugaucucucugaau

SEQ ID NO: 2095074 - RNA, 12 nt, Human
ugaauguucuga

SEQ ID NO: 2095075 - RNA, 21 nt, Human
ugaauguucugacauuaacag

SEQ ID NO: 2095076 - RNA, 14 nt, Human
ugaauguucugaca

SEQ ID NO: 2095077 - RNA, 15 nt, Human
ugaauguucugacau

SEQ ID NO: 2095078 - RNA, 16 nt, Human
ugaauguucugacauu

SEQ ID NO: 2095079 - RNA, 17 nt, Human
ugaauguucugacauua

SEQ ID NO: 2095080 - RNA, 18 nt, Human
ugaauguucugacauuaa

SEQ ID NO: 2095081 - RNA, 20 nt, Human
ugaauguucugacauuaaca

SEQ ID NO: 2095082 - RNA, 23 nt, Human
ugaauguucugacauuaacaguu

SEQ ID NO: 2095083 - RNA, 20 nt, Human
ugaauuaucccuuuucuuga

SEQ ID NO: 2095084 - RNA, 13 nt, Human
ugaauugauaaua

SEQ ID NO: 2095085 - RNA, 15 nt, Human
ugaauugauaauaaa

SEQ ID NO: 2095086 - RNA, 16 nt, Human
ugaauugauaauaaac

SEQ ID NO: 2095087 - RNA, 17 nt, Human
ugaauugauaauaaacu

SEQ ID NO: 2095088 - RNA, 13 nt, Human
ugaauucauagaa

SEQ ID NO: 2095089 - RNA, 14 nt, Human
ugaacuccugggcu

SEQ ID NO: 2095090 - RNA, 14 nt, Human
ugaaccaaaacauu

SEQ ID NO: 2095091 - RNA, 17 nt, Human
ugaaccaaaacauuccg

SEQ ID NO: 2095092 - RNA, 21 nt, Human
ugaaccaaaacauuccguuua

SEQ ID NO: 2095093 - RNA, 17 nt, Human
ugaacuccuggccucaa

SEQ ID NO: 2095094 - RNA, 20 nt, Human
ugaaggaauaaauugcuccu

SEQ ID NO: 2095095 - RNA, 15 nt, Human
ugaagauacaugucu

SEQ ID NO: 2095096 - RNA, 18 nt, Human
ugaagauaccaucagcaa

SEQ ID NO: 2095097 - RNA, 23 nt, Human
ugaagauaccaucagcaaagaau

SEQ ID NO: 2095098 - RNA, 20 nt, Human
ugaaggacauugcggacagc

SEQ ID NO: 2095099 - RNA, 19 nt, Human
ugaaggacauugcggacag

SEQ ID NO: 2095100 - RNA, 22 nt, Human
ugaaggacauugcggacagcca

SEQ ID NO: 2095101 - RNA, 16 nt, Human
ugaaggagagcccuuc

SEQ ID NO: 2095102 - RNA, 20 nt, Human
ugaagugauauggugagcag

SEQ ID NO: 2095103 - RNA, 18 nt, Human
ugaaguguguuuccuuca

SEQ ID NO: 2095104 - RNA, 22 nt, Human
ugaaguguguuuccuucagugc

SEQ ID NO: 2095105 - RNA, 16 nt, Human
ugaaguguguuuccuu

SEQ ID NO: 2095106 - RNA, 14 nt, Human
ugaaguuaacagag

SEQ ID NO: 2095107 - RNA, 14 nt, Human
ugaauaaaaauuaa

SEQ ID NO: 2095108 - RNA, 15 nt, Human
ugaauaaaaauuaag

SEQ ID NO: 2095109 - RNA, 17 nt, Human
ugaaguuaucuggcuuc

SEQ ID NO: 2095110 - RNA, 14 nt, Human
ugaaguucuccuga

SEQ ID NO: 2095111 - RNA, 14 nt, Human
ugaaguuggacagc

SEQ ID NO: 2095112 - RNA, 18 nt, Human
ugaaguuggacagcaaaa

SEQ ID NO: 2095113 - RNA, 15 nt, Human
ugaccagaagggaaa

SEQ ID NO: 2095114 - RNA, 19 nt, Human
ugaccagcaacuugucuuu

SEQ ID NO: 2095115 - RNA, 23 nt, Human
ugaccagccuccaugcugccucc

SEQ ID NO: 2095116 - RNA, 20 nt, Human
ugaccaguugcacuuggccu

SEQ ID NO: 2095117 - RNA, 16 nt, Human
ugaccauacugaggga

SEQ ID NO: 2095118 - RNA, 22 nt, Human
ugacccugcgaaggggcccugg

SEQ ID NO: 2095119 - RNA, 23 nt, Human
ugacccugcgaaggggcccuggu

SEQ ID NO: 2095120 - RNA, 19 nt, Human
ugaccgaaacagcgcuggg

SEQ ID NO: 2095121 - RNA, 16 nt, Human
ugacaugucccuacac

SEQ ID NO: 2095122 - RNA, 16 nt, Human
ugacauauuaugucuu

SEQ ID NO: 2095123 - RNA, 21 nt, Human
ugaccacgcuuucuagcuguu

SEQ ID NO: 2095124 - RNA, 22 nt, Human
ugaccacgcuuucuagcuguug

SEQ ID NO: 2095125 - RNA, 21 nt, Human
ugaauugcauuuuuuaaaaca

SEQ ID NO: 2095126 - RNA, 22 nt, Human
ugaauugcauuuuuuaaaacaa

SEQ ID NO: 2095127 - RNA, 14 nt, Human
ugacaacuucuaau

SEQ ID NO: 2095128 - RNA, 15 nt, Human
ugacaacuucuaauu

SEQ ID NO: 2095129 - RNA, 19 nt, Human
ugacaacuucuaauugcca

SEQ ID NO: 2095130 - RNA, 22 nt, Human
ugacaacuucuaauugccaugu

SEQ ID NO: 2095131 - RNA, 13 nt, Human
ugacaagccccag

SEQ ID NO: 2095132 - RNA, 15 nt, Human
ugacaagccccaggc

SEQ ID NO: 2095133 - RNA, 22 nt, Human
ugacaagcuccuggucuugaga

SEQ ID NO: 2095134 - RNA, 17 nt, Human
ugacaagccccaggcag

SEQ ID NO: 2095135 - RNA, 21 nt, Human
ugacaagccccaggcaggcug

SEQ ID NO: 2095136 - RNA, 18 nt, Human
ugacaaggauugcuacug

SEQ ID NO: 2095137 - RNA, 23 nt, Human
ugacaauuccuagauaaaaagau

SEQ ID NO: 2095138 - RNA, 16 nt, Human
ugacaauuuuguacaa

SEQ ID NO: 2095139 - RNA, 13 nt, Human
ugacaaugaugau

SEQ ID NO: 2095140 - RNA, 18 nt, Human
ugacaauuuuguacaaau

SEQ ID NO: 2095141 - RNA, 22 nt, Human
ugacaauuuuguacaaauuugu

SEQ ID NO: 2095142 - RNA, 14 nt, Human
ugacaauaaaugug

SEQ ID NO: 2095143 - RNA, 14 nt, Human
ugacaauaauuuca

SEQ ID NO: 2095144 - RNA, 18 nt, Human
ugacaaucaacucuaaua

SEQ ID NO: 2095145 - RNA, 17 nt, Human
ugacaauaauuucaggu

SEQ ID NO: 2095146 - RNA, 15 nt, Human
ugacaaucaacucua

SEQ ID NO: 2095147 - RNA, 20 nt, Human
ugacacuuugccagaaagca

SEQ ID NO: 2095148 - RNA, 17 nt, Human
ugacacaaaaaaaguug

SEQ ID NO: 2095149 - RNA, 13 nt, Human
ugacagaacacug

SEQ ID NO: 2095150 - RNA, 14 nt, Human
ugacagaacacugu

SEQ ID NO: 2095151 - RNA, 15 nt, Human
ugacagaacacuguc

SEQ ID NO: 2095152 - RNA, 16 nt, Human
ugacagaacacugucu

SEQ ID NO: 2095153 - RNA, 17 nt, Human
ugacagaacacugucuu

SEQ ID NO: 2095154 - RNA, 21 nt, Human
ugacagaacacugucuugaag

SEQ ID NO: 2095155 - RNA, 19 nt, Human
ugacagagugagacucugu

SEQ ID NO: 2095156 - RNA, 17 nt, Human
ugacauaacacuauaaa

SEQ ID NO: 2095157 - RNA, 21 nt, Human
ugacauaacacuauaaagguu

SEQ ID NO: 2095158 - RNA, 17 nt, Human
ugacagagugagacucu

SEQ ID NO: 2095159 - RNA, 14 nt, Human
ugacagagugagac

SEQ ID NO: 2095160 - RNA, 23 nt, Human
ugacagaggcagccccauucugc

SEQ ID NO: 2095161 - RNA, 18 nt, Human
ugacagaggcagccccau

SEQ ID NO: 2095162 - RNA, 17 nt, Human
ugacagaggcagcccca

SEQ ID NO: 2095163 - RNA, 16 nt, Human
ugacagaggcagcccc

SEQ ID NO: 2095164 - RNA, 15 nt, Human
ugacagaggcagccc

SEQ ID NO: 2095165 - RNA, 14 nt, Human
ugacagaggcagcc

SEQ ID NO: 2095166 - RNA, 23 nt, Human
ugacagacacaggcccggcucca

SEQ ID NO: 2095167 - RNA, 20 nt, Human
ugacagacacaggcccggcu

SEQ ID NO: 2095168 - RNA, 13 nt, Human
ugacagaggcagc

SEQ ID NO: 2095169 - RNA, 20 nt, Human
ugagacucagacaggaaagg

SEQ ID NO: 2095170 - RNA, 14 nt, Human
ugagacccccacac

SEQ ID NO: 2095171 - RNA, 15 nt, Human
ugagacccccacacc

SEQ ID NO: 2095172 - RNA, 16 nt, Human
ugagacccccacaccu

SEQ ID NO: 2095173 - RNA, 17 nt, Human
ugagacccccacaccuc

SEQ ID NO: 2095174 - RNA, 21 nt, Human
ugagacccauuccuauuucuu

SEQ ID NO: 2095175 - RNA, 13 nt, Human
ugagacccccaca

SEQ ID NO: 2095176 - RNA, 17 nt, Human
ugagaccagccugggca

SEQ ID NO: 2095177 - RNA, 21 nt, Human
ugaccucaggugauccaccca

SEQ ID NO: 2095178 - RNA, 20 nt, Human
ugaccucaggugauccaccc

SEQ ID NO: 2095179 - RNA, 21 nt, Human
ugagaacagaucuccaaagcu

SEQ ID NO: 2095180 - RNA, 22 nt, Human
ugagaacagaucuccaaagcuu

SEQ ID NO: 2095181 - RNA, 16 nt, Human
ugagaacauguuggua

SEQ ID NO: 2095182 - RNA, 24 nt, Human
ugagagugucuucacggcaggaca

SEQ ID NO: 2095183 - RNA, 22 nt, Human
ugagagugucuucacggcagga

SEQ ID NO: 2095184 - RNA, 15 nt, Human
ugagcagggcucagc

SEQ ID NO: 2095185 - RNA, 14 nt, Human
ugagcagggcucag

SEQ ID NO: 2095186 - RNA, 13 nt, Human
ugagcagggcuca

SEQ ID NO: 2095187 - RNA, 12 nt, Human
ugagcagggcuc

SEQ ID NO: 2095188 - RNA, 15 nt, Human
ugagaucaaaacggu

SEQ ID NO: 2095189 - RNA, 14 nt, Human
ugaccggaggcaaa

SEQ ID NO: 2095190 - RNA, 15 nt, Human
ugagauauuuauugu

SEQ ID NO: 2095191 - RNA, 14 nt, Human
ugagaucagccugg

SEQ ID NO: 2095192 - RNA, 15 nt, Human
ugagaucagccuggg

SEQ ID NO: 2095193 - RNA, 15 nt, Human
ugagcagugugucuc

SEQ ID NO: 2095194 - RNA, 17 nt, Human
ugagcagugugucuccu

SEQ ID NO: 2095195 - RNA, 18 nt, Human
ugagcagugugucuccug

SEQ ID NO: 2095196 - RNA, 17 nt, Human
ugagcagggcucagcgg

SEQ ID NO: 2095197 - RNA, 16 nt, Human
ugagcagggcucagcg

SEQ ID NO: 2095198 - RNA, 20 nt, Human
ugagauauuuauuguuuauu

SEQ ID NO: 2095199 - RNA, 19 nt, Human
ugagcagggcucagcgggg

SEQ ID NO: 2095200 - RNA, 21 nt, Human
ugagccucagcauccuggcac

SEQ ID NO: 2095201 - RNA, 18 nt, Human
ugagccucagcauccugg

SEQ ID NO: 2095202 - RNA, 22 nt, Human
ugagccucagcauccuggcacc

SEQ ID NO: 2095203 - RNA, 17 nt, Human
ugagccucagcauccug

SEQ ID NO: 2095204 - RNA, 21 nt, Human
ugagccgagaucacgccacug

SEQ ID NO: 2095205 - RNA, 19 nt, Human
ugagccgagaucacgccac

SEQ ID NO: 2095206 - RNA, 19 nt, Human
ugagcuccucugggcagga

SEQ ID NO: 2095207 - RNA, 14 nt, Human
ugagccugagcaga

SEQ ID NO: 2095208 - RNA, 18 nt, Human
ugagcuggaccucaccaa

SEQ ID NO: 2095209 - RNA, 14 nt, Human
ugagcucgguggac

SEQ ID NO: 2095210 - RNA, 20 nt, Human
ugagcucgguggacccaggg

SEQ ID NO: 2095211 - RNA, 21 nt, Human
ugagcucgguggacccaggga

SEQ ID NO: 2095212 - RNA, 20 nt, Human
ugagggaacagacaggagaa

SEQ ID NO: 2095213 - RNA, 22 nt, Human
ugagggaacagacaggagaaau

SEQ ID NO: 2095214 - RNA, 21 nt, Human
ugagggacaaauuuaaaacaa

SEQ ID NO: 2095215 - RNA, 22 nt, Human
ugagggacaaauuuaaaacaaa

SEQ ID NO: 2095216 - RNA, 23 nt, Human
ugagggacaaauuuaaaacaaac

SEQ ID NO: 2095217 - RNA, 13 nt, Human
ugagggaccagcc

SEQ ID NO: 2095218 - RNA, 18 nt, Human
ugagggaccagccaagag

SEQ ID NO: 2095219 - RNA, 12 nt, Human
ugaggugggagg

SEQ ID NO: 2095220 - RNA, 13 nt, Human
ugaggugggagga

SEQ ID NO: 2095221 - RNA, 23 nt, Human
ugaggucugcucggccgucuuca

SEQ ID NO: 2095222 - RNA, 17 nt, Human
ugaggucucuugaggga

SEQ ID NO: 2095223 - RNA, 18 nt, Human
ugaggucucuugagggag

SEQ ID NO: 2095224 - RNA, 15 nt, Human
ugaggucugaaaugg

SEQ ID NO: 2095225 - RNA, 15 nt, Human
ugaggucugcucggc

SEQ ID NO: 2095226 - RNA, 16 nt, Human
ugaggucugcucggcc

SEQ ID NO: 2095227 - RNA, 14 nt, Human
ugagggagcuuagc

SEQ ID NO: 2095228 - RNA, 17 nt, Human
ugaggucccaggcagag

SEQ ID NO: 2095229 - RNA, 19 nt, Human
ugaggucccaggcagagaa

SEQ ID NO: 2095230 - RNA, 16 nt, Human
ugagggagcuuagcca

SEQ ID NO: 2095231 - RNA, 15 nt, Human
ugaggucccaggcag

SEQ ID NO: 2095232 - RNA, 13 nt, Human
ugagguccugggg

SEQ ID NO: 2095233 - RNA, 15 nt, Human
ugagguccugggggc

SEQ ID NO: 2095234 - RNA, 16 nt, Human
ugagguccugggggcc

SEQ ID NO: 2095235 - RNA, 18 nt, Human
ugagguccugggggccug

SEQ ID NO: 2095236 - RNA, 21 nt, Human
ugagguccugggggccugacc

SEQ ID NO: 2095237 - RNA, 23 nt, Human
ugaggucuaggaacauacuucag

SEQ ID NO: 2095238 - RNA, 12 nt, Human
ugaggaggaagg

SEQ ID NO: 2095239 - RNA, 13 nt, Human
ugaggaggaagga

SEQ ID NO: 2095240 - RNA, 21 nt, Human
ugaggaggaaggagagaaggg

SEQ ID NO: 2095241 - RNA, 17 nt, Human
ugaggaggcagaaagca

SEQ ID NO: 2095242 - RNA, 23 nt, Human
ugaggaggcagaaagcagaggcu

SEQ ID NO: 2095243 - RNA, 24 nt, Human
ugaggaggcagaaagcagaggcug

SEQ ID NO: 2095244 - RNA, 18 nt, Human
ugaggaggaaggagagaa

SEQ ID NO: 2095245 - RNA, 18 nt, Human
ugaggcaggugacaguga

SEQ ID NO: 2095246 - RNA, 20 nt, Human
ugaggcaggugacagugagg

SEQ ID NO: 2095247 - RNA, 17 nt, Human
ugaggagcugcuggcuu

SEQ ID NO: 2095248 - RNA, 13 nt, Human
ugaggagcugcug

SEQ ID NO: 2095249 - RNA, 14 nt, Human
ugaggagcugcugg

SEQ ID NO: 2095250 - RNA, 15 nt, Human
ugaggagcugcuggc

SEQ ID NO: 2095251 - RNA, 16 nt, Human
ugaggagcugcuggcu

SEQ ID NO: 2095252 - RNA, 22 nt, Human
ugaggcauuugggugguaagag

SEQ ID NO: 2095253 - RNA, 14 nt, Human
ugaguuugcccugg

SEQ ID NO: 2095254 - RNA, 22 nt, Human
ugaguuugcccugguuucacug

SEQ ID NO: 2095255 - RNA, 14 nt, Human
ugaguuucuuuuau

SEQ ID NO: 2095256 - RNA, 23 nt, Human
ugaguugacuugacagaacacug

SEQ ID NO: 2095257 - RNA, 12 nt, Human
ugauaacagcua

SEQ ID NO: 2095258 - RNA, 15 nt, Human
ugauaacagcuacca

SEQ ID NO: 2095259 - RNA, 23 nt, Human
ugauaacagcuaccaugacaacc

SEQ ID NO: 2095260 - RNA, 18 nt, Human
ugaguuuuuucucuuggg

SEQ ID NO: 2095261 - RNA, 19 nt, Human
ugaguuuuuucucuugggc

SEQ ID NO: 2095262 - RNA, 14 nt, Human
ugauaaaaaauuuu

SEQ ID NO: 2095263 - RNA, 16 nt, Human
ugauaaaaaauuuugu

SEQ ID NO: 2095264 - RNA, 19 nt, Human
ugauaaaaaauuuuguaau

SEQ ID NO: 2095265 - RNA, 20 nt, Human
ugauaaaaaauuuuguaauu

SEQ ID NO: 2095266 - RNA, 22 nt, Human
ugauaaaaaauuuuguaauuuu

SEQ ID NO: 2095267 - RNA, 20 nt, Human
ugaguuuuguuuuaaaauua

SEQ ID NO: 2095268 - RNA, 18 nt, Human
ugaguuuuuauggggcug

SEQ ID NO: 2095269 - RNA, 13 nt, Human
ugaguuuuugaua

SEQ ID NO: 2095270 - RNA, 18 nt, Human
ugaguuuuugauagcuuu

SEQ ID NO: 2095271 - RNA, 19 nt, Human
ugaguuuuugauagcuuua

SEQ ID NO: 2095272 - RNA, 19 nt, Human
ugaguuuuuauggggcuga

SEQ ID NO: 2095273 - RNA, 17 nt, Human
ugaguuuuuucucuugg

SEQ ID NO: 2095274 - RNA, 18 nt, Human
ugaguuuuauugagaauu

SEQ ID NO: 2095275 - RNA, 15 nt, Human
ugagucucuucagaa

SEQ ID NO: 2095276 - RNA, 19 nt, Human
ugagucgaggacagggagg

SEQ ID NO: 2095277 - RNA, 14 nt, Human
ugagucucuucaga

SEQ ID NO: 2095278 - RNA, 21 nt, Human
ugaggugggaggaucucuuga

SEQ ID NO: 2095279 - RNA, 13 nt, Human
ugaguccagaagu

SEQ ID NO: 2095280 - RNA, 19 nt, Human
ugaguccagaaguuugaga

SEQ ID NO: 2095281 - RNA, 15 nt, Human
ugauccaagcugguc

SEQ ID NO: 2095282 - RNA, 14 nt, Human
ugauccaagcuggu

SEQ ID NO: 2095283 - RNA, 13 nt, Human
ugauccaagcugg

SEQ ID NO: 2095284 - RNA, 22 nt, Human
ugaucauuuuccccccacucuc

SEQ ID NO: 2095285 - RNA, 18 nt, Human
ugaucauuuuccccccac

SEQ ID NO: 2095286 - RNA, 19 nt, Human
ugaucauuuuccccccacu

SEQ ID NO: 2095287 - RNA, 20 nt, Human
ugaucauuuuccccccacuc

SEQ ID NO: 2095288 - RNA, 21 nt, Human
ugaucauuuuccccccacucu

SEQ ID NO: 2095289 - RNA, 16 nt, Human
ugaucauuuucccccc

SEQ ID NO: 2095290 - RNA, 17 nt, Human
ugaucauuuucccccca

SEQ ID NO: 2095291 - RNA, 13 nt, Human
ugaucaugcauug

SEQ ID NO: 2095292 - RNA, 14 nt, Human
ugaucaugcauugu

SEQ ID NO: 2095293 - RNA, 15 nt, Human
ugaucaugcauuguu

SEQ ID NO: 2095294 - RNA, 16 nt, Human
ugaucaugcauuguug

SEQ ID NO: 2095295 - RNA, 17 nt, Human
ugaucaugcauuguuga

SEQ ID NO: 2095296 - RNA, 23 nt, Human
ugaucaugcauuguugagguggu

SEQ ID NO: 2095297 - RNA, 17 nt, Human
ugaucagcuguuuguca

SEQ ID NO: 2095298 - RNA, 16 nt, Human
ugaucagcuguuuguc

SEQ ID NO: 2095299 - RNA, 23 nt, Human
ugauagcaagugaauuuuucucu

SEQ ID NO: 2095300 - RNA, 18 nt, Human
ugaucagcuguuugucau

SEQ ID NO: 2095301 - RNA, 12 nt, Human
ugaucucaggga

SEQ ID NO: 2095302 - RNA, 14 nt, Human
ugaucucagggaag

SEQ ID NO: 2095303 - RNA, 16 nt, Human
ugaucucagggaagcc

SEQ ID NO: 2095304 - RNA, 19 nt, Human
ugaucucagggaagcccag

SEQ ID NO: 2095305 - RNA, 21 nt, Human
ugaucucagggaagcccagcu

SEQ ID NO: 2095306 - RNA, 22 nt, Human
ugaucucagggaagcccagcuc

SEQ ID NO: 2095307 - RNA, 19 nt, Human
ugauccacccaccucagcc

SEQ ID NO: 2095308 - RNA, 18 nt, Human
ugauccacccaccucagc

SEQ ID NO: 2095309 - RNA, 17 nt, Human
ugauccacccaccucag

SEQ ID NO: 2095310 - RNA, 11 nt, Human
ugaucugggaa

SEQ ID NO: 2095311 - RNA, 16 nt, Human
ugaucugggaacuccc

SEQ ID NO: 2095312 - RNA, 18 nt, Human
ugaucugggaacucccaa

SEQ ID NO: 2095313 - RNA, 22 nt, Human
ugaucugggaacucccaagaac

SEQ ID NO: 2095314 - RNA, 16 nt, Human
ugaucuccauauguua

SEQ ID NO: 2095315 - RNA, 19 nt, Human
ugaucuccauauguuacac

SEQ ID NO: 2095316 - RNA, 21 nt, Human
ugaucuccauauguuacacua

SEQ ID NO: 2095317 - RNA, 13 nt, Human
ugaucucccugcc

SEQ ID NO: 2095318 - RNA, 18 nt, Human
ugaucuccguggcuuugg

SEQ ID NO: 2095319 - RNA, 15 nt, Human
ugaucuccguggcuu

SEQ ID NO: 2095320 - RNA, 14 nt, Human
ugaucucccugccg

SEQ ID NO: 2095321 - RNA, 15 nt, Human
ugaucucccugccgc

SEQ ID NO: 2095322 - RNA, 16 nt, Human
ugaucucccugccgcc

SEQ ID NO: 2095323 - RNA, 17 nt, Human
ugaucucccugccgccu

SEQ ID NO: 2095324 - RNA, 15 nt, Human
ugaucugugggcaca

SEQ ID NO: 2095325 - RNA, 13 nt, Human
ugaucuguauaua

SEQ ID NO: 2095326 - RNA, 15 nt, Human
ugaucuguauauaca

SEQ ID NO: 2095327 - RNA, 19 nt, Human
ugaucuguauauacaauaa

SEQ ID NO: 2095328 - RNA, 22 nt, Human
ugaucuguauauacaauaacau

SEQ ID NO: 2095329 - RNA, 18 nt, Human
ugaucuugcucuaucuca

SEQ ID NO: 2095330 - RNA, 20 nt, Human
ugaucuugcucuaucucaca

SEQ ID NO: 2095331 - RNA, 21 nt, Human
ugaucuuggcuuacugcagcc

SEQ ID NO: 2095332 - RNA, 14 nt, Human
ugaucuugugacau

SEQ ID NO: 2095333 - RNA, 15 nt, Human
ugaucuugugacaua

SEQ ID NO: 2095334 - RNA, 20 nt, Human
ugaucuucuuuauaauucua

SEQ ID NO: 2095335 - RNA, 11 nt, Human
ugaugcuaaau

SEQ ID NO: 2095336 - RNA, 16 nt, Human
ugaugcuaaauaggag

SEQ ID NO: 2095337 - RNA, 14 nt, Human
ugaugccucccugu

SEQ ID NO: 2095338 - RNA, 14 nt, Human
ugaugcacauuuca

SEQ ID NO: 2095339 - RNA, 17 nt, Human
ugaugcacauuucaugu

SEQ ID NO: 2095340 - RNA, 16 nt, Human
ugaucuuugcagacag

SEQ ID NO: 2095341 - RNA, 20 nt, Human
ugaugauuuagagugcuguc

SEQ ID NO: 2095342 - RNA, 18 nt, Human
ugaucuuugcagacaggc

SEQ ID NO: 2095343 - RNA, 14 nt, Human
ugaugguuccccug

SEQ ID NO: 2095344 - RNA, 20 nt, Human
ugaugcugugcuaugaauuu

SEQ ID NO: 2095345 - RNA, 18 nt, Human
ugaugucacaucuuggca

SEQ ID NO: 2095346 - RNA, 19 nt, Human
ugaugucccaacuuguaaa

SEQ ID NO: 2095347 - RNA, 18 nt, Human
ugaugugggucaaggaau

SEQ ID NO: 2095348 - RNA, 14 nt, Human
ugauguuaaaauuc

SEQ ID NO: 2095349 - RNA, 18 nt, Human
ugauguggcaacugcuga

SEQ ID NO: 2095350 - RNA, 16 nt, Human
ugauguguuaucucuu

SEQ ID NO: 2095351 - RNA, 18 nt, Human
ugauuagcaaguuacagu

SEQ ID NO: 2095352 - RNA, 16 nt, Human
ugauuaguaaagaaau

SEQ ID NO: 2095353 - RNA, 17 nt, Human
ugauuaguaaagaaaug

SEQ ID NO: 2095354 - RNA, 13 nt, Human
ugauuagcaaguu

SEQ ID NO: 2095355 - RNA, 14 nt, Human
ugauuacugucaau

SEQ ID NO: 2095356 - RNA, 15 nt, Human
ugauuacugucaaua

SEQ ID NO: 2095357 - RNA, 16 nt, Human
ugauuacugucaauaa

SEQ ID NO: 2095358 - RNA, 17 nt, Human
ugauuacugucaauaaa

SEQ ID NO: 2095359 - RNA, 18 nt, Human
ugauuacugucaauaaac

SEQ ID NO: 2095360 - RNA, 19 nt, Human
ugauuacugucaauaaaca

SEQ ID NO: 2095361 - RNA, 23 nt, Human
ugauuacugucaauaaacagcuu

SEQ ID NO: 2095362 - RNA, 13 nt, Human
ugauuacugucaa

SEQ ID NO: 2095363 - RNA, 16 nt, Human
ugauguuaaaauucca

SEQ ID NO: 2095364 - RNA, 17 nt, Human
ugauguuaaaauuccau

SEQ ID NO: 2095365 - RNA, 10 nt, Human
ugauguuaac

SEQ ID NO: 2095366 - RNA, 22 nt, Human
ugauguuaaccagaauaaaguu

SEQ ID NO: 2095367 - RNA, 17 nt, Human
ugauguuaggcugggcc

SEQ ID NO: 2095368 - RNA, 17 nt, Human
ugauguugagggaacag

SEQ ID NO: 2095369 - RNA, 14 nt, Human
ugauuacucuuuga

SEQ ID NO: 2095370 - RNA, 16 nt, Human
ugauuacucuuugaga

SEQ ID NO: 2095371 - RNA, 16 nt, Human
ugauuauuuaucacau

SEQ ID NO: 2095372 - RNA, 17 nt, Human
ugauuauuuaucacaua

SEQ ID NO: 2095373 - RNA, 15 nt, Human
ugauuaugacuguuu

SEQ ID NO: 2095374 - RNA, 12 nt, Human
ugauucacagug

SEQ ID NO: 2095375 - RNA, 21 nt, Human
ugauucuccugccucagccuc

SEQ ID NO: 2095376 - RNA, 19 nt, Human
ugauugcuguguccaacuc

SEQ ID NO: 2095377 - RNA, 22 nt, Human
ugauugcuguguccaacuccag

SEQ ID NO: 2095378 - RNA, 20 nt, Human
ugauucuugaguuuagugau

SEQ ID NO: 2095379 - RNA, 14 nt, Human
ugauucuuuguuac

SEQ ID NO: 2095380 - RNA, 19 nt, Human
ugauucuuuguuacaggca

SEQ ID NO: 2095381 - RNA, 15 nt, Human
ugauucuguguguuu

SEQ ID NO: 2095382 - RNA, 15 nt, Human
ugauucuugaguuua

SEQ ID NO: 2095383 - RNA, 13 nt, Human
ugauucugugugu

SEQ ID NO: 2095384 - RNA, 16 nt, Human
ugauuguuugcucuga

SEQ ID NO: 2095385 - RNA, 19 nt, Human
ugauuguuaauuuacagcu

SEQ ID NO: 2095386 - RNA, 16 nt, Human
ugauugguuuuaauug

SEQ ID NO: 2095387 - RNA, 17 nt, Human
ugauuggugcaacccuu

SEQ ID NO: 2095388 - RNA, 19 nt, Human
ugauuggugcaacccuuac

SEQ ID NO: 2095389 - RNA, 21 nt, Human
ugauuggugcaacccuuaccc

SEQ ID NO: 2095390 - RNA, 14 nt, Human
ugauugucagcuac

SEQ ID NO: 2095391 - RNA, 19 nt, Human
ugauuguacagaaucauug

SEQ ID NO: 2095392 - RNA, 23 nt, Human
ugauuguacagaaucauugcuua

SEQ ID NO: 2095393 - RNA, 20 nt, Human
ugauuggcaggaguuggaag

SEQ ID NO: 2095394 - RNA, 16 nt, Human
ugcugguuuuucaguu

SEQ ID NO: 2095395 - RNA, 18 nt, Human
ugcugguuuuucaguuuu

SEQ ID NO: 2095396 - RNA, 20 nt, Human
ugcuguaaauaaaugcuuua

SEQ ID NO: 2095397 - RNA, 20 nt, Human
ugcugguuuuccuaaaugca

SEQ ID NO: 2095398 - RNA, 17 nt, Human
ugcuguaaaaacugugg

SEQ ID NO: 2095399 - RNA, 12 nt, Human
ugcugguuuuuc

SEQ ID NO: 2095400 - RNA, 15 nt, Human
ugcugguuuuucagu

SEQ ID NO: 2095401 - RNA, 15 nt, Human
ugcugguuuuccuaa

SEQ ID NO: 2095402 - RNA, 22 nt, Human
ugcugguuuuccuaaaugcagu

SEQ ID NO: 2095403 - RNA, 14 nt, Human
ugcugguuuuccua

SEQ ID NO: 2095404 - RNA, 23 nt, Human
ugcugguugucauuuuugcagua

SEQ ID NO: 2095405 - RNA, 14 nt, Human
ugcuguggucucuu

SEQ ID NO: 2095406 - RNA, 17 nt, Human
ugcuguggucucuuugu

SEQ ID NO: 2095407 - RNA, 16 nt, Human
ugcugugguuccuggg

SEQ ID NO: 2095408 - RNA, 17 nt, Human
ugcugugguuccugggg

SEQ ID NO: 2095409 - RNA, 16 nt, Human
ugcuguguaacacugu

SEQ ID NO: 2095410 - RNA, 15 nt, Human
ugcuguguccaacuc

SEQ ID NO: 2095411 - RNA, 18 nt, Human
ugcuguguccaacuccag

SEQ ID NO: 2095412 - RNA, 19 nt, Human
ugcuguguccaacuccagu

SEQ ID NO: 2095413 - RNA, 20 nt, Human
ugcuguguccaacuccagua

SEQ ID NO: 2095414 - RNA, 17 nt, Human
ugcugggcuugucugua

SEQ ID NO: 2095415 - RNA, 23 nt, Human
ugcugggcucuccaccucagccu

SEQ ID NO: 2095416 - RNA, 14 nt, Human
ugcugggcucucca

SEQ ID NO: 2095417 - RNA, 15 nt, Human
ugcugggcucuccac

SEQ ID NO: 2095418 - RNA, 16 nt, Human
ugcugggcucuccacc

SEQ ID NO: 2095419 - RNA, 17 nt, Human
ugcugggcucuccaccu

SEQ ID NO: 2095420 - RNA, 18 nt, Human
ugcugggcucuccaccuc

SEQ ID NO: 2095421 - RNA, 20 nt, Human
ugcugggcucuccaccucag

SEQ ID NO: 2095422 - RNA, 22 nt, Human
ugcugggcucuccaccucagcc

SEQ ID NO: 2095423 - RNA, 23 nt, Human
ugcuggggcaagucccugacucu

SEQ ID NO: 2095424 - RNA, 18 nt, Human
ugcuggggcaagucccug

SEQ ID NO: 2095425 - RNA, 16 nt, Human
ugcuggucacugccau

SEQ ID NO: 2095426 - RNA, 18 nt, Human
ugcuggugagccaagcag

SEQ ID NO: 2095427 - RNA, 19 nt, Human
ugcugcuuuaauugugaau

SEQ ID NO: 2095428 - RNA, 16 nt, Human
ugcugggggccgcccu

SEQ ID NO: 2095429 - RNA, 15 nt, Human
ugcugcuucccucug

SEQ ID NO: 2095430 - RNA, 16 nt, Human
ugcugcuucccucugc

SEQ ID NO: 2095431 - RNA, 17 nt, Human
ugcugcuucccucugcc

SEQ ID NO: 2095432 - RNA, 20 nt, Human
ugcugcuucccucugccugu

SEQ ID NO: 2095433 - RNA, 12 nt, Human
ugcugcuugagg

SEQ ID NO: 2095434 - RNA, 12 nt, Human
ugcugcugcugc

SEQ ID NO: 2095435 - RNA, 20 nt, Human
ugcugggauuacagguguga

SEQ ID NO: 2095436 - RNA, 19 nt, Human
ugcugcuugaggcaacuca

SEQ ID NO: 2095437 - RNA, 21 nt, Human
ugcugcuucccucugccuguc

SEQ ID NO: 2095438 - RNA, 14 nt, Human
ugcugccugaguca

SEQ ID NO: 2095439 - RNA, 16 nt, Human
ugcugcuauuuuacug

SEQ ID NO: 2095440 - RNA, 18 nt, Human
ugcugcuauuuuacuguc

SEQ ID NO: 2095441 - RNA, 19 nt, Human
ugcugcuauuuuacugucu

SEQ ID NO: 2095442 - RNA, 21 nt, Human
ugcugcuauuuuacugucuua

SEQ ID NO: 2095443 - RNA, 22 nt, Human
ugcugcuauuuuacugucuuaa

SEQ ID NO: 2095444 - RNA, 17 nt, Human
ugcugcuccuuagcugc

SEQ ID NO: 2095445 - RNA, 18 nt, Human
ugcugcuccuuagcugcc

SEQ ID NO: 2095446 - RNA, 20 nt, Human
ugcugcuccuuagcugccaa

SEQ ID NO: 2095447 - RNA, 12 nt, Human
ugcucuccucuu

SEQ ID NO: 2095448 - RNA, 20 nt, Human
ugcucuccccugcccugcug

SEQ ID NO: 2095449 - RNA, 23 nt, Human
ugcucuccgaccagacaccuuga

SEQ ID NO: 2095450 - RNA, 17 nt, Human
ugcucuaucucacagca

SEQ ID NO: 2095451 - RNA, 20 nt, Human
ugcucuaucucacagcacac

SEQ ID NO: 2095452 - RNA, 16 nt, Human
ugcucuccccugcccu

SEQ ID NO: 2095453 - RNA, 17 nt, Human
ugcucuccccugcccug

SEQ ID NO: 2095454 - RNA, 18 nt, Human
ugcucuuguccuagcuug

SEQ ID NO: 2095455 - RNA, 19 nt, Human
ugcucuuguccuagcuugg

SEQ ID NO: 2095456 - RNA, 13 nt, Human
ugcucagaacaca

SEQ ID NO: 2095457 - RNA, 15 nt, Human
ugcucggccgucuuc

SEQ ID NO: 2095458 - RNA, 15 nt, Human
ugcucuaagcacacg

SEQ ID NO: 2095459 - RNA, 17 nt, Human
ugcucuaagcacacgga

SEQ ID NO: 2095460 - RNA, 18 nt, Human
ugcucuaagcacacggag

SEQ ID NO: 2095461 - RNA, 23 nt, Human
ugcucaccuggggugugggaggc

SEQ ID NO: 2095462 - RNA, 17 nt, Human
ugcucacauaucuguca

SEQ ID NO: 2095463 - RNA, 12 nt, Human
ugcucaccuggg

SEQ ID NO: 2095464 - RNA, 13 nt, Human
ugcucaccugggg

SEQ ID NO: 2095465 - RNA, 14 nt, Human
ugcucaccuggggu

SEQ ID NO: 2095466 - RNA, 22 nt, Human
ugcucaccuggggugugggagg

SEQ ID NO: 2095467 - RNA, 19 nt, Human
ugcguguguccaugugugu

SEQ ID NO: 2095468 - RNA, 17 nt, Human
ugcguguguccaugugu

SEQ ID NO: 2095469 - RNA, 13 nt, Human
ugcguuacuaauu

SEQ ID NO: 2095470 - RNA, 15 nt, Human
ugcggacaaguuuua

SEQ ID NO: 2095471 - RNA, 18 nt, Human
ugcgcguucugaaauauu

SEQ ID NO: 2095472 - RNA, 17 nt, Human
ugcgcuuuugcugguca

SEQ ID NO: 2095473 - RNA, 18 nt, Human
ugcgcuuuugcuggucac

SEQ ID NO: 2095474 - RNA, 17 nt, Human
ugcggacagccacggcc

SEQ ID NO: 2095475 - RNA, 13 nt, Human
ugcguuuuggaag

SEQ ID NO: 2095476 - RNA, 19 nt, Human
ugcguuagaaugaggagga

SEQ ID NO: 2095477 - RNA, 22 nt, Human
ugcuaagaagcgagcacugacc

SEQ ID NO: 2095478 - RNA, 17 nt, Human
ugcuaacuuggagcccc

SEQ ID NO: 2095479 - RNA, 19 nt, Human
ugcuaacuuggagccccag

SEQ ID NO: 2095480 - RNA, 22 nt, Human
ugcuaacuagcuuggaaacugg

SEQ ID NO: 2095481 - RNA, 20 nt, Human
ugcuaacuagcuuggaaacu

SEQ ID NO: 2095482 - RNA, 23 nt, Human
ugcuaaccacgucugucuucaca

SEQ ID NO: 2095483 - RNA, 15 nt, Human
ugcuacuuccugccu

SEQ ID NO: 2095484 - RNA, 22 nt, Human
ugcuacuuccugccuggucucc

SEQ ID NO: 2095485 - RNA, 22 nt, Human
ugcuacuguccuacccacccuc

SEQ ID NO: 2095486 - RNA, 21 nt, Human
ugcuacuguccuacccacccu

SEQ ID NO: 2095487 - RNA, 14 nt, Human
ugcuacuacaaaaa

SEQ ID NO: 2095488 - RNA, 15 nt, Human
ugcuacucuguuccu

SEQ ID NO: 2095489 - RNA, 16 nt, Human
ugcuacucuguuccuu

SEQ ID NO: 2095490 - RNA, 14 nt, Human
ugcuacugauuguu

SEQ ID NO: 2095491 - RNA, 20 nt, Human
ugcuacugauuguuucauug

SEQ ID NO: 2095492 - RNA, 11 nt, Human
ugccuugggcu

SEQ ID NO: 2095493 - RNA, 15 nt, Human
ugccuugggcugcuc

SEQ ID NO: 2095494 - RNA, 17 nt, Human
ugcgcugacaaccaccg

SEQ ID NO: 2095495 - RNA, 23 nt, Human
ugcgcugacaaccaccgcucccc

SEQ ID NO: 2095496 - RNA, 20 nt, Human
ugcgcucuagccugggcaac

SEQ ID NO: 2095497 - RNA, 13 nt, Human
ugccuuggcuuca

SEQ ID NO: 2095498 - RNA, 23 nt, Human
ugcgcgugcacguggagagcugg

SEQ ID NO: 2095499 - RNA, 17 nt, Human
ugcgccauugcacucca

SEQ ID NO: 2095500 - RNA, 23 nt, Human
ugcauauucuuauguaugugaaa

SEQ ID NO: 2095501 - RNA, 14 nt, Human
ugcaucaauccugu

SEQ ID NO: 2095502 - RNA, 15 nt, Human
ugcaucaauccugug

SEQ ID NO: 2095503 - RNA, 20 nt, Human
ugcaucaauccugugugguu

SEQ ID NO: 2095504 - RNA, 15 nt, Human
ugcauagucccagcu

SEQ ID NO: 2095505 - RNA, 16 nt, Human
ugcauagucccagcua

SEQ ID NO: 2095506 - RNA, 20 nt, Human
ugcauagucccagcuaccca

SEQ ID NO: 2095507 - RNA, 19 nt, Human
ugcauaguucccauguuaa

SEQ ID NO: 2095508 - RNA, 13 nt, Human
ugcauauguuucg

SEQ ID NO: 2095509 - RNA, 21 nt, Human
ugcauaguauuccauugugug

SEQ ID NO: 2095510 - RNA, 19 nt, Human
ugcaguuugagacaggaga

SEQ ID NO: 2095511 - RNA, 21 nt, Human
ugcaguggugcgaucuggguu

SEQ ID NO: 2095512 - RNA, 20 nt, Human
ugcaguggugcgaucugggu

SEQ ID NO: 2095513 - RNA, 24 nt, Human
ugcagggaggagguggcagcccug

SEQ ID NO: 2095514 - RNA, 15 nt, Human
ugcaguucagcacca

SEQ ID NO: 2095515 - RNA, 18 nt, Human
ugcaguucagcaccaccc

SEQ ID NO: 2095516 - RNA, 19 nt, Human
ugcaguucagcaccacccu

SEQ ID NO: 2095517 - RNA, 21 nt, Human
ugcaguuacacuaaaagguga

SEQ ID NO: 2095518 - RNA, 14 nt, Human
ugauuuaauaacau

SEQ ID NO: 2095519 - RNA, 20 nt, Human
ugauuuaauaacauaacaaa

SEQ ID NO: 2095520 - RNA, 13 nt, Human
ugcagggaguccg

SEQ ID NO: 2095521 - RNA, 14 nt, Human
ugcagggagccgag

SEQ ID NO: 2095522 - RNA, 18 nt, Human
ugcaggcuggcaccgccu

SEQ ID NO: 2095523 - RNA, 21 nt, Human
ugcaggcuggcaccgccuucu

SEQ ID NO: 2095524 - RNA, 22 nt, Human
ugcaggcuggcaccgccuucuc

SEQ ID NO: 2095525 - RNA, 23 nt, Human
ugcaggcuggcaccgccuucucu

SEQ ID NO: 2095526 - RNA, 17 nt, Human
ugccaccuccccuaucc

SEQ ID NO: 2095527 - RNA, 18 nt, Human
ugccaccuccccuaucca

SEQ ID NO: 2095528 - RNA, 21 nt, Human
ugccaccuccccuauccaccc

SEQ ID NO: 2095529 - RNA, 22 nt, Human
ugccaccuccccuauccaccca

SEQ ID NO: 2095530 - RNA, 10 nt, Human
ugccaccugc

SEQ ID NO: 2095531 - RNA, 16 nt, Human
ugccaccuggggcagu

SEQ ID NO: 2095532 - RNA, 17 nt, Human
ugccaccuggggcaguc

SEQ ID NO: 2095533 - RNA, 19 nt, Human
ugccaccuggggcagucac

SEQ ID NO: 2095534 - RNA, 13 nt, Human
ugccaccuccccu

SEQ ID NO: 2095535 - RNA, 20 nt, Human
ugccacccuggggagaaagu

SEQ ID NO: 2095536 - RNA, 23 nt, Human
ugccaaauuuuggccaaaguguu

SEQ ID NO: 2095537 - RNA, 14 nt, Human
ugccaggcauggug

SEQ ID NO: 2095538 - RNA, 22 nt, Human
ugccacgcgguacaaaggaaaa

SEQ ID NO: 2095539 - RNA, 16 nt, Human
ugcauuuggucaagau

SEQ ID NO: 2095540 - RNA, 19 nt, Human
ugccaaaaucauuuuaaug

SEQ ID NO: 2095541 - RNA, 14 nt, Human
ugccaaagggaaau

SEQ ID NO: 2095542 - RNA, 18 nt, Human
ugccaaagggaaauauca

SEQ ID NO: 2095543 - RNA, 20 nt, Human
ugccaaagcuaggguggccc

SEQ ID NO: 2095544 - RNA, 21 nt, Human
ugccaaagcuaggguggcccu

SEQ ID NO: 2095545 - RNA, 22 nt, Human
ugccaaagcuaggguggcccuu

SEQ ID NO: 2095546 - RNA, 17 nt, Human
ugcaugggugaagggag

SEQ ID NO: 2095547 - RNA, 23 nt, Human
ugcauggggugggguagggcuga

SEQ ID NO: 2095548 - RNA, 16 nt, Human
ugcaugggugaaggga

SEQ ID NO: 2095549 - RNA, 17 nt, Human
ugcauggguuuuguagg

SEQ ID NO: 2095550 - RNA, 18 nt, Human
ugcauggguuuuguaggu

SEQ ID NO: 2095551 - RNA, 19 nt, Human
ugcauggguuuuguaggua

SEQ ID NO: 2095552 - RNA, 23 nt, Human
ugcauggguuuuguagguacuuu

SEQ ID NO: 2095553 - RNA, 16 nt, Human
ugcaugguaauuuaua

SEQ ID NO: 2095554 - RNA, 18 nt, Human
ugcaugguaauuuauagu

SEQ ID NO: 2095555 - RNA, 19 nt, Human
ugcaugguaauuuauaguu

SEQ ID NO: 2095556 - RNA, 14 nt, Human
ugcaucagaaaugu

SEQ ID NO: 2095557 - RNA, 21 nt, Human
ugcaucagaaaugucuggaga

SEQ ID NO: 2095558 - RNA, 23 nt, Human
ugcaucagaaaugucuggagaau

SEQ ID NO: 2095559 - RNA, 20 nt, Human
ugccguugccaagaacugaa

SEQ ID NO: 2095560 - RNA, 14 nt, Human
ugccuauaguccca

SEQ ID NO: 2095561 - RNA, 17 nt, Human
ugccuauagucccagcu

SEQ ID NO: 2095562 - RNA, 18 nt, Human
ugccuauagucccagcua

SEQ ID NO: 2095563 - RNA, 20 nt, Human
ugccuaucaccucuuaugca

SEQ ID NO: 2095564 - RNA, 16 nt, Human
ugccuccucuucaacu

SEQ ID NO: 2095565 - RNA, 14 nt, Human
ugccuccucuucaa

SEQ ID NO: 2095566 - RNA, 13 nt, Human
ugccuccugugua

SEQ ID NO: 2095567 - RNA, 24 nt, Human
ugccucaaugugaaucagacccua

SEQ ID NO: 2095568 - RNA, 22 nt, Human
ugccucaaugugaaucagaccc

SEQ ID NO: 2095569 - RNA, 23 nt, Human
ugccucaaugugaaucagacccu

SEQ ID NO: 2095570 - RNA, 16 nt, Human
ugcccugggaugucca

SEQ ID NO: 2095571 - RNA, 17 nt, Human
ugcccuggugcugccac

SEQ ID NO: 2095572 - RNA, 21 nt, Human
ugcccugguccagggaagcug

SEQ ID NO: 2095573 - RNA, 16 nt, Human
ugcccuggugcugcca

SEQ ID NO: 2095574 - RNA, 14 nt, Human
ugcccuggugcugc

SEQ ID NO: 2095575 - RNA, 12 nt, Human
ugcccuggugcu

SEQ ID NO: 2095576 - RNA, 21 nt, Human
ugcccuggggcugaucucagg

SEQ ID NO: 2095577 - RNA, 22 nt, Human
ugcccuggggcugaucucaggg

SEQ ID NO: 2095578 - RNA, 23 nt, Human
ugcccuggggcugaucucaggga

SEQ ID NO: 2095579 - RNA, 18 nt, Human
ugcccugguccagggaag

SEQ ID NO: 2095580 - RNA, 16 nt, Human
ugccccucccuucaac

SEQ ID NO: 2095581 - RNA, 15 nt, Human
ugccccucccuucaa

SEQ ID NO: 2095582 - RNA, 13 nt, Human
ugccccagcucug

SEQ ID NO: 2095583 - RNA, 14 nt, Human
ugccccagcucugg

SEQ ID NO: 2095584 - RNA, 16 nt, Human
ugccccagcucuggcu

SEQ ID NO: 2095585 - RNA, 18 nt, Human
ugccccagcucuggcuuc

SEQ ID NO: 2095586 - RNA, 19 nt, Human
ugccccagcucuggcuucc

SEQ ID NO: 2095587 - RNA, 13 nt, Human
ugccccucucucc

SEQ ID NO: 2095588 - RNA, 15 nt, Human
ugccccucucuccau

SEQ ID NO: 2095589 - RNA, 20 nt, Human
ugcccgagcuggugcauuac

SEQ ID NO: 2095590 - RNA, 16 nt, Human
ugcccgagcuggugca

SEQ ID NO: 2095591 - RNA, 19 nt, Human
ugcccgagcuggugcauua

SEQ ID NO: 2095592 - RNA, 21 nt, Human
ugcccggagauuggacggccu

SEQ ID NO: 2095593 - RNA, 14 nt, Human
ugcccgagcuggug

SEQ ID NO: 2095594 - RNA, 13 nt, Human
ugcccgagcuggu

SEQ ID NO: 2095595 - RNA, 23 nt, Human
ugccccugcugccuccccaaccc

SEQ ID NO: 2095596 - RNA, 13 nt, Human
ugccccugcugcc

SEQ ID NO: 2095597 - RNA, 14 nt, Human
ugccccugcugccu

SEQ ID NO: 2095598 - RNA, 16 nt, Human
ugccccugcugccucc

SEQ ID NO: 2095599 - RNA, 17 nt, Human
ugccccugcugccuccc

SEQ ID NO: 2095600 - RNA, 14 nt, Human
ugcccggcugcgga

SEQ ID NO: 2095601 - RNA, 12 nt, Human
ugcccggcugcg

SEQ ID NO: 2095602 - RNA, 18 nt, Human
ugcccggauucugggagg

SEQ ID NO: 2095603 - RNA, 22 nt, Human
ugcccggauucugggaggaagc

SEQ ID NO: 2095604 - RNA, 23 nt, Human
ugcccggagauuggacggccuga

SEQ ID NO: 2095605 - RNA, 15 nt, Human
ugcccggauucuggg

SEQ ID NO: 2095606 - RNA, 16 nt, Human
ugcccggauucuggga

SEQ ID NO: 2095607 - RNA, 17 nt, Human
ugcccggauucugggag

SEQ ID NO: 2095608 - RNA, 12 nt, Human
ugccccaccugc

SEQ ID NO: 2095609 - RNA, 13 nt, Human
ugccccaccugcc

SEQ ID NO: 2095610 - RNA, 14 nt, Human
ugccccaccugcca

SEQ ID NO: 2095611 - RNA, 15 nt, Human
ugccccaccugccac

SEQ ID NO: 2095612 - RNA, 16 nt, Human
ugccccaccugccacu

SEQ ID NO: 2095613 - RNA, 17 nt, Human
ugccccaccugccacua

SEQ ID NO: 2095614 - RNA, 21 nt, Human
ugccccaccugccacuaggcu

SEQ ID NO: 2095615 - RNA, 19 nt, Human
ugccccaccuuuauuaaaa

SEQ ID NO: 2095616 - RNA, 16 nt, Human
ugccccaacuccugga

SEQ ID NO: 2095617 - RNA, 13 nt, Human
ugccccaacuccu

SEQ ID NO: 2095618 - RNA, 15 nt, Human
ugccccaacuccugg

SEQ ID NO: 2095619 - RNA, 21 nt, Human
ugccccaccuuuauuaaaauc

SEQ ID NO: 2095620 - RNA, 13 nt, Human
ugccccagagcug

SEQ ID NO: 2095621 - RNA, 14 nt, Human
ugccccagagcugu

SEQ ID NO: 2095622 - RNA, 15 nt, Human
ugccccagagcuguu

SEQ ID NO: 2095623 - RNA, 17 nt, Human
ugccccagagcuguuua

SEQ ID NO: 2095624 - RNA, 23 nt, Human
ugccccagagcuguuuauggccu

SEQ ID NO: 2095625 - RNA, 14 nt, Human
ugccccaaacaaau

SEQ ID NO: 2095626 - RNA, 16 nt, Human
ugcccauuccccagcc

SEQ ID NO: 2095627 - RNA, 18 nt, Human
ugcccauuccccagccuc

SEQ ID NO: 2095628 - RNA, 20 nt, Human
ugccccaaacaaauaugcaa

SEQ ID NO: 2095629 - RNA, 21 nt, Human
ugccccaaaggaagcuuucuc

SEQ ID NO: 2095630 - RNA, 22 nt, Human
ugccccaaaggaagcuuucucu

SEQ ID NO: 2095631 - RNA, 20 nt, Human
ugcccaggcuggcgugcagu

SEQ ID NO: 2095632 - RNA, 19 nt, Human
ugcccagagggcccaggca

SEQ ID NO: 2095633 - RNA, 19 nt, Human
ugcccaggcuggcgugcag

SEQ ID NO: 2095634 - RNA, 18 nt, Human
ugcccaggcuggcgugca

SEQ ID NO: 2095635 - RNA, 11 nt, Human
ugcccagagau

SEQ ID NO: 2095636 - RNA, 12 nt, Human
ugcccagagaug

SEQ ID NO: 2095637 - RNA, 16 nt, Human
ugcccagagaugccuc

SEQ ID NO: 2095638 - RNA, 17 nt, Human
ugcccagagaugccucc

SEQ ID NO: 2095639 - RNA, 18 nt, Human
ugcccagagaugccucca

SEQ ID NO: 2095640 - RNA, 19 nt, Human
ugcccagagaugccuccac

SEQ ID NO: 2095641 - RNA, 20 nt, Human
ugcccagagaugccuccacc

SEQ ID NO: 2095642 - RNA, 21 nt, Human
ugcccagagaugccuccaccg

SEQ ID NO: 2095643 - RNA, 22 nt, Human
ugcccagagaugccuccaccgc

SEQ ID NO: 2095644 - RNA, 15 nt, Human
ugcccagagauggga

SEQ ID NO: 2095645 - RNA, 11 nt, Human
ugcccagagcu

SEQ ID NO: 2095646 - RNA, 12 nt, Human
ugcccagagcug

SEQ ID NO: 2095647 - RNA, 13 nt, Human
ugcccagagcugg

SEQ ID NO: 2095648 - RNA, 14 nt, Human
ugcccagagcuggg

SEQ ID NO: 2095649 - RNA, 15 nt, Human
ugcccagagcugggu

SEQ ID NO: 2095650 - RNA, 17 nt, Human
ugcccagagcuggguga

SEQ ID NO: 2095651 - RNA, 18 nt, Human
ugcccagagggcccaggc

SEQ ID NO: 2095652 - RNA, 15 nt, Human
ugcccagaccacacg

SEQ ID NO: 2095653 - RNA, 16 nt, Human
ugcccagaauucccag

SEQ ID NO: 2095654 - RNA, 21 nt, Human
ugcccagaauucccagcuguc

SEQ ID NO: 2095655 - RNA, 22 nt, Human
ugcccagaauucccagcugucu

SEQ ID NO: 2095656 - RNA, 23 nt, Human
ugcccagaauucccagcugucug

SEQ ID NO: 2095657 - RNA, 18 nt, Human
ugcccagaccccucuggc

SEQ ID NO: 2095658 - RNA, 19 nt, Human
ugcccagaccccucuggcc

SEQ ID NO: 2095659 - RNA, 22 nt, Human
ugcccagaccccucuggccagg

SEQ ID NO: 2095660 - RNA, 11 nt, Human
ugccaggcccg

SEQ ID NO: 2095661 - RNA, 14 nt, Human
ugccaggcccgggg

SEQ ID NO: 2095662 - RNA, 13 nt, Human
uggccaggcuggu

SEQ ID NO: 2095663 - RNA, 16 nt, Human
uggcccccgagcuggg

SEQ ID NO: 2095664 - RNA, 17 nt, Human
uggcccccgagcugggg

SEQ ID NO: 2095665 - RNA, 14 nt, Human
uggcccccgagcug

SEQ ID NO: 2095666 - RNA, 15 nt, Human
uggcccccgagcugg

SEQ ID NO: 2095667 - RNA, 13 nt, Human
uggcccccacugg

SEQ ID NO: 2095668 - RNA, 14 nt, Human
uggcccccacuggc

SEQ ID NO: 2095669 - RNA, 15 nt, Human
uggcccccacuggcu

SEQ ID NO: 2095670 - RNA, 18 nt, Human
uggcccccacuggcugug

SEQ ID NO: 2095671 - RNA, 20 nt, Human
uggcccccacuggcuguggg

SEQ ID NO: 2095672 - RNA, 21 nt, Human
uggcccccacuggcugugggc

SEQ ID NO: 2095673 - RNA, 20 nt, Human
uggccccugcccggcugcgg

SEQ ID NO: 2095674 - RNA, 13 nt, Human
uggccccucaccu

SEQ ID NO: 2095675 - RNA, 13 nt, Human
uggccucaacccu

SEQ ID NO: 2095676 - RNA, 16 nt, Human
uggccccugcccggcu

SEQ ID NO: 2095677 - RNA, 15 nt, Human
uggccccugcccggc

SEQ ID NO: 2095678 - RNA, 14 nt, Human
uggccccugcccgg

SEQ ID NO: 2095679 - RNA, 19 nt, Human
uggcccccgagcugggggc

SEQ ID NO: 2095680 - RNA, 19 nt, Human
uggccccuagaaucagccu

SEQ ID NO: 2095681 - RNA, 18 nt, Human
uggccagaugcaccagcc

SEQ ID NO: 2095682 - RNA, 17 nt, Human
uggccagaugcaccagc

SEQ ID NO: 2095683 - RNA, 19 nt, Human
uggccagaugcaccagccc

SEQ ID NO: 2095684 - RNA, 16 nt, Human
uggcuccucccggugc

SEQ ID NO: 2095685 - RNA, 14 nt, Human
uggcuccucccggu

SEQ ID NO: 2095686 - RNA, 15 nt, Human
uggcucccagggcca

SEQ ID NO: 2095687 - RNA, 17 nt, Human
uggcucccagggccaug

SEQ ID NO: 2095688 - RNA, 14 nt, Human
uggcucccaugacc

SEQ ID NO: 2095689 - RNA, 19 nt, Human
uggcuccucccggugccca

SEQ ID NO: 2095690 - RNA, 18 nt, Human
uggcuccucccggugccc

SEQ ID NO: 2095691 - RNA, 14 nt, Human
uggcuccugagggg

SEQ ID NO: 2095692 - RNA, 20 nt, Human
uggcucccaugaccauacug

SEQ ID NO: 2095693 - RNA, 14 nt, Human
uggcugcugacuga

SEQ ID NO: 2095694 - RNA, 20 nt, Human
uggcuccugaggggcaucug

SEQ ID NO: 2095695 - RNA, 20 nt, Human
uggcucccacaggcccuucc

SEQ ID NO: 2095696 - RNA, 17 nt, Human
uggcucccacaggcccu

SEQ ID NO: 2095697 - RNA, 14 nt, Human
uggcucccacaggc

SEQ ID NO: 2095698 - RNA, 19 nt, Human
uggcguagagggugcugcc

SEQ ID NO: 2095699 - RNA, 20 nt, Human
uggcguagagggugcugccc

SEQ ID NO: 2095700 - RNA, 23 nt, Human
uggcguagagggugcugccccau

SEQ ID NO: 2095701 - RNA, 13 nt, Human
uggcggugccugg

SEQ ID NO: 2095702 - RNA, 13 nt, Human
uggcgggccaagg

SEQ ID NO: 2095703 - RNA, 17 nt, Human
uggcgggccaaggacug

SEQ ID NO: 2095704 - RNA, 15 nt, Human
uggcggcuacucagc

SEQ ID NO: 2095705 - RNA, 16 nt, Human
uggcggcuacucagca

SEQ ID NO: 2095706 - RNA, 17 nt, Human
uggcggcuacucagcag

SEQ ID NO: 2095707 - RNA, 21 nt, Human
uggcggcuacucagcagcccu

SEQ ID NO: 2095708 - RNA, 22 nt, Human
uggcggcuacucagcagcccuc

SEQ ID NO: 2095709 - RNA, 23 nt, Human
uggcggcuacucagcagcccucc

SEQ ID NO: 2095710 - RNA, 19 nt, Human
uggccucaacccucccuca

SEQ ID NO: 2095711 - RNA, 17 nt, Human
uggccucaacccucccu

SEQ ID NO: 2095712 - RNA, 18 nt, Human
uggccucaacccucccuc

SEQ ID NO: 2095713 - RNA, 13 nt, Human
uggccucagcugc

SEQ ID NO: 2095714 - RNA, 14 nt, Human
uggccucaacccuc

SEQ ID NO: 2095715 - RNA, 15 nt, Human
uggccucaacccucc

SEQ ID NO: 2095716 - RNA, 16 nt, Human
uggccucaacccuccc

SEQ ID NO: 2095717 - RNA, 20 nt, Human
uggccucaacccucccucag

SEQ ID NO: 2095718 - RNA, 19 nt, Human
uggccucagcugccucacu

SEQ ID NO: 2095719 - RNA, 14 nt, Human
uggccucagcugcc

SEQ ID NO: 2095720 - RNA, 16 nt, Human
uggccucagcugccuc

SEQ ID NO: 2095721 - RNA, 17 nt, Human
uggccucagcugccuca

SEQ ID NO: 2095722 - RNA, 18 nt, Human
uggccucagcugccucac

SEQ ID NO: 2095723 - RNA, 18 nt, Human
uggcgauucccauugaaa

SEQ ID NO: 2095724 - RNA, 14 nt, Human
uggcgcaagccugu

SEQ ID NO: 2095725 - RNA, 17 nt, Human
uggauuuuugucuugug

SEQ ID NO: 2095726 - RNA, 12 nt, Human
uggcaaaaaggc

SEQ ID NO: 2095727 - RNA, 16 nt, Human
uggcaaaaaggcagga

SEQ ID NO: 2095728 - RNA, 15 nt, Human
uggcaaagcagaaaa

SEQ ID NO: 2095729 - RNA, 21 nt, Human
uggcaaagccuucauugccuu

SEQ ID NO: 2095730 - RNA, 17 nt, Human
uggcaaacuucagacug

SEQ ID NO: 2095731 - RNA, 13 nt, Human
uggcaaagacaga

SEQ ID NO: 2095732 - RNA, 17 nt, Human
uggcaaagacagaagcc

SEQ ID NO: 2095733 - RNA, 17 nt, Human
uggcaaagaugugggga

SEQ ID NO: 2095734 - RNA, 15 nt, Human
uggcacuauaaugua

SEQ ID NO: 2095735 - RNA, 16 nt, Human
uggcacuauaauguaa

SEQ ID NO: 2095736 - RNA, 22 nt, Human
uggcagaauggggugcaugaag

SEQ ID NO: 2095737 - RNA, 14 nt, Human
uggcagaaguguuu

SEQ ID NO: 2095738 - RNA, 16 nt, Human
uggcagaaguguuuca

SEQ ID NO: 2095739 - RNA, 19 nt, Human
uggcagaauaaucuuuggg

SEQ ID NO: 2095740 - RNA, 20 nt, Human
uggcagaauaaucuuugggu

SEQ ID NO: 2095741 - RNA, 17 nt, Human
uggcaauaguguguucu

SEQ ID NO: 2095742 - RNA, 18 nt, Human
uggcaauaguguguucug

SEQ ID NO: 2095743 - RNA, 15 nt, Human
uggcaauaguguguu

SEQ ID NO: 2095744 - RNA, 16 nt, Human
uggcaauaguguguuc

SEQ ID NO: 2095745 - RNA, 17 nt, Human
uggcaaggguucaccug

SEQ ID NO: 2095746 - RNA, 14 nt, Human
uggagacugucuca

SEQ ID NO: 2095747 - RNA, 20 nt, Human
uggaggagcucaggacacua

SEQ ID NO: 2095748 - RNA, 22 nt, Human
uggaggagcucaggacacuaau

SEQ ID NO: 2095749 - RNA, 22 nt, Human
uggaggaaugcucccccauccu

SEQ ID NO: 2095750 - RNA, 21 nt, Human
uggaggaagggggguugcagu

SEQ ID NO: 2095751 - RNA, 15 nt, Human
uggaggaaugcuccc

SEQ ID NO: 2095752 - RNA, 16 nt, Human
uggaggaaugcucccc

SEQ ID NO: 2095753 - RNA, 17 nt, Human
uggaggaaugcuccccc

SEQ ID NO: 2095754 - RNA, 22 nt, Human
uggaggagcuugggggaugacu

SEQ ID NO: 2095755 - RNA, 12 nt, Human
uggaggaggagg

SEQ ID NO: 2095756 - RNA, 13 nt, Human
uggaggaggaggc

SEQ ID NO: 2095757 - RNA, 14 nt, Human
uggaggaggaggca

SEQ ID NO: 2095758 - RNA, 15 nt, Human
uggaggaggaggcaa

SEQ ID NO: 2095759 - RNA, 16 nt, Human
uggaggaggaggcaau

SEQ ID NO: 2095760 - RNA, 17 nt, Human
uggaggcacacagcugc

SEQ ID NO: 2095761 - RNA, 15 nt, Human
uggaggauggagaga

SEQ ID NO: 2095762 - RNA, 20 nt, Human
uggaggaccaaaaaaauaag

SEQ ID NO: 2095763 - RNA, 20 nt, Human
uggaggauggagagagggga

SEQ ID NO: 2095764 - RNA, 17 nt, Human
uggaguuuuaacuguaa

SEQ ID NO: 2095765 - RNA, 21 nt, Human
uggaucugggacccuuuccuu

SEQ ID NO: 2095766 - RNA, 20 nt, Human
uggaucugggacccuuuccu

SEQ ID NO: 2095767 - RNA, 19 nt, Human
uggaucugggacccuuucc

SEQ ID NO: 2095768 - RNA, 23 nt, Human
uggaucugggacccuuuccuucc

SEQ ID NO: 2095769 - RNA, 16 nt, Human
uggaucucccagggcu

SEQ ID NO: 2095770 - RNA, 14 nt, Human
ugcuguuuccuuuu

SEQ ID NO: 2095771 - RNA, 11 nt, Human
ugcuguuuccu

SEQ ID NO: 2095772 - RNA, 12 nt, Human
ugcuguuuccuu

SEQ ID NO: 2095773 - RNA, 22 nt, Human
ugcuguugucauugcuuuacug

SEQ ID NO: 2095774 - RNA, 23 nt, Human
ugcuguugucauugcuuuacugg

SEQ ID NO: 2095775 - RNA, 14 nt, Human
ugcuguugccucau

SEQ ID NO: 2095776 - RNA, 15 nt, Human
uggacaguccuggga

SEQ ID NO: 2095777 - RNA, 16 nt, Human
uggacaguccugggag

SEQ ID NO: 2095778 - RNA, 17 nt, Human
uggacaguccugggaga

SEQ ID NO: 2095779 - RNA, 13 nt, Human
uggaccaaagcug

SEQ ID NO: 2095780 - RNA, 14 nt, Human
uggaccaaagcuga

SEQ ID NO: 2095781 - RNA, 12 nt, Human
uggacaguccug

SEQ ID NO: 2095782 - RNA, 13 nt, Human
uggacaguccugg

SEQ ID NO: 2095783 - RNA, 14 nt, Human
uggacaguccuggg

SEQ ID NO: 2095784 - RNA, 13 nt, Human
uggacaggucugg

SEQ ID NO: 2095785 - RNA, 14 nt, Human
uggacaggucuggg

SEQ ID NO: 2095786 - RNA, 16 nt, Human
uggacaggucugggag

SEQ ID NO: 2095787 - RNA, 17 nt, Human
uggacaggucugggaga

SEQ ID NO: 2095788 - RNA, 20 nt, Human
uggacaggucugggagaggc

SEQ ID NO: 2095789 - RNA, 22 nt, Human
uggacaggucugggagaggcag

SEQ ID NO: 2095790 - RNA, 14 nt, Human
uggagacucugugg

SEQ ID NO: 2095791 - RNA, 19 nt, Human
uggagacucuguggggccu

SEQ ID NO: 2095792 - RNA, 13 nt, Human
uggagacaaugca

SEQ ID NO: 2095793 - RNA, 18 nt, Human
uggagacaaugcagaugc

SEQ ID NO: 2095794 - RNA, 20 nt, Human
uggagacaaugcagaugcca

SEQ ID NO: 2095795 - RNA, 16 nt, Human
uggagaauaauucuuu

SEQ ID NO: 2095796 - RNA, 18 nt, Human
uggagaauaauucuuuga

SEQ ID NO: 2095797 - RNA, 21 nt, Human
uggagaagcucccugaaguaa

SEQ ID NO: 2095798 - RNA, 22 nt, Human
uggagaagucuuagacuugaaa

SEQ ID NO: 2095799 - RNA, 13 nt, Human
uggacuccucugu

SEQ ID NO: 2095800 - RNA, 17 nt, Human
uggacugaagccugcag

SEQ ID NO: 2095801 - RNA, 19 nt, Human
uggacugaagccugcagga

SEQ ID NO: 2095802 - RNA, 18 nt, Human
uggacugaagccugcagg

SEQ ID NO: 2095803 - RNA, 13 nt, Human
uggacugacauuu

SEQ ID NO: 2095804 - RNA, 18 nt, Human
uggacucaggaugcccag

SEQ ID NO: 2095805 - RNA, 15 nt, Human
uggacuccagaucug

SEQ ID NO: 2095806 - RNA, 18 nt, Human
uggacuccagaucugcac

SEQ ID NO: 2095807 - RNA, 13 nt, Human
uggaccagaugcu

SEQ ID NO: 2095808 - RNA, 14 nt, Human
uggaccagaugcug

SEQ ID NO: 2095809 - RNA, 16 nt, Human
uggacucaggaugccc

SEQ ID NO: 2095810 - RNA, 13 nt, Human
uggucccugggag

SEQ ID NO: 2095811 - RNA, 14 nt, Human
uggucccugggagg

SEQ ID NO: 2095812 - RNA, 14 nt, Human
ugguccccaagacc

SEQ ID NO: 2095813 - RNA, 19 nt, Human
uggucccugggaggaaauu

SEQ ID NO: 2095814 - RNA, 15 nt, Human
ugguccgguguccuu

SEQ ID NO: 2095815 - RNA, 14 nt, Human
ugguccuaaguccc

SEQ ID NO: 2095816 - RNA, 18 nt, Human
ugguccuaagucccugcc

SEQ ID NO: 2095817 - RNA, 19 nt, Human
ugguccuaagucccugccc

SEQ ID NO: 2095818 - RNA, 20 nt, Human
ugguccuaagucccugcccc

SEQ ID NO: 2095819 - RNA, 21 nt, Human
ugguccuaagucccugccccc

SEQ ID NO: 2095820 - RNA, 14 nt, Human
ugguccucuugcca

SEQ ID NO: 2095821 - RNA, 15 nt, Human
ugguccucuugccau

SEQ ID NO: 2095822 - RNA, 12 nt, Human
ugguccugacuc

SEQ ID NO: 2095823 - RNA, 19 nt, Human
ugguccugacucaacaugu

SEQ ID NO: 2095824 - RNA, 19 nt, Human
uggucacaggacucugccu

SEQ ID NO: 2095825 - RNA, 18 nt, Human
uggucaacuugagcaugu

SEQ ID NO: 2095826 - RNA, 15 nt, Human
uggucaagauuuuga

SEQ ID NO: 2095827 - RNA, 18 nt, Human
uggucacaggacucugcc

SEQ ID NO: 2095828 - RNA, 14 nt, Human
uggucaacacuuaa

SEQ ID NO: 2095829 - RNA, 19 nt, Human
ugguauggaacucucucca

SEQ ID NO: 2095830 - RNA, 14 nt, Human
ugguauggguuucu

SEQ ID NO: 2095831 - RNA, 19 nt, Human
ugguauggguuucucccag

SEQ ID NO: 2095832 - RNA, 21 nt, Human
ugguaugugacaugcgggcug

SEQ ID NO: 2095833 - RNA, 21 nt, Human
uggguaucaccacuggagauc

SEQ ID NO: 2095834 - RNA, 13 nt, Human
ugggucaaggaau

SEQ ID NO: 2095835 - RNA, 22 nt, Human
uggguaucaccacuggagauca

SEQ ID NO: 2095836 - RNA, 19 nt, Human
uggguauccugcccagugu

SEQ ID NO: 2095837 - RNA, 20 nt, Human
uggguauccugcccaguguu

SEQ ID NO: 2095838 - RNA, 19 nt, Human
uggguauauucauuucaaa

SEQ ID NO: 2095839 - RNA, 17 nt, Human
uggguaucaaacagcuc

SEQ ID NO: 2095840 - RNA, 20 nt, Human
uggguaucaaacagcucagg

SEQ ID NO: 2095841 - RNA, 21 nt, Human
ugguauguguguguaugcuac

SEQ ID NO: 2095842 - RNA, 19 nt, Human
ugguauuugagacauucca

SEQ ID NO: 2095843 - RNA, 19 nt, Human
ugguauuuaucuauuguaa

SEQ ID NO: 2095844 - RNA, 20 nt, Human
ugguauuuaucuauuguaag

SEQ ID NO: 2095845 - RNA, 21 nt, Human
ugguauuuaucuauuguaaga

SEQ ID NO: 2095846 - RNA, 22 nt, Human
ugguauuuaucuauuguaagau

SEQ ID NO: 2095847 - RNA, 12 nt, Human
ugguaugugugu

SEQ ID NO: 2095848 - RNA, 15 nt, Human
ugguaugugugugua

SEQ ID NO: 2095849 - RNA, 17 nt, Human
ugguauguguguguaug

SEQ ID NO: 2095850 - RNA, 19 nt, Human
ugguauguguguguaugcu

SEQ ID NO: 2095851 - RNA, 22 nt, Human
uggugaccucugccugaaguca

SEQ ID NO: 2095852 - RNA, 17 nt, Human
uggugaccucugccuga

SEQ ID NO: 2095853 - RNA, 16 nt, Human
uggugaccucugccug

SEQ ID NO: 2095854 - RNA, 15 nt, Human
uggugaccucugccu

SEQ ID NO: 2095855 - RNA, 17 nt, Human
uggugacccagucagag

SEQ ID NO: 2095856 - RNA, 14 nt, Human
uggugaggaagcuc

SEQ ID NO: 2095857 - RNA, 16 nt, Human
uggugaggaagcucca

SEQ ID NO: 2095858 - RNA, 13 nt, Human
uggugaggagcac

SEQ ID NO: 2095859 - RNA, 17 nt, Human
uggugagguugggcagc

SEQ ID NO: 2095860 - RNA, 17 nt, Human
uggugaucaauuaaaug

SEQ ID NO: 2095861 - RNA, 18 nt, Human
uggugaucaauuaaaugu

SEQ ID NO: 2095862 - RNA, 22 nt, Human
uggugauuuagcaggaagcugu

SEQ ID NO: 2095863 - RNA, 16 nt, Human
uggugauuuagcagga

SEQ ID NO: 2095864 - RNA, 19 nt, Human
uggugaggcuuaacaaugu

SEQ ID NO: 2095865 - RNA, 17 nt, Human
uggugcagggccuccau

SEQ ID NO: 2095866 - RNA, 10 nt, Human
uggugcauua

SEQ ID NO: 2095867 - RNA, 13 nt, Human
uggugcauuacag

SEQ ID NO: 2095868 - RNA, 16 nt, Human
uggugcauuacagaga

SEQ ID NO: 2095869 - RNA, 19 nt, Human
uggugcauuacagagagga

SEQ ID NO: 2095870 - RNA, 14 nt, Human
uggugaccucugcc

SEQ ID NO: 2095871 - RNA, 13 nt, Human
uggugaccucugc

SEQ ID NO: 2095872 - RNA, 13 nt, Human
uggugaauuugaa

SEQ ID NO: 2095873 - RNA, 14 nt, Human
uggugaauuugaau

SEQ ID NO: 2095874 - RNA, 16 nt, Human
uggugacaccagccuu

SEQ ID NO: 2095875 - RNA, 18 nt, Human
uggugacaccagccuuuc

SEQ ID NO: 2095876 - RNA, 16 nt, Human
ugguccuggggcucug

SEQ ID NO: 2095877 - RNA, 19 nt, Human
ugguccuggggcucugugc

SEQ ID NO: 2095878 - RNA, 22 nt, Human
ugguccugacucaacauguuac

SEQ ID NO: 2095879 - RNA, 11 nt, Human
ugguccugggg

SEQ ID NO: 2095880 - RNA, 14 nt, Human
ugguccuggggcuc

SEQ ID NO: 2095881 - RNA, 13 nt, Human
uggucgcccagga

SEQ ID NO: 2095882 - RNA, 14 nt, Human
uggucgcccaggag

SEQ ID NO: 2095883 - RNA, 23 nt, Human
ugguccuuccaggcccccaccac

SEQ ID NO: 2095884 - RNA, 15 nt, Human
uggucgcccaggaga

SEQ ID NO: 2095885 - RNA, 14 nt, Human
ugggauguuucugu

SEQ ID NO: 2095886 - RNA, 17 nt, Human
ugggcagggaggcacca

SEQ ID NO: 2095887 - RNA, 21 nt, Human
ugggcagggaggcaccauuca

SEQ ID NO: 2095888 - RNA, 11 nt, Human
ugggcccuccu

SEQ ID NO: 2095889 - RNA, 15 nt, Human
ugggcaggugggagc

SEQ ID NO: 2095890 - RNA, 20 nt, Human
uggcugggggccucagugcc

SEQ ID NO: 2095891 - RNA, 17 nt, Human
uggcugggggccucagu

SEQ ID NO: 2095892 - RNA, 16 nt, Human
uggcugggggccucag

SEQ ID NO: 2095893 - RNA, 22 nt, Human
ugggauuacaagcgugagccac

SEQ ID NO: 2095894 - RNA, 19 nt, Human
ugggauguccacagaugcc

SEQ ID NO: 2095895 - RNA, 15 nt, Human
ugggaugucuuauuu

SEQ ID NO: 2095896 - RNA, 16 nt, Human
ugggaugucuuauuuu

SEQ ID NO: 2095897 - RNA, 18 nt, Human
uggguacuuguggacaca

SEQ ID NO: 2095898 - RNA, 17 nt, Human
uggguacuuguggacac

SEQ ID NO: 2095899 - RNA, 15 nt, Human
uggguauauucauuu

SEQ ID NO: 2095900 - RNA, 22 nt, Human
uggggguucuuucuuccucugc

SEQ ID NO: 2095901 - RNA, 20 nt, Human
uggggguucuuucuuccucu

SEQ ID NO: 2095902 - RNA, 18 nt, Human
uggguaaucgauggggga

SEQ ID NO: 2095903 - RNA, 15 nt, Human
uggguacagagaggu

SEQ ID NO: 2095904 - RNA, 19 nt, Human
uggggguucuuucuuccuc

SEQ ID NO: 2095905 - RNA, 15 nt, Human
uggggguucuuucuu

SEQ ID NO: 2095906 - RNA, 16 nt, Human
ugggggaagcccugga

SEQ ID NO: 2095907 - RNA, 19 nt, Human
ugggggagucugaagcaga

SEQ ID NO: 2095908 - RNA, 23 nt, Human
uggggaugagaaagguugaagca

SEQ ID NO: 2095909 - RNA, 15 nt, Human
uggggaugagaaagg

SEQ ID NO: 2095910 - RNA, 17 nt, Human
uggggauaaaggagaag

SEQ ID NO: 2095911 - RNA, 15 nt, Human
ugggggaagcccugg

SEQ ID NO: 2095912 - RNA, 19 nt, Human
ugggcuuccauuugugugu

SEQ ID NO: 2095913 - RNA, 23 nt, Human
ugggcuuccauuugugugugugc

SEQ ID NO: 2095914 - RNA, 11 nt, Human
uuaaagacaga

SEQ ID NO: 2095915 - RNA, 12 nt, Human
uuaaagacagag

SEQ ID NO: 2095916 - RNA, 21 nt, Human
uuaaagacaaagacaaauucu

SEQ ID NO: 2095917 - RNA, 17 nt, Human
uuaaagaaucauuauuu

SEQ ID NO: 2095918 - RNA, 12 nt, Human
uuaaauuaaaca

SEQ ID NO: 2095919 - RNA, 14 nt, Human
uuaaauuaaacaau

SEQ ID NO: 2095920 - RNA, 19 nt, Human
uuaaauuaaacaauuuauu

SEQ ID NO: 2095921 - RNA, 15 nt, Human
uuaacauuucuaacu

SEQ ID NO: 2095922 - RNA, 17 nt, Human
uuaaccacuucagcuga

SEQ ID NO: 2095923 - RNA, 22 nt, Human
uuaacauugaccaagaacugca

SEQ ID NO: 2095924 - RNA, 23 nt, Human
uuaacauugaccaagaacugcau

SEQ ID NO: 2095925 - RNA, 16 nt, Human
uuaaccagucugaagu

SEQ ID NO: 2095926 - RNA, 21 nt, Human
uuaaccagucugaaguuucau

SEQ ID NO: 2095927 - RNA, 22 nt, Human
uuaaccagucugaaguuucauu

SEQ ID NO: 2095928 - RNA, 13 nt, Human
uuaaccagaauaa

SEQ ID NO: 2095929 - RNA, 14 nt, Human
uuaacuagaauuua

SEQ ID NO: 2095930 - RNA, 12 nt, Human
uuaacuagaauu

SEQ ID NO: 2095931 - RNA, 23 nt, Human
uuaacuaaucuauuggguucauu

SEQ ID NO: 2095932 - RNA, 17 nt, Human
uuaaccuggugcuggau

SEQ ID NO: 2095933 - RNA, 15 nt, Human
uuaaccucaguguca

SEQ ID NO: 2095934 - RNA, 19 nt, Human
uuaaccucagugucauuua

SEQ ID NO: 2095935 - RNA, 15 nt, Human
uuaaccuaccuguaa

SEQ ID NO: 2095936 - RNA, 13 nt, Human
uuaaccuggugcu

SEQ ID NO: 2095937 - RNA, 18 nt, Human
uuaacuuagcuugaagga

SEQ ID NO: 2095938 - RNA, 18 nt, Human
uuaacuuaacauucugua

SEQ ID NO: 2095939 - RNA, 19 nt, Human
uuaacuguguauguacaua

SEQ ID NO: 2095940 - RNA, 22 nt, Human
uuaacuucagagggaaaguaaa

SEQ ID NO: 2095941 - RNA, 22 nt, Human
uuaacuuaaauuuuaauuuauu

SEQ ID NO: 2095942 - RNA, 11 nt, Human
uuaacucuuug

SEQ ID NO: 2095943 - RNA, 12 nt, Human
uuaacucuuugc

SEQ ID NO: 2095944 - RNA, 20 nt, Human
uuaacucuuugccuuugcca

SEQ ID NO: 2095945 - RNA, 12 nt, Human
uuaacucaauau

SEQ ID NO: 2095946 - RNA, 14 nt, Human
uuaacucaggacuc

SEQ ID NO: 2095947 - RNA, 17 nt, Human
uuaacucaggacuccag

SEQ ID NO: 2095948 - RNA, 18 nt, Human
uuaacucaggacuccagc

SEQ ID NO: 2095949 - RNA, 19 nt, Human
uuaacucaggacuccagcc

SEQ ID NO: 2095950 - RNA, 22 nt, Human
uuaacucaggacuccagcccau

SEQ ID NO: 2095951 - RNA, 21 nt, Human
uuaacuagaauuuauucaauu

SEQ ID NO: 2095952 - RNA, 14 nt, Human
uuaacuauguacaa

SEQ ID NO: 2095953 - RNA, 15 nt, Human
uuaacuauguacaau

SEQ ID NO: 2095954 - RNA, 18 nt, Human
uuaacuauguacaauauu

SEQ ID NO: 2095955 - RNA, 23 nt, Human
uuaacuauguacaauauuuuaag

SEQ ID NO: 2095956 - RNA, 16 nt, Human
uuaacuagaauuuauu

SEQ ID NO: 2095957 - RNA, 15 nt, Human
uuaacuagaauuuau

SEQ ID NO: 2095958 - RNA, 19 nt, Human
uuaacuauuuuauuuucua

SEQ ID NO: 2095959 - RNA, 11 nt, Human
uuaauguuuuu

SEQ ID NO: 2095960 - RNA, 18 nt, Human
uuaauguuuuuaaauaua

SEQ ID NO: 2095961 - RNA, 20 nt, Human
uuacaagcgugagccacugc

SEQ ID NO: 2095962 - RNA, 21 nt, Human
uuacaagcgugagccacugca

SEQ ID NO: 2095963 - RNA, 13 nt, Human
uuacaauugaaau

SEQ ID NO: 2095964 - RNA, 14 nt, Human
uuacaauugaaaug

SEQ ID NO: 2095965 - RNA, 15 nt, Human
uuacaauugaaauga

SEQ ID NO: 2095966 - RNA, 17 nt, Human
uuacaauugaaaugacu

SEQ ID NO: 2095967 - RNA, 20 nt, Human
uuaaugcauguuaggaaaau

SEQ ID NO: 2095968 - RNA, 18 nt, Human
uuaagcaguaaaaacugu

SEQ ID NO: 2095969 - RNA, 17 nt, Human
uuaagcuguuacugucu

SEQ ID NO: 2095970 - RNA, 14 nt, Human
uuaagcuguuucca

SEQ ID NO: 2095971 - RNA, 15 nt, Human
uuaauauaacugccu

SEQ ID NO: 2095972 - RNA, 20 nt, Human
uuaauauucuuucaauaacg

SEQ ID NO: 2095973 - RNA, 22 nt, Human
uuaauauucauuguauaaaaau

SEQ ID NO: 2095974 - RNA, 18 nt, Human
uuaauauugauaugcuua

SEQ ID NO: 2095975 - RNA, 22 nt, Human
uuaauauugauaugcuuauaca

SEQ ID NO: 2095976 - RNA, 17 nt, Human
uuaauauagcuauuuuu

SEQ ID NO: 2095977 - RNA, 15 nt, Human
uuaauauagcuauuu

SEQ ID NO: 2095978 - RNA, 23 nt, Human
uuaauauaacugccuuaaaacuu

SEQ ID NO: 2095979 - RNA, 20 nt, Human
uguuucauauugaugugugu

SEQ ID NO: 2095980 - RNA, 18 nt, Human
uguuucacgaaguuuguu

SEQ ID NO: 2095981 - RNA, 20 nt, Human
uguuuuaagaggcagggucu

SEQ ID NO: 2095982 - RNA, 16 nt, Human
uguuugucagauauga

SEQ ID NO: 2095983 - RNA, 19 nt, Human
uguuugucugucuucauag

SEQ ID NO: 2095984 - RNA, 17 nt, Human
uguuugucugucuucau

SEQ ID NO: 2095985 - RNA, 16 nt, Human
uguuugguucuggggc

SEQ ID NO: 2095986 - RNA, 20 nt, Human
uguuugguucuggggccccu

SEQ ID NO: 2095987 - RNA, 15 nt, Human
uguuuggguauccug

SEQ ID NO: 2095988 - RNA, 18 nt, Human
uguuuggguauccugccc

SEQ ID NO: 2095989 - RNA, 23 nt, Human
uguuuggguauccugcccagugu

SEQ ID NO: 2095990 - RNA, 13 nt, Human
uguuuguaaauaa

SEQ ID NO: 2095991 - RNA, 15 nt, Human
uguuuguaaauaaga

SEQ ID NO: 2095992 - RNA, 16 nt, Human
uguuuguaaauaagag

SEQ ID NO: 2095993 - RNA, 18 nt, Human
uguuuguaaauaagagau

SEQ ID NO: 2095994 - RNA, 19 nt, Human
uguuuguaaauaagagauu

SEQ ID NO: 2095995 - RNA, 21 nt, Human
uguuuguaaauaagagauuug

SEQ ID NO: 2095996 - RNA, 20 nt, Human
uguuucuagagccugcugga

SEQ ID NO: 2095997 - RNA, 23 nt, Human
uguuucuagagccugcuggaucu

SEQ ID NO: 2095998 - RNA, 15 nt, Human
uguuucuagggaaau

SEQ ID NO: 2095999 - RNA, 11 nt, Human
uguuuccuuuu

SEQ ID NO: 2096000 - RNA, 21 nt, Human
uguuucgcugauauauguguu

SEQ ID NO: 2096001 - RNA, 20 nt, Human
uguuucgugaaguauacugu

SEQ ID NO: 2096002 - RNA, 15 nt, Human
uguuucgugaaguau

SEQ ID NO: 2096003 - RNA, 19 nt, Human
uguuucgugaaguauacug

SEQ ID NO: 2096004 - RNA, 16 nt, Human
uguuuccuucauuucu

SEQ ID NO: 2096005 - RNA, 12 nt, Human
uguuuccuucag

SEQ ID NO: 2096006 - RNA, 15 nt, Human
uguuuccuucagugc

SEQ ID NO: 2096007 - RNA, 20 nt, Human
uuaaaagaaagccucagaga

SEQ ID NO: 2096008 - RNA, 19 nt, Human
uguuuuuuuuuuccacuua

SEQ ID NO: 2096009 - RNA, 18 nt, Human
uguuuuuuuuuuccacuu

SEQ ID NO: 2096010 - RNA, 17 nt, Human
uguuuuaaggaagaaaa

SEQ ID NO: 2096011 - RNA, 18 nt, Human
uguuuuaaggaagaaaaa

SEQ ID NO: 2096012 - RNA, 22 nt, Human
uguuuuaagaggcagggucuca

SEQ ID NO: 2096013 - RNA, 14 nt, Human
uguuuuguguuguu

SEQ ID NO: 2096014 - RNA, 17 nt, Human
uguuuuguucuuuaaag

SEQ ID NO: 2096015 - RNA, 16 nt, Human
uguuuuuaaaaaucau

SEQ ID NO: 2096016 - RNA, 13 nt, Human
uguuuuguuucug

SEQ ID NO: 2096017 - RNA, 13 nt, Human
uguuuuguuuuaa

SEQ ID NO: 2096018 - RNA, 12 nt, Human
uuaaaagccauc

SEQ ID NO: 2096019 - RNA, 19 nt, Human
uuaaaagccaucauguaaa

SEQ ID NO: 2096020 - RNA, 21 nt, Human
uuaaaagccaucauguaaauu

SEQ ID NO: 2096021 - RNA, 21 nt, Human
uuaaacuguguggacugugau

SEQ ID NO: 2096022 - RNA, 20 nt, Human
uuaaacuguguggacuguga

SEQ ID NO: 2096023 - RNA, 22 nt, Human
uuaaaauagcaacacucuauau

SEQ ID NO: 2096024 - RNA, 22 nt, Human
uuaggccaaaaaaauguaagau

SEQ ID NO: 2096025 - RNA, 18 nt, Human
uuaggcaugcacagcugu

SEQ ID NO: 2096026 - RNA, 15 nt, Human
uuaggcuauucacaa

SEQ ID NO: 2096027 - RNA, 16 nt, Human
uuaggcuauucacaac

SEQ ID NO: 2096028 - RNA, 12 nt, Human
uuaguagcaugu

SEQ ID NO: 2096029 - RNA, 13 nt, Human
uuaguagcauguu

SEQ ID NO: 2096030 - RNA, 17 nt, Human
uuaguagagacaggguu

SEQ ID NO: 2096031 - RNA, 12 nt, Human
uuaggcugggcc

SEQ ID NO: 2096032 - RNA, 14 nt, Human
uuaggcugggccca

SEQ ID NO: 2096033 - RNA, 16 nt, Human
uuaggcugggcccaga

SEQ ID NO: 2096034 - RNA, 17 nt, Human
uuaggcugggcccagag

SEQ ID NO: 2096035 - RNA, 13 nt, Human
uuaggcagcagcu

SEQ ID NO: 2096036 - RNA, 23 nt, Human
uuaggcagcagcuuuuaauacag

SEQ ID NO: 2096037 - RNA, 14 nt, Human
uuaggcagggaagu

SEQ ID NO: 2096038 - RNA, 15 nt, Human
uuaggcagauugaaa

SEQ ID NO: 2096039 - RNA, 21 nt, Human
uuaggaguucgagaccagccu

SEQ ID NO: 2096040 - RNA, 15 nt, Human
uuaggacuugcccuc

SEQ ID NO: 2096041 - RNA, 21 nt, Human
uuaggagagaagguagggguu

SEQ ID NO: 2096042 - RNA, 15 nt, Human
uuaggaagagaaacc

SEQ ID NO: 2096043 - RNA, 13 nt, Human
uuaggaaguguaa

SEQ ID NO: 2096044 - RNA, 19 nt, Human
uuaggaaguguaacagcug

SEQ ID NO: 2096045 - RNA, 20 nt, Human
uuaggaaguguaacagcuga

SEQ ID NO: 2096046 - RNA, 21 nt, Human
uuaggaaguguaacagcugag

SEQ ID NO: 2096047 - RNA, 15 nt, Human
uuaguaucuaacaug

SEQ ID NO: 2096048 - RNA, 19 nt, Human
uuaguauauuuauauaauu

SEQ ID NO: 2096049 - RNA, 20 nt, Human
uuaguauauuuauauaauua

SEQ ID NO: 2096050 - RNA, 17 nt, Human
uuaguaucuaacaugua

SEQ ID NO: 2096051 - RNA, 18 nt, Human
uuaguaucuaacauguau

SEQ ID NO: 2096052 - RNA, 23 nt, Human
uuaguaucuaacauguaucccaa

SEQ ID NO: 2096053 - RNA, 15 nt, Human
uuagucauuuugcuu

SEQ ID NO: 2096054 - RNA, 22 nt, Human
uuaguauuuauuuaauguuaug

SEQ ID NO: 2096055 - RNA, 13 nt, Human
uuaguauuugcau

SEQ ID NO: 2096056 - RNA, 16 nt, Human
uuaguauuugcauauu

SEQ ID NO: 2096057 - RNA, 14 nt, Human
uuagucauagaaga

SEQ ID NO: 2096058 - RNA, 15 nt, Human
uuagucauagaagaa

SEQ ID NO: 2096059 - RNA, 16 nt, Human
uuagucauagaagaac

SEQ ID NO: 2096060 - RNA, 21 nt, Human
uuaguguuuggguauauucau

SEQ ID NO: 2096061 - RNA, 16 nt, Human
uuagcugugugaaaua

SEQ ID NO: 2096062 - RNA, 16 nt, Human
uuagcuguuauuucua

SEQ ID NO: 2096063 - RNA, 17 nt, Human
uuagcuguuauuucuau

SEQ ID NO: 2096064 - RNA, 19 nt, Human
uuagcuguuauuucuauuu

SEQ ID NO: 2096065 - RNA, 21 nt, Human
uuagcuguuauuucuauuuuu

SEQ ID NO: 2096066 - RNA, 16 nt, Human
uuagcuuagaccucag

SEQ ID NO: 2096067 - RNA, 17 nt, Human
uuagcuuagaccucagc

SEQ ID NO: 2096068 - RNA, 18 nt, Human
uuagcuuagaccucagcc

SEQ ID NO: 2096069 - RNA, 21 nt, Human
uuagcuuagaccucagccugu

SEQ ID NO: 2096070 - RNA, 17 nt, Human
uuagcuuuacuguuugu

SEQ ID NO: 2096071 - RNA, 15 nt, Human
uuagcuuuacuguuu

SEQ ID NO: 2096072 - RNA, 16 nt, Human
uuagcuuuacuguuug

SEQ ID NO: 2096073 - RNA, 15 nt, Human
uuagcuuaucaauuu

SEQ ID NO: 2096074 - RNA, 17 nt, Human
uuagcuuaucaauuugu

SEQ ID NO: 2096075 - RNA, 19 nt, Human
uuagcuuaucaauuuguca

SEQ ID NO: 2096076 - RNA, 21 nt, Human
uuagcuugaaggaucuguuuu

SEQ ID NO: 2096077 - RNA, 17 nt, Human
uuagcuugcaccuuguc

SEQ ID NO: 2096078 - RNA, 11 nt, Human
uuaggaaauaa

SEQ ID NO: 2096079 - RNA, 12 nt, Human
uuaggaaauaaa

SEQ ID NO: 2096080 - RNA, 20 nt, Human
uuaggaaauaaaaccuuuca

SEQ ID NO: 2096081 - RNA, 21 nt, Human
uuaggaaauaaaaccuuucaa

SEQ ID NO: 2096082 - RNA, 15 nt, Human
uuaggaaauaaaacc

SEQ ID NO: 2096083 - RNA, 17 nt, Human
uuaggaaauaaaaccuu

SEQ ID NO: 2096084 - RNA, 18 nt, Human
uuaggaaauaaaaccuuu

SEQ ID NO: 2096085 - RNA, 19 nt, Human
uuaggaaauaaaaccuuuc

SEQ ID NO: 2096086 - RNA, 10 nt, Human
uuagcugugc

SEQ ID NO: 2096087 - RNA, 15 nt, Human
uuagcugugugaaau

SEQ ID NO: 2096088 - RNA, 12 nt, Human
uuagcucagccc

SEQ ID NO: 2096089 - RNA, 13 nt, Human
uuagcucagcccc

SEQ ID NO: 2096090 - RNA, 19 nt, Human
uuagcucagccccagccca

SEQ ID NO: 2096091 - RNA, 13 nt, Human
uuagcugcagaac

SEQ ID NO: 2096092 - RNA, 15 nt, Human
uuagcugccaagccc

SEQ ID NO: 2096093 - RNA, 17 nt, Human
uuagcugccaagcccca

SEQ ID NO: 2096094 - RNA, 22 nt, Human
uuagcugccaagccccauccug

SEQ ID NO: 2096095 - RNA, 16 nt, Human
uuagauaucuuuuuau

SEQ ID NO: 2096096 - RNA, 23 nt, Human
uuagauaucuuuuuauugaugug

SEQ ID NO: 2096097 - RNA, 21 nt, Human
uuagcguagcuaagugaaaag

SEQ ID NO: 2096098 - RNA, 17 nt, Human
uuagaggaaaaaaauga

SEQ ID NO: 2096099 - RNA, 18 nt, Human
uuagaggaaaaaaaugac

SEQ ID NO: 2096100 - RNA, 19 nt, Human
uuagaggaaaaaaaugacu

SEQ ID NO: 2096101 - RNA, 12 nt, Human
uuagaggccagc

SEQ ID NO: 2096102 - RNA, 15 nt, Human
uuagagauaagaguu

SEQ ID NO: 2096103 - RNA, 13 nt, Human
uuagagaugaauu

SEQ ID NO: 2096104 - RNA, 21 nt, Human
uuagagcagaugaccccuccc

SEQ ID NO: 2096105 - RNA, 14 nt, Human
uuagagucagccuu

SEQ ID NO: 2096106 - RNA, 11 nt, Human
uuacuuuguau

SEQ ID NO: 2096107 - RNA, 12 nt, Human
uuacuuuguaug

SEQ ID NO: 2096108 - RNA, 13 nt, Human
uuacuuuguauga

SEQ ID NO: 2096109 - RNA, 15 nt, Human
uuacuuuguaugaua

SEQ ID NO: 2096110 - RNA, 18 nt, Human
uuacuuucuguugccaca

SEQ ID NO: 2096111 - RNA, 11 nt, Human
uuacuuucugu

SEQ ID NO: 2096112 - RNA, 19 nt, Human
uuacuugcauugaauauau

SEQ ID NO: 2096113 - RNA, 18 nt, Human
uuacuuuaaaaggagcca

SEQ ID NO: 2096114 - RNA, 17 nt, Human
uuacuuuaaaaggagcc

SEQ ID NO: 2096115 - RNA, 14 nt, Human
uuacuuuguguuca

SEQ ID NO: 2096116 - RNA, 16 nt, Human
uuagaccucagccugu

SEQ ID NO: 2096117 - RNA, 14 nt, Human
uuagaccucagccu

SEQ ID NO: 2096118 - RNA, 15 nt, Human
uuagaccucagccug

SEQ ID NO: 2096119 - RNA, 11 nt, Human
uuagaccucag

SEQ ID NO: 2096120 - RNA, 12 nt, Human
uuagaccucagc

SEQ ID NO: 2096121 - RNA, 13 nt, Human
uuagaccucagcc

SEQ ID NO: 2096122 - RNA, 17 nt, Human
uuagacuugaaauacua

SEQ ID NO: 2096123 - RNA, 18 nt, Human
uuagacuuuagaaauaaa

SEQ ID NO: 2096124 - RNA, 20 nt, Human
uuagagacaggguccugcua

SEQ ID NO: 2096125 - RNA, 21 nt, Human
uuacuuaaaccgccaaggcug

SEQ ID NO: 2096126 - RNA, 18 nt, Human
uuacuuagguguggggga

SEQ ID NO: 2096127 - RNA, 18 nt, Human
uuacuuauuaucuucagg

SEQ ID NO: 2096128 - RNA, 14 nt, Human
uuacuuacagcaua

SEQ ID NO: 2096129 - RNA, 14 nt, Human
uuacuuagcaaugu

SEQ ID NO: 2096130 - RNA, 13 nt, Human
uuacuuagcaugc

SEQ ID NO: 2096131 - RNA, 15 nt, Human
uuacuuagcuuauca

SEQ ID NO: 2096132 - RNA, 19 nt, Human
uuacuuagcuuaucaauuu

SEQ ID NO: 2096133 - RNA, 21 nt, Human
uuacuuagcuuaucaauuugu

SEQ ID NO: 2096134 - RNA, 15 nt, Human
uuacuguuuguuaug

SEQ ID NO: 2096135 - RNA, 12 nt, Human
uuacuucugcua

SEQ ID NO: 2096136 - RNA, 23 nt, Human
uuacuucuuauacauuugauaaa

SEQ ID NO: 2096137 - RNA, 11 nt, Human
uuacuucugcu

SEQ ID NO: 2096138 - RNA, 15 nt, Human
uuacuuccuaucaag

SEQ ID NO: 2096139 - RNA, 14 nt, Human
uuacuacaaaauuu

SEQ ID NO: 2096140 - RNA, 20 nt, Human
uuacuacaaaauuugaaauu

SEQ ID NO: 2096141 - RNA, 15 nt, Human
uuacuacaguuguuu

SEQ ID NO: 2096142 - RNA, 13 nt, Human
uuacuacaguugu

SEQ ID NO: 2096143 - RNA, 18 nt, Human
uuacuacaugugggagcu

SEQ ID NO: 2096144 - RNA, 13 nt, Human
uuacuacugugga

SEQ ID NO: 2096145 - RNA, 19 nt, Human
uuacuaucaugucaaacgu

SEQ ID NO: 2096146 - RNA, 21 nt, Human
uuacuaucaugucaaacguga

SEQ ID NO: 2096147 - RNA, 22 nt, Human
uuacuauccuggcuuugcccaa

SEQ ID NO: 2096148 - RNA, 16 nt, Human
uuacuaugcacaauuu

SEQ ID NO: 2096149 - RNA, 19 nt, Human
uuacacaaauacuuauuca

SEQ ID NO: 2096150 - RNA, 15 nt, Human
uucuaaagauggaaa

SEQ ID NO: 2096151 - RNA, 11 nt, Human
uucguuuguuu

SEQ ID NO: 2096152 - RNA, 15 nt, Human
uucguuuguuuguuu

SEQ ID NO: 2096153 - RNA, 18 nt, Human
uucguuuguuuguuuugu

SEQ ID NO: 2096154 - RNA, 12 nt, Human
uucguuuugguu

SEQ ID NO: 2096155 - RNA, 22 nt, Human
uucguuuugguuaaguuggcuu

SEQ ID NO: 2096156 - RNA, 13 nt, Human
uucuaaaaaacag

SEQ ID NO: 2096157 - RNA, 19 nt, Human
uuccuggagagucucacuc

SEQ ID NO: 2096158 - RNA, 17 nt, Human
uucguucuuguuaguac

SEQ ID NO: 2096159 - RNA, 15 nt, Human
uucguucuuguucug

SEQ ID NO: 2096160 - RNA, 20 nt, Human
uucguucuuguucuguuuug

SEQ ID NO: 2096161 - RNA, 14 nt, Human
uucgggcccugccu

SEQ ID NO: 2096162 - RNA, 20 nt, Human
uucgggaggucgaggcagga

SEQ ID NO: 2096163 - RNA, 18 nt, Human
uuccuuggcaugccuucc

SEQ ID NO: 2096164 - RNA, 21 nt, Human
uuccuuggcaugccuuccagc

SEQ ID NO: 2096165 - RNA, 17 nt, Human
uuccuuggggcaggcag

SEQ ID NO: 2096166 - RNA, 18 nt, Human
uuccuuggggcaggcagu

SEQ ID NO: 2096167 - RNA, 14 nt, Human
uuccuuggggcagg

SEQ ID NO: 2096168 - RNA, 15 nt, Human
uuccuuggggcaggc

SEQ ID NO: 2096169 - RNA, 18 nt, Human
uuccuggcaauagugugu

SEQ ID NO: 2096170 - RNA, 20 nt, Human
uuccuggcaauaguguguuc

SEQ ID NO: 2096171 - RNA, 22 nt, Human
uuccuggcaauaguguguucug

SEQ ID NO: 2096172 - RNA, 23 nt, Human
uuccuggcaauaguguguucuga

SEQ ID NO: 2096173 - RNA, 20 nt, Human
uuccuugaguugauucagcu

SEQ ID NO: 2096174 - RNA, 17 nt, Human
uuccuugagaaaaacaa

SEQ ID NO: 2096175 - RNA, 13 nt, Human
uuccuugaccagc

SEQ ID NO: 2096176 - RNA, 15 nt, Human
uuccuugaccagcag

SEQ ID NO: 2096177 - RNA, 15 nt, Human
uuccuggcaauagug

SEQ ID NO: 2096178 - RNA, 13 nt, Human
uuccuggagcccg

SEQ ID NO: 2096179 - RNA, 14 nt, Human
uuccuggagcccga

SEQ ID NO: 2096180 - RNA, 20 nt, Human
uuccuggagcccgaggcacc

SEQ ID NO: 2096181 - RNA, 17 nt, Human
uuccugccaggcauggu

SEQ ID NO: 2096182 - RNA, 13 nt, Human
uuccugaugaccc

SEQ ID NO: 2096183 - RNA, 15 nt, Human
uuccugaugacccag

SEQ ID NO: 2096184 - RNA, 16 nt, Human
uuccugaugacccagg

SEQ ID NO: 2096185 - RNA, 17 nt, Human
uuccugaugacccaggc

SEQ ID NO: 2096186 - RNA, 18 nt, Human
uuccugaugacccaggcu

SEQ ID NO: 2096187 - RNA, 21 nt, Human
uuccugaugacccaggcugcc

SEQ ID NO: 2096188 - RNA, 14 nt, Human
uuccuccccagcag

SEQ ID NO: 2096189 - RNA, 18 nt, Human
uuccugcauuugugaaau

SEQ ID NO: 2096190 - RNA, 16 nt, Human
uuccugcauuugugaa

SEQ ID NO: 2096191 - RNA, 15 nt, Human
uuccugcauuuguga

SEQ ID NO: 2096192 - RNA, 11 nt, Human
uuccuccccag

SEQ ID NO: 2096193 - RNA, 12 nt, Human
uuccuccccagc

SEQ ID NO: 2096194 - RNA, 13 nt, Human
uuccuccccagca

SEQ ID NO: 2096195 - RNA, 21 nt, Human
uuccuccccauuagagucagc

SEQ ID NO: 2096196 - RNA, 23 nt, Human
uuccuccccauuagagucagccu

SEQ ID NO: 2096197 - RNA, 14 nt, Human
uuccuaucccaucc

SEQ ID NO: 2096198 - RNA, 15 nt, Human
uuccuaucccauccc

SEQ ID NO: 2096199 - RNA, 16 nt, Human
uuccuaucccauccca

SEQ ID NO: 2096200 - RNA, 17 nt, Human
uuccuaucccaucccau

SEQ ID NO: 2096201 - RNA, 18 nt, Human
uuccuaucccaucccauc

SEQ ID NO: 2096202 - RNA, 21 nt, Human
uuccuauauaguuuauugaca

SEQ ID NO: 2096203 - RNA, 22 nt, Human
uuccuauauaguuuauugacaa

SEQ ID NO: 2096204 - RNA, 19 nt, Human
uuccuauauaguuuauuga

SEQ ID NO: 2096205 - RNA, 16 nt, Human
uucccuuugcuccacc

SEQ ID NO: 2096206 - RNA, 17 nt, Human
uucccuuugcuccaccc

SEQ ID NO: 2096207 - RNA, 18 nt, Human
uucccuuugcuccacccc

SEQ ID NO: 2096208 - RNA, 20 nt, Human
uuccuauaauauaauaaaua

SEQ ID NO: 2096209 - RNA, 15 nt, Human
uucccuugagcccuc

SEQ ID NO: 2096210 - RNA, 14 nt, Human
uucccuugagcccu

SEQ ID NO: 2096211 - RNA, 14 nt, Human
uuccuauguaacug

SEQ ID NO: 2096212 - RNA, 15 nt, Human
uuccuauuucuuaua

SEQ ID NO: 2096213 - RNA, 16 nt, Human
uuccucauuccugaaa

SEQ ID NO: 2096214 - RNA, 13 nt, Human
uuccucauuagca

SEQ ID NO: 2096215 - RNA, 21 nt, Human
uuccucacaccaggcuugccu

SEQ ID NO: 2096216 - RNA, 19 nt, Human
uucccccuccaaucccacc

SEQ ID NO: 2096217 - RNA, 15 nt, Human
uucccuccugcuacu

SEQ ID NO: 2096218 - RNA, 14 nt, Human
uucccucucccugu

SEQ ID NO: 2096219 - RNA, 13 nt, Human
uucccucugccug

SEQ ID NO: 2096220 - RNA, 14 nt, Human
uucccucugccugu

SEQ ID NO: 2096221 - RNA, 17 nt, Human
uucccucugccuguccc

SEQ ID NO: 2096222 - RNA, 18 nt, Human
uucccucugccugucccu

SEQ ID NO: 2096223 - RNA, 20 nt, Human
uucccugaaaacccagagag

SEQ ID NO: 2096224 - RNA, 15 nt, Human
uucccugaauguauu

SEQ ID NO: 2096225 - RNA, 21 nt, Human
uucccucugccugucccucuc

SEQ ID NO: 2096226 - RNA, 17 nt, Human
uucccugaaaacccaga

SEQ ID NO: 2096227 - RNA, 19 nt, Human
uucccugaaaacccagaga

SEQ ID NO: 2096228 - RNA, 23 nt, Human
uucccugaaaaccucacaugcau

SEQ ID NO: 2096229 - RNA, 23 nt, Human
uucccuggcuuguaacuccacca

SEQ ID NO: 2096230 - RNA, 17 nt, Human
uucccuucuccuuccaa

SEQ ID NO: 2096231 - RNA, 20 nt, Human
uucccuucuccuuccaacug

SEQ ID NO: 2096232 - RNA, 17 nt, Human
uucccugcuuaaugaaa

SEQ ID NO: 2096233 - RNA, 16 nt, Human
uucccugagucaccag

SEQ ID NO: 2096234 - RNA, 18 nt, Human
uucccugagucaccagga

SEQ ID NO: 2096235 - RNA, 19 nt, Human
uucccugagucaccaggaa

SEQ ID NO: 2096236 - RNA, 10 nt, Human
uucccugcaa

SEQ ID NO: 2096237 - RNA, 11 nt, Human
uucccuggacc

SEQ ID NO: 2096238 - RNA, 12 nt, Human
uucccuggacca

SEQ ID NO: 2096239 - RNA, 19 nt, Human
uucccuggaccagaugcug

SEQ ID NO: 2096240 - RNA, 18 nt, Human
uuccacucaggucuguuu

SEQ ID NO: 2096241 - RNA, 15 nt, Human
uuccacuacugcuac

SEQ ID NO: 2096242 - RNA, 20 nt, Human
uuccagaugccuucuccaga

SEQ ID NO: 2096243 - RNA, 21 nt, Human
uuccagagaguggcuccuccc

SEQ ID NO: 2096244 - RNA, 20 nt, Human
uuccagagaguggcuccucc

SEQ ID NO: 2096245 - RNA, 19 nt, Human
uuccagagaguggcuccuc

SEQ ID NO: 2096246 - RNA, 18 nt, Human
uuccagagaguggcuccu

SEQ ID NO: 2096247 - RNA, 17 nt, Human
uuccagagaguggcucc

SEQ ID NO: 2096248 - RNA, 23 nt, Human
uuccaaauucacaaguuguguuu

SEQ ID NO: 2096249 - RNA, 15 nt, Human
uuccaaauucacaag

SEQ ID NO: 2096250 - RNA, 15 nt, Human
uuccaaauucugcuu

SEQ ID NO: 2096251 - RNA, 16 nt, Human
uucauuugaugcuaaa

SEQ ID NO: 2096252 - RNA, 13 nt, Human
uucauuucugaua

SEQ ID NO: 2096253 - RNA, 19 nt, Human
uucauuucugauauagaau

SEQ ID NO: 2096254 - RNA, 16 nt, Human
uucauuuccugugucu

SEQ ID NO: 2096255 - RNA, 15 nt, Human
uucauuuccuguguc

SEQ ID NO: 2096256 - RNA, 14 nt, Human
uucaugcaaugaca

SEQ ID NO: 2096257 - RNA, 20 nt, Human
uucaugcaaggggaaaaucu

SEQ ID NO: 2096258 - RNA, 15 nt, Human
uucaugcaaugacau

SEQ ID NO: 2096259 - RNA, 21 nt, Human
uucaugcaaugacaucuucaa

SEQ ID NO: 2096260 - RNA, 16 nt, Human
uucaggaaccuggacc

SEQ ID NO: 2096261 - RNA, 17 nt, Human
uucaggaaccuggacca

SEQ ID NO: 2096262 - RNA, 22 nt, Human
uucaggaaccuggaccaaagcu

SEQ ID NO: 2096263 - RNA, 23 nt, Human
uucaggaaccuggaccaaagcug

SEQ ID NO: 2096264 - RNA, 22 nt, Human
uucaucuuggucacauacaauu

SEQ ID NO: 2096265 - RNA, 17 nt, Human
uucaugaaaauccuacc

SEQ ID NO: 2096266 - RNA, 18 nt, Human
uucaugaaaauccuacca

SEQ ID NO: 2096267 - RNA, 15 nt, Human
uuccaugugcccagu

SEQ ID NO: 2096268 - RNA, 17 nt, Human
uuccaugugcccaguua

SEQ ID NO: 2096269 - RNA, 16 nt, Human
uuccaugugcccaguu

SEQ ID NO: 2096270 - RNA, 14 nt, Human
uuccauuaugauuc

SEQ ID NO: 2096271 - RNA, 15 nt, Human
uuccauuaugauucu

SEQ ID NO: 2096272 - RNA, 16 nt, Human
uuccauuaugauucuu

SEQ ID NO: 2096273 - RNA, 11 nt, Human
uucccauaauu

SEQ ID NO: 2096274 - RNA, 15 nt, Human
uucccauaauuuucu

SEQ ID NO: 2096275 - RNA, 16 nt, Human
uucccauaauuuucuu

SEQ ID NO: 2096276 - RNA, 18 nt, Human
uucccauaauuuucuuca

SEQ ID NO: 2096277 - RNA, 23 nt, Human
uucccaucacuggagcaccaggc

SEQ ID NO: 2096278 - RNA, 13 nt, Human
uucccauguuaaa

SEQ ID NO: 2096279 - RNA, 18 nt, Human
uucccauugaaaauguaa

SEQ ID NO: 2096280 - RNA, 14 nt, Human
uucccauucuugca

SEQ ID NO: 2096281 - RNA, 11 nt, Human
uucccucccuu

SEQ ID NO: 2096282 - RNA, 18 nt, Human
uuccccccacucucccca

SEQ ID NO: 2096283 - RNA, 19 nt, Human
uuccccccacucuccccac

SEQ ID NO: 2096284 - RNA, 21 nt, Human
uuccccccacucuccccacac

SEQ ID NO: 2096285 - RNA, 17 nt, Human
uucccucccuuccucuu

SEQ ID NO: 2096286 - RNA, 20 nt, Human
uucccucccuuccucuuucc

SEQ ID NO: 2096287 - RNA, 14 nt, Human
uucccccaaagugg

SEQ ID NO: 2096288 - RNA, 18 nt, Human
uucccccaccagcuaagg

SEQ ID NO: 2096289 - RNA, 13 nt, Human
uucccccagcccu

SEQ ID NO: 2096290 - RNA, 14 nt, Human
uucccccagcccug

SEQ ID NO: 2096291 - RNA, 15 nt, Human
uucccccagcccugu

SEQ ID NO: 2096292 - RNA, 20 nt, Human
uucccccagcccuguggaag

SEQ ID NO: 2096293 - RNA, 14 nt, Human
uucccccauagcca

SEQ ID NO: 2096294 - RNA, 12 nt, Human
uuccccccacuc

SEQ ID NO: 2096295 - RNA, 18 nt, Human
uucccccauagccacccc

SEQ ID NO: 2096296 - RNA, 15 nt, Human
uucccccauagccac

SEQ ID NO: 2096297 - RNA, 17 nt, Human
uucccccauagccaccc

SEQ ID NO: 2096298 - RNA, 11 nt, Human
uuccccauggg

SEQ ID NO: 2096299 - RNA, 16 nt, Human
uuccccauacucuguc

SEQ ID NO: 2096300 - RNA, 19 nt, Human
uuauugcagcgauuaauaa

SEQ ID NO: 2096301 - RNA, 12 nt, Human
uuauugcacaaa

SEQ ID NO: 2096302 - RNA, 15 nt, Human
uuauugcccacgcug

SEQ ID NO: 2096303 - RNA, 13 nt, Human
uuauugcauuaua

SEQ ID NO: 2096304 - RNA, 13 nt, Human
uuauugagaauuu

SEQ ID NO: 2096305 - RNA, 19 nt, Human
uuauugagaauuuuaaauu

SEQ ID NO: 2096306 - RNA, 14 nt, Human
uuauucuugugaau

SEQ ID NO: 2096307 - RNA, 11 nt, Human
uuauucugcuc

SEQ ID NO: 2096308 - RNA, 22 nt, Human
uuauugacaauaauuucagguu

SEQ ID NO: 2096309 - RNA, 14 nt, Human
uuauugacaauaau

SEQ ID NO: 2096310 - RNA, 18 nt, Human
uuauugacaauaauuuca

SEQ ID NO: 2096311 - RNA, 23 nt, Human
uuauuacagggcauucaaauggg

SEQ ID NO: 2096312 - RNA, 13 nt, Human
uuauucuagauua

SEQ ID NO: 2096313 - RNA, 14 nt, Human
uuauucucaaagca

SEQ ID NO: 2096314 - RNA, 15 nt, Human
uuauucucaaagcag

SEQ ID NO: 2096315 - RNA, 16 nt, Human
uuauucucaaagcagg

SEQ ID NO: 2096316 - RNA, 17 nt, Human
uuauucucacuccacca

SEQ ID NO: 2096317 - RNA, 12 nt, Human
uuauuaauuuga

SEQ ID NO: 2096318 - RNA, 15 nt, Human
uuauuaaugcuaagg

SEQ ID NO: 2096319 - RNA, 16 nt, Human
uuauuaaugcuaaggg

SEQ ID NO: 2096320 - RNA, 13 nt, Human
uuauuaaugcuaa

SEQ ID NO: 2096321 - RNA, 14 nt, Human
uuauuaaugcuaag

SEQ ID NO: 2096322 - RNA, 11 nt, Human
uuauggccuca

SEQ ID NO: 2096323 - RNA, 12 nt, Human
uuauggccucag

SEQ ID NO: 2096324 - RNA, 13 nt, Human
uuauggccucagc

SEQ ID NO: 2096325 - RNA, 15 nt, Human
uuauggccucagcug

SEQ ID NO: 2096326 - RNA, 18 nt, Human
uuauggccucagcugccu

SEQ ID NO: 2096327 - RNA, 12 nt, Human
uuauuaaaaucu

SEQ ID NO: 2096328 - RNA, 16 nt, Human
uuauuaaaaucuuaaa

SEQ ID NO: 2096329 - RNA, 14 nt, Human
uuaugcauagauaa

SEQ ID NO: 2096330 - RNA, 20 nt, Human
uuaugcagcuuccuuuugag

SEQ ID NO: 2096331 - RNA, 23 nt, Human
uuaugcaggggcaaacaccugcu

SEQ ID NO: 2096332 - RNA, 15 nt, Human
uuaucuuuguaauua

SEQ ID NO: 2096333 - RNA, 17 nt, Human
uuaucuuuucuacagca

SEQ ID NO: 2096334 - RNA, 12 nt, Human
uuaucuuuugag

SEQ ID NO: 2096335 - RNA, 17 nt, Human
uuaugcaaauucccaga

SEQ ID NO: 2096336 - RNA, 17 nt, Human
uuaugcaaggaaggaaa

SEQ ID NO: 2096337 - RNA, 18 nt, Human
uuaugcaaggaaggaaag

SEQ ID NO: 2096338 - RNA, 22 nt, Human
uuaugcaaggaaggaaagaaag

SEQ ID NO: 2096339 - RNA, 16 nt, Human
uuaucuuggacugaca

SEQ ID NO: 2096340 - RNA, 17 nt, Human
uuaucuuggacugacau

SEQ ID NO: 2096341 - RNA, 17 nt, Human
uuaucuugucucugggc

SEQ ID NO: 2096342 - RNA, 16 nt, Human
uuaucuugucucuggg

SEQ ID NO: 2096343 - RNA, 16 nt, Human
uuaugcuguauuuucu

SEQ ID NO: 2096344 - RNA, 21 nt, Human
uuaugcuguauuuucuuuuua

SEQ ID NO: 2096345 - RNA, 17 nt, Human
uuaugcauaacugacaa

SEQ ID NO: 2096346 - RNA, 18 nt, Human
uuaugccauuuguuuauu

SEQ ID NO: 2096347 - RNA, 15 nt, Human
uuaugccuuuuauuu

SEQ ID NO: 2096348 - RNA, 14 nt, Human
uuaugcucaggguc

SEQ ID NO: 2096349 - RNA, 13 nt, Human
uuaguugcuguau

SEQ ID NO: 2096350 - RNA, 15 nt, Human
uuaguugcuguaugu

SEQ ID NO: 2096351 - RNA, 20 nt, Human
uuaguuguaucucuuuugaa

SEQ ID NO: 2096352 - RNA, 17 nt, Human
uuaguuuacaaucagcc

SEQ ID NO: 2096353 - RNA, 16 nt, Human
uuaguuccucauuagc

SEQ ID NO: 2096354 - RNA, 14 nt, Human
uuaguuccuugagu

SEQ ID NO: 2096355 - RNA, 12 nt, Human
uuaguucuauuu

SEQ ID NO: 2096356 - RNA, 15 nt, Human
uuaguucuuuguuau

SEQ ID NO: 2096357 - RNA, 18 nt, Human
uuaucugugcgugaaaca

SEQ ID NO: 2096358 - RNA, 19 nt, Human
uuaucugugcgugaaacac

SEQ ID NO: 2096359 - RNA, 18 nt, Human
uuaucuguguuuuugaaa

SEQ ID NO: 2096360 - RNA, 14 nt, Human
uuaucuggcuucaa

SEQ ID NO: 2096361 - RNA, 23 nt, Human
uuaucugggauuaugguuuugug

SEQ ID NO: 2096362 - RNA, 18 nt, Human
uuaucugagucaacuccu

SEQ ID NO: 2096363 - RNA, 13 nt, Human
uucacuaaagcag

SEQ ID NO: 2096364 - RNA, 14 nt, Human
uucacuaaagcagu

SEQ ID NO: 2096365 - RNA, 22 nt, Human
uucacgugcagcagcaacacaa

SEQ ID NO: 2096366 - RNA, 23 nt, Human
uucacuacccaucgguguccauu

SEQ ID NO: 2096367 - RNA, 18 nt, Human
uucacggaagagccuugc

SEQ ID NO: 2096368 - RNA, 16 nt, Human
uucaccuugggaugau

SEQ ID NO: 2096369 - RNA, 22 nt, Human
uucaccuugggaugaugccuca

SEQ ID NO: 2096370 - RNA, 11 nt, Human
uucaccuguaa

SEQ ID NO: 2096371 - RNA, 13 nt, Human
uucaccuguaaaa

SEQ ID NO: 2096372 - RNA, 14 nt, Human
uucaccuguaaaac

SEQ ID NO: 2096373 - RNA, 16 nt, Human
uucaccuguaaaacuu

SEQ ID NO: 2096374 - RNA, 17 nt, Human
uucaccuguaaaacuuu

SEQ ID NO: 2096375 - RNA, 21 nt, Human
uucaccuguuuuuaagcuguu

SEQ ID NO: 2096376 - RNA, 19 nt, Human
uucaccuguuuuuaagcug

SEQ ID NO: 2096377 - RNA, 23 nt, Human
uucaccuguuuuuaagcuguuuc

SEQ ID NO: 2096378 - RNA, 22 nt, Human
uucaccuguuuuuaagcuguuu

SEQ ID NO: 2096379 - RNA, 14 nt, Human
uucaccuugaagaa

SEQ ID NO: 2096380 - RNA, 17 nt, Human
uucaauuuccaagagcu

SEQ ID NO: 2096381 - RNA, 19 nt, Human
uucaauuuccaagagcuga

SEQ ID NO: 2096382 - RNA, 17 nt, Human
uucaauuuauucaagaa

SEQ ID NO: 2096383 - RNA, 16 nt, Human
uucaauuuauugcaca

SEQ ID NO: 2096384 - RNA, 17 nt, Human
uucaauuuauugcacaa

SEQ ID NO: 2096385 - RNA, 18 nt, Human
uucaauuuauugcacaaa

SEQ ID NO: 2096386 - RNA, 20 nt, Human
uucaauuuauugcacaaaau

SEQ ID NO: 2096387 - RNA, 15 nt, Human
uucacaaaauuucca

SEQ ID NO: 2096388 - RNA, 12 nt, Human
uucaauuuguuc

SEQ ID NO: 2096389 - RNA, 19 nt, Human
uucaauuuguucagucuuu

SEQ ID NO: 2096390 - RNA, 19 nt, Human
uucaauuuauucaagaaaa

SEQ ID NO: 2096391 - RNA, 16 nt, Human
uucaauuuauucaaga

SEQ ID NO: 2096392 - RNA, 14 nt, Human
uucaacugaaaaga

SEQ ID NO: 2096393 - RNA, 13 nt, Human
uucagagagcugg

SEQ ID NO: 2096394 - RNA, 14 nt, Human
uucagagagcuggu

SEQ ID NO: 2096395 - RNA, 15 nt, Human
uucagagagcuggua

SEQ ID NO: 2096396 - RNA, 22 nt, Human
uucagagccuccuuucuggcuu

SEQ ID NO: 2096397 - RNA, 23 nt, Human
uucacuccggugugccugcagcc

SEQ ID NO: 2096398 - RNA, 24 nt, Human
uucacuccggugugccugcagccc

SEQ ID NO: 2096399 - RNA, 18 nt, Human
uucacuauaaaugguguu

SEQ ID NO: 2096400 - RNA, 20 nt, Human
uucacuauuuuuauuuauau

SEQ ID NO: 2096401 - RNA, 13 nt, Human
uucacuccagccu

SEQ ID NO: 2096402 - RNA, 21 nt, Human
uucacuccggugugccugcag

SEQ ID NO: 2096403 - RNA, 22 nt, Human
uucacuccggugugccugcagc

SEQ ID NO: 2096404 - RNA, 17 nt, Human
uuauuguaccucucuua

SEQ ID NO: 2096405 - RNA, 15 nt, Human
uuauuguaccucucu

SEQ ID NO: 2096406 - RNA, 21 nt, Human
uuauuguacguuuaaagugua

SEQ ID NO: 2096407 - RNA, 12 nt, Human
uuauugcuguug

SEQ ID NO: 2096408 - RNA, 22 nt, Human
uuauuggaauuaaccuggugcu

SEQ ID NO: 2096409 - RNA, 23 nt, Human
uuauugcuugauacuuuugacaa

SEQ ID NO: 2096410 - RNA, 13 nt, Human
uuauuggaauuaa

SEQ ID NO: 2096411 - RNA, 14 nt, Human
uuauuguaccucuc

SEQ ID NO: 2096412 - RNA, 12 nt, Human
uuauuguaccuc

SEQ ID NO: 2096413 - RNA, 16 nt, Human
uuauuggaauuaaccu

SEQ ID NO: 2096414 - RNA, 19 nt, Human
uucaacgcagcccugcuuu

SEQ ID NO: 2096415 - RNA, 16 nt, Human
uucaacgcagcccugc

SEQ ID NO: 2096416 - RNA, 20 nt, Human
uucaacgcagcccugcuuug

SEQ ID NO: 2096417 - RNA, 17 nt, Human
uucaacugaccagccuc

SEQ ID NO: 2096418 - RNA, 12 nt, Human
uuauuuuagcag

SEQ ID NO: 2096419 - RNA, 16 nt, Human
uuauuuuagcaguucu

SEQ ID NO: 2096420 - RNA, 20 nt, Human
uuauuuuagcaguucugcaa

SEQ ID NO: 2096421 - RNA, 21 nt, Human
uuauuuuagcaguucugcaaa

SEQ ID NO: 2096422 - RNA, 12 nt, Human
uuauuuuaaauu

SEQ ID NO: 2096423 - RNA, 14 nt, Human
uuauuuuaaauuau

SEQ ID NO: 2096424 - RNA, 21 nt, Human
uuauuuuaaauuauaaggacu

SEQ ID NO: 2096425 - RNA, 22 nt, Human
uuauuuuaaauuauaaggacug

SEQ ID NO: 2096426 - RNA, 23 nt, Human
uuauuuuaaauuauaaggacugc

SEQ ID NO: 2096427 - RNA, 16 nt, Human
uucaaagcuugaagau

SEQ ID NO: 2096428 - RNA, 11 nt, Human
uucaaagcuga

SEQ ID NO: 2096429 - RNA, 21 nt, Human
uuugaggguguauauuuucug

SEQ ID NO: 2096430 - RNA, 20 nt, Human
uuugaggucaaguaagaaga

SEQ ID NO: 2096431 - RNA, 23 nt, Human
uuugaggucaaguaagaagacau

SEQ ID NO: 2096432 - RNA, 15 nt, Human
uuugaggcugcagcg

SEQ ID NO: 2096433 - RNA, 23 nt, Human
uuugagggacaaauuuaaaacaa

SEQ ID NO: 2096434 - RNA, 16 nt, Human
uuugagaucagccugg

SEQ ID NO: 2096435 - RNA, 17 nt, Human
uuugagaucagccuggg

SEQ ID NO: 2096436 - RNA, 17 nt, Human
uuugaauauaaacacua

SEQ ID NO: 2096437 - RNA, 18 nt, Human
uuugaauauaaacacuau

SEQ ID NO: 2096438 - RNA, 19 nt, Human
uuugaauauaaacacuaua

SEQ ID NO: 2096439 - RNA, 20 nt, Human
uuucuuguuuaucagcaguu

SEQ ID NO: 2096440 - RNA, 14 nt, Human
uuugaaccaaaaca

SEQ ID NO: 2096441 - RNA, 16 nt, Human
uuugaaccaaaacauu

SEQ ID NO: 2096442 - RNA, 22 nt, Human
uuugaacaacuaggcuucagca

SEQ ID NO: 2096443 - RNA, 15 nt, Human
uuugaacuaauaaaa

SEQ ID NO: 2096444 - RNA, 16 nt, Human
uuugaagcuaauuauu

SEQ ID NO: 2096445 - RNA, 18 nt, Human
uuugaagcuaauuauuuu

SEQ ID NO: 2096446 - RNA, 19 nt, Human
uuugaagcuaauuauuuua

SEQ ID NO: 2096447 - RNA, 23 nt, Human
uuugaagcuaauuauuuuaauua

SEQ ID NO: 2096448 - RNA, 21 nt, Human
uuucuugcugguugucauuuu

SEQ ID NO: 2096449 - RNA, 11 nt, Human
uuucuugcugg

SEQ ID NO: 2096450 - RNA, 23 nt, Human
uuucugaucugaugcaagcaaga

SEQ ID NO: 2096451 - RNA, 14 nt, Human
uuucugauauagaa

SEQ ID NO: 2096452 - RNA, 15 nt, Human
uuucuuaaaugggcu

SEQ ID NO: 2096453 - RNA, 15 nt, Human
uuuggguuaaaaaaa

SEQ ID NO: 2096454 - RNA, 11 nt, Human
uuuggguuucu

SEQ ID NO: 2096455 - RNA, 16 nt, Human
uuuggguuucugcccu

SEQ ID NO: 2096456 - RNA, 14 nt, Human
uuugguucuggggc

SEQ ID NO: 2096457 - RNA, 13 nt, Human
uuugguucugggg

SEQ ID NO: 2096458 - RNA, 13 nt, Human
uuugguucuaaua

SEQ ID NO: 2096459 - RNA, 21 nt, Human
uuuguaaaggugaaaaaagcu

SEQ ID NO: 2096460 - RNA, 16 nt, Human
uuuguaugcacuuugu

SEQ ID NO: 2096461 - RNA, 22 nt, Human
uuuguaugccaagugagaagau

SEQ ID NO: 2096462 - RNA, 22 nt, Human
uuuguauguugugaagauguuu

SEQ ID NO: 2096463 - RNA, 14 nt, Human
uuuguaaauaagag

SEQ ID NO: 2096464 - RNA, 15 nt, Human
uuuguaaauaagaga

SEQ ID NO: 2096465 - RNA, 17 nt, Human
uuuguaaauaagagauu

SEQ ID NO: 2096466 - RNA, 22 nt, Human
uuuguaaauaagagauuuggag

SEQ ID NO: 2096467 - RNA, 16 nt, Human
uuugcuucucucucua

SEQ ID NO: 2096468 - RNA, 22 nt, Human
uuugcuucuucccuuaaaauuu

SEQ ID NO: 2096469 - RNA, 14 nt, Human
uuugcuugaacaca

SEQ ID NO: 2096470 - RNA, 16 nt, Human
uuugcuugaacacagu

SEQ ID NO: 2096471 - RNA, 17 nt, Human
uuugcuugaacacagua

SEQ ID NO: 2096472 - RNA, 19 nt, Human
uuugcuugaacacaguauu

SEQ ID NO: 2096473 - RNA, 16 nt, Human
uuuggacgcacacagc

SEQ ID NO: 2096474 - RNA, 17 nt, Human
uuuggacgcacacagcu

SEQ ID NO: 2096475 - RNA, 19 nt, Human
uuuggagacucuguggggc

SEQ ID NO: 2096476 - RNA, 18 nt, Human
uuugaucagguggggagu

SEQ ID NO: 2096477 - RNA, 17 nt, Human
uuugauauccaaagcug

SEQ ID NO: 2096478 - RNA, 23 nt, Human
uuugauauccaaagcugaauaca

SEQ ID NO: 2096479 - RNA, 21 nt, Human
uuugccagaacaguuuguaca

SEQ ID NO: 2096480 - RNA, 19 nt, Human
uuugccaaaauaaugucuu

SEQ ID NO: 2096481 - RNA, 23 nt, Human
uuugccaaaauaaugucuuguua

SEQ ID NO: 2096482 - RNA, 17 nt, Human
uuuccacucaggucugu

SEQ ID NO: 2096483 - RNA, 19 nt, Human
uuuccacgaugaaaaacuu

SEQ ID NO: 2096484 - RNA, 15 nt, Human
uuuccuaaaugcagu

SEQ ID NO: 2096485 - RNA, 17 nt, Human
uuuccuaaaugcaguga

SEQ ID NO: 2096486 - RNA, 13 nt, Human
uuuccuaaaugua

SEQ ID NO: 2096487 - RNA, 18 nt, Human
uuuccuaacaggauuaga

SEQ ID NO: 2096488 - RNA, 22 nt, Human
uuuccuaacaggauuagacagu

SEQ ID NO: 2096489 - RNA, 13 nt, Human
uuuccacuacugc

SEQ ID NO: 2096490 - RNA, 14 nt, Human
uuuccacuacugcu

SEQ ID NO: 2096491 - RNA, 15 nt, Human
uuuccacuacugcua

SEQ ID NO: 2096492 - RNA, 15 nt, Human
uuuccacccccuccc

SEQ ID NO: 2096493 - RNA, 22 nt, Human
uuuccacccccucccuggccug

SEQ ID NO: 2096494 - RNA, 18 nt, Human
uuucagguguuuaguugc

SEQ ID NO: 2096495 - RNA, 18 nt, Human
uuucagguuuuguaaaga

SEQ ID NO: 2096496 - RNA, 19 nt, Human
uuucagguuuuguaaagau

SEQ ID NO: 2096497 - RNA, 19 nt, Human
uuucauuuaugauacaaaa

SEQ ID NO: 2096498 - RNA, 18 nt, Human
uuucaguaauaaaacauc

SEQ ID NO: 2096499 - RNA, 20 nt, Human
uuucaguaauaaaacaucuu

SEQ ID NO: 2096500 - RNA, 17 nt, Human
uuucagugaaagcauca

SEQ ID NO: 2096501 - RNA, 13 nt, Human
uuucacaguuuuu

SEQ ID NO: 2096502 - RNA, 14 nt, Human
uuucacauagaugu

SEQ ID NO: 2096503 - RNA, 15 nt, Human
uuucacaguuuuucc

SEQ ID NO: 2096504 - RNA, 19 nt, Human
uuucacaguguguuuguga

SEQ ID NO: 2096505 - RNA, 14 nt, Human
uuucaauuuccaag

SEQ ID NO: 2096506 - RNA, 23 nt, Human
uuucacaccugaaaauguuagug

SEQ ID NO: 2096507 - RNA, 19 nt, Human
uuuaugagccagacaaaug

SEQ ID NO: 2096508 - RNA, 12 nt, Human
uuuaugagccag

SEQ ID NO: 2096509 - RNA, 17 nt, Human
uuuaugagccagacaaa

SEQ ID NO: 2096510 - RNA, 16 nt, Human
uuuaugagcucaugua

SEQ ID NO: 2096511 - RNA, 20 nt, Human
uuuaugagcucauguagcaa

SEQ ID NO: 2096512 - RNA, 23 nt, Human
uuuaugagcucauguagcaauca

SEQ ID NO: 2096513 - RNA, 20 nt, Human
uuuaugccuuuuauuucuua

SEQ ID NO: 2096514 - RNA, 16 nt, Human
uuucaauucaaaaaug

SEQ ID NO: 2096515 - RNA, 17 nt, Human
uuucaauucaaaaaugu

SEQ ID NO: 2096516 - RNA, 18 nt, Human
uuucaauucaaaaaugua

SEQ ID NO: 2096517 - RNA, 19 nt, Human
uuucaauucaaaaauguac

SEQ ID NO: 2096518 - RNA, 20 nt, Human
uuucaauucaaaaauguaca

SEQ ID NO: 2096519 - RNA, 23 nt, Human
uuuauggaggauggagagagggg

SEQ ID NO: 2096520 - RNA, 21 nt, Human
uuucaaugguuugcaaggaag

SEQ ID NO: 2096521 - RNA, 22 nt, Human
uuucucuacagaugucccauuu

SEQ ID NO: 2096522 - RNA, 16 nt, Human
uuucuaccuugagguc

SEQ ID NO: 2096523 - RNA, 22 nt, Human
uuucucuaacuucaaggcccau

SEQ ID NO: 2096524 - RNA, 18 nt, Human
uuucuacccagcgagccc

SEQ ID NO: 2096525 - RNA, 15 nt, Human
uuucuacccagcgag

SEQ ID NO: 2096526 - RNA, 22 nt, Human
uuucuacccagcgagcccuggu

SEQ ID NO: 2096527 - RNA, 19 nt, Human
uuucugaaaauuaacacug

SEQ ID NO: 2096528 - RNA, 20 nt, Human
uuucugaaaauuaacacugc

SEQ ID NO: 2096529 - RNA, 18 nt, Human
uuucugaaaauuccagaa

SEQ ID NO: 2096530 - RNA, 21 nt, Human
uuucugaaaauuccagaaagg

SEQ ID NO: 2096531 - RNA, 22 nt, Human
uuucugaaaauuccagaaagga

SEQ ID NO: 2096532 - RNA, 17 nt, Human
uuucugaaacuaaugaa

SEQ ID NO: 2096533 - RNA, 18 nt, Human
uuucugaaacuaaugaaa

SEQ ID NO: 2096534 - RNA, 19 nt, Human
uuucugaaacuaaugaaag

SEQ ID NO: 2096535 - RNA, 14 nt, Human
uuucucucuccagu

SEQ ID NO: 2096536 - RNA, 17 nt, Human
uuucagucuuuuccugu

SEQ ID NO: 2096537 - RNA, 15 nt, Human
uuucuaaugugugaa

SEQ ID NO: 2096538 - RNA, 13 nt, Human
uuucuaaauguuu

SEQ ID NO: 2096539 - RNA, 20 nt, Human
uuucuacacuguauuacaua

SEQ ID NO: 2096540 - RNA, 14 nt, Human
uuucuacagcaaau

SEQ ID NO: 2096541 - RNA, 15 nt, Human
uuucuacagcaaauu

SEQ ID NO: 2096542 - RNA, 17 nt, Human
uuucuacagcaaauuua

SEQ ID NO: 2096543 - RNA, 22 nt, Human
uuucuacagcaaauuuauaauu

SEQ ID NO: 2096544 - RNA, 22 nt, Human
uuuccucuuagucgagccaagu

SEQ ID NO: 2096545 - RNA, 24 nt, Human
uuuccuacucucaggaucaagaaa

SEQ ID NO: 2096546 - RNA, 19 nt, Human
uugucuuuggugaacauug

SEQ ID NO: 2096547 - RNA, 23 nt, Human
uugucuuuguaaugucaccaccu

SEQ ID NO: 2096548 - RNA, 22 nt, Human
uuguuauuacauccuuguggca

SEQ ID NO: 2096549 - RNA, 14 nt, Human
uuguuauuauauaa

SEQ ID NO: 2096550 - RNA, 23 nt, Human
uuguuauuauauaauuacauauu

SEQ ID NO: 2096551 - RNA, 13 nt, Human
uugucuuuauaug

SEQ ID NO: 2096552 - RNA, 14 nt, Human
uugucuuuauauga

SEQ ID NO: 2096553 - RNA, 16 nt, Human
uugucuuuauaugaac

SEQ ID NO: 2096554 - RNA, 19 nt, Human
uugucuuuauaugaacaua

SEQ ID NO: 2096555 - RNA, 14 nt, Human
uuguuauuuauaac

SEQ ID NO: 2096556 - RNA, 20 nt, Human
uuguucaaaauauguucuuu

SEQ ID NO: 2096557 - RNA, 21 nt, Human
uuuaaaacaagaaaguuuccc

SEQ ID NO: 2096558 - RNA, 20 nt, Human
uuuaaaacaagaaaguuucc

SEQ ID NO: 2096559 - RNA, 22 nt, Human
uuuaaaacaagaaaguuucccc

SEQ ID NO: 2096560 - RNA, 10 nt, Human
uuguuuguuu

SEQ ID NO: 2096561 - RNA, 21 nt, Human
uuguuuguuucucccccuggg

SEQ ID NO: 2096562 - RNA, 12 nt, Human
uuguuuguuuug

SEQ ID NO: 2096563 - RNA, 23 nt, Human
uuguuuguuuuguuuuuuaguuc

SEQ ID NO: 2096564 - RNA, 18 nt, Human
uuguuuuaaaauuaaagc

SEQ ID NO: 2096565 - RNA, 20 nt, Human
uuguuuuaaaauuaaagcua

SEQ ID NO: 2096566 - RNA, 16 nt, Human
uuguuuuaaggaagaa

SEQ ID NO: 2096567 - RNA, 13 nt, Human
uuguuuguaaaua

SEQ ID NO: 2096568 - RNA, 22 nt, Human
uuguuuguaaauaagagauuug

SEQ ID NO: 2096569 - RNA, 20 nt, Human
uuguuuggggaugagaaagg

SEQ ID NO: 2096570 - RNA, 16 nt, Human
uuguuuggguauccug

SEQ ID NO: 2096571 - RNA, 21 nt, Human
uuguuuggguauccugcccag

SEQ ID NO: 2096572 - RNA, 15 nt, Human
uuguuucuuccaaag

SEQ ID NO: 2096573 - RNA, 19 nt, Human
uuguuucuuccaaagcaca

SEQ ID NO: 2096574 - RNA, 11 nt, Human
uuguuucuucc

SEQ ID NO: 2096575 - RNA, 12 nt, Human
uuguuucuucca

SEQ ID NO: 2096576 - RNA, 13 nt, Human
uuguuucuuccaa

SEQ ID NO: 2096577 - RNA, 21 nt, Human
uuguuucugaaaauuccagaa

SEQ ID NO: 2096578 - RNA, 13 nt, Human
uuguuuaucagca

SEQ ID NO: 2096579 - RNA, 17 nt, Human
uuguuucucccccuggg

SEQ ID NO: 2096580 - RNA, 11 nt, Human
uuuaaaaugua

SEQ ID NO: 2096581 - RNA, 17 nt, Human
uuuaaaauuuuaucucu

SEQ ID NO: 2096582 - RNA, 12 nt, Human
uuuaaaauguau

SEQ ID NO: 2096583 - RNA, 18 nt, Human
uuuaaaauguauaaguug

SEQ ID NO: 2096584 - RNA, 20 nt, Human
uuuaaaauguauaaguugag

SEQ ID NO: 2096585 - RNA, 22 nt, Human
uuuaaacugaaugaacaaccuc

SEQ ID NO: 2096586 - RNA, 15 nt, Human
uuuaaacugauucau

SEQ ID NO: 2096587 - RNA, 18 nt, Human
uuuaaaccuauacucacu

SEQ ID NO: 2096588 - RNA, 18 nt, Human
uuuaacacacauaaagga

SEQ ID NO: 2096589 - RNA, 19 nt, Human
uuuaaaagacacacuuguc

SEQ ID NO: 2096590 - RNA, 14 nt, Human
uuuaaaagacacug

SEQ ID NO: 2096591 - RNA, 12 nt, Human
uuuaaaagacac

SEQ ID NO: 2096592 - RNA, 13 nt, Human
uuuaaaaucacua

SEQ ID NO: 2096593 - RNA, 14 nt, Human
uuuaaaaucacuaa

SEQ ID NO: 2096594 - RNA, 18 nt, Human
uuuaaaaucacuaacauu

SEQ ID NO: 2096595 - RNA, 19 nt, Human
uuuaaaaucacuaacauua

SEQ ID NO: 2096596 - RNA, 20 nt, Human
uuuaaaaucacuaacauuau

SEQ ID NO: 2096597 - RNA, 15 nt, Human
uuuaaaaguuauuaa

SEQ ID NO: 2096598 - RNA, 19 nt, Human
uuuaaaaguuauuaauauu

SEQ ID NO: 2096599 - RNA, 15 nt, Human
uuuacauacugcugu

SEQ ID NO: 2096600 - RNA, 13 nt, Human
uuuacagcugccu

SEQ ID NO: 2096601 - RNA, 20 nt, Human
uuuacagccucacuugaaug

SEQ ID NO: 2096602 - RNA, 23 nt, Human
uuuaccagccuccguauuucaga

SEQ ID NO: 2096603 - RNA, 14 nt, Human
uuuaccauuuguaa

SEQ ID NO: 2096604 - RNA, 16 nt, Human
uuuaccauuuguaaua

SEQ ID NO: 2096605 - RNA, 19 nt, Human
uuuaccauuuguaauaaag

SEQ ID NO: 2096606 - RNA, 20 nt, Human
uuuaccauuuguaauaaagu

SEQ ID NO: 2096607 - RNA, 23 nt, Human
uuuaccauuuguaauaaaguaua

SEQ ID NO: 2096608 - RNA, 15 nt, Human
uuuaauauagcuauu

SEQ ID NO: 2096609 - RNA, 16 nt, Human
uuuaauauagcuauuu

SEQ ID NO: 2096610 - RNA, 14 nt, Human
uuuaauauagcuau

SEQ ID NO: 2096611 - RNA, 13 nt, Human
uuuaaucaaauuu

SEQ ID NO: 2096612 - RNA, 17 nt, Human
uuuaaucaaauuuguag

SEQ ID NO: 2096613 - RNA, 15 nt, Human
uuuaauauugagaaa

SEQ ID NO: 2096614 - RNA, 22 nt, Human
uuuaauauugagaaagaaacua

SEQ ID NO: 2096615 - RNA, 13 nt, Human
uuuaauauguauu

SEQ ID NO: 2096616 - RNA, 14 nt, Human
uuuaauauguauuu

SEQ ID NO: 2096617 - RNA, 15 nt, Human
uuuaauauaaagccu

SEQ ID NO: 2096618 - RNA, 22 nt, Human
uuuacccagaaugucagauucc

SEQ ID NO: 2096619 - RNA, 23 nt, Human
uuuacccagaaugucagauuccu

SEQ ID NO: 2096620 - RNA, 19 nt, Human
uuuagacccuauugcugcu

SEQ ID NO: 2096621 - RNA, 15 nt, Human
uuuagaccauuuauc

SEQ ID NO: 2096622 - RNA, 21 nt, Human
uuuacccaauaagauacauca

SEQ ID NO: 2096623 - RNA, 22 nt, Human
uuuagacccuauugcugcuuga

SEQ ID NO: 2096624 - RNA, 15 nt, Human
uuuauacaggggaau

SEQ ID NO: 2096625 - RNA, 17 nt, Human
uuuauacaggggaauau

SEQ ID NO: 2096626 - RNA, 16 nt, Human
uuuauacaauaucauc

SEQ ID NO: 2096627 - RNA, 13 nt, Human
uuuauaaauuaaa

SEQ ID NO: 2096628 - RNA, 15 nt, Human
uuuauaaauuaaaua

SEQ ID NO: 2096629 - RNA, 16 nt, Human
uuuauaaauuaaauau

SEQ ID NO: 2096630 - RNA, 17 nt, Human
uuuauaaauuaaauaua

SEQ ID NO: 2096631 - RNA, 18 nt, Human
uuuauaaauuaaauauau

SEQ ID NO: 2096632 - RNA, 11 nt, Human
uuuaguucuuu

SEQ ID NO: 2096633 - RNA, 19 nt, Human
uuuaguugcagaaacauuu

SEQ ID NO: 2096634 - RNA, 20 nt, Human
uuuaguuguaucucuuuuga

SEQ ID NO: 2096635 - RNA, 19 nt, Human
uuuaguugcagacucaguu

SEQ ID NO: 2096636 - RNA, 17 nt, Human
uuuaguuguaucucuuu

SEQ ID NO: 2096637 - RNA, 18 nt, Human
uuuauacaguagugagaa

SEQ ID NO: 2096638 - RNA, 22 nt, Human
uuuauacaguagugagaagaau

SEQ ID NO: 2096639 - RNA, 19 nt, Human
uuuauacaguuuuaaagaa

SEQ ID NO: 2096640 - RNA, 17 nt, Human
uuuaucccacggaaaau

SEQ ID NO: 2096641 - RNA, 21 nt, Human
uuuauagaauaaugugggaag

SEQ ID NO: 2096642 - RNA, 15 nt, Human
uuuauccaaucuugu

SEQ ID NO: 2096643 - RNA, 16 nt, Human
uuuauacuguuuacug

SEQ ID NO: 2096644 - RNA, 14 nt, Human
uuuaucuugucucu

SEQ ID NO: 2096645 - RNA, 21 nt, Human
uuuaucuuggacugacauuua

SEQ ID NO: 2096646 - RNA, 16 nt, Human
uuuaucuguaguaaac

SEQ ID NO: 2096647 - RNA, 19 nt, Human
uuuaucuguaguaaacuau

SEQ ID NO: 2096648 - RNA, 20 nt, Human
uuuaugaaugaaaaaacagu

SEQ ID NO: 2096649 - RNA, 21 nt, Human
uuuaucuauuguaagauaaaa

SEQ ID NO: 2096650 - RNA, 16 nt, Human
uuuauccuaucucucc

SEQ ID NO: 2096651 - RNA, 17 nt, Human
uuuaucugggauuaugg

SEQ ID NO: 2096652 - RNA, 19 nt, Human
uugcagcgauuaauaacag

SEQ ID NO: 2096653 - RNA, 23 nt, Human
uugcagcucuccccuucucugua

SEQ ID NO: 2096654 - RNA, 18 nt, Human
uugcagcgauuaauaaca

SEQ ID NO: 2096655 - RNA, 14 nt, Human
uugcagcugggaga

SEQ ID NO: 2096656 - RNA, 17 nt, Human
uugcagcugggagaagg

SEQ ID NO: 2096657 - RNA, 18 nt, Human
uugcagcugggagaaggg

SEQ ID NO: 2096658 - RNA, 16 nt, Human
uugcaguucagcacca

SEQ ID NO: 2096659 - RNA, 18 nt, Human
uugcagauucauuuuucu

SEQ ID NO: 2096660 - RNA, 19 nt, Human
uugcagagacaggaccuga

SEQ ID NO: 2096661 - RNA, 23 nt, Human
uugcagcagugagucucuucaga

SEQ ID NO: 2096662 - RNA, 12 nt, Human
uugcagcaguga

SEQ ID NO: 2096663 - RNA, 14 nt, Human
uugcagcagugagu

SEQ ID NO: 2096664 - RNA, 23 nt, Human
uugcagacaggcaagcaccuccu

SEQ ID NO: 2096665 - RNA, 21 nt, Human
uugcagaaaagcaccugccga

SEQ ID NO: 2096666 - RNA, 19 nt, Human
uugcagacucaguuuguca

SEQ ID NO: 2096667 - RNA, 18 nt, Human
uugcagagaagccuuggu

SEQ ID NO: 2096668 - RNA, 14 nt, Human
uugcagagacagga

SEQ ID NO: 2096669 - RNA, 15 nt, Human
uugcagaaacauuuu

SEQ ID NO: 2096670 - RNA, 17 nt, Human
uugcagaaaagcaccug

SEQ ID NO: 2096671 - RNA, 18 nt, Human
uugcagaaaagcaccugc

SEQ ID NO: 2096672 - RNA, 19 nt, Human
uugcagaaaagcaccugcc

SEQ ID NO: 2096673 - RNA, 20 nt, Human
uugcagaaaagcaccugccg

SEQ ID NO: 2096674 - RNA, 16 nt, Human
uugcacuccagccugg

SEQ ID NO: 2096675 - RNA, 14 nt, Human
uugauuccaucucc

SEQ ID NO: 2096676 - RNA, 23 nt, Human
uugccauccccuauggaccagaa

SEQ ID NO: 2096677 - RNA, 23 nt, Human
uugccaugacaacuucuaauugc

SEQ ID NO: 2096678 - RNA, 19 nt, Human
uugccauguuggccaggcu

SEQ ID NO: 2096679 - RNA, 18 nt, Human
uugccauguuggccaggc

SEQ ID NO: 2096680 - RNA, 17 nt, Human
uugccauguuggccagg

SEQ ID NO: 2096681 - RNA, 16 nt, Human
uugccauguuggccag

SEQ ID NO: 2096682 - RNA, 17 nt, Human
uugccagaaagcauaaa

SEQ ID NO: 2096683 - RNA, 14 nt, Human
uugccagagaugga

SEQ ID NO: 2096684 - RNA, 20 nt, Human
uugccagaaagcauaaaauu

SEQ ID NO: 2096685 - RNA, 22 nt, Human
uugccagacauguggugggaca

SEQ ID NO: 2096686 - RNA, 14 nt, Human
uugcauaaaauugg

SEQ ID NO: 2096687 - RNA, 15 nt, Human
uugcauaauaagcua

SEQ ID NO: 2096688 - RNA, 20 nt, Human
uugcauaauaagcuaaagag

SEQ ID NO: 2096689 - RNA, 21 nt, Human
uugcauaauaagcuaaagagg

SEQ ID NO: 2096690 - RNA, 15 nt, Human
uugccagaaagcaua

SEQ ID NO: 2096691 - RNA, 13 nt, Human
uugaggaguguga

SEQ ID NO: 2096692 - RNA, 15 nt, Human
uugaggaguuuccua

SEQ ID NO: 2096693 - RNA, 13 nt, Human
uugaggccaggag

SEQ ID NO: 2096694 - RNA, 14 nt, Human
uugagcugagaugg

SEQ ID NO: 2096695 - RNA, 20 nt, Human
uugagcgugaaucuguaucu

SEQ ID NO: 2096696 - RNA, 15 nt, Human
uugaauucauagaaa

SEQ ID NO: 2096697 - RNA, 23 nt, Human
uugaauugcauuuuuuaaaacaa

SEQ ID NO: 2096698 - RNA, 23 nt, Human
uugagcucagacccccacucuca

SEQ ID NO: 2096699 - RNA, 14 nt, Human
uugagccugggagg

SEQ ID NO: 2096700 - RNA, 23 nt, Human
uugaauuaaauuaggaauaaaua

SEQ ID NO: 2096701 - RNA, 17 nt, Human
uugaauuaaauuaggaa

SEQ ID NO: 2096702 - RNA, 22 nt, Human
uugaauuaaauuaggaauaaau

SEQ ID NO: 2096703 - RNA, 16 nt, Human
uugaucuccguggcuu

SEQ ID NO: 2096704 - RNA, 18 nt, Human
uugaucauuuucccccca

SEQ ID NO: 2096705 - RNA, 19 nt, Human
uugaucauuuuccccccac

SEQ ID NO: 2096706 - RNA, 22 nt, Human
uugaucauuuuccccccacucu

SEQ ID NO: 2096707 - RNA, 16 nt, Human
uugauucagcucugca

SEQ ID NO: 2096708 - RNA, 22 nt, Human
uugauaugaaaaauaugauauu

SEQ ID NO: 2096709 - RNA, 22 nt, Human
uugauauuuucaacgcagcccu

SEQ ID NO: 2096710 - RNA, 14 nt, Human
uugaucaguauaau

SEQ ID NO: 2096711 - RNA, 14 nt, Human
uugaggcugcagcg

SEQ ID NO: 2096712 - RNA, 13 nt, Human
uugauaugaaaaa

SEQ ID NO: 2096713 - RNA, 16 nt, Human
uugauaugcuuauaca

SEQ ID NO: 2096714 - RNA, 16 nt, Human
uugauaugaaaaauau

SEQ ID NO: 2096715 - RNA, 21 nt, Human
uugauaugaaaaauaugauau

SEQ ID NO: 2096716 - RNA, 13 nt, Human
uucugugcagcca

SEQ ID NO: 2096717 - RNA, 19 nt, Human
uucugugagacccccacac

SEQ ID NO: 2096718 - RNA, 13 nt, Human
uucugugcccagc

SEQ ID NO: 2096719 - RNA, 14 nt, Human
uucugugcccagcu

SEQ ID NO: 2096720 - RNA, 14 nt, Human
uucuggccugccuu

SEQ ID NO: 2096721 - RNA, 20 nt, Human
uucuggccugccuucguuaa

SEQ ID NO: 2096722 - RNA, 17 nt, Human
uucuucagaucagugcu

SEQ ID NO: 2096723 - RNA, 23 nt, Human
uucuucagccaccucucuuuuuc

SEQ ID NO: 2096724 - RNA, 14 nt, Human
uucuucagccaccu

SEQ ID NO: 2096725 - RNA, 20 nt, Human
uucuucauucaauacaagug

SEQ ID NO: 2096726 - RNA, 21 nt, Human
uucuucauccggcagccugga

SEQ ID NO: 2096727 - RNA, 11 nt, Human
uucuucaguug

SEQ ID NO: 2096728 - RNA, 13 nt, Human
uucuucaguuggu

SEQ ID NO: 2096729 - RNA, 14 nt, Human
uucuucaugcaaug

SEQ ID NO: 2096730 - RNA, 15 nt, Human
uucuucaugcaauga

SEQ ID NO: 2096731 - RNA, 17 nt, Human
uucuucaugcaaugaca

SEQ ID NO: 2096732 - RNA, 18 nt, Human
uucuucaugcaaugacau

SEQ ID NO: 2096733 - RNA, 19 nt, Human
uucuugugaauauguacau

SEQ ID NO: 2096734 - RNA, 17 nt, Human
uucuugugaucuugcuc

SEQ ID NO: 2096735 - RNA, 14 nt, Human
uucuuuaaccaguc

SEQ ID NO: 2096736 - RNA, 16 nt, Human
uucuugucacaauaaa

SEQ ID NO: 2096737 - RNA, 19 nt, Human
uucuuauucucacuccacc

SEQ ID NO: 2096738 - RNA, 17 nt, Human
uucuuauguugcccagu

SEQ ID NO: 2096739 - RNA, 21 nt, Human
uucuuauguaugugaaaguua

SEQ ID NO: 2096740 - RNA, 13 nt, Human
uucuuagugucac

SEQ ID NO: 2096741 - RNA, 15 nt, Human
uucuuaguagauuuu

SEQ ID NO: 2096742 - RNA, 20 nt, Human
uucuuuccauuaugauucuu

SEQ ID NO: 2096743 - RNA, 14 nt, Human
uucuuuccauuaug

SEQ ID NO: 2096744 - RNA, 17 nt, Human
uucuuuccauuaugauu

SEQ ID NO: 2096745 - RNA, 21 nt, Human
uucuuucccugcuuaaugaaa

SEQ ID NO: 2096746 - RNA, 14 nt, Human
uugaaaauauuauc

SEQ ID NO: 2096747 - RNA, 23 nt, Human
uugaaaauauuaucuuuguaauu

SEQ ID NO: 2096748 - RNA, 19 nt, Human
uugaaaccaccuuuuauua

SEQ ID NO: 2096749 - RNA, 20 nt, Human
uugaaaauguaaguaaaugu

SEQ ID NO: 2096750 - RNA, 21 nt, Human
uugaaugaaaaauuuaagcau

SEQ ID NO: 2096751 - RNA, 22 nt, Human
uugaaugaaaaauuuaagcauu

SEQ ID NO: 2096752 - RNA, 23 nt, Human
uugaaugaaaaauuuaagcauug

SEQ ID NO: 2096753 - RNA, 20 nt, Human
uugaagaucguuaguaucua

SEQ ID NO: 2096754 - RNA, 18 nt, Human
uugaagaugcugaaacag

SEQ ID NO: 2096755 - RNA, 22 nt, Human
uugaagauaucuugaaaugaaa

SEQ ID NO: 2096756 - RNA, 17 nt, Human
uugcgaaugguuccauu

SEQ ID NO: 2096757 - RNA, 18 nt, Human
uugcgacggagagaaaaa

SEQ ID NO: 2096758 - RNA, 19 nt, Human
uugcgacggagagaaaaaa

SEQ ID NO: 2096759 - RNA, 20 nt, Human
uugcgacggagagaaaaaag

SEQ ID NO: 2096760 - RNA, 22 nt, Human
uugcgacggagagaaaaaagaa

SEQ ID NO: 2096761 - RNA, 17 nt, Human
uugccuuuguuuugaug

SEQ ID NO: 2096762 - RNA, 20 nt, Human
uugccuugggcugcuccuca

SEQ ID NO: 2096763 - RNA, 21 nt, Human
uugccuuccacgcugucucca

SEQ ID NO: 2096764 - RNA, 16 nt, Human
uugccuuaacuggagc

SEQ ID NO: 2096765 - RNA, 12 nt, Human
uugccugugcca

SEQ ID NO: 2096766 - RNA, 20 nt, Human
uugccaugacaacuucuaau

SEQ ID NO: 2096767 - RNA, 17 nt, Human
uugcccaaaucugccua

SEQ ID NO: 2096768 - RNA, 13 nt, Human
uugcccaaccuca

SEQ ID NO: 2096769 - RNA, 15 nt, Human
uugcccaaccucagc

SEQ ID NO: 2096770 - RNA, 16 nt, Human
uugcccaaccucagca

SEQ ID NO: 2096771 - RNA, 17 nt, Human
uugcccaaccucagcaa

SEQ ID NO: 2096772 - RNA, 19 nt, Human
uugcccaaccucagcaacc

SEQ ID NO: 2096773 - RNA, 21 nt, Human
uugccauguuggccaggcugg

SEQ ID NO: 2096774 - RNA, 20 nt, Human
uugccauguuggccaggcug

SEQ ID NO: 2096775 - RNA, 14 nt, Human
uugcugcuugaggc

SEQ ID NO: 2096776 - RNA, 16 nt, Human
uugcugcuugaggcaa

SEQ ID NO: 2096777 - RNA, 20 nt, Human
uugcugcuauuuuacugucu

SEQ ID NO: 2096778 - RNA, 23 nt, Human
uugcugcuauuuuacugucuuaa

SEQ ID NO: 2096779 - RNA, 19 nt, Human
uugcugcuccuuagcugcc

SEQ ID NO: 2096780 - RNA, 21 nt, Human
uugcugcuccuuagcugccaa

SEQ ID NO: 2096781 - RNA, 18 nt, Human
uugcugcuuuuccuuggg

SEQ ID NO: 2096782 - RNA, 23 nt, Human
uugcugcuuuuccuuggggcagg

SEQ ID NO: 2096783 - RNA, 16 nt, Human
uugcuggcaaagacag

SEQ ID NO: 2096784 - RNA, 21 nt, Human
uugcugucauaagaaugaaua

SEQ ID NO: 2096785 - RNA, 15 nt, Human
uugcuguccuaggcc

SEQ ID NO: 2096786 - RNA, 20 nt, Human
uugcugugagcaagaaguca

SEQ ID NO: 2096787 - RNA, 11 nt, Human
uugcuguccua

SEQ ID NO: 2096788 - RNA, 15 nt, Human
uuggaaucuagaaga

SEQ ID NO: 2096789 - RNA, 17 nt, Human
uuggaaucuagaagaaa

SEQ ID NO: 2096790 - RNA, 19 nt, Human
uuggaaucuagaagaaaug

SEQ ID NO: 2096791 - RNA, 21 nt, Human
uuggaaucuagaagaaaugaa

SEQ ID NO: 2096792 - RNA, 22 nt, Human
uuggaaucuagaagaaaugaaa

SEQ ID NO: 2096793 - RNA, 23 nt, Human
uuggaaucuagaagaaaugaaau

SEQ ID NO: 2096794 - RNA, 15 nt, Human
uuggaauuaaaacaa

SEQ ID NO: 2096795 - RNA, 16 nt, Human
uuggaauuaaaacaau

SEQ ID NO: 2096796 - RNA, 18 nt, Human
uuggaauuaaaacaaugu

SEQ ID NO: 2096797 - RNA, 17 nt, Human
uuggaauuaaccuggug

SEQ ID NO: 2096798 - RNA, 21 nt, Human
uuggaauucuguucauuuguu

SEQ ID NO: 2096799 - RNA, 19 nt, Human
uuggaauuaaccuggugcu

SEQ ID NO: 2096800 - RNA, 20 nt, Human
uuggaauuaaccuggugcug

SEQ ID NO: 2096801 - RNA, 18 nt, Human
uuggaauuaaccuggugc

SEQ ID NO: 2096802 - RNA, 13 nt, Human
uuggacagcaaaa

SEQ ID NO: 2096803 - RNA, 14 nt, Human
uuggacagcaaaac

SEQ ID NO: 2096804 - RNA, 18 nt, Human
uuggacagcaaaaccauu

SEQ ID NO: 2096805 - RNA, 22 nt, Human
uuggacagcaaaaccauugcuu

SEQ ID NO: 2096806 - RNA, 23 nt, Human
uuggacagcaaaaccauugcuuc

SEQ ID NO: 2096807 - RNA, 23 nt, Human
uuggacauguccaugaccagaag

SEQ ID NO: 2096808 - RNA, 18 nt, Human
uuggacauuaagcaucac

SEQ ID NO: 2096809 - RNA, 23 nt, Human
uuggacaaucaugaaauaugcau

SEQ ID NO: 2096810 - RNA, 15 nt, Human
uuggacacacacagc

SEQ ID NO: 2096811 - RNA, 16 nt, Human
uuggacacacacagcu

SEQ ID NO: 2096812 - RNA, 17 nt, Human
uuggacacacacagcuu

SEQ ID NO: 2096813 - RNA, 19 nt, Human
uugcuguguccaacuccag

SEQ ID NO: 2096814 - RNA, 20 nt, Human
uugcuguguccaacuccagu

SEQ ID NO: 2096815 - RNA, 17 nt, Human
uugcuguggucucuuug

SEQ ID NO: 2096816 - RNA, 20 nt, Human
uugcugugucauaccaggcc

SEQ ID NO: 2096817 - RNA, 13 nt, Human
uugcuguuuccuu

SEQ ID NO: 2096818 - RNA, 15 nt, Human
uugcuguuuccuuuu

SEQ ID NO: 2096819 - RNA, 17 nt, Human
uuggaagcucugaaguc

SEQ ID NO: 2096820 - RNA, 19 nt, Human
uuggaagcuccgcuuucua

SEQ ID NO: 2096821 - RNA, 15 nt, Human
uuggcacagaaacac

SEQ ID NO: 2096822 - RNA, 16 nt, Human
uuggcacagaaacaca

SEQ ID NO: 2096823 - RNA, 23 nt, Human
uuggcacagaaacacaauauuuu

SEQ ID NO: 2096824 - RNA, 22 nt, Human
uuggcacugagauauuuauugu

SEQ ID NO: 2096825 - RNA, 20 nt, Human
uuggcagccuacuagggacc

SEQ ID NO: 2096826 - RNA, 20 nt, Human
uugguacauggccaguguga

SEQ ID NO: 2096827 - RNA, 20 nt, Human
uuggucugacccacugcuuu

SEQ ID NO: 2096828 - RNA, 14 nt, Human
uugggcaauauaac

SEQ ID NO: 2096829 - RNA, 18 nt, Human
uugggaugaugccucaug

SEQ ID NO: 2096830 - RNA, 13 nt, Human
uugggaugucuua

SEQ ID NO: 2096831 - RNA, 17 nt, Human
uugggaugucuuauuuu

SEQ ID NO: 2096832 - RNA, 18 nt, Human
uugggaugucuuauuuuu

SEQ ID NO: 2096833 - RNA, 19 nt, Human
uugggaugucuuauuuuua

SEQ ID NO: 2096834 - RNA, 23 nt, Human
uugggaugucuuauuuuuagaug

SEQ ID NO: 2096835 - RNA, 13 nt, Human
uugggauuaauau

SEQ ID NO: 2096836 - RNA, 15 nt, Human
uugggaggcugaggc

SEQ ID NO: 2096837 - RNA, 16 nt, Human
uuggcuucuguuucua

SEQ ID NO: 2096838 - RNA, 18 nt, Human
uuggcuucuguuucuagu

SEQ ID NO: 2096839 - RNA, 17 nt, Human
uuggcuugugaucuggg

SEQ ID NO: 2096840 - RNA, 23 nt, Human
uuggcuucacggaagagccuugc

SEQ ID NO: 2096841 - RNA, 21 nt, Human
uuggcagggguggaggagagc

SEQ ID NO: 2096842 - RNA, 11 nt, Human
uuguaccucuc

SEQ ID NO: 2096843 - RNA, 14 nt, Human
uuguaaacuguacu

SEQ ID NO: 2096844 - RNA, 15 nt, Human
uuguaaacuguacua

SEQ ID NO: 2096845 - RNA, 16 nt, Human
uuguaaacguuucagu

SEQ ID NO: 2096846 - RNA, 18 nt, Human
uuguaaacguuucaguaa

SEQ ID NO: 2096847 - RNA, 23 nt, Human
uuguaaacaaacuguguaacugc

SEQ ID NO: 2096848 - RNA, 20 nt, Human
uuguaaacauuaguucuauu

SEQ ID NO: 2096849 - RNA, 22 nt, Human
uuguaaacauuaguucuauuuc

SEQ ID NO: 2096850 - RNA, 22 nt, Human
uuguaaacaaacuguguaacug

SEQ ID NO: 2096851 - RNA, 15 nt, Human
uugguaagcuuccag

SEQ ID NO: 2096852 - RNA, 22 nt, Human
uuguagaaggguuauauuuuac

SEQ ID NO: 2096853 - RNA, 22 nt, Human
uuguagaaguaggaagugaaaa

SEQ ID NO: 2096854 - RNA, 14 nt, Human
uuguauuuuaguau

SEQ ID NO: 2096855 - RNA, 20 nt, Human
uuguauuuuauuuuuuucuc

SEQ ID NO: 2096856 - RNA, 20 nt, Human
uuguaugauccuaaugaaug

SEQ ID NO: 2096857 - RNA, 22 nt, Human
uuguaugaaagauggcugugcc

SEQ ID NO: 2096858 - RNA, 22 nt, Human
uugucaaacuguagaaaugaug

SEQ ID NO: 2096859 - RNA, 14 nt, Human
uugucuaugggacu

SEQ ID NO: 2096860 - RNA, 19 nt, Human
uugucucuaugccagcuca

SEQ ID NO: 2096861 - RNA, 20 nt, Human
uugucaagucucugcuggcc

SEQ ID NO: 2096862 - RNA, 20 nt, Human
uugucuaugggacucaaugc

SEQ ID NO: 2096863 - RNA, 22 nt, Human
uugucuuaaaaaguggaaaaau

SEQ ID NO: 2096864 - RNA, 13 nt, Human
uugucuuaaauaa

SEQ ID NO: 2096865 - RNA, 17 nt, Human
uugucuuaaauaaaaga

SEQ ID NO: 2096866 - RNA, 18 nt, Human
uugucugaagucacugca

SEQ ID NO: 2096867 - RNA, 17 nt, Human
uugucugaagucacugc

SEQ ID NO: 2096868 - RNA, 12 nt, Human
uugucucugggc

SEQ ID NO: 2096869 - RNA, 22 nt, Human
uuugugguacgaccuuuagauu

SEQ ID NO: 2096870 - RNA, 12 nt, Human
uuuguggcuggg

SEQ ID NO: 2096871 - RNA, 15 nt, Human
uuuguguaauaaagu

SEQ ID NO: 2096872 - RNA, 16 nt, Human
uuuguguaauaaagug

SEQ ID NO: 2096873 - RNA, 17 nt, Human
uuuguguaauaaagugu

SEQ ID NO: 2096874 - RNA, 22 nt, Human
uuuguguaauaaaguguuuuca

SEQ ID NO: 2096875 - RNA, 14 nt, Human
uuuguguacagugu

SEQ ID NO: 2096876 - RNA, 16 nt, Human
auaugcaguuuuccuu

SEQ ID NO: 2096877 - RNA, 20 nt, Human
auaugcucugcauguuacau

SEQ ID NO: 2096878 - RNA, 18 nt, Human
auaugcugccaaauuuug

SEQ ID NO: 2096879 - RNA, 22 nt, Human
auaugcugccaaauuuuggcca

SEQ ID NO: 2096880 - RNA, 18 nt, Human
auauggauauuagucaua

SEQ ID NO: 2096881 - RNA, 22 nt, Human
auaucaguuacucagcccuggg

SEQ ID NO: 2096882 - RNA, 13 nt, Human
auaucaguuugcu

SEQ ID NO: 2096883 - RNA, 20 nt, Human
auaucaguuacucagcccug

SEQ ID NO: 2096884 - RNA, 21 nt, Human
auaucaguuacucagcccugg

SEQ ID NO: 2096885 - RNA, 23 nt, Human
auaucaguuacucagcccugggc

SEQ ID NO: 2096886 - RNA, 17 nt, Human
auaucaguuacucagcc

SEQ ID NO: 2096887 - RNA, 18 nt, Human
auaucaguuacucagccc

SEQ ID NO: 2096888 - RNA, 19 nt, Human
auaucaguuacucagcccu

SEQ ID NO: 2096889 - RNA, 16 nt, Human
auaugcucugcauguu

SEQ ID NO: 2096890 - RNA, 17 nt, Human
auaugcucugcauguua

SEQ ID NO: 2096891 - RNA, 22 nt, Human
auauucagugcuguggccuggg

SEQ ID NO: 2096892 - RNA, 14 nt, Human
auauucauuguaua

SEQ ID NO: 2096893 - RNA, 15 nt, Human
auauucauuguauaa

SEQ ID NO: 2096894 - RNA, 16 nt, Human
auauucauuguauaaa

SEQ ID NO: 2096895 - RNA, 23 nt, Human
auauucagugcuguggccugggc

SEQ ID NO: 2096896 - RNA, 17 nt, Human
auauuuauaacucauca

SEQ ID NO: 2096897 - RNA, 20 nt, Human
auauuuauaacucaucauaa

SEQ ID NO: 2096898 - RNA, 21 nt, Human
auauuuauaacucaucauaaa

SEQ ID NO: 2096899 - RNA, 22 nt, Human
auauuuauaacucaucauaaaa

SEQ ID NO: 2096900 - RNA, 23 nt, Human
auauuuauaacucaucauaaaau

SEQ ID NO: 2096901 - RNA, 21 nt, Human
auauucauuguauaaaaauag

SEQ ID NO: 2096902 - RNA, 15 nt, Human
auauuuauagucaca

SEQ ID NO: 2096903 - RNA, 14 nt, Human
auauuuauauaauu

SEQ ID NO: 2096904 - RNA, 20 nt, Human
auauuuauauaauuauguua

SEQ ID NO: 2096905 - RNA, 22 nt, Human
auauuuauauaauuauguuauu

SEQ ID NO: 2096906 - RNA, 14 nt, Human
auauuuauauuuca

SEQ ID NO: 2096907 - RNA, 15 nt, Human
auauuuauauuucac

SEQ ID NO: 2096908 - RNA, 19 nt, Human
auauuuauggggggagaac

SEQ ID NO: 2096909 - RNA, 14 nt, Human
auauuuauguagau

SEQ ID NO: 2096910 - RNA, 20 nt, Human
auauuuauguagaugugcau

SEQ ID NO: 2096911 - RNA, 14 nt, Human
auauauuuuucaca

SEQ ID NO: 2096912 - RNA, 15 nt, Human
auauauuuuucacag

SEQ ID NO: 2096913 - RNA, 21 nt, Human
auauauuuuucacaguuuuuc

SEQ ID NO: 2096914 - RNA, 17 nt, Human
auauauuuuuuaauuug

SEQ ID NO: 2096915 - RNA, 19 nt, Human
auauauuuuuuaauuugau

SEQ ID NO: 2096916 - RNA, 20 nt, Human
auauauuuuuuaauuugaug

SEQ ID NO: 2096917 - RNA, 23 nt, Human
auauauuuuuuaauuugaugaaa

SEQ ID NO: 2096918 - RNA, 12 nt, Human
auauaauaaagu

SEQ ID NO: 2096919 - RNA, 14 nt, Human
auauaauaaaguau

SEQ ID NO: 2096920 - RNA, 15 nt, Human
auauaauaaaguauu

SEQ ID NO: 2096921 - RNA, 17 nt, Human
auauaauaaaguauucc

SEQ ID NO: 2096922 - RNA, 20 nt, Human
auauaauaaaguauuccacc

SEQ ID NO: 2096923 - RNA, 15 nt, Human
auaguagcauacauu

SEQ ID NO: 2096924 - RNA, 16 nt, Human
auaguagcauacauuu

SEQ ID NO: 2096925 - RNA, 14 nt, Human
auaguacuggcaug

SEQ ID NO: 2096926 - RNA, 14 nt, Human
auaguaccuuugcu

SEQ ID NO: 2096927 - RNA, 15 nt, Human
auaguaccuuugcuc

SEQ ID NO: 2096928 - RNA, 18 nt, Human
auaguaccuuugcucuug

SEQ ID NO: 2096929 - RNA, 18 nt, Human
auaguacucuuuguagca

SEQ ID NO: 2096930 - RNA, 21 nt, Human
auauaauuuuuuuauguuuug

SEQ ID NO: 2096931 - RNA, 23 nt, Human
auauaauuuuuuuauguuuuguu

SEQ ID NO: 2096932 - RNA, 18 nt, Human
auauacaauaacauaauu

SEQ ID NO: 2096933 - RNA, 16 nt, Human
auauacaauaacauaa

SEQ ID NO: 2096934 - RNA, 14 nt, Human
auauacaauuauau

SEQ ID NO: 2096935 - RNA, 15 nt, Human
auauaauauauguuu

SEQ ID NO: 2096936 - RNA, 23 nt, Human
auauaauaugcacacagugcuuu

SEQ ID NO: 2096937 - RNA, 17 nt, Human
auagccuaggugacaga

SEQ ID NO: 2096938 - RNA, 15 nt, Human
auagccuaggugaca

SEQ ID NO: 2096939 - RNA, 14 nt, Human
auagccgggcaugg

SEQ ID NO: 2096940 - RNA, 18 nt, Human
auagccgggcaugguggc

SEQ ID NO: 2096941 - RNA, 14 nt, Human
auaguaaaaauaaa

SEQ ID NO: 2096942 - RNA, 18 nt, Human
auaguaaaagauaacaag

SEQ ID NO: 2096943 - RNA, 13 nt, Human
auaguaaaaauaa

SEQ ID NO: 2096944 - RNA, 12 nt, Human
auagccaaaaau

SEQ ID NO: 2096945 - RNA, 13 nt, Human
auauacacacagc

SEQ ID NO: 2096946 - RNA, 17 nt, Human
auauacacacacaaaga

SEQ ID NO: 2096947 - RNA, 18 nt, Human
auauacacacacaaagag

SEQ ID NO: 2096948 - RNA, 20 nt, Human
auauacacacacaaagagag

SEQ ID NO: 2096949 - RNA, 21 nt, Human
auauacacacacaaagagagu

SEQ ID NO: 2096950 - RNA, 15 nt, Human
auagcacuuucauug

SEQ ID NO: 2096951 - RNA, 18 nt, Human
auagcacuuucauugcca

SEQ ID NO: 2096952 - RNA, 15 nt, Human
auagcacugagcaaa

SEQ ID NO: 2096953 - RNA, 20 nt, Human
auagaaauaaauagcuauau

SEQ ID NO: 2096954 - RNA, 20 nt, Human
auagaaauauagccaaaaau

SEQ ID NO: 2096955 - RNA, 21 nt, Human
auagaaacucaccauguaaaa

SEQ ID NO: 2096956 - RNA, 22 nt, Human
auagaaagccaaaucaaaauau

SEQ ID NO: 2096957 - RNA, 13 nt, Human
auagcauuaacua

SEQ ID NO: 2096958 - RNA, 15 nt, Human
auagcauuaacuaau

SEQ ID NO: 2096959 - RNA, 21 nt, Human
auagcauuaacuaaucuauug

SEQ ID NO: 2096960 - RNA, 13 nt, Human
auagcauguaaug

SEQ ID NO: 2096961 - RNA, 22 nt, Human
auagcagauuuuaauuuugaau

SEQ ID NO: 2096962 - RNA, 14 nt, Human
auagcagauuuuaa

SEQ ID NO: 2096963 - RNA, 15 nt, Human
auacuuguuuucaaa

SEQ ID NO: 2096964 - RNA, 12 nt, Human
auacuuuacaug

SEQ ID NO: 2096965 - RNA, 17 nt, Human
auacuugucuuguucac

SEQ ID NO: 2096966 - RNA, 13 nt, Human
auacuugagacug

SEQ ID NO: 2096967 - RNA, 18 nt, Human
auaaagauuauauaaaga

SEQ ID NO: 2096968 - RNA, 20 nt, Human
auaaagauuauauaaagacc

SEQ ID NO: 2096969 - RNA, 20 nt, Human
auaaagauuucuugaguuuu

SEQ ID NO: 2096970 - RNA, 17 nt, Human
auaacaagaucuuucag

SEQ ID NO: 2096971 - RNA, 19 nt, Human
auaacaagaucuuucagga

SEQ ID NO: 2096972 - RNA, 20 nt, Human
auaaauuugguucuaauaga

SEQ ID NO: 2096973 - RNA, 20 nt, Human
auaacauguaauuaaguacu

SEQ ID NO: 2096974 - RNA, 11 nt, Human
auaacacacau

SEQ ID NO: 2096975 - RNA, 13 nt, Human
auaacacagagag

SEQ ID NO: 2096976 - RNA, 14 nt, Human
auaacacagagaga

SEQ ID NO: 2096977 - RNA, 22 nt, Human
auaacacagagagacagacuug

SEQ ID NO: 2096978 - RNA, 12 nt, Human
auaacauguaau

SEQ ID NO: 2096979 - RNA, 14 nt, Human
auaacacaauauga

SEQ ID NO: 2096980 - RNA, 13 nt, Human
auaacauguaauu

SEQ ID NO: 2096981 - RNA, 18 nt, Human
auaacauguaauuaagua

SEQ ID NO: 2096982 - RNA, 20 nt, Human
aguuugcacuguaugcugga

SEQ ID NO: 2096983 - RNA, 13 nt, Human
aguuugcagaaaa

SEQ ID NO: 2096984 - RNA, 11 nt, Human
auaaaaccuuu

SEQ ID NO: 2096985 - RNA, 13 nt, Human
auaaaaccuuuca

SEQ ID NO: 2096986 - RNA, 14 nt, Human
auaaaaccuuucaa

SEQ ID NO: 2096987 - RNA, 15 nt, Human
auaaaaccuuucaaa

SEQ ID NO: 2096988 - RNA, 20 nt, Human
auaaaaccuuucaaauuuca

SEQ ID NO: 2096989 - RNA, 21 nt, Human
auaaaaccuuucaaauuucac

SEQ ID NO: 2096990 - RNA, 22 nt, Human
auaaaaccuuucaaauuucaca

SEQ ID NO: 2096991 - RNA, 14 nt, Human
auaaagaugcucuu

SEQ ID NO: 2096992 - RNA, 15 nt, Human
auaaagaugcucuuu

SEQ ID NO: 2096993 - RNA, 18 nt, Human
auaaagauggcugacuuu

SEQ ID NO: 2096994 - RNA, 17 nt, Human
auaaaacuuugcugcca

SEQ ID NO: 2096995 - RNA, 20 nt, Human
auaaaacauuuucacacaau

SEQ ID NO: 2096996 - RNA, 18 nt, Human
auaaaacauuuucacaca

SEQ ID NO: 2096997 - RNA, 11 nt, Human
auaaaaaggca

SEQ ID NO: 2096998 - RNA, 12 nt, Human
auaaaaaggcac

SEQ ID NO: 2096999 - RNA, 21 nt, Human
auaaaaaggcaccuauaaaac

SEQ ID NO: 2097000 - RNA, 20 nt, Human
aguuugagaucagccugggc

SEQ ID NO: 2097001 - RNA, 18 nt, Human
aguuugagaucagccugg

SEQ ID NO: 2097002 - RNA, 19 nt, Human
aguuugagaucagccuggg

SEQ ID NO: 2097003 - RNA, 16 nt, Human
aguuucuucaaucuga

SEQ ID NO: 2097004 - RNA, 13 nt, Human
aguuucuuuggga

SEQ ID NO: 2097005 - RNA, 16 nt, Human
auacaaugacaaguau

SEQ ID NO: 2097006 - RNA, 15 nt, Human
auacaauaucaucca

SEQ ID NO: 2097007 - RNA, 22 nt, Human
auaauguuuaauauugagaaag

SEQ ID NO: 2097008 - RNA, 19 nt, Human
auaauguuuaauauugaga

SEQ ID NO: 2097009 - RNA, 13 nt, Human
auacacuuacacu

SEQ ID NO: 2097010 - RNA, 22 nt, Human
auacacuuacacuuuaugcaca

SEQ ID NO: 2097011 - RNA, 23 nt, Human
auacagaaagauggaugugcuuu

SEQ ID NO: 2097012 - RNA, 18 nt, Human
auacccauagcuuccaug

SEQ ID NO: 2097013 - RNA, 18 nt, Human
auaaugguugacuggguu

SEQ ID NO: 2097014 - RNA, 14 nt, Human
auaaugguugacug

SEQ ID NO: 2097015 - RNA, 21 nt, Human
auaauguugugguuuguugcc

SEQ ID NO: 2097016 - RNA, 20 nt, Human
auaagggagcguagaaucug

SEQ ID NO: 2097017 - RNA, 21 nt, Human
auaagggagcguagaaucugu

SEQ ID NO: 2097018 - RNA, 13 nt, Human
auaagguguauug

SEQ ID NO: 2097019 - RNA, 14 nt, Human
auaagguguauugc

SEQ ID NO: 2097020 - RNA, 18 nt, Human
auaaggccuuaauauguu

SEQ ID NO: 2097021 - RNA, 21 nt, Human
auaagccuccauuuaguucuu

SEQ ID NO: 2097022 - RNA, 15 nt, Human
aguaacaagagugau

SEQ ID NO: 2097023 - RNA, 18 nt, Human
aguaacaagagugauucu

SEQ ID NO: 2097024 - RNA, 21 nt, Human
aguaacaagagugauucuugc

SEQ ID NO: 2097025 - RNA, 22 nt, Human
aguaacaagagugauucuugcu

SEQ ID NO: 2097026 - RNA, 17 nt, Human
aguaacagggccuugcu

SEQ ID NO: 2097027 - RNA, 20 nt, Human
aguaagaaagugaagcaaau

SEQ ID NO: 2097028 - RNA, 21 nt, Human
aguaagaaagugaagcaaauc

SEQ ID NO: 2097029 - RNA, 19 nt, Human
aguaagagcuggugucuga

SEQ ID NO: 2097030 - RNA, 14 nt, Human
aguaagaagacaug

SEQ ID NO: 2097031 - RNA, 15 nt, Human
aguaagaagacauga

SEQ ID NO: 2097032 - RNA, 16 nt, Human
aguaagaagacaugaa

SEQ ID NO: 2097033 - RNA, 16 nt, Human
aguaagaccggaagcu

SEQ ID NO: 2097034 - RNA, 19 nt, Human
aguaagaccggaagcuccu

SEQ ID NO: 2097035 - RNA, 21 nt, Human
aguaagaccggaagcuccugg

SEQ ID NO: 2097036 - RNA, 22 nt, Human
aguaagaccggaagcuccuggu

SEQ ID NO: 2097037 - RNA, 12 nt, Human
aguaagagcugg

SEQ ID NO: 2097038 - RNA, 14 nt, Human
aguaagagcuggug

SEQ ID NO: 2097039 - RNA, 20 nt, Human
aguacuggcugauggaguaa

SEQ ID NO: 2097040 - RNA, 16 nt, Human
aguacuguguacagaa

SEQ ID NO: 2097041 - RNA, 12 nt, Human
aguacuauguau

SEQ ID NO: 2097042 - RNA, 14 nt, Human
aguacuauguauca

SEQ ID NO: 2097043 - RNA, 12 nt, Human
aguacuucuuuu

SEQ ID NO: 2097044 - RNA, 17 nt, Human
aguacuucuccacccug

SEQ ID NO: 2097045 - RNA, 14 nt, Human
aguacuauaucugu

SEQ ID NO: 2097046 - RNA, 16 nt, Human
aguacuauaucuguuu

SEQ ID NO: 2097047 - RNA, 22 nt, Human
aguacuauaucuguuuuacugc

SEQ ID NO: 2097048 - RNA, 22 nt, Human
aguaagcccuugaagauaucuu

SEQ ID NO: 2097049 - RNA, 19 nt, Human
aggucucagaaucuuuccu

SEQ ID NO: 2097050 - RNA, 23 nt, Human
aguaagauuuacccagaauguca

SEQ ID NO: 2097051 - RNA, 19 nt, Human
aguaucauggaaauauuau

SEQ ID NO: 2097052 - RNA, 18 nt, Human
aguaucgggggcuggggc

SEQ ID NO: 2097053 - RNA, 16 nt, Human
aguaucuaacauguau

SEQ ID NO: 2097054 - RNA, 21 nt, Human
aguauuuuuauauuuaaaugu

SEQ ID NO: 2097055 - RNA, 19 nt, Human
aguauuuuuauauuuaaau

SEQ ID NO: 2097056 - RNA, 22 nt, Human
agucacacaguauuacuucugc

SEQ ID NO: 2097057 - RNA, 13 nt, Human
agucacaaaggaa

SEQ ID NO: 2097058 - RNA, 14 nt, Human
agucacaaaggaau

SEQ ID NO: 2097059 - RNA, 15 nt, Human
agucacaaaggaaug

SEQ ID NO: 2097060 - RNA, 16 nt, Human
agucacaagagcccag

SEQ ID NO: 2097061 - RNA, 18 nt, Human
agucaauccccucauuca

SEQ ID NO: 2097062 - RNA, 18 nt, Human
agucaaaaggugccugug

SEQ ID NO: 2097063 - RNA, 21 nt, Human
agucaaaacagagaugugaua

SEQ ID NO: 2097064 - RNA, 15 nt, Human
agucaaaaggugccu

SEQ ID NO: 2097065 - RNA, 16 nt, Human
agucaaaaggugccug

SEQ ID NO: 2097066 - RNA, 17 nt, Human
agucaaaaggugccugu

SEQ ID NO: 2097067 - RNA, 19 nt, Human
agucaaaacacuuguaauu

SEQ ID NO: 2097068 - RNA, 14 nt, Human
agucaaaacagaga

SEQ ID NO: 2097069 - RNA, 18 nt, Human
agugaccugaggaagcgu

SEQ ID NO: 2097070 - RNA, 16 nt, Human
agugaccugaggaagc

SEQ ID NO: 2097071 - RNA, 17 nt, Human
agugaccugaggaagcg

SEQ ID NO: 2097072 - RNA, 14 nt, Human
agugaccugaggaa

SEQ ID NO: 2097073 - RNA, 15 nt, Human
agugaccugaggaag

SEQ ID NO: 2097074 - RNA, 14 nt, Human
agugacgugcaccu

SEQ ID NO: 2097075 - RNA, 15 nt, Human
agucugugugaaggu

SEQ ID NO: 2097076 - RNA, 11 nt, Human
agucugugugc

SEQ ID NO: 2097077 - RNA, 21 nt, Human
agucugugugcugugguuccu

SEQ ID NO: 2097078 - RNA, 23 nt, Human
agucugugugcugugguuccugg

SEQ ID NO: 2097079 - RNA, 17 nt, Human
agucugugugggacugu

SEQ ID NO: 2097080 - RNA, 18 nt, Human
agucugugugggacugua

SEQ ID NO: 2097081 - RNA, 19 nt, Human
agucugugugggacuguac

SEQ ID NO: 2097082 - RNA, 22 nt, Human
agucugugugggacuguacaca

SEQ ID NO: 2097083 - RNA, 19 nt, Human
agugaauuugaaugaaaaa

SEQ ID NO: 2097084 - RNA, 23 nt, Human
agugaauuuuucucuaacucaga

SEQ ID NO: 2097085 - RNA, 17 nt, Human
agugaauuuuucucuaa

SEQ ID NO: 2097086 - RNA, 20 nt, Human
agugaauuuuucucuaacuc

SEQ ID NO: 2097087 - RNA, 20 nt, Human
agugaauuugaaugaaaaau

SEQ ID NO: 2097088 - RNA, 15 nt, Human
agugaauuuuucucu

SEQ ID NO: 2097089 - RNA, 16 nt, Human
agugaauuuuucucua

SEQ ID NO: 2097090 - RNA, 21 nt, Human
agugaauugugaccaaguuau

SEQ ID NO: 2097091 - RNA, 13 nt, Human
agugaauuugaau

SEQ ID NO: 2097092 - RNA, 14 nt, Human
agugaauuugaaug

SEQ ID NO: 2097093 - RNA, 15 nt, Human
agugaauuugaauga

SEQ ID NO: 2097094 - RNA, 14 nt, Human
agucugugccugga

SEQ ID NO: 2097095 - RNA, 16 nt, Human
agucugugccuggagc

SEQ ID NO: 2097096 - RNA, 17 nt, Human
agucugugccuggagcu

SEQ ID NO: 2097097 - RNA, 21 nt, Human
agucugugccuggagcuccug

SEQ ID NO: 2097098 - RNA, 22 nt, Human
agucugugccuggagcuccugg

SEQ ID NO: 2097099 - RNA, 23 nt, Human
agucugugccuggagcuccuggg

SEQ ID NO: 2097100 - RNA, 23 nt, Human
agucugacuuccccgcauuccag

SEQ ID NO: 2097101 - RNA, 11 nt, Human
agucuguguga

SEQ ID NO: 2097102 - RNA, 12 nt, Human
agucugugugaa

SEQ ID NO: 2097103 - RNA, 15 nt, Human
aguccuuaccucuuc

SEQ ID NO: 2097104 - RNA, 17 nt, Human
aguccuuaccucuuccg

SEQ ID NO: 2097105 - RNA, 21 nt, Human
aguccuuaccucuuccggaga

SEQ ID NO: 2097106 - RNA, 23 nt, Human
aguccuuaccucuuccggagaug

SEQ ID NO: 2097107 - RNA, 17 nt, Human
agucugaaguuucauuu

SEQ ID NO: 2097108 - RNA, 18 nt, Human
agucugaaguuucauuua

SEQ ID NO: 2097109 - RNA, 15 nt, Human
aguccuugcaagaau

SEQ ID NO: 2097110 - RNA, 13 nt, Human
agucaugugcauu

SEQ ID NO: 2097111 - RNA, 16 nt, Human
aguccaaauguccucc

SEQ ID NO: 2097112 - RNA, 21 nt, Human
agucaugaucucccugccgcc

SEQ ID NO: 2097113 - RNA, 15 nt, Human
agucaugaucucccu

SEQ ID NO: 2097114 - RNA, 16 nt, Human
agucaugaucucccug

SEQ ID NO: 2097115 - RNA, 17 nt, Human
agucaugaucucccugc

SEQ ID NO: 2097116 - RNA, 18 nt, Human
agucaugaucucccugcc

SEQ ID NO: 2097117 - RNA, 19 nt, Human
agucaugaucucccugccg

SEQ ID NO: 2097118 - RNA, 20 nt, Human
agucaugaucucccugccgc

SEQ ID NO: 2097119 - RNA, 23 nt, Human
agucaugaucucccugccgccuc

SEQ ID NO: 2097120 - RNA, 19 nt, Human
agucaugcguuuaaucaca

SEQ ID NO: 2097121 - RNA, 19 nt, Human
aguccucuuuucugagagg

SEQ ID NO: 2097122 - RNA, 18 nt, Human
aguccaacguggggcagc

SEQ ID NO: 2097123 - RNA, 19 nt, Human
aguccaaauguccuccaga

SEQ ID NO: 2097124 - RNA, 23 nt, Human
aguccaaauguccuccagaagcc

SEQ ID NO: 2097125 - RNA, 19 nt, Human
aguccaacguggggcagca

SEQ ID NO: 2097126 - RNA, 20 nt, Human
aguccaacguggggcagcac

SEQ ID NO: 2097127 - RNA, 22 nt, Human
aguccaacguggggcagcacag

SEQ ID NO: 2097128 - RNA, 23 nt, Human
aguccaacguggggcagcacaga

SEQ ID NO: 2097129 - RNA, 22 nt, Human
aguccucuuuucugagaggacu

SEQ ID NO: 2097130 - RNA, 14 nt, Human
agucaugagcugag

SEQ ID NO: 2097131 - RNA, 16 nt, Human
agucaugagcugagca

SEQ ID NO: 2097132 - RNA, 22 nt, Human
agucaugagcugagcagggaga

SEQ ID NO: 2097133 - RNA, 21 nt, Human
agugggccaggacaggcccgg

SEQ ID NO: 2097134 - RNA, 14 nt, Human
agugggccagugug

SEQ ID NO: 2097135 - RNA, 22 nt, Human
agugggauaaaggcccagacuc

SEQ ID NO: 2097136 - RNA, 13 nt, Human
agugggccaggac

SEQ ID NO: 2097137 - RNA, 15 nt, Human
agugggccaggacag

SEQ ID NO: 2097138 - RNA, 16 nt, Human
agugggccaggacagg

SEQ ID NO: 2097139 - RNA, 19 nt, Human
agugggccaggacaggccc

SEQ ID NO: 2097140 - RNA, 20 nt, Human
agugggccaggacaggcccg

SEQ ID NO: 2097141 - RNA, 22 nt, Human
agugucucggagggauuccccu

SEQ ID NO: 2097142 - RNA, 14 nt, Human
agugucuaaaaaca

SEQ ID NO: 2097143 - RNA, 18 nt, Human
agugucucaguccaccug

SEQ ID NO: 2097144 - RNA, 14 nt, Human
agugucaggaggaa

SEQ ID NO: 2097145 - RNA, 19 nt, Human
agugucacuuaccuagauu

SEQ ID NO: 2097146 - RNA, 21 nt, Human
agugucacuuaccuagauuua

SEQ ID NO: 2097147 - RNA, 19 nt, Human
agugucauuuaugaaaaga

SEQ ID NO: 2097148 - RNA, 21 nt, Human
agugggacagggcauggccag

SEQ ID NO: 2097149 - RNA, 19 nt, Human
agugggacagggcauggcc

SEQ ID NO: 2097150 - RNA, 20 nt, Human
agugggaacgugacugcccc

SEQ ID NO: 2097151 - RNA, 20 nt, Human
agugggaaggacuuggcgcg

SEQ ID NO: 2097152 - RNA, 15 nt, Human
agugggacagagucu

SEQ ID NO: 2097153 - RNA, 17 nt, Human
agugggacagagucugg

SEQ ID NO: 2097154 - RNA, 12 nt, Human
agugggagaaaa

SEQ ID NO: 2097155 - RNA, 13 nt, Human
aguggccuggcuc

SEQ ID NO: 2097156 - RNA, 14 nt, Human
aguggccuggcucc

SEQ ID NO: 2097157 - RNA, 17 nt, Human
aguggccuggcuccgcu

SEQ ID NO: 2097158 - RNA, 23 nt, Human
aguggccuggcuccgcugugugg

SEQ ID NO: 2097159 - RNA, 22 nt, Human
aguggccuggccaggagcucuu

SEQ ID NO: 2097160 - RNA, 23 nt, Human
aguggccuggccaggagcucuuc

SEQ ID NO: 2097161 - RNA, 13 nt, Human
aguggccuggcca

SEQ ID NO: 2097162 - RNA, 14 nt, Human
aguggccuggccag

SEQ ID NO: 2097163 - RNA, 15 nt, Human
aguggccuggccagg

SEQ ID NO: 2097164 - RNA, 18 nt, Human
aguggccuggccaggagc

SEQ ID NO: 2097165 - RNA, 19 nt, Human
aguggccuggccaggagcu

SEQ ID NO: 2097166 - RNA, 20 nt, Human
aguggccuggccaggagcuc

SEQ ID NO: 2097167 - RNA, 19 nt, Human
agugucucaguccaccuga

SEQ ID NO: 2097168 - RNA, 22 nt, Human
agugucucaguccaccugagcu

SEQ ID NO: 2097169 - RNA, 22 nt, Human
agugucuguaucggagacagug

SEQ ID NO: 2097170 - RNA, 13 nt, Human
agugucugugugc

SEQ ID NO: 2097171 - RNA, 22 nt, Human
agugucugugugcaagugugug

SEQ ID NO: 2097172 - RNA, 24 nt, Human
agugauccucccaccucagccucc

SEQ ID NO: 2097173 - RNA, 18 nt, Human
agugauccucccaccuca

SEQ ID NO: 2097174 - RNA, 15 nt, Human
agugauccucccacc

SEQ ID NO: 2097175 - RNA, 14 nt, Human
agugauccucccac

SEQ ID NO: 2097176 - RNA, 17 nt, Human
agugauucuccugccuc

SEQ ID NO: 2097177 - RNA, 15 nt, Human
agugauucuccugcc

SEQ ID NO: 2097178 - RNA, 16 nt, Human
agugccuuaccuccug

SEQ ID NO: 2097179 - RNA, 17 nt, Human
agugccuuaccuccugc

SEQ ID NO: 2097180 - RNA, 18 nt, Human
agugccuuaccuccugcc

SEQ ID NO: 2097181 - RNA, 19 nt, Human
agugccuuaccuccugccc

SEQ ID NO: 2097182 - RNA, 20 nt, Human
agugccuuaccuccugccca

SEQ ID NO: 2097183 - RNA, 14 nt, Human
agugauucuccugc

SEQ ID NO: 2097184 - RNA, 21 nt, Human
agugaugcugugcuaugaauu

SEQ ID NO: 2097185 - RNA, 13 nt, Human
agugaucuccaua

SEQ ID NO: 2097186 - RNA, 14 nt, Human
agugaucuccauau

SEQ ID NO: 2097187 - RNA, 21 nt, Human
agugaucuccauauguuacac

SEQ ID NO: 2097188 - RNA, 23 nt, Human
agugccuuaccuccugcccagga

SEQ ID NO: 2097189 - RNA, 21 nt, Human
agugccuuaccuccugcccag

SEQ ID NO: 2097190 - RNA, 22 nt, Human
agugccuuaccuccugcccagg

SEQ ID NO: 2097191 - RNA, 22 nt, Human
aguggccucaacccucccucag

SEQ ID NO: 2097192 - RNA, 15 nt, Human
aguggccucaacccu

SEQ ID NO: 2097193 - RNA, 20 nt, Human
aguggccucaacccucccuc

SEQ ID NO: 2097194 - RNA, 21 nt, Human
aguggccucaacccucccuca

SEQ ID NO: 2097195 - RNA, 18 nt, Human
aguucagguaacaggcag

SEQ ID NO: 2097196 - RNA, 15 nt, Human
aguucagcaccaccc

SEQ ID NO: 2097197 - RNA, 17 nt, Human
aguucagcaccacccua

SEQ ID NO: 2097198 - RNA, 18 nt, Human
aguucagcaccacccuag

SEQ ID NO: 2097199 - RNA, 21 nt, Human
aguucaggagucccaaggaaa

SEQ ID NO: 2097200 - RNA, 19 nt, Human
aguucaggagucccaagga

SEQ ID NO: 2097201 - RNA, 20 nt, Human
aguucaggagucccaaggaa

SEQ ID NO: 2097202 - RNA, 15 nt, Human
aguucagcugcuucu

SEQ ID NO: 2097203 - RNA, 16 nt, Human
aguucagcugcuucuc

SEQ ID NO: 2097204 - RNA, 16 nt, Human
aguucaggagucccaa

SEQ ID NO: 2097205 - RNA, 16 nt, Human
aguugaggccaggagu

SEQ ID NO: 2097206 - RNA, 15 nt, Human
aguugaggaguuucc

SEQ ID NO: 2097207 - RNA, 16 nt, Human
aguugaggaguuuccu

SEQ ID NO: 2097208 - RNA, 17 nt, Human
aguugaggaguuuccua

SEQ ID NO: 2097209 - RNA, 18 nt, Human
aguugugcacauggcuua

SEQ ID NO: 2097210 - RNA, 19 nt, Human
aguugucccgauuguaacu

SEQ ID NO: 2097211 - RNA, 20 nt, Human
aguugucccgauuguaacuc

SEQ ID NO: 2097212 - RNA, 22 nt, Human
aguugacuugacagaacacugu

SEQ ID NO: 2097213 - RNA, 14 nt, Human
auguuugccucugc

SEQ ID NO: 2097214 - RNA, 18 nt, Human
auguuucuuaaaugggcu

SEQ ID NO: 2097215 - RNA, 17 nt, Human
auguuugccucugccuc

SEQ ID NO: 2097216 - RNA, 15 nt, Human
auguuugccucugcc

SEQ ID NO: 2097217 - RNA, 23 nt, Human
auguuucgugaaguauacuguau

SEQ ID NO: 2097218 - RNA, 22 nt, Human
auguuucgcugauauauguguu

SEQ ID NO: 2097219 - RNA, 20 nt, Human
auguuucgugaaguauacug

SEQ ID NO: 2097220 - RNA, 13 nt, Human
auguucucugagg

SEQ ID NO: 2097221 - RNA, 17 nt, Human
auguucucucuucucca

SEQ ID NO: 2097222 - RNA, 16 nt, Human
auguucucucuucucc

SEQ ID NO: 2097223 - RNA, 14 nt, Human
auguucugggacac

SEQ ID NO: 2097224 - RNA, 17 nt, Human
auguucucugaggacac

SEQ ID NO: 2097225 - RNA, 15 nt, Human
auguucugggacaca

SEQ ID NO: 2097226 - RNA, 21 nt, Human
auguucugugccuguaaacau

SEQ ID NO: 2097227 - RNA, 14 nt, Human
auguucccuucucc

SEQ ID NO: 2097228 - RNA, 18 nt, Human
auguguaucggaugcuuu

SEQ ID NO: 2097229 - RNA, 13 nt, Human
auguguaaguauu

SEQ ID NO: 2097230 - RNA, 13 nt, Human
augucacaggcag

SEQ ID NO: 2097231 - RNA, 21 nt, Human
auguacaaaauaaaguuacau

SEQ ID NO: 2097232 - RNA, 20 nt, Human
auguaacugcauugagaacu

SEQ ID NO: 2097233 - RNA, 23 nt, Human
auguaacugcauugagaacugca

SEQ ID NO: 2097234 - RNA, 13 nt, Human
augguccccaugg

SEQ ID NO: 2097235 - RNA, 15 nt, Human
augguccgguguccu

SEQ ID NO: 2097236 - RNA, 15 nt, Human
auguaauugaauaaa

SEQ ID NO: 2097237 - RNA, 17 nt, Human
auguaauuuguguaaua

SEQ ID NO: 2097238 - RNA, 18 nt, Human
auguaauuuguguaauaa

SEQ ID NO: 2097239 - RNA, 21 nt, Human
auguaauuuguguaauaaagu

SEQ ID NO: 2097240 - RNA, 19 nt, Human
augucacaggcagguccag

SEQ ID NO: 2097241 - RNA, 13 nt, Human
augucaccaccuu

SEQ ID NO: 2097242 - RNA, 15 nt, Human
augucaccaccuucc

SEQ ID NO: 2097243 - RNA, 16 nt, Human
augucaccaccuuccc

SEQ ID NO: 2097244 - RNA, 18 nt, Human
augucaccaccuucccag

SEQ ID NO: 2097245 - RNA, 19 nt, Human
augucaccaccuucccagc

SEQ ID NO: 2097246 - RNA, 20 nt, Human
augucaccaccuucccagcu

SEQ ID NO: 2097247 - RNA, 23 nt, Human
augucaccaccuucccagcucuc

SEQ ID NO: 2097248 - RNA, 19 nt, Human
augucaccggauccugggu

SEQ ID NO: 2097249 - RNA, 20 nt, Human
augucaccggauccugggug

SEQ ID NO: 2097250 - RNA, 19 nt, Human
augucuuuuuuucuguuaa

SEQ ID NO: 2097251 - RNA, 20 nt, Human
augucuuuuuaagcuuauuu

SEQ ID NO: 2097252 - RNA, 16 nt, Human
augucuuuuuaagcuu

SEQ ID NO: 2097253 - RNA, 18 nt, Human
augucuuuuuaagcuuau

SEQ ID NO: 2097254 - RNA, 23 nt, Human
augucuuuuuaagcuuauuuaau

SEQ ID NO: 2097255 - RNA, 19 nt, Human
auggguguguguuugugug

SEQ ID NO: 2097256 - RNA, 12 nt, Human
augggugugugu

SEQ ID NO: 2097257 - RNA, 13 nt, Human
auggguguguguu

SEQ ID NO: 2097258 - RNA, 19 nt, Human
auggguuuuguagguacuu

SEQ ID NO: 2097259 - RNA, 15 nt, Human
auggguuauguguau

SEQ ID NO: 2097260 - RNA, 14 nt, Human
auggguugcauuug

SEQ ID NO: 2097261 - RNA, 23 nt, Human
augguaaaaguuacuuauucuag

SEQ ID NO: 2097262 - RNA, 13 nt, Human
augguaaaauugc

SEQ ID NO: 2097263 - RNA, 14 nt, Human
augguaaaauugca

SEQ ID NO: 2097264 - RNA, 15 nt, Human
augguaaaauugcau

SEQ ID NO: 2097265 - RNA, 16 nt, Human
augguaaaauugcaug

SEQ ID NO: 2097266 - RNA, 17 nt, Human
augguaaaauugcaugg

SEQ ID NO: 2097267 - RNA, 16 nt, Human
augguagucuaaccaa

SEQ ID NO: 2097268 - RNA, 19 nt, Human
augguagucuaaccaaaug

SEQ ID NO: 2097269 - RNA, 21 nt, Human
augguagucuaaccaaaugca

SEQ ID NO: 2097270 - RNA, 22 nt, Human
augguagucuaaccaaaugcau

SEQ ID NO: 2097271 - RNA, 18 nt, Human
augguaaagauauuauuc

SEQ ID NO: 2097272 - RNA, 20 nt, Human
augguaauuuauaguuuaua

SEQ ID NO: 2097273 - RNA, 19 nt, Human
augguacuagggggaagug

SEQ ID NO: 2097274 - RNA, 19 nt, Human
augcugcgcccuuccccag

SEQ ID NO: 2097275 - RNA, 15 nt, Human
auggaggccuguccu

SEQ ID NO: 2097276 - RNA, 19 nt, Human
auggaggcacacagcugca

SEQ ID NO: 2097277 - RNA, 12 nt, Human
auggaggccugu

SEQ ID NO: 2097278 - RNA, 18 nt, Human
auggaggcuauguggagu

SEQ ID NO: 2097279 - RNA, 17 nt, Human
auggaguagaccccugg

SEQ ID NO: 2097280 - RNA, 18 nt, Human
auggaguagaccccuggc

SEQ ID NO: 2097281 - RNA, 21 nt, Human
auggaguagaccccuggcugg

SEQ ID NO: 2097282 - RNA, 22 nt, Human
auggaguagaccccuggcuggu

SEQ ID NO: 2097283 - RNA, 18 nt, Human
auggaggggugguccuga

SEQ ID NO: 2097284 - RNA, 20 nt, Human
auggaggggugguccugacu

SEQ ID NO: 2097285 - RNA, 22 nt, Human
auggaggggugguccugacuca

SEQ ID NO: 2097286 - RNA, 17 nt, Human
auggauccccagugaaa

SEQ ID NO: 2097287 - RNA, 22 nt, Human
auggauccccagugaaaacuag

SEQ ID NO: 2097288 - RNA, 16 nt, Human
auggauauuagucaua

SEQ ID NO: 2097289 - RNA, 23 nt, Human
auggauauuagucauagaagaac

SEQ ID NO: 2097290 - RNA, 17 nt, Human
auggcugugccucugcc

SEQ ID NO: 2097291 - RNA, 16 nt, Human
auggcugugccucugc

SEQ ID NO: 2097292 - RNA, 15 nt, Human
auggcugugccucug

SEQ ID NO: 2097293 - RNA, 15 nt, Human
augcugccuccagaa

SEQ ID NO: 2097294 - RNA, 12 nt, Human
augcugccucca

SEQ ID NO: 2097295 - RNA, 16 nt, Human
augcugcgcccuuccc

SEQ ID NO: 2097296 - RNA, 18 nt, Human
augcugcgcccuucccca

SEQ ID NO: 2097297 - RNA, 17 nt, Human
augcugccuaggcugac

SEQ ID NO: 2097298 - RNA, 19 nt, Human
augcugccuaggcugaccu

SEQ ID NO: 2097299 - RNA, 12 nt, Human
augcugccugag

SEQ ID NO: 2097300 - RNA, 13 nt, Human
augcugccugagu

SEQ ID NO: 2097301 - RNA, 21 nt, Human
augcugacuguacuccuccca

SEQ ID NO: 2097302 - RNA, 20 nt, Human
augcugacuguacuccuccc

SEQ ID NO: 2097303 - RNA, 19 nt, Human
augcugacuguacuccucc

SEQ ID NO: 2097304 - RNA, 18 nt, Human
augaugaaaugaggucag

SEQ ID NO: 2097305 - RNA, 15 nt, Human
augaucuuuucaagu

SEQ ID NO: 2097306 - RNA, 23 nt, Human
augaugaaaugaggucagagccu

SEQ ID NO: 2097307 - RNA, 17 nt, Human
augaugacgacgacaac

SEQ ID NO: 2097308 - RNA, 22 nt, Human
augaugacgacgacaacgauga

SEQ ID NO: 2097309 - RNA, 11 nt, Human
augaugcacau

SEQ ID NO: 2097310 - RNA, 16 nt, Human
augaugcacauuucau

SEQ ID NO: 2097311 - RNA, 20 nt, Human
augaugauguggaagaacuu

SEQ ID NO: 2097312 - RNA, 15 nt, Human
augaugauccuaggc

SEQ ID NO: 2097313 - RNA, 15 nt, Human
augcacaaugucuug

SEQ ID NO: 2097314 - RNA, 16 nt, Human
augcacaaugucuugg

SEQ ID NO: 2097315 - RNA, 17 nt, Human
augaucuuugcagacag

SEQ ID NO: 2097316 - RNA, 14 nt, Human
augaucuugugaca

SEQ ID NO: 2097317 - RNA, 15 nt, Human
augaucuugugacau

SEQ ID NO: 2097318 - RNA, 21 nt, Human
augaucuuugcagacaggcaa

SEQ ID NO: 2097319 - RNA, 19 nt, Human
augaucuuugcagacaggc

SEQ ID NO: 2097320 - RNA, 18 nt, Human
augaucuuugcagacagg

SEQ ID NO: 2097321 - RNA, 15 nt, Human
augccuuacuuugua

SEQ ID NO: 2097322 - RNA, 16 nt, Human
augccuuacuuuguau

SEQ ID NO: 2097323 - RNA, 18 nt, Human
augccuuacuuuguauga

SEQ ID NO: 2097324 - RNA, 23 nt, Human
augccuuacuuuguaugauauuc

SEQ ID NO: 2097325 - RNA, 18 nt, Human
augccuuccagcacccug

SEQ ID NO: 2097326 - RNA, 19 nt, Human
augccuuccagcacccugc

SEQ ID NO: 2097327 - RNA, 15 nt, Human
augccuucuccagac

SEQ ID NO: 2097328 - RNA, 15 nt, Human
augcacaaaguguau

SEQ ID NO: 2097329 - RNA, 16 nt, Human
augccugcggaguugu

SEQ ID NO: 2097330 - RNA, 19 nt, Human
augccugccccaaacaaau

SEQ ID NO: 2097331 - RNA, 17 nt, Human
augccuguccagccugg

SEQ ID NO: 2097332 - RNA, 18 nt, Human
augccuguccagccuggg

SEQ ID NO: 2097333 - RNA, 21 nt, Human
augcacacagugcuuuccgug

SEQ ID NO: 2097334 - RNA, 19 nt, Human
aucccgugcaaaacaugcu

SEQ ID NO: 2097335 - RNA, 20 nt, Human
aucccgugcaaaacaugcua

SEQ ID NO: 2097336 - RNA, 23 nt, Human
auccccaggggucccagccaccc

SEQ ID NO: 2097337 - RNA, 19 nt, Human
auccccaggggucccagcc

SEQ ID NO: 2097338 - RNA, 21 nt, Human
auccccaggggucccagccac

SEQ ID NO: 2097339 - RNA, 22 nt, Human
aucccuacccccuaagagccau

SEQ ID NO: 2097340 - RNA, 14 nt, Human
aucccuacccccua

SEQ ID NO: 2097341 - RNA, 21 nt, Human
aucccuacccccuaagagcca

SEQ ID NO: 2097342 - RNA, 19 nt, Human
aucccaugagccucagcau

SEQ ID NO: 2097343 - RNA, 22 nt, Human
auccagaguuuagaggaaaaaa

SEQ ID NO: 2097344 - RNA, 13 nt, Human
auccccacccuug

SEQ ID NO: 2097345 - RNA, 14 nt, Human
aucccauugcccug

SEQ ID NO: 2097346 - RNA, 16 nt, Human
auccacucuacccucc

SEQ ID NO: 2097347 - RNA, 13 nt, Human
auccaccugucuc

SEQ ID NO: 2097348 - RNA, 18 nt, Human
auccaccugucucagccu

SEQ ID NO: 2097349 - RNA, 21 nt, Human
auccaccugucucagccuccc

SEQ ID NO: 2097350 - RNA, 19 nt, Human
auccagacccggcugcgug

SEQ ID NO: 2097351 - RNA, 18 nt, Human
auccacucuacccuccca

SEQ ID NO: 2097352 - RNA, 19 nt, Human
auccacucuacccucccac

SEQ ID NO: 2097353 - RNA, 20 nt, Human
auccacucuacccucccacc

SEQ ID NO: 2097354 - RNA, 21 nt, Human
auccacucuacccucccaccc

SEQ ID NO: 2097355 - RNA, 14 nt, Human
auccucacugggug

SEQ ID NO: 2097356 - RNA, 14 nt, Human
auccucaguuccug

SEQ ID NO: 2097357 - RNA, 19 nt, Human
auccucaguuccugcagca

SEQ ID NO: 2097358 - RNA, 22 nt, Human
auccucaguuccugcagcagag

SEQ ID NO: 2097359 - RNA, 15 nt, Human
auccuuagcaacagc

SEQ ID NO: 2097360 - RNA, 15 nt, Human
auccucacugggugg

SEQ ID NO: 2097361 - RNA, 12 nt, Human
auccuuccacgg

SEQ ID NO: 2097362 - RNA, 20 nt, Human
auccuucaagaacucugggc

SEQ ID NO: 2097363 - RNA, 21 nt, Human
auccuuguuuugugacauuuu

SEQ ID NO: 2097364 - RNA, 17 nt, Human
auccuuuaaauccuucc

SEQ ID NO: 2097365 - RNA, 19 nt, Human
aucgcccuccacaucccug

SEQ ID NO: 2097366 - RNA, 23 nt, Human
aucgcgccacuacacuccagccu

SEQ ID NO: 2097367 - RNA, 21 nt, Human
aucgcuccaccuugcagcucu

SEQ ID NO: 2097368 - RNA, 17 nt, Human
aucgcuccaccuugcag

SEQ ID NO: 2097369 - RNA, 14 nt, Human
aucaugucuggcua

SEQ ID NO: 2097370 - RNA, 16 nt, Human
aucaugaaauaugcau

SEQ ID NO: 2097371 - RNA, 15 nt, Human
aucaugaaauaugca

SEQ ID NO: 2097372 - RNA, 18 nt, Human
aucaugaaauaugcaucu

SEQ ID NO: 2097373 - RNA, 14 nt, Human
aucaugaaauaugc

SEQ ID NO: 2097374 - RNA, 12 nt, Human
aucaccucaggc

SEQ ID NO: 2097375 - RNA, 21 nt, Human
aucaggaaauauauaugugug

SEQ ID NO: 2097376 - RNA, 20 nt, Human
aucaggaaauauauaugugu

SEQ ID NO: 2097377 - RNA, 15 nt, Human
aucaccuagaaacuu

SEQ ID NO: 2097378 - RNA, 20 nt, Human
aucaccgagaguagccgaga

SEQ ID NO: 2097379 - RNA, 13 nt, Human
aucaccagacagg

SEQ ID NO: 2097380 - RNA, 15 nt, Human
aucacauaacagaau

SEQ ID NO: 2097381 - RNA, 17 nt, Human
aucacauagugaaaguu

SEQ ID NO: 2097382 - RNA, 23 nt, Human
aucacaggguugggcccagaucu

SEQ ID NO: 2097383 - RNA, 21 nt, Human
aucacagggccccagaaggca

SEQ ID NO: 2097384 - RNA, 14 nt, Human
aucacacuucugug

SEQ ID NO: 2097385 - RNA, 16 nt, Human
aucacacuucugugag

SEQ ID NO: 2097386 - RNA, 18 nt, Human
aucacacuucugugagac

SEQ ID NO: 2097387 - RNA, 11 nt, Human
aucacacacac

SEQ ID NO: 2097388 - RNA, 13 nt, Human
aucacacaaagca

SEQ ID NO: 2097389 - RNA, 13 nt, Human
aucacagccucug

SEQ ID NO: 2097390 - RNA, 15 nt, Human
aucacagaggcuucu

SEQ ID NO: 2097391 - RNA, 12 nt, Human
aucacagggccc

SEQ ID NO: 2097392 - RNA, 16 nt, Human
aucacagggccccaga

SEQ ID NO: 2097393 - RNA, 14 nt, Human
aucacagaggcuuc

SEQ ID NO: 2097394 - RNA, 22 nt, Human
aucacagggccccagaaggcag

SEQ ID NO: 2097395 - RNA, 18 nt, Human
aucacaggguugggccca

SEQ ID NO: 2097396 - RNA, 19 nt, Human
aucacaggguugggcccag

SEQ ID NO: 2097397 - RNA, 20 nt, Human
aucacaggguugggcccaga

SEQ ID NO: 2097398 - RNA, 20 nt, Human
aucaaauagaaccacuauga

SEQ ID NO: 2097399 - RNA, 21 nt, Human
aucaaauagaaccacuaugaa

SEQ ID NO: 2097400 - RNA, 21 nt, Human
aucaaaggaaaauaguaaugu

SEQ ID NO: 2097401 - RNA, 20 nt, Human
aucaaagagguuuuaaaaaa

SEQ ID NO: 2097402 - RNA, 23 nt, Human
aucaaagagguuuuaaaaaaauc

SEQ ID NO: 2097403 - RNA, 14 nt, Human
aucaaacagcucag

SEQ ID NO: 2097404 - RNA, 21 nt, Human
auauuuccuuaaacugugugg

SEQ ID NO: 2097405 - RNA, 21 nt, Human
aucaaaaucuguagagcaggg

SEQ ID NO: 2097406 - RNA, 13 nt, Human
aucaaaaugaccu

SEQ ID NO: 2097407 - RNA, 23 nt, Human
aucaaaaugaccucaccauuuuu

SEQ ID NO: 2097408 - RNA, 16 nt, Human
aucaaaauaaauugaa

SEQ ID NO: 2097409 - RNA, 17 nt, Human
aucaaaauaaauugaaa

SEQ ID NO: 2097410 - RNA, 19 nt, Human
aucaaaauaaauugaaaua

SEQ ID NO: 2097411 - RNA, 15 nt, Human
aucugggugacugag

SEQ ID NO: 2097412 - RNA, 16 nt, Human
aucuggggcucuggga

SEQ ID NO: 2097413 - RNA, 13 nt, Human
aucuuauucacau

SEQ ID NO: 2097414 - RNA, 15 nt, Human
aucuucaaagcuuga

SEQ ID NO: 2097415 - RNA, 19 nt, Human
aucuucaaagcuugaagau

SEQ ID NO: 2097416 - RNA, 21 nt, Human
aucuucacaauggugcucauu

SEQ ID NO: 2097417 - RNA, 16 nt, Human
aucuuauuuucaugua

SEQ ID NO: 2097418 - RNA, 23 nt, Human
aucuuauuuucauguauaugugu

SEQ ID NO: 2097419 - RNA, 16 nt, Human
aucucugcuuuggaaa

SEQ ID NO: 2097420 - RNA, 22 nt, Human
aucuggacuccucuguccaggc

SEQ ID NO: 2097421 - RNA, 17 nt, Human
aucucucuuuaauauaa

SEQ ID NO: 2097422 - RNA, 16 nt, Human
aucucugaacuucagc

SEQ ID NO: 2097423 - RNA, 17 nt, Human
aucucugaacuucagcu

SEQ ID NO: 2097424 - RNA, 15 nt, Human
aucuucguucuuguu

SEQ ID NO: 2097425 - RNA, 18 nt, Human
aucuucguucuuguuagu

SEQ ID NO: 2097426 - RNA, 22 nt, Human
aucuucccuagaggguuccugu

SEQ ID NO: 2097427 - RNA, 21 nt, Human
aucuuccccaacgaaaagcac

SEQ ID NO: 2097428 - RNA, 21 nt, Human
aucuucccuagaggguuccug

SEQ ID NO: 2097429 - RNA, 20 nt, Human
aucuauauaguaccuuugcu

SEQ ID NO: 2097430 - RNA, 21 nt, Human
aucuauauaguaccuuugcuc

SEQ ID NO: 2097431 - RNA, 12 nt, Human
aucuauuguaag

SEQ ID NO: 2097432 - RNA, 13 nt, Human
aucuauuguaaga

SEQ ID NO: 2097433 - RNA, 14 nt, Human
aucuauuguaagau

SEQ ID NO: 2097434 - RNA, 15 nt, Human
aucuauuguaagaua

SEQ ID NO: 2097435 - RNA, 17 nt, Human
aucuauuguaagauaaa

SEQ ID NO: 2097436 - RNA, 19 nt, Human
aucuauuguaagauaaaaa

SEQ ID NO: 2097437 - RNA, 20 nt, Human
aucuauuguaagauaaaaaa

SEQ ID NO: 2097438 - RNA, 21 nt, Human
aucuauuguaagauaaaaaag

SEQ ID NO: 2097439 - RNA, 15 nt, Human
aucuauugggauuuu

SEQ ID NO: 2097440 - RNA, 17 nt, Human
aucuauugggauuuucu

SEQ ID NO: 2097441 - RNA, 16 nt, Human
aucuauuggguucauu

SEQ ID NO: 2097442 - RNA, 17 nt, Human
aucuauuggguucauua

SEQ ID NO: 2097443 - RNA, 19 nt, Human
aucuauuggguucauuauu

SEQ ID NO: 2097444 - RNA, 15 nt, Human
aucuauuucugagaa

SEQ ID NO: 2097445 - RNA, 22 nt, Human
aucuauuggguucauuauugga

SEQ ID NO: 2097446 - RNA, 13 nt, Human
aucuauuuauugg

SEQ ID NO: 2097447 - RNA, 14 nt, Human
aucuauuuauugga

SEQ ID NO: 2097448 - RNA, 12 nt, Human
aucuauuuguau

SEQ ID NO: 2097449 - RNA, 20 nt, Human
aucuauuuguauauauacau

SEQ ID NO: 2097450 - RNA, 22 nt, Human
aucuauuuguauauauacauaa

SEQ ID NO: 2097451 - RNA, 14 nt, Human
aucuauuucugaga

SEQ ID NO: 2097452 - RNA, 15 nt, Human
aucuccguggcuuug

SEQ ID NO: 2097453 - RNA, 20 nt, Human
aucuccugaggaucagaaag

SEQ ID NO: 2097454 - RNA, 21 nt, Human
aucuccugaggaucagaaagu

SEQ ID NO: 2097455 - RNA, 22 nt, Human
aucuccugaggaucagaaagua

SEQ ID NO: 2097456 - RNA, 13 nt, Human
aucuccuauuuuu

SEQ ID NO: 2097457 - RNA, 14 nt, Human
aucuccuauuuuuu

SEQ ID NO: 2097458 - RNA, 18 nt, Human
aucuccuauuuuuuuaaa

SEQ ID NO: 2097459 - RNA, 20 nt, Human
aucuccuauuuuuuuaaaau

SEQ ID NO: 2097460 - RNA, 22 nt, Human
aucuccuauuuuuuuaaaauca

SEQ ID NO: 2097461 - RNA, 13 nt, Human
aucuccucacuga

SEQ ID NO: 2097462 - RNA, 20 nt, Human
aucuccucgcaagcugggua

SEQ ID NO: 2097463 - RNA, 14 nt, Human
aucuccugugcaug

SEQ ID NO: 2097464 - RNA, 11 nt, Human
aucucucccuc

SEQ ID NO: 2097465 - RNA, 23 nt, Human
aucucucccuccccugccauuuu

SEQ ID NO: 2097466 - RNA, 14 nt, Human
aucucucccucccc

SEQ ID NO: 2097467 - RNA, 15 nt, Human
aucucucccuccccu

SEQ ID NO: 2097468 - RNA, 20 nt, Human
aucuaggugaggauugauua

SEQ ID NO: 2097469 - RNA, 18 nt, Human
aucuagguggaguugaaa

SEQ ID NO: 2097470 - RNA, 21 nt, Human
aucuagguggaguugaaagag

SEQ ID NO: 2097471 - RNA, 22 nt, Human
aucuagguggaguugaaagagu

SEQ ID NO: 2097472 - RNA, 21 nt, Human
aucuagugcagcugauuuuaa

SEQ ID NO: 2097473 - RNA, 18 nt, Human
aucuagugcagcugauuu

SEQ ID NO: 2097474 - RNA, 19 nt, Human
aucuagugcagcugauuuu

SEQ ID NO: 2097475 - RNA, 22 nt, Human
aucuagugcagcugauuuuaac

SEQ ID NO: 2097476 - RNA, 13 nt, Human
aucuagugcagcu

SEQ ID NO: 2097477 - RNA, 14 nt, Human
aucuagugcagcug

SEQ ID NO: 2097478 - RNA, 15 nt, Human
aucuagugcagcuga

SEQ ID NO: 2097479 - RNA, 17 nt, Human
aucuagugcagcugauu

SEQ ID NO: 2097480 - RNA, 12 nt, Human
augaaaauguca

SEQ ID NO: 2097481 - RNA, 13 nt, Human
augaaaaugucag

SEQ ID NO: 2097482 - RNA, 15 nt, Human
augaaaaugucagaa

SEQ ID NO: 2097483 - RNA, 19 nt, Human
augaaaaugucagaaacca

SEQ ID NO: 2097484 - RNA, 20 nt, Human
augaaaaugcaacaacaugu

SEQ ID NO: 2097485 - RNA, 15 nt, Human
augaaaauccuacca

SEQ ID NO: 2097486 - RNA, 17 nt, Human
augaaaauccuaccaac

SEQ ID NO: 2097487 - RNA, 19 nt, Human
augaaaauccuaccaaccu

SEQ ID NO: 2097488 - RNA, 20 nt, Human
augaaaauccuaccaaccuc

SEQ ID NO: 2097489 - RNA, 21 nt, Human
augaaaauccuaccaaccucu

SEQ ID NO: 2097490 - RNA, 19 nt, Human
augaaguguguuuccuuca

SEQ ID NO: 2097491 - RNA, 23 nt, Human
augaaguguguuuccuucagugc

SEQ ID NO: 2097492 - RNA, 14 nt, Human
augacuaaaaauau

SEQ ID NO: 2097493 - RNA, 16 nt, Human
augacuaaaaauauua

SEQ ID NO: 2097494 - RNA, 23 nt, Human
augacuaaaaauauuauaacuua

SEQ ID NO: 2097495 - RNA, 11 nt, Human
augacuaaaga

SEQ ID NO: 2097496 - RNA, 12 nt, Human
augacuaaagag

SEQ ID NO: 2097497 - RNA, 13 nt, Human
augacuaaagaga

SEQ ID NO: 2097498 - RNA, 14 nt, Human
augacuaaagagag

SEQ ID NO: 2097499 - RNA, 15 nt, Human
augacuaaagagaga

SEQ ID NO: 2097500 - RNA, 16 nt, Human
augacuaaagagagaa

SEQ ID NO: 2097501 - RNA, 17 nt, Human
augacuaaagagagaau

SEQ ID NO: 2097502 - RNA, 18 nt, Human
augacuaaagagagaaug

SEQ ID NO: 2097503 - RNA, 12 nt, Human
augacccaggcu

SEQ ID NO: 2097504 - RNA, 18 nt, Human
augacccaggcugccuga

SEQ ID NO: 2097505 - RNA, 16 nt, Human
augacggaagaacaua

SEQ ID NO: 2097506 - RNA, 19 nt, Human
augacggaagaacauagaa

SEQ ID NO: 2097507 - RNA, 21 nt, Human
augacggaagaacauagaacu

SEQ ID NO: 2097508 - RNA, 15 nt, Human
augaaguuguaggua

SEQ ID NO: 2097509 - RNA, 17 nt, Human
augaccauacugaggga

SEQ ID NO: 2097510 - RNA, 20 nt, Human
augaccagaagggaaacagu

SEQ ID NO: 2097511 - RNA, 14 nt, Human
augaaguuuauaca

SEQ ID NO: 2097512 - RNA, 15 nt, Human
augaaguuuauacag

SEQ ID NO: 2097513 - RNA, 16 nt, Human
augaaguuuauacagu

SEQ ID NO: 2097514 - RNA, 17 nt, Human
augaaguuuauacagua

SEQ ID NO: 2097515 - RNA, 21 nt, Human
augacuaaagagagaauguag

SEQ ID NO: 2097516 - RNA, 19 nt, Human
augacuaaagagagaaugu

SEQ ID NO: 2097517 - RNA, 20 nt, Human
augacuaaagagagaaugua

SEQ ID NO: 2097518 - RNA, 23 nt, Human
augacuaaagagagaauguagau

SEQ ID NO: 2097519 - RNA, 13 nt, Human
augacugcauuuu

SEQ ID NO: 2097520 - RNA, 12 nt, Human
augacuggaauu

SEQ ID NO: 2097521 - RNA, 13 nt, Human
augacuggaauuu

SEQ ID NO: 2097522 - RNA, 15 nt, Human
augacuggaauuuuu

SEQ ID NO: 2097523 - RNA, 17 nt, Human
augacuggaauuuuuau

SEQ ID NO: 2097524 - RNA, 22 nt, Human
augacuggaauuuuuauuaugc

SEQ ID NO: 2097525 - RNA, 15 nt, Human
augacuguuuuuuaa

SEQ ID NO: 2097526 - RNA, 15 nt, Human
augaggggcccgagc

SEQ ID NO: 2097527 - RNA, 16 nt, Human
augagggaucacaggg

SEQ ID NO: 2097528 - RNA, 22 nt, Human
augaaaaauuuaagcauuguuu

SEQ ID NO: 2097529 - RNA, 22 nt, Human
agacugaccaauauuguacagu

SEQ ID NO: 2097530 - RNA, 16 nt, Human
agacucuguggggccu

SEQ ID NO: 2097531 - RNA, 13 nt, Human
agacugagcucaa

SEQ ID NO: 2097532 - RNA, 19 nt, Human
agacugcugggacuggcca

SEQ ID NO: 2097533 - RNA, 20 nt, Human
agacugcugggacuggccag

SEQ ID NO: 2097534 - RNA, 22 nt, Human
agacugcugggacuggccaggu

SEQ ID NO: 2097535 - RNA, 13 nt, Human
agacucugucuca

SEQ ID NO: 2097536 - RNA, 18 nt, Human
agacucugucucaaaaaa

SEQ ID NO: 2097537 - RNA, 14 nt, Human
agacgccuuacugg

SEQ ID NO: 2097538 - RNA, 14 nt, Human
agagccucaaauga

SEQ ID NO: 2097539 - RNA, 17 nt, Human
agagccucaaaugagaa

SEQ ID NO: 2097540 - RNA, 15 nt, Human
agagcccuucauuug

SEQ ID NO: 2097541 - RNA, 13 nt, Human
agagccgggaagc

SEQ ID NO: 2097542 - RNA, 16 nt, Human
agagccgggaagcgau

SEQ ID NO: 2097543 - RNA, 17 nt, Human
agagccgugaugccucc

SEQ ID NO: 2097544 - RNA, 20 nt, Human
agagccuccuuucuggcuuu

SEQ ID NO: 2097545 - RNA, 20 nt, Human
agacuggauaguccgucucu

SEQ ID NO: 2097546 - RNA, 14 nt, Human
agagagacaagaag

SEQ ID NO: 2097547 - RNA, 19 nt, Human
agagagaagugccccugcu

SEQ ID NO: 2097548 - RNA, 15 nt, Human
agagagaagugcccc

SEQ ID NO: 2097549 - RNA, 16 nt, Human
agacuggauaguccgu

SEQ ID NO: 2097550 - RNA, 13 nt, Human
agacuggagggga

SEQ ID NO: 2097551 - RNA, 23 nt, Human
agacuggaggggacgcugguaga

SEQ ID NO: 2097552 - RNA, 15 nt, Human
agacuggauacugcc

SEQ ID NO: 2097553 - RNA, 16 nt, Human
agacuggauacugccc

SEQ ID NO: 2097554 - RNA, 16 nt, Human
agagagaccacuuuuc

SEQ ID NO: 2097555 - RNA, 13 nt, Human
agagagagaagug

SEQ ID NO: 2097556 - RNA, 11 nt, Human
agacuggaggg

SEQ ID NO: 2097557 - RNA, 13 nt, Human
agagccagggucu

SEQ ID NO: 2097558 - RNA, 14 nt, Human
agagagggggccac

SEQ ID NO: 2097559 - RNA, 16 nt, Human
agagagggggccaccu

SEQ ID NO: 2097560 - RNA, 19 nt, Human
agagagggggccaccuccc

SEQ ID NO: 2097561 - RNA, 22 nt, Human
agagaggggaauaauagaagaa

SEQ ID NO: 2097562 - RNA, 19 nt, Human
agagccauggacucuacac

SEQ ID NO: 2097563 - RNA, 13 nt, Human
agagcccaccuug

SEQ ID NO: 2097564 - RNA, 17 nt, Human
agagagggaauucucuu

SEQ ID NO: 2097565 - RNA, 18 nt, Human
agagagggaauucucuug

SEQ ID NO: 2097566 - RNA, 14 nt, Human
agagagaguguuug

SEQ ID NO: 2097567 - RNA, 23 nt, Human
agaggacuuuucuuuguggcuuc

SEQ ID NO: 2097568 - RNA, 14 nt, Human
agaggagucagaga

SEQ ID NO: 2097569 - RNA, 21 nt, Human
agaggagggcgugacucaccc

SEQ ID NO: 2097570 - RNA, 19 nt, Human
agaggagggcgugacucac

SEQ ID NO: 2097571 - RNA, 17 nt, Human
agaggagggaugcugcc

SEQ ID NO: 2097572 - RNA, 22 nt, Human
agaggacuuuucuuuguggcuu

SEQ ID NO: 2097573 - RNA, 21 nt, Human
agaggacuuuucuuuguggcu

SEQ ID NO: 2097574 - RNA, 14 nt, Human
agaggacuuuucuu

SEQ ID NO: 2097575 - RNA, 23 nt, Human
agaggaaucagacuucacacugc

SEQ ID NO: 2097576 - RNA, 14 nt, Human
agaggggggcugcc

SEQ ID NO: 2097577 - RNA, 12 nt, Human
agagggggccac

SEQ ID NO: 2097578 - RNA, 24 nt, Human
agaggaaucagacuucacacugca

SEQ ID NO: 2097579 - RNA, 11 nt, Human
agacagagucu

SEQ ID NO: 2097580 - RNA, 12 nt, Human
agacagagcugg

SEQ ID NO: 2097581 - RNA, 21 nt, Human
agacagagcugguugggaaga

SEQ ID NO: 2097582 - RNA, 20 nt, Human
agacagagucucacuguugc

SEQ ID NO: 2097583 - RNA, 19 nt, Human
agacagagucucacuguug

SEQ ID NO: 2097584 - RNA, 18 nt, Human
agacaaaugcugcgcccu

SEQ ID NO: 2097585 - RNA, 14 nt, Human
agacaaauggagga

SEQ ID NO: 2097586 - RNA, 18 nt, Human
agacaaauggaggaauau

SEQ ID NO: 2097587 - RNA, 16 nt, Human
agacaaaccagaagca

SEQ ID NO: 2097588 - RNA, 17 nt, Human
agacaaaccagaagcaa

SEQ ID NO: 2097589 - RNA, 15 nt, Human
agaccagccuggcca

SEQ ID NO: 2097590 - RNA, 13 nt, Human
agaccagccuggc

SEQ ID NO: 2097591 - RNA, 14 nt, Human
agaccagccuggcc

SEQ ID NO: 2097592 - RNA, 12 nt, Human
agaccagccugg

SEQ ID NO: 2097593 - RNA, 16 nt, Human
agacccaaggaggaaa

SEQ ID NO: 2097594 - RNA, 14 nt, Human
agacccaaggagga

SEQ ID NO: 2097595 - RNA, 17 nt, Human
agacgauuugucaguua

SEQ ID NO: 2097596 - RNA, 21 nt, Human
agacagagucucacuguugcc

SEQ ID NO: 2097597 - RNA, 14 nt, Human
agacagaugcccca

SEQ ID NO: 2097598 - RNA, 15 nt, Human
agacagaugccccag

SEQ ID NO: 2097599 - RNA, 16 nt, Human
agacagaugccccaga

SEQ ID NO: 2097600 - RNA, 19 nt, Human
agacagaugccccagagcu

SEQ ID NO: 2097601 - RNA, 12 nt, Human
agacagcagcuc

SEQ ID NO: 2097602 - RNA, 14 nt, Human
agacagcagcucag

SEQ ID NO: 2097603 - RNA, 16 nt, Human
agacagcagcucaggc

SEQ ID NO: 2097604 - RNA, 12 nt, Human
agaccagagcuc

SEQ ID NO: 2097605 - RNA, 14 nt, Human
agaccagagcucug

SEQ ID NO: 2097606 - RNA, 15 nt, Human
agaccagagcucugg

SEQ ID NO: 2097607 - RNA, 16 nt, Human
agaccagagcucugga

SEQ ID NO: 2097608 - RNA, 17 nt, Human
agaccagagcucuggag

SEQ ID NO: 2097609 - RNA, 18 nt, Human
agaccagagcucuggagc

SEQ ID NO: 2097610 - RNA, 19 nt, Human
agaccagagcucuggagcc

SEQ ID NO: 2097611 - RNA, 20 nt, Human
agaccagagcucuggagcca

SEQ ID NO: 2097612 - RNA, 21 nt, Human
acuuuccucuuagucgagcca

SEQ ID NO: 2097613 - RNA, 19 nt, Human
acuuuccccauacucuguc

SEQ ID NO: 2097614 - RNA, 21 nt, Human
acuuuccccauacucugucuc

SEQ ID NO: 2097615 - RNA, 22 nt, Human
acuuuccccauacucugucucc

SEQ ID NO: 2097616 - RNA, 22 nt, Human
acuuuccccgugggccauggca

SEQ ID NO: 2097617 - RNA, 21 nt, Human
agaagacacugaugggcaacc

SEQ ID NO: 2097618 - RNA, 12 nt, Human
agaagacaugaa

SEQ ID NO: 2097619 - RNA, 12 nt, Human
agaagacacugc

SEQ ID NO: 2097620 - RNA, 15 nt, Human
agaagacaugaacca

SEQ ID NO: 2097621 - RNA, 16 nt, Human
agaagacaugaaccaa

SEQ ID NO: 2097622 - RNA, 13 nt, Human
agaagacacugau

SEQ ID NO: 2097623 - RNA, 18 nt, Human
agaagagacucuuugcau

SEQ ID NO: 2097624 - RNA, 15 nt, Human
agaagagagaaauag

SEQ ID NO: 2097625 - RNA, 21 nt, Human
agaagagauugugguuucauu

SEQ ID NO: 2097626 - RNA, 22 nt, Human
agaagagaguccauauuucaau

SEQ ID NO: 2097627 - RNA, 18 nt, Human
agaagguuucagaaagaa

SEQ ID NO: 2097628 - RNA, 13 nt, Human
agaaguaacaaga

SEQ ID NO: 2097629 - RNA, 20 nt, Human
agaaguaacaagagugauuc

SEQ ID NO: 2097630 - RNA, 21 nt, Human
agaaguaacaagagugauucu

SEQ ID NO: 2097631 - RNA, 14 nt, Human
agaaguaacuuacu

SEQ ID NO: 2097632 - RNA, 21 nt, Human
agaaguaggcaugagggauca

SEQ ID NO: 2097633 - RNA, 17 nt, Human
agaaguaggcaugaggg

SEQ ID NO: 2097634 - RNA, 21 nt, Human
agaagguauuccuuuugugua

SEQ ID NO: 2097635 - RNA, 23 nt, Human
agaaggguuuuccacccuggaau

SEQ ID NO: 2097636 - RNA, 21 nt, Human
agaaggguuuuccacccugga

SEQ ID NO: 2097637 - RNA, 22 nt, Human
agaaggguuuuccacccuggaa

SEQ ID NO: 2097638 - RNA, 15 nt, Human
agaaggguccuuccc

SEQ ID NO: 2097639 - RNA, 18 nt, Human
agaaggguccuucccucu

SEQ ID NO: 2097640 - RNA, 20 nt, Human
agaaggguccuucccucucc

SEQ ID NO: 2097641 - RNA, 23 nt, Human
agaaggguccuucccucucccca

SEQ ID NO: 2097642 - RNA, 16 nt, Human
agaaggguuauauuuu

SEQ ID NO: 2097643 - RNA, 19 nt, Human
agaaggguuauauuuuacu

SEQ ID NO: 2097644 - RNA, 20 nt, Human
agaaggguuuuccacccugg

SEQ ID NO: 2097645 - RNA, 19 nt, Human
agaagguggggguuggcug

SEQ ID NO: 2097646 - RNA, 20 nt, Human
agaagguggggguuggcugg

SEQ ID NO: 2097647 - RNA, 22 nt, Human
agaagguggggguuggcugggu

SEQ ID NO: 2097648 - RNA, 23 nt, Human
agaagguggggguuggcugggua

SEQ ID NO: 2097649 - RNA, 14 nt, Human
agaagguccuuaau

SEQ ID NO: 2097650 - RNA, 20 nt, Human
agaagguccuuaaugauccg

SEQ ID NO: 2097651 - RNA, 21 nt, Human
agaagguccuuaaugauccgu

SEQ ID NO: 2097652 - RNA, 22 nt, Human
agaagagaugggcuuguuuucu

SEQ ID NO: 2097653 - RNA, 17 nt, Human
agaagaggcagauucaa

SEQ ID NO: 2097654 - RNA, 20 nt, Human
agaagagaugggcuuguuuu

SEQ ID NO: 2097655 - RNA, 17 nt, Human
agaagggggccaugagg

SEQ ID NO: 2097656 - RNA, 18 nt, Human
agaagggggucaaagcaa

SEQ ID NO: 2097657 - RNA, 19 nt, Human
agaagggggucaaagcaag

SEQ ID NO: 2097658 - RNA, 20 nt, Human
agaagggggucaaagcaagg

SEQ ID NO: 2097659 - RNA, 21 nt, Human
agaagggggucaaagcaagga

SEQ ID NO: 2097660 - RNA, 20 nt, Human
agaaugaaauugcugaaaga

SEQ ID NO: 2097661 - RNA, 18 nt, Human
agaaugaaagggcccaga

SEQ ID NO: 2097662 - RNA, 17 nt, Human
agaagucaugaagccca

SEQ ID NO: 2097663 - RNA, 14 nt, Human
agaagucaaaguaa

SEQ ID NO: 2097664 - RNA, 18 nt, Human
agaagucacucaauuguu

SEQ ID NO: 2097665 - RNA, 13 nt, Human
agaagucaugaag

SEQ ID NO: 2097666 - RNA, 14 nt, Human
agaaugagagugug

SEQ ID NO: 2097667 - RNA, 23 nt, Human
agaauggcuuuggucucuugcuu

SEQ ID NO: 2097668 - RNA, 18 nt, Human
agaauggcuuuggucucu

SEQ ID NO: 2097669 - RNA, 13 nt, Human
agaaugcugguuu

SEQ ID NO: 2097670 - RNA, 18 nt, Human
agaaugcugguuuuccua

SEQ ID NO: 2097671 - RNA, 14 nt, Human
agcaaaccugcccc

SEQ ID NO: 2097672 - RNA, 15 nt, Human
agcaaaccugcccca

SEQ ID NO: 2097673 - RNA, 19 nt, Human
agcaaacuaacuugacuuu

SEQ ID NO: 2097674 - RNA, 13 nt, Human
agcaaacacauua

SEQ ID NO: 2097675 - RNA, 16 nt, Human
agcaaaagaaguaaca

SEQ ID NO: 2097676 - RNA, 18 nt, Human
agcaaaagaugcuucuca

SEQ ID NO: 2097677 - RNA, 21 nt, Human
agauugcaacaggcugggcuu

SEQ ID NO: 2097678 - RNA, 20 nt, Human
agauugcaacaggcugggcu

SEQ ID NO: 2097679 - RNA, 23 nt, Human
agauugcaacaggcugggcuuca

SEQ ID NO: 2097680 - RNA, 16 nt, Human
agcaaaaccauugcuu

SEQ ID NO: 2097681 - RNA, 17 nt, Human
agcaaaaccauugcuuc

SEQ ID NO: 2097682 - RNA, 18 nt, Human
agcaaaaccauugcuuca

SEQ ID NO: 2097683 - RNA, 19 nt, Human
agcaaaaccauugcuucac

SEQ ID NO: 2097684 - RNA, 20 nt, Human
agcaaaaccauugcuucacu

SEQ ID NO: 2097685 - RNA, 22 nt, Human
agcaaaaccauugcuucacuac

SEQ ID NO: 2097686 - RNA, 17 nt, Human
agcaaaacuccaucuca

SEQ ID NO: 2097687 - RNA, 15 nt, Human
agauugaaaaggaag

SEQ ID NO: 2097688 - RNA, 16 nt, Human
agauugaaaaggaaga

SEQ ID NO: 2097689 - RNA, 16 nt, Human
agcaaauguggcuccu

SEQ ID NO: 2097690 - RNA, 15 nt, Human
agcaaaugugaccug

SEQ ID NO: 2097691 - RNA, 13 nt, Human
agcaaauguuaca

SEQ ID NO: 2097692 - RNA, 14 nt, Human
agcaaauguuacau

SEQ ID NO: 2097693 - RNA, 15 nt, Human
agcaaauguuacaua

SEQ ID NO: 2097694 - RNA, 19 nt, Human
agcaaauguuacauagugu

SEQ ID NO: 2097695 - RNA, 20 nt, Human
agcaaauguuacauagugua

SEQ ID NO: 2097696 - RNA, 17 nt, Human
agcaaauguuaugcaua

SEQ ID NO: 2097697 - RNA, 23 nt, Human
agcaaaggaguagaaagacagag

SEQ ID NO: 2097698 - RNA, 13 nt, Human
agaugauccauga

SEQ ID NO: 2097699 - RNA, 14 nt, Human
agaugguuacacug

SEQ ID NO: 2097700 - RNA, 16 nt, Human
agaugguuacacuguu

SEQ ID NO: 2097701 - RNA, 18 nt, Human
agaugguuacacuguuag

SEQ ID NO: 2097702 - RNA, 19 nt, Human
agaugguuacacuguuaga

SEQ ID NO: 2097703 - RNA, 19 nt, Human
agaugguauauuugguacu

SEQ ID NO: 2097704 - RNA, 13 nt, Human
agaugggugggga

SEQ ID NO: 2097705 - RNA, 21 nt, Human
agauguagcaaaacgcaugga

SEQ ID NO: 2097706 - RNA, 19 nt, Human
agauguagauaaacucaga

SEQ ID NO: 2097707 - RNA, 20 nt, Human
agauguaagagcuuuacaaa

SEQ ID NO: 2097708 - RNA, 18 nt, Human
agaugguuugagccugag

SEQ ID NO: 2097709 - RNA, 11 nt, Human
agaguggccug

SEQ ID NO: 2097710 - RNA, 12 nt, Human
agaguggccugg

SEQ ID NO: 2097711 - RNA, 21 nt, Human
agagugcuguccgguggagau

SEQ ID NO: 2097712 - RNA, 13 nt, Human
agagugccccacc

SEQ ID NO: 2097713 - RNA, 16 nt, Human
agagugccccaccugc

SEQ ID NO: 2097714 - RNA, 18 nt, Human
agagugccccaccugcca

SEQ ID NO: 2097715 - RNA, 19 nt, Human
agagugccccaccugccac

SEQ ID NO: 2097716 - RNA, 13 nt, Human
agagugcccagaa

SEQ ID NO: 2097717 - RNA, 12 nt, Human
agagugcccaga

SEQ ID NO: 2097718 - RNA, 18 nt, Human
agagugcauugugagggu

SEQ ID NO: 2097719 - RNA, 17 nt, Human
agagugauaauacaagu

SEQ ID NO: 2097720 - RNA, 14 nt, Human
agagugcaaaacau

SEQ ID NO: 2097721 - RNA, 13 nt, Human
agagugcaacagu

SEQ ID NO: 2097722 - RNA, 17 nt, Human
agagugcaacaguagca

SEQ ID NO: 2097723 - RNA, 22 nt, Human
agagugcaacaguagcauagga

SEQ ID NO: 2097724 - RNA, 19 nt, Human
agaugaagcaaacacauua

SEQ ID NO: 2097725 - RNA, 20 nt, Human
agaugaagagugagagggca

SEQ ID NO: 2097726 - RNA, 18 nt, Human
agaugaagcaaacacauu

SEQ ID NO: 2097727 - RNA, 17 nt, Human
agaugaagcaaacacau

SEQ ID NO: 2097728 - RNA, 21 nt, Human
agaugaacucuuucuggccug

SEQ ID NO: 2097729 - RNA, 17 nt, Human
agaugaagagugagagg

SEQ ID NO: 2097730 - RNA, 19 nt, Human
agaugaagagugagagggc

SEQ ID NO: 2097731 - RNA, 17 nt, Human
agcaauguuaucuuggu

SEQ ID NO: 2097732 - RNA, 14 nt, Human
agcaauccuccuga

SEQ ID NO: 2097733 - RNA, 17 nt, Human
agcaauccuccugagug

SEQ ID NO: 2097734 - RNA, 12 nt, Human
agcagccucuga

SEQ ID NO: 2097735 - RNA, 14 nt, Human
agcagccucugaag

SEQ ID NO: 2097736 - RNA, 15 nt, Human
agcagcuugcugcac

SEQ ID NO: 2097737 - RNA, 17 nt, Human
agcagcuugcugcaccc

SEQ ID NO: 2097738 - RNA, 14 nt, Human
agcacuuggagcca

SEQ ID NO: 2097739 - RNA, 17 nt, Human
agcacuuggagccaagg

SEQ ID NO: 2097740 - RNA, 16 nt, Human
agcagcccuccucacc

SEQ ID NO: 2097741 - RNA, 17 nt, Human
agcagcccuccucaccc

SEQ ID NO: 2097742 - RNA, 23 nt, Human
agcagcccuccucaccccgucug

SEQ ID NO: 2097743 - RNA, 18 nt, Human
agcagcccuccucacccc

SEQ ID NO: 2097744 - RNA, 14 nt, Human
agccaaacucugcc

SEQ ID NO: 2097745 - RNA, 15 nt, Human
agccaaacucugcca

SEQ ID NO: 2097746 - RNA, 17 nt, Human
agcauccuggcacccgg

SEQ ID NO: 2097747 - RNA, 14 nt, Human
agcauccuggcacc

SEQ ID NO: 2097748 - RNA, 18 nt, Human
agccaaagcuaggccugg

SEQ ID NO: 2097749 - RNA, 16 nt, Human
agccaaagcuaggccu

SEQ ID NO: 2097750 - RNA, 15 nt, Human
agccaaagauaaucu

SEQ ID NO: 2097751 - RNA, 19 nt, Human
agccaagauugcgccauug

SEQ ID NO: 2097752 - RNA, 13 nt, Human
agccaagcagcca

SEQ ID NO: 2097753 - RNA, 16 nt, Human
agccaagcagccaagc

SEQ ID NO: 2097754 - RNA, 15 nt, Human
agccaagcuccuugg

SEQ ID NO: 2097755 - RNA, 17 nt, Human
agccaagcuccuuggga

SEQ ID NO: 2097756 - RNA, 23 nt, Human
agccaagcuccuugggaggcccc

SEQ ID NO: 2097757 - RNA, 11 nt, Human
agccagcagcc

SEQ ID NO: 2097758 - RNA, 15 nt, Human
agccaaagagaaugc

SEQ ID NO: 2097759 - RNA, 13 nt, Human
agccagcagccag

SEQ ID NO: 2097760 - RNA, 22 nt, Human
agcccacguucucucugccugu

SEQ ID NO: 2097761 - RNA, 14 nt, Human
agcccaccuuggcu

SEQ ID NO: 2097762 - RNA, 16 nt, Human
agcccaccuuggcuca

SEQ ID NO: 2097763 - RNA, 15 nt, Human
agcccaccccucaac

SEQ ID NO: 2097764 - RNA, 13 nt, Human
agcccaccccccu

SEQ ID NO: 2097765 - RNA, 14 nt, Human
agcccaccccccuc

SEQ ID NO: 2097766 - RNA, 16 nt, Human
agcccaccccccucau

SEQ ID NO: 2097767 - RNA, 19 nt, Human
agcccacagguguccccag

SEQ ID NO: 2097768 - RNA, 22 nt, Human
agcccacagguguccccagccc

SEQ ID NO: 2097769 - RNA, 16 nt, Human
agcccaauaaaccucu

SEQ ID NO: 2097770 - RNA, 14 nt, Human
agccagcagccagc

SEQ ID NO: 2097771 - RNA, 16 nt, Human
agccagcagccagcuc

SEQ ID NO: 2097772 - RNA, 20 nt, Human
agcccaauauuauaauuuuu

SEQ ID NO: 2097773 - RNA, 16 nt, Human
agcccaauauuauaau

SEQ ID NO: 2097774 - RNA, 15 nt, Human
agcccaauauuauaa

SEQ ID NO: 2097775 - RNA, 20 nt, Human
agccagcagccagcucucag

SEQ ID NO: 2097776 - RNA, 20 nt, Human
agcacuuacagauaggccuu

SEQ ID NO: 2097777 - RNA, 13 nt, Human
agcauccuggcac

SEQ ID NO: 2097778 - RNA, 20 nt, Human
agccccaacccaaaccugga

SEQ ID NO: 2097779 - RNA, 21 nt, Human
agccccaacccaaaccuggag

SEQ ID NO: 2097780 - RNA, 22 nt, Human
agccccaacccaaaccuggaga

SEQ ID NO: 2097781 - RNA, 23 nt, Human
agccccaacccaaaccuggagau

SEQ ID NO: 2097782 - RNA, 16 nt, Human
agccccaagaaggcug

SEQ ID NO: 2097783 - RNA, 17 nt, Human
agccccaagaaggcugg

SEQ ID NO: 2097784 - RNA, 18 nt, Human
agccccaagaaggcuggg

SEQ ID NO: 2097785 - RNA, 15 nt, Human
agccccacacggagg

SEQ ID NO: 2097786 - RNA, 15 nt, Human
agccccauccugccg

SEQ ID NO: 2097787 - RNA, 18 nt, Human
agccccauccugccgccc

SEQ ID NO: 2097788 - RNA, 13 nt, Human
agcccucccugcc

SEQ ID NO: 2097789 - RNA, 12 nt, Human
agcccucccugc

SEQ ID NO: 2097790 - RNA, 19 nt, Human
agccccauucugccugccc

SEQ ID NO: 2097791 - RNA, 18 nt, Human
agccccauucugccugcc

SEQ ID NO: 2097792 - RNA, 17 nt, Human
agccccauucugccugc

SEQ ID NO: 2097793 - RNA, 20 nt, Human
agccccacccaggagggagg

SEQ ID NO: 2097794 - RNA, 12 nt, Human
agccccacccag

SEQ ID NO: 2097795 - RNA, 13 nt, Human
agccccacccagg

SEQ ID NO: 2097796 - RNA, 15 nt, Human
agccccacccaggag

SEQ ID NO: 2097797 - RNA, 16 nt, Human
agccccacccaggagg

SEQ ID NO: 2097798 - RNA, 22 nt, Human
aggcuggucucaaacuccugac

SEQ ID NO: 2097799 - RNA, 17 nt, Human
aggcugaggcagaagaa

SEQ ID NO: 2097800 - RNA, 21 nt, Human
aggcuguaucccaugagccuc

SEQ ID NO: 2097801 - RNA, 20 nt, Human
aggcuguaucccaugagccu

SEQ ID NO: 2097802 - RNA, 22 nt, Human
aggcuguaucccaugagccuca

SEQ ID NO: 2097803 - RNA, 14 nt, Human
agggaccagccaag

SEQ ID NO: 2097804 - RNA, 15 nt, Human
agggaccagccaaga

SEQ ID NO: 2097805 - RNA, 20 nt, Human
agggaccagccaagagggcu

SEQ ID NO: 2097806 - RNA, 15 nt, Human
agggaccccugcccu

SEQ ID NO: 2097807 - RNA, 23 nt, Human
agggaccccugcccuugucccac

SEQ ID NO: 2097808 - RNA, 23 nt, Human
agggacugccagucccccugccc

SEQ ID NO: 2097809 - RNA, 19 nt, Human
aggcugaccaagagagaaa

SEQ ID NO: 2097810 - RNA, 20 nt, Human
aggcugaccaagagagaaag

SEQ ID NO: 2097811 - RNA, 22 nt, Human
aggcugaccaagagagaaagaa

SEQ ID NO: 2097812 - RNA, 16 nt, Human
aggcuaccuuauugua

SEQ ID NO: 2097813 - RNA, 17 nt, Human
aggcugaggcaggagga

SEQ ID NO: 2097814 - RNA, 11 nt, Human
aggcugaggcg

SEQ ID NO: 2097815 - RNA, 21 nt, Human
aggcugaggcggguggaucac

SEQ ID NO: 2097816 - RNA, 22 nt, Human
aggcugaccuugaacuccuggg

SEQ ID NO: 2097817 - RNA, 15 nt, Human
aggcugaggcagaag

SEQ ID NO: 2097818 - RNA, 17 nt, Human
aggcugagacugcggga

SEQ ID NO: 2097819 - RNA, 16 nt, Human
aggcugagacugcggg

SEQ ID NO: 2097820 - RNA, 14 nt, Human
aggcugaggcagga

SEQ ID NO: 2097821 - RNA, 15 nt, Human
aggcugaggcaggag

SEQ ID NO: 2097822 - RNA, 18 nt, Human
aggcugaggcaggagaau

SEQ ID NO: 2097823 - RNA, 19 nt, Human
aggcugaggcaggagaaug

SEQ ID NO: 2097824 - RNA, 14 nt, Human
aggcuaagcugccg

SEQ ID NO: 2097825 - RNA, 19 nt, Human
aggcuaaggcaggaaaauu

SEQ ID NO: 2097826 - RNA, 14 nt, Human
aggcgggaaggagg

SEQ ID NO: 2097827 - RNA, 15 nt, Human
aggcgggaaggaggg

SEQ ID NO: 2097828 - RNA, 21 nt, Human
aggcggccuuuguugcucagc

SEQ ID NO: 2097829 - RNA, 14 nt, Human
aggccaggugcagu

SEQ ID NO: 2097830 - RNA, 15 nt, Human
aggccauggcagaau

SEQ ID NO: 2097831 - RNA, 19 nt, Human
aggccaugauucgcccaaa

SEQ ID NO: 2097832 - RNA, 21 nt, Human
aggccaugauucgcccaaagc

SEQ ID NO: 2097833 - RNA, 14 nt, Human
aggccagcuggcag

SEQ ID NO: 2097834 - RNA, 15 nt, Human
aggccagcuggcagc

SEQ ID NO: 2097835 - RNA, 16 nt, Human
aggccagcuggcagca

SEQ ID NO: 2097836 - RNA, 16 nt, Human
aggccagcugugguuu

SEQ ID NO: 2097837 - RNA, 20 nt, Human
aggccagcugugguuuucuu

SEQ ID NO: 2097838 - RNA, 21 nt, Human
aggccagcugugguuuucuuu

SEQ ID NO: 2097839 - RNA, 23 nt, Human
aggccagcugugguuuucuuuug

SEQ ID NO: 2097840 - RNA, 17 nt, Human
aggccagcuggcagcag

SEQ ID NO: 2097841 - RNA, 18 nt, Human
aggccagcuggcagcaga

SEQ ID NO: 2097842 - RNA, 19 nt, Human
aggccagcuggcagcagag

SEQ ID NO: 2097843 - RNA, 20 nt, Human
aggccagcuggcagcagagu

SEQ ID NO: 2097844 - RNA, 11 nt, Human
aggccaggagu

SEQ ID NO: 2097845 - RNA, 21 nt, Human
aggccaggaguuugagaccag

SEQ ID NO: 2097846 - RNA, 12 nt, Human
aggccauggcuc

SEQ ID NO: 2097847 - RNA, 22 nt, Human
aggcccuuccucuccacugccu

SEQ ID NO: 2097848 - RNA, 19 nt, Human
aggcccuuccucuccacug

SEQ ID NO: 2097849 - RNA, 14 nt, Human
aggccgccccagcc

SEQ ID NO: 2097850 - RNA, 19 nt, Human
aggccgccccagccucuga

SEQ ID NO: 2097851 - RNA, 18 nt, Human
aggccgccccagccucug

SEQ ID NO: 2097852 - RNA, 20 nt, Human
aggccgcuguucacccacag

SEQ ID NO: 2097853 - RNA, 17 nt, Human
aggccgcuguucaccca

SEQ ID NO: 2097854 - RNA, 19 nt, Human
aggcauguucucugaggac

SEQ ID NO: 2097855 - RNA, 18 nt, Human
aggcauguucucugagga

SEQ ID NO: 2097856 - RNA, 17 nt, Human
aggcauguucucugagg

SEQ ID NO: 2097857 - RNA, 17 nt, Human
aggcagauugaaaagga

SEQ ID NO: 2097858 - RNA, 16 nt, Human
aggcagauugaaaagg

SEQ ID NO: 2097859 - RNA, 16 nt, Human
aggcagauucaauuuu

SEQ ID NO: 2097860 - RNA, 15 nt, Human
aggcagauugaaaag

SEQ ID NO: 2097861 - RNA, 22 nt, Human
aggcagaucugugccccaugcc

SEQ ID NO: 2097862 - RNA, 23 nt, Human
aggcagaucugugccccaugccu

SEQ ID NO: 2097863 - RNA, 12 nt, Human
aggcagcauuua

SEQ ID NO: 2097864 - RNA, 15 nt, Human
aggcaugguggccca

SEQ ID NO: 2097865 - RNA, 22 nt, Human
aggcagagaaucauacuuagca

SEQ ID NO: 2097866 - RNA, 14 nt, Human
aggcagagaaucau

SEQ ID NO: 2097867 - RNA, 15 nt, Human
aggcagaucugugcc

SEQ ID NO: 2097868 - RNA, 16 nt, Human
aggcagaucugugccc

SEQ ID NO: 2097869 - RNA, 20 nt, Human
aggcagaucugugccccaug

SEQ ID NO: 2097870 - RNA, 21 nt, Human
aggcagaucugugccccaugc

SEQ ID NO: 2097871 - RNA, 22 nt, Human
aggcagacuucccugaauguau

SEQ ID NO: 2097872 - RNA, 19 nt, Human
aggcacucauggguaauaa

SEQ ID NO: 2097873 - RNA, 17 nt, Human
aggcacgaacccaccug

SEQ ID NO: 2097874 - RNA, 18 nt, Human
aggcacgaacccaccugc

SEQ ID NO: 2097875 - RNA, 19 nt, Human
aggcacgaacccaccugcu

SEQ ID NO: 2097876 - RNA, 20 nt, Human
aggcacgaacccaccugcug

SEQ ID NO: 2097877 - RNA, 21 nt, Human
aggcacgaacccaccugcuga

SEQ ID NO: 2097878 - RNA, 16 nt, Human
aggagagggaaaaugu

SEQ ID NO: 2097879 - RNA, 17 nt, Human
aggagagggaaaauguu

SEQ ID NO: 2097880 - RNA, 18 nt, Human
aggagagggaaaauguuu

SEQ ID NO: 2097881 - RNA, 19 nt, Human
aggagagggaaaauguuuu

SEQ ID NO: 2097882 - RNA, 14 nt, Human
aggcacgaacccac

SEQ ID NO: 2097883 - RNA, 20 nt, Human
agggucaacaucuuuuacau

SEQ ID NO: 2097884 - RNA, 12 nt, Human
aggggccuggca

SEQ ID NO: 2097885 - RNA, 13 nt, Human
aggggccuggcag

SEQ ID NO: 2097886 - RNA, 13 nt, Human
aggguauuccaga

SEQ ID NO: 2097887 - RNA, 22 nt, Human
aggguccugcuauuucccaagc

SEQ ID NO: 2097888 - RNA, 14 nt, Human
aggguccuggcucc

SEQ ID NO: 2097889 - RNA, 16 nt, Human
aggguccuggcuccug

SEQ ID NO: 2097890 - RNA, 22 nt, Human
aggggcccaaauucuuucagug

SEQ ID NO: 2097891 - RNA, 16 nt, Human
aggggcaucugccccu

SEQ ID NO: 2097892 - RNA, 20 nt, Human
aggggcagucuggaggggca

SEQ ID NO: 2097893 - RNA, 15 nt, Human
aggggcaucugcccc

SEQ ID NO: 2097894 - RNA, 17 nt, Human
aggggcagucuggaggg

SEQ ID NO: 2097895 - RNA, 18 nt, Human
aggggcagucuggagggg

SEQ ID NO: 2097896 - RNA, 14 nt, Human
aggggcaucugccc

SEQ ID NO: 2097897 - RNA, 15 nt, Human
aggggcagucuggag

SEQ ID NO: 2097898 - RNA, 16 nt, Human
aggggcagucuggagg

SEQ ID NO: 2097899 - RNA, 21 nt, Human
aggggcccgagcagaagcagg

SEQ ID NO: 2097900 - RNA, 21 nt, Human
agggccuggucccugggagga

SEQ ID NO: 2097901 - RNA, 17 nt, Human
agggccuggucccuggg

SEQ ID NO: 2097902 - RNA, 16 nt, Human
agggccuuaaaagcca

SEQ ID NO: 2097903 - RNA, 17 nt, Human
agggccuuaaaagccau

SEQ ID NO: 2097904 - RNA, 18 nt, Human
agggccuuaaaagccauc

SEQ ID NO: 2097905 - RNA, 23 nt, Human
agggccuuaaaagccaucaugua

SEQ ID NO: 2097906 - RNA, 12 nt, Human
agggccuugccc

SEQ ID NO: 2097907 - RNA, 14 nt, Human
agggccuugcccag

SEQ ID NO: 2097908 - RNA, 15 nt, Human
agggccuugcccaga

SEQ ID NO: 2097909 - RNA, 16 nt, Human
agggccuugcccagag

SEQ ID NO: 2097910 - RNA, 17 nt, Human
agggccuugcccagaga

SEQ ID NO: 2097911 - RNA, 23 nt, Human
agggcgaggggaggguggcaggu

SEQ ID NO: 2097912 - RNA, 19 nt, Human
agggcgagacucugucuca

SEQ ID NO: 2097913 - RNA, 13 nt, Human
agggcgaggggag

SEQ ID NO: 2097914 - RNA, 12 nt, Human
aggggcaggagc

SEQ ID NO: 2097915 - RNA, 14 nt, Human
aggggcaggagcuc

SEQ ID NO: 2097916 - RNA, 17 nt, Human
aggggcaggagcucaga

SEQ ID NO: 2097917 - RNA, 19 nt, Human
aggggcaggagcucagaug

SEQ ID NO: 2097918 - RNA, 20 nt, Human
aggggcaggagcucagauga

SEQ ID NO: 2097919 - RNA, 18 nt, Human
agggccuugcccagagau

SEQ ID NO: 2097920 - RNA, 19 nt, Human
agggccuugcccagagaug

SEQ ID NO: 2097921 - RNA, 12 nt, Human
agggccuugcua

SEQ ID NO: 2097922 - RNA, 23 nt, Human
agggccuugcccagagaugccuc

SEQ ID NO: 2097923 - RNA, 20 nt, Human
agggcgaacgacaauagcuu

SEQ ID NO: 2097924 - RNA, 18 nt, Human
agggaucagcccugcccu

SEQ ID NO: 2097925 - RNA, 18 nt, Human
agggauguucuggcccuc

SEQ ID NO: 2097926 - RNA, 13 nt, Human
agggaucacaggg

SEQ ID NO: 2097927 - RNA, 14 nt, Human
agggaucacagggc

SEQ ID NO: 2097928 - RNA, 15 nt, Human
agggaucacagggcc

SEQ ID NO: 2097929 - RNA, 17 nt, Human
agggaucacagggcccc

SEQ ID NO: 2097930 - RNA, 22 nt, Human
agggaucacagggccccagaag

SEQ ID NO: 2097931 - RNA, 22 nt, Human
agggauuuucagcccucagaau

SEQ ID NO: 2097932 - RNA, 17 nt, Human
agggauuuucagcccuc

SEQ ID NO: 2097933 - RNA, 17 nt, Human
agggauagcacugagca

SEQ ID NO: 2097934 - RNA, 19 nt, Human
agggauagucaccuuuuaa

SEQ ID NO: 2097935 - RNA, 20 nt, Human
agggauagucaccuuuuaaa

SEQ ID NO: 2097936 - RNA, 21 nt, Human
agggauagucaccuuuuaaau

SEQ ID NO: 2097937 - RNA, 22 nt, Human
agggauagucaccuuuuaaauc

SEQ ID NO: 2097938 - RNA, 13 nt, Human
agggauagagggg

SEQ ID NO: 2097939 - RNA, 16 nt, Human
agggauagaggggggc

SEQ ID NO: 2097940 - RNA, 22 nt, Human
agggauagcacugagcaaagca

SEQ ID NO: 2097941 - RNA, 13 nt, Human
agggacuuaaaaa

SEQ ID NO: 2097942 - RNA, 17 nt, Human
agggacuuaaaaaacuu

SEQ ID NO: 2097943 - RNA, 12 nt, Human
agggacuuaaaa

SEQ ID NO: 2097944 - RNA, 23 nt, Human
aggguuuugccauguuggccagg

SEQ ID NO: 2097945 - RNA, 15 nt, Human
aggguuuuccacccu

SEQ ID NO: 2097946 - RNA, 18 nt, Human
aggguuuuccacccugga

SEQ ID NO: 2097947 - RNA, 19 nt, Human
aggguuuuccacccuggaa

SEQ ID NO: 2097948 - RNA, 22 nt, Human
aggguuuugccauguuggccag

SEQ ID NO: 2097949 - RNA, 14 nt, Human
aggguuuguggcug

SEQ ID NO: 2097950 - RNA, 14 nt, Human
agguaacaggcaga

SEQ ID NO: 2097951 - RNA, 13 nt, Human
agguaacaggcag

SEQ ID NO: 2097952 - RNA, 16 nt, Human
agguaacaggcagaua

SEQ ID NO: 2097953 - RNA, 13 nt, Human
agguacucuccug

SEQ ID NO: 2097954 - RNA, 14 nt, Human
agguacucuccugg

SEQ ID NO: 2097955 - RNA, 15 nt, Human
agguacuaaauaccu

SEQ ID NO: 2097956 - RNA, 21 nt, Human
aggucuccccaugugccugca

SEQ ID NO: 2097957 - RNA, 13 nt, Human
aggucucccggga

SEQ ID NO: 2097958 - RNA, 16 nt, Human
aggucucccgggaagc

SEQ ID NO: 2097959 - RNA, 23 nt, Human
aggucucccgggaagccacccuc

SEQ ID NO: 2097960 - RNA, 11 nt, Human
aggucuccucu

SEQ ID NO: 2097961 - RNA, 12 nt, Human
aggucuccucuu

SEQ ID NO: 2097962 - RNA, 13 nt, Human
aggucuccucuua

SEQ ID NO: 2097963 - RNA, 14 nt, Human
aggucuccucuuaa

SEQ ID NO: 2097964 - RNA, 15 nt, Human
aggucuccucuuaaa

SEQ ID NO: 2097965 - RNA, 17 nt, Human
aggucuccucuuaaaaa

SEQ ID NO: 2097966 - RNA, 23 nt, Human
aggucuccucuuaaaaaauaaaa

SEQ ID NO: 2097967 - RNA, 16 nt, Human
aggucugggagaggca

SEQ ID NO: 2097968 - RNA, 18 nt, Human
aggucugggagaggcaga

SEQ ID NO: 2097969 - RNA, 19 nt, Human
aggucugggagaggcagag

SEQ ID NO: 2097970 - RNA, 21 nt, Human
aggucugggagaggcagagug

SEQ ID NO: 2097971 - RNA, 22 nt, Human
aggucugggagaggcagagugc

SEQ ID NO: 2097972 - RNA, 22 nt, Human
aggucuaggaacauacuucagc

SEQ ID NO: 2097973 - RNA, 13 nt, Human
aggucgggcucag

SEQ ID NO: 2097974 - RNA, 14 nt, Human
aggucgggcucagc

SEQ ID NO: 2097975 - RNA, 15 nt, Human
aggucgggcucagcu

SEQ ID NO: 2097976 - RNA, 18 nt, Human
aggucgggcucagcucug

SEQ ID NO: 2097977 - RNA, 17 nt, Human
aggguuuuaucucuguc

SEQ ID NO: 2097978 - RNA, 21 nt, Human
agguccucuacuuaaugagau

SEQ ID NO: 2097979 - RNA, 20 nt, Human
agggucucacuauguugccc

SEQ ID NO: 2097980 - RNA, 15 nt, Human
agggucuagggagag

SEQ ID NO: 2097981 - RNA, 16 nt, Human
agggucuagggagaga

SEQ ID NO: 2097982 - RNA, 19 nt, Human
agggucuagggagagaccc

SEQ ID NO: 2097983 - RNA, 23 nt, Human
agggucuagggagagacccuugu

SEQ ID NO: 2097984 - RNA, 16 nt, Human
aggaccuguggccaag

SEQ ID NO: 2097985 - RNA, 15 nt, Human
aggagaggagagggg

SEQ ID NO: 2097986 - RNA, 17 nt, Human
aggagagaaggggagga

SEQ ID NO: 2097987 - RNA, 21 nt, Human
aggagagaaggggaggagggc

SEQ ID NO: 2097988 - RNA, 18 nt, Human
aggagagagaucaugaga

SEQ ID NO: 2097989 - RNA, 20 nt, Human
aggagagagaucaugagaaa

SEQ ID NO: 2097990 - RNA, 20 nt, Human
aggacccggaggggccuggc

SEQ ID NO: 2097991 - RNA, 18 nt, Human
aggacccggaggggccug

SEQ ID NO: 2097992 - RNA, 13 nt, Human
aggaccaggacuc

SEQ ID NO: 2097993 - RNA, 16 nt, Human
aggaccaggacucccu

SEQ ID NO: 2097994 - RNA, 17 nt, Human
aggaccaggacucccuc

SEQ ID NO: 2097995 - RNA, 18 nt, Human
aggaccaggacucccucc

SEQ ID NO: 2097996 - RNA, 19 nt, Human
aggaccaggacucccuccu

SEQ ID NO: 2097997 - RNA, 21 nt, Human
aggaccaggacucccuccuca

SEQ ID NO: 2097998 - RNA, 22 nt, Human
aggacccggaggggccuggcag

SEQ ID NO: 2097999 - RNA, 21 nt, Human
aggacccggaggggccuggca

SEQ ID NO: 2098000 - RNA, 16 nt, Human
aggacccucgcuggcc

SEQ ID NO: 2098001 - RNA, 18 nt, Human
aggacccucgcuggcccc

SEQ ID NO: 2098002 - RNA, 19 nt, Human
aggacccucgcuggccccc

SEQ ID NO: 2098003 - RNA, 12 nt, Human
aggaccaggacu

SEQ ID NO: 2098004 - RNA, 22 nt, Human
aggaauaugacggaagaacaua

SEQ ID NO: 2098005 - RNA, 18 nt, Human
aggaauagcaugucacua

SEQ ID NO: 2098006 - RNA, 20 nt, Human
aggaauaugacggaagaaca

SEQ ID NO: 2098007 - RNA, 15 nt, Human
aggaaucaacagggc

SEQ ID NO: 2098008 - RNA, 17 nt, Human
aggaaucaacagggcag

SEQ ID NO: 2098009 - RNA, 15 nt, Human
aggaaucagacuuca

SEQ ID NO: 2098010 - RNA, 17 nt, Human
agcuguaagaagagacu

SEQ ID NO: 2098011 - RNA, 18 nt, Human
agcuguaagaagagacug

SEQ ID NO: 2098012 - RNA, 22 nt, Human
agcugguuuccucauuccugaa

SEQ ID NO: 2098013 - RNA, 20 nt, Human
agcuuauuuccucauuuuua

SEQ ID NO: 2098014 - RNA, 12 nt, Human
agcuuauuuaau

SEQ ID NO: 2098015 - RNA, 16 nt, Human
agcuucaagucugugc

SEQ ID NO: 2098016 - RNA, 17 nt, Human
agcuucaagucugugcc

SEQ ID NO: 2098017 - RNA, 19 nt, Human
agcuucaagucugugccug

SEQ ID NO: 2098018 - RNA, 21 nt, Human
agcuucaagucugugccugga

SEQ ID NO: 2098019 - RNA, 24 nt, Human
agcuucaagucugugccuggagcu

SEQ ID NO: 2098020 - RNA, 18 nt, Human
agcuucauuuccuguguc

SEQ ID NO: 2098021 - RNA, 15 nt, Human
agcuucaugccuuug

SEQ ID NO: 2098022 - RNA, 17 nt, Human
agcuucaugccuuugua

SEQ ID NO: 2098023 - RNA, 18 nt, Human
agcuucaugccuuuguaa

SEQ ID NO: 2098024 - RNA, 20 nt, Human
agcuucaugccuuuguaagu

SEQ ID NO: 2098025 - RNA, 21 nt, Human
agcuucaugccuuuguaaguu

SEQ ID NO: 2098026 - RNA, 22 nt, Human
agcuucaugccuuuguaaguua

SEQ ID NO: 2098027 - RNA, 12 nt, Human
agcuucuccaac

SEQ ID NO: 2098028 - RNA, 19 nt, Human
agcuucauuuccugugucu

SEQ ID NO: 2098029 - RNA, 13 nt, Human
agcuucucuguga

SEQ ID NO: 2098030 - RNA, 14 nt, Human
agcuucucugugaa

SEQ ID NO: 2098031 - RNA, 14 nt, Human
agcuucucuuuaac

SEQ ID NO: 2098032 - RNA, 16 nt, Human
agcuucucuuuaacuc

SEQ ID NO: 2098033 - RNA, 18 nt, Human
agcuucucuuuaacucag

SEQ ID NO: 2098034 - RNA, 19 nt, Human
agcuucucuuuaacucagg

SEQ ID NO: 2098035 - RNA, 22 nt, Human
agcuucucuuuaacucaggacu

SEQ ID NO: 2098036 - RNA, 23 nt, Human
agcuucucuuuaacucaggacuc

SEQ ID NO: 2098037 - RNA, 15 nt, Human
agcuucugaccucag

SEQ ID NO: 2098038 - RNA, 16 nt, Human
agcuucugaccucagc

SEQ ID NO: 2098039 - RNA, 17 nt, Human
agcuucugaccucagca

SEQ ID NO: 2098040 - RNA, 18 nt, Human
agcuucugaccucagcau

SEQ ID NO: 2098041 - RNA, 16 nt, Human
agcuuuuaaacccuau

SEQ ID NO: 2098042 - RNA, 23 nt, Human
agcuuuguuuguugucagcugaa

SEQ ID NO: 2098043 - RNA, 18 nt, Human
agcuucugaggcgcugcu

SEQ ID NO: 2098044 - RNA, 17 nt, Human
agcuucugccacauaaa

SEQ ID NO: 2098045 - RNA, 12 nt, Human
aggaaggggcug

SEQ ID NO: 2098046 - RNA, 14 nt, Human
aggaaggggcugga

SEQ ID NO: 2098047 - RNA, 16 nt, Human
aggaaggggcuggacu

SEQ ID NO: 2098048 - RNA, 17 nt, Human
aggaaggggcuggacug

SEQ ID NO: 2098049 - RNA, 23 nt, Human
aggaaggggcuggacuggcuguc

SEQ ID NO: 2098050 - RNA, 19 nt, Human
aggaagggggguugcagug

SEQ ID NO: 2098051 - RNA, 17 nt, Human
aggaagucuaggagcug

SEQ ID NO: 2098052 - RNA, 18 nt, Human
aggaagucuaggagcugg

SEQ ID NO: 2098053 - RNA, 17 nt, Human
aggaagugaaaauaggu

SEQ ID NO: 2098054 - RNA, 12 nt, Human
aggaagggcaaa

SEQ ID NO: 2098055 - RNA, 17 nt, Human
aggaagggcaggaagga

SEQ ID NO: 2098056 - RNA, 22 nt, Human
aggaaggcugagaggagagaga

SEQ ID NO: 2098057 - RNA, 15 nt, Human
aggaaggcugagagg

SEQ ID NO: 2098058 - RNA, 16 nt, Human
aggaaguguaacagcu

SEQ ID NO: 2098059 - RNA, 18 nt, Human
aggaaguguaacagcuga

SEQ ID NO: 2098060 - RNA, 17 nt, Human
aggaaguguaacagcug

SEQ ID NO: 2098061 - RNA, 19 nt, Human
aggaauaaauugcuccuug

SEQ ID NO: 2098062 - RNA, 13 nt, Human
aggaauaaauaaa

SEQ ID NO: 2098063 - RNA, 19 nt, Human
aggaauaaauaaaaaugga

SEQ ID NO: 2098064 - RNA, 20 nt, Human
aggaauaaauugcuccuuga

SEQ ID NO: 2098065 - RNA, 14 nt, Human
aggaauaaggccuu

SEQ ID NO: 2098066 - RNA, 21 nt, Human
aggaauaaauaaaaauggaua

SEQ ID NO: 2098067 - RNA, 13 nt, Human
aggaaccuggacc

SEQ ID NO: 2098068 - RNA, 19 nt, Human
aggaaccuccuccacacca

SEQ ID NO: 2098069 - RNA, 18 nt, Human
aggaacugggccuguugc

SEQ ID NO: 2098070 - RNA, 17 nt, Human
agcuuuuaguacccacc

SEQ ID NO: 2098071 - RNA, 18 nt, Human
agcuuuuaguacccaccu

SEQ ID NO: 2098072 - RNA, 19 nt, Human
agcuuuuaguacccaccug

SEQ ID NO: 2098073 - RNA, 23 nt, Human
agcuuuuaguacccaccugagcu

SEQ ID NO: 2098074 - RNA, 14 nt, Human
agccuggcuucugg

SEQ ID NO: 2098075 - RNA, 19 nt, Human
agcccucccugccccuccc

SEQ ID NO: 2098076 - RNA, 17 nt, Human
agcccucccugccccuc

SEQ ID NO: 2098077 - RNA, 16 nt, Human
agcccucccugccccu

SEQ ID NO: 2098078 - RNA, 15 nt, Human
agcccucccugcccc

SEQ ID NO: 2098079 - RNA, 23 nt, Human
agcccucccugccccucccuuca

SEQ ID NO: 2098080 - RNA, 22 nt, Human
agcccucccugccccucccuuc

SEQ ID NO: 2098081 - RNA, 14 nt, Human
agcccucccugucc

SEQ ID NO: 2098082 - RNA, 12 nt, Human
agccugggaggu

SEQ ID NO: 2098083 - RNA, 19 nt, Human
agccugggcagccaggcug

SEQ ID NO: 2098084 - RNA, 20 nt, Human
agccugggcagccaggcugc

SEQ ID NO: 2098085 - RNA, 21 nt, Human
agccuggcuucuggagcccuu

SEQ ID NO: 2098086 - RNA, 23 nt, Human
agccuggcuucuggagcccuugg

SEQ ID NO: 2098087 - RNA, 15 nt, Human
agccuggcuucugga

SEQ ID NO: 2098088 - RNA, 18 nt, Human
agccuggcuucuggagcc

SEQ ID NO: 2098089 - RNA, 19 nt, Human
agccuggcuucuggagccc

SEQ ID NO: 2098090 - RNA, 20 nt, Human
agccuggcuucuggagcccu

SEQ ID NO: 2098091 - RNA, 15 nt, Human
agccugggcgacaga

SEQ ID NO: 2098092 - RNA, 21 nt, Human
agccugggcagccaggcugcc

SEQ ID NO: 2098093 - RNA, 14 nt, Human
agccugggcgacag

SEQ ID NO: 2098094 - RNA, 18 nt, Human
agcgaggucaacagagaa

SEQ ID NO: 2098095 - RNA, 17 nt, Human
agcgaggcucuaaccac

SEQ ID NO: 2098096 - RNA, 24 nt, Human
agcgaggcugagccuacagaugaa

SEQ ID NO: 2098097 - RNA, 23 nt, Human
agcgaggucaacagagaaggcag

SEQ ID NO: 2098098 - RNA, 19 nt, Human
agcgaggucaacagagaag

SEQ ID NO: 2098099 - RNA, 22 nt, Human
agcgaggucaacagagaaggca

SEQ ID NO: 2098100 - RNA, 14 nt, Human
agcgaguuguggaa

SEQ ID NO: 2098101 - RNA, 21 nt, Human
agcgaguuguggaaagccucu

SEQ ID NO: 2098102 - RNA, 19 nt, Human
agcgaugaauuuggagacu

SEQ ID NO: 2098103 - RNA, 18 nt, Human
agcgaugaauuuggagac

SEQ ID NO: 2098104 - RNA, 19 nt, Human
agcgagcccugguggcagu

SEQ ID NO: 2098105 - RNA, 13 nt, Human
agcgagcccuggu

SEQ ID NO: 2098106 - RNA, 16 nt, Human
agcgagagucugucuc

SEQ ID NO: 2098107 - RNA, 16 nt, Human
agcuaaucagcauucu

SEQ ID NO: 2098108 - RNA, 16 nt, Human
agcuaauaauucuuca

SEQ ID NO: 2098109 - RNA, 22 nt, Human
agcuaauaauucuucaccuaag

SEQ ID NO: 2098110 - RNA, 21 nt, Human
agcuaaucagcauucucacuc

SEQ ID NO: 2098111 - RNA, 21 nt, Human
agcuaauaaaauaucauucag

SEQ ID NO: 2098112 - RNA, 23 nt, Human
agcuaauaaaauaucauucagca

SEQ ID NO: 2098113 - RNA, 17 nt, Human
agcuaauaaaauaucau

SEQ ID NO: 2098114 - RNA, 18 nt, Human
agcuaauaaaauaucauu

SEQ ID NO: 2098115 - RNA, 19 nt, Human
agcuaauaaaauaucauuc

SEQ ID NO: 2098116 - RNA, 20 nt, Human
agcuaauaaaauaucauuca

SEQ ID NO: 2098117 - RNA, 14 nt, Human
agcuaauaaaauau

SEQ ID NO: 2098118 - RNA, 15 nt, Human
agcuaauaaaauauc

SEQ ID NO: 2098119 - RNA, 16 nt, Human
agcuaauaaaauauca

SEQ ID NO: 2098120 - RNA, 22 nt, Human
agcguuugcccaaaucugccua

SEQ ID NO: 2098121 - RNA, 19 nt, Human
agcguuggaauuaaaacaa

SEQ ID NO: 2098122 - RNA, 20 nt, Human
agcguuggaauuaaaacaau

SEQ ID NO: 2098123 - RNA, 16 nt, Human
agcucaccagccccag

SEQ ID NO: 2098124 - RNA, 23 nt, Human
agcucaagucuucccugaucaag

SEQ ID NO: 2098125 - RNA, 18 nt, Human
agcucaagucuucccuga

SEQ ID NO: 2098126 - RNA, 12 nt, Human
agcuaauuauuu

SEQ ID NO: 2098127 - RNA, 15 nt, Human
agcuaauuauuuuaa

SEQ ID NO: 2098128 - RNA, 16 nt, Human
agcuaauuauuuuaau

SEQ ID NO: 2098129 - RNA, 18 nt, Human
agcuaauuauuuuaauua

SEQ ID NO: 2098130 - RNA, 21 nt, Human
agcuaauuauuuuaauuaggu

SEQ ID NO: 2098131 - RNA, 13 nt, Human
agcucaaaggcac

SEQ ID NO: 2098132 - RNA, 15 nt, Human
agcucaaaggcacag

SEQ ID NO: 2098133 - RNA, 16 nt, Human
agcucaaaggcacagu

SEQ ID NO: 2098134 - RNA, 20 nt, Human
agcucaccagccccagugcc

SEQ ID NO: 2098135 - RNA, 19 nt, Human
agcucaccagccccagugc

SEQ ID NO: 2098136 - RNA, 13 nt, Human
agcucacgucaca

SEQ ID NO: 2098137 - RNA, 16 nt, Human
agcucacgucacacuu

SEQ ID NO: 2098138 - RNA, 15 nt, Human
agcucagacccccac

SEQ ID NO: 2098139 - RNA, 16 nt, Human
agcucagacccccacu

SEQ ID NO: 2098140 - RNA, 17 nt, Human
agcucagacccccacuc

SEQ ID NO: 2098141 - RNA, 18 nt, Human
agcucagacccccacucu

SEQ ID NO: 2098142 - RNA, 20 nt, Human
agcucagacccccacucuca

SEQ ID NO: 2098143 - RNA, 24 nt, Human
agcugaacaguguuggcuuucaug

SEQ ID NO: 2098144 - RNA, 15 nt, Human
agcugaaccugggua

SEQ ID NO: 2098145 - RNA, 23 nt, Human
agcugaagagugaggauaugagu

SEQ ID NO: 2098146 - RNA, 15 nt, Human
agcugaauacauucu

SEQ ID NO: 2098147 - RNA, 18 nt, Human
agcugaauacauucugcu

SEQ ID NO: 2098148 - RNA, 14 nt, Human
agcugaagccgcca

SEQ ID NO: 2098149 - RNA, 19 nt, Human
agcugaagccgccaggacc

SEQ ID NO: 2098150 - RNA, 17 nt, Human
agcugaggcaauucuaa

SEQ ID NO: 2098151 - RNA, 18 nt, Human
agcugcgguccacccagg

SEQ ID NO: 2098152 - RNA, 17 nt, Human
agcugcgguccacccag

SEQ ID NO: 2098153 - RNA, 16 nt, Human
agcugcgguccaccca

SEQ ID NO: 2098154 - RNA, 13 nt, Human
agcugcgguccac

SEQ ID NO: 2098155 - RNA, 20 nt, Human
agcugcgguccacccaggag

SEQ ID NO: 2098156 - RNA, 19 nt, Human
agcugcgguccacccagga

SEQ ID NO: 2098157 - RNA, 12 nt, Human
agcugcugacag

SEQ ID NO: 2098158 - RNA, 17 nt, Human
agcuggucccacucagu

SEQ ID NO: 2098159 - RNA, 16 nt, Human
agcuggucccacucag

SEQ ID NO: 2098160 - RNA, 14 nt, Human
agcugcugacagug

SEQ ID NO: 2098161 - RNA, 13 nt, Human
agcugcugacagu

SEQ ID NO: 2098162 - RNA, 19 nt, Human
agcuggucccacucagucc

SEQ ID NO: 2098163 - RNA, 18 nt, Human
agcuggucccacucaguc

SEQ ID NO: 2098164 - RNA, 22 nt, Human
agcugguuuuuagcggagacgg

SEQ ID NO: 2098165 - RNA, 15 nt, Human
agcugguuuccucau

SEQ ID NO: 2098166 - RNA, 21 nt, Human
agcugguuuccucauuccuga

SEQ ID NO: 2098167 - RNA, 16 nt, Human
agcugguugagguuuc

SEQ ID NO: 2098168 - RNA, 22 nt, Human
agcucagcccaccccccucauu

SEQ ID NO: 2098169 - RNA, 13 nt, Human
agcucagccccag

SEQ ID NO: 2098170 - RNA, 15 nt, Human
agcucagccccagcc

SEQ ID NO: 2098171 - RNA, 17 nt, Human
agcucagccccagccca

SEQ ID NO: 2098172 - RNA, 18 nt, Human
agcucagccccagcccag

SEQ ID NO: 2098173 - RNA, 20 nt, Human
agcucagccccagcccagcc

SEQ ID NO: 2098174 - RNA, 16 nt, Human
agcucagcccaccccc

SEQ ID NO: 2098175 - RNA, 19 nt, Human
agcucagcccaccccccuc

SEQ ID NO: 2098176 - RNA, 20 nt, Human
agcucagcccaccccccuca

SEQ ID NO: 2098177 - RNA, 21 nt, Human
agcucagcccaccccccucau

SEQ ID NO: 2098178 - RNA, 11 nt, Human
agcucagccca

SEQ ID NO: 2098179 - RNA, 14 nt, Human
agcucagcccaccc

SEQ ID NO: 2098180 - RNA, 15 nt, Human
agcucagcccacccc

SEQ ID NO: 2098181 - RNA, 18 nt, Human
aaagcccaaagugguaua

SEQ ID NO: 2098182 - RNA, 16 nt, Human
aaagcccaaccuccug

SEQ ID NO: 2098183 - RNA, 17 nt, Human
aaaggcaguggggcugg

SEQ ID NO: 2098184 - RNA, 19 nt, Human
aaaggcaguggggcugggg

SEQ ID NO: 2098185 - RNA, 16 nt, Human
aaaggcauucucugaa

SEQ ID NO: 2098186 - RNA, 18 nt, Human
aaaggcauucucugaaga

SEQ ID NO: 2098187 - RNA, 20 nt, Human
aaaggcucugaaagccagcu

SEQ ID NO: 2098188 - RNA, 20 nt, Human
aaaggcuaugauugucuuug

SEQ ID NO: 2098189 - RNA, 19 nt, Human
aaaggcucagucucaggag

SEQ ID NO: 2098190 - RNA, 21 nt, Human
aaaggcucagucucaggagca

SEQ ID NO: 2098191 - RNA, 15 nt, Human
aaagccaaagcuagg

SEQ ID NO: 2098192 - RNA, 17 nt, Human
aaagccaaacucugcca

SEQ ID NO: 2098193 - RNA, 20 nt, Human
aaagccaaaucaaaauaugu

SEQ ID NO: 2098194 - RNA, 23 nt, Human
aaagccaacagucaaaacagaga

SEQ ID NO: 2098195 - RNA, 16 nt, Human
aaagcauuuacuuuga

SEQ ID NO: 2098196 - RNA, 17 nt, Human
aaagcauuuacuuugaa

SEQ ID NO: 2098197 - RNA, 11 nt, Human
aaauaaauuau

SEQ ID NO: 2098198 - RNA, 16 nt, Human
aaauaaauugaaauau

SEQ ID NO: 2098199 - RNA, 23 nt, Human
aaagugaucaauaaaaugugauu

SEQ ID NO: 2098200 - RNA, 21 nt, Human
aaagugauaauuucuggaauu

SEQ ID NO: 2098201 - RNA, 23 nt, Human
aaagugcagcuccguuuggcagu

SEQ ID NO: 2098202 - RNA, 20 nt, Human
aaagucaaaaggugccugug

SEQ ID NO: 2098203 - RNA, 18 nt, Human
aaagucaaaaggugccug

SEQ ID NO: 2098204 - RNA, 16 nt, Human
aaagucagguccaauu

SEQ ID NO: 2098205 - RNA, 13 nt, Human
aaaggcuguggua

SEQ ID NO: 2098206 - RNA, 19 nt, Human
aaauaaacacauagauuca

SEQ ID NO: 2098207 - RNA, 21 nt, Human
aaauaaacacauagauucacc

SEQ ID NO: 2098208 - RNA, 23 nt, Human
aaauaaacacauagauucaccug

SEQ ID NO: 2098209 - RNA, 15 nt, Human
aaauaaaaccuuuca

SEQ ID NO: 2098210 - RNA, 11 nt, Human
aaauaaaaccu

SEQ ID NO: 2098211 - RNA, 12 nt, Human
aaauaaaaccuu

SEQ ID NO: 2098212 - RNA, 13 nt, Human
aaauaaaaccuuu

SEQ ID NO: 2098213 - RNA, 14 nt, Human
aaauaaaaccuuuc

SEQ ID NO: 2098214 - RNA, 15 nt, Human
aaauaaaaauggaua

SEQ ID NO: 2098215 - RNA, 12 nt, Human
aaauaaaacauu

SEQ ID NO: 2098216 - RNA, 23 nt, Human
aaauaaaaauuauuauugauuuu

SEQ ID NO: 2098217 - RNA, 18 nt, Human
aaauaaaacauuuucaca

SEQ ID NO: 2098218 - RNA, 22 nt, Human
aaauaaaacauuuucacacaau

SEQ ID NO: 2098219 - RNA, 20 nt, Human
aaagaaaccccaaacucagg

SEQ ID NO: 2098220 - RNA, 20 nt, Human
aaagaaacccgacagaggga

SEQ ID NO: 2098221 - RNA, 23 nt, Human
aaagaaacccgacagagggaaga

SEQ ID NO: 2098222 - RNA, 19 nt, Human
aaagaagacaacauuaaaa

SEQ ID NO: 2098223 - RNA, 18 nt, Human
aaagaaaauucuuggaau

SEQ ID NO: 2098224 - RNA, 13 nt, Human
aaagaaaauaugc

SEQ ID NO: 2098225 - RNA, 14 nt, Human
aaagaaaauaugca

SEQ ID NO: 2098226 - RNA, 17 nt, Human
aaagaaaauaugcaucu

SEQ ID NO: 2098227 - RNA, 15 nt, Human
aaagaaaauaugcau

SEQ ID NO: 2098228 - RNA, 17 nt, Human
aaacucuugaccucagg

SEQ ID NO: 2098229 - RNA, 12 nt, Human
aaacccugucuc

SEQ ID NO: 2098230 - RNA, 16 nt, Human
aaacccuugaaaagac

SEQ ID NO: 2098231 - RNA, 15 nt, Human
aaaccguccucuuuu

SEQ ID NO: 2098232 - RNA, 19 nt, Human
aaaccguccuguguacaca

SEQ ID NO: 2098233 - RNA, 17 nt, Human
aaaccccaucucuacaa

SEQ ID NO: 2098234 - RNA, 20 nt, Human
aaaccccaccuuuauuccuu

SEQ ID NO: 2098235 - RNA, 13 nt, Human
aaaccccaucucu

SEQ ID NO: 2098236 - RNA, 20 nt, Human
aaagauaacaagaucuuuca

SEQ ID NO: 2098237 - RNA, 22 nt, Human
aaagauaacaagaucuuucagg

SEQ ID NO: 2098238 - RNA, 19 nt, Human
aaagauaaucucucagcuu

SEQ ID NO: 2098239 - RNA, 15 nt, Human
aaagauacauuugua

SEQ ID NO: 2098240 - RNA, 17 nt, Human
aaacagcuaaugggaca

SEQ ID NO: 2098241 - RNA, 14 nt, Human
aaacagcucaggcu

SEQ ID NO: 2098242 - RNA, 12 nt, Human
aaacaggagaga

SEQ ID NO: 2098243 - RNA, 18 nt, Human
aaacagcuucaugccuuu

SEQ ID NO: 2098244 - RNA, 20 nt, Human
aaacagcuucaugccuuugu

SEQ ID NO: 2098245 - RNA, 21 nt, Human
aaacagcuucaugccuuugua

SEQ ID NO: 2098246 - RNA, 22 nt, Human
aaacagcuucaugccuuuguaa

SEQ ID NO: 2098247 - RNA, 14 nt, Human
aaacaggaaaaaaa

SEQ ID NO: 2098248 - RNA, 15 nt, Human
aaacaggaaaaaaac

SEQ ID NO: 2098249 - RNA, 16 nt, Human
aaacaggaaaaaaacu

SEQ ID NO: 2098250 - RNA, 18 nt, Human
aaacaggaaaaaaacuuu

SEQ ID NO: 2098251 - RNA, 20 nt, Human
aaacaggaaaaaaacuuuua

SEQ ID NO: 2098252 - RNA, 11 nt, Human
aaacaggacca

SEQ ID NO: 2098253 - RNA, 11 nt, Human
aaacaggcagu

SEQ ID NO: 2098254 - RNA, 21 nt, Human
aaacaggcaguuggccagaga

SEQ ID NO: 2098255 - RNA, 12 nt, Human
aaaauuccagaa

SEQ ID NO: 2098256 - RNA, 16 nt, Human
aaaauuccagaaagga

SEQ ID NO: 2098257 - RNA, 20 nt, Human
aaaauuccagaaaggauauu

SEQ ID NO: 2098258 - RNA, 21 nt, Human
aaaauuccaucccaucaucuu

SEQ ID NO: 2098259 - RNA, 20 nt, Human
aaaauucucagucaguaauu

SEQ ID NO: 2098260 - RNA, 13 nt, Human
aaaauucuaaaua

SEQ ID NO: 2098261 - RNA, 20 nt, Human
aaaauucuaaauaaaauaua

SEQ ID NO: 2098262 - RNA, 21 nt, Human
aaacagcgcuggguccacccc

SEQ ID NO: 2098263 - RNA, 18 nt, Human
aaacagcauugcuuucug

SEQ ID NO: 2098264 - RNA, 22 nt, Human
aaacagccgucagccaaaugua

SEQ ID NO: 2098265 - RNA, 23 nt, Human
aaacagccgucagccaaauguaa

SEQ ID NO: 2098266 - RNA, 15 nt, Human
aaacagccucacaga

SEQ ID NO: 2098267 - RNA, 14 nt, Human
aaacagcauugcuu

SEQ ID NO: 2098268 - RNA, 16 nt, Human
aaacagcauugcuuuc

SEQ ID NO: 2098269 - RNA, 17 nt, Human
aaacagcauugcuuucu

SEQ ID NO: 2098270 - RNA, 21 nt, Human
aaacagcauugcuuucugaaa

SEQ ID NO: 2098271 - RNA, 13 nt, Human
aaaauucuuggaa

SEQ ID NO: 2098272 - RNA, 12 nt, Human
aaaauugaauuu

SEQ ID NO: 2098273 - RNA, 13 nt, Human
aaaauugaauuua

SEQ ID NO: 2098274 - RNA, 16 nt, Human
aaaauuauagaaguuu

SEQ ID NO: 2098275 - RNA, 14 nt, Human
aaaauuaucuauuu

SEQ ID NO: 2098276 - RNA, 15 nt, Human
aaaauuaucuauuug

SEQ ID NO: 2098277 - RNA, 17 nt, Human
aaaauuaucuauuugua

SEQ ID NO: 2098278 - RNA, 18 nt, Human
aaaauuaucuauuuguau

SEQ ID NO: 2098279 - RNA, 14 nt, Human
aaaauuauuucaga

SEQ ID NO: 2098280 - RNA, 19 nt, Human
aaaauuauuucagaaaugu

SEQ ID NO: 2098281 - RNA, 19 nt, Human
aaaauuaggauuucaugau

SEQ ID NO: 2098282 - RNA, 18 nt, Human
aaaauuagccgggcgugg

SEQ ID NO: 2098283 - RNA, 20 nt, Human
aaaauuagaaauuggcugga

SEQ ID NO: 2098284 - RNA, 14 nt, Human
aaaauuagaaauug

SEQ ID NO: 2098285 - RNA, 15 nt, Human
aaaauuagccaagug

SEQ ID NO: 2098286 - RNA, 17 nt, Human
aaaauuaaggcaacuga

SEQ ID NO: 2098287 - RNA, 21 nt, Human
aaaauuaaggcaacugaacaa

SEQ ID NO: 2098288 - RNA, 14 nt, Human
aaaauuaacacugc

SEQ ID NO: 2098289 - RNA, 14 nt, Human
aaaauccaugaaca

SEQ ID NO: 2098290 - RNA, 14 nt, Human
aaaauuaagaaugu

SEQ ID NO: 2098291 - RNA, 15 nt, Human
aaaauuaaagaaaau

SEQ ID NO: 2098292 - RNA, 16 nt, Human
aaaauuaaagaaaaua

SEQ ID NO: 2098293 - RNA, 11 nt, Human
aaaauuaaagc

SEQ ID NO: 2098294 - RNA, 11 nt, Human
aaaaucacuaa

SEQ ID NO: 2098295 - RNA, 16 nt, Human
aaaaucacuaacauua

SEQ ID NO: 2098296 - RNA, 21 nt, Human
aaaauaaaaagcgggcacggg

SEQ ID NO: 2098297 - RNA, 16 nt, Human
aaaaguuugccagaag

SEQ ID NO: 2098298 - RNA, 17 nt, Human
aaaaguuugccagaagu

SEQ ID NO: 2098299 - RNA, 11 nt, Human
aaaauaaaaac

SEQ ID NO: 2098300 - RNA, 16 nt, Human
aacgagucaauccccu

SEQ ID NO: 2098301 - RNA, 12 nt, Human
aacgaggaagcc

SEQ ID NO: 2098302 - RNA, 14 nt, Human
aacgacaauagcuu

SEQ ID NO: 2098303 - RNA, 13 nt, Human
aacgaaagcuggg

SEQ ID NO: 2098304 - RNA, 21 nt, Human
aacgaaagcugggcaacaugc

SEQ ID NO: 2098305 - RNA, 15 nt, Human
aacgaaacugcucua

SEQ ID NO: 2098306 - RNA, 12 nt, Human
aacgaaaagcac

SEQ ID NO: 2098307 - RNA, 12 nt, Human
aacgaagaaaaa

SEQ ID NO: 2098308 - RNA, 13 nt, Human
aacgaagaaaaaa

SEQ ID NO: 2098309 - RNA, 14 nt, Human
aacgaagaaaaaaa

SEQ ID NO: 2098310 - RNA, 12 nt, Human
aacgaaguuggg

SEQ ID NO: 2098311 - RNA, 11 nt, Human
aacgaaugaag

SEQ ID NO: 2098312 - RNA, 23 nt, Human
aacgacaaagccaaacucugcca

SEQ ID NO: 2098313 - RNA, 22 nt, Human
aacgguacacagacuauugaca

SEQ ID NO: 2098314 - RNA, 17 nt, Human
aacguaaccacggaaaa

SEQ ID NO: 2098315 - RNA, 17 nt, Human
aacgggcugcccugcca

SEQ ID NO: 2098316 - RNA, 15 nt, Human
aacgggguccuucaa

SEQ ID NO: 2098317 - RNA, 12 nt, Human
aacggggagaaa

SEQ ID NO: 2098318 - RNA, 17 nt, Human
aacgguaaauuucugug

SEQ ID NO: 2098319 - RNA, 13 nt, Human
aacgguuaaaacu

SEQ ID NO: 2098320 - RNA, 14 nt, Human
aacgguuaaaacug

SEQ ID NO: 2098321 - RNA, 21 nt, Human
aacgccugcuugucccugccc

SEQ ID NO: 2098322 - RNA, 17 nt, Human
aacucaaacucuuaaaa

SEQ ID NO: 2098323 - RNA, 14 nt, Human
aacucaaacacaga

SEQ ID NO: 2098324 - RNA, 16 nt, Human
aacucaaacacagaga

SEQ ID NO: 2098325 - RNA, 22 nt, Human
aacucacccccaaggggcaguc

SEQ ID NO: 2098326 - RNA, 17 nt, Human
aacucaccuaauguuua

SEQ ID NO: 2098327 - RNA, 22 nt, Human
aacugaauggaagguuuguaua

SEQ ID NO: 2098328 - RNA, 13 nt, Human
aacugaaggagaa

SEQ ID NO: 2098329 - RNA, 15 nt, Human
aacugaaggagaagg

SEQ ID NO: 2098330 - RNA, 14 nt, Human
aacucaucauaaaa

SEQ ID NO: 2098331 - RNA, 15 nt, Human
aacucaucauaaaau

SEQ ID NO: 2098332 - RNA, 13 nt, Human
aacugaagccaga

SEQ ID NO: 2098333 - RNA, 16 nt, Human
aacucaucauaaaaua

SEQ ID NO: 2098334 - RNA, 17 nt, Human
aacucaucauaaaauaa

SEQ ID NO: 2098335 - RNA, 18 nt, Human
aacucaucauaaaauaaa

SEQ ID NO: 2098336 - RNA, 22 nt, Human
aacugagcuccucugggcagga

SEQ ID NO: 2098337 - RNA, 14 nt, Human
aacugagcuccucu

SEQ ID NO: 2098338 - RNA, 18 nt, Human
aacugagcuccucugggc

SEQ ID NO: 2098339 - RNA, 18 nt, Human
aacagcucaagucuuccc

SEQ ID NO: 2098340 - RNA, 22 nt, Human
aacagcuaugggagccccaggg

SEQ ID NO: 2098341 - RNA, 16 nt, Human
aacaggaaaaaaacuu

SEQ ID NO: 2098342 - RNA, 17 nt, Human
aacaggaaaaaaacuuu

SEQ ID NO: 2098343 - RNA, 22 nt, Human
aacaggaaaaaaacuuuuauaa

SEQ ID NO: 2098344 - RNA, 11 nt, Human
aacaggaaaag

SEQ ID NO: 2098345 - RNA, 12 nt, Human
aacaggaaaaga

SEQ ID NO: 2098346 - RNA, 14 nt, Human
aacaggaaaagaaa

SEQ ID NO: 2098347 - RNA, 22 nt, Human
aacaggaaaggcucgaaauaca

SEQ ID NO: 2098348 - RNA, 15 nt, Human
aacagcuaccaugac

SEQ ID NO: 2098349 - RNA, 18 nt, Human
aacagcuaugggagcccc

SEQ ID NO: 2098350 - RNA, 19 nt, Human
aacagcuaugggagcccca

SEQ ID NO: 2098351 - RNA, 19 nt, Human
aacaggagcugggauccua

SEQ ID NO: 2098352 - RNA, 21 nt, Human
aacaggagcugggauccuaag

SEQ ID NO: 2098353 - RNA, 20 nt, Human
aacaggaccacaaaaaugaa

SEQ ID NO: 2098354 - RNA, 22 nt, Human
aacauccuaucaacaacaaggu

SEQ ID NO: 2098355 - RNA, 19 nt, Human
aacauccuucaagaacucu

SEQ ID NO: 2098356 - RNA, 19 nt, Human
aacaggauuagacagucaa

SEQ ID NO: 2098357 - RNA, 16 nt, Human
aacaggauuagacagu

SEQ ID NO: 2098358 - RNA, 18 nt, Human
aacagauuuggugaauuu

SEQ ID NO: 2098359 - RNA, 22 nt, Human
aacagauuuggugaauuugaau

SEQ ID NO: 2098360 - RNA, 16 nt, Human
aacagcuaaugggaca

SEQ ID NO: 2098361 - RNA, 13 nt, Human
aacagcgcugggu

SEQ ID NO: 2098362 - RNA, 14 nt, Human
aacacuauauggca

SEQ ID NO: 2098363 - RNA, 18 nt, Human
aacacuauauggcagugu

SEQ ID NO: 2098364 - RNA, 20 nt, Human
aacacuauauggcagugucu

SEQ ID NO: 2098365 - RNA, 21 nt, Human
aacacuauauggcagugucuu

SEQ ID NO: 2098366 - RNA, 15 nt, Human
aacacuauaaagguu

SEQ ID NO: 2098367 - RNA, 22 nt, Human
aaccauaggcugcucugccugu

SEQ ID NO: 2098368 - RNA, 22 nt, Human
aaccauacaaaaauuccuuuuc

SEQ ID NO: 2098369 - RNA, 16 nt, Human
aacccuguuuuauacu

SEQ ID NO: 2098370 - RNA, 23 nt, Human
aacccuguuuuauacuguacuua

SEQ ID NO: 2098371 - RNA, 20 nt, Human
aacccuguuuuauacuguac

SEQ ID NO: 2098372 - RNA, 22 nt, Human
aacccuguuuuauacuguacuu

SEQ ID NO: 2098373 - RNA, 21 nt, Human
aacccuuaccccuuagccucc

SEQ ID NO: 2098374 - RNA, 23 nt, Human
aacccuuaccccuuagccucccu

SEQ ID NO: 2098375 - RNA, 14 nt, Human
aaccaguuauguga

SEQ ID NO: 2098376 - RNA, 18 nt, Human
aaccaguuucagguguuu

SEQ ID NO: 2098377 - RNA, 18 nt, Human
aaccagggaagcuguccc

SEQ ID NO: 2098378 - RNA, 19 nt, Human
aaccagggaagcugucccu

SEQ ID NO: 2098379 - RNA, 21 nt, Human
aaccagggagccccuuugaug

SEQ ID NO: 2098380 - RNA, 17 nt, Human
aaccagggcaccaagcc

SEQ ID NO: 2098381 - RNA, 22 nt, Human
aaccagggcaccaagcccacag

SEQ ID NO: 2098382 - RNA, 16 nt, Human
aaccaguauacaagau

SEQ ID NO: 2098383 - RNA, 17 nt, Human
aaccaguauacaagaua

SEQ ID NO: 2098384 - RNA, 18 nt, Human
aaccaguauacaagauaa

SEQ ID NO: 2098385 - RNA, 19 nt, Human
aaccaguauacaagauaag

SEQ ID NO: 2098386 - RNA, 17 nt, Human
aacaucuagcaaauguu

SEQ ID NO: 2098387 - RNA, 16 nt, Human
aacaucugaaagccac

SEQ ID NO: 2098388 - RNA, 16 nt, Human
aacaugcuucaugaaa

SEQ ID NO: 2098389 - RNA, 22 nt, Human
aacauggaacucauuccugccu

SEQ ID NO: 2098390 - RNA, 17 nt, Human
aacaugcuaccugaucc

SEQ ID NO: 2098391 - RNA, 13 nt, Human
aaccgaugcucca

SEQ ID NO: 2098392 - RNA, 21 nt, Human
aaccgcaggaagcugcuccgu

SEQ ID NO: 2098393 - RNA, 13 nt, Human
aaccgcaggaagc

SEQ ID NO: 2098394 - RNA, 14 nt, Human
aaccgcaggaagcu

SEQ ID NO: 2098395 - RNA, 15 nt, Human
aaccgcaggaagcug

SEQ ID NO: 2098396 - RNA, 15 nt, Human
aaccgaugcuccagc

SEQ ID NO: 2098397 - RNA, 17 nt, Human
aaccgaugcuccagcca

SEQ ID NO: 2098398 - RNA, 21 nt, Human
aaccgaugcuccagccaaccc

SEQ ID NO: 2098399 - RNA, 17 nt, Human
aacacauagauucaccu

SEQ ID NO: 2098400 - RNA, 18 nt, Human
aacacauagauucaccug

SEQ ID NO: 2098401 - RNA, 20 nt, Human
aacacauagauucaccugua

SEQ ID NO: 2098402 - RNA, 22 nt, Human
aacacauagauucaccuguaaa

SEQ ID NO: 2098403 - RNA, 16 nt, Human
aacaccuagaucagaa

SEQ ID NO: 2098404 - RNA, 18 nt, Human
aacaccuagaucagaaca

SEQ ID NO: 2098405 - RNA, 18 nt, Human
aacacccucgaagcgcgc

SEQ ID NO: 2098406 - RNA, 19 nt, Human
aacaccucugcacaagcug

SEQ ID NO: 2098407 - RNA, 17 nt, Human
aacaaaguggaaggaaa

SEQ ID NO: 2098408 - RNA, 18 nt, Human
aacaaaguggaaggaaag

SEQ ID NO: 2098409 - RNA, 19 nt, Human
aacaaaguggaaggaaaga

SEQ ID NO: 2098410 - RNA, 13 nt, Human
aacaaauaugcaa

SEQ ID NO: 2098411 - RNA, 12 nt, Human
aacaaauaugca

SEQ ID NO: 2098412 - RNA, 20 nt, Human
aacaaauuagguuuuguaca

SEQ ID NO: 2098413 - RNA, 19 nt, Human
aacaaauuagguuuuguac

SEQ ID NO: 2098414 - RNA, 12 nt, Human
aacacaguauuu

SEQ ID NO: 2098415 - RNA, 13 nt, Human
aacacaguauuuu

SEQ ID NO: 2098416 - RNA, 14 nt, Human
aacacaguauuuuc

SEQ ID NO: 2098417 - RNA, 21 nt, Human
aacacauacaggaagguagaa

SEQ ID NO: 2098418 - RNA, 21 nt, Human
aacaaauuagguuuuguacaa

SEQ ID NO: 2098419 - RNA, 12 nt, Human
aaauuaaacaau

SEQ ID NO: 2098420 - RNA, 13 nt, Human
aaauuaaacaauu

SEQ ID NO: 2098421 - RNA, 20 nt, Human
aaauuaaccauagauguaga

SEQ ID NO: 2098422 - RNA, 13 nt, Human
aaauugagagaau

SEQ ID NO: 2098423 - RNA, 17 nt, Human
aaauugagagaauggaa

SEQ ID NO: 2098424 - RNA, 21 nt, Human
aacaaacccucguuucugauu

SEQ ID NO: 2098425 - RNA, 23 nt, Human
aaauugagcuggaccucaccaag

SEQ ID NO: 2098426 - RNA, 15 nt, Human
aaauguucuuugggg

SEQ ID NO: 2098427 - RNA, 18 nt, Human
aaaucugcuuuuuaaaga

SEQ ID NO: 2098428 - RNA, 13 nt, Human
aaaucuccuauuu

SEQ ID NO: 2098429 - RNA, 14 nt, Human
aaaucuccuauuuu

SEQ ID NO: 2098430 - RNA, 15 nt, Human
aaaucuccuauuuuu

SEQ ID NO: 2098431 - RNA, 17 nt, Human
aaaucucucucuguugu

SEQ ID NO: 2098432 - RNA, 19 nt, Human
aaaucucucucuguugugu

SEQ ID NO: 2098433 - RNA, 21 nt, Human
aaaucucucucuguuguguuc

SEQ ID NO: 2098434 - RNA, 17 nt, Human
aaaucugaccaaaacaa

SEQ ID NO: 2098435 - RNA, 17 nt, Human
aaaugcugcgcccuucc

SEQ ID NO: 2098436 - RNA, 19 nt, Human
aaauggaauucauucuggu

SEQ ID NO: 2098437 - RNA, 15 nt, Human
aaguucuuaguugcu

SEQ ID NO: 2098438 - RNA, 12 nt, Human
aaguucugugua

SEQ ID NO: 2098439 - RNA, 16 nt, Human
aaguucuguguauuua

SEQ ID NO: 2098440 - RNA, 17 nt, Human
aaguucuguguauuuaa

SEQ ID NO: 2098441 - RNA, 13 nt, Human
aaguucuuagaua

SEQ ID NO: 2098442 - RNA, 14 nt, Human
aaguucuuagauau

SEQ ID NO: 2098443 - RNA, 15 nt, Human
aaguucuuagauauc

SEQ ID NO: 2098444 - RNA, 17 nt, Human
aaguucuuagauaucuu

SEQ ID NO: 2098445 - RNA, 18 nt, Human
aaguucuuagauaucuuu

SEQ ID NO: 2098446 - RNA, 23 nt, Human
aaguucuuagauaucuuuuuauu

SEQ ID NO: 2098447 - RNA, 22 nt, Human
aaguucuuaguugcuguauguc

SEQ ID NO: 2098448 - RNA, 15 nt, Human
aaguggggacagagc

SEQ ID NO: 2098449 - RNA, 16 nt, Human
aagugggccaggacag

SEQ ID NO: 2098450 - RNA, 21 nt, Human
aagugggccaggacaggcccg

SEQ ID NO: 2098451 - RNA, 19 nt, Human
aagugggggcagagggcag

SEQ ID NO: 2098452 - RNA, 12 nt, Human
aaguauacugua

SEQ ID NO: 2098453 - RNA, 18 nt, Human
aaguauacuguauuuuua

SEQ ID NO: 2098454 - RNA, 18 nt, Human
aauaaagccuucaaacuc

SEQ ID NO: 2098455 - RNA, 15 nt, Human
aauaaagccugcuuu

SEQ ID NO: 2098456 - RNA, 19 nt, Human
aauaauaaagaugcucuuu

SEQ ID NO: 2098457 - RNA, 18 nt, Human
aauaauaaagaugcucuu

SEQ ID NO: 2098458 - RNA, 18 nt, Human
aauaaacacauagauuca

SEQ ID NO: 2098459 - RNA, 18 nt, Human
aaguugauggugaugaaa

SEQ ID NO: 2098460 - RNA, 16 nt, Human
aaguugcagugagcug

SEQ ID NO: 2098461 - RNA, 17 nt, Human
aauaauaugcauuguca

SEQ ID NO: 2098462 - RNA, 15 nt, Human
aauaauaugcauugu

SEQ ID NO: 2098463 - RNA, 13 nt, Human
aauaauaugcauu

SEQ ID NO: 2098464 - RNA, 12 nt, Human
aauaauaugcau

SEQ ID NO: 2098465 - RNA, 11 nt, Human
aauaauaugca

SEQ ID NO: 2098466 - RNA, 11 nt, Human
aauaauaaauc

SEQ ID NO: 2098467 - RNA, 13 nt, Human
aauaauaaauugc

SEQ ID NO: 2098468 - RNA, 14 nt, Human
aauaauaaauugca

SEQ ID NO: 2098469 - RNA, 21 nt, Human
aauaauaaauugcaugcugcu

SEQ ID NO: 2098470 - RNA, 11 nt, Human
aauaauaauua

SEQ ID NO: 2098471 - RNA, 21 nt, Human
aauaauaauuauccagaguuu

SEQ ID NO: 2098472 - RNA, 17 nt, Human
aauagaaauggggaacu

SEQ ID NO: 2098473 - RNA, 22 nt, Human
aauagaacauugauugcugugu

SEQ ID NO: 2098474 - RNA, 15 nt, Human
aauagaagaacaucc

SEQ ID NO: 2098475 - RNA, 16 nt, Human
aauagaaauccaauug

SEQ ID NO: 2098476 - RNA, 21 nt, Human
aauagaaacucaccauguaaa

SEQ ID NO: 2098477 - RNA, 13 nt, Human
aauagaaacucac

SEQ ID NO: 2098478 - RNA, 22 nt, Human
aauacuuauauuuuuaauaaaa

SEQ ID NO: 2098479 - RNA, 13 nt, Human
aauacuuauucau

SEQ ID NO: 2098480 - RNA, 17 nt, Human
aauacuuauucauugug

SEQ ID NO: 2098481 - RNA, 23 nt, Human
aauacuuauucauugugguuauu

SEQ ID NO: 2098482 - RNA, 20 nt, Human
aauacgccagaacugcuuua

SEQ ID NO: 2098483 - RNA, 15 nt, Human
aauauagcuauuuuu

SEQ ID NO: 2098484 - RNA, 13 nt, Human
aauauagcuauuu

SEQ ID NO: 2098485 - RNA, 16 nt, Human
aauauaaccaauguuu

SEQ ID NO: 2098486 - RNA, 17 nt, Human
aauauaaccaauguuua

SEQ ID NO: 2098487 - RNA, 18 nt, Human
aauauaaccaauguuuaa

SEQ ID NO: 2098488 - RNA, 21 nt, Human
aauauaaccaauguuuaaaaa

SEQ ID NO: 2098489 - RNA, 13 nt, Human
aauauaacugccu

SEQ ID NO: 2098490 - RNA, 13 nt, Human
aauauaaacacua

SEQ ID NO: 2098491 - RNA, 14 nt, Human
aauauaaacacuau

SEQ ID NO: 2098492 - RNA, 21 nt, Human
aauauaaagauggcugacuuu

SEQ ID NO: 2098493 - RNA, 16 nt, Human
aauauaaagcaucuaa

SEQ ID NO: 2098494 - RNA, 17 nt, Human
aauauaaagcaucuaaa

SEQ ID NO: 2098495 - RNA, 21 nt, Human
aauauaaagcaucuaaacuuu

SEQ ID NO: 2098496 - RNA, 14 nt, Human
aauaugcugccaaa

SEQ ID NO: 2098497 - RNA, 19 nt, Human
aauaugcugccaaauuuug

SEQ ID NO: 2098498 - RNA, 22 nt, Human
aauaugcugccaaauuuuggcc

SEQ ID NO: 2098499 - RNA, 20 nt, Human
aauauagaauuuuuaauguu

SEQ ID NO: 2098500 - RNA, 18 nt, Human
aauccaccugccucggcc

SEQ ID NO: 2098501 - RNA, 19 nt, Human
aauccaccugccucggccu

SEQ ID NO: 2098502 - RNA, 13 nt, Human
aauccacacauca

SEQ ID NO: 2098503 - RNA, 17 nt, Human
aauccaacccaugauga

SEQ ID NO: 2098504 - RNA, 13 nt, Human
aauccagaaagaa

SEQ ID NO: 2098505 - RNA, 17 nt, Human
aauccagaaagaaaaaa

SEQ ID NO: 2098506 - RNA, 22 nt, Human
aauccagaauugaccuuuugac

SEQ ID NO: 2098507 - RNA, 16 nt, Human
aaucauuuuccuuuuu

SEQ ID NO: 2098508 - RNA, 16 nt, Human
aaucuggacuccucug

SEQ ID NO: 2098509 - RNA, 15 nt, Human
aaucuggacuccucu

SEQ ID NO: 2098510 - RNA, 18 nt, Human
aaucuggacuccucuguc

SEQ ID NO: 2098511 - RNA, 17 nt, Human
aaucuggacuccucugu

SEQ ID NO: 2098512 - RNA, 20 nt, Human
aaucuggacuccucugucca

SEQ ID NO: 2098513 - RNA, 12 nt, Human
aaugaaauguuu

SEQ ID NO: 2098514 - RNA, 13 nt, Human
aaugaaauguuuu

SEQ ID NO: 2098515 - RNA, 14 nt, Human
aaugaaauguuuua

SEQ ID NO: 2098516 - RNA, 14 nt, Human
aaucuccuauuuuu

SEQ ID NO: 2098517 - RNA, 21 nt, Human
aaucuccuauuuuuuuaaaau

SEQ ID NO: 2098518 - RNA, 15 nt, Human
aaucuccucuuuuau

SEQ ID NO: 2098519 - RNA, 18 nt, Human
aaucuccucuuuuaucuu

SEQ ID NO: 2098520 - RNA, 15 nt, Human
aauccaugcuugggu

SEQ ID NO: 2098521 - RNA, 17 nt, Human
aauccauguuaguuuuu

SEQ ID NO: 2098522 - RNA, 15 nt, Human
aaugauagcuacugu

SEQ ID NO: 2098523 - RNA, 14 nt, Human
aaugauguugaaua

SEQ ID NO: 2098524 - RNA, 23 nt, Human
aaugaaauuacuacaaaauuuga

SEQ ID NO: 2098525 - RNA, 17 nt, Human
aaugaaauuacuacaaa

SEQ ID NO: 2098526 - RNA, 12 nt, Human
aaugaaauuuua

SEQ ID NO: 2098527 - RNA, 13 nt, Human
aaugaaauuuuac

SEQ ID NO: 2098528 - RNA, 14 nt, Human
aaugaaauuuuacc

SEQ ID NO: 2098529 - RNA, 16 nt, Human
aaugaaauuuuaccaa

SEQ ID NO: 2098530 - RNA, 22 nt, Human
aaugaaauuuuaccaaguuaua

SEQ ID NO: 2098531 - RNA, 18 nt, Human
aaugauacccugaauuug

SEQ ID NO: 2098532 - RNA, 19 nt, Human
aaucaaauuuguaggguuu

SEQ ID NO: 2098533 - RNA, 21 nt, Human
aaucauuucuugggcccuccu

SEQ ID NO: 2098534 - RNA, 22 nt, Human
aaucauuucuugggcccuccug

SEQ ID NO: 2098535 - RNA, 20 nt, Human
aaucauuuuacccuuggcuc

SEQ ID NO: 2098536 - RNA, 16 nt, Human
aaugcccuuaaaucau

SEQ ID NO: 2098537 - RNA, 15 nt, Human
aaugccuaagaagau

SEQ ID NO: 2098538 - RNA, 12 nt, Human
aaugccuccucc

SEQ ID NO: 2098539 - RNA, 14 nt, Human
aaugccuccucccu

SEQ ID NO: 2098540 - RNA, 15 nt, Human
aaugccuccucccug

SEQ ID NO: 2098541 - RNA, 21 nt, Human
aaugcuaaauguaagaaucau

SEQ ID NO: 2098542 - RNA, 20 nt, Human
aaugcuaacaguucacuugc

SEQ ID NO: 2098543 - RNA, 17 nt, Human
aaugcuaagggcaggcc

SEQ ID NO: 2098544 - RNA, 23 nt, Human
aaugcucuuuacuucauggacuu

SEQ ID NO: 2098545 - RNA, 13 nt, Human
aaugcucuccuuu

SEQ ID NO: 2098546 - RNA, 14 nt, Human
aaugcucuccuuuc

SEQ ID NO: 2098547 - RNA, 21 nt, Human
aaugcucccccauccuccccu

SEQ ID NO: 2098548 - RNA, 22 nt, Human
aaugcucccccauccuccccuu

SEQ ID NO: 2098549 - RNA, 11 nt, Human
aaugcuccccc

SEQ ID NO: 2098550 - RNA, 14 nt, Human
aaugcucccccauc

SEQ ID NO: 2098551 - RNA, 20 nt, Human
aaugcucccccauccucccc

SEQ ID NO: 2098552 - RNA, 13 nt, Human
aaugggacacuaa

SEQ ID NO: 2098553 - RNA, 18 nt, Human
aaugggacuggagucccu

SEQ ID NO: 2098554 - RNA, 15 nt, Human
aaugucacaggcagg

SEQ ID NO: 2098555 - RNA, 16 nt, Human
aaugguauggaacucu

SEQ ID NO: 2098556 - RNA, 14 nt, Human
aacuuacuuagugu

SEQ ID NO: 2098557 - RNA, 16 nt, Human
aacuuagcauguguug

SEQ ID NO: 2098558 - RNA, 23 nt, Human
aagacaggacagugcuucagccu

SEQ ID NO: 2098559 - RNA, 22 nt, Human
aagacagcuucucauccugcag

SEQ ID NO: 2098560 - RNA, 17 nt, Human
aacuguugccagagaug

SEQ ID NO: 2098561 - RNA, 18 nt, Human
aacuguugccagagaugg

SEQ ID NO: 2098562 - RNA, 21 nt, Human
aacuguucucuauuagacuuu

SEQ ID NO: 2098563 - RNA, 14 nt, Human
aacuguugauugca

SEQ ID NO: 2098564 - RNA, 15 nt, Human
aacuguugccagaga

SEQ ID NO: 2098565 - RNA, 13 nt, Human
aacuuacacacaa

SEQ ID NO: 2098566 - RNA, 23 nt, Human
aacuuacauugugaaacuucugu

SEQ ID NO: 2098567 - RNA, 19 nt, Human
aagacauggggaggaagga

SEQ ID NO: 2098568 - RNA, 13 nt, Human
aagacauugucaa

SEQ ID NO: 2098569 - RNA, 14 nt, Human
aagacauugucaau

SEQ ID NO: 2098570 - RNA, 18 nt, Human
aagagaagcuacuuuguu

SEQ ID NO: 2098571 - RNA, 21 nt, Human
aagagaacugaugacacugag

SEQ ID NO: 2098572 - RNA, 10 nt, Human
aagagaaugu

SEQ ID NO: 2098573 - RNA, 13 nt, Human
aagagaauguaga

SEQ ID NO: 2098574 - RNA, 13 nt, Human
aagagaauguuau

SEQ ID NO: 2098575 - RNA, 14 nt, Human
aagagaauguuaua

SEQ ID NO: 2098576 - RNA, 22 nt, Human
aagagaauguuauagugaauua

SEQ ID NO: 2098577 - RNA, 13 nt, Human
aagagaauguuga

SEQ ID NO: 2098578 - RNA, 20 nt, Human
aagagaauauuagcuuuacu

SEQ ID NO: 2098579 - RNA, 19 nt, Human
aagagaaugccauucucuu

SEQ ID NO: 2098580 - RNA, 14 nt, Human
aagagagaaagaag

SEQ ID NO: 2098581 - RNA, 21 nt, Human
aagagagaaagaaguaggcau

SEQ ID NO: 2098582 - RNA, 16 nt, Human
aagagagccuugguuc

SEQ ID NO: 2098583 - RNA, 22 nt, Human
aagagagccuugguucaucagu

SEQ ID NO: 2098584 - RNA, 15 nt, Human
aagagagauguuuug

SEQ ID NO: 2098585 - RNA, 12 nt, Human
aagagagaaugu

SEQ ID NO: 2098586 - RNA, 13 nt, Human
aagagagaaugua

SEQ ID NO: 2098587 - RNA, 14 nt, Human
aagagagagcugag

SEQ ID NO: 2098588 - RNA, 18 nt, Human
aagauuauuuuuuaugag

SEQ ID NO: 2098589 - RNA, 15 nt, Human
aagauucccagagac

SEQ ID NO: 2098590 - RNA, 18 nt, Human
aagauucccagagacagg

SEQ ID NO: 2098591 - RNA, 19 nt, Human
aagauucccagagacagga

SEQ ID NO: 2098592 - RNA, 20 nt, Human
aagauucauauuuacuucuu

SEQ ID NO: 2098593 - RNA, 12 nt, Human
aagauucccaga

SEQ ID NO: 2098594 - RNA, 13 nt, Human
aagauucccagag

SEQ ID NO: 2098595 - RNA, 14 nt, Human
aagauucccagaga

SEQ ID NO: 2098596 - RNA, 17 nt, Human
aagauucauccauuuau

SEQ ID NO: 2098597 - RNA, 12 nt, Human
aagauagaagaa

SEQ ID NO: 2098598 - RNA, 13 nt, Human
aagauagaagaaa

SEQ ID NO: 2098599 - RNA, 14 nt, Human
aagauagaagaaaa

SEQ ID NO: 2098600 - RNA, 21 nt, Human
aagauagaagaaaaaagaaug

SEQ ID NO: 2098601 - RNA, 22 nt, Human
aagauacuuggaccgaguagag

SEQ ID NO: 2098602 - RNA, 21 nt, Human
aagauuuuggaggagaaggac

SEQ ID NO: 2098603 - RNA, 11 nt, Human
aagauuuugaa

SEQ ID NO: 2098604 - RNA, 12 nt, Human
aagauuuugaaa

SEQ ID NO: 2098605 - RNA, 14 nt, Human
aagauuuugaaaac

SEQ ID NO: 2098606 - RNA, 15 nt, Human
aagauuuugaaaacu

SEQ ID NO: 2098607 - RNA, 20 nt, Human
aagauuuugaaaacuacauu

SEQ ID NO: 2098608 - RNA, 23 nt, Human
aagauuuugaaaacuacauuuua

SEQ ID NO: 2098609 - RNA, 15 nt, Human
aagauuuugaaugcu

SEQ ID NO: 2098610 - RNA, 17 nt, Human
aagauuuugaaugcuuc

SEQ ID NO: 2098611 - RNA, 21 nt, Human
aagauuuugaaugcuuccuga

SEQ ID NO: 2098612 - RNA, 19 nt, Human
aagauuuugaaauuuuuau

SEQ ID NO: 2098613 - RNA, 21 nt, Human
aagauugaaaaggaagaucag

SEQ ID NO: 2098614 - RNA, 18 nt, Human
aagcacuuugggauucuu

SEQ ID NO: 2098615 - RNA, 14 nt, Human
aagcagaugcaaag

SEQ ID NO: 2098616 - RNA, 16 nt, Human
aagcagaugcaaagag

SEQ ID NO: 2098617 - RNA, 18 nt, Human
aagcagaugcaaagaggc

SEQ ID NO: 2098618 - RNA, 21 nt, Human
aagcagaggaaggagaggaga

SEQ ID NO: 2098619 - RNA, 13 nt, Human
aagcagaggcugg

SEQ ID NO: 2098620 - RNA, 18 nt, Human
aagcagaggcuggccuca

SEQ ID NO: 2098621 - RNA, 20 nt, Human
aagcagaggcuggccucaga

SEQ ID NO: 2098622 - RNA, 13 nt, Human
aaggcagcaggcg

SEQ ID NO: 2098623 - RNA, 20 nt, Human
aaggaauucuaggcauccca

SEQ ID NO: 2098624 - RNA, 16 nt, Human
aaggacaaagucucca

SEQ ID NO: 2098625 - RNA, 17 nt, Human
aaggacaaagucuccag

SEQ ID NO: 2098626 - RNA, 21 nt, Human
aaggacaaagucuccagccca

SEQ ID NO: 2098627 - RNA, 22 nt, Human
aaggacccggaggggccuggca

SEQ ID NO: 2098628 - RNA, 13 nt, Human
aaggaccuccuga

SEQ ID NO: 2098629 - RNA, 16 nt, Human
aaggaccuauguuugc

SEQ ID NO: 2098630 - RNA, 17 nt, Human
aaggaccuauguuugcu

SEQ ID NO: 2098631 - RNA, 22 nt, Human
aaggaccuauguuugcucagaa

SEQ ID NO: 2098632 - RNA, 20 nt, Human
aaggacccuucagagguggc

SEQ ID NO: 2098633 - RNA, 21 nt, Human
aaggacggccuucaacugaaa

SEQ ID NO: 2098634 - RNA, 14 nt, Human
aagcugcugacagu

SEQ ID NO: 2098635 - RNA, 20 nt, Human
aagcgugagccacugcaccg

SEQ ID NO: 2098636 - RNA, 17 nt, Human
aagcgugagccacugca

SEQ ID NO: 2098637 - RNA, 21 nt, Human
aagcgugagccacugcaccgg

SEQ ID NO: 2098638 - RNA, 21 nt, Human
aaggaaucuccaguuuucagu

SEQ ID NO: 2098639 - RNA, 16 nt, Human
aaggaauuaucaauua

SEQ ID NO: 2098640 - RNA, 15 nt, Human
aaggaauucuaggca

SEQ ID NO: 2098641 - RNA, 17 nt, Human
aaggaaugcuuggaaua

SEQ ID NO: 2098642 - RNA, 16 nt, Human
aaggaauggaggcucu

SEQ ID NO: 2098643 - RNA, 21 nt, Human
aaggaauguagcugguuuccu

SEQ ID NO: 2098644 - RNA, 17 nt, Human
aaggaaucuccaguuuu

SEQ ID NO: 2098645 - RNA, 16 nt, Human
aaggaaugucuuuggu

SEQ ID NO: 2098646 - RNA, 16 nt, Human
aagcugcugacagugu

SEQ ID NO: 2098647 - RNA, 21 nt, Human
aagcugcuuuaaaaaaauaca

SEQ ID NO: 2098648 - RNA, 23 nt, Human
aagcugcuuggaccucgugcuuu

SEQ ID NO: 2098649 - RNA, 11 nt, Human
aagcugcuuuu

SEQ ID NO: 2098650 - RNA, 14 nt, Human
aagcugcuuuugac

SEQ ID NO: 2098651 - RNA, 17 nt, Human
aagcgauucuucugcuu

SEQ ID NO: 2098652 - RNA, 16 nt, Human
aagcgauucuucugcu

SEQ ID NO: 2098653 - RNA, 14 nt, Human
aagcgauucuucug

SEQ ID NO: 2098654 - RNA, 15 nt, Human
aagcgauucuucugc

SEQ ID NO: 2098655 - RNA, 17 nt, Human
aagccacugaagcuggg

SEQ ID NO: 2098656 - RNA, 13 nt, Human
aagccacugaagc

SEQ ID NO: 2098657 - RNA, 14 nt, Human
aagccacugaagcu

SEQ ID NO: 2098658 - RNA, 11 nt, Human
aagccacccuc

SEQ ID NO: 2098659 - RNA, 15 nt, Human
aagccacccucccag

SEQ ID NO: 2098660 - RNA, 16 nt, Human
aagccacccucccagc

SEQ ID NO: 2098661 - RNA, 18 nt, Human
aagccacccucccagcuc

SEQ ID NO: 2098662 - RNA, 19 nt, Human
aagccacccucccagcucu

SEQ ID NO: 2098663 - RNA, 21 nt, Human
aagccacccucccagcucuga

SEQ ID NO: 2098664 - RNA, 23 nt, Human
aagggauuuucagcccucagaau

SEQ ID NO: 2098665 - RNA, 21 nt, Human
aagggauuuucagcccucaga

SEQ ID NO: 2098666 - RNA, 22 nt, Human
aagggcaggcccaaauuaucaa

SEQ ID NO: 2098667 - RNA, 22 nt, Human
aagggcagggcaucuccugugc

SEQ ID NO: 2098668 - RNA, 14 nt, Human
aagggcaguggagg

SEQ ID NO: 2098669 - RNA, 15 nt, Human
aagggcaguggaggu

SEQ ID NO: 2098670 - RNA, 21 nt, Human
aagggcaggaaggagagccug

SEQ ID NO: 2098671 - RNA, 22 nt, Human
aagggcaggaaggagagccugc

SEQ ID NO: 2098672 - RNA, 21 nt, Human
aagggauggaaaaggaagacu

SEQ ID NO: 2098673 - RNA, 24 nt, Human
aagggauggaggucacacugguag

SEQ ID NO: 2098674 - RNA, 15 nt, Human
aagggauuuucagcc

SEQ ID NO: 2098675 - RNA, 20 nt, Human
aagggacuuggaagcuccgc

SEQ ID NO: 2098676 - RNA, 15 nt, Human
aagggauggaaaagg

SEQ ID NO: 2098677 - RNA, 20 nt, Human
aagggauggaaaaggaagac

SEQ ID NO: 2098678 - RNA, 20 nt, Human
aaggucucucuuuggacucu

SEQ ID NO: 2098679 - RNA, 17 nt, Human
aagguguaacucuaauu

SEQ ID NO: 2098680 - RNA, 20 nt, Human
aaggugguauguguguguau

SEQ ID NO: 2098681 - RNA, 18 nt, Human
aaggugucagaauaauaa

SEQ ID NO: 2098682 - RNA, 20 nt, Human
aaggugucuggacauucaga

SEQ ID NO: 2098683 - RNA, 20 nt, Human
aaggugggcugagcccuggc

SEQ ID NO: 2098684 - RNA, 21 nt, Human
aaggugggcugagcccuggca

SEQ ID NO: 2098685 - RNA, 16 nt, Human
aaggugguaugugugu

SEQ ID NO: 2098686 - RNA, 21 nt, Human
aagguggggucuuugugagag

SEQ ID NO: 2098687 - RNA, 17 nt, Human
aaggugguaugugugug

SEQ ID NO: 2098688 - RNA, 19 nt, Human
aagguggggguuggcuggg

SEQ ID NO: 2098689 - RNA, 20 nt, Human
aagguggggguuggcugggu

SEQ ID NO: 2098690 - RNA, 22 nt, Human
aagguggggguuggcuggguac

SEQ ID NO: 2098691 - RNA, 22 nt, Human
aagguguucauucacuugcauu

SEQ ID NO: 2098692 - RNA, 17 nt, Human
aagguucacuaaagcag

SEQ ID NO: 2098693 - RNA, 22 nt, Human
aagguuccaaucagaucuuuau

SEQ ID NO: 2098694 - RNA, 19 nt, Human
aaguagacuucauuuuucc

SEQ ID NO: 2098695 - RNA, 23 nt, Human
aaguagacuucauuuuuccuaac

SEQ ID NO: 2098696 - RNA, 12 nt, Human
acaguguacagu

SEQ ID NO: 2098697 - RNA, 13 nt, Human
acaguguacaguc

SEQ ID NO: 2098698 - RNA, 19 nt, Human
acagugguucuacaaucua

SEQ ID NO: 2098699 - RNA, 23 nt, Human
acagugguucuacaaucuauuua

SEQ ID NO: 2098700 - RNA, 14 nt, Human
acagugggugcccc

SEQ ID NO: 2098701 - RNA, 21 nt, Human
acagugggugccccccuugcc

SEQ ID NO: 2098702 - RNA, 23 nt, Human
acagugagucgaggacagggagg

SEQ ID NO: 2098703 - RNA, 22 nt, Human
acagugauuuuuuuuuagaaca

SEQ ID NO: 2098704 - RNA, 23 nt, Human
acagugauuuuuuuuuagaacag

SEQ ID NO: 2098705 - RNA, 18 nt, Human
acaguguacagucuugua

SEQ ID NO: 2098706 - RNA, 15 nt, Human
acaguguacagucuu

SEQ ID NO: 2098707 - RNA, 17 nt, Human
acaguguacagucuugu

SEQ ID NO: 2098708 - RNA, 23 nt, Human
acagugucuguaucggagacagu

SEQ ID NO: 2098709 - RNA, 24 nt, Human
acagugucuguaucggagacagug

SEQ ID NO: 2098710 - RNA, 22 nt, Human
acagggcuaagagcuagcgcug

SEQ ID NO: 2098711 - RNA, 14 nt, Human
acaggcaaugcugg

SEQ ID NO: 2098712 - RNA, 19 nt, Human
acaggucuccucuuaaaaa

SEQ ID NO: 2098713 - RNA, 16 nt, Human
acaggucugggagagg

SEQ ID NO: 2098714 - RNA, 19 nt, Human
acaggucugggagaggcag

SEQ ID NO: 2098715 - RNA, 16 nt, Human
acagguggacacacaa

SEQ ID NO: 2098716 - RNA, 18 nt, Human
acagguggacacacaagg

SEQ ID NO: 2098717 - RNA, 23 nt, Human
acaggugugagucaccaagccca

SEQ ID NO: 2098718 - RNA, 22 nt, Human
acaggugugagucaccaagccc

SEQ ID NO: 2098719 - RNA, 19 nt, Human
acaggugugaaccaccaca

SEQ ID NO: 2098720 - RNA, 17 nt, Human
acagguguccccagccc

SEQ ID NO: 2098721 - RNA, 22 nt, Human
acagguguccccagcccacugg

SEQ ID NO: 2098722 - RNA, 14 nt, Human
acagguguuuauac

SEQ ID NO: 2098723 - RNA, 22 nt, Human
acagugagucgaggacagggag

SEQ ID NO: 2098724 - RNA, 23 nt, Human
acagugagcuuggaaaggaccag

SEQ ID NO: 2098725 - RNA, 15 nt, Human
acagugagguccugg

SEQ ID NO: 2098726 - RNA, 16 nt, Human
acagugagguccuggg

SEQ ID NO: 2098727 - RNA, 18 nt, Human
acagugagguccuggggg

SEQ ID NO: 2098728 - RNA, 19 nt, Human
acagugagguccugggggc

SEQ ID NO: 2098729 - RNA, 20 nt, Human
acagugagguccugggggcc

SEQ ID NO: 2098730 - RNA, 22 nt, Human
acagugagguccugggggccug

SEQ ID NO: 2098731 - RNA, 14 nt, Human
acagcucuguccug

SEQ ID NO: 2098732 - RNA, 23 nt, Human
acagcuccuucuguccuacucug

SEQ ID NO: 2098733 - RNA, 18 nt, Human
acagcuccuucuguccua

SEQ ID NO: 2098734 - RNA, 16 nt, Human
acagcuccuucugucc

SEQ ID NO: 2098735 - RNA, 15 nt, Human
acagcuccuucuguc

SEQ ID NO: 2098736 - RNA, 17 nt, Human
acagcucuguccuggga

SEQ ID NO: 2098737 - RNA, 16 nt, Human
acagcucuguccuggg

SEQ ID NO: 2098738 - RNA, 13 nt, Human
acagcucuguccu

SEQ ID NO: 2098739 - RNA, 20 nt, Human
acagaggagggcgugacuca

SEQ ID NO: 2098740 - RNA, 22 nt, Human
acagcugaggucucuugaggga

SEQ ID NO: 2098741 - RNA, 16 nt, Human
acagcugaggucucuu

SEQ ID NO: 2098742 - RNA, 15 nt, Human
acagcugcagagaca

SEQ ID NO: 2098743 - RNA, 17 nt, Human
acagcugcagagacaga

SEQ ID NO: 2098744 - RNA, 21 nt, Human
acagcugcagagacagagagg

SEQ ID NO: 2098745 - RNA, 23 nt, Human
acaggcaagcaccuccugccucg

SEQ ID NO: 2098746 - RNA, 20 nt, Human
acaggcaagcaccuccugcc

SEQ ID NO: 2098747 - RNA, 12 nt, Human
acagcugccugc

SEQ ID NO: 2098748 - RNA, 16 nt, Human
acagcugccugcagua

SEQ ID NO: 2098749 - RNA, 15 nt, Human
acaucaguaauguau

SEQ ID NO: 2098750 - RNA, 20 nt, Human
acaucaguggcauggcucca

SEQ ID NO: 2098751 - RNA, 22 nt, Human
acaucaguggcauggcuccagu

SEQ ID NO: 2098752 - RNA, 23 nt, Human
acaucaguggcauggcuccaguc

SEQ ID NO: 2098753 - RNA, 16 nt, Human
acauacaauuauuuuu

SEQ ID NO: 2098754 - RNA, 22 nt, Human
acauacaauuauuuuuacaguu

SEQ ID NO: 2098755 - RNA, 16 nt, Human
acauaagauaaaugug

SEQ ID NO: 2098756 - RNA, 15 nt, Human
acaucaguuacucug

SEQ ID NO: 2098757 - RNA, 18 nt, Human
acaucaguuacucugaag

SEQ ID NO: 2098758 - RNA, 20 nt, Human
acaucaguuacucugaaggg

SEQ ID NO: 2098759 - RNA, 16 nt, Human
acauccggaggagaag

SEQ ID NO: 2098760 - RNA, 14 nt, Human
acauccuccgucca

SEQ ID NO: 2098761 - RNA, 17 nt, Human
acauccuccguccagcc

SEQ ID NO: 2098762 - RNA, 15 nt, Human
acaugcaaggcacug

SEQ ID NO: 2098763 - RNA, 20 nt, Human
acaugcaaggcacuguacua

SEQ ID NO: 2098764 - RNA, 14 nt, Human
accaugaaacaaag

SEQ ID NO: 2098765 - RNA, 15 nt, Human
accaugaaacaaagc

SEQ ID NO: 2098766 - RNA, 13 nt, Human
acccacagggcua

SEQ ID NO: 2098767 - RNA, 15 nt, Human
acccacacugcaaca

SEQ ID NO: 2098768 - RNA, 19 nt, Human
acccacacugcaacaggaa

SEQ ID NO: 2098769 - RNA, 13 nt, Human
acccacagaaaga

SEQ ID NO: 2098770 - RNA, 14 nt, Human
acccacagaaagag

SEQ ID NO: 2098771 - RNA, 16 nt, Human
acccacagaaagagag

SEQ ID NO: 2098772 - RNA, 12 nt, Human
acccacagccuc

SEQ ID NO: 2098773 - RNA, 13 nt, Human
acccacagccucu

SEQ ID NO: 2098774 - RNA, 19 nt, Human
acccacagccucugccugu

SEQ ID NO: 2098775 - RNA, 16 nt, Human
acccacccagcaccca

SEQ ID NO: 2098776 - RNA, 16 nt, Human
acccaccaguugaauu

SEQ ID NO: 2098777 - RNA, 15 nt, Human
acccacccuccuuuc

SEQ ID NO: 2098778 - RNA, 15 nt, Human
acccauagcuuccau

SEQ ID NO: 2098779 - RNA, 16 nt, Human
acccauagcuuccaug

SEQ ID NO: 2098780 - RNA, 14 nt, Human
acccauaggaaauc

SEQ ID NO: 2098781 - RNA, 19 nt, Human
acccaucagaaggagaagg

SEQ ID NO: 2098782 - RNA, 20 nt, Human
acccaugaugagcuccucuu

SEQ ID NO: 2098783 - RNA, 18 nt, Human
acccaucacgccugugca

SEQ ID NO: 2098784 - RNA, 14 nt, Human
acccaucagaagga

SEQ ID NO: 2098785 - RNA, 18 nt, Human
acccaucagaaggagaag

SEQ ID NO: 2098786 - RNA, 15 nt, Human
accauacugagggac

SEQ ID NO: 2098787 - RNA, 18 nt, Human
accauagcgcugcucuua

SEQ ID NO: 2098788 - RNA, 22 nt, Human
accauccacucuacccucccac

SEQ ID NO: 2098789 - RNA, 23 nt, Human
accauccacucuacccucccacc

SEQ ID NO: 2098790 - RNA, 15 nt, Human
acauuuauaauguuu

SEQ ID NO: 2098791 - RNA, 20 nt, Human
acauuuauaauguuugcuau

SEQ ID NO: 2098792 - RNA, 18 nt, Human
acauuuauaauguuugcu

SEQ ID NO: 2098793 - RNA, 12 nt, Human
acauuucuaacu

SEQ ID NO: 2098794 - RNA, 14 nt, Human
acauuucuaacucu

SEQ ID NO: 2098795 - RNA, 20 nt, Human
acauuucuaacucugaugua

SEQ ID NO: 2098796 - RNA, 22 nt, Human
acauuucuaacucugauguaaa

SEQ ID NO: 2098797 - RNA, 22 nt, Human
accaacuuuucuauuaaaagug

SEQ ID NO: 2098798 - RNA, 14 nt, Human
accaagaaagcagg

SEQ ID NO: 2098799 - RNA, 12 nt, Human
accaagaacugc

SEQ ID NO: 2098800 - RNA, 14 nt, Human
accaagaacugcau

SEQ ID NO: 2098801 - RNA, 15 nt, Human
accaagaacugcaug

SEQ ID NO: 2098802 - RNA, 11 nt, Human
accaagaagau

SEQ ID NO: 2098803 - RNA, 16 nt, Human
accaagaagaugucuu

SEQ ID NO: 2098804 - RNA, 21 nt, Human
accaacuuuucuauuaaaagu

SEQ ID NO: 2098805 - RNA, 17 nt, Human
accaaggagaugaagca

SEQ ID NO: 2098806 - RNA, 16 nt, Human
accaagaugccaucug

SEQ ID NO: 2098807 - RNA, 18 nt, Human
accaaggaccccucaccu

SEQ ID NO: 2098808 - RNA, 13 nt, Human
accaagagagaaa

SEQ ID NO: 2098809 - RNA, 15 nt, Human
accaagagagaaaga

SEQ ID NO: 2098810 - RNA, 20 nt, Human
accaagagagaaagaaguag

SEQ ID NO: 2098811 - RNA, 21 nt, Human
accaagaauucuccaaaacaa

SEQ ID NO: 2098812 - RNA, 22 nt, Human
accaagaauucuccaaaacaau

SEQ ID NO: 2098813 - RNA, 16 nt, Human
accaagacucugaaau

SEQ ID NO: 2098814 - RNA, 12 nt, Human
accaccugccca

SEQ ID NO: 2098815 - RNA, 13 nt, Human
accaccuucccag

SEQ ID NO: 2098816 - RNA, 14 nt, Human
accaccuucccagc

SEQ ID NO: 2098817 - RNA, 20 nt, Human
accaccuucccagcucuccc

SEQ ID NO: 2098818 - RNA, 21 nt, Human
accaccuucccagcucucccu

SEQ ID NO: 2098819 - RNA, 15 nt, Human
accaccuucccagcu

SEQ ID NO: 2098820 - RNA, 16 nt, Human
accaccuucccagcuc

SEQ ID NO: 2098821 - RNA, 17 nt, Human
accaccuucccagcucu

SEQ ID NO: 2098822 - RNA, 19 nt, Human
accaccuucccagcucucc

SEQ ID NO: 2098823 - RNA, 20 nt, Human
accacccuagucccuucccc

SEQ ID NO: 2098824 - RNA, 21 nt, Human
accacccuagucccuuccccu

SEQ ID NO: 2098825 - RNA, 20 nt, Human
accagccccagugcccacag

SEQ ID NO: 2098826 - RNA, 19 nt, Human
accagccccagugcccaca

SEQ ID NO: 2098827 - RNA, 18 nt, Human
accagccccagugcccac

SEQ ID NO: 2098828 - RNA, 19 nt, Human
accagcagaucccagcuca

SEQ ID NO: 2098829 - RNA, 21 nt, Human
accagcagaucccagcucacg

SEQ ID NO: 2098830 - RNA, 17 nt, Human
accacgauguggcccug

SEQ ID NO: 2098831 - RNA, 18 nt, Human
accacgauguggcccugg

SEQ ID NO: 2098832 - RNA, 19 nt, Human
accacgauguggcccuggc

SEQ ID NO: 2098833 - RNA, 15 nt, Human
accagcagaucccag

SEQ ID NO: 2098834 - RNA, 17 nt, Human
accagccccagugccca

SEQ ID NO: 2098835 - RNA, 16 nt, Human
accagccccagugccc

SEQ ID NO: 2098836 - RNA, 22 nt, Human
accaccuucccagcucucccuc

SEQ ID NO: 2098837 - RNA, 17 nt, Human
accaccuuuuauuacau

SEQ ID NO: 2098838 - RNA, 16 nt, Human
accacgauguggcccu

SEQ ID NO: 2098839 - RNA, 16 nt, Human
acacuguuagaacacu

SEQ ID NO: 2098840 - RNA, 17 nt, Human
acacuguuagaacacua

SEQ ID NO: 2098841 - RNA, 18 nt, Human
acacuguuagaacacuau

SEQ ID NO: 2098842 - RNA, 15 nt, Human
acacugggggagggg

SEQ ID NO: 2098843 - RNA, 16 nt, Human
acacugggggagggga

SEQ ID NO: 2098844 - RNA, 14 nt, Human
acagacacacacac

SEQ ID NO: 2098845 - RNA, 13 nt, Human
acagacacacaca

SEQ ID NO: 2098846 - RNA, 12 nt, Human
acagacacacac

SEQ ID NO: 2098847 - RNA, 16 nt, Human
acagaagucaugaagc

SEQ ID NO: 2098848 - RNA, 14 nt, Human
acagacaacagaag

SEQ ID NO: 2098849 - RNA, 21 nt, Human
acagacaagguagcccuggcc

SEQ ID NO: 2098850 - RNA, 22 nt, Human
acagacaagguagcccuggcca

SEQ ID NO: 2098851 - RNA, 13 nt, Human
acagaagcuucca

SEQ ID NO: 2098852 - RNA, 21 nt, Human
acagaagccucacugcaagca

SEQ ID NO: 2098853 - RNA, 23 nt, Human
acagaggccaugggccuccugug

SEQ ID NO: 2098854 - RNA, 21 nt, Human
acagaggccaugggccuccug

SEQ ID NO: 2098855 - RNA, 17 nt, Human
acagaggccaugggccu

SEQ ID NO: 2098856 - RNA, 17 nt, Human
acagaggccauggcaga

SEQ ID NO: 2098857 - RNA, 13 nt, Human
acagaggcagccc

SEQ ID NO: 2098858 - RNA, 18 nt, Human
acagaggaagagcaggca

SEQ ID NO: 2098859 - RNA, 17 nt, Human
acagaggaagagcaggc

SEQ ID NO: 2098860 - RNA, 14 nt, Human
acagacacacgcac

SEQ ID NO: 2098861 - RNA, 16 nt, Human
acacguacuuaaauga

SEQ ID NO: 2098862 - RNA, 17 nt, Human
acacggaggcaucugca

SEQ ID NO: 2098863 - RNA, 18 nt, Human
acacggaggcaucugcac

SEQ ID NO: 2098864 - RNA, 21 nt, Human
acacagcucuucuccaggcug

SEQ ID NO: 2098865 - RNA, 20 nt, Human
acacagcucuucuccaggcu

SEQ ID NO: 2098866 - RNA, 22 nt, Human
acacagcucuucuccaggcugu

SEQ ID NO: 2098867 - RNA, 19 nt, Human
acacaaaaguuucucuuuu

SEQ ID NO: 2098868 - RNA, 14 nt, Human
acacaaacaaacaa

SEQ ID NO: 2098869 - RNA, 22 nt, Human
acacaaacaaacaagcuaggug

SEQ ID NO: 2098870 - RNA, 19 nt, Human
acacagcucuucuccaggc

SEQ ID NO: 2098871 - RNA, 18 nt, Human
acaauuauaucaguccuc

SEQ ID NO: 2098872 - RNA, 18 nt, Human
acaauuauuuuuacaguu

SEQ ID NO: 2098873 - RNA, 21 nt, Human
acaauuauuuuuacaguucuc

SEQ ID NO: 2098874 - RNA, 14 nt, Human
acaauuccaaagga

SEQ ID NO: 2098875 - RNA, 18 nt, Human
acaauuccaaaggaaucu

SEQ ID NO: 2098876 - RNA, 19 nt, Human
acaauuccuagauaaaaag

SEQ ID NO: 2098877 - RNA, 22 nt, Human
acaauuccuagauaaaaagaug

SEQ ID NO: 2098878 - RNA, 23 nt, Human
acaauuccuagauaaaaagaugg

SEQ ID NO: 2098879 - RNA, 14 nt, Human
acaauuuaaagcaa

SEQ ID NO: 2098880 - RNA, 20 nt, Human
acaauuuaaagcaaaggagu

SEQ ID NO: 2098881 - RNA, 13 nt, Human
acaauuuaaagca

SEQ ID NO: 2098882 - RNA, 15 nt, Human
acaauucuacauugu

SEQ ID NO: 2098883 - RNA, 16 nt, Human
acaaggauugcuacug

SEQ ID NO: 2098884 - RNA, 16 nt, Human
aauuuugugcccccau

SEQ ID NO: 2098885 - RNA, 22 nt, Human
aauuuuggccaaaguguuaauc

SEQ ID NO: 2098886 - RNA, 20 nt, Human
aauuuucaguauaauuuaac

SEQ ID NO: 2098887 - RNA, 17 nt, Human
aauuuuggccaaagugu

SEQ ID NO: 2098888 - RNA, 18 nt, Human
aauuuugccuaauacauu

SEQ ID NO: 2098889 - RNA, 17 nt, Human
aauuuucagaccccagc

SEQ ID NO: 2098890 - RNA, 19 nt, Human
aauuuucaaguaauuguga

SEQ ID NO: 2098891 - RNA, 19 nt, Human
aauuuucaagcaucuccug

SEQ ID NO: 2098892 - RNA, 15 nt, Human
aauuuucaaguaauu

SEQ ID NO: 2098893 - RNA, 23 nt, Human
acaaccccccaucacaaacuuaa

SEQ ID NO: 2098894 - RNA, 14 nt, Human
acaacccugcaaag

SEQ ID NO: 2098895 - RNA, 19 nt, Human
acaacccugcaaaggacug

SEQ ID NO: 2098896 - RNA, 17 nt, Human
acaacccuguuuuauac

SEQ ID NO: 2098897 - RNA, 18 nt, Human
acaacccuguuuuauacu

SEQ ID NO: 2098898 - RNA, 19 nt, Human
acaaccgaugcuccagcca

SEQ ID NO: 2098899 - RNA, 20 nt, Human
acaaccgaugcuccagccaa

SEQ ID NO: 2098900 - RNA, 22 nt, Human
acaaccgaugcuccagccaacc

SEQ ID NO: 2098901 - RNA, 13 nt, Human
acaaccguuggaa

SEQ ID NO: 2098902 - RNA, 17 nt, Human
aauuuauuuauacuauu

SEQ ID NO: 2098903 - RNA, 20 nt, Human
aauuuauuuauacuauuuag

SEQ ID NO: 2098904 - RNA, 20 nt, Human
aauuuauuuuauuuuagcag

SEQ ID NO: 2098905 - RNA, 22 nt, Human
aauuuauuuuauuuuagcaguu

SEQ ID NO: 2098906 - RNA, 17 nt, Human
aauuuauuuauuaagau

SEQ ID NO: 2098907 - RNA, 16 nt, Human
aauuuauugcuugaua

SEQ ID NO: 2098908 - RNA, 16 nt, Human
aauuuauuuauuaaga

SEQ ID NO: 2098909 - RNA, 22 nt, Human
aauuuauuuauuaagauggauu

SEQ ID NO: 2098910 - RNA, 14 nt, Human
aauuuauugcacaa

SEQ ID NO: 2098911 - RNA, 15 nt, Human
aauuuauugcacaaa

SEQ ID NO: 2098912 - RNA, 16 nt, Human
aauuuauugcacaaaa

SEQ ID NO: 2098913 - RNA, 21 nt, Human
aauuuauucaauuccucuggg

SEQ ID NO: 2098914 - RNA, 12 nt, Human
aauuuauucaau

SEQ ID NO: 2098915 - RNA, 14 nt, Human
aauuuauucaagaa

SEQ ID NO: 2098916 - RNA, 13 nt, Human
aauuguccccagu

SEQ ID NO: 2098917 - RNA, 12 nt, Human
aauugugaaaaa

SEQ ID NO: 2098918 - RNA, 20 nt, Human
aauugugccgagaaaagcau

SEQ ID NO: 2098919 - RNA, 16 nt, Human
aauugugaauugauaa

SEQ ID NO: 2098920 - RNA, 18 nt, Human
aauugugaauugauaaua

SEQ ID NO: 2098921 - RNA, 20 nt, Human
aauugugaauugauaauaaa

SEQ ID NO: 2098922 - RNA, 21 nt, Human
aauugugaauugauaauaaac

SEQ ID NO: 2098923 - RNA, 19 nt, Human
aaugucacaggcaggucca

SEQ ID NO: 2098924 - RNA, 16 nt, Human
aaugucacaggcaggu

SEQ ID NO: 2098925 - RNA, 19 nt, Human
aaugucaccaccuucccag

SEQ ID NO: 2098926 - RNA, 20 nt, Human
aaugucaccaccuucccagc

SEQ ID NO: 2098927 - RNA, 23 nt, Human
aaugucaccaccuucccagcucu

SEQ ID NO: 2098928 - RNA, 15 nt, Human
aaugucaccaccuuc

SEQ ID NO: 2098929 - RNA, 16 nt, Human
aaugucaccaccuucc

SEQ ID NO: 2098930 - RNA, 18 nt, Human
aaugucaccaccuuccca

SEQ ID NO: 2098931 - RNA, 13 nt, Human
aauuguaaacugu

SEQ ID NO: 2098932 - RNA, 14 nt, Human
aauuguaaacugua

SEQ ID NO: 2098933 - RNA, 15 nt, Human
aauuguaaacuguac

SEQ ID NO: 2098934 - RNA, 17 nt, Human
aauuguaaacuguacua

SEQ ID NO: 2098935 - RNA, 17 nt, Human
aauuguaaaacugaggc

SEQ ID NO: 2098936 - RNA, 16 nt, Human
aauuguauuuuaguaa

SEQ ID NO: 2098937 - RNA, 13 nt, Human
aauuguaucuagu

SEQ ID NO: 2098938 - RNA, 20 nt, Human
aauuguaucuagugcagcug

SEQ ID NO: 2098939 - RNA, 23 nt, Human
aauuguaucuagugcagcugauu

SEQ ID NO: 2098940 - RNA, 18 nt, Human
aauuguaucauuugaaca

SEQ ID NO: 2098941 - RNA, 24 nt, Human
aauuguaucauuugaacaacuagg

SEQ ID NO: 2098942 - RNA, 18 nt, Human
aauuucgccguugaagag

SEQ ID NO: 2098943 - RNA, 21 nt, Human
aauuucgccguugaagaggaa

SEQ ID NO: 2098944 - RNA, 20 nt, Human
aauuucagguuuuguaaaga

SEQ ID NO: 2098945 - RNA, 22 nt, Human
aauuucagguuuuguaaagaug

SEQ ID NO: 2098946 - RNA, 14 nt, Human
aauuucaauuuguu

SEQ ID NO: 2098947 - RNA, 15 nt, Human
aauuucaauuuguuc

SEQ ID NO: 2098948 - RNA, 14 nt, Human
aauuucacauuaau

SEQ ID NO: 2098949 - RNA, 22 nt, Human
acugaccaauauuguacaguuu

SEQ ID NO: 2098950 - RNA, 20 nt, Human
acugaccaauauuguacagu

SEQ ID NO: 2098951 - RNA, 21 nt, Human
acugaccaauauuguacaguu

SEQ ID NO: 2098952 - RNA, 13 nt, Human
acugaccagccuc

SEQ ID NO: 2098953 - RNA, 20 nt, Human
acugaccagccuccaugcug

SEQ ID NO: 2098954 - RNA, 15 nt, Human
acugaccagccucca

SEQ ID NO: 2098955 - RNA, 21 nt, Human
acugaauauuuauauuucacu

SEQ ID NO: 2098956 - RNA, 22 nt, Human
acugaauauuuauauuucacua

SEQ ID NO: 2098957 - RNA, 15 nt, Human
acugaauauuuauau

SEQ ID NO: 2098958 - RNA, 18 nt, Human
acugaauauuuauauuuc

SEQ ID NO: 2098959 - RNA, 23 nt, Human
acugacauuguuggccaaagcca

SEQ ID NO: 2098960 - RNA, 22 nt, Human
acugacauuguuggccaaagcc

SEQ ID NO: 2098961 - RNA, 22 nt, Human
acugaugggcaacccccagccu

SEQ ID NO: 2098962 - RNA, 12 nt, Human
acugaugggcaa

SEQ ID NO: 2098963 - RNA, 23 nt, Human
acugaccauccacucuacccucc

SEQ ID NO: 2098964 - RNA, 14 nt, Human
acugauggaaacaa

SEQ ID NO: 2098965 - RNA, 18 nt, Human
acugauggaaacaaagug

SEQ ID NO: 2098966 - RNA, 19 nt, Human
acugauggaaacaaagugg

SEQ ID NO: 2098967 - RNA, 22 nt, Human
acugauggcuaauguacugcau

SEQ ID NO: 2098968 - RNA, 23 nt, Human
acugaccagccuccaugcugccu

SEQ ID NO: 2098969 - RNA, 16 nt, Human
acugaccauccacucu

SEQ ID NO: 2098970 - RNA, 22 nt, Human
acugaccauccacucuacccuc

SEQ ID NO: 2098971 - RNA, 20 nt, Human
acugauucauaauaaauauc

SEQ ID NO: 2098972 - RNA, 13 nt, Human
acugauuguuuca

SEQ ID NO: 2098973 - RNA, 15 nt, Human
acugcaaaggcgcag

SEQ ID NO: 2098974 - RNA, 20 nt, Human
acucuacuuagcaugucccu

SEQ ID NO: 2098975 - RNA, 22 nt, Human
acucuaauucccauuuugcaaa

SEQ ID NO: 2098976 - RNA, 21 nt, Human
acucuacuuagcaugucccua

SEQ ID NO: 2098977 - RNA, 19 nt, Human
acucugucucaaaaaaaca

SEQ ID NO: 2098978 - RNA, 19 nt, Human
acucugugucagguggggc

SEQ ID NO: 2098979 - RNA, 21 nt, Human
acucugugucagguggggcag

SEQ ID NO: 2098980 - RNA, 21 nt, Human
acugaaguuaacagagacaga

SEQ ID NO: 2098981 - RNA, 17 nt, Human
acugaaguuaacagaga

SEQ ID NO: 2098982 - RNA, 14 nt, Human
acucuaauagugcu

SEQ ID NO: 2098983 - RNA, 21 nt, Human
acucuaauagugcuuaaaaau

SEQ ID NO: 2098984 - RNA, 20 nt, Human
acucuaauucccauuuugca

SEQ ID NO: 2098985 - RNA, 21 nt, Human
acucuaauucccauuuugcaa

SEQ ID NO: 2098986 - RNA, 13 nt, Human
acucuaauucuaa

SEQ ID NO: 2098987 - RNA, 14 nt, Human
acucuaauucuaac

SEQ ID NO: 2098988 - RNA, 15 nt, Human
acucuaauucuaacc

SEQ ID NO: 2098989 - RNA, 16 nt, Human
acucuaauucuaacca

SEQ ID NO: 2098990 - RNA, 18 nt, Human
acuauuuuuauuuauauu

SEQ ID NO: 2098991 - RNA, 12 nt, Human
acuauuuucaga

SEQ ID NO: 2098992 - RNA, 13 nt, Human
acuauuuucagaa

SEQ ID NO: 2098993 - RNA, 14 nt, Human
acuauuuucagaau

SEQ ID NO: 2098994 - RNA, 16 nt, Human
acuauuuucagaaucu

SEQ ID NO: 2098995 - RNA, 17 nt, Human
acuauuuucagaaucug

SEQ ID NO: 2098996 - RNA, 19 nt, Human
acuauuuucagaaucugaa

SEQ ID NO: 2098997 - RNA, 17 nt, Human
acuauuuuauuuucuaa

SEQ ID NO: 2098998 - RNA, 11 nt, Human
acuauuuuauu

SEQ ID NO: 2098999 - RNA, 13 nt, Human
acuauuuuacuuc

SEQ ID NO: 2099000 - RNA, 19 nt, Human
acuauuugcuuauuuaaua

SEQ ID NO: 2099001 - RNA, 23 nt, Human
acuauuugcuuauuuaauaaaga

SEQ ID NO: 2099002 - RNA, 15 nt, Human
acugcuuuuggucug

SEQ ID NO: 2099003 - RNA, 11 nt, Human
acugcccucug

SEQ ID NO: 2099004 - RNA, 12 nt, Human
acugcccucugu

SEQ ID NO: 2099005 - RNA, 14 nt, Human
acugcccucuguuc

SEQ ID NO: 2099006 - RNA, 21 nt, Human
acugcccucuguucaguaaca

SEQ ID NO: 2099007 - RNA, 22 nt, Human
acugcccucuguucaguaacag

SEQ ID NO: 2099008 - RNA, 22 nt, Human
acugcccggcaggguccuagaa

SEQ ID NO: 2099009 - RNA, 22 nt, Human
acugcccgagcuggugcauuac

SEQ ID NO: 2099010 - RNA, 17 nt, Human
acugcccggggcagcug

SEQ ID NO: 2099011 - RNA, 20 nt, Human
acugcccggggcagcugcca

SEQ ID NO: 2099012 - RNA, 20 nt, Human
acugcuuuuggucuguguga

SEQ ID NO: 2099013 - RNA, 16 nt, Human
acugcuuuuggucugu

SEQ ID NO: 2099014 - RNA, 13 nt, Human
acuggaaguuuug

SEQ ID NO: 2099015 - RNA, 17 nt, Human
acuggaaguuuugcauu

SEQ ID NO: 2099016 - RNA, 21 nt, Human
acugcccggggcagcugccag

SEQ ID NO: 2099017 - RNA, 22 nt, Human
acugcccggggcagcugccaga

SEQ ID NO: 2099018 - RNA, 18 nt, Human
acugccagucccccugcc

SEQ ID NO: 2099019 - RNA, 19 nt, Human
acugccagucccccugccc

SEQ ID NO: 2099020 - RNA, 15 nt, Human
acugcccggcagggu

SEQ ID NO: 2099021 - RNA, 13 nt, Human
acuucugccucuu

SEQ ID NO: 2099022 - RNA, 19 nt, Human
acuucugugagacccccac

SEQ ID NO: 2099023 - RNA, 20 nt, Human
acuucugugagacccccaca

SEQ ID NO: 2099024 - RNA, 23 nt, Human
acuucugugagacccccacaccu

SEQ ID NO: 2099025 - RNA, 17 nt, Human
acuucuuauacauuuga

SEQ ID NO: 2099026 - RNA, 18 nt, Human
acuucuuauacauuugau

SEQ ID NO: 2099027 - RNA, 13 nt, Human
acuucagcucugu

SEQ ID NO: 2099028 - RNA, 20 nt, Human
acuucugccauauucuguug

SEQ ID NO: 2099029 - RNA, 22 nt, Human
acuucaagugcaugcucucugc

SEQ ID NO: 2099030 - RNA, 23 nt, Human
acuucaagugcaugcucucugca

SEQ ID NO: 2099031 - RNA, 16 nt, Human
acuucaaguuaaagug

SEQ ID NO: 2099032 - RNA, 16 nt, Human
acuucacacacaggca

SEQ ID NO: 2099033 - RNA, 18 nt, Human
acuucaagcaccagggaa

SEQ ID NO: 2099034 - RNA, 16 nt, Human
acuucagcuagagcuu

SEQ ID NO: 2099035 - RNA, 13 nt, Human
acuucaaggccca

SEQ ID NO: 2099036 - RNA, 19 nt, Human
acuuaaauaaaugucauua

SEQ ID NO: 2099037 - RNA, 20 nt, Human
acuuaaaauauuccugcauu

SEQ ID NO: 2099038 - RNA, 16 nt, Human
acuuaaaaaaugucca

SEQ ID NO: 2099039 - RNA, 15 nt, Human
acuuaaaaaaugucc

SEQ ID NO: 2099040 - RNA, 22 nt, Human
acuuaaaauauuccugcauuug

SEQ ID NO: 2099041 - RNA, 13 nt, Human
acuuaaaauauuu

SEQ ID NO: 2099042 - RNA, 17 nt, Human
acuuaaaggcuguggua

SEQ ID NO: 2099043 - RNA, 13 nt, Human
acuuaaaaagucu

SEQ ID NO: 2099044 - RNA, 20 nt, Human
acuuaaaaagucugcauuac

SEQ ID NO: 2099045 - RNA, 13 nt, Human
acuggaauuuuua

SEQ ID NO: 2099046 - RNA, 14 nt, Human
acuggaauuuuuau

SEQ ID NO: 2099047 - RNA, 18 nt, Human
acuggaauuuuuauuaug

SEQ ID NO: 2099048 - RNA, 19 nt, Human
acuggaauuuuuauuaugc

SEQ ID NO: 2099049 - RNA, 21 nt, Human
acuggaauuuuuauuaugcau

SEQ ID NO: 2099050 - RNA, 23 nt, Human
acuggaauuuuuauuaugcauaa

SEQ ID NO: 2099051 - RNA, 24 nt, Human
acuggaauuuuuauuaugcauaac

SEQ ID NO: 2099052 - RNA, 16 nt, Human
acuggaaguuuugcau

SEQ ID NO: 2099053 - RNA, 16 nt, Human
acuugggaggcugagg

SEQ ID NO: 2099054 - RNA, 22 nt, Human
acuuucaggccacauggcuaaa

SEQ ID NO: 2099055 - RNA, 20 nt, Human
acuuucacauagaugucccu

SEQ ID NO: 2099056 - RNA, 21 nt, Human
acuuucacauagaugucccuu

SEQ ID NO: 2099057 - RNA, 18 nt, Human
acuuucagguacuaaaua

SEQ ID NO: 2099058 - RNA, 21 nt, Human
acuuucagguacuaaauaccu

SEQ ID NO: 2099059 - RNA, 15 nt, Human
acuuucacauagaug

SEQ ID NO: 2099060 - RNA, 17 nt, Human
acuuucacauagauguc

SEQ ID NO: 2099061 - RNA, 17 nt, Human
acuauugcuugcacaaa

SEQ ID NO: 2099062 - RNA, 12 nt, Human
acuauugacauc

SEQ ID NO: 2099063 - RNA, 17 nt, Human
acuauugacaucagcau

SEQ ID NO: 2099064 - RNA, 18 nt, Human
acuauugaaguugcagau

SEQ ID NO: 2099065 - RNA, 14 nt, Human
acuauuggaaagua

SEQ ID NO: 2099066 - RNA, 16 nt, Human
acuauuggaaaguacu

SEQ ID NO: 2099067 - RNA, 13 nt, Human
acuauuggagggu

SEQ ID NO: 2099068 - RNA, 19 nt, Human
acuauuggagggugggaga

SEQ ID NO: 2099069 - RNA, 23 nt, Human
acuaguaccuucagauccuaccc

SEQ ID NO: 2099070 - RNA, 17 nt, Human
acuagggaagauaauau

SEQ ID NO: 2099071 - RNA, 13 nt, Human
acuagggaccugg

SEQ ID NO: 2099072 - RNA, 14 nt, Human
acuagggaccuggg

SEQ ID NO: 2099073 - RNA, 16 nt, Human
acuagggaccugggga

SEQ ID NO: 2099074 - RNA, 12 nt, Human
acuaggcugggu

SEQ ID NO: 2099075 - RNA, 13 nt, Human
acuaggcugggug

SEQ ID NO: 2099076 - RNA, 14 nt, Human
acuaggcugggugc

SEQ ID NO: 2099077 - RNA, 19 nt, Human
acuaggcugggugcccaca

SEQ ID NO: 2099078 - RNA, 20 nt, Human
acuaggcugggugcccacag

SEQ ID NO: 2099079 - RNA, 21 nt, Human
acuaggcugggugcccacagc

SEQ ID NO: 2099080 - RNA, 22 nt, Human
acuaggcugggugcccacagcc

SEQ ID NO: 2099081 - RNA, 23 nt, Human
acuaggcugggugcccacagccc

SEQ ID NO: 2099082 - RNA, 21 nt, Human
acuagggaagaaagcagaaca

SEQ ID NO: 2099083 - RNA, 14 nt, Human
acuaaucuuucugc

SEQ ID NO: 2099084 - RNA, 18 nt, Human
acuaaucuauuggguuca

SEQ ID NO: 2099085 - RNA, 20 nt, Human
acuaaucuauuggguucauu

SEQ ID NO: 2099086 - RNA, 22 nt, Human
acuaaucuauuggguucauuau

SEQ ID NO: 2099087 - RNA, 13 nt, Human
acuaaugauguuu

SEQ ID NO: 2099088 - RNA, 18 nt, Human
accuguggccaaguucuu

SEQ ID NO: 2099089 - RNA, 19 nt, Human
accuguggccaaguucuua

SEQ ID NO: 2099090 - RNA, 14 nt, Human
accugugaccagca

SEQ ID NO: 2099091 - RNA, 19 nt, Human
accugugaccagcacuguc

SEQ ID NO: 2099092 - RNA, 23 nt, Human
accugugaccagcacugucucag

SEQ ID NO: 2099093 - RNA, 19 nt, Human
accuguggggauuucuccc

SEQ ID NO: 2099094 - RNA, 20 nt, Human
accuguggggauuucuccca

SEQ ID NO: 2099095 - RNA, 21 nt, Human
accuguggggauuucucccag

SEQ ID NO: 2099096 - RNA, 22 nt, Human
accuguggggauuucucccagc

SEQ ID NO: 2099097 - RNA, 23 nt, Human
accuguggggauuucucccagcu

SEQ ID NO: 2099098 - RNA, 13 nt, Human
accugugucacua

SEQ ID NO: 2099099 - RNA, 19 nt, Human
acgcuggagugcagugagc

SEQ ID NO: 2099100 - RNA, 19 nt, Human
acgcagaugauccaugagu

SEQ ID NO: 2099101 - RNA, 15 nt, Human
acgcagaugauccau

SEQ ID NO: 2099102 - RNA, 17 nt, Human
acgcagaugauccauga

SEQ ID NO: 2099103 - RNA, 20 nt, Human
acgcacgugggucuucaggg

SEQ ID NO: 2099104 - RNA, 19 nt, Human
acgcacgugggucuucagg

SEQ ID NO: 2099105 - RNA, 15 nt, Human
acggaagagccuugc

SEQ ID NO: 2099106 - RNA, 16 nt, Human
acggaagagccuugcg

SEQ ID NO: 2099107 - RNA, 23 nt, Human
acgcugucccuaguaaaaauaca

SEQ ID NO: 2099108 - RNA, 21 nt, Human
acgcugguagagauggaggag

SEQ ID NO: 2099109 - RNA, 11 nt, Human
acgcugucucc

SEQ ID NO: 2099110 - RNA, 12 nt, Human
acgcugucucca

SEQ ID NO: 2099111 - RNA, 14 nt, Human
acgcugucuccaga

SEQ ID NO: 2099112 - RNA, 15 nt, Human
acgcugucuccagac

SEQ ID NO: 2099113 - RNA, 17 nt, Human
acgcugucuccagaccc

SEQ ID NO: 2099114 - RNA, 19 nt, Human
acgcugguagagauggagg

SEQ ID NO: 2099115 - RNA, 20 nt, Human
acgcugguagagauggagga

SEQ ID NO: 2099116 - RNA, 23 nt, Human
acgcugguagagauggaggagga

SEQ ID NO: 2099117 - RNA, 19 nt, Human
acggacacucaaaagcugg

SEQ ID NO: 2099118 - RNA, 15 nt, Human
acggaauaguuggcu

SEQ ID NO: 2099119 - RNA, 19 nt, Human
acgcugucuccagaccccc

SEQ ID NO: 2099120 - RNA, 23 nt, Human
acgucugacaggcaaugcuggcu

SEQ ID NO: 2099121 - RNA, 13 nt, Human
acgucugucuuca

SEQ ID NO: 2099122 - RNA, 16 nt, Human
acgucugacccucucc

SEQ ID NO: 2099123 - RNA, 22 nt, Human
acgucugacccucuccacccca

SEQ ID NO: 2099124 - RNA, 15 nt, Human
acgucugacaggcaa

SEQ ID NO: 2099125 - RNA, 14 nt, Human
acggagauguuuca

SEQ ID NO: 2099126 - RNA, 19 nt, Human
acggagagcgccugccccu

SEQ ID NO: 2099127 - RNA, 12 nt, Human
acggagagaaaa

SEQ ID NO: 2099128 - RNA, 13 nt, Human
acggagagaaaaa

SEQ ID NO: 2099129 - RNA, 14 nt, Human
acggagagaaaaaa

SEQ ID NO: 2099130 - RNA, 13 nt, Human
acggagagcgccu

SEQ ID NO: 2099131 - RNA, 21 nt, Human
acguggaggaaugcuccccca

SEQ ID NO: 2099132 - RNA, 15 nt, Human
acguggcccagagaa

SEQ ID NO: 2099133 - RNA, 19 nt, Human
acggaaggaccuauguuug

SEQ ID NO: 2099134 - RNA, 12 nt, Human
acguggagaggg

SEQ ID NO: 2099135 - RNA, 14 nt, Human
acgucugucuucac

SEQ ID NO: 2099136 - RNA, 15 nt, Human
acgucugucuucaca

SEQ ID NO: 2099137 - RNA, 19 nt, Human
acgucugucuucacagcuc

SEQ ID NO: 2099138 - RNA, 13 nt, Human
acguggagaggga

SEQ ID NO: 2099139 - RNA, 15 nt, Human
acguggagagggaug

SEQ ID NO: 2099140 - RNA, 14 nt, Human
acguggagagggau

SEQ ID NO: 2099141 - RNA, 19 nt, Human
acuaauauuuuaugugaga

SEQ ID NO: 2099142 - RNA, 15 nt, Human
acuaaccuggguucc

SEQ ID NO: 2099143 - RNA, 19 nt, Human
accucaggcuuccuuggca

SEQ ID NO: 2099144 - RNA, 18 nt, Human
accucaggugagaagcag

SEQ ID NO: 2099145 - RNA, 16 nt, Human
accucagugucauuua

SEQ ID NO: 2099146 - RNA, 21 nt, Human
accucagugucauuuaugaaa

SEQ ID NO: 2099147 - RNA, 16 nt, Human
accucaguucccuugg

SEQ ID NO: 2099148 - RNA, 17 nt, Human
accucaguucccuuggc

SEQ ID NO: 2099149 - RNA, 18 nt, Human
accucaguucccuuggcc

SEQ ID NO: 2099150 - RNA, 19 nt, Human
accucaguucccuuggccu

SEQ ID NO: 2099151 - RNA, 20 nt, Human
accucaguucccuuggccuc

SEQ ID NO: 2099152 - RNA, 21 nt, Human
accucaguucccuuggccuca

SEQ ID NO: 2099153 - RNA, 22 nt, Human
accucaguucccuuggccucag

SEQ ID NO: 2099154 - RNA, 23 nt, Human
accucaguucccuuggccucaga

SEQ ID NO: 2099155 - RNA, 19 nt, Human
accucagugucauuuauga

SEQ ID NO: 2099156 - RNA, 18 nt, Human
accucaggcuuccuuggc

SEQ ID NO: 2099157 - RNA, 19 nt, Human
accgggccacagagaaagu

SEQ ID NO: 2099158 - RNA, 15 nt, Human
accgggccacagaga

SEQ ID NO: 2099159 - RNA, 13 nt, Human
accgguacagaaa

SEQ ID NO: 2099160 - RNA, 15 nt, Human
accguccucuuuuuc

SEQ ID NO: 2099161 - RNA, 16 nt, Human
accgucgggggcugag

SEQ ID NO: 2099162 - RNA, 15 nt, Human
accgguugcuucugg

SEQ ID NO: 2099163 - RNA, 16 nt, Human
accgguugcuucuggg

SEQ ID NO: 2099164 - RNA, 18 nt, Human
accgguugcuucugggaa

SEQ ID NO: 2099165 - RNA, 20 nt, Human
accgggcacucagaagacac

SEQ ID NO: 2099166 - RNA, 14 nt, Human
accggcugcuuuuc

SEQ ID NO: 2099167 - RNA, 20 nt, Human
accggcugcuuuucccuaag

SEQ ID NO: 2099168 - RNA, 18 nt, Human
accggcaauuuccggcca

SEQ ID NO: 2099169 - RNA, 16 nt, Human
acccuguuuuauacug

SEQ ID NO: 2099170 - RNA, 18 nt, Human
acccuuaccccuuagccu

SEQ ID NO: 2099171 - RNA, 19 nt, Human
acccuuaccccuuagccuc

SEQ ID NO: 2099172 - RNA, 22 nt, Human
acccuuaccccuuagccucccu

SEQ ID NO: 2099173 - RNA, 20 nt, Human
accggaggcaaaaggcagug

SEQ ID NO: 2099174 - RNA, 13 nt, Human
accggauccuggg

SEQ ID NO: 2099175 - RNA, 14 nt, Human
accggauccugggu

SEQ ID NO: 2099176 - RNA, 16 nt, Human
accggauccugggugg

SEQ ID NO: 2099177 - RNA, 17 nt, Human
accggcaauuuccggcc

SEQ ID NO: 2099178 - RNA, 17 nt, Human
acccuguuaccauuuug

SEQ ID NO: 2099179 - RNA, 21 nt, Human
acccugugguuuccaaggagc

SEQ ID NO: 2099180 - RNA, 17 nt, Human
accccaaggagggagau

SEQ ID NO: 2099181 - RNA, 13 nt, Human
accugugaccagc

SEQ ID NO: 2099182 - RNA, 18 nt, Human
accugccauuugcacccu

SEQ ID NO: 2099183 - RNA, 19 nt, Human
accugccauuugcacccuc

SEQ ID NO: 2099184 - RNA, 15 nt, Human
accugccauuugcac

SEQ ID NO: 2099185 - RNA, 13 nt, Human
accucugccucaa

SEQ ID NO: 2099186 - RNA, 14 nt, Human
accucugccucaau

SEQ ID NO: 2099187 - RNA, 15 nt, Human
accucugccucaaug

SEQ ID NO: 2099188 - RNA, 12 nt, Human
accucugccuca

SEQ ID NO: 2099189 - RNA, 16 nt, Human
cucuugccacugccuc

SEQ ID NO: 2099190 - RNA, 20 nt, Human
cucuugccacugccucuucc

SEQ ID NO: 2099191 - RNA, 19 nt, Human
cucuugccacugccucuuc

SEQ ID NO: 2099192 - RNA, 18 nt, Human
cucuugccacugccucuu

SEQ ID NO: 2099193 - RNA, 17 nt, Human
cucuugccacugccucu

SEQ ID NO: 2099194 - RNA, 20 nt, Human
cugaaaacauaaaaaguuaa

SEQ ID NO: 2099195 - RNA, 14 nt, Human
cugaaaacccagag

SEQ ID NO: 2099196 - RNA, 15 nt, Human
cugaaaacccagaga

SEQ ID NO: 2099197 - RNA, 17 nt, Human
cugaaaacccagagagg

SEQ ID NO: 2099198 - RNA, 22 nt, Human
cucuugcuugugggacuagccu

SEQ ID NO: 2099199 - RNA, 17 nt, Human
cucuugcggucccuucu

SEQ ID NO: 2099200 - RNA, 22 nt, Human
cugaaggaauaaauugcuccuu

SEQ ID NO: 2099201 - RNA, 20 nt, Human
cugaagcuuauuaaugcuaa

SEQ ID NO: 2099202 - RNA, 21 nt, Human
cugaagcuuauuaaugcuaag

SEQ ID NO: 2099203 - RNA, 12 nt, Human
cugaagcuuauu

SEQ ID NO: 2099204 - RNA, 22 nt, Human
cugaaaauuccagaaaggauau

SEQ ID NO: 2099205 - RNA, 14 nt, Human
cugaagcuuauuaa

SEQ ID NO: 2099206 - RNA, 16 nt, Human
cugaagcuuauuaaug

SEQ ID NO: 2099207 - RNA, 17 nt, Human
cugaagcuuauuaaugc

SEQ ID NO: 2099208 - RNA, 18 nt, Human
cugaagcuuauuaaugcu

SEQ ID NO: 2099209 - RNA, 23 nt, Human
cugaagcuuauuaaugcuaaggg

SEQ ID NO: 2099210 - RNA, 16 nt, Human
cugaaaauguaugugu

SEQ ID NO: 2099211 - RNA, 18 nt, Human
cugaaaagacucaguguu

SEQ ID NO: 2099212 - RNA, 19 nt, Human
cugaaaagacucaguguuc

SEQ ID NO: 2099213 - RNA, 16 nt, Human
cugaaaauuaacacug

SEQ ID NO: 2099214 - RNA, 17 nt, Human
cugaaaauuaacacugc

SEQ ID NO: 2099215 - RNA, 13 nt, Human
cugaaaauguuag

SEQ ID NO: 2099216 - RNA, 22 nt, Human
cugaaaauguuuuucugccagg

SEQ ID NO: 2099217 - RNA, 21 nt, Human
cugaaggacauugcggacagc

SEQ ID NO: 2099218 - RNA, 20 nt, Human
cugaaggacauugcggacag

SEQ ID NO: 2099219 - RNA, 19 nt, Human
cugaaggacauugcggaca

SEQ ID NO: 2099220 - RNA, 19 nt, Human
cugaagguaaaauugaaag

SEQ ID NO: 2099221 - RNA, 21 nt, Human
cugaagggguucucacagugg

SEQ ID NO: 2099222 - RNA, 17 nt, Human
cugaagggguucucaca

SEQ ID NO: 2099223 - RNA, 15 nt, Human
cugaagguaaaauug

SEQ ID NO: 2099224 - RNA, 14 nt, Human
cugacagaaggacu

SEQ ID NO: 2099225 - RNA, 13 nt, Human
cugaaggcuuuca

SEQ ID NO: 2099226 - RNA, 18 nt, Human
cugaaggcuuucagggcc

SEQ ID NO: 2099227 - RNA, 20 nt, Human
cugaaggcuuucagggccuc

SEQ ID NO: 2099228 - RNA, 23 nt, Human
cugaaggcuuucagggccuccag

SEQ ID NO: 2099229 - RNA, 14 nt, Human
cugacagacacagg

SEQ ID NO: 2099230 - RNA, 12 nt, Human
cugacagacaca

SEQ ID NO: 2099231 - RNA, 17 nt, Human
cugaagguaaaauugaa

SEQ ID NO: 2099232 - RNA, 15 nt, Human
cugacagacacaggc

SEQ ID NO: 2099233 - RNA, 23 nt, Human
cugacccugcuucaaauauuucc

SEQ ID NO: 2099234 - RNA, 20 nt, Human
cugaccuugaacuccugggc

SEQ ID NO: 2099235 - RNA, 21 nt, Human
cugaccucccucuaauuuauc

SEQ ID NO: 2099236 - RNA, 11 nt, Human
cugaccucagc

SEQ ID NO: 2099237 - RNA, 12 nt, Human
cugaccucagca

SEQ ID NO: 2099238 - RNA, 13 nt, Human
cugaccuccacag

SEQ ID NO: 2099239 - RNA, 14 nt, Human
cugaccuccacagc

SEQ ID NO: 2099240 - RNA, 15 nt, Human
cugaccuccacagcu

SEQ ID NO: 2099241 - RNA, 18 nt, Human
cugaccgaaacagcgcug

SEQ ID NO: 2099242 - RNA, 20 nt, Human
cugaccgaaacagcgcuggg

SEQ ID NO: 2099243 - RNA, 20 nt, Human
cugaccucccucuaauuuau

SEQ ID NO: 2099244 - RNA, 18 nt, Human
cugaccucccucuaauuu

SEQ ID NO: 2099245 - RNA, 14 nt, Human
cugaccucccccuc

SEQ ID NO: 2099246 - RNA, 16 nt, Human
cugaccucccccuccu

SEQ ID NO: 2099247 - RNA, 17 nt, Human
cugaccucccccuccuu

SEQ ID NO: 2099248 - RNA, 18 nt, Human
cugaccucccccuccuuc

SEQ ID NO: 2099249 - RNA, 21 nt, Human
cugaccucccccuccuuccca

SEQ ID NO: 2099250 - RNA, 22 nt, Human
cugaccucccccuccuucccag

SEQ ID NO: 2099251 - RNA, 16 nt, Human
cugaccuccacagcuu

SEQ ID NO: 2099252 - RNA, 14 nt, Human
cucugcagccagcc

SEQ ID NO: 2099253 - RNA, 15 nt, Human
cucugcagccagccc

SEQ ID NO: 2099254 - RNA, 13 nt, Human
cucugcagccagc

SEQ ID NO: 2099255 - RNA, 19 nt, Human
cucugcuccaccacauccu

SEQ ID NO: 2099256 - RNA, 18 nt, Human
cucugcuccaccacaucc

SEQ ID NO: 2099257 - RNA, 15 nt, Human
cucugcuccaccaca

SEQ ID NO: 2099258 - RNA, 16 nt, Human
cucugcuccaccacau

SEQ ID NO: 2099259 - RNA, 12 nt, Human
cucugcuccacc

SEQ ID NO: 2099260 - RNA, 13 nt, Human
cucugcuccacca

SEQ ID NO: 2099261 - RNA, 14 nt, Human
cucugcuccaccac

SEQ ID NO: 2099262 - RNA, 22 nt, Human
cucuguauuugaaucagccuac

SEQ ID NO: 2099263 - RNA, 16 nt, Human
cucugguucuucauuu

SEQ ID NO: 2099264 - RNA, 19 nt, Human
cucugcugacagacacagg

SEQ ID NO: 2099265 - RNA, 18 nt, Human
cucugcugacagacacag

SEQ ID NO: 2099266 - RNA, 17 nt, Human
cucugcugacagacaca

SEQ ID NO: 2099267 - RNA, 15 nt, Human
cucugguuaucuaau

SEQ ID NO: 2099268 - RNA, 12 nt, Human
cuccgcugugug

SEQ ID NO: 2099269 - RNA, 18 nt, Human
cuccgcuguguggauggg

SEQ ID NO: 2099270 - RNA, 22 nt, Human
cuccguccagccgccauugcca

SEQ ID NO: 2099271 - RNA, 22 nt, Human
cuccgucuuagaaguggaccag

SEQ ID NO: 2099272 - RNA, 21 nt, Human
cucuccgaccagacaccuuga

SEQ ID NO: 2099273 - RNA, 13 nt, Human
cucuccucagacu

SEQ ID NO: 2099274 - RNA, 14 nt, Human
cucuccucagacug

SEQ ID NO: 2099275 - RNA, 15 nt, Human
cucuccucagacugc

SEQ ID NO: 2099276 - RNA, 18 nt, Human
cucuccucagacugcuca

SEQ ID NO: 2099277 - RNA, 11 nt, Human
cucucagccaa

SEQ ID NO: 2099278 - RNA, 23 nt, Human
cucucagccaacgaguaauuuau

SEQ ID NO: 2099279 - RNA, 15 nt, Human
cucugaaggacauug

SEQ ID NO: 2099280 - RNA, 13 nt, Human
cucugaagagugg

SEQ ID NO: 2099281 - RNA, 21 nt, Human
cucugaagaguggguuucaca

SEQ ID NO: 2099282 - RNA, 22 nt, Human
cucugaagaguggguuucacaa

SEQ ID NO: 2099283 - RNA, 23 nt, Human
cucugaagaguggguuucacaag

SEQ ID NO: 2099284 - RNA, 14 nt, Human
cucucacugugucc

SEQ ID NO: 2099285 - RNA, 15 nt, Human
cucucacuguguccc

SEQ ID NO: 2099286 - RNA, 17 nt, Human
cucucagaauucuucag

SEQ ID NO: 2099287 - RNA, 16 nt, Human
cucucagaagguauuc

SEQ ID NO: 2099288 - RNA, 17 nt, Human
cucucaaagcaaauaau

SEQ ID NO: 2099289 - RNA, 13 nt, Human
cucuauuuagcau

SEQ ID NO: 2099290 - RNA, 14 nt, Human
cucuauuuagcaug

SEQ ID NO: 2099291 - RNA, 10 nt, Human
cucuauuuaa

SEQ ID NO: 2099292 - RNA, 12 nt, Human
cucuauuuaaau

SEQ ID NO: 2099293 - RNA, 14 nt, Human
cucuauuuaaauuc

SEQ ID NO: 2099294 - RNA, 15 nt, Human
cucuauuuaaauucu

SEQ ID NO: 2099295 - RNA, 16 nt, Human
cucuauuuaaauucuu

SEQ ID NO: 2099296 - RNA, 17 nt, Human
cucuauuuaaauucuuu

SEQ ID NO: 2099297 - RNA, 18 nt, Human
cucuauuuaaauucuuuu

SEQ ID NO: 2099298 - RNA, 22 nt, Human
cucuauuaccacugaagauaga

SEQ ID NO: 2099299 - RNA, 23 nt, Human
cucuauuaccacugaagauagaa

SEQ ID NO: 2099300 - RNA, 23 nt, Human
cucuauuagacuuuagaaauaaa

SEQ ID NO: 2099301 - RNA, 24 nt, Human
cucuauuagacuuuagaaauaaau

SEQ ID NO: 2099302 - RNA, 15 nt, Human
cuccgccucugcugg

SEQ ID NO: 2099303 - RNA, 18 nt, Human
cuccgccuucacuccggu

SEQ ID NO: 2099304 - RNA, 19 nt, Human
cuccgccuucacuccggug

SEQ ID NO: 2099305 - RNA, 19 nt, Human
cuccgcuuucuacccagcg

SEQ ID NO: 2099306 - RNA, 21 nt, Human
cuccgccuucacuccggugug

SEQ ID NO: 2099307 - RNA, 16 nt, Human
cuccgccucugcuggc

SEQ ID NO: 2099308 - RNA, 15 nt, Human
cucccuccucugucc

SEQ ID NO: 2099309 - RNA, 12 nt, Human
cucccugaugua

SEQ ID NO: 2099310 - RNA, 15 nt, Human
cucccugauguacag

SEQ ID NO: 2099311 - RNA, 12 nt, Human
cucccuccucug

SEQ ID NO: 2099312 - RNA, 17 nt, Human
cucccuccucaccucug

SEQ ID NO: 2099313 - RNA, 18 nt, Human
cucccuccucaccucugg

SEQ ID NO: 2099314 - RNA, 19 nt, Human
cucccuccucaccucugga

SEQ ID NO: 2099315 - RNA, 21 nt, Human
cucccuccucaccucuggacu

SEQ ID NO: 2099316 - RNA, 15 nt, Human
cucccugacccugca

SEQ ID NO: 2099317 - RNA, 16 nt, Human
cucccugacccugcag

SEQ ID NO: 2099318 - RNA, 18 nt, Human
cucccugacccugcagag

SEQ ID NO: 2099319 - RNA, 21 nt, Human
cucccugacccugcagagaug

SEQ ID NO: 2099320 - RNA, 23 nt, Human
cucccccugggcucugccccagc

SEQ ID NO: 2099321 - RNA, 14 nt, Human
cuccccgcuucugc

SEQ ID NO: 2099322 - RNA, 14 nt, Human
cucccuccucaccu

SEQ ID NO: 2099323 - RNA, 15 nt, Human
cucccuccucaccuc

SEQ ID NO: 2099324 - RNA, 14 nt, Human
cuccccucccuccu

SEQ ID NO: 2099325 - RNA, 12 nt, Human
cuccagucugcu

SEQ ID NO: 2099326 - RNA, 14 nt, Human
cuccaguccugcuc

SEQ ID NO: 2099327 - RNA, 15 nt, Human
cuccaguccugcucu

SEQ ID NO: 2099328 - RNA, 16 nt, Human
cuccaguccugcucuc

SEQ ID NO: 2099329 - RNA, 17 nt, Human
cuccaguccugcucucu

SEQ ID NO: 2099330 - RNA, 20 nt, Human
cuccaguccugcucucuacc

SEQ ID NO: 2099331 - RNA, 22 nt, Human
cuccaguccugcucucuaccca

SEQ ID NO: 2099332 - RNA, 23 nt, Human
cuccaguccugcucucuacccag

SEQ ID NO: 2099333 - RNA, 16 nt, Human
cuccagucuuccaccu

SEQ ID NO: 2099334 - RNA, 19 nt, Human
cuccagucuuccaccugga

SEQ ID NO: 2099335 - RNA, 20 nt, Human
cuccagucuuccaccuggaa

SEQ ID NO: 2099336 - RNA, 15 nt, Human
cuccagucugcugcc

SEQ ID NO: 2099337 - RNA, 17 nt, Human
cuccagucugcugcccu

SEQ ID NO: 2099338 - RNA, 20 nt, Human
cuccagucugcugcccucca

SEQ ID NO: 2099339 - RNA, 21 nt, Human
cuccagucugcugcccuccau

SEQ ID NO: 2099340 - RNA, 13 nt, Human
cucccaccucagc

SEQ ID NO: 2099341 - RNA, 13 nt, Human
cucccccugccag

SEQ ID NO: 2099342 - RNA, 16 nt, Human
cucccccugccagugc

SEQ ID NO: 2099343 - RNA, 17 nt, Human
cucccccugccagugcc

SEQ ID NO: 2099344 - RNA, 18 nt, Human
cucccccugccagugccu

SEQ ID NO: 2099345 - RNA, 19 nt, Human
cucccccugccagugccuu

SEQ ID NO: 2099346 - RNA, 11 nt, Human
cucccccuggg

SEQ ID NO: 2099347 - RNA, 12 nt, Human
cucccccugggc

SEQ ID NO: 2099348 - RNA, 13 nt, Human
cucccccugggcu

SEQ ID NO: 2099349 - RNA, 12 nt, Human
cucccaccucag

SEQ ID NO: 2099350 - RNA, 22 nt, Human
cuccagguccucuacuuaauga

SEQ ID NO: 2099351 - RNA, 14 nt, Human
cuccagaagccucu

SEQ ID NO: 2099352 - RNA, 15 nt, Human
cuccagaagccucug

SEQ ID NO: 2099353 - RNA, 16 nt, Human
cuccagaagccucugg

SEQ ID NO: 2099354 - RNA, 17 nt, Human
cuccagaagccucuggc

SEQ ID NO: 2099355 - RNA, 18 nt, Human
cuccagaagccucuggcu

SEQ ID NO: 2099356 - RNA, 19 nt, Human
cuccagaagccucuggcua

SEQ ID NO: 2099357 - RNA, 20 nt, Human
cuccagaagccucuggcuag

SEQ ID NO: 2099358 - RNA, 21 nt, Human
cuccagaagccucuggcuaga

SEQ ID NO: 2099359 - RNA, 17 nt, Human
cuccagacccaccacac

SEQ ID NO: 2099360 - RNA, 12 nt, Human
cuccagaccccc

SEQ ID NO: 2099361 - RNA, 16 nt, Human
cuccagacccccaccc

SEQ ID NO: 2099362 - RNA, 18 nt, Human
cuccagacccccaccccu

SEQ ID NO: 2099363 - RNA, 21 nt, Human
cuccagacccccaccccuucc

SEQ ID NO: 2099364 - RNA, 22 nt, Human
cuccagacccccaccccuuccc

SEQ ID NO: 2099365 - RNA, 14 nt, Human
cuccagacccccag

SEQ ID NO: 2099366 - RNA, 16 nt, Human
cuccagacccccagca

SEQ ID NO: 2099367 - RNA, 14 nt, Human
cucagccuccugag

SEQ ID NO: 2099368 - RNA, 22 nt, Human
cucagccuccugaguagcugga

SEQ ID NO: 2099369 - RNA, 12 nt, Human
cucagccuggug

SEQ ID NO: 2099370 - RNA, 16 nt, Human
cucagccuggugggcc

SEQ ID NO: 2099371 - RNA, 18 nt, Human
cucagccuggugggccuc

SEQ ID NO: 2099372 - RNA, 19 nt, Human
cucagccuggugggccucc

SEQ ID NO: 2099373 - RNA, 20 nt, Human
cucagccuggugggccuccu

SEQ ID NO: 2099374 - RNA, 13 nt, Human
cucagccugugcu

SEQ ID NO: 2099375 - RNA, 14 nt, Human
cucagccugugcug

SEQ ID NO: 2099376 - RNA, 23 nt, Human
cucagccuuccccuugcccaggg

SEQ ID NO: 2099377 - RNA, 15 nt, Human
cucagccuccugugu

SEQ ID NO: 2099378 - RNA, 16 nt, Human
cucagccugugcugcc

SEQ ID NO: 2099379 - RNA, 18 nt, Human
cucagccugugcugcccg

SEQ ID NO: 2099380 - RNA, 22 nt, Human
cucagccuuccccuugcccagg

SEQ ID NO: 2099381 - RNA, 13 nt, Human
cucagcggggaca

SEQ ID NO: 2099382 - RNA, 16 nt, Human
cucaggccaccugccc

SEQ ID NO: 2099383 - RNA, 14 nt, Human
cucagcgaaugaau

SEQ ID NO: 2099384 - RNA, 11 nt, Human
cucagccuugg

SEQ ID NO: 2099385 - RNA, 15 nt, Human
cucagccuuggauaa

SEQ ID NO: 2099386 - RNA, 18 nt, Human
cucaggccaccugccccc

SEQ ID NO: 2099387 - RNA, 19 nt, Human
cucaggccaccugcccccu

SEQ ID NO: 2099388 - RNA, 22 nt, Human
cucaggccaccugcccccuucu

SEQ ID NO: 2099389 - RNA, 23 nt, Human
cucaggccaccugcccccuucuc

SEQ ID NO: 2099390 - RNA, 13 nt, Human
cucagccucccaa

SEQ ID NO: 2099391 - RNA, 19 nt, Human
cuauccacccagcccauuc

SEQ ID NO: 2099392 - RNA, 12 nt, Human
cuaucccauccc

SEQ ID NO: 2099393 - RNA, 13 nt, Human
cuaucccauccca

SEQ ID NO: 2099394 - RNA, 14 nt, Human
cuaucccaucccau

SEQ ID NO: 2099395 - RNA, 16 nt, Human
cuaucccaucccaucc

SEQ ID NO: 2099396 - RNA, 12 nt, Human
cuauccacccag

SEQ ID NO: 2099397 - RNA, 13 nt, Human
cuauccacccagc

SEQ ID NO: 2099398 - RNA, 14 nt, Human
cuauccacccagcc

SEQ ID NO: 2099399 - RNA, 15 nt, Human
cuauccacccagccc

SEQ ID NO: 2099400 - RNA, 16 nt, Human
cuauccacccagccca

SEQ ID NO: 2099401 - RNA, 16 nt, Human
cucagccucccaaagu

SEQ ID NO: 2099402 - RNA, 14 nt, Human
cucagccucccaaa

SEQ ID NO: 2099403 - RNA, 17 nt, Human
cuauccacccagcccau

SEQ ID NO: 2099404 - RNA, 21 nt, Human
cucagccucccaaagugcugg

SEQ ID NO: 2099405 - RNA, 23 nt, Human
cucagccucccgaauagcuggga

SEQ ID NO: 2099406 - RNA, 13 nt, Human
cucagccucccag

SEQ ID NO: 2099407 - RNA, 20 nt, Human
cucagccucccagagugcug

SEQ ID NO: 2099408 - RNA, 20 nt, Human
cucagccuccggaguagcug

SEQ ID NO: 2099409 - RNA, 13 nt, Human
cucagccucccga

SEQ ID NO: 2099410 - RNA, 22 nt, Human
cucagccucccaaagugcuggg

SEQ ID NO: 2099411 - RNA, 15 nt, Human
cucaggccaggugca

SEQ ID NO: 2099412 - RNA, 18 nt, Human
cucaggccaggugcagug

SEQ ID NO: 2099413 - RNA, 17 nt, Human
cucagucuggcccuucc

SEQ ID NO: 2099414 - RNA, 18 nt, Human
cucagucuggcccuuccu

SEQ ID NO: 2099415 - RNA, 13 nt, Human
cucagugccacua

SEQ ID NO: 2099416 - RNA, 22 nt, Human
cucaguggacuuuccacccccu

SEQ ID NO: 2099417 - RNA, 16 nt, Human
cucaguggacuuucca

SEQ ID NO: 2099418 - RNA, 19 nt, Human
cucaguggacuuuccaccc

SEQ ID NO: 2099419 - RNA, 20 nt, Human
cucaguggacuuuccacccc

SEQ ID NO: 2099420 - RNA, 14 nt, Human
cucagugucauuua

SEQ ID NO: 2099421 - RNA, 17 nt, Human
cucagugucauuuauga

SEQ ID NO: 2099422 - RNA, 18 nt, Human
cucagugucauuuaugaa

SEQ ID NO: 2099423 - RNA, 22 nt, Human
cucagugucauuuaugaaaaga

SEQ ID NO: 2099424 - RNA, 12 nt, Human
cuccaacaauaa

SEQ ID NO: 2099425 - RNA, 15 nt, Human
cuccaaaugagaucu

SEQ ID NO: 2099426 - RNA, 20 nt, Human
ccuucugaaaaaguauccug

SEQ ID NO: 2099427 - RNA, 21 nt, Human
ccuucugcuggauaaaaugag

SEQ ID NO: 2099428 - RNA, 20 nt, Human
ccuucugcuggauaaaauga

SEQ ID NO: 2099429 - RNA, 12 nt, Human
ccuucugggaaa

SEQ ID NO: 2099430 - RNA, 22 nt, Human
ccuucuguaaagguuuuuggaa

SEQ ID NO: 2099431 - RNA, 20 nt, Human
ccuuuuucuuuauaaacuuu

SEQ ID NO: 2099432 - RNA, 16 nt, Human
ccuuuuucuuuauaaa

SEQ ID NO: 2099433 - RNA, 17 nt, Human
ccuuuuucccaauaaau

SEQ ID NO: 2099434 - RNA, 13 nt, Human
ccuuuuuccuucc

SEQ ID NO: 2099435 - RNA, 15 nt, Human
ccuuuuggguuucug

SEQ ID NO: 2099436 - RNA, 21 nt, Human
ccuuuuggguuucugcccugc

SEQ ID NO: 2099437 - RNA, 12 nt, Human
ccuuuuggcacu

SEQ ID NO: 2099438 - RNA, 12 nt, Human
ccuuuuggcccc

SEQ ID NO: 2099439 - RNA, 19 nt, Human
ccuuuuggcccccgagcug

SEQ ID NO: 2099440 - RNA, 20 nt, Human
ccuuuuggcccccgagcugg

SEQ ID NO: 2099441 - RNA, 21 nt, Human
ccuuuuggcccccgagcuggg

SEQ ID NO: 2099442 - RNA, 23 nt, Human
ccuuuuggcccccgagcuggggg

SEQ ID NO: 2099443 - RNA, 19 nt, Human
ccuuuuguaccauggugug

SEQ ID NO: 2099444 - RNA, 14 nt, Human
cgaccaccugccca

SEQ ID NO: 2099445 - RNA, 12 nt, Human
cgaccaccugcc

SEQ ID NO: 2099446 - RNA, 23 nt, Human
cgaccagacaccuugacagggca

SEQ ID NO: 2099447 - RNA, 19 nt, Human
cgacauggacccggagcua

SEQ ID NO: 2099448 - RNA, 18 nt, Human
ccuuuagcacguuuaaag

SEQ ID NO: 2099449 - RNA, 20 nt, Human
ccuuuagcacguuuaaaguu

SEQ ID NO: 2099450 - RNA, 21 nt, Human
ccuuuagcacguuuaaaguuc

SEQ ID NO: 2099451 - RNA, 23 nt, Human
ccuuuagcacguuuaaaguucug

SEQ ID NO: 2099452 - RNA, 14 nt, Human
ccuugccuccugug

SEQ ID NO: 2099453 - RNA, 20 nt, Human
ccuuuagcgcccaguugggu

SEQ ID NO: 2099454 - RNA, 14 nt, Human
ccuuuagcgcccag

SEQ ID NO: 2099455 - RNA, 20 nt, Human
ccuuuccaguggccuggcuc

SEQ ID NO: 2099456 - RNA, 11 nt, Human
ccuuuccauaa

SEQ ID NO: 2099457 - RNA, 22 nt, Human
ccuuucccaacacuucagacug

SEQ ID NO: 2099458 - RNA, 14 nt, Human
ccuuucccuaaaga

SEQ ID NO: 2099459 - RNA, 12 nt, Human
ccuuuucuuguu

SEQ ID NO: 2099460 - RNA, 17 nt, Human
ccuuuucuuguuuauca

SEQ ID NO: 2099461 - RNA, 21 nt, Human
ccuuuucuuguuuaucagcag

SEQ ID NO: 2099462 - RNA, 15 nt, Human
ccuuuucuccuaucu

SEQ ID NO: 2099463 - RNA, 18 nt, Human
ccuuuucuccuaucuuca

SEQ ID NO: 2099464 - RNA, 13 nt, Human
ccuuuucucuuca

SEQ ID NO: 2099465 - RNA, 11 nt, Human
ccuugcccaga

SEQ ID NO: 2099466 - RNA, 12 nt, Human
ccuugcccagag

SEQ ID NO: 2099467 - RNA, 13 nt, Human
ccuugcccagaga

SEQ ID NO: 2099468 - RNA, 14 nt, Human
ccuugcccagagau

SEQ ID NO: 2099469 - RNA, 19 nt, Human
ccuugcccagagaugccuc

SEQ ID NO: 2099470 - RNA, 21 nt, Human
ccuugcccagagaugccucca

SEQ ID NO: 2099471 - RNA, 23 nt, Human
ccuugcccagagaugccuccacc

SEQ ID NO: 2099472 - RNA, 13 nt, Human
ccuugcccagggc

SEQ ID NO: 2099473 - RNA, 15 nt, Human
ccuugcccagggcuc

SEQ ID NO: 2099474 - RNA, 16 nt, Human
ccuugcccagggcuca

SEQ ID NO: 2099475 - RNA, 17 nt, Human
ccuugcccagggcucag

SEQ ID NO: 2099476 - RNA, 18 nt, Human
ccuugcccagggcucagc

SEQ ID NO: 2099477 - RNA, 20 nt, Human
ccuugcccagggcucagccu

SEQ ID NO: 2099478 - RNA, 12 nt, Human
ccuugccuccug

SEQ ID NO: 2099479 - RNA, 15 nt, Human
ccuugccuccugugu

SEQ ID NO: 2099480 - RNA, 15 nt, Human
cgaccagagccccac

SEQ ID NO: 2099481 - RNA, 12 nt, Human
cgaccucagccu

SEQ ID NO: 2099482 - RNA, 13 nt, Human
cgaccucagccuu

SEQ ID NO: 2099483 - RNA, 14 nt, Human
cgaccucagccuuc

SEQ ID NO: 2099484 - RNA, 15 nt, Human
cgaccucagccuucc

SEQ ID NO: 2099485 - RNA, 12 nt, Human
cgaccucggugg

SEQ ID NO: 2099486 - RNA, 14 nt, Human
cgaccucguccucc

SEQ ID NO: 2099487 - RNA, 16 nt, Human
cgaccucguccucccc

SEQ ID NO: 2099488 - RNA, 19 nt, Human
cgaccucguccucccccug

SEQ ID NO: 2099489 - RNA, 22 nt, Human
cgaccucguccucccccugcca

SEQ ID NO: 2099490 - RNA, 23 nt, Human
cgaccucguccucccccugccag

SEQ ID NO: 2099491 - RNA, 16 nt, Human
cgaguagcugggacua

SEQ ID NO: 2099492 - RNA, 15 nt, Human
cgaguagcugggacu

SEQ ID NO: 2099493 - RNA, 14 nt, Human
cgaguagcugggac

SEQ ID NO: 2099494 - RNA, 13 nt, Human
cgaguagcuggga

SEQ ID NO: 2099495 - RNA, 19 nt, Human
cgagugugugcaugugugu

SEQ ID NO: 2099496 - RNA, 11 nt, Human
cgagugugugc

SEQ ID NO: 2099497 - RNA, 18 nt, Human
cgagugugugcaugugug

SEQ ID NO: 2099498 - RNA, 13 nt, Human
cgagugggaagga

SEQ ID NO: 2099499 - RNA, 17 nt, Human
cgaguggauagaugccc

SEQ ID NO: 2099500 - RNA, 20 nt, Human
cgaguggauagaugcccugc

SEQ ID NO: 2099501 - RNA, 21 nt, Human
cgaguggauagaugcccugcu

SEQ ID NO: 2099502 - RNA, 22 nt, Human
cgaguggauagaugcccugcua

SEQ ID NO: 2099503 - RNA, 23 nt, Human
cgaguggauagaugcccugcuag

SEQ ID NO: 2099504 - RNA, 14 nt, Human
cgccuacaggagug

SEQ ID NO: 2099505 - RNA, 11 nt, Human
cgccucccagc

SEQ ID NO: 2099506 - RNA, 14 nt, Human
cgccucccagccug

SEQ ID NO: 2099507 - RNA, 13 nt, Human
cgccguggcugcg

SEQ ID NO: 2099508 - RNA, 22 nt, Human
cgaguuguggaaagccucugcu

SEQ ID NO: 2099509 - RNA, 23 nt, Human
cgccaaggcugggggaagaagcu

SEQ ID NO: 2099510 - RNA, 13 nt, Human
cgccaaggcuggg

SEQ ID NO: 2099511 - RNA, 16 nt, Human
cgccaaggcuggggga

SEQ ID NO: 2099512 - RNA, 12 nt, Human
cgccaaggcugg

SEQ ID NO: 2099513 - RNA, 15 nt, Human
cgccucccagccugg

SEQ ID NO: 2099514 - RNA, 20 nt, Human
cgccucccuccccugcccuc

SEQ ID NO: 2099515 - RNA, 18 nt, Human
cggcucacugcagccuca

SEQ ID NO: 2099516 - RNA, 19 nt, Human
cggcucacugcagccucaa

SEQ ID NO: 2099517 - RNA, 22 nt, Human
cggcuccucucuaaccuccuuu

SEQ ID NO: 2099518 - RNA, 23 nt, Human
cggcuccucucuaaccuccuuua

SEQ ID NO: 2099519 - RNA, 20 nt, Human
cggcucgagcaguccugccu

SEQ ID NO: 2099520 - RNA, 12 nt, Human
cggcuccuggac

SEQ ID NO: 2099521 - RNA, 17 nt, Human
cggcuccuggacucauu

SEQ ID NO: 2099522 - RNA, 21 nt, Human
cggcuccuggacucauugcuu

SEQ ID NO: 2099523 - RNA, 18 nt, Human
cggaguaucugggaacug

SEQ ID NO: 2099524 - RNA, 13 nt, Human
cggagguugcagg

SEQ ID NO: 2099525 - RNA, 19 nt, Human
cggagcuaacacuggcccc

SEQ ID NO: 2099526 - RNA, 17 nt, Human
cggagcuaacacuggcc

SEQ ID NO: 2099527 - RNA, 18 nt, Human
cggagcuaacacuggccc

SEQ ID NO: 2099528 - RNA, 22 nt, Human
cggagccucauccgaggcaggg

SEQ ID NO: 2099529 - RNA, 20 nt, Human
cggagccucauccgaggcag

SEQ ID NO: 2099530 - RNA, 21 nt, Human
cggagccucauccgaggcagg

SEQ ID NO: 2099531 - RNA, 18 nt, Human
cggaggggccuggcagcc

SEQ ID NO: 2099532 - RNA, 16 nt, Human
cggaggggccuggcag

SEQ ID NO: 2099533 - RNA, 14 nt, Human
cggagucccaccuu

SEQ ID NO: 2099534 - RNA, 17 nt, Human
cggccuuuguugcucag

SEQ ID NO: 2099535 - RNA, 20 nt, Human
cggcgcgguggcucacgccu

SEQ ID NO: 2099536 - RNA, 15 nt, Human
cggcgcccccagugu

SEQ ID NO: 2099537 - RNA, 17 nt, Human
cggcgcccccagugugc

SEQ ID NO: 2099538 - RNA, 13 nt, Human
cggcgcgguggcu

SEQ ID NO: 2099539 - RNA, 19 nt, Human
cggagauuggacggccuga

SEQ ID NO: 2099540 - RNA, 23 nt, Human
cuagaaaugauccccagcuguuu

SEQ ID NO: 2099541 - RNA, 13 nt, Human
cuagaaauuuuuc

SEQ ID NO: 2099542 - RNA, 23 nt, Human
cuagaaauuuuucagaugcuucu

SEQ ID NO: 2099543 - RNA, 19 nt, Human
cuagaaauuccccacccug

SEQ ID NO: 2099544 - RNA, 15 nt, Human
cuagaacugaauuuu

SEQ ID NO: 2099545 - RNA, 18 nt, Human
cuagaacucuccaucuua

SEQ ID NO: 2099546 - RNA, 12 nt, Human
cuagcagcaggg

SEQ ID NO: 2099547 - RNA, 13 nt, Human
cuagaagaaauga

SEQ ID NO: 2099548 - RNA, 14 nt, Human
cuagaagaaaugaa

SEQ ID NO: 2099549 - RNA, 15 nt, Human
cuagaagaaaugaaa

SEQ ID NO: 2099550 - RNA, 16 nt, Human
cuagaagaaaugaaau

SEQ ID NO: 2099551 - RNA, 17 nt, Human
cuagaagaaaugaaauu

SEQ ID NO: 2099552 - RNA, 18 nt, Human
cuagaagaaaugaaauuu

SEQ ID NO: 2099553 - RNA, 20 nt, Human
cuagaagaaaugaaauuuua

SEQ ID NO: 2099554 - RNA, 21 nt, Human
cuagaagaaaugaaauuuuac

SEQ ID NO: 2099555 - RNA, 22 nt, Human
cuagaagaaaugaaauuuuacc

SEQ ID NO: 2099556 - RNA, 22 nt, Human
cuagcagcagggagggcuucug

SEQ ID NO: 2099557 - RNA, 23 nt, Human
cuagcagcagggagggcuucugc

SEQ ID NO: 2099558 - RNA, 17 nt, Human
cuaccugaacacuuauu

SEQ ID NO: 2099559 - RNA, 22 nt, Human
cuaccugaacacuuauugcuuu

SEQ ID NO: 2099560 - RNA, 23 nt, Human
cuaccugaacacuuauugcuuug

SEQ ID NO: 2099561 - RNA, 22 nt, Human
cuauaaccccagcucccuagga

SEQ ID NO: 2099562 - RNA, 21 nt, Human
cuaguucuucaucccacucca

SEQ ID NO: 2099563 - RNA, 18 nt, Human
cuauaaaugguguuuuuu

SEQ ID NO: 2099564 - RNA, 16 nt, Human
cuauaaaugguguuuu

SEQ ID NO: 2099565 - RNA, 23 nt, Human
cuauaaaugguguuuuuuuaaua

SEQ ID NO: 2099566 - RNA, 15 nt, Human
cuaguugaggaguuu

SEQ ID NO: 2099567 - RNA, 18 nt, Human
cuauaaccccagcucccu

SEQ ID NO: 2099568 - RNA, 14 nt, Human
cuagggcugggugu

SEQ ID NO: 2099569 - RNA, 14 nt, Human
cuagggggaaguga

SEQ ID NO: 2099570 - RNA, 21 nt, Human
cuagggaaaaaccagcgugug

SEQ ID NO: 2099571 - RNA, 21 nt, Human
cuaggcuucagcauauuuaua

SEQ ID NO: 2099572 - RNA, 23 nt, Human
cuaggcuucagcauauuuauagc

SEQ ID NO: 2099573 - RNA, 20 nt, Human
cuagggauucaggcugcuug

SEQ ID NO: 2099574 - RNA, 17 nt, Human
cuagggauucaggcugc

SEQ ID NO: 2099575 - RNA, 18 nt, Human
cuagggauucaggcugcu

SEQ ID NO: 2099576 - RNA, 19 nt, Human
cuagggauguucuggcccu

SEQ ID NO: 2099577 - RNA, 15 nt, Human
cuagggauucaggcu

SEQ ID NO: 2099578 - RNA, 16 nt, Human
cuagggauucaggcug

SEQ ID NO: 2099579 - RNA, 19 nt, Human
cuagggaaaaaccagcgug

SEQ ID NO: 2099580 - RNA, 17 nt, Human
cuaggcuggagcccagg

SEQ ID NO: 2099581 - RNA, 20 nt, Human
cuaggcuggagcccagggag

SEQ ID NO: 2099582 - RNA, 12 nt, Human
cuaggcugggug

SEQ ID NO: 2099583 - RNA, 13 nt, Human
cuaggcugggugc

SEQ ID NO: 2099584 - RNA, 17 nt, Human
cuaggcugggugcccac

SEQ ID NO: 2099585 - RNA, 18 nt, Human
cuaggcugggugcccaca

SEQ ID NO: 2099586 - RNA, 19 nt, Human
cuaggcugggugcccacag

SEQ ID NO: 2099587 - RNA, 20 nt, Human
cuaggcugggugcccacagc

SEQ ID NO: 2099588 - RNA, 21 nt, Human
cuaggcugggugcccacagcc

SEQ ID NO: 2099589 - RNA, 22 nt, Human
cuaggcugggugcccacagccc

SEQ ID NO: 2099590 - RNA, 13 nt, Human
cuagccucuccag

SEQ ID NO: 2099591 - RNA, 13 nt, Human
cuagccgaccuca

SEQ ID NO: 2099592 - RNA, 14 nt, Human
cuagccgaccucag

SEQ ID NO: 2099593 - RNA, 15 nt, Human
cuagccgaccucagc

SEQ ID NO: 2099594 - RNA, 16 nt, Human
cuagccgaccucagcc

SEQ ID NO: 2099595 - RNA, 17 nt, Human
cuagccgaccucagccu

SEQ ID NO: 2099596 - RNA, 18 nt, Human
cuagccgaccucagccuu

SEQ ID NO: 2099597 - RNA, 19 nt, Human
cuagccgaccucagccuuc

SEQ ID NO: 2099598 - RNA, 20 nt, Human
cuagccgaccucagccuucc

SEQ ID NO: 2099599 - RNA, 20 nt, Human
cuacaguguacagucuugua

SEQ ID NO: 2099600 - RNA, 23 nt, Human
cuacaguuaggguugaguuacuu

SEQ ID NO: 2099601 - RNA, 13 nt, Human
cuacaguugaaaa

SEQ ID NO: 2099602 - RNA, 15 nt, Human
cuacaguguacaguc

SEQ ID NO: 2099603 - RNA, 14 nt, Human
cuacaguguacagu

SEQ ID NO: 2099604 - RNA, 16 nt, Human
cuacaguguacagucu

SEQ ID NO: 2099605 - RNA, 17 nt, Human
cuacaguguacagucuu

SEQ ID NO: 2099606 - RNA, 18 nt, Human
cuacaugacgacaaagcu

SEQ ID NO: 2099607 - RNA, 19 nt, Human
cuacaugacgacaaagcug

SEQ ID NO: 2099608 - RNA, 21 nt, Human
cuacaugacgacaaagcugcu

SEQ ID NO: 2099609 - RNA, 18 nt, Human
cuacauacaauuccaaac

SEQ ID NO: 2099610 - RNA, 22 nt, Human
cuaagugauccucccaccucag

SEQ ID NO: 2099611 - RNA, 20 nt, Human
cuaagugauccucccaccuc

SEQ ID NO: 2099612 - RNA, 14 nt, Human
cuaagugaaaaggu

SEQ ID NO: 2099613 - RNA, 17 nt, Human
cuaauuuaacccagcuc

SEQ ID NO: 2099614 - RNA, 19 nt, Human
cuaauuggccucuuuaaga

SEQ ID NO: 2099615 - RNA, 23 nt, Human
cuacaaaaaauuagaaauuggcu

SEQ ID NO: 2099616 - RNA, 17 nt, Human
cuaauuuuuaagcaaaa

SEQ ID NO: 2099617 - RNA, 17 nt, Human
cggcucuggccuccaag

SEQ ID NO: 2099618 - RNA, 20 nt, Human
cggcugagucaugaucuccc

SEQ ID NO: 2099619 - RNA, 17 nt, Human
cgugacagugccuggga

SEQ ID NO: 2099620 - RNA, 18 nt, Human
cgugacauccccacccuu

SEQ ID NO: 2099621 - RNA, 13 nt, Human
cgugacucaccca

SEQ ID NO: 2099622 - RNA, 16 nt, Human
cgugacagugccuggg

SEQ ID NO: 2099623 - RNA, 23 nt, Human
cgugacuguauuauacaugggua

SEQ ID NO: 2099624 - RNA, 12 nt, Human
cgugagaagcau

SEQ ID NO: 2099625 - RNA, 23 nt, Human
cgugagagugucuucacggcagg

SEQ ID NO: 2099626 - RNA, 20 nt, Human
cgugacugccccaacuccug

SEQ ID NO: 2099627 - RNA, 21 nt, Human
cgugacugccccaacuccugg

SEQ ID NO: 2099628 - RNA, 22 nt, Human
cgugacugccccaacuccugga

SEQ ID NO: 2099629 - RNA, 23 nt, Human
cgugacugccccaacuccuggaa

SEQ ID NO: 2099630 - RNA, 14 nt, Human
cgugacucacccaa

SEQ ID NO: 2099631 - RNA, 15 nt, Human
cgugacucacccaag

SEQ ID NO: 2099632 - RNA, 16 nt, Human
cgugacucacccaagc

SEQ ID NO: 2099633 - RNA, 17 nt, Human
cgugacucacccaagca

SEQ ID NO: 2099634 - RNA, 18 nt, Human
cgugacucacccaagcau

SEQ ID NO: 2099635 - RNA, 13 nt, Human
cgugacugcccca

SEQ ID NO: 2099636 - RNA, 16 nt, Human
cgugacugccccaacu

SEQ ID NO: 2099637 - RNA, 17 nt, Human
cgugacugccccaacuc

SEQ ID NO: 2099638 - RNA, 22 nt, Human
cgugggucuucagggggccagg

SEQ ID NO: 2099639 - RNA, 23 nt, Human
cguggguguguguagccaagguc

SEQ ID NO: 2099640 - RNA, 19 nt, Human
cgugagcagugugucuccu

SEQ ID NO: 2099641 - RNA, 20 nt, Human
cguggggcagcacagagagg

SEQ ID NO: 2099642 - RNA, 21 nt, Human
cguggugaucaauuaaaugua

SEQ ID NO: 2099643 - RNA, 14 nt, Human
cgugucuguauuua

SEQ ID NO: 2099644 - RNA, 15 nt, Human
cguggugauuuagca

SEQ ID NO: 2099645 - RNA, 22 nt, Human
cgugucuguauuuaugugugag

SEQ ID NO: 2099646 - RNA, 18 nt, Human
cgugugcacacacaccac

SEQ ID NO: 2099647 - RNA, 16 nt, Human
cgugugcgugcaugug

SEQ ID NO: 2099648 - RNA, 17 nt, Human
cuaaacuuuaauaugua

SEQ ID NO: 2099649 - RNA, 20 nt, Human
cuaacugugcucaagagguu

SEQ ID NO: 2099650 - RNA, 13 nt, Human
cuaacuuuugugu

SEQ ID NO: 2099651 - RNA, 17 nt, Human
cuaacuuuugugugaaa

SEQ ID NO: 2099652 - RNA, 22 nt, Human
cuaagaaaagauacgacuuuau

SEQ ID NO: 2099653 - RNA, 23 nt, Human
cuaagaaaagauacgacuuuauu

SEQ ID NO: 2099654 - RNA, 17 nt, Human
cuaaccuggguucccuu

SEQ ID NO: 2099655 - RNA, 18 nt, Human
cuaaagaggcugaaagag

SEQ ID NO: 2099656 - RNA, 20 nt, Human
ccugaguagcuggauuacag

SEQ ID NO: 2099657 - RNA, 15 nt, Human
ccugaguagcuggau

SEQ ID NO: 2099658 - RNA, 19 nt, Human
ccugaguagcuggauuaca

SEQ ID NO: 2099659 - RNA, 22 nt, Human
ccugcacuugcagacucuacag

SEQ ID NO: 2099660 - RNA, 13 nt, Human
ccugcagccugga

SEQ ID NO: 2099661 - RNA, 15 nt, Human
ccugcagccuggagg

SEQ ID NO: 2099662 - RNA, 16 nt, Human
ccugcagccuggaggc

SEQ ID NO: 2099663 - RNA, 12 nt, Human
ccugcagccugg

SEQ ID NO: 2099664 - RNA, 15 nt, Human
ccugagaucagaguc

SEQ ID NO: 2099665 - RNA, 17 nt, Human
ccugagaucagaguccu

SEQ ID NO: 2099666 - RNA, 21 nt, Human
ccugagacaaauggaggccug

SEQ ID NO: 2099667 - RNA, 20 nt, Human
ccugagacaaauggaggccu

SEQ ID NO: 2099668 - RNA, 19 nt, Human
ccugagacaaauggaggcc

SEQ ID NO: 2099669 - RNA, 15 nt, Human
ccugagacaaaugga

SEQ ID NO: 2099670 - RNA, 22 nt, Human
ccugagaagugucuaaaaacac

SEQ ID NO: 2099671 - RNA, 14 nt, Human
ccugaccugucuca

SEQ ID NO: 2099672 - RNA, 14 nt, Human
ccugaccucccccu

SEQ ID NO: 2099673 - RNA, 16 nt, Human
ccugaccucccccucc

SEQ ID NO: 2099674 - RNA, 17 nt, Human
ccugaccucccccuccu

SEQ ID NO: 2099675 - RNA, 19 nt, Human
ccugaccucccccuccuuc

SEQ ID NO: 2099676 - RNA, 13 nt, Human
ccugacucucugu

SEQ ID NO: 2099677 - RNA, 15 nt, Human
ccugacucucuguga

SEQ ID NO: 2099678 - RNA, 16 nt, Human
ccugacucucugugac

SEQ ID NO: 2099679 - RNA, 17 nt, Human
ccugacucucugugacc

SEQ ID NO: 2099680 - RNA, 18 nt, Human
ccugacucucugugaccu

SEQ ID NO: 2099681 - RNA, 13 nt, Human
ccucuuggguuca

SEQ ID NO: 2099682 - RNA, 12 nt, Human
ccucuuuaagag

SEQ ID NO: 2099683 - RNA, 13 nt, Human
ccugacccugcag

SEQ ID NO: 2099684 - RNA, 14 nt, Human
ccugacccugcaga

SEQ ID NO: 2099685 - RNA, 16 nt, Human
ccugaccucacuguga

SEQ ID NO: 2099686 - RNA, 16 nt, Human
ccugaccucccucuaa

SEQ ID NO: 2099687 - RNA, 22 nt, Human
ccucugccugaagucacacagu

SEQ ID NO: 2099688 - RNA, 17 nt, Human
ccucugccugcauucug

SEQ ID NO: 2099689 - RNA, 12 nt, Human
ccucugccuguc

SEQ ID NO: 2099690 - RNA, 14 nt, Human
ccucugccuguccc

SEQ ID NO: 2099691 - RNA, 15 nt, Human
ccucugccugucccu

SEQ ID NO: 2099692 - RNA, 16 nt, Human
ccucugccugucccuc

SEQ ID NO: 2099693 - RNA, 17 nt, Human
ccucugccugucccucu

SEQ ID NO: 2099694 - RNA, 18 nt, Human
ccucugccugucccucuc

SEQ ID NO: 2099695 - RNA, 14 nt, Human
ccucugcugccaug

SEQ ID NO: 2099696 - RNA, 21 nt, Human
ccucucucuucugcuccaccc

SEQ ID NO: 2099697 - RNA, 22 nt, Human
ccucucucuucugcuccacccu

SEQ ID NO: 2099698 - RNA, 15 nt, Human
ccucucucuggaaag

SEQ ID NO: 2099699 - RNA, 12 nt, Human
ccucucucuucu

SEQ ID NO: 2099700 - RNA, 16 nt, Human
ccucucucuucugcuc

SEQ ID NO: 2099701 - RNA, 18 nt, Human
ccucucucuucugcucca

SEQ ID NO: 2099702 - RNA, 19 nt, Human
ccucucucuucugcuccac

SEQ ID NO: 2099703 - RNA, 20 nt, Human
ccucucucuucugcuccacc

SEQ ID NO: 2099704 - RNA, 21 nt, Human
ccucugcuggcacauuucccc

SEQ ID NO: 2099705 - RNA, 19 nt, Human
ccucugcuggccgggcaca

SEQ ID NO: 2099706 - RNA, 21 nt, Human
ccucugcuggccgggcacagc

SEQ ID NO: 2099707 - RNA, 22 nt, Human
ccucugcuggccgggcacagcu

SEQ ID NO: 2099708 - RNA, 23 nt, Human
ccucugcuggccgggcacagcug

SEQ ID NO: 2099709 - RNA, 15 nt, Human
ccucugcugccaugg

SEQ ID NO: 2099710 - RNA, 18 nt, Human
ccuggcacagggcagugg

SEQ ID NO: 2099711 - RNA, 17 nt, Human
ccuggcacagggcagug

SEQ ID NO: 2099712 - RNA, 16 nt, Human
ccuggcacagggcagu

SEQ ID NO: 2099713 - RNA, 18 nt, Human
ccuggcacccggccccug

SEQ ID NO: 2099714 - RNA, 22 nt, Human
ccuggaugaaguuaucuggcuu

SEQ ID NO: 2099715 - RNA, 21 nt, Human
ccuggauccaucaggccacuu

SEQ ID NO: 2099716 - RNA, 16 nt, Human
ccuggaucuaccagca

SEQ ID NO: 2099717 - RNA, 22 nt, Human
ccuggaucuaccagcauaaaua

SEQ ID NO: 2099718 - RNA, 16 nt, Human
ccugcccaggccccug

SEQ ID NO: 2099719 - RNA, 15 nt, Human
ccugcccaggccccu

SEQ ID NO: 2099720 - RNA, 14 nt, Human
ccugcccaggcccc

SEQ ID NO: 2099721 - RNA, 14 nt, Human
ccugcuggccccuc

SEQ ID NO: 2099722 - RNA, 15 nt, Human
ccugcuggccccuca

SEQ ID NO: 2099723 - RNA, 16 nt, Human
ccugcuggccccucac

SEQ ID NO: 2099724 - RNA, 17 nt, Human
ccugcuggccccucacc

SEQ ID NO: 2099725 - RNA, 18 nt, Human
ccugcuggccccucaccu

SEQ ID NO: 2099726 - RNA, 21 nt, Human
ccugcuggccccucaccuggg

SEQ ID NO: 2099727 - RNA, 12 nt, Human
ccugcugggcuc

SEQ ID NO: 2099728 - RNA, 16 nt, Human
ccugcugggcucucca

SEQ ID NO: 2099729 - RNA, 17 nt, Human
ccugcugggcucuccac

SEQ ID NO: 2099730 - RNA, 18 nt, Human
ccugcugggcucuccacc

SEQ ID NO: 2099731 - RNA, 19 nt, Human
ccugcugggcucuccaccu

SEQ ID NO: 2099732 - RNA, 20 nt, Human
ccugcugggcucuccaccuc

SEQ ID NO: 2099733 - RNA, 12 nt, Human
ccugcccagugu

SEQ ID NO: 2099734 - RNA, 13 nt, Human
ccugcccaguguu

SEQ ID NO: 2099735 - RNA, 23 nt, Human
ccugcccaguguuguuuguaaau

SEQ ID NO: 2099736 - RNA, 11 nt, Human
ccugcccagug

SEQ ID NO: 2099737 - RNA, 21 nt, Human
ccugcugggcucuccaccuca

SEQ ID NO: 2099738 - RNA, 22 nt, Human
ccugcugggcucuccaccucag

SEQ ID NO: 2099739 - RNA, 24 nt, Human
ccugcugggcucuccaccucagcc

SEQ ID NO: 2099740 - RNA, 13 nt, Human
ccuggagcuccug

SEQ ID NO: 2099741 - RNA, 14 nt, Human
ccuggagcuccugg

SEQ ID NO: 2099742 - RNA, 15 nt, Human
ccuggagcuccuggg

SEQ ID NO: 2099743 - RNA, 16 nt, Human
ccuggagcuccuggga

SEQ ID NO: 2099744 - RNA, 18 nt, Human
ccuggagcuccugggaag

SEQ ID NO: 2099745 - RNA, 16 nt, Human
ccuggaggaaccgaaa

SEQ ID NO: 2099746 - RNA, 22 nt, Human
ccuggaggaaccgaaaggccaa

SEQ ID NO: 2099747 - RNA, 23 nt, Human
ccugcugggcucuccaccucagc

SEQ ID NO: 2099748 - RNA, 12 nt, Human
ccuggagcccga

SEQ ID NO: 2099749 - RNA, 14 nt, Human
ccuggagcccgagg

SEQ ID NO: 2099750 - RNA, 20 nt, Human
ccuggagcccgaggcaccag

SEQ ID NO: 2099751 - RNA, 16 nt, Human
ccuggaggauuucauc

SEQ ID NO: 2099752 - RNA, 14 nt, Human
ccuggcccuggggc

SEQ ID NO: 2099753 - RNA, 15 nt, Human
ccuggcccuggggcc

SEQ ID NO: 2099754 - RNA, 16 nt, Human
ccuggcccuggggccu

SEQ ID NO: 2099755 - RNA, 17 nt, Human
ccuggcccuggggccug

SEQ ID NO: 2099756 - RNA, 20 nt, Human
ccuggcccuggggccuguac

SEQ ID NO: 2099757 - RNA, 14 nt, Human
ccucagccuccuga

SEQ ID NO: 2099758 - RNA, 12 nt, Human
ccucagccuccg

SEQ ID NO: 2099759 - RNA, 22 nt, Human
ccucagccucccgaauagcugg

SEQ ID NO: 2099760 - RNA, 23 nt, Human
ccucagccucccaaagugcuggg

SEQ ID NO: 2099761 - RNA, 18 nt, Human
ccuccaaguccacagugg

SEQ ID NO: 2099762 - RNA, 21 nt, Human
ccuccaaguccacaguggaac

SEQ ID NO: 2099763 - RNA, 19 nt, Human
ccucauuacggcuccucuc

SEQ ID NO: 2099764 - RNA, 22 nt, Human
ccuccaaucccaccaacccuca

SEQ ID NO: 2099765 - RNA, 22 nt, Human
ccucccaaggggcccaaauucu

SEQ ID NO: 2099766 - RNA, 22 nt, Human
ccuccaagcuccaucuccacuc

SEQ ID NO: 2099767 - RNA, 21 nt, Human
ccuccaagcuccaucuccacu

SEQ ID NO: 2099768 - RNA, 18 nt, Human
ccucauuagcauuuugcu

SEQ ID NO: 2099769 - RNA, 12 nt, Human
ccucccagcucu

SEQ ID NO: 2099770 - RNA, 13 nt, Human
ccucccagcucug

SEQ ID NO: 2099771 - RNA, 14 nt, Human
ccucccagcucuga

SEQ ID NO: 2099772 - RNA, 20 nt, Human
ccucccaggcgccccuuccc

SEQ ID NO: 2099773 - RNA, 14 nt, Human
ccucccaggcgccc

SEQ ID NO: 2099774 - RNA, 12 nt, Human
ccucccaccaca

SEQ ID NO: 2099775 - RNA, 14 nt, Human
ccucccaccacagc

SEQ ID NO: 2099776 - RNA, 15 nt, Human
ccucccaccacagca

SEQ ID NO: 2099777 - RNA, 12 nt, Human
ccucccagccug

SEQ ID NO: 2099778 - RNA, 21 nt, Human
ccucaaggacaaagucuccag

SEQ ID NO: 2099779 - RNA, 22 nt, Human
ccucaaggacaaagucuccagc

SEQ ID NO: 2099780 - RNA, 23 nt, Human
ccucaaggacaaagucuccagcc

SEQ ID NO: 2099781 - RNA, 12 nt, Human
ccucaaggacuu

SEQ ID NO: 2099782 - RNA, 13 nt, Human
ccucaaggacuug

SEQ ID NO: 2099783 - RNA, 19 nt, Human
ccucaaggacuugaaagca

SEQ ID NO: 2099784 - RNA, 20 nt, Human
ccucaaggacuugaaagcau

SEQ ID NO: 2099785 - RNA, 21 nt, Human
ccucaaggacuugaaagcauc

SEQ ID NO: 2099786 - RNA, 22 nt, Human
ccucagccucccaaagugcugg

SEQ ID NO: 2099787 - RNA, 11 nt, Human
ccucagccucc

SEQ ID NO: 2099788 - RNA, 22 nt, Human
ccucaaggacuugaaagcaucc

SEQ ID NO: 2099789 - RNA, 23 nt, Human
ccucaaggacuugaaagcaucca

SEQ ID NO: 2099790 - RNA, 14 nt, Human
ccucagccuagacc

SEQ ID NO: 2099791 - RNA, 16 nt, Human
ccucagccuagacccu

SEQ ID NO: 2099792 - RNA, 19 nt, Human
ccucagccuagacccuccu

SEQ ID NO: 2099793 - RNA, 20 nt, Human
ccucagccuagacccuccuc

SEQ ID NO: 2099794 - RNA, 16 nt, Human
ccuauuucaaaaauuu

SEQ ID NO: 2099795 - RNA, 22 nt, Human
ccuauuucaaaaauuuggaauu

SEQ ID NO: 2099796 - RNA, 16 nt, Human
ccucaaccuccugggc

SEQ ID NO: 2099797 - RNA, 14 nt, Human
ccucaaccuguaaa

SEQ ID NO: 2099798 - RNA, 20 nt, Human
ccucaaccuguaaauuauuu

SEQ ID NO: 2099799 - RNA, 23 nt, Human
ccucaaccuguaaauuauuuuaa

SEQ ID NO: 2099800 - RNA, 13 nt, Human
ccucaaccuguga

SEQ ID NO: 2099801 - RNA, 21 nt, Human
ccucaacucaccuaauguuua

SEQ ID NO: 2099802 - RNA, 14 nt, Human
ccucaaccugugau

SEQ ID NO: 2099803 - RNA, 17 nt, Human
ccgucagccaaauguaa

SEQ ID NO: 2099804 - RNA, 20 nt, Human
ccgucaguaucaggccugcc

SEQ ID NO: 2099805 - RNA, 15 nt, Human
ccgucauguuccuca

SEQ ID NO: 2099806 - RNA, 16 nt, Human
ccgucauguuccucaa

SEQ ID NO: 2099807 - RNA, 17 nt, Human
ccgucauguuccucaaa

SEQ ID NO: 2099808 - RNA, 22 nt, Human
ccguccagccgccauugccacc

SEQ ID NO: 2099809 - RNA, 16 nt, Human
ccgucucaugaggggc

SEQ ID NO: 2099810 - RNA, 12 nt, Human
ccguauuucaga

SEQ ID NO: 2099811 - RNA, 22 nt, Human
ccguaguucccugaaaacccag

SEQ ID NO: 2099812 - RNA, 14 nt, Human
ccguaguucccuga

SEQ ID NO: 2099813 - RNA, 15 nt, Human
ccguaguucccugaa

SEQ ID NO: 2099814 - RNA, 16 nt, Human
ccguaguucccugaaa

SEQ ID NO: 2099815 - RNA, 24 nt, Human
ccguagacgugcacgcacacuguc

SEQ ID NO: 2099816 - RNA, 17 nt, Human
ccggcuaugggggcacu

SEQ ID NO: 2099817 - RNA, 23 nt, Human
ccggcuaugggggcacugaggac

SEQ ID NO: 2099818 - RNA, 22 nt, Human
ccggcuaugggggcacugagga

SEQ ID NO: 2099819 - RNA, 16 nt, Human
ccuaauacauuaaagc

SEQ ID NO: 2099820 - RNA, 18 nt, Human
ccuaauacauuaaagcag

SEQ ID NO: 2099821 - RNA, 20 nt, Human
ccuaauacauuaaagcaguc

SEQ ID NO: 2099822 - RNA, 17 nt, Human
ccuagauaaaaagaugg

SEQ ID NO: 2099823 - RNA, 21 nt, Human
ccuaagauuuauuuuguuaaa

SEQ ID NO: 2099824 - RNA, 14 nt, Human
ccuaaguggcugcu

SEQ ID NO: 2099825 - RNA, 15 nt, Human
ccuaaguggcugcug

SEQ ID NO: 2099826 - RNA, 16 nt, Human
ccuaaguggcugcuga

SEQ ID NO: 2099827 - RNA, 17 nt, Human
ccuaaguuaccuuucua

SEQ ID NO: 2099828 - RNA, 15 nt, Human
ccuaaguucuuagau

SEQ ID NO: 2099829 - RNA, 17 nt, Human
ccuaaguucuuagauau

SEQ ID NO: 2099830 - RNA, 18 nt, Human
ccuaaguucuuagauauc

SEQ ID NO: 2099831 - RNA, 20 nt, Human
ccuaaguuucaguugauuuu

SEQ ID NO: 2099832 - RNA, 16 nt, Human
ccuaagucccugcccc

SEQ ID NO: 2099833 - RNA, 18 nt, Human
ccuaagucccugcccccu

SEQ ID NO: 2099834 - RNA, 13 nt, Human
ccuaagucucugu

SEQ ID NO: 2099835 - RNA, 14 nt, Human
ccuaagucucugug

SEQ ID NO: 2099836 - RNA, 15 nt, Human
ccuaagucucuguga

SEQ ID NO: 2099837 - RNA, 17 nt, Human
ccgucugggguucagcc

SEQ ID NO: 2099838 - RNA, 19 nt, Human
ccgucugggguucagcccc

SEQ ID NO: 2099839 - RNA, 20 nt, Human
ccgucugggguucagccccu

SEQ ID NO: 2099840 - RNA, 21 nt, Human
ccgucugggguucagccccuc

SEQ ID NO: 2099841 - RNA, 22 nt, Human
ccgucugggguucagccccucc

SEQ ID NO: 2099842 - RNA, 23 nt, Human
ccgucugggguucagccccuccu

SEQ ID NO: 2099843 - RNA, 23 nt, Human
ccuaaggcacccacaaauaaaug

SEQ ID NO: 2099844 - RNA, 19 nt, Human
ccuaagggcucaccguggc

SEQ ID NO: 2099845 - RNA, 13 nt, Human
ccuaagccaaggg

SEQ ID NO: 2099846 - RNA, 21 nt, Human
ccuaagccaagggccucuugc

SEQ ID NO: 2099847 - RNA, 18 nt, Human
ccuagcacucacaugcug

SEQ ID NO: 2099848 - RNA, 17 nt, Human
ccuagauccacacacag

SEQ ID NO: 2099849 - RNA, 19 nt, Human
ccuagauccacacacagag

SEQ ID NO: 2099850 - RNA, 20 nt, Human
ccuagauccacacacagagg

SEQ ID NO: 2099851 - RNA, 12 nt, Human
ccuaggagacca

SEQ ID NO: 2099852 - RNA, 21 nt, Human
ccgccacauccccgcuggcug

SEQ ID NO: 2099853 - RNA, 15 nt, Human
ccgcauucccugagu

SEQ ID NO: 2099854 - RNA, 23 nt, Human
ccgcauucccugagucaccagga

SEQ ID NO: 2099855 - RNA, 12 nt, Human
ccgccaggcgag

SEQ ID NO: 2099856 - RNA, 19 nt, Human
ccgaccgaggcuggagcug

SEQ ID NO: 2099857 - RNA, 12 nt, Human
ccgaccucagcc

SEQ ID NO: 2099858 - RNA, 13 nt, Human
ccgaccucagccu

SEQ ID NO: 2099859 - RNA, 17 nt, Human
ccgccaaggcuggggga

SEQ ID NO: 2099860 - RNA, 14 nt, Human
ccgaccucagccuu

SEQ ID NO: 2099861 - RNA, 15 nt, Human
ccgaccucagccuuc

SEQ ID NO: 2099862 - RNA, 21 nt, Human
ccgaccgaggcuggagcuggc

SEQ ID NO: 2099863 - RNA, 13 nt, Human
ccgaccucguccu

SEQ ID NO: 2099864 - RNA, 19 nt, Human
ccgaccucguccucccccu

SEQ ID NO: 2099865 - RNA, 22 nt, Human
ccgaccucguccucccccugcc

SEQ ID NO: 2099866 - RNA, 18 nt, Human
ccgacaaccgaugcucca

SEQ ID NO: 2099867 - RNA, 20 nt, Human
ccgacaaccgaugcuccagc

SEQ ID NO: 2099868 - RNA, 15 nt, Human
ccgacaaccgaugcu

SEQ ID NO: 2099869 - RNA, 13 nt, Human
ccgacagagggaa

SEQ ID NO: 2099870 - RNA, 13 nt, Human
ccgaccagagccc

SEQ ID NO: 2099871 - RNA, 17 nt, Human
ccgacacgcucccuccc

SEQ ID NO: 2099872 - RNA, 14 nt, Human
cccuucugugccca

SEQ ID NO: 2099873 - RNA, 15 nt, Human
cccuucugugcccag

SEQ ID NO: 2099874 - RNA, 16 nt, Human
cccuucugugcccagc

SEQ ID NO: 2099875 - RNA, 17 nt, Human
cccuucugugcccagcu

SEQ ID NO: 2099876 - RNA, 18 nt, Human
cccuucugugcccagcuc

SEQ ID NO: 2099877 - RNA, 20 nt, Human
cccuucugugcccagcucag

SEQ ID NO: 2099878 - RNA, 12 nt, Human
cccuucuuucca

SEQ ID NO: 2099879 - RNA, 20 nt, Human
ccgaauagcugggacuacag

SEQ ID NO: 2099880 - RNA, 16 nt, Human
ccgccaugcuccuggc

SEQ ID NO: 2099881 - RNA, 21 nt, Human
ccgccauucucaagcccugca

SEQ ID NO: 2099882 - RNA, 14 nt, Human
ccgccauugccacc

SEQ ID NO: 2099883 - RNA, 20 nt, Human
ccgccauucucaagcccugc

SEQ ID NO: 2099884 - RNA, 15 nt, Human
ccgccauugccacca

SEQ ID NO: 2099885 - RNA, 16 nt, Human
ccgccauugccaccag

SEQ ID NO: 2099886 - RNA, 19 nt, Human
ccgccauugccaccaggag

SEQ ID NO: 2099887 - RNA, 14 nt, Human
ccgccccagccucu

SEQ ID NO: 2099888 - RNA, 13 nt, Human
ccgccccacauuc

SEQ ID NO: 2099889 - RNA, 15 nt, Human
ccgccccagccucug

SEQ ID NO: 2099890 - RNA, 18 nt, Human
cccuucgcuccugugucu

SEQ ID NO: 2099891 - RNA, 16 nt, Human
cccuucgcuccugugu

SEQ ID NO: 2099892 - RNA, 14 nt, Human
cccuucuacacucu

SEQ ID NO: 2099893 - RNA, 15 nt, Human
cccuucuacacucuc

SEQ ID NO: 2099894 - RNA, 17 nt, Human
cccuucuacacucuccu

SEQ ID NO: 2099895 - RNA, 18 nt, Human
cccuucuacacucuccug

SEQ ID NO: 2099896 - RNA, 23 nt, Human
cccuucuacacucuccugggccc

SEQ ID NO: 2099897 - RNA, 14 nt, Human
cccuucuacugcuu

SEQ ID NO: 2099898 - RNA, 16 nt, Human
cccuucuacugcuucu

SEQ ID NO: 2099899 - RNA, 18 nt, Human
cccuucuacugcuucuac

SEQ ID NO: 2099900 - RNA, 13 nt, Human
cccuucucuguau

SEQ ID NO: 2099901 - RNA, 22 nt, Human
cccuggcaggaugacccugcga

SEQ ID NO: 2099902 - RNA, 20 nt, Human
cccuggcaggaugacccugc

SEQ ID NO: 2099903 - RNA, 13 nt, Human
cccuggccagagg

SEQ ID NO: 2099904 - RNA, 14 nt, Human
cccuggccagaggc

SEQ ID NO: 2099905 - RNA, 15 nt, Human
cccuggccagaggcu

SEQ ID NO: 2099906 - RNA, 13 nt, Human
cccuggccaucuc

SEQ ID NO: 2099907 - RNA, 14 nt, Human
cccuggccaucucu

SEQ ID NO: 2099908 - RNA, 15 nt, Human
cccuggccaucucug

SEQ ID NO: 2099909 - RNA, 13 nt, Human
cccuggccugcug

SEQ ID NO: 2099910 - RNA, 14 nt, Human
cccuggccugcugg

SEQ ID NO: 2099911 - RNA, 21 nt, Human
cccuggccugcugggcucucc

SEQ ID NO: 2099912 - RNA, 22 nt, Human
cccuggccugcugggcucucca

SEQ ID NO: 2099913 - RNA, 15 nt, Human
cccuggccuguucug

SEQ ID NO: 2099914 - RNA, 19 nt, Human
cccuggccuguucuguuuu

SEQ ID NO: 2099915 - RNA, 20 nt, Human
cccuggcuuguaacuccacc

SEQ ID NO: 2099916 - RNA, 23 nt, Human
cccuggcuuguaacuccaccaac

SEQ ID NO: 2099917 - RNA, 13 nt, Human
cccuggcuuuuca

SEQ ID NO: 2099918 - RNA, 19 nt, Human
cccuggcucccacaggccc

SEQ ID NO: 2099919 - RNA, 17 nt, Human
cccuggcucccacaggc

SEQ ID NO: 2099920 - RNA, 19 nt, Human
cccuggcuuguaacuccac

SEQ ID NO: 2099921 - RNA, 11 nt, Human
cccuggcuggu

SEQ ID NO: 2099922 - RNA, 20 nt, Human
cccuggcugguaagggccaa

SEQ ID NO: 2099923 - RNA, 22 nt, Human
cccuggcugguaagggccaagu

SEQ ID NO: 2099924 - RNA, 13 nt, Human
cccucaccccugc

SEQ ID NO: 2099925 - RNA, 19 nt, Human
ccagcuuaaaggggcuaga

SEQ ID NO: 2099926 - RNA, 17 nt, Human
ccagcuguucagcuggu

SEQ ID NO: 2099927 - RNA, 21 nt, Human
ccagcuacuccggaggcugag

SEQ ID NO: 2099928 - RNA, 15 nt, Human
ccagcuacucaggag

SEQ ID NO: 2099929 - RNA, 17 nt, Human
ccagcuacucaggaggc

SEQ ID NO: 2099930 - RNA, 19 nt, Human
ccagcuacucaggaggcug

SEQ ID NO: 2099931 - RNA, 20 nt, Human
ccagcuacucaggaggcuga

SEQ ID NO: 2099932 - RNA, 22 nt, Human
ccagcucaccagccccagugcc

SEQ ID NO: 2099933 - RNA, 16 nt, Human
ccagcuguucagcugg

SEQ ID NO: 2099934 - RNA, 16 nt, Human
ccagcucaccagcccc

SEQ ID NO: 2099935 - RNA, 15 nt, Human
ccagcucaccagccc

SEQ ID NO: 2099936 - RNA, 16 nt, Human
ccagccccugccccuc

SEQ ID NO: 2099937 - RNA, 20 nt, Human
ccagcuacucaagaggcuga

SEQ ID NO: 2099938 - RNA, 14 nt, Human
ccagcuacucagaa

SEQ ID NO: 2099939 - RNA, 16 nt, Human
ccagcuacucagaagc

SEQ ID NO: 2099940 - RNA, 17 nt, Human
ccagcuacucagaagcc

SEQ ID NO: 2099941 - RNA, 20 nt, Human
ccagcuacucagaagccuga

SEQ ID NO: 2099942 - RNA, 21 nt, Human
ccagcuacucagaagccugag

SEQ ID NO: 2099943 - RNA, 23 nt, Human
ccagcuacucagaagccugaggc

SEQ ID NO: 2099944 - RNA, 13 nt, Human
ccagcuacucagg

SEQ ID NO: 2099945 - RNA, 14 nt, Human
ccagcuacucagga

SEQ ID NO: 2099946 - RNA, 14 nt, Human
ccaggaaccuccuc

SEQ ID NO: 2099947 - RNA, 15 nt, Human
ccagcagccagcucu

SEQ ID NO: 2099948 - RNA, 16 nt, Human
ccagcagccagcucuc

SEQ ID NO: 2099949 - RNA, 18 nt, Human
ccagcagccagcucucag

SEQ ID NO: 2099950 - RNA, 19 nt, Human
ccagcagccagcucucagc

SEQ ID NO: 2099951 - RNA, 20 nt, Human
ccagcagccagcucucagcc

SEQ ID NO: 2099952 - RNA, 21 nt, Human
ccagcagccagcucucagcca

SEQ ID NO: 2099953 - RNA, 16 nt, Human
ccaccuuggcucaagu

SEQ ID NO: 2099954 - RNA, 18 nt, Human
ccagaucccagaaggacc

SEQ ID NO: 2099955 - RNA, 13 nt, Human
ccagaucccagaa

SEQ ID NO: 2099956 - RNA, 16 nt, Human
ccagaucccagaagga

SEQ ID NO: 2099957 - RNA, 17 nt, Human
ccagaucccagaaggac

SEQ ID NO: 2099958 - RNA, 13 nt, Human
ccagaguggccug

SEQ ID NO: 2099959 - RNA, 14 nt, Human
ccagaguggccugg

SEQ ID NO: 2099960 - RNA, 15 nt, Human
ccagaguggccuggc

SEQ ID NO: 2099961 - RNA, 16 nt, Human
ccagaguggccuggcc

SEQ ID NO: 2099962 - RNA, 17 nt, Human
ccagaguggccuggcca

SEQ ID NO: 2099963 - RNA, 18 nt, Human
ccagagugugggaaggga

SEQ ID NO: 2099964 - RNA, 21 nt, Human
ccagagugugggaagggagag

SEQ ID NO: 2099965 - RNA, 23 nt, Human
ccagaguggccuggccaggagcu

SEQ ID NO: 2099966 - RNA, 18 nt, Human
ccagaguggccuggccag

SEQ ID NO: 2099967 - RNA, 19 nt, Human
ccagaguggccuggccagg

SEQ ID NO: 2099968 - RNA, 21 nt, Human
ccagaguggccuggccaggag

SEQ ID NO: 2099969 - RNA, 22 nt, Human
ccagaguggccuggccaggagc

SEQ ID NO: 2099970 - RNA, 15 nt, Human
ccagaugcaccagcc

SEQ ID NO: 2099971 - RNA, 17 nt, Human
ccagaugcaccagcccu

SEQ ID NO: 2099972 - RNA, 18 nt, Human
ccagaugcaccagcccuu

SEQ ID NO: 2099973 - RNA, 18 nt, Human
ccaggcuggcgugcagug

SEQ ID NO: 2099974 - RNA, 17 nt, Human
ccaggcuggcgugcagu

SEQ ID NO: 2099975 - RNA, 19 nt, Human
ccaggcuggcgugcagugg

SEQ ID NO: 2099976 - RNA, 16 nt, Human
ccaggcuggcgugcag

SEQ ID NO: 2099977 - RNA, 23 nt, Human
ccaggcuccuuccugucuuccug

SEQ ID NO: 2099978 - RNA, 15 nt, Human
ccaggcuccuuccug

SEQ ID NO: 2099979 - RNA, 22 nt, Human
ccaggcuccuuccugucuuccu

SEQ ID NO: 2099980 - RNA, 18 nt, Human
ccaggcagaucugugccc

SEQ ID NO: 2099981 - RNA, 20 nt, Human
ccaggcagaucugugcccca

SEQ ID NO: 2099982 - RNA, 14 nt, Human
ccaggcuccucccu

SEQ ID NO: 2099983 - RNA, 16 nt, Human
ccaggcuccucccucc

SEQ ID NO: 2099984 - RNA, 14 nt, Human
ccaggcuccuuccu

SEQ ID NO: 2099985 - RNA, 21 nt, Human
ccaggcuccuuuagcgcccag

SEQ ID NO: 2099986 - RNA, 20 nt, Human
ccaggcuccuuuagcgccca

SEQ ID NO: 2099987 - RNA, 19 nt, Human
ccaggggaaaaucagccug

SEQ ID NO: 2099988 - RNA, 20 nt, Human
ccaggggaaaaucagccugc

SEQ ID NO: 2099989 - RNA, 18 nt, Human
ccaggcacgaacccaccu

SEQ ID NO: 2099990 - RNA, 19 nt, Human
ccaggcacgaacccaccug

SEQ ID NO: 2099991 - RNA, 20 nt, Human
ccaggcacgaacccaccugc

SEQ ID NO: 2099992 - RNA, 16 nt, Human
ccaggcacccaaaccc

SEQ ID NO: 2099993 - RNA, 18 nt, Human
ccaggcacugcugcccag

SEQ ID NO: 2099994 - RNA, 16 nt, Human
ccaggcacugcugccc

SEQ ID NO: 2099995 - RNA, 21 nt, Human
ccaggcacgaacccaccugcu

SEQ ID NO: 2099996 - RNA, 22 nt, Human
ccaggcacgaacccaccugcug

SEQ ID NO: 2099997 - RNA, 23 nt, Human
ccaggcacgaacccaccugcuga

SEQ ID NO: 2099998 - RNA, 13 nt, Human
ccaggcagaucug

SEQ ID NO: 2099999 - RNA, 17 nt, Human
ccaggcagaucugugcc

SEQ ID NO: 2100000 - RNA, 22 nt, Human
ccaugucaccggauccugggug

SEQ ID NO: 2100001 - RNA, 23 nt, Human
ccaugucaccggauccugggugg

SEQ ID NO: 2100002 - RNA, 14 nt, Human
ccauggugccucug

SEQ ID NO: 2100003 - RNA, 16 nt, Human
ccauggugccucugga

SEQ ID NO: 2100004 - RNA, 14 nt, Human
ccauggucacagag

SEQ ID NO: 2100005 - RNA, 15 nt, Human
ccauggucacagaga

SEQ ID NO: 2100006 - RNA, 14 nt, Human
ccaugguugagaaa

SEQ ID NO: 2100007 - RNA, 14 nt, Human
ccauguaaaacaaa

SEQ ID NO: 2100008 - RNA, 16 nt, Human
ccauguaaaacaaaaa

SEQ ID NO: 2100009 - RNA, 17 nt, Human
ccauguaaaacaaaaaa

SEQ ID NO: 2100010 - RNA, 23 nt, Human
ccaugagccucagcauccuggca

SEQ ID NO: 2100011 - RNA, 21 nt, Human
ccaugagccucagcauccugg

SEQ ID NO: 2100012 - RNA, 17 nt, Human
ccaugagcuccagaccc

SEQ ID NO: 2100013 - RNA, 18 nt, Human
ccaugagcuccagacccc

SEQ ID NO: 2100014 - RNA, 19 nt, Human
ccaugagcuccagaccccc

SEQ ID NO: 2100015 - RNA, 23 nt, Human
ccaugagcuccagacccccagca

SEQ ID NO: 2100016 - RNA, 13 nt, Human
ccaugagcuccag

SEQ ID NO: 2100017 - RNA, 15 nt, Human
ccaugagcuccagac

SEQ ID NO: 2100018 - RNA, 16 nt, Human
ccaugagcuccagacc

SEQ ID NO: 2100019 - RNA, 21 nt, Human
ccaguuucagguguuuaguug

SEQ ID NO: 2100020 - RNA, 21 nt, Human
ccaguugucccgauuguaacu

SEQ ID NO: 2100021 - RNA, 22 nt, Human
ccaguugucccgauuguaacuc

SEQ ID NO: 2100022 - RNA, 18 nt, Human
ccaguuguauauuauucu

SEQ ID NO: 2100023 - RNA, 21 nt, Human
ccaguuccuuucaaugguuug

SEQ ID NO: 2100024 - RNA, 22 nt, Human
ccaguuccuuucaaugguuugc

SEQ ID NO: 2100025 - RNA, 23 nt, Human
ccaguuccuuucaaugguuugca

SEQ ID NO: 2100026 - RNA, 13 nt, Human
ccaguuugcagaa

SEQ ID NO: 2100027 - RNA, 23 nt, Human
ccaugaccagaagggaaacaguc

SEQ ID NO: 2100028 - RNA, 14 nt, Human
ccaugaccauacug

SEQ ID NO: 2100029 - RNA, 22 nt, Human
ccaugacaacuucuaauugcca

SEQ ID NO: 2100030 - RNA, 18 nt, Human
ccaugaauguaucaggaa

SEQ ID NO: 2100031 - RNA, 19 nt, Human
ccaugaauguaucaggaaa

SEQ ID NO: 2100032 - RNA, 20 nt, Human
ccaguuggguggaugccugg

SEQ ID NO: 2100033 - RNA, 19 nt, Human
ccaguuggguggaugccug

SEQ ID NO: 2100034 - RNA, 17 nt, Human
ccaguuggguggaugcc

SEQ ID NO: 2100035 - RNA, 20 nt, Human
ccaguuauuuuccgcccuca

SEQ ID NO: 2100036 - RNA, 17 nt, Human
ccaguuaugugaaugau

SEQ ID NO: 2100037 - RNA, 14 nt, Human
ccaguucaggaguc

SEQ ID NO: 2100038 - RNA, 18 nt, Human
ccaguucaggagucccaa

SEQ ID NO: 2100039 - RNA, 21 nt, Human
ccaguucaggagucccaagga

SEQ ID NO: 2100040 - RNA, 12 nt, Human
cccacccccauc

SEQ ID NO: 2100041 - RNA, 18 nt, Human
cccacccugaaagcccug

SEQ ID NO: 2100042 - RNA, 13 nt, Human
cccaccccccuca

SEQ ID NO: 2100043 - RNA, 14 nt, Human
cccaccccccucau

SEQ ID NO: 2100044 - RNA, 12 nt, Human
cccacucacaga

SEQ ID NO: 2100045 - RNA, 14 nt, Human
cccacucacagaga

SEQ ID NO: 2100046 - RNA, 16 nt, Human
cccacucaagccaagc

SEQ ID NO: 2100047 - RNA, 17 nt, Human
cccacucaagccaagca

SEQ ID NO: 2100048 - RNA, 19 nt, Human
cccacucaagccaagcagc

SEQ ID NO: 2100049 - RNA, 20 nt, Human
cccacucaagccaagcagcc

SEQ ID NO: 2100050 - RNA, 23 nt, Human
cccacucaagccaagcagccaag

SEQ ID NO: 2100051 - RNA, 17 nt, Human
cccacguucucucugcc

SEQ ID NO: 2100052 - RNA, 18 nt, Human
cccacguucucucugccu

SEQ ID NO: 2100053 - RNA, 23 nt, Human
cccacguucucucugccugugag

SEQ ID NO: 2100054 - RNA, 17 nt, Human
cccacuccccaccuuca

SEQ ID NO: 2100055 - RNA, 15 nt, Human
cccacugcaggcccc

SEQ ID NO: 2100056 - RNA, 23 nt, Human
cccacugcaggccccgcuugucc

SEQ ID NO: 2100057 - RNA, 19 nt, Human
cccacugcaggccccgcuu

SEQ ID NO: 2100058 - RNA, 13 nt, Human
cccacugccugcc

SEQ ID NO: 2100059 - RNA, 16 nt, Human
cccacugccugcccac

SEQ ID NO: 2100060 - RNA, 13 nt, Human
cccacugcucugg

SEQ ID NO: 2100061 - RNA, 12 nt, Human
cccacugcucug

SEQ ID NO: 2100062 - RNA, 19 nt, Human
cccacugcuuuuggucugu

SEQ ID NO: 2100063 - RNA, 22 nt, Human
cccacugcuuuuggucugugug

SEQ ID NO: 2100064 - RNA, 14 nt, Human
cccacugccugccc

SEQ ID NO: 2100065 - RNA, 15 nt, Human
cccacugccugccca

SEQ ID NO: 2100066 - RNA, 13 nt, Human
cccagcugcaccu

SEQ ID NO: 2100067 - RNA, 18 nt, Human
cccagcugcaccugccag

SEQ ID NO: 2100068 - RNA, 21 nt, Human
cccagcugcaccugccagccu

SEQ ID NO: 2100069 - RNA, 22 nt, Human
cccagcugcaccugccagccug

SEQ ID NO: 2100070 - RNA, 22 nt, Human
cccagcuuaaaggggcuagagu

SEQ ID NO: 2100071 - RNA, 12 nt, Human
cccagcugcacc

SEQ ID NO: 2100072 - RNA, 22 nt, Human
cccagccaccccgggcucucug

SEQ ID NO: 2100073 - RNA, 14 nt, Human
cccagccaccccgg

SEQ ID NO: 2100074 - RNA, 19 nt, Human
cccagccaccccgggcucu

SEQ ID NO: 2100075 - RNA, 18 nt, Human
cccauacucugucucccu

SEQ ID NO: 2100076 - RNA, 16 nt, Human
cccauagcuuccauga

SEQ ID NO: 2100077 - RNA, 13 nt, Human
cccauagcuucca

SEQ ID NO: 2100078 - RNA, 19 nt, Human
cccauagugaccggcugcu

SEQ ID NO: 2100079 - RNA, 22 nt, Human
cccagggccagggcccugcaga

SEQ ID NO: 2100080 - RNA, 15 nt, Human
cccagggcuacccuc

SEQ ID NO: 2100081 - RNA, 17 nt, Human
cccaggcuggcgugcag

SEQ ID NO: 2100082 - RNA, 21 nt, Human
cccagggccagggcccugcag

SEQ ID NO: 2100083 - RNA, 13 nt, Human
cccaggcuggcgu

SEQ ID NO: 2100084 - RNA, 23 nt, Human
cccagcugcaccugccagccugg

SEQ ID NO: 2100085 - RNA, 22 nt, Human
cccauccuccccuucccugcaa

SEQ ID NO: 2100086 - RNA, 14 nt, Human
cccauccuccccuu

SEQ ID NO: 2100087 - RNA, 15 nt, Human
cccauccuccccuuc

SEQ ID NO: 2100088 - RNA, 16 nt, Human
cccauccuccccuucc

SEQ ID NO: 2100089 - RNA, 18 nt, Human
cccauccuccccuucccu

SEQ ID NO: 2100090 - RNA, 12 nt, Human
cccauccucccc

SEQ ID NO: 2100091 - RNA, 13 nt, Human
cccauccuccccu

SEQ ID NO: 2100092 - RNA, 23 nt, Human
ccccgaggccuucucugaaggac

SEQ ID NO: 2100093 - RNA, 13 nt, Human
ccccgagcugggg

SEQ ID NO: 2100094 - RNA, 14 nt, Human
ccccgagcccuacu

SEQ ID NO: 2100095 - RNA, 12 nt, Human
ccccgagcuggg

SEQ ID NO: 2100096 - RNA, 14 nt, Human
ccccgcuucugccu

SEQ ID NO: 2100097 - RNA, 15 nt, Human
ccccgcuuguccagc

SEQ ID NO: 2100098 - RNA, 17 nt, Human
ccccgcuuguccagcgc

SEQ ID NO: 2100099 - RNA, 18 nt, Human
ccccgcuuguccagcgcc

SEQ ID NO: 2100100 - RNA, 19 nt, Human
ccccgcuuguccagcgccu

SEQ ID NO: 2100101 - RNA, 12 nt, Human
cccccaaagugg

SEQ ID NO: 2100102 - RNA, 22 nt, Human
ccccagcaagugagagcugggu

SEQ ID NO: 2100103 - RNA, 11 nt, Human
ccccagcacua

SEQ ID NO: 2100104 - RNA, 19 nt, Human
ccccagcacuaaagcagug

SEQ ID NO: 2100105 - RNA, 21 nt, Human
ccccagcaagugagagcuggg

SEQ ID NO: 2100106 - RNA, 12 nt, Human
ccccagagcugu

SEQ ID NO: 2100107 - RNA, 21 nt, Human
ccccagagcuguuuauggccu

SEQ ID NO: 2100108 - RNA, 22 nt, Human
ccccagagcuguuuauggccuc

SEQ ID NO: 2100109 - RNA, 23 nt, Human
ccccagagcuguuuauggccuca

SEQ ID NO: 2100110 - RNA, 10 nt, Human
ccccagagac

SEQ ID NO: 2100111 - RNA, 21 nt, Human
ccccagagacucagagggagg

SEQ ID NO: 2100112 - RNA, 11 nt, Human
ccccagagcug

SEQ ID NO: 2100113 - RNA, 20 nt, Human
ccccauuucuauuuauuuac

SEQ ID NO: 2100114 - RNA, 17 nt, Human
ccccauuucuauuuauu

SEQ ID NO: 2100115 - RNA, 13 nt, Human
ccccauuucuauu

SEQ ID NO: 2100116 - RNA, 14 nt, Human
ccccaucucuacua

SEQ ID NO: 2100117 - RNA, 19 nt, Human
ccccaucucucccuccccu

SEQ ID NO: 2100118 - RNA, 12 nt, Human
ccccaucucucc

SEQ ID NO: 2100119 - RNA, 16 nt, Human
ccccaucucucccucc

SEQ ID NO: 2100120 - RNA, 12 nt, Human
cccauugucuuc

SEQ ID NO: 2100121 - RNA, 15 nt, Human
ccccaaagaagaagu

SEQ ID NO: 2100122 - RNA, 19 nt, Human
ccccaaacgggcugcccug

SEQ ID NO: 2100123 - RNA, 17 nt, Human
cccuauugguaaagaau

SEQ ID NO: 2100124 - RNA, 18 nt, Human
cccuauuagagaagagau

SEQ ID NO: 2100125 - RNA, 23 nt, Human
cccgggaggcagagguugcagug

SEQ ID NO: 2100126 - RNA, 23 nt, Human
cccgggacucacuggcagcccca

SEQ ID NO: 2100127 - RNA, 24 nt, Human
cccgggacucacuggcagccccag

SEQ ID NO: 2100128 - RNA, 22 nt, Human
cccggcucgagcaguccugccu

SEQ ID NO: 2100129 - RNA, 16 nt, Human
cccggcuccaggcucc

SEQ ID NO: 2100130 - RNA, 15 nt, Human
cccggcuccaggcuc

SEQ ID NO: 2100131 - RNA, 14 nt, Human
cccggcuccaggcu

SEQ ID NO: 2100132 - RNA, 13 nt, Human
cccggcuccaggc

SEQ ID NO: 2100133 - RNA, 12 nt, Human
cccggcuccagg

SEQ ID NO: 2100134 - RNA, 11 nt, Human
cccggcuccag

SEQ ID NO: 2100135 - RNA, 17 nt, Human
ccccuuuuucuuccuca

SEQ ID NO: 2100136 - RNA, 14 nt, Human
cccgaauagcuggg

SEQ ID NO: 2100137 - RNA, 20 nt, Human
ccccuuugaugauuaauuca

SEQ ID NO: 2100138 - RNA, 18 nt, Human
ccccuuuuuacuccccuu

SEQ ID NO: 2100139 - RNA, 19 nt, Human
ccccuuuuuacuccccuug

SEQ ID NO: 2100140 - RNA, 23 nt, Human
ccccuugcccagggcucagccug

SEQ ID NO: 2100141 - RNA, 17 nt, Human
ccccuugcccagggcuc

SEQ ID NO: 2100142 - RNA, 20 nt, Human
ccccuugcccagggcucagc

SEQ ID NO: 2100143 - RNA, 21 nt, Human
ccccuugcccagggcucagcc

SEQ ID NO: 2100144 - RNA, 12 nt, Human
ccccucuugccc

SEQ ID NO: 2100145 - RNA, 22 nt, Human
ccccuugcucuccccugcccug

SEQ ID NO: 2100146 - RNA, 19 nt, Human
auuagcauuugucaacaaa

SEQ ID NO: 2100147 - RNA, 17 nt, Human
auuagcaguuugcuuug

SEQ ID NO: 2100148 - RNA, 14 nt, Human
auuagauuauauug

SEQ ID NO: 2100149 - RNA, 21 nt, Human
auuagauuauauugagacaaa

SEQ ID NO: 2100150 - RNA, 18 nt, Human
auuagccgggcauggugg

SEQ ID NO: 2100151 - RNA, 15 nt, Human
auuagccagguaaug

SEQ ID NO: 2100152 - RNA, 17 nt, Human
auuagccacaaaauugg

SEQ ID NO: 2100153 - RNA, 14 nt, Human
auuagcauuuaguc

SEQ ID NO: 2100154 - RNA, 16 nt, Human
auuacaggugugaacc

SEQ ID NO: 2100155 - RNA, 21 nt, Human
auuacagagaggagaaacaca

SEQ ID NO: 2100156 - RNA, 22 nt, Human
auuacagagaggagaaacacau

SEQ ID NO: 2100157 - RNA, 15 nt, Human
auuacaacagugaga

SEQ ID NO: 2100158 - RNA, 19 nt, Human
auuacagagaggagaaaca

SEQ ID NO: 2100159 - RNA, 14 nt, Human
auuaauuaaaugca

SEQ ID NO: 2100160 - RNA, 19 nt, Human
auuaauucaccuuccagug

SEQ ID NO: 2100161 - RNA, 18 nt, Human
auguuuguggccucagaa

SEQ ID NO: 2100162 - RNA, 14 nt, Human
auguuuguggccuc

SEQ ID NO: 2100163 - RNA, 15 nt, Human
auguuuguggccuca

SEQ ID NO: 2100164 - RNA, 16 nt, Human
auguuuguggccucag

SEQ ID NO: 2100165 - RNA, 17 nt, Human
auguuuguggccucaga

SEQ ID NO: 2100166 - RNA, 23 nt, Human
auguuuguccugaacacuuuugu

SEQ ID NO: 2100167 - RNA, 10 nt, Human
auguuugugg

SEQ ID NO: 2100168 - RNA, 13 nt, Human
auguuuguggccu

SEQ ID NO: 2100169 - RNA, 23 nt, Human
auguuugggagacugcugaguca

SEQ ID NO: 2100170 - RNA, 18 nt, Human
auguuugccucugccucu

SEQ ID NO: 2100171 - RNA, 15 nt, Human
auuagggguugcuaa

SEQ ID NO: 2100172 - RNA, 22 nt, Human
auuagggguugcuaagaagcga

SEQ ID NO: 2100173 - RNA, 16 nt, Human
auuagcugugugaaau

SEQ ID NO: 2100174 - RNA, 15 nt, Human
auuagcuuuacuguu

SEQ ID NO: 2100175 - RNA, 20 nt, Human
auuagcuuuacuguuuguua

SEQ ID NO: 2100176 - RNA, 15 nt, Human
auuaggaaaauaugg

SEQ ID NO: 2100177 - RNA, 20 nt, Human
auuaggaaguguaacagcug

SEQ ID NO: 2100178 - RNA, 22 nt, Human
auuaggaaguguaacagcugag

SEQ ID NO: 2100179 - RNA, 13 nt, Human
auuaggaauaaau

SEQ ID NO: 2100180 - RNA, 16 nt, Human
auuaggaauaaauaaa

SEQ ID NO: 2100181 - RNA, 21 nt, Human
auuaggaaguguaacagcuga

SEQ ID NO: 2100182 - RNA, 13 nt, Human
auuagguuaacua

SEQ ID NO: 2100183 - RNA, 15 nt, Human
auuagguuaacuaug

SEQ ID NO: 2100184 - RNA, 19 nt, Human
auuagguuaacuauguaca

SEQ ID NO: 2100185 - RNA, 20 nt, Human
auuagguuaacuauguacaa

SEQ ID NO: 2100186 - RNA, 18 nt, Human
auucaauuccucugggaa

SEQ ID NO: 2100187 - RNA, 17 nt, Human
auucaauuccucuggga

SEQ ID NO: 2100188 - RNA, 13 nt, Human
auucacaagcugc

SEQ ID NO: 2100189 - RNA, 14 nt, Human
auucacaagcugcc

SEQ ID NO: 2100190 - RNA, 15 nt, Human
auucacaagcugccu

SEQ ID NO: 2100191 - RNA, 16 nt, Human
auucacaagcugccuc

SEQ ID NO: 2100192 - RNA, 20 nt, Human
auucacaagcugccucccug

SEQ ID NO: 2100193 - RNA, 13 nt, Human
auucacaauagaa

SEQ ID NO: 2100194 - RNA, 14 nt, Human
auucacaauagaaa

SEQ ID NO: 2100195 - RNA, 22 nt, Human
auucacaaugaaaugcucuccu

SEQ ID NO: 2100196 - RNA, 23 nt, Human
auucaauguuuaugcaaggaagg

SEQ ID NO: 2100197 - RNA, 14 nt, Human
auucaaauaccaau

SEQ ID NO: 2100198 - RNA, 22 nt, Human
auucaauguuuaugcaaggaag

SEQ ID NO: 2100199 - RNA, 16 nt, Human
auucaauuccucuggg

SEQ ID NO: 2100200 - RNA, 14 nt, Human
auucaauuccucug

SEQ ID NO: 2100201 - RNA, 21 nt, Human
auuaugcaggggcaaacaccu

SEQ ID NO: 2100202 - RNA, 15 nt, Human
auuaugcauaacuga

SEQ ID NO: 2100203 - RNA, 17 nt, Human
auuaugcauaacugaca

SEQ ID NO: 2100204 - RNA, 14 nt, Human
auuaugcaaauucc

SEQ ID NO: 2100205 - RNA, 17 nt, Human
auuaugcaaauucccag

SEQ ID NO: 2100206 - RNA, 21 nt, Human
auuaugaugugggucaaggaa

SEQ ID NO: 2100207 - RNA, 16 nt, Human
auuaugacaguuauac

SEQ ID NO: 2100208 - RNA, 17 nt, Human
auuaugacaguuauacu

SEQ ID NO: 2100209 - RNA, 19 nt, Human
auuaugacaguuauacugu

SEQ ID NO: 2100210 - RNA, 14 nt, Human
auuaugacuguuuu

SEQ ID NO: 2100211 - RNA, 21 nt, Human
auuaugacuguuuuuuaaacu

SEQ ID NO: 2100212 - RNA, 20 nt, Human
auuaugagaggcaaugauug

SEQ ID NO: 2100213 - RNA, 12 nt, Human
auuaugacaguu

SEQ ID NO: 2100214 - RNA, 14 nt, Human
auuaugacaguuau

SEQ ID NO: 2100215 - RNA, 15 nt, Human
auuaugacaguuaua

SEQ ID NO: 2100216 - RNA, 22 nt, Human
auugcuacuguccuacccaccc

SEQ ID NO: 2100217 - RNA, 20 nt, Human
auugcuacuguccuacccac

SEQ ID NO: 2100218 - RNA, 17 nt, Human
auugauaugaaaaauau

SEQ ID NO: 2100219 - RNA, 15 nt, Human
auugcuacuuccugc

SEQ ID NO: 2100220 - RNA, 19 nt, Human
auugcuacuuccugccugg

SEQ ID NO: 2100221 - RNA, 23 nt, Human
auugcuacuuccugccuggucuc

SEQ ID NO: 2100222 - RNA, 17 nt, Human
auugauaugcuuauaca

SEQ ID NO: 2100223 - RNA, 19 nt, Human
auugauauaaauaaaacau

SEQ ID NO: 2100224 - RNA, 21 nt, Human
auugauauacacggaugacuu

SEQ ID NO: 2100225 - RNA, 18 nt, Human
auugauauaaauaaaaca

SEQ ID NO: 2100226 - RNA, 14 nt, Human
auugauaugaaaaa

SEQ ID NO: 2100227 - RNA, 15 nt, Human
auugauaugaaaaau

SEQ ID NO: 2100228 - RNA, 16 nt, Human
auugauaugaaaaaua

SEQ ID NO: 2100229 - RNA, 15 nt, Human
auugcuacuguccua

SEQ ID NO: 2100230 - RNA, 12 nt, Human
auugauaauaaa

SEQ ID NO: 2100231 - RNA, 13 nt, Human
auugauaauaaac

SEQ ID NO: 2100232 - RNA, 14 nt, Human
auucuucugcuuca

SEQ ID NO: 2100233 - RNA, 16 nt, Human
auucuugaaagcugug

SEQ ID NO: 2100234 - RNA, 22 nt, Human
auucuucuuccaacguggccca

SEQ ID NO: 2100235 - RNA, 13 nt, Human
auucuugaguuua

SEQ ID NO: 2100236 - RNA, 12 nt, Human
auucuucugcuu

SEQ ID NO: 2100237 - RNA, 11 nt, Human
auucuucugcu

SEQ ID NO: 2100238 - RNA, 12 nt, Human
auucucuuuggu

SEQ ID NO: 2100239 - RNA, 20 nt, Human
auucucuuugguguacaaaa

SEQ ID NO: 2100240 - RNA, 13 nt, Human
auuguaauguuac

SEQ ID NO: 2100241 - RNA, 15 nt, Human
auuguaauguuacug

SEQ ID NO: 2100242 - RNA, 17 nt, Human
auuguaauguuacugau

SEQ ID NO: 2100243 - RNA, 24 nt, Human
auuguaauguuacugaucaugcau

SEQ ID NO: 2100244 - RNA, 15 nt, Human
auuguaaauacaagu

SEQ ID NO: 2100245 - RNA, 16 nt, Human
auuguaaauacaaguu

SEQ ID NO: 2100246 - RNA, 23 nt, Human
auuguaaauacaaguucuauuua

SEQ ID NO: 2100247 - RNA, 18 nt, Human
auugcuugagcucaggag

SEQ ID NO: 2100248 - RNA, 23 nt, Human
auugcuugaaagaaaauaugcau

SEQ ID NO: 2100249 - RNA, 23 nt, Human
auuguaaacaaacuguguaacug

SEQ ID NO: 2100250 - RNA, 12 nt, Human
auuguaaacugu

SEQ ID NO: 2100251 - RNA, 13 nt, Human
auuguaaacugua

SEQ ID NO: 2100252 - RNA, 14 nt, Human
auuguaaacuguac

SEQ ID NO: 2100253 - RNA, 15 nt, Human
auuguaaacuguacu

SEQ ID NO: 2100254 - RNA, 17 nt, Human
auuguaaacuguacuag

SEQ ID NO: 2100255 - RNA, 12 nt, Human
auuguuccaaga

SEQ ID NO: 2100256 - RNA, 14 nt, Human
auuguuccaagaca

SEQ ID NO: 2100257 - RNA, 20 nt, Human
auuguguggucaguggcucu

SEQ ID NO: 2100258 - RNA, 12 nt, Human
auugcugcuuga

SEQ ID NO: 2100259 - RNA, 18 nt, Human
auugcugcuccuuagcug

SEQ ID NO: 2100260 - RNA, 20 nt, Human
auugcugcuccuuagcugcc

SEQ ID NO: 2100261 - RNA, 21 nt, Human
auugcugcuccuuagcugcca

SEQ ID NO: 2100262 - RNA, 22 nt, Human
auugcugcuccuuagcugccaa

SEQ ID NO: 2100263 - RNA, 19 nt, Human
auugcuggcaaagacagaa

SEQ ID NO: 2100264 - RNA, 20 nt, Human
auugcuggcaaagacagaag

SEQ ID NO: 2100265 - RNA, 13 nt, Human
auugcuucuguag

SEQ ID NO: 2100266 - RNA, 15 nt, Human
auugcuucuguagua

SEQ ID NO: 2100267 - RNA, 22 nt, Human
auugcuucuguaguacuccuua

SEQ ID NO: 2100268 - RNA, 20 nt, Human
auugcuucacaacccaucua

SEQ ID NO: 2100269 - RNA, 22 nt, Human
auugcuggcaaagacagaagcc

SEQ ID NO: 2100270 - RNA, 15 nt, Human
auugcuggucuugua

SEQ ID NO: 2100271 - RNA, 16 nt, Human
auugcuggucuuguaa

SEQ ID NO: 2100272 - RNA, 17 nt, Human
auugcuggucuuguaag

SEQ ID NO: 2100273 - RNA, 18 nt, Human
auugcuggucuuguaaga

SEQ ID NO: 2100274 - RNA, 19 nt, Human
auugcuggucuuguaagag

SEQ ID NO: 2100275 - RNA, 16 nt, Human
auugcuugaaagaaaa

SEQ ID NO: 2100276 - RNA, 17 nt, Human
auugcuugagcccagga

SEQ ID NO: 2100277 - RNA, 18 nt, Human
auugcuugagcccaggag

SEQ ID NO: 2100278 - RNA, 14 nt, Human
auugcuugagcuca

SEQ ID NO: 2100279 - RNA, 23 nt, Human
auugcucaaguucauugaugacc

SEQ ID NO: 2100280 - RNA, 12 nt, Human
auugcuccuuga

SEQ ID NO: 2100281 - RNA, 17 nt, Human
auugaguaagauuuacc

SEQ ID NO: 2100282 - RNA, 22 nt, Human
auuguugagguggucugaaugu

SEQ ID NO: 2100283 - RNA, 23 nt, Human
auuguugagguggucugaauguu

SEQ ID NO: 2100284 - RNA, 20 nt, Human
auuguugagguggucugaau

SEQ ID NO: 2100285 - RNA, 21 nt, Human
auuguugagguggucugaaug

SEQ ID NO: 2100286 - RNA, 15 nt, Human
auuguuccaagacau

SEQ ID NO: 2100287 - RNA, 16 nt, Human
auuguuccaagacauu

SEQ ID NO: 2100288 - RNA, 17 nt, Human
auuguuccaagacauug

SEQ ID NO: 2100289 - RNA, 18 nt, Human
auuguuccaagacauugu

SEQ ID NO: 2100290 - RNA, 21 nt, Human
auuguuccaagacauugucaa

SEQ ID NO: 2100291 - RNA, 20 nt, Human
auuguuccaagacauuguca

SEQ ID NO: 2100292 - RNA, 23 nt, Human
auuuguuuauuuuuauauagcuu

SEQ ID NO: 2100293 - RNA, 21 nt, Human
auuuuaugaaagguuuacauu

SEQ ID NO: 2100294 - RNA, 18 nt, Human
auuuguuuuagaaugaug

SEQ ID NO: 2100295 - RNA, 18 nt, Human
auuuuauagcucaguuua

SEQ ID NO: 2100296 - RNA, 19 nt, Human
auuuuauagcucaguuuau

SEQ ID NO: 2100297 - RNA, 22 nt, Human
auuuuauagcucaguuuaucca

SEQ ID NO: 2100298 - RNA, 16 nt, Human
auuuuaugaaugucuu

SEQ ID NO: 2100299 - RNA, 16 nt, Human
auuuguguaauaaagu

SEQ ID NO: 2100300 - RNA, 17 nt, Human
auuuguguaauaaagug

SEQ ID NO: 2100301 - RNA, 18 nt, Human
auuuguguaauaaagugu

SEQ ID NO: 2100302 - RNA, 20 nt, Human
auuuguguaauaaaguguuu

SEQ ID NO: 2100303 - RNA, 21 nt, Human
auuuguguaauaaaguguuuu

SEQ ID NO: 2100304 - RNA, 22 nt, Human
auuuguguaauaaaguguuuuc

SEQ ID NO: 2100305 - RNA, 17 nt, Human
auuugcuaucaaaauaa

SEQ ID NO: 2100306 - RNA, 18 nt, Human
auuugcuuauuuaauaaa

SEQ ID NO: 2100307 - RNA, 12 nt, Human
auuuggaaaaua

SEQ ID NO: 2100308 - RNA, 13 nt, Human
auuuggaaaauaa

SEQ ID NO: 2100309 - RNA, 20 nt, Human
auuuuaugccuuuuauuucu

SEQ ID NO: 2100310 - RNA, 21 nt, Human
auuuuaugccuuuuauuucuu

SEQ ID NO: 2100311 - RNA, 14 nt, Human
auuugccaaaauaa

SEQ ID NO: 2100312 - RNA, 17 nt, Human
auuugccaaaauaaugu

SEQ ID NO: 2100313 - RNA, 20 nt, Human
auuugccaaaauaaugucuu

SEQ ID NO: 2100314 - RNA, 18 nt, Human
auuugcgcacaacuuaaa

SEQ ID NO: 2100315 - RNA, 15 nt, Human
auuugccugugccac

SEQ ID NO: 2100316 - RNA, 15 nt, Human
auuugcccauuuaca

SEQ ID NO: 2100317 - RNA, 19 nt, Human
auuugcccauuuacacuuu

SEQ ID NO: 2100318 - RNA, 20 nt, Human
auuugcccauuuacacuuuu

SEQ ID NO: 2100319 - RNA, 21 nt, Human
auuugcccauuuacacuuuug

SEQ ID NO: 2100320 - RNA, 21 nt, Human
auuugccuguuucugcuugcu

SEQ ID NO: 2100321 - RNA, 15 nt, Human
auuugcgaaugguuc

SEQ ID NO: 2100322 - RNA, 23 nt, Human
auuugauucuguguguuuucaua

SEQ ID NO: 2100323 - RNA, 17 nt, Human
auuugcauauguaugac

SEQ ID NO: 2100324 - RNA, 15 nt, Human
auuugcauauguaug

SEQ ID NO: 2100325 - RNA, 17 nt, Human
caaagcacauugaaaga

SEQ ID NO: 2100326 - RNA, 18 nt, Human
caaagcacauugaaagag

SEQ ID NO: 2100327 - RNA, 22 nt, Human
caaagauguuugucagauauga

SEQ ID NO: 2100328 - RNA, 16 nt, Human
caaagauguuugucag

SEQ ID NO: 2100329 - RNA, 18 nt, Human
caaagauguuugucagau

SEQ ID NO: 2100330 - RNA, 13 nt, Human
caaagucuccagc

SEQ ID NO: 2100331 - RNA, 14 nt, Human
caaagucuccagcc

SEQ ID NO: 2100332 - RNA, 14 nt, Human
caaaguagaagucu

SEQ ID NO: 2100333 - RNA, 21 nt, Human
caaaguagaagucuuagaugu

SEQ ID NO: 2100334 - RNA, 18 nt, Human
caaaguaaaacuugcugc

SEQ ID NO: 2100335 - RNA, 16 nt, Human
caaaguaaaacuugcu

SEQ ID NO: 2100336 - RNA, 14 nt, Human
caaagguauaauuu

SEQ ID NO: 2100337 - RNA, 13 nt, Human
caacacguuacua

SEQ ID NO: 2100338 - RNA, 15 nt, Human
caaaugcuguauucu

SEQ ID NO: 2100339 - RNA, 14 nt, Human
caacaagagcgaaa

SEQ ID NO: 2100340 - RNA, 18 nt, Human
caacaagggcaguggagg

SEQ ID NO: 2100341 - RNA, 19 nt, Human
caacaagggcaguggaggu

SEQ ID NO: 2100342 - RNA, 20 nt, Human
caacaccucugcacaagcug

SEQ ID NO: 2100343 - RNA, 21 nt, Human
caaaagauguauccuuccaau

SEQ ID NO: 2100344 - RNA, 16 nt, Human
caaacagcucaggcug

SEQ ID NO: 2100345 - RNA, 13 nt, Human
caaacagccacac

SEQ ID NO: 2100346 - RNA, 13 nt, Human
caaacccaguguu

SEQ ID NO: 2100347 - RNA, 24 nt, Human
caaacccaguguuuuaggagcaug

SEQ ID NO: 2100348 - RNA, 15 nt, Human
caaaagggacaugaa

SEQ ID NO: 2100349 - RNA, 19 nt, Human
auuuuuuuuuuaaauuauu

SEQ ID NO: 2100350 - RNA, 16 nt, Human
caaaagaugcuucuca

SEQ ID NO: 2100351 - RNA, 18 nt, Human
caaaagaugcuucucacu

SEQ ID NO: 2100352 - RNA, 19 nt, Human
caaaaggcaguggggcugg

SEQ ID NO: 2100353 - RNA, 20 nt, Human
caaaaggcaguggggcuggg

SEQ ID NO: 2100354 - RNA, 21 nt, Human
caaaaggcaguggggcugggg

SEQ ID NO: 2100355 - RNA, 20 nt, Human
caccuacaguguacagucuu

SEQ ID NO: 2100356 - RNA, 13 nt, Human
caccucagccucc

SEQ ID NO: 2100357 - RNA, 18 nt, Human
caccucagccuccugugu

SEQ ID NO: 2100358 - RNA, 14 nt, Human
caccucagccuccc

SEQ ID NO: 2100359 - RNA, 13 nt, Human
caccuacagugua

SEQ ID NO: 2100360 - RNA, 14 nt, Human
caccuaauguuuau

SEQ ID NO: 2100361 - RNA, 20 nt, Human
caccuaauguuuaugagcca

SEQ ID NO: 2100362 - RNA, 21 nt, Human
caccuaauguuuaugagccag

SEQ ID NO: 2100363 - RNA, 16 nt, Human
caccuacaguguacag

SEQ ID NO: 2100364 - RNA, 17 nt, Human
caccuacaguguacagu

SEQ ID NO: 2100365 - RNA, 23 nt, Human
caccugccucggccucccaaagu

SEQ ID NO: 2100366 - RNA, 13 nt, Human
caccugccgaccu

SEQ ID NO: 2100367 - RNA, 23 nt, Human
caccugcccccuucucccacacu

SEQ ID NO: 2100368 - RNA, 21 nt, Human
caccugccgaccucguccucc

SEQ ID NO: 2100369 - RNA, 23 nt, Human
caccugccgaccucguccucccc

SEQ ID NO: 2100370 - RNA, 19 nt, Human
caccugcccccuucuccca

SEQ ID NO: 2100371 - RNA, 20 nt, Human
caccugcccccuucucccac

SEQ ID NO: 2100372 - RNA, 21 nt, Human
caccugcccccuucucccaca

SEQ ID NO: 2100373 - RNA, 22 nt, Human
caccugcccccuucucccacac

SEQ ID NO: 2100374 - RNA, 12 nt, Human
caccucagccuu

SEQ ID NO: 2100375 - RNA, 13 nt, Human
caccucagccuug

SEQ ID NO: 2100376 - RNA, 15 nt, Human
caccucaggccaggu

SEQ ID NO: 2100377 - RNA, 15 nt, Human
caccucagccuugga

SEQ ID NO: 2100378 - RNA, 23 nt, Human
caccucaggccaggugcaguggc

SEQ ID NO: 2100379 - RNA, 15 nt, Human
caccugcccccuucu

SEQ ID NO: 2100380 - RNA, 17 nt, Human
caccugcccccuucucc

SEQ ID NO: 2100381 - RNA, 14 nt, Human
cacccucccagcuc

SEQ ID NO: 2100382 - RNA, 15 nt, Human
cacccucccagcucu

SEQ ID NO: 2100383 - RNA, 16 nt, Human
cacccucccagcucug

SEQ ID NO: 2100384 - RNA, 14 nt, Human
cacccucaggcagg

SEQ ID NO: 2100385 - RNA, 16 nt, Human
cacccuggggagaaag

SEQ ID NO: 2100386 - RNA, 15 nt, Human
cacccuggggagaaa

SEQ ID NO: 2100387 - RNA, 17 nt, Human
cacccugaaagcccuga

SEQ ID NO: 2100388 - RNA, 15 nt, Human
cacccucucccagga

SEQ ID NO: 2100389 - RNA, 16 nt, Human
cacccucucccaggac

SEQ ID NO: 2100390 - RNA, 13 nt, Human
caccuuggcugca

SEQ ID NO: 2100391 - RNA, 15 nt, Human
caccuuggcucaagu

SEQ ID NO: 2100392 - RNA, 14 nt, Human
caccuuggcucaag

SEQ ID NO: 2100393 - RNA, 14 nt, Human
caccuuggcugcag

SEQ ID NO: 2100394 - RNA, 14 nt, Human
caccccacccuucc

SEQ ID NO: 2100395 - RNA, 14 nt, Human
caccccacucacag

SEQ ID NO: 2100396 - RNA, 17 nt, Human
caccccacucacagaga

SEQ ID NO: 2100397 - RNA, 20 nt, Human
cacuccaggaaggggcugga

SEQ ID NO: 2100398 - RNA, 14 nt, Human
cacuccccugcacu

SEQ ID NO: 2100399 - RNA, 17 nt, Human
cacuccccugcacugga

SEQ ID NO: 2100400 - RNA, 14 nt, Human
cacugaauauuuau

SEQ ID NO: 2100401 - RNA, 13 nt, Human
cacugaauauuua

SEQ ID NO: 2100402 - RNA, 23 nt, Human
cacugaauuaaugacagagccag

SEQ ID NO: 2100403 - RNA, 19 nt, Human
cacugacacaaaaaguaga

SEQ ID NO: 2100404 - RNA, 13 nt, Human
cacuaggcugggu

SEQ ID NO: 2100405 - RNA, 14 nt, Human
cacuaggcugggug

SEQ ID NO: 2100406 - RNA, 15 nt, Human
cacuaggcugggugc

SEQ ID NO: 2100407 - RNA, 18 nt, Human
cacuaggcugggugccca

SEQ ID NO: 2100408 - RNA, 21 nt, Human
cacuaggcugggugcccacag

SEQ ID NO: 2100409 - RNA, 22 nt, Human
cacuaggcugggugcccacagc

SEQ ID NO: 2100410 - RNA, 23 nt, Human
cacuaggcugggugcccacagcc

SEQ ID NO: 2100411 - RNA, 16 nt, Human
cacuccagccugggug

SEQ ID NO: 2100412 - RNA, 16 nt, Human
cacuccaaucugggug

SEQ ID NO: 2100413 - RNA, 24 nt, Human
cacuuagaaauugcauuuccugac

SEQ ID NO: 2100414 - RNA, 13 nt, Human
cacuuauugcuuu

SEQ ID NO: 2100415 - RNA, 14 nt, Human
cacuuauugcuuug

SEQ ID NO: 2100416 - RNA, 15 nt, Human
cacuuauugcuuuga

SEQ ID NO: 2100417 - RNA, 23 nt, Human
cacuuauguuacugguguccagc

SEQ ID NO: 2100418 - RNA, 19 nt, Human
cacuuguauccucugguuc

SEQ ID NO: 2100419 - RNA, 16 nt, Human
cacuuacacuuuaugc

SEQ ID NO: 2100420 - RNA, 18 nt, Human
cacuuacacuuuaugcac

SEQ ID NO: 2100421 - RNA, 18 nt, Human
cacuuaccuagauuuaca

SEQ ID NO: 2100422 - RNA, 19 nt, Human
cacuuacagauaggccuuc

SEQ ID NO: 2100423 - RNA, 21 nt, Human
cacuuacagauaggccuucuu

SEQ ID NO: 2100424 - RNA, 23 nt, Human
cacuuacagauaggccuucuugu

SEQ ID NO: 2100425 - RNA, 13 nt, Human
cacuuaccuucaa

SEQ ID NO: 2100426 - RNA, 14 nt, Human
cacuuaccuucaau

SEQ ID NO: 2100427 - RNA, 15 nt, Human
cacuuaccuucaaua

SEQ ID NO: 2100428 - RNA, 16 nt, Human
cacuuaccuucaauaa

SEQ ID NO: 2100429 - RNA, 17 nt, Human
cacuuaccuucaauaaa

SEQ ID NO: 2100430 - RNA, 18 nt, Human
cacuuaccuucaauaaag

SEQ ID NO: 2100431 - RNA, 19 nt, Human
cacuuaccuucaauaaagu

SEQ ID NO: 2100432 - RNA, 21 nt, Human
cacuuaccuucaauaaaguau

SEQ ID NO: 2100433 - RNA, 23 nt, Human
cacugguggcccgacagccuggc

SEQ ID NO: 2100434 - RNA, 15 nt, Human
cacugggguccuggg

SEQ ID NO: 2100435 - RNA, 18 nt, Human
cacugggguccuggggcc

SEQ ID NO: 2100436 - RNA, 19 nt, Human
cacugggguccuggggccu

SEQ ID NO: 2100437 - RNA, 23 nt, Human
cacuggugugagggccccugccu

SEQ ID NO: 2100438 - RNA, 13 nt, Human
cacuuguuccagc

SEQ ID NO: 2100439 - RNA, 15 nt, Human
cacuuguuccagcuc

SEQ ID NO: 2100440 - RNA, 18 nt, Human
cacuuguuccagcucuuu

SEQ ID NO: 2100441 - RNA, 16 nt, Human
cacuuguuccagcucu

SEQ ID NO: 2100442 - RNA, 17 nt, Human
cacuuguuccagcucuu

SEQ ID NO: 2100443 - RNA, 12 nt, Human
cacugcagccuc

SEQ ID NO: 2100444 - RNA, 20 nt, Human
cacugcacuccagccugggu

SEQ ID NO: 2100445 - RNA, 12 nt, Human
cacugcacucca

SEQ ID NO: 2100446 - RNA, 13 nt, Human
cacugcacucuag

SEQ ID NO: 2100447 - RNA, 18 nt, Human
cacugcacucuagccgga

SEQ ID NO: 2100448 - RNA, 17 nt, Human
cacugcacuccagccug

SEQ ID NO: 2100449 - RNA, 20 nt, Human
cacugcacuccagccugggc

SEQ ID NO: 2100450 - RNA, 15 nt, Human
cacugcacuccagcc

SEQ ID NO: 2100451 - RNA, 16 nt, Human
cacugcacuccagccu

SEQ ID NO: 2100452 - RNA, 18 nt, Human
cacugcacuccagccugg

SEQ ID NO: 2100453 - RNA, 19 nt, Human
cacugcacuccagccuggg

SEQ ID NO: 2100454 - RNA, 19 nt, Human
cacugcacuauagccuagg

SEQ ID NO: 2100455 - RNA, 11 nt, Human
cacugccacac

SEQ ID NO: 2100456 - RNA, 13 nt, Human
cacugcagccuca

SEQ ID NO: 2100457 - RNA, 13 nt, Human
cacugcaggcccc

SEQ ID NO: 2100458 - RNA, 16 nt, Human
cacugcauaccaaccu

SEQ ID NO: 2100459 - RNA, 16 nt, Human
cacugcaggccccgcu

SEQ ID NO: 2100460 - RNA, 22 nt, Human
cacuggcugucaguaugacauu

SEQ ID NO: 2100461 - RNA, 13 nt, Human
cacuggcuguggg

SEQ ID NO: 2100462 - RNA, 14 nt, Human
cacuggcugugggc

SEQ ID NO: 2100463 - RNA, 17 nt, Human
cacuggcugugggcucc

SEQ ID NO: 2100464 - RNA, 18 nt, Human
cacuggcugugggcuccc

SEQ ID NO: 2100465 - RNA, 20 nt, Human
cacuggcugugggcucccuu

SEQ ID NO: 2100466 - RNA, 21 nt, Human
cacuggcugugggcucccuuc

SEQ ID NO: 2100467 - RNA, 14 nt, Human
cacugggggagggg

SEQ ID NO: 2100468 - RNA, 15 nt, Human
cacugggggagggga

SEQ ID NO: 2100469 - RNA, 18 nt, Human
cacugggggaggggacau

SEQ ID NO: 2100470 - RNA, 21 nt, Human
cacugggggaggggacauuga

SEQ ID NO: 2100471 - RNA, 17 nt, Human
caaguccacaguggaac

SEQ ID NO: 2100472 - RNA, 17 nt, Human
caagucaugugcauuuc

SEQ ID NO: 2100473 - RNA, 12 nt, Human
caagucacaaag

SEQ ID NO: 2100474 - RNA, 14 nt, Human
caagucacaaagga

SEQ ID NO: 2100475 - RNA, 16 nt, Human
caagucacaaaggaau

SEQ ID NO: 2100476 - RNA, 19 nt, Human
caagucacaaaggaaugga

SEQ ID NO: 2100477 - RNA, 19 nt, Human
caagucaaccaauguagaa

SEQ ID NO: 2100478 - RNA, 12 nt, Human
caagucauuuua

SEQ ID NO: 2100479 - RNA, 17 nt, Human
caagucauuuuaacuuu

SEQ ID NO: 2100480 - RNA, 21 nt, Human
caaguaugaauaaagacaccu

SEQ ID NO: 2100481 - RNA, 19 nt, Human
caaguaugaauaaagacac

SEQ ID NO: 2100482 - RNA, 15 nt, Human
caaguaugugagugu

SEQ ID NO: 2100483 - RNA, 13 nt, Human
caagucaagugaa

SEQ ID NO: 2100484 - RNA, 17 nt, Human
caagucaagugaaaaag

SEQ ID NO: 2100485 - RNA, 16 nt, Human
caaguaugaauaaaga

SEQ ID NO: 2100486 - RNA, 17 nt, Human
caagcuaggugcuaauu

SEQ ID NO: 2100487 - RNA, 12 nt, Human
caagcucacagu

SEQ ID NO: 2100488 - RNA, 16 nt, Human
caagcucacaguuccu

SEQ ID NO: 2100489 - RNA, 19 nt, Human
caagcucacaguuccucgc

SEQ ID NO: 2100490 - RNA, 20 nt, Human
caagcucacaguuccucgcc

SEQ ID NO: 2100491 - RNA, 21 nt, Human
caagcucacaguuccucgccc

SEQ ID NO: 2100492 - RNA, 22 nt, Human
caagcucacaguuccucgcccu

SEQ ID NO: 2100493 - RNA, 23 nt, Human
caagcuaauaaaauaucauucag

SEQ ID NO: 2100494 - RNA, 22 nt, Human
caagcuaauaaaauaucauuca

SEQ ID NO: 2100495 - RNA, 22 nt, Human
caagcuccuugggaggccccac

SEQ ID NO: 2100496 - RNA, 13 nt, Human
caagcucugcucc

SEQ ID NO: 2100497 - RNA, 17 nt, Human
caagcuccuugggaggc

SEQ ID NO: 2100498 - RNA, 14 nt, Human
caagcucugcuccu

SEQ ID NO: 2100499 - RNA, 13 nt, Human
caagcugcacccu

SEQ ID NO: 2100500 - RNA, 14 nt, Human
caagcugcacccuc

SEQ ID NO: 2100501 - RNA, 18 nt, Human
caagcugcacccucaggc

SEQ ID NO: 2100502 - RNA, 20 nt, Human
caagcugcacccucaggcag

SEQ ID NO: 2100503 - RNA, 15 nt, Human
caaggcacuguacua

SEQ ID NO: 2100504 - RNA, 16 nt, Human
caaggcacuguacuag

SEQ ID NO: 2100505 - RNA, 23 nt, Human
caagucccugacucucugugacc

SEQ ID NO: 2100506 - RNA, 20 nt, Human
caagucccugacucucugug

SEQ ID NO: 2100507 - RNA, 21 nt, Human
caagucccugacucucuguga

SEQ ID NO: 2100508 - RNA, 20 nt, Human
caaguccaggucgggcucag

SEQ ID NO: 2100509 - RNA, 22 nt, Human
caagucccaccgguugcuucug

SEQ ID NO: 2100510 - RNA, 23 nt, Human
caagucccaccgguugcuucugg

SEQ ID NO: 2100511 - RNA, 18 nt, Human
caagucccugacucucug

SEQ ID NO: 2100512 - RNA, 12 nt, Human
caauaaaguauc

SEQ ID NO: 2100513 - RNA, 16 nt, Human
caauaaaguaucuaca

SEQ ID NO: 2100514 - RNA, 11 nt, Human
caauaaaguau

SEQ ID NO: 2100515 - RNA, 16 nt, Human
caagcuaauaaaauau

SEQ ID NO: 2100516 - RNA, 17 nt, Human
caagcuaauaaaauauc

SEQ ID NO: 2100517 - RNA, 19 nt, Human
caagcuaauaaaauaucau

SEQ ID NO: 2100518 - RNA, 21 nt, Human
caagcuaauaaaauaucauuc

SEQ ID NO: 2100519 - RNA, 23 nt, Human
cacacagugagucgaggacaggg

SEQ ID NO: 2100520 - RNA, 21 nt, Human
cacacagugagucgaggacag

SEQ ID NO: 2100521 - RNA, 15 nt, Human
cacacauacacacac

SEQ ID NO: 2100522 - RNA, 23 nt, Human
cacacauauaaacaucacacaca

SEQ ID NO: 2100523 - RNA, 21 nt, Human
cacacauauaaacaucacaca

SEQ ID NO: 2100524 - RNA, 13 nt, Human
cacacauaaagga

SEQ ID NO: 2100525 - RNA, 23 nt, Human
cacacaguauuacuucugcuaca

SEQ ID NO: 2100526 - RNA, 20 nt, Human
cacacaguauuacuucugcu

SEQ ID NO: 2100527 - RNA, 18 nt, Human
cacacagugagucgagga

SEQ ID NO: 2100528 - RNA, 16 nt, Human
cacacagcucuguccu

SEQ ID NO: 2100529 - RNA, 15 nt, Human
cacacagcugcagag

SEQ ID NO: 2100530 - RNA, 22 nt, Human
cacacagcuuuuaguacccacc

SEQ ID NO: 2100531 - RNA, 13 nt, Human
cacacaggcaacu

SEQ ID NO: 2100532 - RNA, 20 nt, Human
cacacaggcaacugaggcag

SEQ ID NO: 2100533 - RNA, 16 nt, Human
cacacaggcaacugag

SEQ ID NO: 2100534 - RNA, 19 nt, Human
cacacaggcaacugaggca

SEQ ID NO: 2100535 - RNA, 11 nt, Human
cacagccucug

SEQ ID NO: 2100536 - RNA, 13 nt, Human
cacagaaacacaa

SEQ ID NO: 2100537 - RNA, 21 nt, Human
cacagaaacacaauauuuugu

SEQ ID NO: 2100538 - RNA, 18 nt, Human
cacagaaacacaauauuu

SEQ ID NO: 2100539 - RNA, 15 nt, Human
cacagguguuuauac

SEQ ID NO: 2100540 - RNA, 19 nt, Human
cacagguucaugccaccau

SEQ ID NO: 2100541 - RNA, 21 nt, Human
cacaguauuacuucugcuaca

SEQ ID NO: 2100542 - RNA, 20 nt, Human
cacaguauuacuucugcuac

SEQ ID NO: 2100543 - RNA, 14 nt, Human
cacagccucugccu

SEQ ID NO: 2100544 - RNA, 14 nt, Human
cacaggugucccca

SEQ ID NO: 2100545 - RNA, 20 nt, Human
cacagguguccccagcccac

SEQ ID NO: 2100546 - RNA, 21 nt, Human
cacagguguccccagcccacu

SEQ ID NO: 2100547 - RNA, 18 nt, Human
cacagacauucugccagg

SEQ ID NO: 2100548 - RNA, 20 nt, Human
cacagacauucugccaggcc

SEQ ID NO: 2100549 - RNA, 23 nt, Human
cacaggcccuuccucuccacugc

SEQ ID NO: 2100550 - RNA, 22 nt, Human
cacaggcccuuccucuccacug

SEQ ID NO: 2100551 - RNA, 17 nt, Human
cacagcgagacuccguc

SEQ ID NO: 2100552 - RNA, 20 nt, Human
caauggagacugucucaaga

SEQ ID NO: 2100553 - RNA, 22 nt, Human
caauggaguagaccccuggcug

SEQ ID NO: 2100554 - RNA, 23 nt, Human
caauggaguagaccccuggcugg

SEQ ID NO: 2100555 - RNA, 12 nt, Human
caauggcagccu

SEQ ID NO: 2100556 - RNA, 11 nt, Human
caauggcagcc

SEQ ID NO: 2100557 - RNA, 13 nt, Human
caauuuaaagcaa

SEQ ID NO: 2100558 - RNA, 18 nt, Human
caauugaacuuaaauaaa

SEQ ID NO: 2100559 - RNA, 21 nt, Human
caauugaacuuaaauaaaugu

SEQ ID NO: 2100560 - RNA, 12 nt, Human
cacaagcugccu

SEQ ID NO: 2100561 - RNA, 14 nt, Human
cacaagcugccucc

SEQ ID NO: 2100562 - RNA, 15 nt, Human
cacaagcugccuccc

SEQ ID NO: 2100563 - RNA, 16 nt, Human
cacaagcugccucccu

SEQ ID NO: 2100564 - RNA, 22 nt, Human
cacaagcugccucccuguccac

SEQ ID NO: 2100565 - RNA, 21 nt, Human
cacaagagcccagcagggccu

SEQ ID NO: 2100566 - RNA, 17 nt, Human
cacaagcugcacccuca

SEQ ID NO: 2100567 - RNA, 23 nt, Human
cacaagcugcacccucaggcagg

SEQ ID NO: 2100568 - RNA, 20 nt, Human
cacaagagcccagcagggcc

SEQ ID NO: 2100569 - RNA, 20 nt, Human
cacacagcucuguccuggga

SEQ ID NO: 2100570 - RNA, 17 nt, Human
cacacagcucuguccug

SEQ ID NO: 2100571 - RNA, 19 nt, Human
ccaaagugguauagaaaug

SEQ ID NO: 2100572 - RNA, 18 nt, Human
ccaaauuaucaagcuaau

SEQ ID NO: 2100573 - RNA, 22 nt, Human
ccaaauuaucaagcuaauaaaa

SEQ ID NO: 2100574 - RNA, 13 nt, Human
ccaaaucugccua

SEQ ID NO: 2100575 - RNA, 20 nt, Human
ccaaaucugccuauugcagc

SEQ ID NO: 2100576 - RNA, 23 nt, Human
ccaaaucugccuauugcagcugg

SEQ ID NO: 2100577 - RNA, 11 nt, Human
ccaacuuguaa

SEQ ID NO: 2100578 - RNA, 23 nt, Human
ccaacuuguauuaaagacagagg

SEQ ID NO: 2100579 - RNA, 21 nt, Human
ccaacuucauuugaugcuaaa

SEQ ID NO: 2100580 - RNA, 13 nt, Human
ccaacuucccagu

SEQ ID NO: 2100581 - RNA, 19 nt, Human
ccaaauuaucaagcuaaua

SEQ ID NO: 2100582 - RNA, 15 nt, Human
ccaacguggggcagc

SEQ ID NO: 2100583 - RNA, 16 nt, Human
ccaacguggggcagca

SEQ ID NO: 2100584 - RNA, 20 nt, Human
ccaacguggggcagcacaga

SEQ ID NO: 2100585 - RNA, 19 nt, Human
ccaacuaacaagaaacuca

SEQ ID NO: 2100586 - RNA, 22 nt, Human
ccaaagugcugggauuacaggg

SEQ ID NO: 2100587 - RNA, 17 nt, Human
ccaagcuuccuuuguuu

SEQ ID NO: 2100588 - RNA, 20 nt, Human
ccaagcugugacccucaauu

SEQ ID NO: 2100589 - RNA, 20 nt, Human
ccaagcuggucccacucagu

SEQ ID NO: 2100590 - RNA, 23 nt, Human
ccaagcuuguccaacccgaggcc

SEQ ID NO: 2100591 - RNA, 20 nt, Human
ccaauguucucucuucucca

SEQ ID NO: 2100592 - RNA, 19 nt, Human
ccaauuaaguccuacuuua

SEQ ID NO: 2100593 - RNA, 17 nt, Human
ccaauuaggaaguguaa

SEQ ID NO: 2100594 - RNA, 23 nt, Human
ccaauuaggaaguguaacagcug

SEQ ID NO: 2100595 - RNA, 14 nt, Human
ccaauguuuaaaaa

SEQ ID NO: 2100596 - RNA, 16 nt, Human
ccaauguuuaaaaaag

SEQ ID NO: 2100597 - RNA, 15 nt, Human
ccaauuaaccagaaa

SEQ ID NO: 2100598 - RNA, 15 nt, Human
ccaccuuggcucaag

SEQ ID NO: 2100599 - RNA, 14 nt, Human
ccaccuuggcucaa

SEQ ID NO: 2100600 - RNA, 19 nt, Human
ccaccuaccuucaaagcug

SEQ ID NO: 2100601 - RNA, 20 nt, Human
ccaccuaccuucaaagcuga

SEQ ID NO: 2100602 - RNA, 23 nt, Human
ccaccgggcugggagcucugcag

SEQ ID NO: 2100603 - RNA, 17 nt, Human
ccaccgguugcuucugg

SEQ ID NO: 2100604 - RNA, 18 nt, Human
ccaccgguugcuucuggg

SEQ ID NO: 2100605 - RNA, 20 nt, Human
ccaccgguugcuucugggaa

SEQ ID NO: 2100606 - RNA, 21 nt, Human
ccaccgguugcuucugggaag

SEQ ID NO: 2100607 - RNA, 22 nt, Human
ccaccgggcugggagcucugca

SEQ ID NO: 2100608 - RNA, 13 nt, Human
ccacccugcucuc

SEQ ID NO: 2100609 - RNA, 18 nt, Human
ccaccaucaccagacagg

SEQ ID NO: 2100610 - RNA, 20 nt, Human
ccaccaggcugcucagggcu

SEQ ID NO: 2100611 - RNA, 11 nt, Human
ccacccuggaa

SEQ ID NO: 2100612 - RNA, 22 nt, Human
ccacacuucaggcucuucuccu

SEQ ID NO: 2100613 - RNA, 20 nt, Human
ccacacuuccuguccagaga

SEQ ID NO: 2100614 - RNA, 21 nt, Human
ccacacuuccuguccagagag

SEQ ID NO: 2100615 - RNA, 12 nt, Human
ccacacuuccug

SEQ ID NO: 2100616 - RNA, 13 nt, Human
ccacacuuccugu

SEQ ID NO: 2100617 - RNA, 16 nt, Human
ccacacuuccugucca

SEQ ID NO: 2100618 - RNA, 18 nt, Human
ccacacuuccuguccaga

SEQ ID NO: 2100619 - RNA, 12 nt, Human
ccacagaaagag

SEQ ID NO: 2100620 - RNA, 13 nt, Human
ccacagaaagaga

SEQ ID NO: 2100621 - RNA, 14 nt, Human
ccacagaaagagag

SEQ ID NO: 2100622 - RNA, 15 nt, Human
ccacagaaagagagc

SEQ ID NO: 2100623 - RNA, 20 nt, Human
ccacagaagacuucccagcu

SEQ ID NO: 2100624 - RNA, 21 nt, Human
ccacagaagacuucccagcuu

SEQ ID NO: 2100625 - RNA, 20 nt, Human
ccacacuuguuccagcucuu

SEQ ID NO: 2100626 - RNA, 21 nt, Human
ccacacuuguuccagcucuuu

SEQ ID NO: 2100627 - RNA, 19 nt, Human
ccaccaggagaaccacuac

SEQ ID NO: 2100628 - RNA, 13 nt, Human
ccaccaggagaac

SEQ ID NO: 2100629 - RNA, 14 nt, Human
ccaccaggagaacc

SEQ ID NO: 2100630 - RNA, 11 nt, Human
ccaccagccug

SEQ ID NO: 2100631 - RNA, 14 nt, Human
ccaccagccugcac

SEQ ID NO: 2100632 - RNA, 23 nt, Human
ccaccagacugacaaauguguau

SEQ ID NO: 2100633 - RNA, 19 nt, Human
cauuuauuuuuuacauuau

SEQ ID NO: 2100634 - RNA, 17 nt, Human
cauuuauuuuuuacauu

SEQ ID NO: 2100635 - RNA, 16 nt, Human
cauuuauucugcucac

SEQ ID NO: 2100636 - RNA, 11 nt, Human
cauugcuucac

SEQ ID NO: 2100637 - RNA, 15 nt, Human
cauugcuucacaacc

SEQ ID NO: 2100638 - RNA, 13 nt, Human
cauugcugcuccu

SEQ ID NO: 2100639 - RNA, 18 nt, Human
cauugcugcuccuuagcu

SEQ ID NO: 2100640 - RNA, 20 nt, Human
cauugcugcuccuuagcugc

SEQ ID NO: 2100641 - RNA, 22 nt, Human
cauugcugcuccuuagcugcca

SEQ ID NO: 2100642 - RNA, 23 nt, Human
cauugcugcuccuuagcugccaa

SEQ ID NO: 2100643 - RNA, 17 nt, Human
cauugcuggucuuguaa

SEQ ID NO: 2100644 - RNA, 19 nt, Human
cauugcuggucuuguaaga

SEQ ID NO: 2100645 - RNA, 20 nt, Human
cauugcuggucuuguaagag

SEQ ID NO: 2100646 - RNA, 20 nt, Human
ccaaaaaauucuacaacaca

SEQ ID NO: 2100647 - RNA, 22 nt, Human
ccaaaaaauucuacaacacaca

SEQ ID NO: 2100648 - RNA, 23 nt, Human
ccaaaaagaaucugcauuuagca

SEQ ID NO: 2100649 - RNA, 18 nt, Human
ccaaaacaaacaaacaga

SEQ ID NO: 2100650 - RNA, 22 nt, Human
ccaaaacauuccguuuacauuu

SEQ ID NO: 2100651 - RNA, 15 nt, Human
ccaaaaccacagccc

SEQ ID NO: 2100652 - RNA, 12 nt, Human
ccaaaacaaaca

SEQ ID NO: 2100653 - RNA, 20 nt, Human
cauuuuugaauacaggcaua

SEQ ID NO: 2100654 - RNA, 18 nt, Human
cauuuuugaauacaggca

SEQ ID NO: 2100655 - RNA, 17 nt, Human
cauuuccaaauucacaa

SEQ ID NO: 2100656 - RNA, 17 nt, Human
cauugccuuaacuggag

SEQ ID NO: 2100657 - RNA, 21 nt, Human
cauugcggacagccacggcca

SEQ ID NO: 2100658 - RNA, 17 nt, Human
cauugcggacagccacg

SEQ ID NO: 2100659 - RNA, 15 nt, Human
cauugcggacagcca

SEQ ID NO: 2100660 - RNA, 14 nt, Human
cauugcggacagcc

SEQ ID NO: 2100661 - RNA, 18 nt, Human
cauugcugggcuugucug

SEQ ID NO: 2100662 - RNA, 21 nt, Human
cauugcgcucuagccugggca

SEQ ID NO: 2100663 - RNA, 21 nt, Human
cauugccuuaacuggagcccc

SEQ ID NO: 2100664 - RNA, 14 nt, Human
cauugccugcgguc

SEQ ID NO: 2100665 - RNA, 16 nt, Human
cauucucacuccuacc

SEQ ID NO: 2100666 - RNA, 17 nt, Human
cauucucacuccuaccu

SEQ ID NO: 2100667 - RNA, 13 nt, Human
cauuaugauucuu

SEQ ID NO: 2100668 - RNA, 14 nt, Human
cauuaugauucuuu

SEQ ID NO: 2100669 - RNA, 22 nt, Human
cauuaugaugugggucaaggaa

SEQ ID NO: 2100670 - RNA, 23 nt, Human
cauuaugaugugggucaaggaau

SEQ ID NO: 2100671 - RNA, 18 nt, Human
cauuagcaguuugcuuug

SEQ ID NO: 2100672 - RNA, 15 nt, Human
cauguucucugagga

SEQ ID NO: 2100673 - RNA, 18 nt, Human
caugaccagaagggaaac

SEQ ID NO: 2100674 - RNA, 21 nt, Human
cauguuccucaaaagcacccu

SEQ ID NO: 2100675 - RNA, 16 nt, Human
cauguucccuucuccu

SEQ ID NO: 2100676 - RNA, 13 nt, Human
cauguuccucaaa

SEQ ID NO: 2100677 - RNA, 22 nt, Human
cauggcguagagggugcugccc

SEQ ID NO: 2100678 - RNA, 14 nt, Human
cauggcgugucccu

SEQ ID NO: 2100679 - RNA, 19 nt, Human
cauggcgugucccucucgg

SEQ ID NO: 2100680 - RNA, 17 nt, Human
cauggcuaagcuuaaaa

SEQ ID NO: 2100681 - RNA, 20 nt, Human
cauggcuaagcuuaaaaaaa

SEQ ID NO: 2100682 - RNA, 18 nt, Human
cauagccuaaucccuggg

SEQ ID NO: 2100683 - RNA, 19 nt, Human
cauagccuaaucccugggc

SEQ ID NO: 2100684 - RNA, 15 nt, Human
cauagccaccccaga

SEQ ID NO: 2100685 - RNA, 15 nt, Human
cauagcauuaacuaa

SEQ ID NO: 2100686 - RNA, 16 nt, Human
cauagcauuaacuaau

SEQ ID NO: 2100687 - RNA, 23 nt, Human
cauagcauuaacuaaucuauugg

SEQ ID NO: 2100688 - RNA, 11 nt, Human
cauagcauuaa

SEQ ID NO: 2100689 - RNA, 14 nt, Human
cauagauucaccug

SEQ ID NO: 2100690 - RNA, 15 nt, Human
cauagauucaccugu

SEQ ID NO: 2100691 - RNA, 16 nt, Human
cauagauucaccugua

SEQ ID NO: 2100692 - RNA, 17 nt, Human
cauagauucaccuguaa

SEQ ID NO: 2100693 - RNA, 18 nt, Human
cauagauucaccuguaaa

SEQ ID NO: 2100694 - RNA, 20 nt, Human
cauagauucaccuguaaaac

SEQ ID NO: 2100695 - RNA, 21 nt, Human
cauagauucaccuguaaaacu

SEQ ID NO: 2100696 - RNA, 22 nt, Human
cauagauucaccuguaaaacuu

SEQ ID NO: 2100697 - RNA, 23 nt, Human
cauagauucaccuguaaaacuuu

SEQ ID NO: 2100698 - RNA, 15 nt, Human
cauagauuucugauu

SEQ ID NO: 2100699 - RNA, 16 nt, Human
cauagauuucugauuu

SEQ ID NO: 2100700 - RNA, 17 nt, Human
cauagauuucugauuuu

SEQ ID NO: 2100701 - RNA, 19 nt, Human
cauagauuucugauuuuau

SEQ ID NO: 2100702 - RNA, 23 nt, Human
cauagaugucccuuucuuggcca

SEQ ID NO: 2100703 - RNA, 20 nt, Human
cauaauuuucuucaugcaau

SEQ ID NO: 2100704 - RNA, 14 nt, Human
cauaauuuucuuca

SEQ ID NO: 2100705 - RNA, 15 nt, Human
cauacaauuccaaac

SEQ ID NO: 2100706 - RNA, 15 nt, Human
cauaggccugggugc

SEQ ID NO: 2100707 - RNA, 17 nt, Human
cauaggccugggugcug

SEQ ID NO: 2100708 - RNA, 18 nt, Human
cauaggccugggugcugg

SEQ ID NO: 2100709 - RNA, 19 nt, Human
cauaggccugggugcuggc

SEQ ID NO: 2100710 - RNA, 17 nt, Human
cauagggucucuucagg

SEQ ID NO: 2100711 - RNA, 16 nt, Human
cauagcgcugcucuua

SEQ ID NO: 2100712 - RNA, 14 nt, Human
cauaggccugggug

SEQ ID NO: 2100713 - RNA, 15 nt, Human
cauagggucucuuca

SEQ ID NO: 2100714 - RNA, 15 nt, Human
caguuugauaacuag

SEQ ID NO: 2100715 - RNA, 20 nt, Human
caguuugauaacuagggaag

SEQ ID NO: 2100716 - RNA, 21 nt, Human
caguuugcagaaaagcaccug

SEQ ID NO: 2100717 - RNA, 22 nt, Human
caguuugcagaaaagcaccugc

SEQ ID NO: 2100718 - RNA, 23 nt, Human
caguuugcagaaaagcaccugcc

SEQ ID NO: 2100719 - RNA, 21 nt, Human
caguuugcuuuguaugcacuu

SEQ ID NO: 2100720 - RNA, 14 nt, Human
caguuugcuuugua

SEQ ID NO: 2100721 - RNA, 12 nt, Human
caguuugcuuug

SEQ ID NO: 2100722 - RNA, 21 nt, Human
caguuuguacagacguaugcu

SEQ ID NO: 2100723 - RNA, 19 nt, Human
cauaaucuggacuccucug

SEQ ID NO: 2100724 - RNA, 13 nt, Human
caguuugucagac

SEQ ID NO: 2100725 - RNA, 20 nt, Human
cauaaucuggacuccucugu

SEQ ID NO: 2100726 - RNA, 22 nt, Human
cauaaucuggacuccucugucc

SEQ ID NO: 2100727 - RNA, 21 nt, Human
cauaaucuggacuccucuguc

SEQ ID NO: 2100728 - RNA, 23 nt, Human
cauaaucuggacuccucugucca

SEQ ID NO: 2100729 - RNA, 20 nt, Human
cauccuuguggcacauuuuu

SEQ ID NO: 2100730 - RNA, 19 nt, Human
cauccuuuucugcagaggg

SEQ ID NO: 2100731 - RNA, 17 nt, Human
cauccuuuucuccuauc

SEQ ID NO: 2100732 - RNA, 18 nt, Human
cauccuuuucuccuaucu

SEQ ID NO: 2100733 - RNA, 17 nt, Human
cauccuuuucugcagag

SEQ ID NO: 2100734 - RNA, 15 nt, Human
caucugucuggaggg

SEQ ID NO: 2100735 - RNA, 16 nt, Human
caucugucuggagggg

SEQ ID NO: 2100736 - RNA, 23 nt, Human
caucugucuggaggggagcucug

SEQ ID NO: 2100737 - RNA, 13 nt, Human
caucuuaacucuu

SEQ ID NO: 2100738 - RNA, 15 nt, Human
caucuuaacucuuug

SEQ ID NO: 2100739 - RNA, 16 nt, Human
caucuuaacucuuugc

SEQ ID NO: 2100740 - RNA, 19 nt, Human
caucuuaacucuuugccuu

SEQ ID NO: 2100741 - RNA, 13 nt, Human
caucuuacugaag

SEQ ID NO: 2100742 - RNA, 21 nt, Human
caucuuagguuggcaaaaagg

SEQ ID NO: 2100743 - RNA, 22 nt, Human
caucuuagguuggcaaaaaggc

SEQ ID NO: 2100744 - RNA, 14 nt, Human
caucuuacugaagg

SEQ ID NO: 2100745 - RNA, 15 nt, Human
caucuuacugaaggu

SEQ ID NO: 2100746 - RNA, 19 nt, Human
caucuuaguauuugcauau

SEQ ID NO: 2100747 - RNA, 12 nt, Human
cauccccaccuu

SEQ ID NO: 2100748 - RNA, 16 nt, Human
caucccauugcccugg

SEQ ID NO: 2100749 - RNA, 16 nt, Human
cauccccacccuugga

SEQ ID NO: 2100750 - RNA, 13 nt, Human
caucccauugccc

SEQ ID NO: 2100751 - RNA, 15 nt, Human
caucccauugcccug

SEQ ID NO: 2100752 - RNA, 17 nt, Human
caucccauugcccuggu

SEQ ID NO: 2100753 - RNA, 11 nt, Human
cauccccaggg

SEQ ID NO: 2100754 - RNA, 12 nt, Human
cauccccagggg

SEQ ID NO: 2100755 - RNA, 18 nt, Human
cauccccaggggucccag

SEQ ID NO: 2100756 - RNA, 21 nt, Human
cauccccaggggucccagcca

SEQ ID NO: 2100757 - RNA, 12 nt, Human
caucccauugcc

SEQ ID NO: 2100758 - RNA, 14 nt, Human
caucccaucccauc

SEQ ID NO: 2100759 - RNA, 15 nt, Human
caucccaucccaucc

SEQ ID NO: 2100760 - RNA, 16 nt, Human
caucccaucccauccc

SEQ ID NO: 2100761 - RNA, 17 nt, Human
caucccaucccauccca

SEQ ID NO: 2100762 - RNA, 18 nt, Human
caucccaucccaucccgc

SEQ ID NO: 2100763 - RNA, 12 nt, Human
caucccaucccg

SEQ ID NO: 2100764 - RNA, 23 nt, Human
cauccuggcacccggccccugcu

SEQ ID NO: 2100765 - RNA, 14 nt, Human
caucagacagaugg

SEQ ID NO: 2100766 - RNA, 23 nt, Human
caucagaaggagaaggaaggaga

SEQ ID NO: 2100767 - RNA, 15 nt, Human
caucagaaggagaag

SEQ ID NO: 2100768 - RNA, 23 nt, Human
caucagcuguaagaagagacugg

SEQ ID NO: 2100769 - RNA, 23 nt, Human
caucagcuuaggggcugcugacc

SEQ ID NO: 2100770 - RNA, 17 nt, Human
caucagcuguaagaaga

SEQ ID NO: 2100771 - RNA, 19 nt, Human
caucagcuguaagaagaga

SEQ ID NO: 2100772 - RNA, 20 nt, Human
caucagaggccuagucagcc

SEQ ID NO: 2100773 - RNA, 16 nt, Human
caugcaaugacaucuu

SEQ ID NO: 2100774 - RNA, 21 nt, Human
caugauucgcccaaagccaga

SEQ ID NO: 2100775 - RNA, 12 nt, Human
caugcugccucc

SEQ ID NO: 2100776 - RNA, 14 nt, Human
caugcugccuccag

SEQ ID NO: 2100777 - RNA, 20 nt, Human
caugacaagccccaggcagg

SEQ ID NO: 2100778 - RNA, 18 nt, Human
caugaccauacugaggga

SEQ ID NO: 2100779 - RNA, 12 nt, Human
caugauuagcaa

SEQ ID NO: 2100780 - RNA, 17 nt, Human
caugaauguaucaggaa

SEQ ID NO: 2100781 - RNA, 18 nt, Human
caugaauguaucaggaaa

SEQ ID NO: 2100782 - RNA, 19 nt, Human
cagcauagcaagacacauc

SEQ ID NO: 2100783 - RNA, 13 nt, Human
cagcaccaccagg

SEQ ID NO: 2100784 - RNA, 15 nt, Human
cagcaccaccagguc

SEQ ID NO: 2100785 - RNA, 16 nt, Human
cagcaccaccaggucu

SEQ ID NO: 2100786 - RNA, 21 nt, Human
cagcaccaccaggucucccgg

SEQ ID NO: 2100787 - RNA, 22 nt, Human
cagcaccaccaggucucccggg

SEQ ID NO: 2100788 - RNA, 13 nt, Human
cagcaccacccua

SEQ ID NO: 2100789 - RNA, 21 nt, Human
cagcaccacccuagucccuuc

SEQ ID NO: 2100790 - RNA, 21 nt, Human
cagauugcaacaggcugggcu

SEQ ID NO: 2100791 - RNA, 15 nt, Human
cagauugcugcuucu

SEQ ID NO: 2100792 - RNA, 18 nt, Human
cagauuggagaaacccuu

SEQ ID NO: 2100793 - RNA, 21 nt, Human
cagauuugaagacaaaaauac

SEQ ID NO: 2100794 - RNA, 23 nt, Human
cagauuugaagacaaaaauacuc

SEQ ID NO: 2100795 - RNA, 12 nt, Human
cagccagcagcc

SEQ ID NO: 2100796 - RNA, 11 nt, Human
cagccagcagc

SEQ ID NO: 2100797 - RNA, 15 nt, Human
cagccagcagccagc

SEQ ID NO: 2100798 - RNA, 14 nt, Human
cagccagcagccag

SEQ ID NO: 2100799 - RNA, 24 nt, Human
cagccccauucugccugcccaggc

SEQ ID NO: 2100800 - RNA, 23 nt, Human
cagccccauucugccugcccagg

SEQ ID NO: 2100801 - RNA, 22 nt, Human
cagccccauucugccugcccag

SEQ ID NO: 2100802 - RNA, 20 nt, Human
cagccccauucugccugccc

SEQ ID NO: 2100803 - RNA, 19 nt, Human
cagccccauucugccugcc

SEQ ID NO: 2100804 - RNA, 22 nt, Human
cagccccucccaccacagcagg

SEQ ID NO: 2100805 - RNA, 13 nt, Human
cagccccucccac

SEQ ID NO: 2100806 - RNA, 14 nt, Human
cagccccucccacc

SEQ ID NO: 2100807 - RNA, 15 nt, Human
cagccccucccacca

SEQ ID NO: 2100808 - RNA, 21 nt, Human
cagccccucccaccacagcag

SEQ ID NO: 2100809 - RNA, 12 nt, Human
cagccccuccuc

SEQ ID NO: 2100810 - RNA, 13 nt, Human
cagccccuccucu

SEQ ID NO: 2100811 - RNA, 14 nt, Human
cagccccuccucug

SEQ ID NO: 2100812 - RNA, 15 nt, Human
cagccccuccucugc

SEQ ID NO: 2100813 - RNA, 16 nt, Human
cagccccuccucugcc

SEQ ID NO: 2100814 - RNA, 17 nt, Human
cagccccuccucugcca

SEQ ID NO: 2100815 - RNA, 19 nt, Human
cagccccuccucugccacc

SEQ ID NO: 2100816 - RNA, 20 nt, Human
cagccccuccucugccaccu

SEQ ID NO: 2100817 - RNA, 21 nt, Human
cagccccuccucugccaccuc

SEQ ID NO: 2100818 - RNA, 22 nt, Human
cagccccuccucugccaccucc

SEQ ID NO: 2100819 - RNA, 23 nt, Human
cagccccuccucugccaccuccc

SEQ ID NO: 2100820 - RNA, 11 nt, Human
cagccccucuu

SEQ ID NO: 2100821 - RNA, 13 nt, Human
cagccccugcaca

SEQ ID NO: 2100822 - RNA, 23 nt, Human
cagccccucuugccccccacccc

SEQ ID NO: 2100823 - RNA, 15 nt, Human
cagccccucuugccc

SEQ ID NO: 2100824 - RNA, 17 nt, Human
cagccccucuugccccc

SEQ ID NO: 2100825 - RNA, 21 nt, Human
cagccccucuugccccccacc

SEQ ID NO: 2100826 - RNA, 22 nt, Human
cagccccucuugccccccaccc

SEQ ID NO: 2100827 - RNA, 12 nt, Human
cagcccugucag

SEQ ID NO: 2100828 - RNA, 16 nt, Human
cagccccgcgccuccu

SEQ ID NO: 2100829 - RNA, 18 nt, Human
cagccccgcgccuccuuc

SEQ ID NO: 2100830 - RNA, 23 nt, Human
cagccgccauugccaccaggaga

SEQ ID NO: 2100831 - RNA, 21 nt, Human
cagccgccauugccaccagga

SEQ ID NO: 2100832 - RNA, 22 nt, Human
cagccgccauugccaccaggag

SEQ ID NO: 2100833 - RNA, 13 nt, Human
cagccgccacauc

SEQ ID NO: 2100834 - RNA, 14 nt, Human
cagccgccacaucc

SEQ ID NO: 2100835 - RNA, 23 nt, Human
cagccgccacauccccgcuggcu

SEQ ID NO: 2100836 - RNA, 17 nt, Human
cagccgccauugccacc

SEQ ID NO: 2100837 - RNA, 18 nt, Human
cagccgccauugccacca

SEQ ID NO: 2100838 - RNA, 19 nt, Human
cagccgccauugccaccag

SEQ ID NO: 2100839 - RNA, 12 nt, Human
cagccgcuccug

SEQ ID NO: 2100840 - RNA, 23 nt, Human
cagccgccaugcuccuggcccac

SEQ ID NO: 2100841 - RNA, 11 nt, Human
cagcccugugg

SEQ ID NO: 2100842 - RNA, 13 nt, Human
cagcccuguucug

SEQ ID NO: 2100843 - RNA, 13 nt, Human
cagcccuuagcag

SEQ ID NO: 2100844 - RNA, 16 nt, Human
cagcccugucagugca

SEQ ID NO: 2100845 - RNA, 18 nt, Human
cagcccugucagugcagc

SEQ ID NO: 2100846 - RNA, 20 nt, Human
cagcccugucagugcagccc

SEQ ID NO: 2100847 - RNA, 21 nt, Human
cagcccugucagugcagcccg

SEQ ID NO: 2100848 - RNA, 14 nt, Human
cagccucucuuccu

SEQ ID NO: 2100849 - RNA, 17 nt, Human
cagccucucuuccuauc

SEQ ID NO: 2100850 - RNA, 20 nt, Human
cagccucucuuccuauccca

SEQ ID NO: 2100851 - RNA, 21 nt, Human
cagccucucuuccuaucccau

SEQ ID NO: 2100852 - RNA, 22 nt, Human
cagccucucuuccuaucccauc

SEQ ID NO: 2100853 - RNA, 23 nt, Human
cagccucucuuccuaucccaucc

SEQ ID NO: 2100854 - RNA, 22 nt, Human
cagccucucuugguuuccuucc

SEQ ID NO: 2100855 - RNA, 12 nt, Human
cagccugaggcu

SEQ ID NO: 2100856 - RNA, 15 nt, Human
cagccugaggcugag

SEQ ID NO: 2100857 - RNA, 18 nt, Human
cagccugaggcugagacu

SEQ ID NO: 2100858 - RNA, 19 nt, Human
cagccugaggcugagacug

SEQ ID NO: 2100859 - RNA, 23 nt, Human
cagccucucuugguuuccuuccu

SEQ ID NO: 2100860 - RNA, 14 nt, Human
cagcggggacagcu

SEQ ID NO: 2100861 - RNA, 14 nt, Human
cagcggcuggugca

SEQ ID NO: 2100862 - RNA, 17 nt, Human
cagcggcuggugcaggg

SEQ ID NO: 2100863 - RNA, 18 nt, Human
cagcggcuggugcagggc

SEQ ID NO: 2100864 - RNA, 20 nt, Human
cagcggcuggugcagggccu

SEQ ID NO: 2100865 - RNA, 12 nt, Human
cagccugccugg

SEQ ID NO: 2100866 - RNA, 14 nt, Human
cagccugccuggag

SEQ ID NO: 2100867 - RNA, 12 nt, Human
cagagagagugu

SEQ ID NO: 2100868 - RNA, 19 nt, Human
cagagagccuggugcugcu

SEQ ID NO: 2100869 - RNA, 20 nt, Human
cagagagccuggugcugcug

SEQ ID NO: 2100870 - RNA, 12 nt, Human
cagagagcuggu

SEQ ID NO: 2100871 - RNA, 19 nt, Human
cagagagcugguaguuagu

SEQ ID NO: 2100872 - RNA, 13 nt, Human
cagagagcuggua

SEQ ID NO: 2100873 - RNA, 13 nt, Human
cagagaggaauca

SEQ ID NO: 2100874 - RNA, 15 nt, Human
cagagaggaaucaga

SEQ ID NO: 2100875 - RNA, 16 nt, Human
cagagaggacgugggc

SEQ ID NO: 2100876 - RNA, 17 nt, Human
cagagaggacgugggcg

SEQ ID NO: 2100877 - RNA, 24 nt, Human
cagagagagaagugccccugcugc

SEQ ID NO: 2100878 - RNA, 14 nt, Human
cagagccugcaguu

SEQ ID NO: 2100879 - RNA, 18 nt, Human
cagagaggacgugggcgg

SEQ ID NO: 2100880 - RNA, 21 nt, Human
cagagaggacgugggcggcag

SEQ ID NO: 2100881 - RNA, 13 nt, Human
cagagaggagaaa

SEQ ID NO: 2100882 - RNA, 16 nt, Human
cagagaggagaaacac

SEQ ID NO: 2100883 - RNA, 17 nt, Human
cagagaggagaaacaca

SEQ ID NO: 2100884 - RNA, 18 nt, Human
cagagaggagaaacacau

SEQ ID NO: 2100885 - RNA, 21 nt, Human
cagagaggagaaacacaucuu

SEQ ID NO: 2100886 - RNA, 22 nt, Human
cagagaggagaaacacaucuuc

SEQ ID NO: 2100887 - RNA, 17 nt, Human
cagagaggagucagaga

SEQ ID NO: 2100888 - RNA, 20 nt, Human
cagagaggagucagagagaa

SEQ ID NO: 2100889 - RNA, 20 nt, Human
cagagcgagagucugucuca

SEQ ID NO: 2100890 - RNA, 16 nt, Human
cagagcuggaccagug

SEQ ID NO: 2100891 - RNA, 9 nt, Human
cagagcugg

SEQ ID NO: 2100892 - RNA, 23 nt, Human
cagauacaggaaaagcugcugac

SEQ ID NO: 2100893 - RNA, 18 nt, Human
cagagguggcucuggaau

SEQ ID NO: 2100894 - RNA, 20 nt, Human
cagagguggcucuggaauga

SEQ ID NO: 2100895 - RNA, 23 nt, Human
cagagcuggaccaguggugccuu

SEQ ID NO: 2100896 - RNA, 10 nt, Human
cagagcuggg

SEQ ID NO: 2100897 - RNA, 13 nt, Human
cagagcugggagg

SEQ ID NO: 2100898 - RNA, 19 nt, Human
cagaucauuucaaaacuca

SEQ ID NO: 2100899 - RNA, 22 nt, Human
cagauacuggaaguuuugcauu

SEQ ID NO: 2100900 - RNA, 17 nt, Human
cagauacaugguuguga

SEQ ID NO: 2100901 - RNA, 18 nt, Human
cagauacuggaaguuuug

SEQ ID NO: 2100902 - RNA, 21 nt, Human
cagauacuggaaguuuugcau

SEQ ID NO: 2100903 - RNA, 13 nt, Human
caggaccucaggu

SEQ ID NO: 2100904 - RNA, 15 nt, Human
caggaccgccaaaga

SEQ ID NO: 2100905 - RNA, 20 nt, Human
caggaccucagaguccaggc

SEQ ID NO: 2100906 - RNA, 21 nt, Human
caggaccucagaguccaggcc

SEQ ID NO: 2100907 - RNA, 22 nt, Human
caggaccucagaguccaggccc

SEQ ID NO: 2100908 - RNA, 16 nt, Human
caggacagugcuucag

SEQ ID NO: 2100909 - RNA, 13 nt, Human
caggacaggcccg

SEQ ID NO: 2100910 - RNA, 12 nt, Human
caggacaggccc

SEQ ID NO: 2100911 - RNA, 13 nt, Human
caggacaggacca

SEQ ID NO: 2100912 - RNA, 12 nt, Human
caggacaggacc

SEQ ID NO: 2100913 - RNA, 15 nt, Human
caggacagcauggug

SEQ ID NO: 2100914 - RNA, 19 nt, Human
caggacagcauggugcaug

SEQ ID NO: 2100915 - RNA, 23 nt, Human
caggacagcauggugcaugccgc

SEQ ID NO: 2100916 - RNA, 22 nt, Human
caggacagugcuucagccugag

SEQ ID NO: 2100917 - RNA, 20 nt, Human
caggacagugcuucagccug

SEQ ID NO: 2100918 - RNA, 21 nt, Human
caggacagugcuucagccuga

SEQ ID NO: 2100919 - RNA, 15 nt, Human
caggacacggggcag

SEQ ID NO: 2100920 - RNA, 20 nt, Human
caggcaaugcuggcuguugg

SEQ ID NO: 2100921 - RNA, 19 nt, Human
caggcaaugcuggcuguug

SEQ ID NO: 2100922 - RNA, 17 nt, Human
caggcacugcugcccag

SEQ ID NO: 2100923 - RNA, 16 nt, Human
caggcacugcugccca

SEQ ID NO: 2100924 - RNA, 14 nt, Human
caggaggcaggguu

SEQ ID NO: 2100925 - RNA, 20 nt, Human
caggaggcagagguugcagu

SEQ ID NO: 2100926 - RNA, 21 nt, Human
caggcaaugcuggcuguuggc

SEQ ID NO: 2100927 - RNA, 13 nt, Human
caggccaccugcc

SEQ ID NO: 2100928 - RNA, 15 nt, Human
caggccaccugcccc

SEQ ID NO: 2100929 - RNA, 16 nt, Human
caggccaccugccccc

SEQ ID NO: 2100930 - RNA, 12 nt, Human
caggcagaaaga

SEQ ID NO: 2100931 - RNA, 13 nt, Human
caggcagaaagag

SEQ ID NO: 2100932 - RNA, 14 nt, Human
caggcagaaagagu

SEQ ID NO: 2100933 - RNA, 15 nt, Human
caggcagaaagaguu

SEQ ID NO: 2100934 - RNA, 23 nt, Human
caggcacugcugcccagccucca

SEQ ID NO: 2100935 - RNA, 22 nt, Human
caggccaccugcccccuucucc

SEQ ID NO: 2100936 - RNA, 23 nt, Human
caggccaccugcccccuucuccc

SEQ ID NO: 2100937 - RNA, 17 nt, Human
caggccaccugcccccu

SEQ ID NO: 2100938 - RNA, 18 nt, Human
caggccaccugcccccuu

SEQ ID NO: 2100939 - RNA, 19 nt, Human
caggccaccugcccccuuc

SEQ ID NO: 2100940 - RNA, 21 nt, Human
caggccaccugcccccuucuc

SEQ ID NO: 2100941 - RNA, 16 nt, Human
caggccacggcagccu

SEQ ID NO: 2100942 - RNA, 17 nt, Human
caggccacggcagccua

SEQ ID NO: 2100943 - RNA, 21 nt, Human
caggaaagggaaggccccaca

SEQ ID NO: 2100944 - RNA, 13 nt, Human
caggaaauauaua

SEQ ID NO: 2100945 - RNA, 15 nt, Human
caggaaauauauaug

SEQ ID NO: 2100946 - RNA, 16 nt, Human
caggaaauauauaugu

SEQ ID NO: 2100947 - RNA, 17 nt, Human
caggaaauauauaugug

SEQ ID NO: 2100948 - RNA, 23 nt, Human
caggaaauauauaugugugugua

SEQ ID NO: 2100949 - RNA, 19 nt, Human
cagcuguucagcugguuga

SEQ ID NO: 2100950 - RNA, 22 nt, Human
cagcuguuagaguccaacgugg

SEQ ID NO: 2100951 - RNA, 16 nt, Human
cagcuguucagcuggu

SEQ ID NO: 2100952 - RNA, 15 nt, Human
cagcuguucagcugg

SEQ ID NO: 2100953 - RNA, 23 nt, Human
cagcuguggugagguugggcagc

SEQ ID NO: 2100954 - RNA, 17 nt, Human
cagcuuaggggcugcug

SEQ ID NO: 2100955 - RNA, 20 nt, Human
caggaaaagcugcugacagu

SEQ ID NO: 2100956 - RNA, 19 nt, Human
caggaaaagcugcugacag

SEQ ID NO: 2100957 - RNA, 23 nt, Human
caggaaaauuguuugaacccagg

SEQ ID NO: 2100958 - RNA, 17 nt, Human
caggaaagggaaggccc

SEQ ID NO: 2100959 - RNA, 16 nt, Human
caggaaaauccucugg

SEQ ID NO: 2100960 - RNA, 17 nt, Human
caggaaaauccucuggc

SEQ ID NO: 2100961 - RNA, 16 nt, Human
cagggagggcuucugc

SEQ ID NO: 2100962 - RNA, 22 nt, Human
cagggaggagguggcagcccug

SEQ ID NO: 2100963 - RNA, 12 nt, Human
cagggaggggac

SEQ ID NO: 2100964 - RNA, 21 nt, Human
cagggaggggacuauuuauga

SEQ ID NO: 2100965 - RNA, 13 nt, Human
cagggaggggacu

SEQ ID NO: 2100966 - RNA, 19 nt, Human
cagggaggggacuauuuau

SEQ ID NO: 2100967 - RNA, 15 nt, Human
cagggcucagccugg

SEQ ID NO: 2100968 - RNA, 16 nt, Human
cagggcucagccuggu

SEQ ID NO: 2100969 - RNA, 15 nt, Human
cagggcucagcgggg

SEQ ID NO: 2100970 - RNA, 12 nt, Human
cagggcucagcg

SEQ ID NO: 2100971 - RNA, 20 nt, Human
cagggcucagcggggacagc

SEQ ID NO: 2100972 - RNA, 19 nt, Human
cagggcucagccugguggg

SEQ ID NO: 2100973 - RNA, 18 nt, Human
cagggaggagguggcagc

SEQ ID NO: 2100974 - RNA, 19 nt, Human
cagggaggagguggcagcc

SEQ ID NO: 2100975 - RNA, 20 nt, Human
cagggaggagguggcagccc

SEQ ID NO: 2100976 - RNA, 21 nt, Human
cagggaggagguggcagcccu

SEQ ID NO: 2100977 - RNA, 15 nt, Human
caggcugggcuucag

SEQ ID NO: 2100978 - RNA, 14 nt, Human
caggcugggcuuca

SEQ ID NO: 2100979 - RNA, 19 nt, Human
caggcuggcgugcaguggu

SEQ ID NO: 2100980 - RNA, 18 nt, Human
caggcuggcgugcagugg

SEQ ID NO: 2100981 - RNA, 17 nt, Human
caggcuggcgugcagug

SEQ ID NO: 2100982 - RNA, 14 nt, Human
caggccugggucug

SEQ ID NO: 2100983 - RNA, 20 nt, Human
cagguugaggggcuccugga

SEQ ID NO: 2100984 - RNA, 21 nt, Human
cagguugaggggcuccuggaa

SEQ ID NO: 2100985 - RNA, 22 nt, Human
cagguugaggggcuccuggaaa

SEQ ID NO: 2100986 - RNA, 23 nt, Human
cagguuuuuggucugacccacug

SEQ ID NO: 2100987 - RNA, 19 nt, Human
caggguuuaucuuuugaga

SEQ ID NO: 2100988 - RNA, 20 nt, Human
cagguucugguuagcucagc

SEQ ID NO: 2100989 - RNA, 21 nt, Human
cagguucugguuagcucagcc

SEQ ID NO: 2100990 - RNA, 22 nt, Human
cagguucugguuagcucagccc

SEQ ID NO: 2100991 - RNA, 23 nt, Human
cagguucugguuagcucagcccc

SEQ ID NO: 2100992 - RNA, 21 nt, Human
caggguuggccccugcccggc

SEQ ID NO: 2100993 - RNA, 17 nt, Human
caggguuggccccugcc

SEQ ID NO: 2100994 - RNA, 18 nt, Human
cagggugggauggaggag

SEQ ID NO: 2100995 - RNA, 13 nt, Human
caggguugggccc

SEQ ID NO: 2100996 - RNA, 14 nt, Human
caggguugggccca

SEQ ID NO: 2100997 - RNA, 15 nt, Human
caggguugggcccag

SEQ ID NO: 2100998 - RNA, 16 nt, Human
caggguugggcccaga

SEQ ID NO: 2100999 - RNA, 20 nt, Human
caggguugggcccagaucug

SEQ ID NO: 2101000 - RNA, 14 nt, Human
caggugcugccauc

SEQ ID NO: 2101001 - RNA, 13 nt, Human
caggugcugccau

SEQ ID NO: 2101002 - RNA, 17 nt, Human
cagggugggauggagga

SEQ ID NO: 2101003 - RNA, 21 nt, Human
caggguugggcccagaucugg

SEQ ID NO: 2101004 - RNA, 15 nt, Human
caguauucuagguag

SEQ ID NO: 2101005 - RNA, 21 nt, Human
caguauucuagguagugcccu

SEQ ID NO: 2101006 - RNA, 21 nt, Human
caguauuuucccaauagcacu

SEQ ID NO: 2101007 - RNA, 23 nt, Human
caguauuuucccaauagcacuuu

SEQ ID NO: 2101008 - RNA, 15 nt, Human
caguauuucagacug

SEQ ID NO: 2101009 - RNA, 23 nt, Human
cagggucucacucugucgcccag

SEQ ID NO: 2101010 - RNA, 16 nt, Human
caggguuggccccugc

SEQ ID NO: 2101011 - RNA, 15 nt, Human
caggguuggccccug

SEQ ID NO: 2101012 - RNA, 14 nt, Human
cagggugaggaugg

SEQ ID NO: 2101013 - RNA, 22 nt, Human
cagggucuucccuaccucaggc

SEQ ID NO: 2101014 - RNA, 21 nt, Human
cagggucucuaccauccccug

SEQ ID NO: 2101015 - RNA, 17 nt, Human
gccuccaagcuccaucu

SEQ ID NO: 2101016 - RNA, 22 nt, Human
gccuccaaaugccaacuugucc

SEQ ID NO: 2101017 - RNA, 17 nt, Human
gccuccaaaugccaacu

SEQ ID NO: 2101018 - RNA, 14 nt, Human
gccuccagcccucu

SEQ ID NO: 2101019 - RNA, 21 nt, Human
gccuccagcccucucacugug

SEQ ID NO: 2101020 - RNA, 12 nt, Human
gccuccagcuca

SEQ ID NO: 2101021 - RNA, 13 nt, Human
gccuccagcucag

SEQ ID NO: 2101022 - RNA, 15 nt, Human
gccuccagcucagca

SEQ ID NO: 2101023 - RNA, 16 nt, Human
gccuccagcucagcag

SEQ ID NO: 2101024 - RNA, 11 nt, Human
gccuccaugcu

SEQ ID NO: 2101025 - RNA, 20 nt, Human
gccuccuuccuugcuguccu

SEQ ID NO: 2101026 - RNA, 13 nt, Human
gccugcuccagcu

SEQ ID NO: 2101027 - RNA, 17 nt, Human
gccugcggccugcugga

SEQ ID NO: 2101028 - RNA, 20 nt, Human
gccugcguuuuggaagcucu

SEQ ID NO: 2101029 - RNA, 14 nt, Human
gccugcguggcuga

SEQ ID NO: 2101030 - RNA, 16 nt, Human
gccugcguggcugacc

SEQ ID NO: 2101031 - RNA, 17 nt, Human
gccugcguggcugaccc

SEQ ID NO: 2101032 - RNA, 22 nt, Human
gccugcguggcugaccccccuc

SEQ ID NO: 2101033 - RNA, 16 nt, Human
gccugcggucaaggcc

SEQ ID NO: 2101034 - RNA, 17 nt, Human
gccugcggucaaggcca

SEQ ID NO: 2101035 - RNA, 19 nt, Human
gccugcggucaaggccagc

SEQ ID NO: 2101036 - RNA, 23 nt, Human
gccugcuaauuccccagauugca

SEQ ID NO: 2101037 - RNA, 17 nt, Human
gccugcuaauuccccag

SEQ ID NO: 2101038 - RNA, 14 nt, Human
gcgauucuucugcu

SEQ ID NO: 2101039 - RNA, 17 nt, Human
gcgauucuucugcuuca

SEQ ID NO: 2101040 - RNA, 20 nt, Human
gcgagaaccuaaguuucagu

SEQ ID NO: 2101041 - RNA, 18 nt, Human
gcgagacuccgucucaaa

SEQ ID NO: 2101042 - RNA, 16 nt, Human
gcgagacucugucuca

SEQ ID NO: 2101043 - RNA, 23 nt, Human
gcgagauggggugggguggagaa

SEQ ID NO: 2101044 - RNA, 16 nt, Human
gcgagagucugucuca

SEQ ID NO: 2101045 - RNA, 14 nt, Human
gcgaggggagggug

SEQ ID NO: 2101046 - RNA, 13 nt, Human
gcgauucuucugc

SEQ ID NO: 2101047 - RNA, 20 nt, Human
gcgagugugugcaugugugu

SEQ ID NO: 2101048 - RNA, 17 nt, Human
gcgauccaccugucuca

SEQ ID NO: 2101049 - RNA, 16 nt, Human
gcgaggucaacagaga

SEQ ID NO: 2101050 - RNA, 17 nt, Human
gcgaggucaacagagaa

SEQ ID NO: 2101051 - RNA, 18 nt, Human
gcgaggucaacagagaag

SEQ ID NO: 2101052 - RNA, 19 nt, Human
gcgaggucaacagagaagg

SEQ ID NO: 2101053 - RNA, 22 nt, Human
gcgaggucaacagagaaggcag

SEQ ID NO: 2101054 - RNA, 23 nt, Human
gcgaggucaacagagaaggcagg

SEQ ID NO: 2101055 - RNA, 17 nt, Human
gcgaguuguggaaagcc

SEQ ID NO: 2101056 - RNA, 17 nt, Human
gcgaucauggcucacug

SEQ ID NO: 2101057 - RNA, 18 nt, Human
gcgaucauggcucacugc

SEQ ID NO: 2101058 - RNA, 20 nt, Human
gcgaucauggcucacugcag

SEQ ID NO: 2101059 - RNA, 21 nt, Human
gcgaucauggcucacugcagc

SEQ ID NO: 2101060 - RNA, 22 nt, Human
gcgaucauggcucacugcagcc

SEQ ID NO: 2101061 - RNA, 16 nt, Human
gcgauccaccugucuc

SEQ ID NO: 2101062 - RNA, 19 nt, Human
gcggccgcauucccugagu

SEQ ID NO: 2101063 - RNA, 16 nt, Human
gcggccgcauucccug

SEQ ID NO: 2101064 - RNA, 17 nt, Human
gcggccgcauucccuga

SEQ ID NO: 2101065 - RNA, 18 nt, Human
gcggccgcauucccugag

SEQ ID NO: 2101066 - RNA, 15 nt, Human
gcggccgcauucccu

SEQ ID NO: 2101067 - RNA, 14 nt, Human
gcgugcacacacca

SEQ ID NO: 2101068 - RNA, 18 nt, Human
gcgugcacacaccagagc

SEQ ID NO: 2101069 - RNA, 16 nt, Human
gcggagcuugcaguga

SEQ ID NO: 2101070 - RNA, 15 nt, Human
gcggagguugcaggg

SEQ ID NO: 2101071 - RNA, 16 nt, Human
gcggagguugcaggga

SEQ ID NO: 2101072 - RNA, 11 nt, Human
gcuagaaauga

SEQ ID NO: 2101073 - RNA, 12 nt, Human
gcuacuuuguuu

SEQ ID NO: 2101074 - RNA, 11 nt, Human
gcuagaaaugg

SEQ ID NO: 2101075 - RNA, 17 nt, Human
gcuacuuccugccuggu

SEQ ID NO: 2101076 - RNA, 20 nt, Human
gcuacuuccugccuggucuc

SEQ ID NO: 2101077 - RNA, 21 nt, Human
gcuacuuccugccuggucucc

SEQ ID NO: 2101078 - RNA, 13 nt, Human
gcuacuugggagg

SEQ ID NO: 2101079 - RNA, 20 nt, Human
gcuacuguccuacccacccu

SEQ ID NO: 2101080 - RNA, 19 nt, Human
gcuacuguccuacccaccc

SEQ ID NO: 2101081 - RNA, 16 nt, Human
gcuaauuuuucauuuu

SEQ ID NO: 2101082 - RNA, 14 nt, Human
gcguuggaauuaaa

SEQ ID NO: 2101083 - RNA, 17 nt, Human
gcguuggaauuaaaaca

SEQ ID NO: 2101084 - RNA, 19 nt, Human
gcguuggaauuaaaacaau

SEQ ID NO: 2101085 - RNA, 20 nt, Human
gcuacaaauacucuuaggaa

SEQ ID NO: 2101086 - RNA, 14 nt, Human
gccagcccagccca

SEQ ID NO: 2101087 - RNA, 13 nt, Human
gccagcccagccc

SEQ ID NO: 2101088 - RNA, 22 nt, Human
gccagccagugaccugaggaag

SEQ ID NO: 2101089 - RNA, 19 nt, Human
gccagccagugaccugagg

SEQ ID NO: 2101090 - RNA, 16 nt, Human
gccagccagcagccag

SEQ ID NO: 2101091 - RNA, 19 nt, Human
gccagccagcagccagcuc

SEQ ID NO: 2101092 - RNA, 17 nt, Human
gccagccccacccagga

SEQ ID NO: 2101093 - RNA, 13 nt, Human
gccagccccaccc

SEQ ID NO: 2101094 - RNA, 14 nt, Human
gccagccccaccca

SEQ ID NO: 2101095 - RNA, 15 nt, Human
gccagccccacccag

SEQ ID NO: 2101096 - RNA, 18 nt, Human
gccaggcccccaagccug

SEQ ID NO: 2101097 - RNA, 23 nt, Human
gccaggcccccaagccugcaguc

SEQ ID NO: 2101098 - RNA, 19 nt, Human
gccaggcccccaagccugc

SEQ ID NO: 2101099 - RNA, 16 nt, Human
gccaggcccggggcug

SEQ ID NO: 2101100 - RNA, 17 nt, Human
gccaggcccggggcugg

SEQ ID NO: 2101101 - RNA, 18 nt, Human
gccaggcccggggcuggc

SEQ ID NO: 2101102 - RNA, 22 nt, Human
gccaggccagagggagugacag

SEQ ID NO: 2101103 - RNA, 15 nt, Human
gccaggccagaggga

SEQ ID NO: 2101104 - RNA, 14 nt, Human
gccaggcagaucug

SEQ ID NO: 2101105 - RNA, 15 nt, Human
gccaggcagaucugu

SEQ ID NO: 2101106 - RNA, 21 nt, Human
gccaggcagaucugugcccca

SEQ ID NO: 2101107 - RNA, 23 nt, Human
gccaggcagaucugugccccaug

SEQ ID NO: 2101108 - RNA, 21 nt, Human
gccagugccuuaccuccugcc

SEQ ID NO: 2101109 - RNA, 20 nt, Human
gccagugccuuaccuccugc

SEQ ID NO: 2101110 - RNA, 22 nt, Human
gccagugccuuaccuccugccc

SEQ ID NO: 2101111 - RNA, 23 nt, Human
gccagugccuuaccuccugccca

SEQ ID NO: 2101112 - RNA, 13 nt, Human
gccagugugacaa

SEQ ID NO: 2101113 - RNA, 12 nt, Human
gccagugucuuu

SEQ ID NO: 2101114 - RNA, 13 nt, Human
gccagugucuuuc

SEQ ID NO: 2101115 - RNA, 14 nt, Human
gccagugucuuucu

SEQ ID NO: 2101116 - RNA, 15 nt, Human
gccagugucuuucuu

SEQ ID NO: 2101117 - RNA, 18 nt, Human
gccagugucuuucuuugg

SEQ ID NO: 2101118 - RNA, 17 nt, Human
gccagugugaucccaag

SEQ ID NO: 2101119 - RNA, 20 nt, Human
gccagugugaucccaagugc

SEQ ID NO: 2101120 - RNA, 14 nt, Human
gccaguuggaacca

SEQ ID NO: 2101121 - RNA, 22 nt, Human
gcccucaggucagggugaggau

SEQ ID NO: 2101122 - RNA, 23 nt, Human
gcccucaggucagggugaggaug

SEQ ID NO: 2101123 - RNA, 21 nt, Human
gcccuagagcacacuguagca

SEQ ID NO: 2101124 - RNA, 13 nt, Human
gcccuagcuccac

SEQ ID NO: 2101125 - RNA, 14 nt, Human
gcccuaggccuggc

SEQ ID NO: 2101126 - RNA, 12 nt, Human
gcccuaggcucc

SEQ ID NO: 2101127 - RNA, 17 nt, Human
gcccuaggcuccgucag

SEQ ID NO: 2101128 - RNA, 22 nt, Human
gcccauuccccagccucucuuc

SEQ ID NO: 2101129 - RNA, 14 nt, Human
gcccauucucucuc

SEQ ID NO: 2101130 - RNA, 15 nt, Human
gcccauucucucucc

SEQ ID NO: 2101131 - RNA, 17 nt, Human
gcccauucucucuccug

SEQ ID NO: 2101132 - RNA, 19 nt, Human
gcccauucucucuccuguc

SEQ ID NO: 2101133 - RNA, 21 nt, Human
gcccauucucucuccugucca

SEQ ID NO: 2101134 - RNA, 21 nt, Human
gcccauuuacacuuuugagac

SEQ ID NO: 2101135 - RNA, 20 nt, Human
gcccauucucucuccugucc

SEQ ID NO: 2101136 - RNA, 22 nt, Human
gcccauuucacaccugaaaaug

SEQ ID NO: 2101137 - RNA, 22 nt, Human
gccccaacuccuggaagcugug

SEQ ID NO: 2101138 - RNA, 17 nt, Human
gccccaagaaggcuggg

SEQ ID NO: 2101139 - RNA, 21 nt, Human
gccccaagaaggcuggggcua

SEQ ID NO: 2101140 - RNA, 19 nt, Human
gccccaagggguuucuguu

SEQ ID NO: 2101141 - RNA, 21 nt, Human
gccccaagggguuucuguuuc

SEQ ID NO: 2101142 - RNA, 22 nt, Human
gccccaagggguuucuguuucu

SEQ ID NO: 2101143 - RNA, 22 nt, Human
gccccugcugguucaggguugg

SEQ ID NO: 2101144 - RNA, 21 nt, Human
gccccugcugguucaggguug

SEQ ID NO: 2101145 - RNA, 15 nt, Human
gcccccgcucauggg

SEQ ID NO: 2101146 - RNA, 16 nt, Human
gcccccgcucaugggc

SEQ ID NO: 2101147 - RNA, 13 nt, Human
gcccccgccccgc

SEQ ID NO: 2101148 - RNA, 16 nt, Human
gcccccgccccgcccc

SEQ ID NO: 2101149 - RNA, 20 nt, Human
gccccacacggaggcaucug

SEQ ID NO: 2101150 - RNA, 18 nt, Human
gccccacccucagaugca

SEQ ID NO: 2101151 - RNA, 15 nt, Human
gccccacccucagau

SEQ ID NO: 2101152 - RNA, 11 nt, Human
gcccccgcccc

SEQ ID NO: 2101153 - RNA, 13 nt, Human
gcccccgagcugg

SEQ ID NO: 2101154 - RNA, 14 nt, Human
gcccccgagcuggg

SEQ ID NO: 2101155 - RNA, 22 nt, Human
gcccccgagcugggggccauga

SEQ ID NO: 2101156 - RNA, 18 nt, Human
gcccaggccccugccacc

SEQ ID NO: 2101157 - RNA, 17 nt, Human
gcccaggccccugccac

SEQ ID NO: 2101158 - RNA, 16 nt, Human
gccauguguuccaagg

SEQ ID NO: 2101159 - RNA, 15 nt, Human
gccauguguuccaag

SEQ ID NO: 2101160 - RNA, 21 nt, Human
gcccaggagagccagcccucc

SEQ ID NO: 2101161 - RNA, 19 nt, Human
gcccaggagagccagcccu

SEQ ID NO: 2101162 - RNA, 20 nt, Human
gcccaggagagccagcccuc

SEQ ID NO: 2101163 - RNA, 14 nt, Human
gccaugugccaggu

SEQ ID NO: 2101164 - RNA, 13 nt, Human
gcccaggccccug

SEQ ID NO: 2101165 - RNA, 15 nt, Human
gcccaggccccugcc

SEQ ID NO: 2101166 - RNA, 16 nt, Human
gcccaggcaggucuug

SEQ ID NO: 2101167 - RNA, 14 nt, Human
gcccaggcaggucu

SEQ ID NO: 2101168 - RNA, 22 nt, Human
gcccaggaguuugaggcugcag

SEQ ID NO: 2101169 - RNA, 12 nt, Human
gcccaggcaggu

SEQ ID NO: 2101170 - RNA, 13 nt, Human
gcccaggcagguc

SEQ ID NO: 2101171 - RNA, 16 nt, Human
gcuggagcccagggag

SEQ ID NO: 2101172 - RNA, 22 nt, Human
gcuggagcccagggagcggaaa

SEQ ID NO: 2101173 - RNA, 19 nt, Human
gcugcugaccuccacagcu

SEQ ID NO: 2101174 - RNA, 16 nt, Human
gcugcugacugauguu

SEQ ID NO: 2101175 - RNA, 12 nt, Human
gcugcugacagu

SEQ ID NO: 2101176 - RNA, 18 nt, Human
gcugcugaccuccacagc

SEQ ID NO: 2101177 - RNA, 17 nt, Human
gcugccauccagguuca

SEQ ID NO: 2101178 - RNA, 12 nt, Human
gcugcuccccuc

SEQ ID NO: 2101179 - RNA, 20 nt, Human
gcugcuccccucccuccucu

SEQ ID NO: 2101180 - RNA, 13 nt, Human
gcugcacccucag

SEQ ID NO: 2101181 - RNA, 15 nt, Human
gcugcacccucaggc

SEQ ID NO: 2101182 - RNA, 16 nt, Human
gcugcacccucaggca

SEQ ID NO: 2101183 - RNA, 18 nt, Human
gcugcagagacagagagg

SEQ ID NO: 2101184 - RNA, 13 nt, Human
gcugccauccagg

SEQ ID NO: 2101185 - RNA, 12 nt, Human
gcugccauccag

SEQ ID NO: 2101186 - RNA, 15 nt, Human
gcugcagcugggcug

SEQ ID NO: 2101187 - RNA, 23 nt, Human
gcugagucaugaucucccugccg

SEQ ID NO: 2101188 - RNA, 21 nt, Human
gcugagucaugaucucccugc

SEQ ID NO: 2101189 - RNA, 22 nt, Human
gcugagucaugaucucccugcc

SEQ ID NO: 2101190 - RNA, 15 nt, Human
gcugaggugggagga

SEQ ID NO: 2101191 - RNA, 19 nt, Human
gcugaggugggaggaucac

SEQ ID NO: 2101192 - RNA, 19 nt, Human
gcuccucuccccagcaagu

SEQ ID NO: 2101193 - RNA, 16 nt, Human
gcuccucuccccagca

SEQ ID NO: 2101194 - RNA, 19 nt, Human
gcucuacugaggugcuaug

SEQ ID NO: 2101195 - RNA, 16 nt, Human
gcucuagacaacccug

SEQ ID NO: 2101196 - RNA, 18 nt, Human
gcucuagacaacccugca

SEQ ID NO: 2101197 - RNA, 19 nt, Human
gcucuagacaacccugcaa

SEQ ID NO: 2101198 - RNA, 11 nt, Human
gcucucagaag

SEQ ID NO: 2101199 - RNA, 10 nt, Human
gcucucagcc

SEQ ID NO: 2101200 - RNA, 11 nt, Human
gcucucagcca

SEQ ID NO: 2101201 - RNA, 17 nt, Human
gcucucagccaacgagu

SEQ ID NO: 2101202 - RNA, 12 nt, Human
gcucucagaagg

SEQ ID NO: 2101203 - RNA, 18 nt, Human
gcucucaaguuaucaggg

SEQ ID NO: 2101204 - RNA, 21 nt, Human
gcuccucccucccucugccgg

SEQ ID NO: 2101205 - RNA, 21 nt, Human
gcucuagccugggcaacaaca

SEQ ID NO: 2101206 - RNA, 14 nt, Human
gcucuagccugggc

SEQ ID NO: 2101207 - RNA, 15 nt, Human
gcuccagacccccag

SEQ ID NO: 2101208 - RNA, 14 nt, Human
gcuccagaccccca

SEQ ID NO: 2101209 - RNA, 17 nt, Human
gcuccagacccccagca

SEQ ID NO: 2101210 - RNA, 23 nt, Human
gcuccagacccccagcaacccuc

SEQ ID NO: 2101211 - RNA, 17 nt, Human
gcuccagcucaccagcc

SEQ ID NO: 2101212 - RNA, 14 nt, Human
gcucccagggccau

SEQ ID NO: 2101213 - RNA, 22 nt, Human
gcucccagggccaugaacuuug

SEQ ID NO: 2101214 - RNA, 14 nt, Human
gcuccagccaaccc

SEQ ID NO: 2101215 - RNA, 16 nt, Human
gcuccagccaaccccu

SEQ ID NO: 2101216 - RNA, 17 nt, Human
gcuccagccaaccccug

SEQ ID NO: 2101217 - RNA, 18 nt, Human
gcuccagccaaccccugu

SEQ ID NO: 2101218 - RNA, 22 nt, Human
gcuccagccaaccccuguggag

SEQ ID NO: 2101219 - RNA, 23 nt, Human
gcuccagccaaccccuguggagc

SEQ ID NO: 2101220 - RNA, 14 nt, Human
gcuccagcucacca

SEQ ID NO: 2101221 - RNA, 13 nt, Human
gcuccagcucacc

SEQ ID NO: 2101222 - RNA, 15 nt, Human
gcuccucuccccagc

SEQ ID NO: 2101223 - RNA, 16 nt, Human
gcuccucccggugccc

SEQ ID NO: 2101224 - RNA, 19 nt, Human
gcuccucccggugcccaag

SEQ ID NO: 2101225 - RNA, 15 nt, Human
gcucugaaagccagc

SEQ ID NO: 2101226 - RNA, 23 nt, Human
gcucugaagucacaucacaggac

SEQ ID NO: 2101227 - RNA, 17 nt, Human
gcucugaaagccagcug

SEQ ID NO: 2101228 - RNA, 22 nt, Human
gcucugaagucacaucacagga

SEQ ID NO: 2101229 - RNA, 20 nt, Human
gcucugaucauccacugugc

SEQ ID NO: 2101230 - RNA, 22 nt, Human
gcucugaucauccacugugcca

SEQ ID NO: 2101231 - RNA, 21 nt, Human
gcucugaucauccacugugcc

SEQ ID NO: 2101232 - RNA, 12 nt, Human
gcucugcccaga

SEQ ID NO: 2101233 - RNA, 13 nt, Human
gcucugcccagag

SEQ ID NO: 2101234 - RNA, 14 nt, Human
gcucugcccagagc

SEQ ID NO: 2101235 - RNA, 15 nt, Human
gcucugcccagagcu

SEQ ID NO: 2101236 - RNA, 16 nt, Human
gcucugcccagagcug

SEQ ID NO: 2101237 - RNA, 17 nt, Human
gcucugcccagagcugg

SEQ ID NO: 2101238 - RNA, 18 nt, Human
gcucugcccagagcuggg

SEQ ID NO: 2101239 - RNA, 20 nt, Human
gcucugcccagagcugggug

SEQ ID NO: 2101240 - RNA, 21 nt, Human
gcucugcccagagcuggguga

SEQ ID NO: 2101241 - RNA, 14 nt, Human
gcucugugcaggga

SEQ ID NO: 2101242 - RNA, 19 nt, Human
gcucuggugacaccagccu

SEQ ID NO: 2101243 - RNA, 20 nt, Human
gcucuggugacaccagccuu

SEQ ID NO: 2101244 - RNA, 15 nt, Human
gcucuggagccaccu

SEQ ID NO: 2101245 - RNA, 16 nt, Human
gcucuggagccaccug

SEQ ID NO: 2101246 - RNA, 17 nt, Human
gcucuggagccaccugu

SEQ ID NO: 2101247 - RNA, 18 nt, Human
gcucuggagccaccuguc

SEQ ID NO: 2101248 - RNA, 20 nt, Human
gcucuggagccaccuguccc

SEQ ID NO: 2101249 - RNA, 22 nt, Human
gcucuggagccaccugucccac

SEQ ID NO: 2101250 - RNA, 23 nt, Human
gcucuggagccaccugucccacc

SEQ ID NO: 2101251 - RNA, 18 nt, Human
gcucuggugacaccagcc

SEQ ID NO: 2101252 - RNA, 15 nt, Human
gcucuuuucaaugaa

SEQ ID NO: 2101253 - RNA, 16 nt, Human
gcucuguguugccaug

SEQ ID NO: 2101254 - RNA, 12 nt, Human
gcugaacaucac

SEQ ID NO: 2101255 - RNA, 18 nt, Human
gcugaaacaggagagaaa

SEQ ID NO: 2101256 - RNA, 14 nt, Human
gcugaaagagaaaa

SEQ ID NO: 2101257 - RNA, 16 nt, Human
gcugaaacaggagaga

SEQ ID NO: 2101258 - RNA, 17 nt, Human
gcugaaacaggagagaa

SEQ ID NO: 2101259 - RNA, 15 nt, Human
gcugagcccuggcag

SEQ ID NO: 2101260 - RNA, 16 nt, Human
gcugagcccuggcagg

SEQ ID NO: 2101261 - RNA, 13 nt, Human
gcugacagacaca

SEQ ID NO: 2101262 - RNA, 19 nt, Human
gcugacacguccaccccag

SEQ ID NO: 2101263 - RNA, 13 nt, Human
gcugagcccuggc

SEQ ID NO: 2101264 - RNA, 14 nt, Human
gcugagcccuggca

SEQ ID NO: 2101265 - RNA, 18 nt, Human
gcugaagaauuauuuuuu

SEQ ID NO: 2101266 - RNA, 15 nt, Human
gcugaagagugagga

SEQ ID NO: 2101267 - RNA, 16 nt, Human
gcugaacggggagaaa

SEQ ID NO: 2101268 - RNA, 17 nt, Human
gcugaacggggagaaaa

SEQ ID NO: 2101269 - RNA, 17 nt, Human
gcugaauacagaggcaa

SEQ ID NO: 2101270 - RNA, 19 nt, Human
gcugacaaccaccgcuccc

SEQ ID NO: 2101271 - RNA, 21 nt, Human
gcugacaaccaccgcucccca

SEQ ID NO: 2101272 - RNA, 22 nt, Human
gcugacaaccaccgcuccccag

SEQ ID NO: 2101273 - RNA, 23 nt, Human
gcugacaaccaccgcuccccagc

SEQ ID NO: 2101274 - RNA, 14 nt, Human
gcuuuuccuugggg

SEQ ID NO: 2101275 - RNA, 20 nt, Human
gcuuuuccuuggggcaggca

SEQ ID NO: 2101276 - RNA, 21 nt, Human
gcuuuuccuuggggcaggcag

SEQ ID NO: 2101277 - RNA, 22 nt, Human
gcuuuuccuuggggcaggcagu

SEQ ID NO: 2101278 - RNA, 23 nt, Human
gcuuuuccuuggggcaggcagug

SEQ ID NO: 2101279 - RNA, 22 nt, Human
gcuuuuccuuuguuuuuaugaa

SEQ ID NO: 2101280 - RNA, 18 nt, Human
gcuuuugucuaugggacu

SEQ ID NO: 2101281 - RNA, 15 nt, Human
gcuuuuggucugugu

SEQ ID NO: 2101282 - RNA, 18 nt, Human
ggaaaauuuuaaaaauac

SEQ ID NO: 2101283 - RNA, 16 nt, Human
gcuuuuugucuuuucu

SEQ ID NO: 2101284 - RNA, 20 nt, Human
gcuuuuuuauuuuuuauaca

SEQ ID NO: 2101285 - RNA, 13 nt, Human
ggaaacaaagugg

SEQ ID NO: 2101286 - RNA, 22 nt, Human
ggaaacaaaguggaaggaaaga

SEQ ID NO: 2101287 - RNA, 17 nt, Human
ggaacugaacauuccag

SEQ ID NO: 2101288 - RNA, 14 nt, Human
ggaagacaauguga

SEQ ID NO: 2101289 - RNA, 16 nt, Human
ggaagacaaugugaaa

SEQ ID NO: 2101290 - RNA, 12 nt, Human
ggaagaaacaaa

SEQ ID NO: 2101291 - RNA, 14 nt, Human
ggaagaaaagagcu

SEQ ID NO: 2101292 - RNA, 13 nt, Human
ggaagaacauaga

SEQ ID NO: 2101293 - RNA, 14 nt, Human
ggaagaacauagaa

SEQ ID NO: 2101294 - RNA, 16 nt, Human
ggaagaacauagaacu

SEQ ID NO: 2101295 - RNA, 16 nt, Human
ggaaacuagcuuacau

SEQ ID NO: 2101296 - RNA, 15 nt, Human
ggaaacgugcccucu

SEQ ID NO: 2101297 - RNA, 14 nt, Human
ggaaacuaaaacuu

SEQ ID NO: 2101298 - RNA, 17 nt, Human
ggaaaugccuaagaaga

SEQ ID NO: 2101299 - RNA, 15 nt, Human
ggaaaugaaagaaag

SEQ ID NO: 2101300 - RNA, 17 nt, Human
ggaaaugaauuucucua

SEQ ID NO: 2101301 - RNA, 17 nt, Human
ggaaauuggaagagcac

SEQ ID NO: 2101302 - RNA, 17 nt, Human
ggaaaugucaacaagua

SEQ ID NO: 2101303 - RNA, 17 nt, Human
gcuuccaugagaacagc

SEQ ID NO: 2101304 - RNA, 17 nt, Human
gcuuccauuugugugug

SEQ ID NO: 2101305 - RNA, 12 nt, Human
gcuuccauucca

SEQ ID NO: 2101306 - RNA, 21 nt, Human
gcuucuuaauauaacugccuu

SEQ ID NO: 2101307 - RNA, 22 nt, Human
gcuucuuaauauaacugccuua

SEQ ID NO: 2101308 - RNA, 18 nt, Human
gcuucuuacuauuaagca

SEQ ID NO: 2101309 - RNA, 20 nt, Human
gcuucuuacuauuaagcagu

SEQ ID NO: 2101310 - RNA, 13 nt, Human
gcuugaaagaaaa

SEQ ID NO: 2101311 - RNA, 15 nt, Human
gcuugacaggacagc

SEQ ID NO: 2101312 - RNA, 16 nt, Human
gcuugacaggacagca

SEQ ID NO: 2101313 - RNA, 14 nt, Human
gcuugaagccaagu

SEQ ID NO: 2101314 - RNA, 22 nt, Human
gcuugaagaucguuaguaucua

SEQ ID NO: 2101315 - RNA, 13 nt, Human
gcuugaacccagg

SEQ ID NO: 2101316 - RNA, 11 nt, Human
gcuugaacaca

SEQ ID NO: 2101317 - RNA, 12 nt, Human
gcuugaacacag

SEQ ID NO: 2101318 - RNA, 16 nt, Human
gcuugaacacaguauu

SEQ ID NO: 2101319 - RNA, 17 nt, Human
gcuugaacacaguauuu

SEQ ID NO: 2101320 - RNA, 23 nt, Human
gcuugaacacaguauuuucccaa

SEQ ID NO: 2101321 - RNA, 21 nt, Human
gcuugaagaucguuaguaucu

SEQ ID NO: 2101322 - RNA, 20 nt, Human
gcuugaaagaaaauaugcau

SEQ ID NO: 2101323 - RNA, 16 nt, Human
gcuugaacccaggagg

SEQ ID NO: 2101324 - RNA, 23 nt, Human
gcuugaaccugggaggcagaggu

SEQ ID NO: 2101325 - RNA, 17 nt, Human
gcuuguaaauagcucag

SEQ ID NO: 2101326 - RNA, 19 nt, Human
gcuuguaaauagcucaggu

SEQ ID NO: 2101327 - RNA, 18 nt, Human
gcuuguaaauagcucagg

SEQ ID NO: 2101328 - RNA, 18 nt, Human
gcuuucucugcuucagcu

SEQ ID NO: 2101329 - RNA, 20 nt, Human
gcuuucucugcuucagcuug

SEQ ID NO: 2101330 - RNA, 13 nt, Human
gcuuucuggagag

SEQ ID NO: 2101331 - RNA, 16 nt, Human
gcugguuccugcuaga

SEQ ID NO: 2101332 - RNA, 19 nt, Human
gcugguuccugcuagaaau

SEQ ID NO: 2101333 - RNA, 23 nt, Human
gcugguucaggguuggccccugc

SEQ ID NO: 2101334 - RNA, 15 nt, Human
gcugguuuccucauu

SEQ ID NO: 2101335 - RNA, 24 nt, Human
gcugguugucauuuuugcaguaga

SEQ ID NO: 2101336 - RNA, 19 nt, Human
gcuguauuagucacagaga

SEQ ID NO: 2101337 - RNA, 13 nt, Human
gcuguauucuucu

SEQ ID NO: 2101338 - RNA, 13 nt, Human
gcuguagaaggag

SEQ ID NO: 2101339 - RNA, 12 nt, Human
gcugguuuuccu

SEQ ID NO: 2101340 - RNA, 14 nt, Human
gcugguuuuccuaa

SEQ ID NO: 2101341 - RNA, 23 nt, Human
gcugguuuuccuaaaugcaguga

SEQ ID NO: 2101342 - RNA, 19 nt, Human
gcuggagugcaguggugcg

SEQ ID NO: 2101343 - RNA, 20 nt, Human
gcuggagugcaguggugcga

SEQ ID NO: 2101344 - RNA, 12 nt, Human
gcuggagcggcu

SEQ ID NO: 2101345 - RNA, 15 nt, Human
gcuggauaaaaugag

SEQ ID NO: 2101346 - RNA, 14 nt, Human
gcuggauaaaauga

SEQ ID NO: 2101347 - RNA, 14 nt, Human
gcuggaucucccag

SEQ ID NO: 2101348 - RNA, 19 nt, Human
gcuggaucucccagggcua

SEQ ID NO: 2101349 - RNA, 20 nt, Human
gcuggaucucccagggcuac

SEQ ID NO: 2101350 - RNA, 15 nt, Human
gcuucaguggcagcu

SEQ ID NO: 2101351 - RNA, 14 nt, Human
gcuucaguggcagc

SEQ ID NO: 2101352 - RNA, 12 nt, Human
gcuuauuuuaaa

SEQ ID NO: 2101353 - RNA, 13 nt, Human
gcuuacaagccag

SEQ ID NO: 2101354 - RNA, 19 nt, Human
gcuuacaagccagcuggag

SEQ ID NO: 2101355 - RNA, 22 nt, Human
gcuuacaagccagcuggagaaa

SEQ ID NO: 2101356 - RNA, 15 nt, Human
gcuuaaaaaucauug

SEQ ID NO: 2101357 - RNA, 13 nt, Human
gcuuaaaaaaaac

SEQ ID NO: 2101358 - RNA, 18 nt, Human
gcuuaaugacacuagcua

SEQ ID NO: 2101359 - RNA, 21 nt, Human
gcuguuuguuugacaaagaaa

SEQ ID NO: 2101360 - RNA, 17 nt, Human
gcuguuuucccugaccu

SEQ ID NO: 2101361 - RNA, 12 nt, Human
gcugugccucug

SEQ ID NO: 2101362 - RNA, 20 nt, Human
gcuguuuguuugacaaagaa

SEQ ID NO: 2101363 - RNA, 12 nt, Human
gcuguuugucau

SEQ ID NO: 2101364 - RNA, 14 nt, Human
gcuguuggcugggg

SEQ ID NO: 2101365 - RNA, 13 nt, Human
gcuguuggcuggg

SEQ ID NO: 2101366 - RNA, 13 nt, Human
ggagcagugucuu

SEQ ID NO: 2101367 - RNA, 17 nt, Human
ggagcagugucuuccau

SEQ ID NO: 2101368 - RNA, 18 nt, Human
ggagcagugucuuccaua

SEQ ID NO: 2101369 - RNA, 16 nt, Human
ggagcaucucuugagg

SEQ ID NO: 2101370 - RNA, 20 nt, Human
ggagcaucucuugaggccag

SEQ ID NO: 2101371 - RNA, 21 nt, Human
ggagcaucucuugaggccagg

SEQ ID NO: 2101372 - RNA, 20 nt, Human
ggagguggagguugcaguga

SEQ ID NO: 2101373 - RNA, 15 nt, Human
ggagguggcagcccu

SEQ ID NO: 2101374 - RNA, 19 nt, Human
ggagguggagguugcagug

SEQ ID NO: 2101375 - RNA, 20 nt, Human
ggagguggaggcugcaguga

SEQ ID NO: 2101376 - RNA, 14 nt, Human
ggaggugaccccag

SEQ ID NO: 2101377 - RNA, 14 nt, Human
ggaggucgaggcag

SEQ ID NO: 2101378 - RNA, 22 nt, Human
ggaggucgaccccaaagccccu

SEQ ID NO: 2101379 - RNA, 20 nt, Human
ggaggucaaggcugcaguga

SEQ ID NO: 2101380 - RNA, 20 nt, Human
ggagguagagguugugguga

SEQ ID NO: 2101381 - RNA, 22 nt, Human
ggagguauucguaaggauggga

SEQ ID NO: 2101382 - RNA, 17 nt, Human
ggaggcccguccggcag

SEQ ID NO: 2101383 - RNA, 13 nt, Human
ggaggccucuggg

SEQ ID NO: 2101384 - RNA, 15 nt, Human
ggaggccucugggcc

SEQ ID NO: 2101385 - RNA, 18 nt, Human
ggaggccgggugcucagg

SEQ ID NO: 2101386 - RNA, 16 nt, Human
ggaggggguuacaaac

SEQ ID NO: 2101387 - RNA, 18 nt, Human
ggaggggguuugggggcu

SEQ ID NO: 2101388 - RNA, 17 nt, Human
ggaggggugguccugac

SEQ ID NO: 2101389 - RNA, 21 nt, Human
ggagcugccuguucagcucca

SEQ ID NO: 2101390 - RNA, 12 nt, Human
ggagcugccugu

SEQ ID NO: 2101391 - RNA, 22 nt, Human
ggagccccgaggccuucucuga

SEQ ID NO: 2101392 - RNA, 13 nt, Human
ggagcccccgccc

SEQ ID NO: 2101393 - RNA, 20 nt, Human
ggagcccccgccccgcccca

SEQ ID NO: 2101394 - RNA, 16 nt, Human
ggagccccgaggccuu

SEQ ID NO: 2101395 - RNA, 16 nt, Human
ggagccaauggagacu

SEQ ID NO: 2101396 - RNA, 23 nt, Human
ggagccaaggguucagagacuca

SEQ ID NO: 2101397 - RNA, 20 nt, Human
ggagccaacagaagcuucca

SEQ ID NO: 2101398 - RNA, 17 nt, Human
ggagccaaauguggcau

SEQ ID NO: 2101399 - RNA, 15 nt, Human
ggagccacucuguuc

SEQ ID NO: 2101400 - RNA, 13 nt, Human
ggagccaccuguc

SEQ ID NO: 2101401 - RNA, 16 nt, Human
ggagccaccuguccca

SEQ ID NO: 2101402 - RNA, 21 nt, Human
ggaggaaggcuuacacccaca

SEQ ID NO: 2101403 - RNA, 22 nt, Human
ggaggaaggagccuauggcauc

SEQ ID NO: 2101404 - RNA, 13 nt, Human
ggaggaaggagag

SEQ ID NO: 2101405 - RNA, 15 nt, Human
ggagcuuaccuccca

SEQ ID NO: 2101406 - RNA, 18 nt, Human
ggagcuuaccucccaccu

SEQ ID NO: 2101407 - RNA, 21 nt, Human
ggagcuuagccaaugugggag

SEQ ID NO: 2101408 - RNA, 21 nt, Human
ggagcugggacacuuaacaga

SEQ ID NO: 2101409 - RNA, 14 nt, Human
ggagcugggaggaa

SEQ ID NO: 2101410 - RNA, 15 nt, Human
ggagcugggaggaaa

SEQ ID NO: 2101411 - RNA, 17 nt, Human
ggagcuggcgucugucu

SEQ ID NO: 2101412 - RNA, 19 nt, Human
ggagcugggcagaaggcca

SEQ ID NO: 2101413 - RNA, 18 nt, Human
ggagcugggcagaaggcc

SEQ ID NO: 2101414 - RNA, 16 nt, Human
ggaggaccaaaaaaau

SEQ ID NO: 2101415 - RNA, 17 nt, Human
ggaggaccaaaaaaaua

SEQ ID NO: 2101416 - RNA, 18 nt, Human
ggaggccaagugcaggcu

SEQ ID NO: 2101417 - RNA, 20 nt, Human
ggaggccaaggugggaggau

SEQ ID NO: 2101418 - RNA, 19 nt, Human
ggaggaaucgaggaaccag

SEQ ID NO: 2101419 - RNA, 20 nt, Human
ggaggaaucgaggaaccaga

SEQ ID NO: 2101420 - RNA, 21 nt, Human
ggaggaaucgaggaaccagag

SEQ ID NO: 2101421 - RNA, 22 nt, Human
ggaggaaucgaggaaccagagc

SEQ ID NO: 2101422 - RNA, 23 nt, Human
ggaggaaucgaggaaccagagcc

SEQ ID NO: 2101423 - RNA, 15 nt, Human
ggaggaaugcucccc

SEQ ID NO: 2101424 - RNA, 16 nt, Human
ggaggaaugcuccccc

SEQ ID NO: 2101425 - RNA, 18 nt, Human
ggaggaaugcucccccau

SEQ ID NO: 2101426 - RNA, 17 nt, Human
ggaggaaugcuccccca

SEQ ID NO: 2101427 - RNA, 15 nt, Human
ggaggaauuucugag

SEQ ID NO: 2101428 - RNA, 21 nt, Human
ggaggaauuucugaguggcca

SEQ ID NO: 2101429 - RNA, 12 nt, Human
ggaggccagcca

SEQ ID NO: 2101430 - RNA, 13 nt, Human
ggaggccagccag

SEQ ID NO: 2101431 - RNA, 17 nt, Human
ggaggccccacugggga

SEQ ID NO: 2101432 - RNA, 16 nt, Human
ggaggccagccaguga

SEQ ID NO: 2101433 - RNA, 20 nt, Human
ggaggccaagugcaggcugg

SEQ ID NO: 2101434 - RNA, 13 nt, Human
ggauguucuggga

SEQ ID NO: 2101435 - RNA, 16 nt, Human
ggauguucugggacac

SEQ ID NO: 2101436 - RNA, 15 nt, Human
ggauguucugggaca

SEQ ID NO: 2101437 - RNA, 16 nt, Human
ggauguacauuuccaa

SEQ ID NO: 2101438 - RNA, 18 nt, Human
ggauguauaugucaucuc

SEQ ID NO: 2101439 - RNA, 22 nt, Human
ggauguauccaugggggcaggg

SEQ ID NO: 2101440 - RNA, 23 nt, Human
ggauguauccaugggggcagggc

SEQ ID NO: 2101441 - RNA, 18 nt, Human
ggauguccacagaugccu

SEQ ID NO: 2101442 - RNA, 18 nt, Human
ggaugucacucagaugga

SEQ ID NO: 2101443 - RNA, 17 nt, Human
ggauguccacagaugcc

SEQ ID NO: 2101444 - RNA, 13 nt, Human
ggaugucaccaau

SEQ ID NO: 2101445 - RNA, 11 nt, Human
ggcacaauaaa

SEQ ID NO: 2101446 - RNA, 12 nt, Human
ggcacaauaaau

SEQ ID NO: 2101447 - RNA, 13 nt, Human
ggcacacaccugu

SEQ ID NO: 2101448 - RNA, 21 nt, Human
ggcacacaccuguagucccag

SEQ ID NO: 2101449 - RNA, 21 nt, Human
ggcacagaaacacaauauuuu

SEQ ID NO: 2101450 - RNA, 12 nt, Human
ggcacagcugug

SEQ ID NO: 2101451 - RNA, 18 nt, Human
ggcacagcggggccccag

SEQ ID NO: 2101452 - RNA, 17 nt, Human
ggcacagccggggccug

SEQ ID NO: 2101453 - RNA, 20 nt, Human
ggcacagccggggccugccu

SEQ ID NO: 2101454 - RNA, 21 nt, Human
ggcacagccggggccugccua

SEQ ID NO: 2101455 - RNA, 23 nt, Human
ggcacagccggggccugccuagc

SEQ ID NO: 2101456 - RNA, 16 nt, Human
ggcacagggcaguggg

SEQ ID NO: 2101457 - RNA, 15 nt, Human
ggagugcagugagcc

SEQ ID NO: 2101458 - RNA, 14 nt, Human
ggauggaggagaag

SEQ ID NO: 2101459 - RNA, 19 nt, Human
ggauggaggggugguccug

SEQ ID NO: 2101460 - RNA, 21 nt, Human
ggauggaggggugguccugac

SEQ ID NO: 2101461 - RNA, 18 nt, Human
ggauggauuuccagccaa

SEQ ID NO: 2101462 - RNA, 12 nt, Human
ggaugggaagga

SEQ ID NO: 2101463 - RNA, 15 nt, Human
ggaugggaaggaggg

SEQ ID NO: 2101464 - RNA, 17 nt, Human
ggaugggaaggagggag

SEQ ID NO: 2101465 - RNA, 14 nt, Human
ggauggggccacag

SEQ ID NO: 2101466 - RNA, 15 nt, Human
ggauggggccacagc

SEQ ID NO: 2101467 - RNA, 21 nt, Human
ggaucugguagggggaaaaug

SEQ ID NO: 2101468 - RNA, 18 nt, Human
ggaucuggggcucuggga

SEQ ID NO: 2101469 - RNA, 19 nt, Human
ggaucugggacccuuuccu

SEQ ID NO: 2101470 - RNA, 15 nt, Human
ggaucugacugcacg

SEQ ID NO: 2101471 - RNA, 15 nt, Human
ggaucugugcccaga

SEQ ID NO: 2101472 - RNA, 16 nt, Human
ggaucugugcccagag

SEQ ID NO: 2101473 - RNA, 23 nt, Human
ggaucuguuguguacguggagag

SEQ ID NO: 2101474 - RNA, 23 nt, Human
ggaucugggacccuuuccuuccu

SEQ ID NO: 2101475 - RNA, 19 nt, Human
ggaguuuccuaaaaguuca

SEQ ID NO: 2101476 - RNA, 13 nt, Human
ggaguuugaggcu

SEQ ID NO: 2101477 - RNA, 21 nt, Human
ggaguuggaagugugugaucu

SEQ ID NO: 2101478 - RNA, 19 nt, Human
ggaguuuaagaccagccug

SEQ ID NO: 2101479 - RNA, 20 nt, Human
ggaguuuaagaccagccugg

SEQ ID NO: 2101480 - RNA, 19 nt, Human
ggaguuggcauugcauuua

SEQ ID NO: 2101481 - RNA, 22 nt, Human
ggaguugucaagucucugcugg

SEQ ID NO: 2101482 - RNA, 19 nt, Human
ggaguuugaggcugcagcg

SEQ ID NO: 2101483 - RNA, 20 nt, Human
ggaguuugaggcugcagcga

SEQ ID NO: 2101484 - RNA, 20 nt, Human
ggauaaugcuguugccucau

SEQ ID NO: 2101485 - RNA, 15 nt, Human
ggauaagccagcugc

SEQ ID NO: 2101486 - RNA, 14 nt, Human
ggauaaaaugaggu

SEQ ID NO: 2101487 - RNA, 19 nt, Human
ggauaaacuuuuagaaacu

SEQ ID NO: 2101488 - RNA, 20 nt, Human
ggauaaacuuuuagaaacuu

SEQ ID NO: 2101489 - RNA, 15 nt, Human
ggauaaaaugagguu

SEQ ID NO: 2101490 - RNA, 20 nt, Human
ggaguucgagaccagccugg

SEQ ID NO: 2101491 - RNA, 15 nt, Human
ggaguucgaggcugc

SEQ ID NO: 2101492 - RNA, 20 nt, Human
ggaguucgaggcugcaguca

SEQ ID NO: 2101493 - RNA, 21 nt, Human
ggaguucgaggcugcagucag

SEQ ID NO: 2101494 - RNA, 17 nt, Human
ggcagugggagcugccu

SEQ ID NO: 2101495 - RNA, 15 nt, Human
ggcaccagcagccug

SEQ ID NO: 2101496 - RNA, 16 nt, Human
ggcaccagcagccugg

SEQ ID NO: 2101497 - RNA, 21 nt, Human
ggcaucuuugccuugggcugc

SEQ ID NO: 2101498 - RNA, 16 nt, Human
ggcaucuuugccuugg

SEQ ID NO: 2101499 - RNA, 13 nt, Human
ggcaucuggccuu

SEQ ID NO: 2101500 - RNA, 17 nt, Human
ggcaucuuugccuuggg

SEQ ID NO: 2101501 - RNA, 19 nt, Human
ggcaucuuugccuugggcu

SEQ ID NO: 2101502 - RNA, 15 nt, Human
ggcaucugacacaaa

SEQ ID NO: 2101503 - RNA, 16 nt, Human
ggcaucugacacaaaa

SEQ ID NO: 2101504 - RNA, 17 nt, Human
ggcaucugacacaaaaa

SEQ ID NO: 2101505 - RNA, 20 nt, Human
ggcaucugacacaaaaaaag

SEQ ID NO: 2101506 - RNA, 15 nt, Human
ggcaucugcacccuc

SEQ ID NO: 2101507 - RNA, 14 nt, Human
ggcaucugccccuc

SEQ ID NO: 2101508 - RNA, 22 nt, Human
ggcaucugcacccucgaugaag

SEQ ID NO: 2101509 - RNA, 19 nt, Human
ggcaucugccccuccccca

SEQ ID NO: 2101510 - RNA, 16 nt, Human
ggcaucugccccuccc

SEQ ID NO: 2101511 - RNA, 18 nt, Human
ggcaucugccccuccccc

SEQ ID NO: 2101512 - RNA, 21 nt, Human
ggcaucccaguggccucaacc

SEQ ID NO: 2101513 - RNA, 15 nt, Human
ggcaucccaggggac

SEQ ID NO: 2101514 - RNA, 18 nt, Human
ggcaucccaguggccuca

SEQ ID NO: 2101515 - RNA, 20 nt, Human
ggcauccuuccucacaccag

SEQ ID NO: 2101516 - RNA, 16 nt, Human
ggcaucuccugugcau

SEQ ID NO: 2101517 - RNA, 17 nt, Human
ggcaucuccugugcaug

SEQ ID NO: 2101518 - RNA, 21 nt, Human
ggcaucuccugugcaugggug

SEQ ID NO: 2101519 - RNA, 13 nt, Human
ggcaucacagggc

SEQ ID NO: 2101520 - RNA, 14 nt, Human
ggcaucacagggca

SEQ ID NO: 2101521 - RNA, 16 nt, Human
ggcaucacagggcaga

SEQ ID NO: 2101522 - RNA, 17 nt, Human
ggcaucacagggcagag

SEQ ID NO: 2101523 - RNA, 17 nt, Human
ggcauaggccugggugc

SEQ ID NO: 2101524 - RNA, 14 nt, Human
ggcauaggccuggg

SEQ ID NO: 2101525 - RNA, 15 nt, Human
ggcauaggccugggu

SEQ ID NO: 2101526 - RNA, 16 nt, Human
ggcauaggccugggug

SEQ ID NO: 2101527 - RNA, 19 nt, Human
ggcagugggagcugccugu

SEQ ID NO: 2101528 - RNA, 18 nt, Human
ggcagugggagcugccug

SEQ ID NO: 2101529 - RNA, 13 nt, Human
ggcaguggggcug

SEQ ID NO: 2101530 - RNA, 15 nt, Human
ggcaguggggcuggg

SEQ ID NO: 2101531 - RNA, 18 nt, Human
ggcaguggggcugggggu

SEQ ID NO: 2101532 - RNA, 21 nt, Human
ggcauagcuccccgcuucugc

SEQ ID NO: 2101533 - RNA, 21 nt, Human
ggccaugauucgcccaaagcc

SEQ ID NO: 2101534 - RNA, 21 nt, Human
ggccaugaggccucaguggac

SEQ ID NO: 2101535 - RNA, 17 nt, Human
ggccaugagcuccagac

SEQ ID NO: 2101536 - RNA, 18 nt, Human
ggccaugagcuccagacc

SEQ ID NO: 2101537 - RNA, 21 nt, Human
ggccaugagcuccagaccccc

SEQ ID NO: 2101538 - RNA, 22 nt, Human
ggccaugagcuccagaccccca

SEQ ID NO: 2101539 - RNA, 14 nt, Human
ggccaucgguccug

SEQ ID NO: 2101540 - RNA, 17 nt, Human
ggccaucgguccugucu

SEQ ID NO: 2101541 - RNA, 22 nt, Human
ggccaucgguccugucuccccu

SEQ ID NO: 2101542 - RNA, 21 nt, Human
ggccaucucugaacuucagcu

SEQ ID NO: 2101543 - RNA, 15 nt, Human
ggccaugaacuuugu

SEQ ID NO: 2101544 - RNA, 17 nt, Human
ggccaugaacuuugucc

SEQ ID NO: 2101545 - RNA, 23 nt, Human
ggccaugaccacuuuccccgugg

SEQ ID NO: 2101546 - RNA, 16 nt, Human
ggccaugagcuccaga

SEQ ID NO: 2101547 - RNA, 16 nt, Human
ggccagugugacaagg

SEQ ID NO: 2101548 - RNA, 16 nt, Human
ggccaucccaaggucu

SEQ ID NO: 2101549 - RNA, 13 nt, Human
ggccagggcccug

SEQ ID NO: 2101550 - RNA, 16 nt, Human
ggccagggcccugcag

SEQ ID NO: 2101551 - RNA, 17 nt, Human
ggccagggcccugcaga

SEQ ID NO: 2101552 - RNA, 18 nt, Human
ggccagggcccugcagag

SEQ ID NO: 2101553 - RNA, 23 nt, Human
ggccagagagccuggugcugcug

SEQ ID NO: 2101554 - RNA, 17 nt, Human
ggccagaggcagaaccc

SEQ ID NO: 2101555 - RNA, 19 nt, Human
ggccagaggcagaacccug

SEQ ID NO: 2101556 - RNA, 12 nt, Human
ggccagcagcuu

SEQ ID NO: 2101557 - RNA, 13 nt, Human
ggccagcagcuug

SEQ ID NO: 2101558 - RNA, 14 nt, Human
ggccaggcuggucu

SEQ ID NO: 2101559 - RNA, 16 nt, Human
ggccagccccacccag

SEQ ID NO: 2101560 - RNA, 20 nt, Human
ggccagccccacccaggagg

SEQ ID NO: 2101561 - RNA, 21 nt, Human
ggccagccccacccaggaggg

SEQ ID NO: 2101562 - RNA, 13 nt, Human
ggccagccccacc

SEQ ID NO: 2101563 - RNA, 14 nt, Human
ggccagccccaccc

SEQ ID NO: 2101564 - RNA, 15 nt, Human
ggccagccccaccca

SEQ ID NO: 2101565 - RNA, 18 nt, Human
ggccaggcuggucucaaa

SEQ ID NO: 2101566 - RNA, 16 nt, Human
ggccaggcuggucuca

SEQ ID NO: 2101567 - RNA, 12 nt, Human
ggccccacuggg

SEQ ID NO: 2101568 - RNA, 19 nt, Human
ggccccagaaggcagggaa

SEQ ID NO: 2101569 - RNA, 11 nt, Human
ggccccagaga

SEQ ID NO: 2101570 - RNA, 12 nt, Human
ggccccagagac

SEQ ID NO: 2101571 - RNA, 13 nt, Human
ggccccagagacu

SEQ ID NO: 2101572 - RNA, 14 nt, Human
ggccccagagacuc

SEQ ID NO: 2101573 - RNA, 18 nt, Human
ggccccagagacucagag

SEQ ID NO: 2101574 - RNA, 23 nt, Human
ggccccagagacucagagggagg

SEQ ID NO: 2101575 - RNA, 24 nt, Human
ggcccauaucugugaaaugcuggc

SEQ ID NO: 2101576 - RNA, 15 nt, Human
ggccgcauucccuga

SEQ ID NO: 2101577 - RNA, 16 nt, Human
ggccgcauucccugag

SEQ ID NO: 2101578 - RNA, 17 nt, Human
ggccgcauucccugagu

SEQ ID NO: 2101579 - RNA, 18 nt, Human
ggccgccccagccucuga

SEQ ID NO: 2101580 - RNA, 17 nt, Human
ggcccuuccucuccacu

SEQ ID NO: 2101581 - RNA, 16 nt, Human
ggccgaggguccuggc

SEQ ID NO: 2101582 - RNA, 18 nt, Human
ggccgaggguccuggcuc

SEQ ID NO: 2101583 - RNA, 15 nt, Human
ggccgagaagcaaga

SEQ ID NO: 2101584 - RNA, 12 nt, Human
ggccgagaagca

SEQ ID NO: 2101585 - RNA, 15 nt, Human
ggcccuuccucucca

SEQ ID NO: 2101586 - RNA, 13 nt, Human
ggcccuuccucuc

SEQ ID NO: 2101587 - RNA, 19 nt, Human
ggccccuuuuuacuccccu

SEQ ID NO: 2101588 - RNA, 21 nt, Human
ggccccuucacuucugaccac

SEQ ID NO: 2101589 - RNA, 20 nt, Human
ggccccuucacuucugacca

SEQ ID NO: 2101590 - RNA, 22 nt, Human
ggccccuucacuucugaccaca

SEQ ID NO: 2101591 - RNA, 11 nt, Human
ggcucagccug

SEQ ID NO: 2101592 - RNA, 23 nt, Human
ggcucagcggggacagcuccuuc

SEQ ID NO: 2101593 - RNA, 22 nt, Human
ggcucagcggggacagcuccuu

SEQ ID NO: 2101594 - RNA, 21 nt, Human
ggcucagcggggacagcuccu

SEQ ID NO: 2101595 - RNA, 23 nt, Human
ggcucagcaaaagaugcuucuca

SEQ ID NO: 2101596 - RNA, 19 nt, Human
ggcguagagggugcugccc

SEQ ID NO: 2101597 - RNA, 18 nt, Human
ggcucacugcagccucga

SEQ ID NO: 2101598 - RNA, 19 nt, Human
ggcucagcaaaagaugcuu

SEQ ID NO: 2101599 - RNA, 10 nt, Human
ggcucagccu

SEQ ID NO: 2101600 - RNA, 12 nt, Human
ggcucagccugg

SEQ ID NO: 2101601 - RNA, 19 nt, Human
ggcgugcaguggugcgauc

SEQ ID NO: 2101602 - RNA, 16 nt, Human
ggcguggagccaggga

SEQ ID NO: 2101603 - RNA, 19 nt, Human
ggcguggagccagggagcg

SEQ ID NO: 2101604 - RNA, 14 nt, Human
ggcgugcaguggug

SEQ ID NO: 2101605 - RNA, 15 nt, Human
ggcgucugucuucaa

SEQ ID NO: 2101606 - RNA, 16 nt, Human
ggcucacugcagccuc

SEQ ID NO: 2101607 - RNA, 16 nt, Human
ggcgugguggcgggca

SEQ ID NO: 2101608 - RNA, 17 nt, Human
ggcucacugcagccuca

SEQ ID NO: 2101609 - RNA, 17 nt, Human
ggccugaggagcagcag

SEQ ID NO: 2101610 - RNA, 20 nt, Human
ggccuccagcccucucacug

SEQ ID NO: 2101611 - RNA, 22 nt, Human
ggccuccagcccucucacugug

SEQ ID NO: 2101612 - RNA, 12 nt, Human
ggccuccagcuc

SEQ ID NO: 2101613 - RNA, 13 nt, Human
ggccuccagcuca

SEQ ID NO: 2101614 - RNA, 14 nt, Human
ggccuccagcucag

SEQ ID NO: 2101615 - RNA, 15 nt, Human
ggccuccagcucagc

SEQ ID NO: 2101616 - RNA, 16 nt, Human
ggccuccagcucagca

SEQ ID NO: 2101617 - RNA, 23 nt, Human
ggccuccaaguccacaguggaac

SEQ ID NO: 2101618 - RNA, 16 nt, Human
ggccgcuguucaccca

SEQ ID NO: 2101619 - RNA, 19 nt, Human
ggccgcuguucacccacag

SEQ ID NO: 2101620 - RNA, 12 nt, Human
ggccuucucuga

SEQ ID NO: 2101621 - RNA, 11 nt, Human
ggccuguugcc

SEQ ID NO: 2101622 - RNA, 23 nt, Human
ggccuggccaggagcucuucagg

SEQ ID NO: 2101623 - RNA, 21 nt, Human
ggccuggccagaugcaccagc

SEQ ID NO: 2101624 - RNA, 14 nt, Human
ggccuggccaggag

SEQ ID NO: 2101625 - RNA, 15 nt, Human
ggccuggccaggagc

SEQ ID NO: 2101626 - RNA, 16 nt, Human
ggccuggccaggagcu

SEQ ID NO: 2101627 - RNA, 17 nt, Human
ggccuggccaggagcuc

SEQ ID NO: 2101628 - RNA, 18 nt, Human
ggccuggccaggagcucu

SEQ ID NO: 2101629 - RNA, 14 nt, Human
ggccugaugcuccc

SEQ ID NO: 2101630 - RNA, 20 nt, Human
ggccugcugggcucuccacc

SEQ ID NO: 2101631 - RNA, 21 nt, Human
ggccugcugggcucuccaccu

SEQ ID NO: 2101632 - RNA, 22 nt, Human
ggccugcugggcucuccaccuc

SEQ ID NO: 2101633 - RNA, 23 nt, Human
ggccugcugggcucuccaccuca

SEQ ID NO: 2101634 - RNA, 20 nt, Human
ggcgacagagcgagacuccg

SEQ ID NO: 2101635 - RNA, 23 nt, Human
ggcgacagagcgagagucugucu

SEQ ID NO: 2101636 - RNA, 18 nt, Human
ggcgacaguuuuccuucu

SEQ ID NO: 2101637 - RNA, 14 nt, Human
ggccuuuggcuuca

SEQ ID NO: 2101638 - RNA, 23 nt, Human
ggccuuugcuuaugaauauuuau

SEQ ID NO: 2101639 - RNA, 15 nt, Human
ggccuuguucucucu

SEQ ID NO: 2101640 - RNA, 13 nt, Human
ggccuuuggcuuc

SEQ ID NO: 2101641 - RNA, 16 nt, Human
ggccuucucugaagga

SEQ ID NO: 2101642 - RNA, 15 nt, Human
ggccuucucugaagg

SEQ ID NO: 2101643 - RNA, 15 nt, Human
ggccuguugcccuuu

SEQ ID NO: 2101644 - RNA, 22 nt, Human
ggccuucuuucuagagagggaa

SEQ ID NO: 2101645 - RNA, 13 nt, Human
ggccuugcccaga

SEQ ID NO: 2101646 - RNA, 14 nt, Human
ggccuugcccagag

SEQ ID NO: 2101647 - RNA, 15 nt, Human
ggccuugcccagaga

SEQ ID NO: 2101648 - RNA, 16 nt, Human
ggccuugcccagagau

SEQ ID NO: 2101649 - RNA, 22 nt, Human
gggaagauaggcucugcacaga

SEQ ID NO: 2101650 - RNA, 22 nt, Human
gggaagcaaaaacgaaagcugg

SEQ ID NO: 2101651 - RNA, 13 nt, Human
gggaagcccagcu

SEQ ID NO: 2101652 - RNA, 14 nt, Human
gggaagcccagcuc

SEQ ID NO: 2101653 - RNA, 19 nt, Human
gggaagcccagcuccaggg

SEQ ID NO: 2101654 - RNA, 12 nt, Human
gggaagcccugg

SEQ ID NO: 2101655 - RNA, 18 nt, Human
gggaaggacuuggcgcgc

SEQ ID NO: 2101656 - RNA, 20 nt, Human
gggaaggaggguuagggagg

SEQ ID NO: 2101657 - RNA, 20 nt, Human
gggaagcuucuuaaaugaga

SEQ ID NO: 2101658 - RNA, 17 nt, Human
gggaaggaggcuggcuu

SEQ ID NO: 2101659 - RNA, 22 nt, Human
gggaaggaagaggaagagugca

SEQ ID NO: 2101660 - RNA, 23 nt, Human
gggaagcggagguugcagggagc

SEQ ID NO: 2101661 - RNA, 16 nt, Human
gggacagcuccuucug

SEQ ID NO: 2101662 - RNA, 16 nt, Human
aaaaauauuauaacuu

SEQ ID NO: 2101663 - RNA, 11 nt, Human
aaaaauauuua

SEQ ID NO: 2101664 - RNA, 17 nt, Human
aaaaaucauaaacugug

SEQ ID NO: 2101665 - RNA, 16 nt, Human
aaaaauccagaaagaa

SEQ ID NO: 2101666 - RNA, 16 nt, Human
gggaccaacugggccc

SEQ ID NO: 2101667 - RNA, 13 nt, Human
gggaccaaggacc

SEQ ID NO: 2101668 - RNA, 17 nt, Human
gggaccaaggaccccuc

SEQ ID NO: 2101669 - RNA, 21 nt, Human
gggacagcuccuucuguccua

SEQ ID NO: 2101670 - RNA, 15 nt, Human
gggacagagucuggg

SEQ ID NO: 2101671 - RNA, 17 nt, Human
gggacagaucauagauu

SEQ ID NO: 2101672 - RNA, 15 nt, Human
aaaaauccuucuaau

SEQ ID NO: 2101673 - RNA, 16 nt, Human
aaaaauccuucuaauc

SEQ ID NO: 2101674 - RNA, 17 nt, Human
aaaaauccuucuaaucu

SEQ ID NO: 2101675 - RNA, 18 nt, Human
aaaaauccuucuaaucug

SEQ ID NO: 2101676 - RNA, 19 nt, Human
aaaaauccuucuaaucugc

SEQ ID NO: 2101677 - RNA, 20 nt, Human
aaaaauccuucuaaucugcu

SEQ ID NO: 2101678 - RNA, 18 nt, Human
aaaacagguggagaaauu

SEQ ID NO: 2101679 - RNA, 18 nt, Human
aaaacaggucaauacagu

SEQ ID NO: 2101680 - RNA, 14 nt, Human
aaaacaugguagaa

SEQ ID NO: 2101681 - RNA, 16 nt, Human
aaaacaugguagaauu

SEQ ID NO: 2101682 - RNA, 17 nt, Human
aaaacauaaaaaguuaa

SEQ ID NO: 2101683 - RNA, 20 nt, Human
aaaacaguccuucaaacuuc

SEQ ID NO: 2101684 - RNA, 21 nt, Human
aaaaccaauguucucucuucu

SEQ ID NO: 2101685 - RNA, 20 nt, Human
aaaacauuccguuuacauuu

SEQ ID NO: 2101686 - RNA, 21 nt, Human
aaaacauuccguuuacauuuu

SEQ ID NO: 2101687 - RNA, 22 nt, Human
aaaacauuccguuuacauuuua

SEQ ID NO: 2101688 - RNA, 20 nt, Human
aaaacauugaagagagagcu

SEQ ID NO: 2101689 - RNA, 22 nt, Human
aaaacauugaagagagagcuga

SEQ ID NO: 2101690 - RNA, 23 nt, Human
aaaacuagagcucuaagcccauu

SEQ ID NO: 2101691 - RNA, 19 nt, Human
aaaacuauauguaugguuu

SEQ ID NO: 2101692 - RNA, 13 nt, Human
aaaaccugacaaa

SEQ ID NO: 2101693 - RNA, 22 nt, Human
aaaaccucacccgaggcugccc

SEQ ID NO: 2101694 - RNA, 15 nt, Human
aaaacccagagagga

SEQ ID NO: 2101695 - RNA, 13 nt, Human
aaaacccagagag

SEQ ID NO: 2101696 - RNA, 22 nt, Human
aaaacugcugacuguuuucucu

SEQ ID NO: 2101697 - RNA, 23 nt, Human
aaaacugcugacuguuuucucuu

SEQ ID NO: 2101698 - RNA, 13 nt, Human
aaaagaugcuucu

SEQ ID NO: 2101699 - RNA, 22 nt, Human
gggcaacagagcaagauccugu

SEQ ID NO: 2101700 - RNA, 15 nt, Human
gggcagaggcuggag

SEQ ID NO: 2101701 - RNA, 14 nt, Human
gggcagaggcugga

SEQ ID NO: 2101702 - RNA, 15 nt, Human
gggcagagggcagag

SEQ ID NO: 2101703 - RNA, 20 nt, Human
gggcagagggcagaggcugg

SEQ ID NO: 2101704 - RNA, 16 nt, Human
gggcagaggcuggagg

SEQ ID NO: 2101705 - RNA, 21 nt, Human
gggcagaggcuggaggcaggg

SEQ ID NO: 2101706 - RNA, 23 nt, Human
gggcagaggcuggaggcagggcc

SEQ ID NO: 2101707 - RNA, 14 nt, Human
gggcagagggcaga

SEQ ID NO: 2101708 - RNA, 16 nt, Human
gggcagcugccagaga

SEQ ID NO: 2101709 - RNA, 18 nt, Human
gggcagcugccagagaag

SEQ ID NO: 2101710 - RNA, 12 nt, Human
gggcagcugcca

SEQ ID NO: 2101711 - RNA, 23 nt, Human
aaaagggcagggcaucuccugug

SEQ ID NO: 2101712 - RNA, 19 nt, Human
aaaagguaugcaaucaaau

SEQ ID NO: 2101713 - RNA, 23 nt, Human
aaaagguaaaacuuuuuauauuu

SEQ ID NO: 2101714 - RNA, 14 nt, Human
aaaagguaaaacuu

SEQ ID NO: 2101715 - RNA, 11 nt, Human
gggcaggcagu

SEQ ID NO: 2101716 - RNA, 20 nt, Human
gggcagggaaggggaggcag

SEQ ID NO: 2101717 - RNA, 18 nt, Human
gggcaacccccagccugc

SEQ ID NO: 2101718 - RNA, 16 nt, Human
gggcaacccccagccu

SEQ ID NO: 2101719 - RNA, 15 nt, Human
gggauuacaggugug

SEQ ID NO: 2101720 - RNA, 19 nt, Human
gggaggccaaggugggagg

SEQ ID NO: 2101721 - RNA, 11 nt, Human
gggaggcccca

SEQ ID NO: 2101722 - RNA, 16 nt, Human
gggaggccccacuggg

SEQ ID NO: 2101723 - RNA, 18 nt, Human
gggaggccccacugggga

SEQ ID NO: 2101724 - RNA, 20 nt, Human
gggaggcggagcuugcagug

SEQ ID NO: 2101725 - RNA, 15 nt, Human
gggagagggucugga

SEQ ID NO: 2101726 - RNA, 13 nt, Human
gggagcagagaca

SEQ ID NO: 2101727 - RNA, 19 nt, Human
gggagaucggggccagagg

SEQ ID NO: 2101728 - RNA, 20 nt, Human
gggagaucggggccagaggc

SEQ ID NO: 2101729 - RNA, 19 nt, Human
gggagauggaucaaucaaa

SEQ ID NO: 2101730 - RNA, 18 nt, Human
aaaagauggccuuugcuu

SEQ ID NO: 2101731 - RNA, 14 nt, Human
aaaagcaaaugaga

SEQ ID NO: 2101732 - RNA, 13 nt, Human
aaaagcauaaaug

SEQ ID NO: 2101733 - RNA, 15 nt, Human
aaaagcauaaaugca

SEQ ID NO: 2101734 - RNA, 14 nt, Human
aaaagcagcuacca

SEQ ID NO: 2101735 - RNA, 16 nt, Human
gggagaagggggucaa

SEQ ID NO: 2101736 - RNA, 15 nt, Human
gggagacaccucaga

SEQ ID NO: 2101737 - RNA, 17 nt, Human
gggagacaccucagagc

SEQ ID NO: 2101738 - RNA, 21 nt, Human
gggagacaccucagagccccg

SEQ ID NO: 2101739 - RNA, 17 nt, Human
gggaggucgaggcagga

SEQ ID NO: 2101740 - RNA, 18 nt, Human
gggaggucgaggcaggag

SEQ ID NO: 2101741 - RNA, 19 nt, Human
gggaggucgaggcaggagg

SEQ ID NO: 2101742 - RNA, 23 nt, Human
gggauguauccaugggggcaggg

SEQ ID NO: 2101743 - RNA, 11 nt, Human
gggaugucuua

SEQ ID NO: 2101744 - RNA, 13 nt, Human
gggauguucuggc

SEQ ID NO: 2101745 - RNA, 16 nt, Human
gggauguucuggcccu

SEQ ID NO: 2101746 - RNA, 18 nt, Human
gggauggaggagaagaau

SEQ ID NO: 2101747 - RNA, 12 nt, Human
gggaugggaggu

SEQ ID NO: 2101748 - RNA, 17 nt, Human
gggauggggccacagcc

SEQ ID NO: 2101749 - RNA, 15 nt, Human
gggaugguccugggg

SEQ ID NO: 2101750 - RNA, 16 nt, Human
gggaugguccuggggc

SEQ ID NO: 2101751 - RNA, 12 nt, Human
gggaugcuucau

SEQ ID NO: 2101752 - RNA, 15 nt, Human
gggauggaaaaggaa

SEQ ID NO: 2101753 - RNA, 14 nt, Human
gggauggaggagaa

SEQ ID NO: 2101754 - RNA, 15 nt, Human
gggauggaggagaag

SEQ ID NO: 2101755 - RNA, 15 nt, Human
gggaggucgagguag

SEQ ID NO: 2101756 - RNA, 13 nt, Human
aaaaugucuuuau

SEQ ID NO: 2101757 - RNA, 18 nt, Human
aaaaugucuguuaacuua

SEQ ID NO: 2101758 - RNA, 21 nt, Human
gggcuggugacccagucagag

SEQ ID NO: 2101759 - RNA, 12 nt, Human
aaaaugugauuu

SEQ ID NO: 2101760 - RNA, 13 nt, Human
aaaaugugauuuu

SEQ ID NO: 2101761 - RNA, 18 nt, Human
aaaaugugauuuuucuga

SEQ ID NO: 2101762 - RNA, 18 nt, Human
aaaauuugaaauuuagcu

SEQ ID NO: 2101763 - RNA, 14 nt, Human
aaaauuugaaccaa

SEQ ID NO: 2101764 - RNA, 15 nt, Human
aaaauuugaaccaaa

SEQ ID NO: 2101765 - RNA, 16 nt, Human
aaaauuugaaccaaaa

SEQ ID NO: 2101766 - RNA, 19 nt, Human
aaaauuugaaccaaaacau

SEQ ID NO: 2101767 - RNA, 20 nt, Human
aaaauuugaaccaaaacauu

SEQ ID NO: 2101768 - RNA, 22 nt, Human
aaaauuugaaccaaaacauucc

SEQ ID NO: 2101769 - RNA, 23 nt, Human
aaaauuugaaccaaaacauuccg

SEQ ID NO: 2101770 - RNA, 13 nt, Human
aaaauuuggaauu

SEQ ID NO: 2101771 - RNA, 14 nt, Human
aaaauuuggaauuc

SEQ ID NO: 2101772 - RNA, 17 nt, Human
aaaauuuccaguaccuu

SEQ ID NO: 2101773 - RNA, 23 nt, Human
aaaauuuccaguaccuuugucac

SEQ ID NO: 2101774 - RNA, 20 nt, Human
aaaauuucacauuaauauuu

SEQ ID NO: 2101775 - RNA, 18 nt, Human
gggcugccaugugaagag

SEQ ID NO: 2101776 - RNA, 10 nt, Human
gggcucagca

SEQ ID NO: 2101777 - RNA, 16 nt, Human
gggcucaagcagucua

SEQ ID NO: 2101778 - RNA, 18 nt, Human
gggcucagcaaaagaugc

SEQ ID NO: 2101779 - RNA, 15 nt, Human
gggcugcccuggugc

SEQ ID NO: 2101780 - RNA, 13 nt, Human
gggcugcccugcc

SEQ ID NO: 2101781 - RNA, 14 nt, Human
gggcugcccuggug

SEQ ID NO: 2101782 - RNA, 13 nt, Human
gggcugcccuggu

SEQ ID NO: 2101783 - RNA, 12 nt, Human
gggcugcccugc

SEQ ID NO: 2101784 - RNA, 18 nt, Human
gggcugggagcucugcag

SEQ ID NO: 2101785 - RNA, 16 nt, Human
gggcugggagcucugc

SEQ ID NO: 2101786 - RNA, 19 nt, Human
gggcuggcggcuacucagc

SEQ ID NO: 2101787 - RNA, 22 nt, Human
aaacaagaguuuucuuccuugu

SEQ ID NO: 2101788 - RNA, 20 nt, Human
aaacaaaaauucacaagcug

SEQ ID NO: 2101789 - RNA, 23 nt, Human
aaacaaaaauucacaagcugccu

SEQ ID NO: 2101790 - RNA, 13 nt, Human
aaacaaaaaacaa

SEQ ID NO: 2101791 - RNA, 14 nt, Human
aaacaaaaaacaau

SEQ ID NO: 2101792 - RNA, 18 nt, Human
aaacagugccugcugaau

SEQ ID NO: 2101793 - RNA, 14 nt, Human
aaacaguuaacuuu

SEQ ID NO: 2101794 - RNA, 18 nt, Human
aaacaguuaacuuucaga

SEQ ID NO: 2101795 - RNA, 23 nt, Human
aaacaguuaacuuucagaagaga

SEQ ID NO: 2101796 - RNA, 22 nt, Human
aaacaucacacacacagacaga

SEQ ID NO: 2101797 - RNA, 14 nt, Human
aaacaucacacaca

SEQ ID NO: 2101798 - RNA, 16 nt, Human
aaacaucaguuacucu

SEQ ID NO: 2101799 - RNA, 19 nt, Human
aaacaucaguuacucugaa

SEQ ID NO: 2101800 - RNA, 20 nt, Human
aaacaucaguuacucugaag

SEQ ID NO: 2101801 - RNA, 22 nt, Human
aaacaucaguuacucugaaggg

SEQ ID NO: 2101802 - RNA, 12 nt, Human
aaacaccugcug

SEQ ID NO: 2101803 - RNA, 12 nt, Human
aaacagugccug

SEQ ID NO: 2101804 - RNA, 20 nt, Human
ggggacagcuccuucugucc

SEQ ID NO: 2101805 - RNA, 14 nt, Human
ggggacagcuccuu

SEQ ID NO: 2101806 - RNA, 12 nt, Human
ggggacagcucc

SEQ ID NO: 2101807 - RNA, 12 nt, Human
aaacaugaagug

SEQ ID NO: 2101808 - RNA, 22 nt, Human
aaacauauuuguuaaauauuua

SEQ ID NO: 2101809 - RNA, 23 nt, Human
aaacaucaguuacucugaagggc

SEQ ID NO: 2101810 - RNA, 18 nt, Human
aaacauccuucaagaacu

SEQ ID NO: 2101811 - RNA, 20 nt, Human
aaacauccuucaagaacucu

SEQ ID NO: 2101812 - RNA, 16 nt, Human
ggggcaugcuggggca

SEQ ID NO: 2101813 - RNA, 20 nt, Human
ggggccacagccagaacccc

SEQ ID NO: 2101814 - RNA, 21 nt, Human
ggggccacagccagaaccccg

SEQ ID NO: 2101815 - RNA, 19 nt, Human
ggggccacuuuugacuagg

SEQ ID NO: 2101816 - RNA, 21 nt, Human
aaacaucuggaaaauaaaagg

SEQ ID NO: 2101817 - RNA, 21 nt, Human
ggggccugaccucccccuccu

SEQ ID NO: 2101818 - RNA, 19 nt, Human
gggcccugguccuuccagg

SEQ ID NO: 2101819 - RNA, 22 nt, Human
gggccuagauccacacacagag

SEQ ID NO: 2101820 - RNA, 20 nt, Human
gggccuagauccacacacag

SEQ ID NO: 2101821 - RNA, 23 nt, Human
gggccuagauccacacacagagg

SEQ ID NO: 2101822 - RNA, 19 nt, Human
gggccaugagcuccagacc

SEQ ID NO: 2101823 - RNA, 15 nt, Human
gggccaugaacuuug

SEQ ID NO: 2101824 - RNA, 18 nt, Human
gggccaugaacuuugucc

SEQ ID NO: 2101825 - RNA, 18 nt, Human
gggccaugagcuccagac

SEQ ID NO: 2101826 - RNA, 18 nt, Human
gggccugaccucccccuc

SEQ ID NO: 2101827 - RNA, 19 nt, Human
gggccugaccucccccucc

SEQ ID NO: 2101828 - RNA, 23 nt, Human
gggccugaccucccccuccuucc

SEQ ID NO: 2101829 - RNA, 23 nt, Human
gggccucuugcggucccuucuua

SEQ ID NO: 2101830 - RNA, 13 nt, Human
gggccuccugugu

SEQ ID NO: 2101831 - RNA, 19 nt, Human
gggccuccauuccuggagc

SEQ ID NO: 2101832 - RNA, 22 nt, Human
gggccuccauuccuggagcccg

SEQ ID NO: 2101833 - RNA, 23 nt, Human
gggccuccucuaacaggggcugg

SEQ ID NO: 2101834 - RNA, 21 nt, Human
gggccuccucuguccagggcc

SEQ ID NO: 2101835 - RNA, 15 nt, Human
gggccuccugugugu

SEQ ID NO: 2101836 - RNA, 23 nt, Human
gggcuaagagcuagcgcugccgc

SEQ ID NO: 2101837 - RNA, 20 nt, Human
gggcuaagagcuagcgcugc

SEQ ID NO: 2101838 - RNA, 15 nt, Human
gggcgggaggauguu

SEQ ID NO: 2101839 - RNA, 14 nt, Human
gggcggcagagagg

SEQ ID NO: 2101840 - RNA, 15 nt, Human
gggcggcaggaggga

SEQ ID NO: 2101841 - RNA, 18 nt, Human
gggccagggcccugcaga

SEQ ID NO: 2101842 - RNA, 15 nt, Human
gggccaguccugccu

SEQ ID NO: 2101843 - RNA, 22 nt, Human
gggccaguccugccuggccagg

SEQ ID NO: 2101844 - RNA, 18 nt, Human
gggccaguccugccuggc

SEQ ID NO: 2101845 - RNA, 19 nt, Human
gggccaguccugccuggcc

SEQ ID NO: 2101846 - RNA, 20 nt, Human
gggccaguccugccuggcca

SEQ ID NO: 2101847 - RNA, 21 nt, Human
gggccaguccugccuggccag

SEQ ID NO: 2101848 - RNA, 13 nt, Human
gggccagggcccu

SEQ ID NO: 2101849 - RNA, 14 nt, Human
gggccagggcccug

SEQ ID NO: 2101850 - RNA, 16 nt, Human
gggccagggcccugca

SEQ ID NO: 2101851 - RNA, 17 nt, Human
gggccagccccucccac

SEQ ID NO: 2101852 - RNA, 13 nt, Human
gggccagccccuc

SEQ ID NO: 2101853 - RNA, 12 nt, Human
gggccagccccu

SEQ ID NO: 2101854 - RNA, 15 nt, Human
gggccagccccuccc

SEQ ID NO: 2101855 - RNA, 16 nt, Human
gggccaggacaggccc

SEQ ID NO: 2101856 - RNA, 17 nt, Human
gggccaggacaggcccg

SEQ ID NO: 2101857 - RNA, 12 nt, Human
aaaaugaagauu

SEQ ID NO: 2101858 - RNA, 15 nt, Human
aaaaugaagauuauu

SEQ ID NO: 2101859 - RNA, 23 nt, Human
aaaaugaagauuauuuuuuauga

SEQ ID NO: 2101860 - RNA, 15 nt, Human
aaaaugaaauguuuu

SEQ ID NO: 2101861 - RNA, 16 nt, Human
aaaaugaaauguuuua

SEQ ID NO: 2101862 - RNA, 22 nt, Human
aaaaugaaagcaugucucaaua

SEQ ID NO: 2101863 - RNA, 9 nt, Human
aaaaugaaa

SEQ ID NO: 2101864 - RNA, 19 nt, Human
aaaaugaaagcaugucuca

SEQ ID NO: 2101865 - RNA, 14 nt, Human
aaaaugagccuggc

SEQ ID NO: 2101866 - RNA, 21 nt, Human
aaaaugagccuggcaagaaug

SEQ ID NO: 2101867 - RNA, 21 nt, Human
aaaaugaguuaccuacauuuu

SEQ ID NO: 2101868 - RNA, 18 nt, Human
aaaaugagguucaacugu

SEQ ID NO: 2101869 - RNA, 23 nt, Human
aaaaugaguuuuuauggggcuga

SEQ ID NO: 2101870 - RNA, 23 nt, Human
aaaaugagcucgcauuugucaau

SEQ ID NO: 2101871 - RNA, 18 nt, Human
aaaaucuuggcacagaaa

SEQ ID NO: 2101872 - RNA, 17 nt, Human
aaaaucuuggcacagaa

SEQ ID NO: 2101873 - RNA, 19 nt, Human
gggcagccugcguggcuga

SEQ ID NO: 2101874 - RNA, 13 nt, Human
aaaaguauauguu

SEQ ID NO: 2101875 - RNA, 14 nt, Human
aaaaguauauguua

SEQ ID NO: 2101876 - RNA, 20 nt, Human
aaaaguagguuuacauucau

SEQ ID NO: 2101877 - RNA, 21 nt, Human
aaaaguaucgggggcuggggc

SEQ ID NO: 2101878 - RNA, 22 nt, Human
aaaaguaucgggggcuggggca

SEQ ID NO: 2101879 - RNA, 15 nt, Human
aaaaguauauguuag

SEQ ID NO: 2101880 - RNA, 16 nt, Human
aaaaucuguggugguc

SEQ ID NO: 2101881 - RNA, 19 nt, Human
gguuucaccauguuggcca

SEQ ID NO: 2101882 - RNA, 16 nt, Human
gguuuaguguaaaaau

SEQ ID NO: 2101883 - RNA, 18 nt, Human
gguuuaguguaaaaauga

SEQ ID NO: 2101884 - RNA, 20 nt, Human
gguuuaguguaaaaaugaga

SEQ ID NO: 2101885 - RNA, 13 nt, Human
gguuucugaaaau

SEQ ID NO: 2101886 - RNA, 14 nt, Human
gguuucugcccugc

SEQ ID NO: 2101887 - RNA, 23 nt, Human
gguucucacagugggagccaggg

SEQ ID NO: 2101888 - RNA, 17 nt, Human
gguucuggggccccuuu

SEQ ID NO: 2101889 - RNA, 17 nt, Human
gguucuccucuccccuc

SEQ ID NO: 2101890 - RNA, 12 nt, Human
gguucuggggcc

SEQ ID NO: 2101891 - RNA, 17 nt, Human
gguucccuuuccuucca

SEQ ID NO: 2101892 - RNA, 22 nt, Human
gguucccuuuccuuccaucccu

SEQ ID NO: 2101893 - RNA, 16 nt, Human
gguuccaauccuggcu

SEQ ID NO: 2101894 - RNA, 23 nt, Human
gguucauuucaaauacaucuuug

SEQ ID NO: 2101895 - RNA, 14 nt, Human
gguucaucaguguu

SEQ ID NO: 2101896 - RNA, 15 nt, Human
gguucaucaguguua

SEQ ID NO: 2101897 - RNA, 19 nt, Human
gguucaucaguguuaaaaa

SEQ ID NO: 2101898 - RNA, 22 nt, Human
gguucaucaguguuaaaaaauu

SEQ ID NO: 2101899 - RNA, 16 nt, Human
gguucauuauuggaau

SEQ ID NO: 2101900 - RNA, 17 nt, Human
gguucauuauuggaauu

SEQ ID NO: 2101901 - RNA, 18 nt, Human
gguucauuauuggaauua

SEQ ID NO: 2101902 - RNA, 19 nt, Human
gguucauuauuggaauuaa

SEQ ID NO: 2101903 - RNA, 15 nt, Human
gguuccccuguucac

SEQ ID NO: 2101904 - RNA, 18 nt, Human
gguuccaauccuggcucu

SEQ ID NO: 2101905 - RNA, 21 nt, Human
gguucccccagcccuguggaa

SEQ ID NO: 2101906 - RNA, 21 nt, Human
gguucaggguuggccccugcc

SEQ ID NO: 2101907 - RNA, 18 nt, Human
gguucaggguuggccccu

SEQ ID NO: 2101908 - RNA, 22 nt, Human
gguucaggguuggccccugccc

SEQ ID NO: 2101909 - RNA, 13 nt, Human
ggugugcucugau

SEQ ID NO: 2101910 - RNA, 21 nt, Human
ggugugcggccuuuggcuuca

SEQ ID NO: 2101911 - RNA, 18 nt, Human
ggugugagucaccaagcc

SEQ ID NO: 2101912 - RNA, 15 nt, Human
ggugugccugcagcc

SEQ ID NO: 2101913 - RNA, 13 nt, Human
ggugugccugcag

SEQ ID NO: 2101914 - RNA, 14 nt, Human
ggugugccugcagc

SEQ ID NO: 2101915 - RNA, 20 nt, Human
ggugugaaagucagaugccc

SEQ ID NO: 2101916 - RNA, 18 nt, Human
ggugggcaccaagagcca

SEQ ID NO: 2101917 - RNA, 17 nt, Human
gguggggcagcuugagg

SEQ ID NO: 2101918 - RNA, 13 nt, Human
gguggggcagcuu

SEQ ID NO: 2101919 - RNA, 16 nt, Human
ggugggauggaggaga

SEQ ID NO: 2101920 - RNA, 17 nt, Human
ggugggauggaggagaa

SEQ ID NO: 2101921 - RNA, 16 nt, Human
ggugggcaccuauaau

SEQ ID NO: 2101922 - RNA, 20 nt, Human
ggugggcagaucacgagguc

SEQ ID NO: 2101923 - RNA, 16 nt, Human
ggugggccagccccuc

SEQ ID NO: 2101924 - RNA, 20 nt, Human
ggugggccagccccucccac

SEQ ID NO: 2101925 - RNA, 14 nt, Human
aaagcaugaauggu

SEQ ID NO: 2101926 - RNA, 19 nt, Human
ggugcuuauucucaaagca

SEQ ID NO: 2101927 - RNA, 20 nt, Human
ggugggaggauugcuugagc

SEQ ID NO: 2101928 - RNA, 22 nt, Human
aaaguuuccccaccagugaaug

SEQ ID NO: 2101929 - RNA, 13 nt, Human
aaaguuugccaga

SEQ ID NO: 2101930 - RNA, 15 nt, Human
aaaguuugccagaag

SEQ ID NO: 2101931 - RNA, 23 nt, Human
aaaguuucucuuuucaaaacauu

SEQ ID NO: 2101932 - RNA, 21 nt, Human
aaaguuucucuuuucaaaaca

SEQ ID NO: 2101933 - RNA, 23 nt, Human
aaaguucccuacuuccugugacu

SEQ ID NO: 2101934 - RNA, 17 nt, Human
gguuuggcgggccaagg

SEQ ID NO: 2101935 - RNA, 19 nt, Human
gguuuggcgggccaaggac

SEQ ID NO: 2101936 - RNA, 14 nt, Human
gguuuggcgggcca

SEQ ID NO: 2101937 - RNA, 16 nt, Human
gguuugccugagggcg

SEQ ID NO: 2101938 - RNA, 14 nt, Human
gguuugcaaggaag

SEQ ID NO: 2101939 - RNA, 12 nt, Human
gguucugggugg

SEQ ID NO: 2101940 - RNA, 15 nt, Human
gguuucugcccugcc

SEQ ID NO: 2101941 - RNA, 17 nt, Human
gguuucugcccugccca

SEQ ID NO: 2101942 - RNA, 18 nt, Human
gguuucugcccugcccac

SEQ ID NO: 2101943 - RNA, 15 nt, Human
gguuugaauauaaac

SEQ ID NO: 2101944 - RNA, 18 nt, Human
gguuugaauauaaacacu

SEQ ID NO: 2101945 - RNA, 21 nt, Human
aaaguucccuacuuccuguga

SEQ ID NO: 2101946 - RNA, 19 nt, Human
aaaguucauaacagugcca

SEQ ID NO: 2101947 - RNA, 22 nt, Human
aaaguucauaacagugccauug

SEQ ID NO: 2101948 - RNA, 22 nt, Human
aaaguucauagggucucuucag

SEQ ID NO: 2101949 - RNA, 18 nt, Human
aaagugugagcaaacuaa

SEQ ID NO: 2101950 - RNA, 20 nt, Human
aaaguguaaauccuuuuucu

SEQ ID NO: 2101951 - RNA, 17 nt, Human
aaaguguaacauaugca

SEQ ID NO: 2101952 - RNA, 11 nt, Human
aaaguguauua

SEQ ID NO: 2101953 - RNA, 14 nt, Human
aaaguguauuauaa

SEQ ID NO: 2101954 - RNA, 18 nt, Human
aaaguguauuauaacagu

SEQ ID NO: 2101955 - RNA, 13 nt, Human
aaauaaugucuug

SEQ ID NO: 2101956 - RNA, 15 nt, Human
aaauaaugucuuguu

SEQ ID NO: 2101957 - RNA, 16 nt, Human
aaauaaugucuuguua

SEQ ID NO: 2101958 - RNA, 21 nt, Human
aaauaaugucuuguuaauauu

SEQ ID NO: 2101959 - RNA, 13 nt, Human
aaauaaaaaaguc

SEQ ID NO: 2101960 - RNA, 18 nt, Human
aaauaaaaaagucucuau

SEQ ID NO: 2101961 - RNA, 14 nt, Human
aaauaagguguauu

SEQ ID NO: 2101962 - RNA, 16 nt, Human
aaauaagguguauugc

SEQ ID NO: 2101963 - RNA, 14 nt, Human
guaaagagaaacuu

SEQ ID NO: 2101964 - RNA, 15 nt, Human
guaaagagaaacuuu

SEQ ID NO: 2101965 - RNA, 19 nt, Human
guaaagagaaacuuugugc

SEQ ID NO: 2101966 - RNA, 20 nt, Human
guaaagagaaacuuugugcu

SEQ ID NO: 2101967 - RNA, 16 nt, Human
guaaagacuguagaag

SEQ ID NO: 2101968 - RNA, 14 nt, Human
guaaauuauucagu

SEQ ID NO: 2101969 - RNA, 15 nt, Human
guaaauuauucaguu

SEQ ID NO: 2101970 - RNA, 20 nt, Human
guaaauuauucaguuaagaa

SEQ ID NO: 2101971 - RNA, 22 nt, Human
guaaauuauucaguuaagaaaa

SEQ ID NO: 2101972 - RNA, 12 nt, Human
guaaauuauuuu

SEQ ID NO: 2101973 - RNA, 14 nt, Human
guaaauuauuuuaa

SEQ ID NO: 2101974 - RNA, 15 nt, Human
guaaauuauuuuaaa

SEQ ID NO: 2101975 - RNA, 17 nt, Human
guaaauuauuuuaaauu

SEQ ID NO: 2101976 - RNA, 18 nt, Human
guaaauuauuuuaaauua

SEQ ID NO: 2101977 - RNA, 21 nt, Human
guaaauuauuuuaaauuauaa

SEQ ID NO: 2101978 - RNA, 22 nt, Human
guaaauuauuuuaaauuauaag

SEQ ID NO: 2101979 - RNA, 23 nt, Human
guaaauuaccaguaaaguguaac

SEQ ID NO: 2101980 - RNA, 15 nt, Human
gguauggaacucucu

SEQ ID NO: 2101981 - RNA, 22 nt, Human
gguaugaucacggcucacugca

SEQ ID NO: 2101982 - RNA, 14 nt, Human
gguaugcaaucaaa

SEQ ID NO: 2101983 - RNA, 14 nt, Human
gguagcuuuucccu

SEQ ID NO: 2101984 - RNA, 19 nt, Human
gguagcuucugaccucagc

SEQ ID NO: 2101985 - RNA, 20 nt, Human
gguagcuucugaccucagca

SEQ ID NO: 2101986 - RNA, 21 nt, Human
gguaugaccuucuaggaagcu

SEQ ID NO: 2101987 - RNA, 19 nt, Human
gguagcugccccuggcucu

SEQ ID NO: 2101988 - RNA, 15 nt, Human
gguagcugccccugg

SEQ ID NO: 2101989 - RNA, 18 nt, Human
gguagcugccccuggcuc

SEQ ID NO: 2101990 - RNA, 17 nt, Human
gguccacccaggagccc

SEQ ID NO: 2101991 - RNA, 11 nt, Human
gguccagggaa

SEQ ID NO: 2101992 - RNA, 21 nt, Human
gguccagggaagcuggccgag

SEQ ID NO: 2101993 - RNA, 16 nt, Human
gguccacccaggagcc

SEQ ID NO: 2101994 - RNA, 15 nt, Human
gguccacccaggagc

SEQ ID NO: 2101995 - RNA, 13 nt, Human
gguccacccagga

SEQ ID NO: 2101996 - RNA, 12 nt, Human
gguccacccagg

SEQ ID NO: 2101997 - RNA, 18 nt, Human
aaagaaguggggacagag

SEQ ID NO: 2101998 - RNA, 19 nt, Human
aaagaaguguccgagaacu

SEQ ID NO: 2101999 - RNA, 21 nt, Human
aaagaaguguccgagaacuaa

SEQ ID NO: 2102000 - RNA, 17 nt, Human
aaagaauacagaaagau

SEQ ID NO: 2102001 - RNA, 15 nt, Human
aaagaauacagaaag

SEQ ID NO: 2102002 - RNA, 16 nt, Human
aaagacaaauucuguu

SEQ ID NO: 2102003 - RNA, 17 nt, Human
aaagacaaauucuguuu

SEQ ID NO: 2102004 - RNA, 19 nt, Human
aaagacaaauucuguuucu

SEQ ID NO: 2102005 - RNA, 22 nt, Human
aaagacaaauucuguuucuuga

SEQ ID NO: 2102006 - RNA, 15 nt, Human
aaagaaucauuauuu

SEQ ID NO: 2102007 - RNA, 18 nt, Human
aaagaaucauuauuuauu

SEQ ID NO: 2102008 - RNA, 19 nt, Human
aaagaaucauuauuuauua

SEQ ID NO: 2102009 - RNA, 23 nt, Human
aaagaaucauuauuuauuaaauu

SEQ ID NO: 2102010 - RNA, 16 nt, Human
aaagaaucccuguuca

SEQ ID NO: 2102011 - RNA, 21 nt, Human
aaagaaucccuguucauugua

SEQ ID NO: 2102012 - RNA, 22 nt, Human
aaagaaucccuguucauuguaa

SEQ ID NO: 2102013 - RNA, 19 nt, Human
aaagacaccuacugagugg

SEQ ID NO: 2102014 - RNA, 13 nt, Human
aaagacaccuacu

SEQ ID NO: 2102015 - RNA, 17 nt, Human
aaagacuaucuaaaugu

SEQ ID NO: 2102016 - RNA, 20 nt, Human
gguaacaggcagauacagga

SEQ ID NO: 2102017 - RNA, 14 nt, Human
gguaacaggcagau

SEQ ID NO: 2102018 - RNA, 19 nt, Human
gguaauaaguacuguguac

SEQ ID NO: 2102019 - RNA, 18 nt, Human
gguaacuagggaagauaa

SEQ ID NO: 2102020 - RNA, 13 nt, Human
gguaacaggcaga

SEQ ID NO: 2102021 - RNA, 19 nt, Human
ggguuucugcccugcccac

SEQ ID NO: 2102022 - RNA, 13 nt, Human
gggugugggaggc

SEQ ID NO: 2102023 - RNA, 16 nt, Human
gggugugggaggcccg

SEQ ID NO: 2102024 - RNA, 14 nt, Human
ggguuuuauauuuu

SEQ ID NO: 2102025 - RNA, 15 nt, Human
ggguuucugcccugc

SEQ ID NO: 2102026 - RNA, 20 nt, Human
ggguuuggcgggccaaggac

SEQ ID NO: 2102027 - RNA, 22 nt, Human
ggguuuggcgggccaaggacug

SEQ ID NO: 2102028 - RNA, 14 nt, Human
gguaccacugauuu

SEQ ID NO: 2102029 - RNA, 15 nt, Human
gguagcuagaggaac

SEQ ID NO: 2102030 - RNA, 20 nt, Human
gguagcccuggccagaggcu

SEQ ID NO: 2102031 - RNA, 17 nt, Human
gguagcuagaggaacca

SEQ ID NO: 2102032 - RNA, 15 nt, Human
gguagcccuggccag

SEQ ID NO: 2102033 - RNA, 18 nt, Human
gguagcccuggccagagg

SEQ ID NO: 2102034 - RNA, 15 nt, Human
gguacagagaaggaa

SEQ ID NO: 2102035 - RNA, 18 nt, Human
gguacagagaaggaaugu

SEQ ID NO: 2102036 - RNA, 12 nt, Human
gguacagagaag

SEQ ID NO: 2102037 - RNA, 17 nt, Human
ggguggaugccuggugg

SEQ ID NO: 2102038 - RNA, 15 nt, Human
ggguggcaccagcag

SEQ ID NO: 2102039 - RNA, 12 nt, Human
ggggccuggcag

SEQ ID NO: 2102040 - RNA, 11 nt, Human
ggggccuggca

SEQ ID NO: 2102041 - RNA, 13 nt, Human
ggguggaugccug

SEQ ID NO: 2102042 - RNA, 14 nt, Human
gggugggagagccc

SEQ ID NO: 2102043 - RNA, 19 nt, Human
gggugggagagcccagcca

SEQ ID NO: 2102044 - RNA, 23 nt, Human
ggguggauuuggguuggaaguga

SEQ ID NO: 2102045 - RNA, 17 nt, Human
gggugggauggaggaga

SEQ ID NO: 2102046 - RNA, 16 nt, Human
ggguggucugcaggca

SEQ ID NO: 2102047 - RNA, 21 nt, Human
gggugguaagagaauguuaua

SEQ ID NO: 2102048 - RNA, 13 nt, Human
gggugguccugac

SEQ ID NO: 2102049 - RNA, 12 nt, Human
ggguggugaccu

SEQ ID NO: 2102050 - RNA, 23 nt, Human
ggguggggacguccugccaccug

SEQ ID NO: 2102051 - RNA, 16 nt, Human
gggugggguagggcug

SEQ ID NO: 2102052 - RNA, 17 nt, Human
gggugggguagggcuga

SEQ ID NO: 2102053 - RNA, 16 nt, Human
aaagcaaaugugaccu

SEQ ID NO: 2102054 - RNA, 21 nt, Human
aaagcaaacuuaagaaacacu

SEQ ID NO: 2102055 - RNA, 23 nt, Human
aaagcaaacuuaagaaacacuga

SEQ ID NO: 2102056 - RNA, 13 nt, Human
aaagcaaaugaga

SEQ ID NO: 2102057 - RNA, 14 nt, Human
aaagauuucuugag

SEQ ID NO: 2102058 - RNA, 18 nt, Human
aaagacacagaacacaga

SEQ ID NO: 2102059 - RNA, 22 nt, Human
aaagauuuguacuacaguucuu

SEQ ID NO: 2102060 - RNA, 15 nt, Human
gguccugggggccug

SEQ ID NO: 2102061 - RNA, 16 nt, Human
gguccugggggccuga

SEQ ID NO: 2102062 - RNA, 21 nt, Human
gguccugggggccugaccucc

SEQ ID NO: 2102063 - RNA, 23 nt, Human
gguccuggggcucugugcaggga

SEQ ID NO: 2102064 - RNA, 12 nt, Human
gguccuggcucc

SEQ ID NO: 2102065 - RNA, 12 nt, Human
gguccuggggcc

SEQ ID NO: 2102066 - RNA, 16 nt, Human
gguccuggcuccugag

SEQ ID NO: 2102067 - RNA, 14 nt, Human
gguccuggcuccug

SEQ ID NO: 2102068 - RNA, 15 nt, Human
gguccuggcuccuga

SEQ ID NO: 2102069 - RNA, 14 nt, Human
gguccuggggccuc

SEQ ID NO: 2102070 - RNA, 12 nt, Human
gguccuggggcu

SEQ ID NO: 2102071 - RNA, 15 nt, Human
gguccuggggcucug

SEQ ID NO: 2102072 - RNA, 22 nt, Human
gguccuggggcucugugcaggg

SEQ ID NO: 2102073 - RNA, 14 nt, Human
ggucuagggagaga

SEQ ID NO: 2102074 - RNA, 14 nt, Human
ggucguuuuuuuca

SEQ ID NO: 2102075 - RNA, 13 nt, Human
ggucuaacuuuug

SEQ ID NO: 2102076 - RNA, 13 nt, Human
ggucugugucucu

SEQ ID NO: 2102077 - RNA, 18 nt, Human
ggucugugucucuuuucu

SEQ ID NO: 2102078 - RNA, 19 nt, Human
ggucugugucucuuuucuc

SEQ ID NO: 2102079 - RNA, 14 nt, Human
ggucgggcucagcu

SEQ ID NO: 2102080 - RNA, 22 nt, Human
ggucgcuuacuuugagugaucc

SEQ ID NO: 2102081 - RNA, 21 nt, Human
gguggaugccugguggcagcu

SEQ ID NO: 2102082 - RNA, 13 nt, Human
gguggauguaaau

SEQ ID NO: 2102083 - RNA, 22 nt, Human
ggugcuguugucauugcuuuac

SEQ ID NO: 2102084 - RNA, 14 nt, Human
gguggaugccuggu

SEQ ID NO: 2102085 - RNA, 18 nt, Human
aaagcagcucaaaggcac

SEQ ID NO: 2102086 - RNA, 19 nt, Human
aaagcagcucaaaggcaca

SEQ ID NO: 2102087 - RNA, 15 nt, Human
aaagcauaaaugcaa

SEQ ID NO: 2102088 - RNA, 16 nt, Human
aaagcaucacuuggga

SEQ ID NO: 2102089 - RNA, 18 nt, Human
aaagcaucaccucaggcc

SEQ ID NO: 2102090 - RNA, 16 nt, Human
aaagcaucaccucagg

SEQ ID NO: 2102091 - RNA, 17 nt, Human
aaagcaucaccucaggc

SEQ ID NO: 2102092 - RNA, 13 nt, Human
aaagcaugaaugg

SEQ ID NO: 2102093 - RNA, 13 nt, Human
aaagcauccaugu

SEQ ID NO: 2102094 - RNA, 22 nt, Human
ggucuucuuacaugcauuugag

SEQ ID NO: 2102095 - RNA, 20 nt, Human
ggucuucccuaccucaggca

SEQ ID NO: 2102096 - RNA, 22 nt, Human
ggucuucccuaccucaggcagg

SEQ ID NO: 2102097 - RNA, 19 nt, Human
ggucuucagggggccaggu

SEQ ID NO: 2102098 - RNA, 17 nt, Human
ggucuucccuaccucag

SEQ ID NO: 2102099 - RNA, 14 nt, Human
gaaugagaguguga

SEQ ID NO: 2102100 - RNA, 20 nt, Human
gaaguguccgagaacuaaag

SEQ ID NO: 2102101 - RNA, 17 nt, Human
gaaguguaacagcugag

SEQ ID NO: 2102102 - RNA, 18 nt, Human
gaaguguaacagcugagg

SEQ ID NO: 2102103 - RNA, 23 nt, Human
gaaguguaacagcugaggucucu

SEQ ID NO: 2102104 - RNA, 18 nt, Human
gaaaucccccuuucucua

SEQ ID NO: 2102105 - RNA, 11 nt, Human
gaaaucauguu

SEQ ID NO: 2102106 - RNA, 12 nt, Human
gaaaucauguua

SEQ ID NO: 2102107 - RNA, 14 nt, Human
gaaaucauguuaug

SEQ ID NO: 2102108 - RNA, 19 nt, Human
gaaaucauguuaugauaaa

SEQ ID NO: 2102109 - RNA, 21 nt, Human
gaaaucauguuaugauaaaaa

SEQ ID NO: 2102110 - RNA, 13 nt, Human
gaagcuaauuauu

SEQ ID NO: 2102111 - RNA, 17 nt, Human
gaagcuaauuauuuuaa

SEQ ID NO: 2102112 - RNA, 18 nt, Human
gaagcuaauuauuuuaau

SEQ ID NO: 2102113 - RNA, 21 nt, Human
gaagcuaauuauuuuaauuag

SEQ ID NO: 2102114 - RNA, 22 nt, Human
gaagcuaauuauuuuaauuagg

SEQ ID NO: 2102115 - RNA, 15 nt, Human
gaagcuacuuuguuu

SEQ ID NO: 2102116 - RNA, 19 nt, Human
gaagcuacuuuguuuuuaa

SEQ ID NO: 2102117 - RNA, 22 nt, Human
gaagcucagcccaccccccuca

SEQ ID NO: 2102118 - RNA, 21 nt, Human
gaagcucagcccaccccccuc

SEQ ID NO: 2102119 - RNA, 17 nt, Human
gaaggcuuucagggccu

SEQ ID NO: 2102120 - RNA, 23 nt, Human
gaaggcuuucagggccuccagcc

SEQ ID NO: 2102121 - RNA, 24 nt, Human
gaaggcuuucagggccuccagccc

SEQ ID NO: 2102122 - RNA, 15 nt, Human
gaagggaagaaaagg

SEQ ID NO: 2102123 - RNA, 22 nt, Human
gaagggcaggaaggagagccug

SEQ ID NO: 2102124 - RNA, 21 nt, Human
gaagggacuaggagcacugua

SEQ ID NO: 2102125 - RNA, 16 nt, Human
gaagggagagccagcu

SEQ ID NO: 2102126 - RNA, 17 nt, Human
gaagcuggccgaggguc

SEQ ID NO: 2102127 - RNA, 23 nt, Human
gaagcuggccgaggguccuggcu

SEQ ID NO: 2102128 - RNA, 13 nt, Human
gaagcugcuccgu

SEQ ID NO: 2102129 - RNA, 11 nt, Human
gaagcuccagu

SEQ ID NO: 2102130 - RNA, 19 nt, Human
gaagcuccaguccugcucu

SEQ ID NO: 2102131 - RNA, 20 nt, Human
gaagcuccaguccugcucuc

SEQ ID NO: 2102132 - RNA, 22 nt, Human
gaagcuguguccuugcaccugc

SEQ ID NO: 2102133 - RNA, 12 nt, Human
gaagcugugucc

SEQ ID NO: 2102134 - RNA, 17 nt, Human
gaagcuguguccuugca

SEQ ID NO: 2102135 - RNA, 20 nt, Human
gaagcuguguccuugcaccu

SEQ ID NO: 2102136 - RNA, 23 nt, Human
gaagggcaggaaggagagccugc

SEQ ID NO: 2102137 - RNA, 18 nt, Human
gaagggcaucaugcaucu

SEQ ID NO: 2102138 - RNA, 14 nt, Human
gaagugaacauuuc

SEQ ID NO: 2102139 - RNA, 18 nt, Human
gaagugacaaggccccag

SEQ ID NO: 2102140 - RNA, 21 nt, Human
gaagugacaaggccccagaga

SEQ ID NO: 2102141 - RNA, 23 nt, Human
gaagugacaaggccccagagacu

SEQ ID NO: 2102142 - RNA, 24 nt, Human
gaagugacaaggccccagagacuc

SEQ ID NO: 2102143 - RNA, 16 nt, Human
gaagugaccaaggagg

SEQ ID NO: 2102144 - RNA, 18 nt, Human
gaagugcaaauuugauac

SEQ ID NO: 2102145 - RNA, 13 nt, Human
gaagugccccugc

SEQ ID NO: 2102146 - RNA, 14 nt, Human
gaagugccccugcu

SEQ ID NO: 2102147 - RNA, 15 nt, Human
gaagugccccugcug

SEQ ID NO: 2102148 - RNA, 18 nt, Human
gaagugccccugcugccu

SEQ ID NO: 2102149 - RNA, 22 nt, Human
gaagugccccugcugccucccc

SEQ ID NO: 2102150 - RNA, 15 nt, Human
gaaguggggacagag

SEQ ID NO: 2102151 - RNA, 14 nt, Human
gaaguguaacagcu

SEQ ID NO: 2102152 - RNA, 15 nt, Human
gaaguguaacagcug

SEQ ID NO: 2102153 - RNA, 16 nt, Human
gaaguguaacagcuga

SEQ ID NO: 2102154 - RNA, 22 nt, Human
gaaguggaccaggacaggacca

SEQ ID NO: 2102155 - RNA, 16 nt, Human
gaagugggccaggaca

SEQ ID NO: 2102156 - RNA, 18 nt, Human
gaagugggccaggacagg

SEQ ID NO: 2102157 - RNA, 19 nt, Human
gaagugggccaggacaggc

SEQ ID NO: 2102158 - RNA, 21 nt, Human
gaagugggccaggacaggccc

SEQ ID NO: 2102159 - RNA, 23 nt, Human
gaagugccccugcugccucccca

SEQ ID NO: 2102160 - RNA, 16 nt, Human
gaaguggaccaggaca

SEQ ID NO: 2102161 - RNA, 18 nt, Human
gaaguggaccaggacagg

SEQ ID NO: 2102162 - RNA, 21 nt, Human
gacacacagcucuguccuggg

SEQ ID NO: 2102163 - RNA, 15 nt, Human
gacacacgcacacac

SEQ ID NO: 2102164 - RNA, 14 nt, Human
gacacacagcucug

SEQ ID NO: 2102165 - RNA, 17 nt, Human
gacaaaaauuaucuauu

SEQ ID NO: 2102166 - RNA, 19 nt, Human
gacacacagcucuguccug

SEQ ID NO: 2102167 - RNA, 18 nt, Human
gacacacagcucuguccu

SEQ ID NO: 2102168 - RNA, 17 nt, Human
gacacacagcucugucc

SEQ ID NO: 2102169 - RNA, 15 nt, Human
gacacacagcucugu

SEQ ID NO: 2102170 - RNA, 20 nt, Human
gaauuuugugcccccaugua

SEQ ID NO: 2102171 - RNA, 21 nt, Human
gaauuuugugcccccauguaa

SEQ ID NO: 2102172 - RNA, 22 nt, Human
gaauuuucuuuuuaauaaaaag

SEQ ID NO: 2102173 - RNA, 14 nt, Human
gaauuuuucucuaa

SEQ ID NO: 2102174 - RNA, 16 nt, Human
gaauuuuuauuaugca

SEQ ID NO: 2102175 - RNA, 17 nt, Human
gaauuuuuauuaugcau

SEQ ID NO: 2102176 - RNA, 19 nt, Human
gaauuuuuauuaugcauaa

SEQ ID NO: 2102177 - RNA, 16 nt, Human
gaauuuuucauugaua

SEQ ID NO: 2102178 - RNA, 13 nt, Human
gacaaaaauacuc

SEQ ID NO: 2102179 - RNA, 17 nt, Human
gacaaaaauacucuaau

SEQ ID NO: 2102180 - RNA, 21 nt, Human
gacaaaaauacucuaauucua

SEQ ID NO: 2102181 - RNA, 22 nt, Human
gaauuuuguuuggacuucuuuu

SEQ ID NO: 2102182 - RNA, 21 nt, Human
gaaugaggucccaggcagaga

SEQ ID NO: 2102183 - RNA, 22 nt, Human
gaaugaggucccaggcagagaa

SEQ ID NO: 2102184 - RNA, 18 nt, Human
gaauuaucccuuuucuug

SEQ ID NO: 2102185 - RNA, 16 nt, Human
gaaugaggucccaggc

SEQ ID NO: 2102186 - RNA, 17 nt, Human
gaaugaggucccaggca

SEQ ID NO: 2102187 - RNA, 18 nt, Human
gaaugaggucccaggcag

SEQ ID NO: 2102188 - RNA, 19 nt, Human
gaaugaggucccaggcaga

SEQ ID NO: 2102189 - RNA, 13 nt, Human
gaaugaggaggaa

SEQ ID NO: 2102190 - RNA, 14 nt, Human
gaaugaggaggaag

SEQ ID NO: 2102191 - RNA, 20 nt, Human
gaaugaggaggaaggagaga

SEQ ID NO: 2102192 - RNA, 14 nt, Human
gaaugaggucccag

SEQ ID NO: 2102193 - RNA, 15 nt, Human
gaaugaggucccagg

SEQ ID NO: 2102194 - RNA, 14 nt, Human
gaauuuucagaccc

SEQ ID NO: 2102195 - RNA, 23 nt, Human
gaauuuucagaccccagcggcug

SEQ ID NO: 2102196 - RNA, 17 nt, Human
gaauuuucaagcaucuc

SEQ ID NO: 2102197 - RNA, 20 nt, Human
gaauuuucaagcaucuccug

SEQ ID NO: 2102198 - RNA, 15 nt, Human
gaauuuuaagugcuu

SEQ ID NO: 2102199 - RNA, 21 nt, Human
gacauuaagcaucacaaauga

SEQ ID NO: 2102200 - RNA, 22 nt, Human
gacauuaagcaucacaaaugau

SEQ ID NO: 2102201 - RNA, 18 nt, Human
gacauuaacaguuuucca

SEQ ID NO: 2102202 - RNA, 19 nt, Human
gacauuaacaguuuuccau

SEQ ID NO: 2102203 - RNA, 22 nt, Human
gacauuaacaguuuuccaugaa

SEQ ID NO: 2102204 - RNA, 23 nt, Human
gacauuaacaguuuuccaugaaa

SEQ ID NO: 2102205 - RNA, 13 nt, Human
gacacugaugggc

SEQ ID NO: 2102206 - RNA, 23 nt, Human
gacacugaaauauacacacagca

SEQ ID NO: 2102207 - RNA, 12 nt, Human
gacacugaaaug

SEQ ID NO: 2102208 - RNA, 22 nt, Human
gacacugaaaugccuuacuuug

SEQ ID NO: 2102209 - RNA, 15 nt, Human
gacacugaugggcaa

SEQ ID NO: 2102210 - RNA, 12 nt, Human
gacagacacagg

SEQ ID NO: 2102211 - RNA, 19 nt, Human
gacacuguuuacaagaaaa

SEQ ID NO: 2102212 - RNA, 22 nt, Human
gacacuguuuacaagaaaaaau

SEQ ID NO: 2102213 - RNA, 13 nt, Human
gacauuaaauaau

SEQ ID NO: 2102214 - RNA, 12 nt, Human
gacauuaacagu

SEQ ID NO: 2102215 - RNA, 14 nt, Human
gacauuaacaguuu

SEQ ID NO: 2102216 - RNA, 17 nt, Human
gacauuaacaguuuucc

SEQ ID NO: 2102217 - RNA, 23 nt, Human
gacaguccugggagaaccucagg

SEQ ID NO: 2102218 - RNA, 15 nt, Human
gacaguccugggaga

SEQ ID NO: 2102219 - RNA, 18 nt, Human
gacaguccugggagaacc

SEQ ID NO: 2102220 - RNA, 16 nt, Human
gacagucaaggagugg

SEQ ID NO: 2102221 - RNA, 17 nt, Human
gacagucaaggaguggc

SEQ ID NO: 2102222 - RNA, 19 nt, Human
gacagucaaggaguggcuu

SEQ ID NO: 2102223 - RNA, 22 nt, Human
gacagucaaggaguggcuuacu

SEQ ID NO: 2102224 - RNA, 13 nt, Human
gacaguccuggga

SEQ ID NO: 2102225 - RNA, 14 nt, Human
gacaguccugggag

SEQ ID NO: 2102226 - RNA, 19 nt, Human
gacagccuggcacagggca

SEQ ID NO: 2102227 - RNA, 13 nt, Human
gacagccuggcac

SEQ ID NO: 2102228 - RNA, 15 nt, Human
gacagacacacacac

SEQ ID NO: 2102229 - RNA, 13 nt, Human
gacagacacacac

SEQ ID NO: 2102230 - RNA, 11 nt, Human
gacagcuccuu

SEQ ID NO: 2102231 - RNA, 20 nt, Human
gacagccuguggcggugccu

SEQ ID NO: 2102232 - RNA, 22 nt, Human
gacagccuguggcggugccugg

SEQ ID NO: 2102233 - RNA, 23 nt, Human
gacagccuguggcggugccuggg

SEQ ID NO: 2102234 - RNA, 22 nt, Human
gacaggguuuugccauguuggc

SEQ ID NO: 2102235 - RNA, 20 nt, Human
gacaggguuuugccauguug

SEQ ID NO: 2102236 - RNA, 16 nt, Human
gacagcucccucugcc

SEQ ID NO: 2102237 - RNA, 17 nt, Human
gacagcucccucugccu

SEQ ID NO: 2102238 - RNA, 18 nt, Human
gacagcucccucugccug

SEQ ID NO: 2102239 - RNA, 14 nt, Human
gacaggucugggag

SEQ ID NO: 2102240 - RNA, 16 nt, Human
gagaagcggcuggcag

SEQ ID NO: 2102241 - RNA, 13 nt, Human
gagaagcggcugg

SEQ ID NO: 2102242 - RNA, 15 nt, Human
gagaagcggcuggca

SEQ ID NO: 2102243 - RNA, 20 nt, Human
gagaaggacccggaggggcc

SEQ ID NO: 2102244 - RNA, 12 nt, Human
gagaaggaagcc

SEQ ID NO: 2102245 - RNA, 23 nt, Human
gagaaggacccggaggggccugg

SEQ ID NO: 2102246 - RNA, 22 nt, Human
gagaaggacccggaggggccug

SEQ ID NO: 2102247 - RNA, 16 nt, Human
gagaaggaaugucuuu

SEQ ID NO: 2102248 - RNA, 14 nt, Human
gagaaggaaggaga

SEQ ID NO: 2102249 - RNA, 21 nt, Human
gagaaggaaggagacucaccu

SEQ ID NO: 2102250 - RNA, 14 nt, Human
gagacccaaggagg

SEQ ID NO: 2102251 - RNA, 12 nt, Human
gagacccccaca

SEQ ID NO: 2102252 - RNA, 13 nt, Human
gagacccccacac

SEQ ID NO: 2102253 - RNA, 14 nt, Human
gagacccccacacc

SEQ ID NO: 2102254 - RNA, 15 nt, Human
gagaagugccccugc

SEQ ID NO: 2102255 - RNA, 20 nt, Human
gagaaucagaucauuucaaa

SEQ ID NO: 2102256 - RNA, 21 nt, Human
gagaaucauacuuagcaaagu

SEQ ID NO: 2102257 - RNA, 23 nt, Human
gagaagucuuagacuugaaauac

SEQ ID NO: 2102258 - RNA, 21 nt, Human
gagacccugucucaaaaaaag

SEQ ID NO: 2102259 - RNA, 13 nt, Human
gagaccccugucu

SEQ ID NO: 2102260 - RNA, 14 nt, Human
gagaccccugucuc

SEQ ID NO: 2102261 - RNA, 15 nt, Human
gagaccccugucucc

SEQ ID NO: 2102262 - RNA, 17 nt, Human
gagacccuacaggagag

SEQ ID NO: 2102263 - RNA, 19 nt, Human
gagacccucguggccuucc

SEQ ID NO: 2102264 - RNA, 15 nt, Human
gagacccccacaccu

SEQ ID NO: 2102265 - RNA, 23 nt, Human
gagacccccacaccucaguuccc

SEQ ID NO: 2102266 - RNA, 11 nt, Human
gagaccucagc

SEQ ID NO: 2102267 - RNA, 13 nt, Human
gagaccucagcca

SEQ ID NO: 2102268 - RNA, 14 nt, Human
gagaccucagccau

SEQ ID NO: 2102269 - RNA, 15 nt, Human
gagaccucagccaug

SEQ ID NO: 2102270 - RNA, 16 nt, Human
gagacuagauugccuu

SEQ ID NO: 2102271 - RNA, 21 nt, Human
gacuuuucuuuguggcuuccu

SEQ ID NO: 2102272 - RNA, 23 nt, Human
gacuuucucagccucugaauaug

SEQ ID NO: 2102273 - RNA, 11 nt, Human
gacuuuccucu

SEQ ID NO: 2102274 - RNA, 15 nt, Human
gacuuuccacccccu

SEQ ID NO: 2102275 - RNA, 16 nt, Human
gacuuuccacccccuc

SEQ ID NO: 2102276 - RNA, 17 nt, Human
gacuuuccacccccucc

SEQ ID NO: 2102277 - RNA, 18 nt, Human
gacuuuccacccccuccc

SEQ ID NO: 2102278 - RNA, 19 nt, Human
gacuuuccacccccucccu

SEQ ID NO: 2102279 - RNA, 17 nt, Human
gacuggugagcagacug

SEQ ID NO: 2102280 - RNA, 14 nt, Human
gacuggugagcaga

SEQ ID NO: 2102281 - RNA, 23 nt, Human
gacugggucucgcuuuguugccc

SEQ ID NO: 2102282 - RNA, 17 nt, Human
gacuagccuggcuuggg

SEQ ID NO: 2102283 - RNA, 14 nt, Human
gacuaggagcacug

SEQ ID NO: 2102284 - RNA, 17 nt, Human
gacuagggauucaggcu

SEQ ID NO: 2102285 - RNA, 18 nt, Human
gacuagggauucaggcug

SEQ ID NO: 2102286 - RNA, 19 nt, Human
gacuagggauucaggcugc

SEQ ID NO: 2102287 - RNA, 20 nt, Human
gacuagggauucaggcugcu

SEQ ID NO: 2102288 - RNA, 21 nt, Human
gacuagggauucaggcugcuu

SEQ ID NO: 2102289 - RNA, 22 nt, Human
gacuaucuaaauguugaaagau

SEQ ID NO: 2102290 - RNA, 18 nt, Human
gacuaucaaacugaagcc

SEQ ID NO: 2102291 - RNA, 22 nt, Human
gacuaucaaacugaagccagaa

SEQ ID NO: 2102292 - RNA, 16 nt, Human
gacuauugacaucagc

SEQ ID NO: 2102293 - RNA, 13 nt, Human
gacuauuuaugaa

SEQ ID NO: 2102294 - RNA, 14 nt, Human
gacuauucaguuuu

SEQ ID NO: 2102295 - RNA, 22 nt, Human
gacuauuugcuuauuuaauaaa

SEQ ID NO: 2102296 - RNA, 16 nt, Human
gacucugucucaaaaa

SEQ ID NO: 2102297 - RNA, 12 nt, Human
gacucugucuca

SEQ ID NO: 2102298 - RNA, 22 nt, Human
gacucugaggcucuuucugggc

SEQ ID NO: 2102299 - RNA, 19 nt, Human
gacucugaggcucuuucug

SEQ ID NO: 2102300 - RNA, 19 nt, Human
gacucucugugaccugccc

SEQ ID NO: 2102301 - RNA, 15 nt, Human
gacucucugugaccu

SEQ ID NO: 2102302 - RNA, 14 nt, Human
gacucucugugacc

SEQ ID NO: 2102303 - RNA, 18 nt, Human
gagcagggacagaucaua

SEQ ID NO: 2102304 - RNA, 20 nt, Human
gagcagggacagaucauaga

SEQ ID NO: 2102305 - RNA, 14 nt, Human
gagcagggcucagc

SEQ ID NO: 2102306 - RNA, 14 nt, Human
gagccccacugccc

SEQ ID NO: 2102307 - RNA, 15 nt, Human
gagccccacugcccu

SEQ ID NO: 2102308 - RNA, 19 nt, Human
gagccccacugcccuucuc

SEQ ID NO: 2102309 - RNA, 12 nt, Human
gagccccagggu

SEQ ID NO: 2102310 - RNA, 13 nt, Human
gagccccaggguc

SEQ ID NO: 2102311 - RNA, 14 nt, Human
gagccccagggucu

SEQ ID NO: 2102312 - RNA, 17 nt, Human
gagccccagugccaagc

SEQ ID NO: 2102313 - RNA, 12 nt, Human
gagccccagugc

SEQ ID NO: 2102314 - RNA, 14 nt, Human
gagccccagugcca

SEQ ID NO: 2102315 - RNA, 18 nt, Human
gagccccaucagcuccag

SEQ ID NO: 2102316 - RNA, 19 nt, Human
gagccccagggucuucccu

SEQ ID NO: 2102317 - RNA, 24 nt, Human
gagccccagggucuucccuaccuc

SEQ ID NO: 2102318 - RNA, 21 nt, Human
gagcauggggauaaaggagaa

SEQ ID NO: 2102319 - RNA, 22 nt, Human
gagcauggggauaaaggagaag

SEQ ID NO: 2102320 - RNA, 21 nt, Human
gagcagggcucagcggggaca

SEQ ID NO: 2102321 - RNA, 18 nt, Human
gagcagugucuuccauaa

SEQ ID NO: 2102322 - RNA, 19 nt, Human
gagcagugucuuccauaau

SEQ ID NO: 2102323 - RNA, 16 nt, Human
gagcagugugucuccu

SEQ ID NO: 2102324 - RNA, 18 nt, Human
gagcagugugucuccugc

SEQ ID NO: 2102325 - RNA, 19 nt, Human
gagcagugugucuccugca

SEQ ID NO: 2102326 - RNA, 23 nt, Human
gagcagugugucuccugcaugca

SEQ ID NO: 2102327 - RNA, 12 nt, Human
gagcuggggaag

SEQ ID NO: 2102328 - RNA, 19 nt, Human
gagcugggcagaaggccaa

SEQ ID NO: 2102329 - RNA, 21 nt, Human
gagcugggacacuuaacagau

SEQ ID NO: 2102330 - RNA, 14 nt, Human
gagcugggaggaaa

SEQ ID NO: 2102331 - RNA, 17 nt, Human
gagcugggcagaaggcc

SEQ ID NO: 2102332 - RNA, 16 nt, Human
gagcugggauccuaag

SEQ ID NO: 2102333 - RNA, 16 nt, Human
gagcugggaggaaaag

SEQ ID NO: 2102334 - RNA, 17 nt, Human
gagcugggaggaaaaga

SEQ ID NO: 2102335 - RNA, 18 nt, Human
gagcugggugucaagagg

SEQ ID NO: 2102336 - RNA, 18 nt, Human
gagcugggggccaugagc

SEQ ID NO: 2102337 - RNA, 17 nt, Human
gagcuggugcauuacag

SEQ ID NO: 2102338 - RNA, 14 nt, Human
gagcuggugcauua

SEQ ID NO: 2102339 - RNA, 16 nt, Human
gagcuggugcauuaca

SEQ ID NO: 2102340 - RNA, 19 nt, Human
gagcugggggccaugagcu

SEQ ID NO: 2102341 - RNA, 24 nt, Human
gagcugggggccaugagcuccaga

SEQ ID NO: 2102342 - RNA, 21 nt, Human
gagcugguaguuaguagcaug

SEQ ID NO: 2102343 - RNA, 11 nt, Human
gagcuggugca

SEQ ID NO: 2102344 - RNA, 22 nt, Human
gagcugccuguucagcuccagc

SEQ ID NO: 2102345 - RNA, 21 nt, Human
gagcugccuguucagcuccag

SEQ ID NO: 2102346 - RNA, 20 nt, Human
gagcugccuguucagcucca

SEQ ID NO: 2102347 - RNA, 17 nt, Human
gagcccccgccccgccc

SEQ ID NO: 2102348 - RNA, 21 nt, Human
gagcccccgccccgccccaca

SEQ ID NO: 2102349 - RNA, 22 nt, Human
gagcccccgccccgccccacau

SEQ ID NO: 2102350 - RNA, 13 nt, Human
gagcgaaacuccg

SEQ ID NO: 2102351 - RNA, 22 nt, Human
gagccuugguguccaccuggcc

SEQ ID NO: 2102352 - RNA, 18 nt, Human
gagccuugguucaucagu

SEQ ID NO: 2102353 - RNA, 19 nt, Human
gagccuugguguccaccug

SEQ ID NO: 2102354 - RNA, 20 nt, Human
gagccuugguguccaccugg

SEQ ID NO: 2102355 - RNA, 18 nt, Human
gagauuucuuguugcuca

SEQ ID NO: 2102356 - RNA, 15 nt, Human
gagauguaagagcuu

SEQ ID NO: 2102357 - RNA, 15 nt, Human
gagauguagcaaaac

SEQ ID NO: 2102358 - RNA, 21 nt, Human
gagauugcaccacugcacucc

SEQ ID NO: 2102359 - RNA, 18 nt, Human
gagauugcaccacugcac

SEQ ID NO: 2102360 - RNA, 14 nt, Human
gagauggggugggg

SEQ ID NO: 2102361 - RNA, 20 nt, Human
gagauggggaaagaauuccu

SEQ ID NO: 2102362 - RNA, 18 nt, Human
gagauggggagaaaccua

SEQ ID NO: 2102363 - RNA, 15 nt, Human
gagauggaggaggag

SEQ ID NO: 2102364 - RNA, 15 nt, Human
gagauggcccucugg

SEQ ID NO: 2102365 - RNA, 16 nt, Human
gagauggcccucuggu

SEQ ID NO: 2102366 - RNA, 17 nt, Human
gagauggcccucuggua

SEQ ID NO: 2102367 - RNA, 17 nt, Human
gagaugggacugggagg

SEQ ID NO: 2102368 - RNA, 18 nt, Human
gagaugggcuuguuuucu

SEQ ID NO: 2102369 - RNA, 19 nt, Human
gagaugggacugggagggc

SEQ ID NO: 2102370 - RNA, 19 nt, Human
gagaugccuccaccgcugc

SEQ ID NO: 2102371 - RNA, 14 nt, Human
gagaugccuccacc

SEQ ID NO: 2102372 - RNA, 15 nt, Human
gagaugccuccaccg

SEQ ID NO: 2102373 - RNA, 20 nt, Human
gagaugccuccaccgcugcc

SEQ ID NO: 2102374 - RNA, 20 nt, Human
gagauggaaguugcagugag

SEQ ID NO: 2102375 - RNA, 23 nt, Human
gagauggaacccuuuuggccccc

SEQ ID NO: 2102376 - RNA, 12 nt, Human
gagauggaggag

SEQ ID NO: 2102377 - RNA, 13 nt, Human
gagauggaggagg

SEQ ID NO: 2102378 - RNA, 14 nt, Human
gagauggaggagga

SEQ ID NO: 2102379 - RNA, 16 nt, Human
gagauggaggaggagg

SEQ ID NO: 2102380 - RNA, 23 nt, Human
gagauggaucaaucaaacccggc

SEQ ID NO: 2102381 - RNA, 13 nt, Human
gagaggcagagug

SEQ ID NO: 2102382 - RNA, 15 nt, Human
gagaggcagagugcc

SEQ ID NO: 2102383 - RNA, 16 nt, Human
gagaggcagagugccc

SEQ ID NO: 2102384 - RNA, 22 nt, Human
gagaggcagacuucccugaaug

SEQ ID NO: 2102385 - RNA, 15 nt, Human
gagacucaccucugc

SEQ ID NO: 2102386 - RNA, 16 nt, Human
gagacucaccucugcc

SEQ ID NO: 2102387 - RNA, 21 nt, Human
gagacuagauuuaugaauaca

SEQ ID NO: 2102388 - RNA, 17 nt, Human
gagacucaccucugccu

SEQ ID NO: 2102389 - RNA, 18 nt, Human
gagacucaccucugccuc

SEQ ID NO: 2102390 - RNA, 19 nt, Human
gagacucaccucugccuca

SEQ ID NO: 2102391 - RNA, 20 nt, Human
gagacucaccucugccucaa

SEQ ID NO: 2102392 - RNA, 23 nt, Human
gagacucaccucugccucaaugu

SEQ ID NO: 2102393 - RNA, 13 nt, Human
gagacucagacag

SEQ ID NO: 2102394 - RNA, 14 nt, Human
gagacucagacagg

SEQ ID NO: 2102395 - RNA, 18 nt, Human
gcauaauaagcuaaagag

SEQ ID NO: 2102396 - RNA, 22 nt, Human
gcagucaucuugaccaagcagg

SEQ ID NO: 2102397 - RNA, 23 nt, Human
gcagucaucuugaccaagcagga

SEQ ID NO: 2102398 - RNA, 17 nt, Human
gcaguccugccucagcc

SEQ ID NO: 2102399 - RNA, 18 nt, Human
gcaguccugccucagccu

SEQ ID NO: 2102400 - RNA, 21 nt, Human
gcaguuugccuggugcagugg

SEQ ID NO: 2102401 - RNA, 14 nt, Human
gcauaauaagcuaa

SEQ ID NO: 2102402 - RNA, 14 nt, Human
gcauaacugacaaa

SEQ ID NO: 2102403 - RNA, 15 nt, Human
gcauaacugacaaau

SEQ ID NO: 2102404 - RNA, 17 nt, Human
gcauaacugacaaauca

SEQ ID NO: 2102405 - RNA, 18 nt, Human
gcauaacugacaaaucaa

SEQ ID NO: 2102406 - RNA, 19 nt, Human
gcauaacugacaaaucaag

SEQ ID NO: 2102407 - RNA, 21 nt, Human
gcauaacugacaaaucaaguu

SEQ ID NO: 2102408 - RNA, 22 nt, Human
gcauaacugacaaaucaaguuu

SEQ ID NO: 2102409 - RNA, 14 nt, Human
gcaguuugggaggu

SEQ ID NO: 2102410 - RNA, 16 nt, Human
gcagguugaggggcuc

SEQ ID NO: 2102411 - RNA, 19 nt, Human
gcagguugaggggcuccug

SEQ ID NO: 2102412 - RNA, 20 nt, Human
gcagguugaggggcuccugg

SEQ ID NO: 2102413 - RNA, 21 nt, Human
gcagguugaggggcuccugga

SEQ ID NO: 2102414 - RNA, 22 nt, Human
gcagguugaggggcuccuggaa

SEQ ID NO: 2102415 - RNA, 13 nt, Human
gcagggaaacagc

SEQ ID NO: 2102416 - RNA, 19 nt, Human
gcagggaggcaccauucag

SEQ ID NO: 2102417 - RNA, 22 nt, Human
gcagggagccgagaucacgcca

SEQ ID NO: 2102418 - RNA, 14 nt, Human
gcaguaaaaacugu

SEQ ID NO: 2102419 - RNA, 14 nt, Human
gcaguaaagagaaa

SEQ ID NO: 2102420 - RNA, 15 nt, Human
gcaguaaagagaaac

SEQ ID NO: 2102421 - RNA, 16 nt, Human
gcaguaaagagaaacu

SEQ ID NO: 2102422 - RNA, 17 nt, Human
gcaguaaagagaaacuu

SEQ ID NO: 2102423 - RNA, 18 nt, Human
gcaguaaagagaaacuuu

SEQ ID NO: 2102424 - RNA, 21 nt, Human
gcaguagaaauaauaugcauu

SEQ ID NO: 2102425 - RNA, 20 nt, Human
gcaguagaaauaauaugcau

SEQ ID NO: 2102426 - RNA, 19 nt, Human
gcaguagaaauaauaugca

SEQ ID NO: 2102427 - RNA, 18 nt, Human
gcaguagagucaucucca

SEQ ID NO: 2102428 - RNA, 20 nt, Human
gcaguagagucaucuccauc

SEQ ID NO: 2102429 - RNA, 19 nt, Human
gcagcugcgguccacccag

SEQ ID NO: 2102430 - RNA, 17 nt, Human
gcagcugcgguccaccc

SEQ ID NO: 2102431 - RNA, 15 nt, Human
gcaggcuggcuggcc

SEQ ID NO: 2102432 - RNA, 20 nt, Human
gcagcccaugcccaccugcc

SEQ ID NO: 2102433 - RNA, 22 nt, Human
gcagccccagcaccaccagguc

SEQ ID NO: 2102434 - RNA, 23 nt, Human
gcagccccagcaccaccaggucu

SEQ ID NO: 2102435 - RNA, 13 nt, Human
gcagcccaugccc

SEQ ID NO: 2102436 - RNA, 15 nt, Human
gcagcccaugcccac

SEQ ID NO: 2102437 - RNA, 17 nt, Human
gcagcccaugcccaccu

SEQ ID NO: 2102438 - RNA, 18 nt, Human
gcagcccaugcccaccug

SEQ ID NO: 2102439 - RNA, 22 nt, Human
gcagcccaugcccaccugccca

SEQ ID NO: 2102440 - RNA, 13 nt, Human
gcaagugagagcu

SEQ ID NO: 2102441 - RNA, 17 nt, Human
gcaagucuggaucuggg

SEQ ID NO: 2102442 - RNA, 21 nt, Human
gcaaguccuaagccuguuagc

SEQ ID NO: 2102443 - RNA, 14 nt, Human
gcacaagcugcacc

SEQ ID NO: 2102444 - RNA, 20 nt, Human
gcaagugaauuuuucucuaa

SEQ ID NO: 2102445 - RNA, 20 nt, Human
gcaauaaccucaaagugacu

SEQ ID NO: 2102446 - RNA, 12 nt, Human
gcaauaaaugaa

SEQ ID NO: 2102447 - RNA, 12 nt, Human
gcacaaugucuu

SEQ ID NO: 2102448 - RNA, 14 nt, Human
gcacaaugucuugg

SEQ ID NO: 2102449 - RNA, 12 nt, Human
gcacacacacac

SEQ ID NO: 2102450 - RNA, 14 nt, Human
gcacacacacacac

SEQ ID NO: 2102451 - RNA, 16 nt, Human
gcacacacacacacag

SEQ ID NO: 2102452 - RNA, 17 nt, Human
gcacacacacacacagg

SEQ ID NO: 2102453 - RNA, 20 nt, Human
gcacacacacacacaggagg

SEQ ID NO: 2102454 - RNA, 19 nt, Human
gcacacacacacacaggag

SEQ ID NO: 2102455 - RNA, 21 nt, Human
gcacaugagcuggcgggauug

SEQ ID NO: 2102456 - RNA, 13 nt, Human
gcacaucugcauu

SEQ ID NO: 2102457 - RNA, 21 nt, Human
gcacaucugcauuuucacccc

SEQ ID NO: 2102458 - RNA, 19 nt, Human
gcacccucgaugaagccca

SEQ ID NO: 2102459 - RNA, 16 nt, Human
gcacccuccgccuuca

SEQ ID NO: 2102460 - RNA, 13 nt, Human
gcaccgccuucuc

SEQ ID NO: 2102461 - RNA, 14 nt, Human
gcaccgccuucucu

SEQ ID NO: 2102462 - RNA, 19 nt, Human
gcaccgccggccagcuggg

SEQ ID NO: 2102463 - RNA, 20 nt, Human
gcaccgccggccagcuggga

SEQ ID NO: 2102464 - RNA, 12 nt, Human
gcacugacauug

SEQ ID NO: 2102465 - RNA, 20 nt, Human
gcacugacccacagccucug

SEQ ID NO: 2102466 - RNA, 16 nt, Human
gcacugacugggcaua

SEQ ID NO: 2102467 - RNA, 18 nt, Human
gcacuuuaaaugaagcua

SEQ ID NO: 2102468 - RNA, 17 nt, Human
gcacugacugggcauag

SEQ ID NO: 2102469 - RNA, 13 nt, Human
gcacuuucauugc

SEQ ID NO: 2102470 - RNA, 21 nt, Human
gcacuuucauugccagugucu

SEQ ID NO: 2102471 - RNA, 22 nt, Human
gcacuuucauugccagugucuu

SEQ ID NO: 2102472 - RNA, 17 nt, Human
gcagaaagggagcagag

SEQ ID NO: 2102473 - RNA, 14 nt, Human
gcagagcaggggca

SEQ ID NO: 2102474 - RNA, 20 nt, Human
gcagagcaggggcaggguga

SEQ ID NO: 2102475 - RNA, 18 nt, Human
gcagaacagccgcuccug

SEQ ID NO: 2102476 - RNA, 21 nt, Human
gcagaacagccgcuccugucu

SEQ ID NO: 2102477 - RNA, 14 nt, Human
gcagaaaucuagaa

SEQ ID NO: 2102478 - RNA, 15 nt, Human
gcagaaaucuagaag

SEQ ID NO: 2102479 - RNA, 15 nt, Human
gauuauuuuuuauga

SEQ ID NO: 2102480 - RNA, 15 nt, Human
gauuaguaaagaaau

SEQ ID NO: 2102481 - RNA, 20 nt, Human
gauuauuagccagguaaugu

SEQ ID NO: 2102482 - RNA, 15 nt, Human
gauuaugguuuugug

SEQ ID NO: 2102483 - RNA, 16 nt, Human
gauuaugguuuuguga

SEQ ID NO: 2102484 - RNA, 17 nt, Human
gauuaugguuuugugau

SEQ ID NO: 2102485 - RNA, 19 nt, Human
gauuagcaaguuacaguga

SEQ ID NO: 2102486 - RNA, 15 nt, Human
gauuagaucuuuuaa

SEQ ID NO: 2102487 - RNA, 14 nt, Human
gauuacaugcaugu

SEQ ID NO: 2102488 - RNA, 22 nt, Human
gauuaccuaguagucauuucau

SEQ ID NO: 2102489 - RNA, 12 nt, Human
gauuacucuuug

SEQ ID NO: 2102490 - RNA, 21 nt, Human
gauuagaaaugaccaauauua

SEQ ID NO: 2102491 - RNA, 23 nt, Human
gauuacucuuugagauagaagaa

SEQ ID NO: 2102492 - RNA, 17 nt, Human
gauuacugucaauaaac

SEQ ID NO: 2102493 - RNA, 18 nt, Human
gauuacugucaauaaaca

SEQ ID NO: 2102494 - RNA, 20 nt, Human
gauuacaggugugaaccacc

SEQ ID NO: 2102495 - RNA, 15 nt, Human
gauauuuuuuuaagu

SEQ ID NO: 2102496 - RNA, 14 nt, Human
gaucuccuugcccu

SEQ ID NO: 2102497 - RNA, 17 nt, Human
gaucucuugagccuggg

SEQ ID NO: 2102498 - RNA, 12 nt, Human
gaucucuugagc

SEQ ID NO: 2102499 - RNA, 16 nt, Human
gaucucuugagccugg

SEQ ID NO: 2102500 - RNA, 12 nt, Human
gaucuccaaagc

SEQ ID NO: 2102501 - RNA, 13 nt, Human
gaucuccaaagcu

SEQ ID NO: 2102502 - RNA, 14 nt, Human
gaucuccaaagcuu

SEQ ID NO: 2102503 - RNA, 17 nt, Human
gaucuccauauguuaca

SEQ ID NO: 2102504 - RNA, 15 nt, Human
gaucucauucaguau

SEQ ID NO: 2102505 - RNA, 17 nt, Human
gaucucauucaguauua

SEQ ID NO: 2102506 - RNA, 20 nt, Human
gaucucauucaguauuaaag

SEQ ID NO: 2102507 - RNA, 21 nt, Human
gaucucauucaguauuaaagg

SEQ ID NO: 2102508 - RNA, 18 nt, Human
gaucucccugccgccuca

SEQ ID NO: 2102509 - RNA, 20 nt, Human
gaucucccugccgccucaau

SEQ ID NO: 2102510 - RNA, 12 nt, Human
gaucucccugcc

SEQ ID NO: 2102511 - RNA, 13 nt, Human
gaucucccagggc

SEQ ID NO: 2102512 - RNA, 15 nt, Human
gaucucccagggcua

SEQ ID NO: 2102513 - RNA, 13 nt, Human
gaucucccugccg

SEQ ID NO: 2102514 - RNA, 14 nt, Human
gaucucccugccgc

SEQ ID NO: 2102515 - RNA, 15 nt, Human
gaucucccugccgcc

SEQ ID NO: 2102516 - RNA, 22 nt, Human
gauccaugaguuugcccugguu

SEQ ID NO: 2102517 - RNA, 16 nt, Human
gauccauguagcagga

SEQ ID NO: 2102518 - RNA, 19 nt, Human
gauccauguagcaggacug

SEQ ID NO: 2102519 - RNA, 21 nt, Human
gauauuuuuucagaaauaugu

SEQ ID NO: 2102520 - RNA, 14 nt, Human
gaugaucuuugcag

SEQ ID NO: 2102521 - RNA, 20 nt, Human
gaugagcccagcccuguucu

SEQ ID NO: 2102522 - RNA, 21 nt, Human
gaugagcccagcccuguucug

SEQ ID NO: 2102523 - RNA, 12 nt, Human
gaugagcauuua

SEQ ID NO: 2102524 - RNA, 18 nt, Human
gaugagcauuuagggcaa

SEQ ID NO: 2102525 - RNA, 21 nt, Human
gaugagcauuuagggcaagga

SEQ ID NO: 2102526 - RNA, 22 nt, Human
gaugagcauuuagggcaaggag

SEQ ID NO: 2102527 - RNA, 21 nt, Human
gaugaucuuugcagacaggca

SEQ ID NO: 2102528 - RNA, 20 nt, Human
gaugaucuuugcagacaggc

SEQ ID NO: 2102529 - RNA, 21 nt, Human
gaugaugaaaugaggucagag

SEQ ID NO: 2102530 - RNA, 21 nt, Human
gagugcucaguagucagacug

SEQ ID NO: 2102531 - RNA, 13 nt, Human
gaguuugcccugg

SEQ ID NO: 2102532 - RNA, 21 nt, Human
gaguuuccucaggcugcugga

SEQ ID NO: 2102533 - RNA, 16 nt, Human
gaguuuccucaggcug

SEQ ID NO: 2102534 - RNA, 20 nt, Human
gaguuuccucaggcugcugg

SEQ ID NO: 2102535 - RNA, 23 nt, Human
gaguuuccucaggcugcuggagg

SEQ ID NO: 2102536 - RNA, 21 nt, Human
gaguuuagugaucugaacaga

SEQ ID NO: 2102537 - RNA, 15 nt, Human
gaguuuccucaggcu

SEQ ID NO: 2102538 - RNA, 20 nt, Human
gagugaggauaugaguagcc

SEQ ID NO: 2102539 - RNA, 15 nt, Human
gaguuuccuaaaagu

SEQ ID NO: 2102540 - RNA, 16 nt, Human
gaguuguggaaagccu

SEQ ID NO: 2102541 - RNA, 20 nt, Human
gaguuguggaaagccucugc

SEQ ID NO: 2102542 - RNA, 16 nt, Human
gaguuguguuguucuu

SEQ ID NO: 2102543 - RNA, 18 nt, Human
gaguuguguuguucuuuu

SEQ ID NO: 2102544 - RNA, 17 nt, Human
gaguuuaagaccagccu

SEQ ID NO: 2102545 - RNA, 19 nt, Human
gaguuuaagaccagccugg

SEQ ID NO: 2102546 - RNA, 14 nt, Human
gaguuuaccauuug

SEQ ID NO: 2102547 - RNA, 17 nt, Human
gaguuuaccauuuguaa

SEQ ID NO: 2102548 - RNA, 20 nt, Human
gaguuuaccauuuguaauaa

SEQ ID NO: 2102549 - RNA, 22 nt, Human
gaguuuaccauuuguaauaaag

SEQ ID NO: 2102550 - RNA, 23 nt, Human
gaguuuaccauuuguaauaaagu

SEQ ID NO: 2102551 - RNA, 18 nt, Human
gaggucucuugagggagc

SEQ ID NO: 2102552 - RNA, 14 nt, Human
gaggucugaaaugg

SEQ ID NO: 2102553 - RNA, 19 nt, Human
gaggucugcucggccgucu

SEQ ID NO: 2102554 - RNA, 23 nt, Human
gaggucugcucggccgucuucac

SEQ ID NO: 2102555 - RNA, 21 nt, Human
gaggugcagagugcccagaac

SEQ ID NO: 2102556 - RNA, 19 nt, Human
gaggugcagagugcccaga

SEQ ID NO: 2102557 - RNA, 18 nt, Human
gaggucuuuugacaugug

SEQ ID NO: 2102558 - RNA, 18 nt, Human
gaggugcagagugcccag

SEQ ID NO: 2102559 - RNA, 20 nt, Human
gaggugggaggaucuuuuga

SEQ ID NO: 2102560 - RNA, 20 nt, Human
gaggugcugcauugccugcg

SEQ ID NO: 2102561 - RNA, 16 nt, Human
gaggugcugggaggga

SEQ ID NO: 2102562 - RNA, 23 nt, Human
gaggugcuacugacuuucucagc

SEQ ID NO: 2102563 - RNA, 16 nt, Human
gaggugggauaucccu

SEQ ID NO: 2102564 - RNA, 12 nt, Human
gagucacacuca

SEQ ID NO: 2102565 - RNA, 20 nt, Human
gagucaauccccucauucag

SEQ ID NO: 2102566 - RNA, 19 nt, Human
gagucaauccccucauuca

SEQ ID NO: 2102567 - RNA, 11 nt, Human
gaggugggagg

SEQ ID NO: 2102568 - RNA, 12 nt, Human
gagugagcuggu

SEQ ID NO: 2102569 - RNA, 13 nt, Human
gagucccaccuug

SEQ ID NO: 2102570 - RNA, 13 nt, Human
gaguccagucucu

SEQ ID NO: 2102571 - RNA, 21 nt, Human
gagucccaccuuggcugcagg

SEQ ID NO: 2102572 - RNA, 24 nt, Human
gagugagcacuaaggugugcucug

SEQ ID NO: 2102573 - RNA, 12 nt, Human
gagugcagugag

SEQ ID NO: 2102574 - RNA, 11 nt, Human
gagugcaguga

SEQ ID NO: 2102575 - RNA, 17 nt, Human
gagugaggcaggugaca

SEQ ID NO: 2102576 - RNA, 14 nt, Human
gagucaccaagccc

SEQ ID NO: 2102577 - RNA, 13 nt, Human
gagucaccaagcc

SEQ ID NO: 2102578 - RNA, 15 nt, Human
gagucaccaagccca

SEQ ID NO: 2102579 - RNA, 13 nt, Human
gaguccaggcccc

SEQ ID NO: 2102580 - RNA, 14 nt, Human
gaguccaggcccca

SEQ ID NO: 2102581 - RNA, 20 nt, Human
gagucccaccuuggcugcag

SEQ ID NO: 2102582 - RNA, 16 nt, Human
gagucccaccuuggcu

SEQ ID NO: 2102583 - RNA, 17 nt, Human
gauacgacaacuugcac

SEQ ID NO: 2102584 - RNA, 13 nt, Human
gauacgacuuuau

SEQ ID NO: 2102585 - RNA, 16 nt, Human
gauacgcaucagacag

SEQ ID NO: 2102586 - RNA, 21 nt, Human
gauacgaguuuuggccgggug

SEQ ID NO: 2102587 - RNA, 22 nt, Human
gauacgaguuuuggccgggugc

SEQ ID NO: 2102588 - RNA, 20 nt, Human
gauacccauagcuuccauga

SEQ ID NO: 2102589 - RNA, 18 nt, Human
gauaugcaguuuuccuua

SEQ ID NO: 2102590 - RNA, 13 nt, Human
gauacucugucag

SEQ ID NO: 2102591 - RNA, 19 nt, Human
gauauguaaacauaauucu

SEQ ID NO: 2102592 - RNA, 19 nt, Human
gauauuccaugaauguauc

SEQ ID NO: 2102593 - RNA, 21 nt, Human
gauauuccaugaauguaucag

SEQ ID NO: 2102594 - RNA, 20 nt, Human
gauauuccccccacuuaaga

SEQ ID NO: 2102595 - RNA, 23 nt, Human
gauauuauucaccauguaaaaca

SEQ ID NO: 2102596 - RNA, 12 nt, Human
gauauuccauag

SEQ ID NO: 2102597 - RNA, 21 nt, Human
gauauuccauaguauauuaaa

SEQ ID NO: 2102598 - RNA, 16 nt, Human
gauauuccaugaaugu

SEQ ID NO: 2102599 - RNA, 18 nt, Human
gauauuccaugaauguau

SEQ ID NO: 2102600 - RNA, 19 nt, Human
gauauuaaauuuuuuaaaa

SEQ ID NO: 2102601 - RNA, 20 nt, Human
cuucuucggggaacuccugg

SEQ ID NO: 2102602 - RNA, 17 nt, Human
cuucuucggggaacucc

SEQ ID NO: 2102603 - RNA, 16 nt, Human
cuucugcaccuuaucu

SEQ ID NO: 2102604 - RNA, 17 nt, Human
cuucugcaccuuaucuu

SEQ ID NO: 2102605 - RNA, 18 nt, Human
cuucugcaccuuaucuua

SEQ ID NO: 2102606 - RNA, 18 nt, Human
cuucuucagaucagugcu

SEQ ID NO: 2102607 - RNA, 12 nt, Human
cuucuguuucua

SEQ ID NO: 2102608 - RNA, 13 nt, Human
cuucuguuucuag

SEQ ID NO: 2102609 - RNA, 14 nt, Human
cuucuguuucuagu

SEQ ID NO: 2102610 - RNA, 16 nt, Human
cuucuguuucuaguug

SEQ ID NO: 2102611 - RNA, 17 nt, Human
cuucuucagccaccucu

SEQ ID NO: 2102612 - RNA, 21 nt, Human
cuucuucagccaccucucuuu

SEQ ID NO: 2102613 - RNA, 15 nt, Human
cuucugaugaaucuu

SEQ ID NO: 2102614 - RNA, 17 nt, Human
cuucugaugaaucuugc

SEQ ID NO: 2102615 - RNA, 18 nt, Human
cuucugaugaaucuugcg

SEQ ID NO: 2102616 - RNA, 19 nt, Human
cuucugaugaaucuugcgu

SEQ ID NO: 2102617 - RNA, 21 nt, Human
cuucucaaaggguacuuccac

SEQ ID NO: 2102618 - RNA, 17 nt, Human
cuuccugccaccugcug

SEQ ID NO: 2102619 - RNA, 13 nt, Human
cuucuagaaccag

SEQ ID NO: 2102620 - RNA, 15 nt, Human
cuucuacugcuucua

SEQ ID NO: 2102621 - RNA, 22 nt, Human
cuucuacuuacacaucuuccac

SEQ ID NO: 2102622 - RNA, 13 nt, Human
cuucuacuucugc

SEQ ID NO: 2102623 - RNA, 21 nt, Human
cuucuacuucugcccuugcca

SEQ ID NO: 2102624 - RNA, 17 nt, Human
cuucuagaaccaggcaa

SEQ ID NO: 2102625 - RNA, 13 nt, Human
cuucuaggaagcu

SEQ ID NO: 2102626 - RNA, 13 nt, Human
cuucuauuuuauu

SEQ ID NO: 2102627 - RNA, 17 nt, Human
cuuccugcauucaccca

SEQ ID NO: 2102628 - RNA, 20 nt, Human
cuuccugcauucacccagac

SEQ ID NO: 2102629 - RNA, 21 nt, Human
cuuccugcauucacccagaca

SEQ ID NO: 2102630 - RNA, 22 nt, Human
cuuccugcauucacccagacag

SEQ ID NO: 2102631 - RNA, 13 nt, Human
cuugaagaucguu

SEQ ID NO: 2102632 - RNA, 20 nt, Human
cuugaagaucguuaguaucu

SEQ ID NO: 2102633 - RNA, 13 nt, Human
cuugaagccacug

SEQ ID NO: 2102634 - RNA, 16 nt, Human
cuugaagccacugaag

SEQ ID NO: 2102635 - RNA, 17 nt, Human
cuugaagccacugaagc

SEQ ID NO: 2102636 - RNA, 18 nt, Human
cuugaagccacugaagcu

SEQ ID NO: 2102637 - RNA, 15 nt, Human
cuugaucuguauaua

SEQ ID NO: 2102638 - RNA, 20 nt, Human
cuugaucuguauauacaaua

SEQ ID NO: 2102639 - RNA, 22 nt, Human
cuugaucuguauauacaauaac

SEQ ID NO: 2102640 - RNA, 16 nt, Human
cuugauaaagggccaa

SEQ ID NO: 2102641 - RNA, 13 nt, Human
cuugauaacagcu

SEQ ID NO: 2102642 - RNA, 14 nt, Human
cuugauaacagcua

SEQ ID NO: 2102643 - RNA, 17 nt, Human
cuugauaauguuguggu

SEQ ID NO: 2102644 - RNA, 21 nt, Human
cuugauaauguugugguuugu

SEQ ID NO: 2102645 - RNA, 20 nt, Human
cuugacagggcacaccgggc

SEQ ID NO: 2102646 - RNA, 13 nt, Human
cuugacagggcac

SEQ ID NO: 2102647 - RNA, 15 nt, Human
cuugacagggcacac

SEQ ID NO: 2102648 - RNA, 14 nt, Human
cuugacagggcaca

SEQ ID NO: 2102649 - RNA, 13 nt, Human
cuugaagccaagu

SEQ ID NO: 2102650 - RNA, 19 nt, Human
cuugaagccacugaagcug

SEQ ID NO: 2102651 - RNA, 21 nt, Human
cuugaagccacugaagcuggg

SEQ ID NO: 2102652 - RNA, 20 nt, Human
cuugaauuucuaaaaaacag

SEQ ID NO: 2102653 - RNA, 15 nt, Human
cuuggcagcugaacu

SEQ ID NO: 2102654 - RNA, 18 nt, Human
cuuggcaucacagggcag

SEQ ID NO: 2102655 - RNA, 14 nt, Human
cuuggcagccuacu

SEQ ID NO: 2102656 - RNA, 19 nt, Human
cuuggcaucacagggcaga

SEQ ID NO: 2102657 - RNA, 19 nt, Human
cuugcgcuuuugcugguca

SEQ ID NO: 2102658 - RNA, 18 nt, Human
cuugauacuuguuuucaa

SEQ ID NO: 2102659 - RNA, 13 nt, Human
cuugaugagugua

SEQ ID NO: 2102660 - RNA, 19 nt, Human
cuugaugaguguaacaaga

SEQ ID NO: 2102661 - RNA, 20 nt, Human
cuugaugaguguaacaagaa

SEQ ID NO: 2102662 - RNA, 21 nt, Human
cuugaugaguguaacaagaaa

SEQ ID NO: 2102663 - RNA, 22 nt, Human
cuugaugaguguaacaagaaag

SEQ ID NO: 2102664 - RNA, 23 nt, Human
cuugaugaguguaacaagaaagg

SEQ ID NO: 2102665 - RNA, 16 nt, Human
cuugaugacuggaauu

SEQ ID NO: 2102666 - RNA, 17 nt, Human
cuugaugacuggaauuu

SEQ ID NO: 2102667 - RNA, 20 nt, Human
cuugaugacuggaauuuuua

SEQ ID NO: 2102668 - RNA, 13 nt, Human
cuugccugcaggc

SEQ ID NO: 2102669 - RNA, 12 nt, Human
cuugccugcagg

SEQ ID NO: 2102670 - RNA, 15 nt, Human
cuuaugccauuuguu

SEQ ID NO: 2102671 - RNA, 17 nt, Human
cuuaugccauuuguuua

SEQ ID NO: 2102672 - RNA, 15 nt, Human
cuuauucucaaagca

SEQ ID NO: 2102673 - RNA, 15 nt, Human
cuuauuguaccucuc

SEQ ID NO: 2102674 - RNA, 14 nt, Human
cuuauuguaccucu

SEQ ID NO: 2102675 - RNA, 13 nt, Human
cuuauuguaccuc

SEQ ID NO: 2102676 - RNA, 18 nt, Human
cuuauuguaccucucuua

SEQ ID NO: 2102677 - RNA, 19 nt, Human
cuuauucauugugguuauu

SEQ ID NO: 2102678 - RNA, 20 nt, Human
cuuauugcuuugaaacuaga

SEQ ID NO: 2102679 - RNA, 15 nt, Human
cuucacggaagagcc

SEQ ID NO: 2102680 - RNA, 19 nt, Human
cuucacggaagagccuugc

SEQ ID NO: 2102681 - RNA, 21 nt, Human
cuuccauaaucuggacuccuc

SEQ ID NO: 2102682 - RNA, 11 nt, Human
cuuccauaauc

SEQ ID NO: 2102683 - RNA, 11 nt, Human
cuuccauaaug

SEQ ID NO: 2102684 - RNA, 23 nt, Human
cuuccauaauguauaaagaacaa

SEQ ID NO: 2102685 - RNA, 11 nt, Human
cuuccauaauu

SEQ ID NO: 2102686 - RNA, 12 nt, Human
cuuccauaguga

SEQ ID NO: 2102687 - RNA, 22 nt, Human
cuuccauagccuaaucccuggg

SEQ ID NO: 2102688 - RNA, 14 nt, Human
cuuccauaauuaug

SEQ ID NO: 2102689 - RNA, 14 nt, Human
cuuccauagccuaa

SEQ ID NO: 2102690 - RNA, 16 nt, Human
cuucaugaaaauccua

SEQ ID NO: 2102691 - RNA, 17 nt, Human
cuucaugaaaauccuac

SEQ ID NO: 2102692 - RNA, 18 nt, Human
cuucaugaaaauccuacc

SEQ ID NO: 2102693 - RNA, 19 nt, Human
cuucaugaaaauccuacca

SEQ ID NO: 2102694 - RNA, 12 nt, Human
cuucaugcaaug

SEQ ID NO: 2102695 - RNA, 13 nt, Human
cuucaugcaauga

SEQ ID NO: 2102696 - RNA, 22 nt, Human
cuucaugcaaugacaucuucaa

SEQ ID NO: 2102697 - RNA, 17 nt, Human
cuucaugcaaugacauc

SEQ ID NO: 2102698 - RNA, 12 nt, Human
cuucaucuuccc

SEQ ID NO: 2102699 - RNA, 18 nt, Human
cuucauagcagauuuuaa

SEQ ID NO: 2102700 - RNA, 17 nt, Human
cuucaguugguguguuu

SEQ ID NO: 2102701 - RNA, 19 nt, Human
cuucaguugguguguuuuu

SEQ ID NO: 2102702 - RNA, 20 nt, Human
cuucaguugguguguuuuug

SEQ ID NO: 2102703 - RNA, 22 nt, Human
cuucaguugguguguuuuuggg

SEQ ID NO: 2102704 - RNA, 16 nt, Human
cuucacggcaggacaa

SEQ ID NO: 2102705 - RNA, 17 nt, Human
cuucacggcaggacaac

SEQ ID NO: 2102706 - RNA, 20 nt, Human
cuucacuccagccuggguga

SEQ ID NO: 2102707 - RNA, 13 nt, Human
cuucacggcagga

SEQ ID NO: 2102708 - RNA, 17 nt, Human
cuucacucgcccccggg

SEQ ID NO: 2102709 - RNA, 24 nt, Human
cuucacuccggugugccugcagcc

SEQ ID NO: 2102710 - RNA, 14 nt, Human
cuucacuccggugu

SEQ ID NO: 2102711 - RNA, 19 nt, Human
cuucacuccggugugccug

SEQ ID NO: 2102712 - RNA, 22 nt, Human
cuucacuccggugugccugcag

SEQ ID NO: 2102713 - RNA, 23 nt, Human
cuucacuccggugugccugcagc

SEQ ID NO: 2102714 - RNA, 13 nt, Human
cuuuccuguucag

SEQ ID NO: 2102715 - RNA, 14 nt, Human
cuuuccuguucagc

SEQ ID NO: 2102716 - RNA, 16 nt, Human
cuuuccuguucagcau

SEQ ID NO: 2102717 - RNA, 17 nt, Human
cuuuccuguucagcauu

SEQ ID NO: 2102718 - RNA, 18 nt, Human
cuuuccuguucagcauuc

SEQ ID NO: 2102719 - RNA, 19 nt, Human
cuuuccuguucagcauucu

SEQ ID NO: 2102720 - RNA, 15 nt, Human
cuuuccuuccauccc

SEQ ID NO: 2102721 - RNA, 11 nt, Human
cuuuccuuccu

SEQ ID NO: 2102722 - RNA, 14 nt, Human
cuuuccuuccucuc

SEQ ID NO: 2102723 - RNA, 16 nt, Human
cuuuccuuccucucau

SEQ ID NO: 2102724 - RNA, 15 nt, Human
cuuuccuuccuuccc

SEQ ID NO: 2102725 - RNA, 16 nt, Human
cuuuccuuccuucccu

SEQ ID NO: 2102726 - RNA, 21 nt, Human
cuuuccuggagagucucacuc

SEQ ID NO: 2102727 - RNA, 20 nt, Human
cuuucagggaauuucaggaa

SEQ ID NO: 2102728 - RNA, 16 nt, Human
cuuucacaaccuucug

SEQ ID NO: 2102729 - RNA, 20 nt, Human
cuuucacaaaauuuuauucc

SEQ ID NO: 2102730 - RNA, 14 nt, Human
cuuucacaaccuuc

SEQ ID NO: 2102731 - RNA, 17 nt, Human
cuuucacaaaauuuuau

SEQ ID NO: 2102732 - RNA, 21 nt, Human
cuuucaaugguuugcaaggaa

SEQ ID NO: 2102733 - RNA, 22 nt, Human
cuuucaaugguuugcaaggaag

SEQ ID NO: 2102734 - RNA, 20 nt, Human
cuuucaaugguuugcaagga

SEQ ID NO: 2102735 - RNA, 22 nt, Human
cuuugauauuuucaacgcagcc

SEQ ID NO: 2102736 - RNA, 15 nt, Human
cuuugaucagguggg

SEQ ID NO: 2102737 - RNA, 21 nt, Human
cuuugaugauuaauucaccuu

SEQ ID NO: 2102738 - RNA, 17 nt, Human
cuuucuagcuaauggaa

SEQ ID NO: 2102739 - RNA, 17 nt, Human
cuuucuacccagcgagc

SEQ ID NO: 2102740 - RNA, 21 nt, Human
cuuugggcugcccuggugcug

SEQ ID NO: 2102741 - RNA, 20 nt, Human
cuuugggcugcccuggugcu

SEQ ID NO: 2102742 - RNA, 19 nt, Human
cuuugggcugcccuggugc

SEQ ID NO: 2102743 - RNA, 15 nt, Human
cuuugggcugcccug

SEQ ID NO: 2102744 - RNA, 18 nt, Human
cuuugaugucauauggaa

SEQ ID NO: 2102745 - RNA, 14 nt, Human
cuuugggcugcccu

SEQ ID NO: 2102746 - RNA, 21 nt, Human
cuuuguaaguaaacugcccug

SEQ ID NO: 2102747 - RNA, 22 nt, Human
cuuuguaaguaaacugcccugu

SEQ ID NO: 2102748 - RNA, 14 nt, Human
cuuuuaugagcuca

SEQ ID NO: 2102749 - RNA, 21 nt, Human
cuuuuaugagcucauguagca

SEQ ID NO: 2102750 - RNA, 22 nt, Human
cuuuuaugagcucauguagcaa

SEQ ID NO: 2102751 - RNA, 19 nt, Human
cuuuuaucacgauauuauu

SEQ ID NO: 2102752 - RNA, 17 nt, Human
cuuuuauccacuuaccu

SEQ ID NO: 2102753 - RNA, 21 nt, Human
cuuuuaguuuuaguugcagaa

SEQ ID NO: 2102754 - RNA, 22 nt, Human
cuuuuaguuuuaguugcagaaa

SEQ ID NO: 2102755 - RNA, 19 nt, Human
cuuuuaguuguaucucuuu

SEQ ID NO: 2102756 - RNA, 20 nt, Human
cuuuuaguuguaucucuuuu

SEQ ID NO: 2102757 - RNA, 21 nt, Human
cuuuuaguuguaucucuuuug

SEQ ID NO: 2102758 - RNA, 18 nt, Human
cuuuuaguuguaucucuu

SEQ ID NO: 2102759 - RNA, 18 nt, Human
cuuuuaguacccaccuga

SEQ ID NO: 2102760 - RNA, 20 nt, Human
cuuuuaguacccaccugagc

SEQ ID NO: 2102761 - RNA, 21 nt, Human
cuuuuaguacccaccugagcu

SEQ ID NO: 2102762 - RNA, 22 nt, Human
cuuuuaguacccaccugagcuu

SEQ ID NO: 2102763 - RNA, 13 nt, Human
cuuuuauaaaaaa

SEQ ID NO: 2102764 - RNA, 20 nt, Human
cuuuuauaaaaaaaaugaaa

SEQ ID NO: 2102765 - RNA, 21 nt, Human
cuuuuauaaaaaaaaugaaau

SEQ ID NO: 2102766 - RNA, 22 nt, Human
cuuuuauaaaaaaaaugaaaug

SEQ ID NO: 2102767 - RNA, 23 nt, Human
cuuuuauaaaaaaaaugaaaugu

SEQ ID NO: 2102768 - RNA, 19 nt, Human
cuuuguaaucguuaugugu

SEQ ID NO: 2102769 - RNA, 21 nt, Human
cuuuguaaucguuaugugugu

SEQ ID NO: 2102770 - RNA, 13 nt, Human
gaaacuuugugcu

SEQ ID NO: 2102771 - RNA, 11 nt, Human
gaaacuuuucu

SEQ ID NO: 2102772 - RNA, 21 nt, Human
gaaacuuuucuuaaaaaguua

SEQ ID NO: 2102773 - RNA, 20 nt, Human
gaaagacuaucuaaauguug

SEQ ID NO: 2102774 - RNA, 19 nt, Human
gaaaggcucugaaagccag

SEQ ID NO: 2102775 - RNA, 15 nt, Human
gaaaggcucugaaag

SEQ ID NO: 2102776 - RNA, 17 nt, Human
gaaaggcucugaaagcc

SEQ ID NO: 2102777 - RNA, 19 nt, Human
gaaagggugcugcuucccu

SEQ ID NO: 2102778 - RNA, 16 nt, Human
gaaagggugcugcuuc

SEQ ID NO: 2102779 - RNA, 22 nt, Human
gaaagggacuuggaagcuccgc

SEQ ID NO: 2102780 - RNA, 17 nt, Human
gaaagggagcagagaag

SEQ ID NO: 2102781 - RNA, 22 nt, Human
gaaagggagcuaucaggaacag

SEQ ID NO: 2102782 - RNA, 19 nt, Human
gaaagggacuuggaagcuc

SEQ ID NO: 2102783 - RNA, 18 nt, Human
gaaagguuacccuguaac

SEQ ID NO: 2102784 - RNA, 15 nt, Human
gaaaauuggacauua

SEQ ID NO: 2102785 - RNA, 19 nt, Human
gaaaauggaaguggcaaua

SEQ ID NO: 2102786 - RNA, 16 nt, Human
gaaaauguaaguaaau

SEQ ID NO: 2102787 - RNA, 20 nt, Human
gaaaauguaaguaaaugucu

SEQ ID NO: 2102788 - RNA, 13 nt, Human
gaaaauugaauuu

SEQ ID NO: 2102789 - RNA, 16 nt, Human
gaaaauugaauuuaac

SEQ ID NO: 2102790 - RNA, 17 nt, Human
gaaaauugaauuuaaca

SEQ ID NO: 2102791 - RNA, 18 nt, Human
gaaaauugaauuuaacaa

SEQ ID NO: 2102792 - RNA, 19 nt, Human
gaaaauugaauuuaacaau

SEQ ID NO: 2102793 - RNA, 20 nt, Human
gaaaauugaauuuaacaaug

SEQ ID NO: 2102794 - RNA, 22 nt, Human
gaaaauugaauuuaacaaugcg

SEQ ID NO: 2102795 - RNA, 14 nt, Human
gaaaauuccagaaa

SEQ ID NO: 2102796 - RNA, 18 nt, Human
gaaaauuccagaaaggau

SEQ ID NO: 2102797 - RNA, 20 nt, Human
gaaaauuccagaaaggauau

SEQ ID NO: 2102798 - RNA, 15 nt, Human
gaaaauguaugugua

SEQ ID NO: 2102799 - RNA, 21 nt, Human
gaaaaugucagaaaccaguua

SEQ ID NO: 2102800 - RNA, 22 nt, Human
gaaaaugucagaaaccaguuau

SEQ ID NO: 2102801 - RNA, 23 nt, Human
gaaaaugucagaaaccaguuaug

SEQ ID NO: 2102802 - RNA, 23 nt, Human
gaaaaugcuguauuagucacaga

SEQ ID NO: 2102803 - RNA, 18 nt, Human
gaaaagaaaaaugagccu

SEQ ID NO: 2102804 - RNA, 20 nt, Human
gaaaaaaaauaacacagaga

SEQ ID NO: 2102805 - RNA, 23 nt, Human
gaaaaacucugggaaauaagaga

SEQ ID NO: 2102806 - RNA, 20 nt, Human
gaaaaacuuccaugaggcca

SEQ ID NO: 2102807 - RNA, 20 nt, Human
cuuuugcccuucacaguguu

SEQ ID NO: 2102808 - RNA, 21 nt, Human
cuuuugcccuucacaguguuu

SEQ ID NO: 2102809 - RNA, 16 nt, Human
cuuuuggaaucuagaa

SEQ ID NO: 2102810 - RNA, 18 nt, Human
cuuuuggaaucuagaaga

SEQ ID NO: 2102811 - RNA, 20 nt, Human
cuuuuggaaucuagaagaaa

SEQ ID NO: 2102812 - RNA, 21 nt, Human
cuuuuggaaucuagaagaaau

SEQ ID NO: 2102813 - RNA, 22 nt, Human
cuuuuggaaucuagaagaaaug

SEQ ID NO: 2102814 - RNA, 23 nt, Human
cuuuuggaaucuagaagaaauga

SEQ ID NO: 2102815 - RNA, 18 nt, Human
cuuuugucuaugggacuc

SEQ ID NO: 2102816 - RNA, 20 nt, Human
cuuuuggcccccgagcuggg

SEQ ID NO: 2102817 - RNA, 13 nt, Human
cuuuuguaaaugu

SEQ ID NO: 2102818 - RNA, 15 nt, Human
cuuuuggcacugaga

SEQ ID NO: 2102819 - RNA, 13 nt, Human
cuuuuggcccccg

SEQ ID NO: 2102820 - RNA, 22 nt, Human
cuuuuuuuuuuuuuaaagacag

SEQ ID NO: 2102821 - RNA, 23 nt, Human
cuuuuuuuuuuuuuaaagacaga

SEQ ID NO: 2102822 - RNA, 19 nt, Human
gaaaaaaaaguuucagaga

SEQ ID NO: 2102823 - RNA, 22 nt, Human
gaaaaaaaaguuucagagaagu

SEQ ID NO: 2102824 - RNA, 14 nt, Human
gaaaaaaaacacac

SEQ ID NO: 2102825 - RNA, 18 nt, Human
gaaaaacaucugaaagcc

SEQ ID NO: 2102826 - RNA, 15 nt, Human
gaaaaacaauaagag

SEQ ID NO: 2102827 - RNA, 20 nt, Human
gaaaaaaaauguucuuuggg

SEQ ID NO: 2102828 - RNA, 13 nt, Human
gaaaaaaacuuuu

SEQ ID NO: 2102829 - RNA, 14 nt, Human
gaaaaaaacuuuua

SEQ ID NO: 2102830 - RNA, 17 nt, Human
gaaaaaaacuuuuauaa

SEQ ID NO: 2102831 - RNA, 23 nt, Human
gaaaaaaacuuuuauaaauuaaa

SEQ ID NO: 2102832 - RNA, 20 nt, Human
gaaaaaaaguuugccagaag

SEQ ID NO: 2102833 - RNA, 19 nt, Human
gaaaaaaauaauuuuauga

SEQ ID NO: 2102834 - RNA, 23 nt, Human
gaaaaaaauaauuuuaugaacug

SEQ ID NO: 2102835 - RNA, 18 nt, Human
gaaaaaaaguuugccaga

SEQ ID NO: 2102836 - RNA, 13 nt, Human
gaaaaaaaugacu

SEQ ID NO: 2102837 - RNA, 21 nt, Human
cuguaggaagguuaauguuca

SEQ ID NO: 2102838 - RNA, 19 nt, Human
cugucacgcagccaccagg

SEQ ID NO: 2102839 - RNA, 23 nt, Human
cugucaccaagcucacaguuccu

SEQ ID NO: 2102840 - RNA, 14 nt, Human
cugucaccaagcuc

SEQ ID NO: 2102841 - RNA, 13 nt, Human
cuguaaaacuuua

SEQ ID NO: 2102842 - RNA, 14 nt, Human
cuguaaaacuuuau

SEQ ID NO: 2102843 - RNA, 20 nt, Human
cuguaaaacuuuauuuuaua

SEQ ID NO: 2102844 - RNA, 16 nt, Human
cuguaaaaugaaauua

SEQ ID NO: 2102845 - RNA, 15 nt, Human
cuguaaaaugaaauu

SEQ ID NO: 2102846 - RNA, 16 nt, Human
cugucauuugagcagg

SEQ ID NO: 2102847 - RNA, 18 nt, Human
cugucauuugagcagggc

SEQ ID NO: 2102848 - RNA, 17 nt, Human
cugucauuugagcaggg

SEQ ID NO: 2102849 - RNA, 20 nt, Human
cugucauuugagcagggcuc

SEQ ID NO: 2102850 - RNA, 18 nt, Human
cuguccugaccugucuca

SEQ ID NO: 2102851 - RNA, 21 nt, Human
cugucagaugggaagacauga

SEQ ID NO: 2102852 - RNA, 22 nt, Human
cugucagaugggaagacaugaa

SEQ ID NO: 2102853 - RNA, 14 nt, Human
cugucacuguuucu

SEQ ID NO: 2102854 - RNA, 19 nt, Human
cugucacuguuucucugcu

SEQ ID NO: 2102855 - RNA, 20 nt, Human
cugucacuguuucucugcug

SEQ ID NO: 2102856 - RNA, 15 nt, Human
cugugaagagaacca

SEQ ID NO: 2102857 - RNA, 14 nt, Human
cugugaacuugggg

SEQ ID NO: 2102858 - RNA, 15 nt, Human
cugugaacuugggga

SEQ ID NO: 2102859 - RNA, 16 nt, Human
cugugaacuuggggaa

SEQ ID NO: 2102860 - RNA, 22 nt, Human
cugugaacuuggggaacaaggg

SEQ ID NO: 2102861 - RNA, 14 nt, Human
cugugcucuggaca

SEQ ID NO: 2102862 - RNA, 20 nt, Human
cugugagacccccacaccuc

SEQ ID NO: 2102863 - RNA, 23 nt, Human
cugugagacccccacaccucagu

SEQ ID NO: 2102864 - RNA, 16 nt, Human
cugugagacccccaca

SEQ ID NO: 2102865 - RNA, 17 nt, Human
cugugagacccccacac

SEQ ID NO: 2102866 - RNA, 18 nt, Human
cugugagacccccacacc

SEQ ID NO: 2102867 - RNA, 19 nt, Human
cugugagacccccacaccu

SEQ ID NO: 2102868 - RNA, 13 nt, Human
cugucgcccaguc

SEQ ID NO: 2102869 - RNA, 14 nt, Human
cuggugagccaagc

SEQ ID NO: 2102870 - RNA, 13 nt, Human
cuggugaggaagc

SEQ ID NO: 2102871 - RNA, 18 nt, Human
cuggugaggaagcuccag

SEQ ID NO: 2102872 - RNA, 19 nt, Human
cuggugaggaagcuccagu

SEQ ID NO: 2102873 - RNA, 14 nt, Human
cuggugaggagcac

SEQ ID NO: 2102874 - RNA, 16 nt, Human
cuggugagcagacugg

SEQ ID NO: 2102875 - RNA, 21 nt, Human
cuggguucccuuuccuuccau

SEQ ID NO: 2102876 - RNA, 16 nt, Human
cuggguucccuuuccu

SEQ ID NO: 2102877 - RNA, 20 nt, Human
cuggguucccuuuccuucca

SEQ ID NO: 2102878 - RNA, 14 nt, Human
cuggguucccuuuc

SEQ ID NO: 2102879 - RNA, 14 nt, Human
cuggguucacugca

SEQ ID NO: 2102880 - RNA, 23 nt, Human
cuggguggcaccagcagccugga

SEQ ID NO: 2102881 - RNA, 19 nt, Human
cuggggccucggagccuca

SEQ ID NO: 2102882 - RNA, 20 nt, Human
cuggggccucggagccucau

SEQ ID NO: 2102883 - RNA, 22 nt, Human
cuggguggcaccagcagccugg

SEQ ID NO: 2102884 - RNA, 13 nt, Human
cugggcagaaggc

SEQ ID NO: 2102885 - RNA, 17 nt, Human
cugggcagaaggccaag

SEQ ID NO: 2102886 - RNA, 16 nt, Human
cugggcagaaggccaa

SEQ ID NO: 2102887 - RNA, 14 nt, Human
cugggcagaaggcc

SEQ ID NO: 2102888 - RNA, 17 nt, Human
cuggggaaauaacagcu

SEQ ID NO: 2102889 - RNA, 12 nt, Human
cugggcagcugu

SEQ ID NO: 2102890 - RNA, 16 nt, Human
cuggggcaagucccug

SEQ ID NO: 2102891 - RNA, 13 nt, Human
cuggggccccacc

SEQ ID NO: 2102892 - RNA, 15 nt, Human
cuggggccccaccgu

SEQ ID NO: 2102893 - RNA, 12 nt, Human
cuggggccccuu

SEQ ID NO: 2102894 - RNA, 14 nt, Human
cuggggcaaguccc

SEQ ID NO: 2102895 - RNA, 21 nt, Human
cuggggcaagucccugacucu

SEQ ID NO: 2102896 - RNA, 19 nt, Human
cuggggaaauaacagcugu

SEQ ID NO: 2102897 - RNA, 22 nt, Human
cuggggaaauaacagcuguggc

SEQ ID NO: 2102898 - RNA, 13 nt, Human
cuggggaagcaaa

SEQ ID NO: 2102899 - RNA, 23 nt, Human
cugggacccuuuccuuccuuccc

SEQ ID NO: 2102900 - RNA, 15 nt, Human
cugggacccuuuccu

SEQ ID NO: 2102901 - RNA, 19 nt, Human
cugggacccuuuccuuccu

SEQ ID NO: 2102902 - RNA, 20 nt, Human
cugggacccuuuccuuccuu

SEQ ID NO: 2102903 - RNA, 13 nt, Human
cuggcucaucucu

SEQ ID NO: 2102904 - RNA, 21 nt, Human
cuggcucauauuccugcagcc

SEQ ID NO: 2102905 - RNA, 22 nt, Human
cuggcucauauuccugcagccu

SEQ ID NO: 2102906 - RNA, 23 nt, Human
cuggcucauauuccugcagccug

SEQ ID NO: 2102907 - RNA, 24 nt, Human
cuggcucauauuccugcagccugg

SEQ ID NO: 2102908 - RNA, 12 nt, Human
cuggccccucac

SEQ ID NO: 2102909 - RNA, 13 nt, Human
cuggccccucacc

SEQ ID NO: 2102910 - RNA, 15 nt, Human
cuggccccucaccug

SEQ ID NO: 2102911 - RNA, 22 nt, Human
cuggccccucaccugggcaccu

SEQ ID NO: 2102912 - RNA, 21 nt, Human
cuggcucagccucaaaugcag

SEQ ID NO: 2102913 - RNA, 19 nt, Human
cuggcucauauuccugcag

SEQ ID NO: 2102914 - RNA, 20 nt, Human
cuggcucauauuccugcagc

SEQ ID NO: 2102915 - RNA, 13 nt, Human
cugggacacaguu

SEQ ID NO: 2102916 - RNA, 12 nt, Human
cugggacacagu

SEQ ID NO: 2102917 - RNA, 14 nt, Human
cugggacccuuucc

SEQ ID NO: 2102918 - RNA, 19 nt, Human
cugggacacuuaacagaug

SEQ ID NO: 2102919 - RNA, 23 nt, Human
cugggacacuuaacagaugcaau

SEQ ID NO: 2102920 - RNA, 15 nt, Human
cuggcucccacaggc

SEQ ID NO: 2102921 - RNA, 17 nt, Human
cuggcagggugggaugg

SEQ ID NO: 2102922 - RNA, 18 nt, Human
cuggccccuagaaucagc

SEQ ID NO: 2102923 - RNA, 20 nt, Human
cuggccccuagaaucagccu

SEQ ID NO: 2102924 - RNA, 18 nt, Human
cuggcagggugggaugga

SEQ ID NO: 2102925 - RNA, 18 nt, Human
cuggcaggaugacccugc

SEQ ID NO: 2102926 - RNA, 20 nt, Human
cuggcaggaugacccugcga

SEQ ID NO: 2102927 - RNA, 13 nt, Human
cugcuucagccuc

SEQ ID NO: 2102928 - RNA, 16 nt, Human
cugcuucagccucccg

SEQ ID NO: 2102929 - RNA, 14 nt, Human
cugcuucagccucc

SEQ ID NO: 2102930 - RNA, 22 nt, Human
cugcuuuuuaaagaaugcucuu

SEQ ID NO: 2102931 - RNA, 16 nt, Human
cuggaaauauuaagaa

SEQ ID NO: 2102932 - RNA, 23 nt, Human
cuggaaauaucaguuacucagcc

SEQ ID NO: 2102933 - RNA, 15 nt, Human
cuggacuggcuagag

SEQ ID NO: 2102934 - RNA, 21 nt, Human
cuggacuggcuagaguccuca

SEQ ID NO: 2102935 - RNA, 21 nt, Human
cuggacugguggccccugccu

SEQ ID NO: 2102936 - RNA, 13 nt, Human
cuggacuggcugu

SEQ ID NO: 2102937 - RNA, 16 nt, Human
cuggacuggcuguccu

SEQ ID NO: 2102938 - RNA, 11 nt, Human
cugcugacagu

SEQ ID NO: 2102939 - RNA, 23 nt, Human
cugcugacagacacaggcccggc

SEQ ID NO: 2102940 - RNA, 21 nt, Human
cugcugacagacacaggcccg

SEQ ID NO: 2102941 - RNA, 20 nt, Human
cugcugacagacacaggccc

SEQ ID NO: 2102942 - RNA, 19 nt, Human
cugcugacagacacaggcc

SEQ ID NO: 2102943 - RNA, 18 nt, Human
cugcugacagacacaggc

SEQ ID NO: 2102944 - RNA, 15 nt, Human
cugcugacagacaca

SEQ ID NO: 2102945 - RNA, 12 nt, Human
cugcccugucua

SEQ ID NO: 2102946 - RNA, 18 nt, Human
cugccucgaacuggcugc

SEQ ID NO: 2102947 - RNA, 17 nt, Human
cugccucgaacuggcug

SEQ ID NO: 2102948 - RNA, 15 nt, Human
cugccucgaacuggc

SEQ ID NO: 2102949 - RNA, 22 nt, Human
cugccuggguuccaauccuggc

SEQ ID NO: 2102950 - RNA, 15 nt, Human
cugccuguucagcuc

SEQ ID NO: 2102951 - RNA, 14 nt, Human
cugccuguucagcu

SEQ ID NO: 2102952 - RNA, 13 nt, Human
cugccuguggagu

SEQ ID NO: 2102953 - RNA, 14 nt, Human
cugccugugcugug

SEQ ID NO: 2102954 - RNA, 16 nt, Human
cugcuaauuccccaga

SEQ ID NO: 2102955 - RNA, 16 nt, Human
cugcuaauaaaaccca

SEQ ID NO: 2102956 - RNA, 14 nt, Human
cugcuaaucuucag

SEQ ID NO: 2102957 - RNA, 18 nt, Human
cugcuaaucuucagggca

SEQ ID NO: 2102958 - RNA, 23 nt, Human
cugcuacaaauacucuuaggaag

SEQ ID NO: 2102959 - RNA, 17 nt, Human
cugcuaccucacugggg

SEQ ID NO: 2102960 - RNA, 15 nt, Human
cugcuaccucacugg

SEQ ID NO: 2102961 - RNA, 13 nt, Human
cugcuaccucacu

SEQ ID NO: 2102962 - RNA, 14 nt, Human
cugcuaccucacug

SEQ ID NO: 2102963 - RNA, 12 nt, Human
cugcuaccucac

SEQ ID NO: 2102964 - RNA, 17 nt, Human
cugcuacccagaaauca

SEQ ID NO: 2102965 - RNA, 13 nt, Human
cugcauguuacau

SEQ ID NO: 2102966 - RNA, 20 nt, Human
cugcauucacccagacagcu

SEQ ID NO: 2102967 - RNA, 21 nt, Human
cugcauucacccagacagcuc

SEQ ID NO: 2102968 - RNA, 22 nt, Human
cugcauucacccagacagcucc

SEQ ID NO: 2102969 - RNA, 15 nt, Human
cugcauuagaaauua

SEQ ID NO: 2102970 - RNA, 18 nt, Human
cugcauguauaaaugaag

SEQ ID NO: 2102971 - RNA, 15 nt, Human
cugcauuacauuccu

SEQ ID NO: 2102972 - RNA, 20 nt, Human
cugcauucaggaucaaaccc

SEQ ID NO: 2102973 - RNA, 19 nt, Human
cugcauucugccgugugcc

SEQ ID NO: 2102974 - RNA, 22 nt, Human
cugcauugccugcggucaaggc

SEQ ID NO: 2102975 - RNA, 23 nt, Human
cugcauugccugcggucaaggcc

SEQ ID NO: 2102976 - RNA, 17 nt, Human
cugcauugagaacugca

SEQ ID NO: 2102977 - RNA, 13 nt, Human
cugcauuuagcac

SEQ ID NO: 2102978 - RNA, 14 nt, Human
cugcauuuagcaca

SEQ ID NO: 2102979 - RNA, 15 nt, Human
cugcauuuagcacaa

SEQ ID NO: 2102980 - RNA, 17 nt, Human
cugcauuuagcacaaaa

SEQ ID NO: 2102981 - RNA, 18 nt, Human
cugcauuuagcacaaaaa

SEQ ID NO: 2102982 - RNA, 23 nt, Human
cugcauuuagcacaaaaaaaauu

SEQ ID NO: 2102983 - RNA, 13 nt, Human
cugcauuugugaa

SEQ ID NO: 2102984 - RNA, 22 nt, Human
cugcauuugugaaaugauggug

SEQ ID NO: 2102985 - RNA, 17 nt, Human
cugcauuugugaaauga

SEQ ID NO: 2102986 - RNA, 15 nt, Human
cugcauuugugaaau

SEQ ID NO: 2102987 - RNA, 14 nt, Human
cugcauuugugaaa

SEQ ID NO: 2102988 - RNA, 17 nt, Human
cugcauuuucaccccac

SEQ ID NO: 2102989 - RNA, 18 nt, Human
cugcauuuucaccccacc

SEQ ID NO: 2102990 - RNA, 20 nt, Human
cugcauuuucugaaacuaau

SEQ ID NO: 2102991 - RNA, 15 nt, Human
cugcauuuucugggu

SEQ ID NO: 2102992 - RNA, 17 nt, Human
cugcauuuucuggguuc

SEQ ID NO: 2102993 - RNA, 21 nt, Human
cugcauuuucuggguucuggg

SEQ ID NO: 2102994 - RNA, 20 nt, Human
cugccaaauuuuggccaaag

SEQ ID NO: 2102995 - RNA, 21 nt, Human
cugccaaagggaaauaucauu

SEQ ID NO: 2102996 - RNA, 18 nt, Human
cugcauuuuuagaccauu

SEQ ID NO: 2102997 - RNA, 18 nt, Human
cugccaaggccagagugg

SEQ ID NO: 2102998 - RNA, 21 nt, Human
cugccaaggccagaguggccu

SEQ ID NO: 2102999 - RNA, 22 nt, Human
cugccaaggccagaguggccug

SEQ ID NO: 2103000 - RNA, 14 nt, Human
cugccaagccccau

SEQ ID NO: 2103001 - RNA, 15 nt, Human
cugccaagccccauc

SEQ ID NO: 2103002 - RNA, 21 nt, Human
cugccaagccccauccugccg

SEQ ID NO: 2103003 - RNA, 15 nt, Human
cugccaaggccagag

SEQ ID NO: 2103004 - RNA, 23 nt, Human
cugccauauucuguuggccagug

SEQ ID NO: 2103005 - RNA, 22 nt, Human
cugccauauucuguuggccagu

SEQ ID NO: 2103006 - RNA, 21 nt, Human
cugccauauucuguuggccag

SEQ ID NO: 2103007 - RNA, 20 nt, Human
cugccauauucuguuggcca

SEQ ID NO: 2103008 - RNA, 23 nt, Human
cugccaaggccagaguggccugg

SEQ ID NO: 2103009 - RNA, 13 nt, Human
cugccaggccccc

SEQ ID NO: 2103010 - RNA, 22 nt, Human
cugccaggcccccaagccugca

SEQ ID NO: 2103011 - RNA, 12 nt, Human
cugccauccagg

SEQ ID NO: 2103012 - RNA, 18 nt, Human
cugccccagcucuggcuu

SEQ ID NO: 2103013 - RNA, 19 nt, Human
cugccccagcucuggcuuc

SEQ ID NO: 2103014 - RNA, 18 nt, Human
cugccaggcccccaagcc

SEQ ID NO: 2103015 - RNA, 21 nt, Human
cugccaggcccccaagccugc

SEQ ID NO: 2103016 - RNA, 16 nt, Human
cugccccagcucuggc

SEQ ID NO: 2103017 - RNA, 18 nt, Human
cugcccccuccccuucac

SEQ ID NO: 2103018 - RNA, 23 nt, Human
cugcccccuccccuucacaccau

SEQ ID NO: 2103019 - RNA, 19 nt, Human
cugccccagggcucccggc

SEQ ID NO: 2103020 - RNA, 12 nt, Human
cugccccauccc

SEQ ID NO: 2103021 - RNA, 15 nt, Human
cugccccucaugcca

SEQ ID NO: 2103022 - RNA, 13 nt, Human
cugccccucccag

SEQ ID NO: 2103023 - RNA, 14 nt, Human
cugccccucccaga

SEQ ID NO: 2103024 - RNA, 15 nt, Human
cugccccucccagaa

SEQ ID NO: 2103025 - RNA, 16 nt, Human
cugccccucccagaac

SEQ ID NO: 2103026 - RNA, 13 nt, Human
cugccccuccccc

SEQ ID NO: 2103027 - RNA, 14 nt, Human
cugccccuccccca

SEQ ID NO: 2103028 - RNA, 22 nt, Human
cugccccucccccaacccccac

SEQ ID NO: 2103029 - RNA, 13 nt, Human
cugccccucccug

SEQ ID NO: 2103030 - RNA, 16 nt, Human
cugccccucccugcca

SEQ ID NO: 2103031 - RNA, 22 nt, Human
cugccccucccugccagcaccc

SEQ ID NO: 2103032 - RNA, 19 nt, Human
cugcccuggugcugccaca

SEQ ID NO: 2103033 - RNA, 18 nt, Human
cugcccuggugcugccac

SEQ ID NO: 2103034 - RNA, 16 nt, Human
cugcccuggugcugcc

SEQ ID NO: 2103035 - RNA, 17 nt, Human
cugcccuggugcugcca

SEQ ID NO: 2103036 - RNA, 21 nt, Human
cugcccuggugcugccacacu

SEQ ID NO: 2103037 - RNA, 20 nt, Human
cugcccuggugcugccacac

SEQ ID NO: 2103038 - RNA, 18 nt, Human
cugaccuuugucaucuuu

SEQ ID NO: 2103039 - RNA, 21 nt, Human
cugaccuugaacuccugggcu

SEQ ID NO: 2103040 - RNA, 22 nt, Human
cugaccuugaacuccugggcuc

SEQ ID NO: 2103041 - RNA, 14 nt, Human
cugagacucagaca

SEQ ID NO: 2103042 - RNA, 17 nt, Human
cugagacucagacagga

SEQ ID NO: 2103043 - RNA, 20 nt, Human
cugagacucagacaggaaag

SEQ ID NO: 2103044 - RNA, 21 nt, Human
cugagacucagacaggaaagg

SEQ ID NO: 2103045 - RNA, 22 nt, Human
aacuucuccccugguagaaaga

SEQ ID NO: 2103046 - RNA, 23 nt, Human
aacuguacuagucugugugggac

SEQ ID NO: 2103047 - RNA, 20 nt, Human
aacuuccaagaccugacuca

SEQ ID NO: 2103048 - RNA, 19 nt, Human
aacuguagaaaugaugaug

SEQ ID NO: 2103049 - RNA, 20 nt, Human
aacuucagcuagagcuucaa

SEQ ID NO: 2103050 - RNA, 13 nt, Human
aacuuccaauuua

SEQ ID NO: 2103051 - RNA, 12 nt, Human
aacuucauuuga

SEQ ID NO: 2103052 - RNA, 14 nt, Human
aacuucauuugaug

SEQ ID NO: 2103053 - RNA, 18 nt, Human
aacuguacuuuuaaggca

SEQ ID NO: 2103054 - RNA, 14 nt, Human
aacuguagaaauga

SEQ ID NO: 2103055 - RNA, 15 nt, Human
aacuguagaaaugau

SEQ ID NO: 2103056 - RNA, 16 nt, Human
aacuguagaaaugaug

SEQ ID NO: 2103057 - RNA, 17 nt, Human
aacuguagaaaugauga

SEQ ID NO: 2103058 - RNA, 21 nt, Human
aacugguuuguugcagccaaa

SEQ ID NO: 2103059 - RNA, 13 nt, Human
gugaugccucccu

SEQ ID NO: 2103060 - RNA, 22 nt, Human
gugaugcuaaagguuguauugc

SEQ ID NO: 2103061 - RNA, 22 nt, Human
gugaugaagaaaagugggccag

SEQ ID NO: 2103062 - RNA, 22 nt, Human
gugaugaucagcuguuugucau

SEQ ID NO: 2103063 - RNA, 15 nt, Human
gugaugccacacaga

SEQ ID NO: 2103064 - RNA, 17 nt, Human
gugaugccacacagagu

SEQ ID NO: 2103065 - RNA, 19 nt, Human
gugaugccacacagagugg

SEQ ID NO: 2103066 - RNA, 13 nt, Human
gugcaugugugug

SEQ ID NO: 2103067 - RNA, 14 nt, Human
gugcaugugugugc

SEQ ID NO: 2103068 - RNA, 15 nt, Human
gugcaugugugugcu

SEQ ID NO: 2103069 - RNA, 18 nt, Human
gugcaugugugugcucag

SEQ ID NO: 2103070 - RNA, 14 nt, Human
gugcauuacagaga

SEQ ID NO: 2103071 - RNA, 16 nt, Human
gugcauuacagagagg

SEQ ID NO: 2103072 - RNA, 23 nt, Human
gugcauuacagagaggagaaaca

SEQ ID NO: 2103073 - RNA, 18 nt, Human
gugccacccaccagggcg

SEQ ID NO: 2103074 - RNA, 17 nt, Human
gugccacugcccgagcu

SEQ ID NO: 2103075 - RNA, 18 nt, Human
gugccacugcccgagcug

SEQ ID NO: 2103076 - RNA, 20 nt, Human
gugccuggguggggcugcuc

SEQ ID NO: 2103077 - RNA, 21 nt, Human
gugccuggguggggcugcucc

SEQ ID NO: 2103078 - RNA, 12 nt, Human
gugccucugccu

SEQ ID NO: 2103079 - RNA, 22 nt, Human
gugccuggguggggcugcuccu

SEQ ID NO: 2103080 - RNA, 23 nt, Human
gugccuggguggggcugcuccuc

SEQ ID NO: 2103081 - RNA, 15 nt, Human
gugccugugaggcag

SEQ ID NO: 2103082 - RNA, 16 nt, Human
gugccugugaggcagg

SEQ ID NO: 2103083 - RNA, 17 nt, Human
gugccugugaggcaggg

SEQ ID NO: 2103084 - RNA, 23 nt, Human
gugccacugcccgagcuggugca

SEQ ID NO: 2103085 - RNA, 19 nt, Human
gugccacugcccgagcugg

SEQ ID NO: 2103086 - RNA, 20 nt, Human
gugccacugcccgagcuggu

SEQ ID NO: 2103087 - RNA, 21 nt, Human
gugccacugcccgagcuggug

SEQ ID NO: 2103088 - RNA, 22 nt, Human
gugccacugcccgagcuggugc

SEQ ID NO: 2103089 - RNA, 13 nt, Human
gugcaugggugaa

SEQ ID NO: 2103090 - RNA, 18 nt, Human
gugcaugggugaagggag

SEQ ID NO: 2103091 - RNA, 21 nt, Human
gugcacacaccagagcccacc

SEQ ID NO: 2103092 - RNA, 20 nt, Human
gugcacagacgucccuccac

SEQ ID NO: 2103093 - RNA, 22 nt, Human
gugcacagacgucccuccacgu

SEQ ID NO: 2103094 - RNA, 22 nt, Human
gugcaauuguaggggugugugu

SEQ ID NO: 2103095 - RNA, 14 nt, Human
gugcaacccuuacc

SEQ ID NO: 2103096 - RNA, 23 nt, Human
gugcaacccuuaccccuuagccu

SEQ ID NO: 2103097 - RNA, 16 nt, Human
gugaugguuccccugu

SEQ ID NO: 2103098 - RNA, 14 nt, Human
gugaugguuccccu

SEQ ID NO: 2103099 - RNA, 22 nt, Human
gugcaaguguaugcacgugugc

SEQ ID NO: 2103100 - RNA, 17 nt, Human
gugcaagugucugugug

SEQ ID NO: 2103101 - RNA, 18 nt, Human
gugcaagugucugugugc

SEQ ID NO: 2103102 - RNA, 20 nt, Human
gugcaaguaugugagugugu

SEQ ID NO: 2103103 - RNA, 14 nt, Human
aacuggcccucuuc

SEQ ID NO: 2103104 - RNA, 15 nt, Human
aacuggcccucuucu

SEQ ID NO: 2103105 - RNA, 16 nt, Human
aacuggcccucuucuu

SEQ ID NO: 2103106 - RNA, 21 nt, Human
aacuggcccucuucuuacuug

SEQ ID NO: 2103107 - RNA, 21 nt, Human
aacuggguacuuguggacaca

SEQ ID NO: 2103108 - RNA, 16 nt, Human
aacuggguacuugugg

SEQ ID NO: 2103109 - RNA, 13 nt, Human
aacuggacucagg

SEQ ID NO: 2103110 - RNA, 15 nt, Human
aacuggacucaggau

SEQ ID NO: 2103111 - RNA, 11 nt, Human
aacuggcugca

SEQ ID NO: 2103112 - RNA, 20 nt, Human
aacuggcaucugacacaaaa

SEQ ID NO: 2103113 - RNA, 17 nt, Human
aacuggcaguuuuccau

SEQ ID NO: 2103114 - RNA, 12 nt, Human
aacuggagcccc

SEQ ID NO: 2103115 - RNA, 21 nt, Human
aacuggacucaggaugcccag

SEQ ID NO: 2103116 - RNA, 22 nt, Human
aacuggacucaggaugcccagg

SEQ ID NO: 2103117 - RNA, 20 nt, Human
aacugcuuuaucccacggaa

SEQ ID NO: 2103118 - RNA, 13 nt, Human
aacuggaagcaca

SEQ ID NO: 2103119 - RNA, 20 nt, Human
aacuggaagcauguaggaga

SEQ ID NO: 2103120 - RNA, 15 nt, Human
aacuggaaguuauuu

SEQ ID NO: 2103121 - RNA, 16 nt, Human
aacuggaaguuauuua

SEQ ID NO: 2103122 - RNA, 23 nt, Human
aacugcugacuguuuucucuuga

SEQ ID NO: 2103123 - RNA, 18 nt, Human
aacugcugaugcucaugg

SEQ ID NO: 2103124 - RNA, 19 nt, Human
aacugcugaugcucauggu

SEQ ID NO: 2103125 - RNA, 20 nt, Human
aacugcugaugcucaugguc

SEQ ID NO: 2103126 - RNA, 13 nt, Human
aacugcugcccca

SEQ ID NO: 2103127 - RNA, 22 nt, Human
aacugcugccccaaaggaagcu

SEQ ID NO: 2103128 - RNA, 20 nt, Human
aacugcugacuguuuucucu

SEQ ID NO: 2103129 - RNA, 21 nt, Human
aacugcugacuguuuucucuu

SEQ ID NO: 2103130 - RNA, 15 nt, Human
aacugcugacuguuu

SEQ ID NO: 2103131 - RNA, 16 nt, Human
aacugccuuggcuuca

SEQ ID NO: 2103132 - RNA, 17 nt, Human
aacugccuuggcuucag

SEQ ID NO: 2103133 - RNA, 15 nt, Human
aacugccucuuuccu

SEQ ID NO: 2103134 - RNA, 17 nt, Human
aacugccuuaaaacuuu

SEQ ID NO: 2103135 - RNA, 13 nt, Human
aacugcaauagag

SEQ ID NO: 2103136 - RNA, 16 nt, Human
aacugcaauagagacu

SEQ ID NO: 2103137 - RNA, 17 nt, Human
aacugcaauagagacug

SEQ ID NO: 2103138 - RNA, 18 nt, Human
aacugcaauagagacugu

SEQ ID NO: 2103139 - RNA, 22 nt, Human
aacugcaauagagacuguagau

SEQ ID NO: 2103140 - RNA, 23 nt, Human
aacugcaauagagacuguagauu

SEQ ID NO: 2103141 - RNA, 14 nt, Human
aacugaaaguguuu

SEQ ID NO: 2103142 - RNA, 16 nt, Human
aacugcaagucacaaa

SEQ ID NO: 2103143 - RNA, 17 nt, Human
aacugcaagucacaaag

SEQ ID NO: 2103144 - RNA, 18 nt, Human
aacugcaagucacaaagg

SEQ ID NO: 2103145 - RNA, 19 nt, Human
aacugcaagucacaaagga

SEQ ID NO: 2103146 - RNA, 23 nt, Human
aacugcaagucacaaaggaaugg

SEQ ID NO: 2103147 - RNA, 17 nt, Human
gugaacuugggccacug

SEQ ID NO: 2103148 - RNA, 19 nt, Human
gugaacuugggccacugug

SEQ ID NO: 2103149 - RNA, 20 nt, Human
gugaacuuggggaacaaggg

SEQ ID NO: 2103150 - RNA, 21 nt, Human
gugaacugugaggguaaaggc

SEQ ID NO: 2103151 - RNA, 22 nt, Human
gugagggcuugucauuaccaga

SEQ ID NO: 2103152 - RNA, 21 nt, Human
gugagggguauaucugggcug

SEQ ID NO: 2103153 - RNA, 17 nt, Human
gugagcaaaccugcccc

SEQ ID NO: 2103154 - RNA, 18 nt, Human
gugagcaaaccugcccca

SEQ ID NO: 2103155 - RNA, 21 nt, Human
gugagcaagaagucaaaguaa

SEQ ID NO: 2103156 - RNA, 15 nt, Human
gugaggcccagggag

SEQ ID NO: 2103157 - RNA, 22 nt, Human
gugagucgaggacagggaggug

SEQ ID NO: 2103158 - RNA, 21 nt, Human
gugaggugcagagugcccaga

SEQ ID NO: 2103159 - RNA, 12 nt, Human
gugagguccugg

SEQ ID NO: 2103160 - RNA, 13 nt, Human
gugagguccuggg

SEQ ID NO: 2103161 - RNA, 16 nt, Human
gugagguccugggggc

SEQ ID NO: 2103162 - RNA, 17 nt, Human
gugagguccugggggcc

SEQ ID NO: 2103163 - RNA, 19 nt, Human
gugagguccugggggccug

SEQ ID NO: 2103164 - RNA, 20 nt, Human
gugagguccugggggccuga

SEQ ID NO: 2103165 - RNA, 19 nt, Human
gugaggugcagagugccca

SEQ ID NO: 2103166 - RNA, 18 nt, Human
gugagggucagagaggag

SEQ ID NO: 2103167 - RNA, 21 nt, Human
aacucuucaaucucuugcacu

SEQ ID NO: 2103168 - RNA, 13 nt, Human
aacucugauguaa

SEQ ID NO: 2103169 - RNA, 20 nt, Human
aacucugauguaaaugaagu

SEQ ID NO: 2103170 - RNA, 21 nt, Human
aacucugauguaaaugaagua

SEQ ID NO: 2103171 - RNA, 19 nt, Human
aacugaaaacaagccauga

SEQ ID NO: 2103172 - RNA, 20 nt, Human
aacugaaaagacucaguguu

SEQ ID NO: 2103173 - RNA, 12 nt, Human
aacugaaaacau

SEQ ID NO: 2103174 - RNA, 15 nt, Human
aacugaaaacauaaa

SEQ ID NO: 2103175 - RNA, 18 nt, Human
aacugaaaacauaaaaag

SEQ ID NO: 2103176 - RNA, 19 nt, Human
aacugaaaacauaaaaagu

SEQ ID NO: 2103177 - RNA, 12 nt, Human
aacugaaaagac

SEQ ID NO: 2103178 - RNA, 21 nt, Human
aaccucgagguuucucaaaga

SEQ ID NO: 2103179 - RNA, 22 nt, Human
aaccucgagguuucucaaagaa

SEQ ID NO: 2103180 - RNA, 16 nt, Human
aaccucuuuucugcau

SEQ ID NO: 2103181 - RNA, 18 nt, Human
aaccucuuuucugcauca

SEQ ID NO: 2103182 - RNA, 21 nt, Human
aaccugaaaagauguuguguc

SEQ ID NO: 2103183 - RNA, 22 nt, Human
aaccugaaaagauguugugucu

SEQ ID NO: 2103184 - RNA, 19 nt, Human
aaccugacaaaaaaaaagu

SEQ ID NO: 2103185 - RNA, 16 nt, Human
aaccugagauggcccu

SEQ ID NO: 2103186 - RNA, 20 nt, Human
aaccugagauggcccucugg

SEQ ID NO: 2103187 - RNA, 21 nt, Human
aaccugagauggcccucuggu

SEQ ID NO: 2103188 - RNA, 13 nt, Human
aaccccuguggag

SEQ ID NO: 2103189 - RNA, 16 nt, Human
aacccgaggcccgcau

SEQ ID NO: 2103190 - RNA, 15 nt, Human
aacccgaggcccgca

SEQ ID NO: 2103191 - RNA, 16 nt, Human
aacccgacagagggaa

SEQ ID NO: 2103192 - RNA, 11 nt, Human
aaccccuuucc

SEQ ID NO: 2103193 - RNA, 17 nt, Human
aacccgacagagggaag

SEQ ID NO: 2103194 - RNA, 11 nt, Human
aacccacacug

SEQ ID NO: 2103195 - RNA, 20 nt, Human
aacccgacagagggaagaaa

SEQ ID NO: 2103196 - RNA, 14 nt, Human
aaccucauucccca

SEQ ID NO: 2103197 - RNA, 19 nt, Human
aaccuccuuuacccucauc

SEQ ID NO: 2103198 - RNA, 13 nt, Human
aaccucaguguca

SEQ ID NO: 2103199 - RNA, 18 nt, Human
aaccucagugucauuuau

SEQ ID NO: 2103200 - RNA, 19 nt, Human
aaccucagugucauuuaug

SEQ ID NO: 2103201 - RNA, 18 nt, Human
aaccucaggcuuccuugg

SEQ ID NO: 2103202 - RNA, 19 nt, Human
aacccccaccccacacuug

SEQ ID NO: 2103203 - RNA, 10 nt, Human
aacccccacc

SEQ ID NO: 2103204 - RNA, 11 nt, Human
aacccccaccc

SEQ ID NO: 2103205 - RNA, 12 nt, Human
aacccccacccc

SEQ ID NO: 2103206 - RNA, 13 nt, Human
aacccccacccca

SEQ ID NO: 2103207 - RNA, 15 nt, Human
aacccccaccccaca

SEQ ID NO: 2103208 - RNA, 17 nt, Human
aacccccaccccacacu

SEQ ID NO: 2103209 - RNA, 18 nt, Human
aacccccaccccacacuu

SEQ ID NO: 2103210 - RNA, 11 nt, Human
aacccagagag

SEQ ID NO: 2103211 - RNA, 12 nt, Human
aacccagagagg

SEQ ID NO: 2103212 - RNA, 13 nt, Human
aacccagaaacac

SEQ ID NO: 2103213 - RNA, 14 nt, Human
aacccagaaacacc

SEQ ID NO: 2103214 - RNA, 14 nt, Human
aacccaccugcuga

SEQ ID NO: 2103215 - RNA, 18 nt, Human
aaccaagccguggcuucc

SEQ ID NO: 2103216 - RNA, 18 nt, Human
gucuccuuugcaggcuca

SEQ ID NO: 2103217 - RNA, 16 nt, Human
aaccaagccguggcuu

SEQ ID NO: 2103218 - RNA, 16 nt, Human
aaccaagucaugugca

SEQ ID NO: 2103219 - RNA, 15 nt, Human
aaccaagucaaguga

SEQ ID NO: 2103220 - RNA, 19 nt, Human
aaccaccacacccagccca

SEQ ID NO: 2103221 - RNA, 14 nt, Human
gucucccucuccug

SEQ ID NO: 2103222 - RNA, 15 nt, Human
gucucccucuccugc

SEQ ID NO: 2103223 - RNA, 16 nt, Human
gucucccucuccugcc

SEQ ID NO: 2103224 - RNA, 17 nt, Human
gucucccucuccugccu

SEQ ID NO: 2103225 - RNA, 18 nt, Human
gucucccucuccugccua

SEQ ID NO: 2103226 - RNA, 19 nt, Human
gucucccucuccugccuac

SEQ ID NO: 2103227 - RNA, 20 nt, Human
gucucccucuccugccuacu

SEQ ID NO: 2103228 - RNA, 21 nt, Human
gucucccucuccugccuacuc

SEQ ID NO: 2103229 - RNA, 22 nt, Human
gucucccucuccugccuacuca

SEQ ID NO: 2103230 - RNA, 20 nt, Human
aacaguuaacuuucagaaga

SEQ ID NO: 2103231 - RNA, 14 nt, Human
aacaguuccuucag

SEQ ID NO: 2103232 - RNA, 23 nt, Human
aacaguguuucccauaauuuucu

SEQ ID NO: 2103233 - RNA, 13 nt, Human
aacaguuaacuuu

SEQ ID NO: 2103234 - RNA, 17 nt, Human
aacaguuaacuuucaga

SEQ ID NO: 2103235 - RNA, 18 nt, Human
aacaguuaacuuucagaa

SEQ ID NO: 2103236 - RNA, 19 nt, Human
aacaguuaagcagccgcca

SEQ ID NO: 2103237 - RNA, 21 nt, Human
aaccaccacacccagcccacu

SEQ ID NO: 2103238 - RNA, 20 nt, Human
aaccaagucaugugcauuuc

SEQ ID NO: 2103239 - RNA, 14 nt, Human
aaccauauggauau

SEQ ID NO: 2103240 - RNA, 16 nt, Human
aaccauauggauauua

SEQ ID NO: 2103241 - RNA, 16 nt, Human
aaccaucauuauaaac

SEQ ID NO: 2103242 - RNA, 12 nt, Human
aaccauugcuuc

SEQ ID NO: 2103243 - RNA, 13 nt, Human
aaccauugcuuca

SEQ ID NO: 2103244 - RNA, 14 nt, Human
aaccauugcuucac

SEQ ID NO: 2103245 - RNA, 15 nt, Human
aaccauugcuucacu

SEQ ID NO: 2103246 - RNA, 16 nt, Human
aaccauugcuucacua

SEQ ID NO: 2103247 - RNA, 23 nt, Human
aaccauugcuucacuacccaucg

SEQ ID NO: 2103248 - RNA, 13 nt, Human
aacccaauaguug

SEQ ID NO: 2103249 - RNA, 16 nt, Human
aacccaagugggggca

SEQ ID NO: 2103250 - RNA, 22 nt, Human
aacccaagguggguagaucacg

SEQ ID NO: 2103251 - RNA, 22 nt, Human
aacccaaauuacguguacuaca

SEQ ID NO: 2103252 - RNA, 16 nt, Human
gucuuuggugaacauu

SEQ ID NO: 2103253 - RNA, 17 nt, Human
gucuuuaggcagcagcu

SEQ ID NO: 2103254 - RNA, 19 nt, Human
gucuuuugacauguggaaa

SEQ ID NO: 2103255 - RNA, 23 nt, Human
gucuuuguaaguaaacugcccug

SEQ ID NO: 2103256 - RNA, 16 nt, Human
gucuuuguaaugucac

SEQ ID NO: 2103257 - RNA, 18 nt, Human
gucuuuguaaugucacca

SEQ ID NO: 2103258 - RNA, 19 nt, Human
gucuuuguaaugucaccac

SEQ ID NO: 2103259 - RNA, 20 nt, Human
gucuuuguaaugucaccacc

SEQ ID NO: 2103260 - RNA, 14 nt, Human
gucuuuugacaugu

SEQ ID NO: 2103261 - RNA, 16 nt, Human
gucuuuugacaugugg

SEQ ID NO: 2103262 - RNA, 15 nt, Human
aaccuguccuugcac

SEQ ID NO: 2103263 - RNA, 15 nt, Human
aaccuguacuucaag

SEQ ID NO: 2103264 - RNA, 19 nt, Human
gucuuucacaguaccaucu

SEQ ID NO: 2103265 - RNA, 11 nt, Human
aaccuguaaau

SEQ ID NO: 2103266 - RNA, 15 nt, Human
aaccuguaaauuauu

SEQ ID NO: 2103267 - RNA, 16 nt, Human
aaccuguaaauuauuu

SEQ ID NO: 2103268 - RNA, 17 nt, Human
aaccuguaaauuauuuu

SEQ ID NO: 2103269 - RNA, 20 nt, Human
aaccuguaaauuauuuuaaa

SEQ ID NO: 2103270 - RNA, 14 nt, Human
aaccuggugcugga

SEQ ID NO: 2103271 - RNA, 23 nt, Human
aaccuguacuucaaguuaaagug

SEQ ID NO: 2103272 - RNA, 15 nt, Human
gucuuuuuaagcuua

SEQ ID NO: 2103273 - RNA, 16 nt, Human
gucuuuuucuggacug

SEQ ID NO: 2103274 - RNA, 20 nt, Human
gucuuuuuaagcuuauuuaa

SEQ ID NO: 2103275 - RNA, 11 nt, Human
aaccuggugcu

SEQ ID NO: 2103276 - RNA, 20 nt, Human
gucuguaucggagacaguga

SEQ ID NO: 2103277 - RNA, 15 nt, Human
gucugucccaccagc

SEQ ID NO: 2103278 - RNA, 17 nt, Human
gucuguccguguuauuu

SEQ ID NO: 2103279 - RNA, 15 nt, Human
gucugucuucacagc

SEQ ID NO: 2103280 - RNA, 17 nt, Human
gucuuccugcauucacc

SEQ ID NO: 2103281 - RNA, 20 nt, Human
gucuuccugcauucacccag

SEQ ID NO: 2103282 - RNA, 19 nt, Human
gucuguauuuaugugugag

SEQ ID NO: 2103283 - RNA, 23 nt, Human
gucuguauuuaugugugaggagc

SEQ ID NO: 2103284 - RNA, 12 nt, Human
gucuguaaugac

SEQ ID NO: 2103285 - RNA, 18 nt, Human
gucuguaaugacaaauaa

SEQ ID NO: 2103286 - RNA, 14 nt, Human
gucuggcccuuccu

SEQ ID NO: 2103287 - RNA, 11 nt, Human
aaccuguccuu

SEQ ID NO: 2103288 - RNA, 17 nt, Human
aacuacucagggaauga

SEQ ID NO: 2103289 - RNA, 12 nt, Human
aacuacauuuua

SEQ ID NO: 2103290 - RNA, 13 nt, Human
aacuacauuuuaa

SEQ ID NO: 2103291 - RNA, 14 nt, Human
aacuacauuuuaac

SEQ ID NO: 2103292 - RNA, 15 nt, Human
aacuacauuuuaaca

SEQ ID NO: 2103293 - RNA, 16 nt, Human
aacuacauuuuaacau

SEQ ID NO: 2103294 - RNA, 20 nt, Human
aacuagacucccaagcugga

SEQ ID NO: 2103295 - RNA, 23 nt, Human
aacuagacucccaagcuggacua

SEQ ID NO: 2103296 - RNA, 13 nt, Human
aacuacuguguuc

SEQ ID NO: 2103297 - RNA, 14 nt, Human
aacuacuguguucc

SEQ ID NO: 2103298 - RNA, 20 nt, Human
aacuagagaugacugagucc

SEQ ID NO: 2103299 - RNA, 15 nt, Human
aacuacuguguuccu

SEQ ID NO: 2103300 - RNA, 18 nt, Human
aacuagagguuuuaugau

SEQ ID NO: 2103301 - RNA, 20 nt, Human
aacuagagguuuuaugauau

SEQ ID NO: 2103302 - RNA, 22 nt, Human
aacuagagguuuuaugauauuu

SEQ ID NO: 2103303 - RNA, 18 nt, Human
aacuaugauaugguaaaa

SEQ ID NO: 2103304 - RNA, 21 nt, Human
aacuaugauuuggaaaauaaa

SEQ ID NO: 2103305 - RNA, 16 nt, Human
aacuaugauuuggaaa

SEQ ID NO: 2103306 - RNA, 18 nt, Human
aacucgcuucucugugac

SEQ ID NO: 2103307 - RNA, 15 nt, Human
aacuccugggcucaa

SEQ ID NO: 2103308 - RNA, 19 nt, Human
aacucauuccugccugucu

SEQ ID NO: 2103309 - RNA, 21 nt, Human
aacucauuccugccugucucc

SEQ ID NO: 2103310 - RNA, 15 nt, Human
aacucauuccugccu

SEQ ID NO: 2103311 - RNA, 12 nt, Human
aacuccuggccu

SEQ ID NO: 2103312 - RNA, 12 nt, Human
aacucauuucua

SEQ ID NO: 2103313 - RNA, 22 nt, Human
aacucauuuccuauguaacugc

SEQ ID NO: 2103314 - RNA, 22 nt, Human
aacucauuccugccugucuccu

SEQ ID NO: 2103315 - RNA, 23 nt, Human
aacucauuccugccugucuccuu

SEQ ID NO: 2103316 - RNA, 23 nt, Human
gugaaccaccacacccagcccac

SEQ ID NO: 2103317 - RNA, 22 nt, Human
gugaaccaccacacccagccca

SEQ ID NO: 2103318 - RNA, 16 nt, Human
gugaacgauuuagaaa

SEQ ID NO: 2103319 - RNA, 14 nt, Human
gugaacgauuuaga

SEQ ID NO: 2103320 - RNA, 24 nt, Human
gugaacgugggaguucagcugcuu

SEQ ID NO: 2103321 - RNA, 23 nt, Human
aacucuauggguaucaaacagcu

SEQ ID NO: 2103322 - RNA, 22 nt, Human
guauauuuguauuuaaaugaaa

SEQ ID NO: 2103323 - RNA, 22 nt, Human
guauauuuauagucacaagagc

SEQ ID NO: 2103324 - RNA, 15 nt, Human
guauauuuauauaau

SEQ ID NO: 2103325 - RNA, 17 nt, Human
guauauuuauauaauua

SEQ ID NO: 2103326 - RNA, 19 nt, Human
guauauuuauauaauuaug

SEQ ID NO: 2103327 - RNA, 13 nt, Human
guauauuuauagu

SEQ ID NO: 2103328 - RNA, 17 nt, Human
guauauuuaaaagaaag

SEQ ID NO: 2103329 - RNA, 19 nt, Human
guaucaaacagcucaggcu

SEQ ID NO: 2103330 - RNA, 20 nt, Human
guaucaaacagcucaggcug

SEQ ID NO: 2103331 - RNA, 17 nt, Human
guauauuuuuguuuguu

SEQ ID NO: 2103332 - RNA, 22 nt, Human
guauauuuuuguuuguuuugug

SEQ ID NO: 2103333 - RNA, 18 nt, Human
guaucaggugcugccauc

SEQ ID NO: 2103334 - RNA, 16 nt, Human
guaucaggugcugcca

SEQ ID NO: 2103335 - RNA, 23 nt, Human
guauaaguccuugcaagaaucag

SEQ ID NO: 2103336 - RNA, 12 nt, Human
guauaauauuuu

SEQ ID NO: 2103337 - RNA, 15 nt, Human
guauaauauuuuuaa

SEQ ID NO: 2103338 - RNA, 19 nt, Human
guauaaugguugacugggu

SEQ ID NO: 2103339 - RNA, 21 nt, Human
guauaaugguugacuggguuu

SEQ ID NO: 2103340 - RNA, 23 nt, Human
guauaaugguugacuggguuucu

SEQ ID NO: 2103341 - RNA, 14 nt, Human
guaugguggcuggg

SEQ ID NO: 2103342 - RNA, 16 nt, Human
guaugguggcuggguu

SEQ ID NO: 2103343 - RNA, 15 nt, Human
guaugguggcugggu

SEQ ID NO: 2103344 - RNA, 21 nt, Human
guaucccaugagccucagcau

SEQ ID NO: 2103345 - RNA, 22 nt, Human
guaucaggugcugccauccagg

SEQ ID NO: 2103346 - RNA, 18 nt, Human
guaucaggccugccagac

SEQ ID NO: 2103347 - RNA, 22 nt, Human
guaucaggccugccagacggca

SEQ ID NO: 2103348 - RNA, 21 nt, Human
guauauuuuuuucuaagagaa

SEQ ID NO: 2103349 - RNA, 19 nt, Human
guaucccaugagccucagc

SEQ ID NO: 2103350 - RNA, 18 nt, Human
guauccaugggggcaggg

SEQ ID NO: 2103351 - RNA, 20 nt, Human
guauccaugggggcagggca

SEQ ID NO: 2103352 - RNA, 19 nt, Human
guaucccaacuccuauaau

SEQ ID NO: 2103353 - RNA, 17 nt, Human
guauccaguacauuuaa

SEQ ID NO: 2103354 - RNA, 18 nt, Human
guauccaguacauuuaau

SEQ ID NO: 2103355 - RNA, 16 nt, Human
guauccaugggggcag

SEQ ID NO: 2103356 - RNA, 16 nt, Human
guaucauggaaauauu

SEQ ID NO: 2103357 - RNA, 14 nt, Human
aaauguaagaucgu

SEQ ID NO: 2103358 - RNA, 22 nt, Human
aaauguaagaucguucucugcc

SEQ ID NO: 2103359 - RNA, 17 nt, Human
aaauguaagaaucauug

SEQ ID NO: 2103360 - RNA, 20 nt, Human
aaauguaagaaucauuguaa

SEQ ID NO: 2103361 - RNA, 13 nt, Human
guaguuaguagca

SEQ ID NO: 2103362 - RNA, 15 nt, Human
guaguuaggaaauaa

SEQ ID NO: 2103363 - RNA, 16 nt, Human
guaguuaggaaauaaa

SEQ ID NO: 2103364 - RNA, 20 nt, Human
guaguuaggaaauaaaaccu

SEQ ID NO: 2103365 - RNA, 22 nt, Human
guaguuaggaaauaaaaccuuu

SEQ ID NO: 2103366 - RNA, 11 nt, Human
guaguuaggaa

SEQ ID NO: 2103367 - RNA, 13 nt, Human
guaguuaggaaau

SEQ ID NO: 2103368 - RNA, 14 nt, Human
guaguuaggaaaua

SEQ ID NO: 2103369 - RNA, 17 nt, Human
guaguuuuucuucaaca

SEQ ID NO: 2103370 - RNA, 20 nt, Human
guaacaggucuccucuuaaa

SEQ ID NO: 2103371 - RNA, 21 nt, Human
guaacaggucuccucuuaaaa

SEQ ID NO: 2103372 - RNA, 14 nt, Human
guaaagauauuauu

SEQ ID NO: 2103373 - RNA, 14 nt, Human
guaacaggucuccu

SEQ ID NO: 2103374 - RNA, 16 nt, Human
guaacaggucuccucu

SEQ ID NO: 2103375 - RNA, 12 nt, Human
guaacaggcaga

SEQ ID NO: 2103376 - RNA, 22 nt, Human
guaacaggaaaauuuuaaaaau

SEQ ID NO: 2103377 - RNA, 16 nt, Human
aaauggucgcccagga

SEQ ID NO: 2103378 - RNA, 17 nt, Human
aaauggucgcccaggag

SEQ ID NO: 2103379 - RNA, 13 nt, Human
aaaugguaaaauu

SEQ ID NO: 2103380 - RNA, 18 nt, Human
aaaugguaaaauugcaug

SEQ ID NO: 2103381 - RNA, 19 nt, Human
aaaugguaaaauugcaugg

SEQ ID NO: 2103382 - RNA, 19 nt, Human
aaauggguagagaaacacu

SEQ ID NO: 2103383 - RNA, 18 nt, Human
aaaugguguuuucaugua

SEQ ID NO: 2103384 - RNA, 19 nt, Human
aaaugguguuuucauguaa

SEQ ID NO: 2103385 - RNA, 22 nt, Human
aaaugguguuuucauguaaaua

SEQ ID NO: 2103386 - RNA, 14 nt, Human
aaaugguguuuuuu

SEQ ID NO: 2103387 - RNA, 20 nt, Human
aaauggugguuguuucuucc

SEQ ID NO: 2103388 - RNA, 21 nt, Human
aaauggugguuguuucuucca

SEQ ID NO: 2103389 - RNA, 22 nt, Human
aaauggugguuguuucuuccaa

SEQ ID NO: 2103390 - RNA, 18 nt, Human
aaauggucgcccaggaga

SEQ ID NO: 2103391 - RNA, 23 nt, Human
aaauggugaaaauaaaauaaagc

SEQ ID NO: 2103392 - RNA, 19 nt, Human
aaauuauaacuuaaaauau

SEQ ID NO: 2103393 - RNA, 22 nt, Human
aaauuauaacuuaaaauauuuu

SEQ ID NO: 2103394 - RNA, 12 nt, Human
aaauuauaagga

SEQ ID NO: 2103395 - RNA, 15 nt, Human
aaauuauaaggacug

SEQ ID NO: 2103396 - RNA, 16 nt, Human
aaauuauaaggacugc

SEQ ID NO: 2103397 - RNA, 17 nt, Human
aaauuauaaggacugca

SEQ ID NO: 2103398 - RNA, 18 nt, Human
aaauuauaaggacugcau

SEQ ID NO: 2103399 - RNA, 20 nt, Human
aaauuauaaggacugcaugg

SEQ ID NO: 2103400 - RNA, 23 nt, Human
aaauuauaaggacugcaugguaa

SEQ ID NO: 2103401 - RNA, 13 nt, Human
aaauuauagaagu

SEQ ID NO: 2103402 - RNA, 16 nt, Human
aaauuauuaugacacc

SEQ ID NO: 2103403 - RNA, 14 nt, Human
aaauuauucaguua

SEQ ID NO: 2103404 - RNA, 16 nt, Human
aaauuauucaguuaag

SEQ ID NO: 2103405 - RNA, 20 nt, Human
aaauuauucaguuaagaaaa

SEQ ID NO: 2103406 - RNA, 21 nt, Human
aaauuauucaguuaagaaaaa

SEQ ID NO: 2103407 - RNA, 23 nt, Human
aaauuauucaguuaagaaaaaaa

SEQ ID NO: 2103408 - RNA, 17 nt, Human
aaauuagguuuuguaca

SEQ ID NO: 2103409 - RNA, 19 nt, Human
aaauuagguuuuguacaau

SEQ ID NO: 2103410 - RNA, 23 nt, Human
aaauuagguuuuguacaauugaa

SEQ ID NO: 2103411 - RNA, 16 nt, Human
aaauuauaacuuaaaa

SEQ ID NO: 2103412 - RNA, 17 nt, Human
aaauuauaacuuaaaau

SEQ ID NO: 2103413 - RNA, 22 nt, Human
aaauuaaggcaacugaacaaaa

SEQ ID NO: 2103414 - RNA, 23 nt, Human
aaauuaaggcaacugaacaaaaa

SEQ ID NO: 2103415 - RNA, 16 nt, Human
aaauguguuuaaaaca

SEQ ID NO: 2103416 - RNA, 13 nt, Human
aaaugugauuuuu

SEQ ID NO: 2103417 - RNA, 20 nt, Human
aaauguguaucggaugcuuu

SEQ ID NO: 2103418 - RNA, 13 nt, Human
aaauguguauuuu

SEQ ID NO: 2103419 - RNA, 13 nt, Human
aaauuaagaaugu

SEQ ID NO: 2103420 - RNA, 14 nt, Human
aaauuaagaauguu

SEQ ID NO: 2103421 - RNA, 16 nt, Human
aaauuaagaauguucu

SEQ ID NO: 2103422 - RNA, 24 nt, Human
aaaugucuaguuguaacaccauga

SEQ ID NO: 2103423 - RNA, 22 nt, Human
aaaugucuuuccuuuugcucuu

SEQ ID NO: 2103424 - RNA, 22 nt, Human
aaauguccuccagaagccucug

SEQ ID NO: 2103425 - RNA, 19 nt, Human
aaaugucuaguuguaacac

SEQ ID NO: 2103426 - RNA, 18 nt, Human
guauccacuguuuauuca

SEQ ID NO: 2103427 - RNA, 16 nt, Human
guaugcuuauuuuaaa

SEQ ID NO: 2103428 - RNA, 16 nt, Human
guaugguuuuguggau

SEQ ID NO: 2103429 - RNA, 11 nt, Human
guauguaaaaa

SEQ ID NO: 2103430 - RNA, 14 nt, Human
aaauguauucaaau

SEQ ID NO: 2103431 - RNA, 15 nt, Human
aaauguauucaaaua

SEQ ID NO: 2103432 - RNA, 18 nt, Human
guaugucaacuuuaugca

SEQ ID NO: 2103433 - RNA, 13 nt, Human
aaauuauuucaga

SEQ ID NO: 2103434 - RNA, 21 nt, Human
aaauuguuucaaaauaaaaac

SEQ ID NO: 2103435 - RNA, 22 nt, Human
aaauuguuuaaguguuguaaau

SEQ ID NO: 2103436 - RNA, 13 nt, Human
aaauucuguuucu

SEQ ID NO: 2103437 - RNA, 22 nt, Human
guauuuuguuuuugucuuaaaa

SEQ ID NO: 2103438 - RNA, 15 nt, Human
gucaaaaggugccug

SEQ ID NO: 2103439 - RNA, 16 nt, Human
gucaaaaggugccugu

SEQ ID NO: 2103440 - RNA, 14 nt, Human
gucaaaaggugccu

SEQ ID NO: 2103441 - RNA, 15 nt, Human
gucaaacaaagccag

SEQ ID NO: 2103442 - RNA, 14 nt, Human
gucaaaacacuugu

SEQ ID NO: 2103443 - RNA, 16 nt, Human
gucaaacaugaagugu

SEQ ID NO: 2103444 - RNA, 15 nt, Human
gucaaacaugaagug

SEQ ID NO: 2103445 - RNA, 16 nt, Human
gucaaacaaagccaga

SEQ ID NO: 2103446 - RNA, 17 nt, Human
gucaaacaaagccagaa

SEQ ID NO: 2103447 - RNA, 14 nt, Human
gucaaacgugaaaa

SEQ ID NO: 2103448 - RNA, 17 nt, Human
gucaaacgugaaaaugc

SEQ ID NO: 2103449 - RNA, 15 nt, Human
gucaaacgugaaaau

SEQ ID NO: 2103450 - RNA, 16 nt, Human
gucaaacuguagaaau

SEQ ID NO: 2103451 - RNA, 20 nt, Human
gucaaacuguagaaaugaug

SEQ ID NO: 2103452 - RNA, 21 nt, Human
gucaacaaguaugaauaaaga

SEQ ID NO: 2103453 - RNA, 22 nt, Human
gucaacacuuaaggguuuuaga

SEQ ID NO: 2103454 - RNA, 16 nt, Human
gucaaagcaaggaucu

SEQ ID NO: 2103455 - RNA, 13 nt, Human
gucaaaguaaaac

SEQ ID NO: 2103456 - RNA, 13 nt, Human
gucauaacuagaa

SEQ ID NO: 2103457 - RNA, 19 nt, Human
gucagucaugauggcacca

SEQ ID NO: 2103458 - RNA, 16 nt, Human
gucaguaucaggccug

SEQ ID NO: 2103459 - RNA, 23 nt, Human
gucaguaucaggccugccagacg

SEQ ID NO: 2103460 - RNA, 18 nt, Human
gucagggaccccugcccu

SEQ ID NO: 2103461 - RNA, 13 nt, Human
gucagggaccaag

SEQ ID NO: 2103462 - RNA, 14 nt, Human
gucagggaccaagg

SEQ ID NO: 2103463 - RNA, 16 nt, Human
gucagggaccaaggac

SEQ ID NO: 2103464 - RNA, 21 nt, Human
gucagggaccaaggaccccuc

SEQ ID NO: 2103465 - RNA, 14 nt, Human
gucagggaccccug

SEQ ID NO: 2103466 - RNA, 14 nt, Human
gucaguaugacauu

SEQ ID NO: 2103467 - RNA, 18 nt, Human
aaauuuguuauaaugaau

SEQ ID NO: 2103468 - RNA, 16 nt, Human
aaauuugguucuaaua

SEQ ID NO: 2103469 - RNA, 15 nt, Human
aaauuugguucuaau

SEQ ID NO: 2103470 - RNA, 12 nt, Human
aaauuuggaauu

SEQ ID NO: 2103471 - RNA, 17 nt, Human
aaauuuggaauucuguu

SEQ ID NO: 2103472 - RNA, 20 nt, Human
aaauuuggaauucuguucau

SEQ ID NO: 2103473 - RNA, 22 nt, Human
gucacacaguauuacuucugcu

SEQ ID NO: 2103474 - RNA, 12 nt, Human
gucacagagaac

SEQ ID NO: 2103475 - RNA, 19 nt, Human
gucacagagaacuaguggu

SEQ ID NO: 2103476 - RNA, 21 nt, Human
gucacacaguauuacuucugc

SEQ ID NO: 2103477 - RNA, 19 nt, Human
gucaacacuuaaggguuuu

SEQ ID NO: 2103478 - RNA, 18 nt, Human
gucaacagagaaggcagg

SEQ ID NO: 2103479 - RNA, 23 nt, Human
gucaacagagaaggcaggaaugu

SEQ ID NO: 2103480 - RNA, 19 nt, Human
gucaacagagaaggcagga

SEQ ID NO: 2103481 - RNA, 22 nt, Human
gucaacagagaaggcaggaaug

SEQ ID NO: 2103482 - RNA, 15 nt, Human
gucagacacaaacaa

SEQ ID NO: 2103483 - RNA, 20 nt, Human
gucagacacaaacaaacaag

SEQ ID NO: 2103484 - RNA, 20 nt, Human
gucagaauaauaagaggugc

SEQ ID NO: 2103485 - RNA, 16 nt, Human
gucaggccacggcagc

SEQ ID NO: 2103486 - RNA, 18 nt, Human
gucaggccacggcagccu

SEQ ID NO: 2103487 - RNA, 12 nt, Human
gucaggccacgg

SEQ ID NO: 2103488 - RNA, 14 nt, Human
gucaggccacggca

SEQ ID NO: 2103489 - RNA, 15 nt, Human
gucaggccacggcag

SEQ ID NO: 2103490 - RNA, 23 nt, Human
gucaggaguucgagaccagccug

SEQ ID NO: 2103491 - RNA, 23 nt, Human
gucaggaguuagaggccagccug

SEQ ID NO: 2103492 - RNA, 13 nt, Human
gucaggaguuccu

SEQ ID NO: 2103493 - RNA, 22 nt, Human
gucaggaguuagaggccagccu

SEQ ID NO: 2103494 - RNA, 19 nt, Human
gucaggaguuagaggccag

SEQ ID NO: 2103495 - RNA, 14 nt, Human
aacaagugaacaca

SEQ ID NO: 2103496 - RNA, 20 nt, Human
aacaagugaacacauugugu

SEQ ID NO: 2103497 - RNA, 21 nt, Human
aacaaugucaaggugcuguug

SEQ ID NO: 2103498 - RNA, 22 nt, Human
aacaaugucaaggugcuguugu

SEQ ID NO: 2103499 - RNA, 17 nt, Human
aacaauggaagauuugc

SEQ ID NO: 2103500 - RNA, 13 nt, Human
aacaagagugauu

SEQ ID NO: 2103501 - RNA, 17 nt, Human
aacaagaucuuucagga

SEQ ID NO: 2103502 - RNA, 19 nt, Human
aacaagagcgaaacuccgu

SEQ ID NO: 2103503 - RNA, 19 nt, Human
aacaagaucuuucaggaaa

SEQ ID NO: 2103504 - RNA, 14 nt, Human
aaauuuucuucagu

SEQ ID NO: 2103505 - RNA, 17 nt, Human
aaauuuucuucaguugg

SEQ ID NO: 2103506 - RNA, 18 nt, Human
aaauuuucuucaguuggu

SEQ ID NO: 2103507 - RNA, 18 nt, Human
aaauuuucacauaaaaua

SEQ ID NO: 2103508 - RNA, 21 nt, Human
aaauuuuauaaaauuaagcaa

SEQ ID NO: 2103509 - RNA, 14 nt, Human
aaauuuuaauuuau

SEQ ID NO: 2103510 - RNA, 14 nt, Human
aaauuuuaccaagu

SEQ ID NO: 2103511 - RNA, 22 nt, Human
aaauuuuaccaaguuauauaaa

SEQ ID NO: 2103512 - RNA, 12 nt, Human
aaauuuuauucc

SEQ ID NO: 2103513 - RNA, 13 nt, Human
aaauuuuauuccu

SEQ ID NO: 2103514 - RNA, 17 nt, Human
aaauuuuaucucuuauu

SEQ ID NO: 2103515 - RNA, 12 nt, Human
aaauuuuggcca

SEQ ID NO: 2103516 - RNA, 18 nt, Human
aaauuuuggccaaagugu

SEQ ID NO: 2103517 - RNA, 17 nt, Human
aaauuuugccuaauaca

SEQ ID NO: 2103518 - RNA, 23 nt, Human
aaauuuugccuaauacauuaaag

SEQ ID NO: 2103519 - RNA, 16 nt, Human
gucccaccuuggcugc

SEQ ID NO: 2103520 - RNA, 15 nt, Human
gucccaccuuggcug

SEQ ID NO: 2103521 - RNA, 14 nt, Human
gucccaccuuggcu

SEQ ID NO: 2103522 - RNA, 19 nt, Human
guccccaggccccaggaag

SEQ ID NO: 2103523 - RNA, 21 nt, Human
guccccaggccccaggaagcc

SEQ ID NO: 2103524 - RNA, 20 nt, Human
guccccaggccccaggaagc

SEQ ID NO: 2103525 - RNA, 18 nt, Human
guccccaguuugcagaaa

SEQ ID NO: 2103526 - RNA, 19 nt, Human
guccccaguuugcagaaaa

SEQ ID NO: 2103527 - RNA, 19 nt, Human
gucccaccgguugcuucug

SEQ ID NO: 2103528 - RNA, 20 nt, Human
gucccaccgguugcuucugg

SEQ ID NO: 2103529 - RNA, 21 nt, Human
gucccaccgguugcuucuggg

SEQ ID NO: 2103530 - RNA, 22 nt, Human
gucccaccgguugcuucuggga

SEQ ID NO: 2103531 - RNA, 23 nt, Human
gucccaccgguugcuucugggaa

SEQ ID NO: 2103532 - RNA, 23 nt, Human
gucccaccucaaaugggucuggg

SEQ ID NO: 2103533 - RNA, 18 nt, Human
guccaacguggggcagca

SEQ ID NO: 2103534 - RNA, 18 nt, Human
gucauuuugcuucauagc

SEQ ID NO: 2103535 - RNA, 12 nt, Human
guccaacuccag

SEQ ID NO: 2103536 - RNA, 13 nt, Human
guccaacuccagu

SEQ ID NO: 2103537 - RNA, 14 nt, Human
guccaacuccagua

SEQ ID NO: 2103538 - RNA, 20 nt, Human
guccaacguggggcagcaca

SEQ ID NO: 2103539 - RNA, 21 nt, Human
guccaacguggggcagcacag

SEQ ID NO: 2103540 - RNA, 12 nt, Human
gucauuuugaag

SEQ ID NO: 2103541 - RNA, 14 nt, Human
gucauuuugaagcu

SEQ ID NO: 2103542 - RNA, 17 nt, Human
gucauuuugaagcuaau

SEQ ID NO: 2103543 - RNA, 19 nt, Human
aacacagacauucugccag

SEQ ID NO: 2103544 - RNA, 20 nt, Human
aacacagacauucugccagg

SEQ ID NO: 2103545 - RNA, 18 nt, Human
aacacacugaggcaggga

SEQ ID NO: 2103546 - RNA, 19 nt, Human
aacacacugaggcagggaa

SEQ ID NO: 2103547 - RNA, 20 nt, Human
aacacacugaggcagggaag

SEQ ID NO: 2103548 - RNA, 21 nt, Human
aacacacugaggcagggaagu

SEQ ID NO: 2103549 - RNA, 11 nt, Human
aacagacaagu

SEQ ID NO: 2103550 - RNA, 17 nt, Human
aacagacaagugacugu

SEQ ID NO: 2103551 - RNA, 18 nt, Human
aacagauaagcaagagag

SEQ ID NO: 2103552 - RNA, 19 nt, Human
aacagauaagcaagagaga

SEQ ID NO: 2103553 - RNA, 18 nt, Human
aacagaucuccaaagcuu

SEQ ID NO: 2103554 - RNA, 20 nt, Human
aacagaucuccaaagcuuuc

SEQ ID NO: 2103555 - RNA, 23 nt, Human
aacagauacuggaaguuuugcau

SEQ ID NO: 2103556 - RNA, 16 nt, Human
aacagaagcuuccauu

SEQ ID NO: 2103557 - RNA, 14 nt, Human
aacagaagcuucca

SEQ ID NO: 2103558 - RNA, 13 nt, Human
aacagaaggauga

SEQ ID NO: 2103559 - RNA, 18 nt, Human
aacagacaaaaacagccu

SEQ ID NO: 2103560 - RNA, 21 nt, Human
aacagacaaaaacagccucac

SEQ ID NO: 2103561 - RNA, 16 nt, Human
aacagacaacagaagu

SEQ ID NO: 2103562 - RNA, 18 nt, Human
aacagacaacagaaguca

SEQ ID NO: 2103563 - RNA, 20 nt, Human
aacagugauuuuuuuuuaga

SEQ ID NO: 2103564 - RNA, 15 nt, Human
aacagggccuugcua

SEQ ID NO: 2103565 - RNA, 22 nt, Human
aacaggguguugucagcaucuu

SEQ ID NO: 2103566 - RNA, 18 nt, Human
aacagugccauugucuuu

SEQ ID NO: 2103567 - RNA, 19 nt, Human
aacagugccauugucuuua

SEQ ID NO: 2103568 - RNA, 20 nt, Human
aacagugccauugucuuuau

SEQ ID NO: 2103569 - RNA, 12 nt, Human
aacagugccugc

SEQ ID NO: 2103570 - RNA, 13 nt, Human
aacagugccugcu

SEQ ID NO: 2103571 - RNA, 14 nt, Human
aacagugccugcug

SEQ ID NO: 2103572 - RNA, 15 nt, Human
aacagugccugcuga

SEQ ID NO: 2103573 - RNA, 19 nt, Human
aacaguguuucccauaauu

SEQ ID NO: 2103574 - RNA, 21 nt, Human
aacaguguuucccauaauuuu

SEQ ID NO: 2103575 - RNA, 13 nt, Human
aacaggggcuggu

SEQ ID NO: 2103576 - RNA, 15 nt, Human
aacaggggcuggugg

SEQ ID NO: 2103577 - RNA, 15 nt, Human
aacaggguaaauuau

SEQ ID NO: 2103578 - RNA, 16 nt, Human
aacaggguaaauuauu

SEQ ID NO: 2103579 - RNA, 12 nt, Human
guccuacucugu

SEQ ID NO: 2103580 - RNA, 15 nt, Human
gucccuuucuuggcc

SEQ ID NO: 2103581 - RNA, 17 nt, Human
gucccuuucuuggccag

SEQ ID NO: 2103582 - RNA, 15 nt, Human
guccuacccacccuc

SEQ ID NO: 2103583 - RNA, 16 nt, Human
guccuacccacccucc

SEQ ID NO: 2103584 - RNA, 21 nt, Human
gucccuugagaccucagccau

SEQ ID NO: 2103585 - RNA, 19 nt, Human
gucccuugagaccucagcc

SEQ ID NO: 2103586 - RNA, 20 nt, Human
gucccuugagaccucagcca

SEQ ID NO: 2103587 - RNA, 13 nt, Human
gucccuugcagcu

SEQ ID NO: 2103588 - RNA, 17 nt, Human
gucccuugagaccucag

SEQ ID NO: 2103589 - RNA, 18 nt, Human
gucccuugagaccucagc

SEQ ID NO: 2103590 - RNA, 22 nt, Human
gucccuugagaccucagccaug

SEQ ID NO: 2103591 - RNA, 14 nt, Human
guuucucaaagaaa

SEQ ID NO: 2103592 - RNA, 23 nt, Human
guuucuauucucuccucagacug

SEQ ID NO: 2103593 - RNA, 19 nt, Human
guuucuauguguagggcgg

SEQ ID NO: 2103594 - RNA, 17 nt, Human
guuucucaaagaaauuu

SEQ ID NO: 2103595 - RNA, 18 nt, Human
guuucucaaagaaauuuc

SEQ ID NO: 2103596 - RNA, 15 nt, Human
guuucucugcuguug

SEQ ID NO: 2103597 - RNA, 21 nt, Human
guuucugaaaauuaacacugc

SEQ ID NO: 2103598 - RNA, 20 nt, Human
guuucugaaaauuaacacug

SEQ ID NO: 2103599 - RNA, 16 nt, Human
guuucugaaaauucca

SEQ ID NO: 2103600 - RNA, 19 nt, Human
guuucugaaaauuccagaa

SEQ ID NO: 2103601 - RNA, 21 nt, Human
aaguaagaaagugaagcaaau

SEQ ID NO: 2103602 - RNA, 13 nt, Human
aaggucaucaucg

SEQ ID NO: 2103603 - RNA, 13 nt, Human
aaguaagcaaaga

SEQ ID NO: 2103604 - RNA, 13 nt, Human
aaguaagaagaca

SEQ ID NO: 2103605 - RNA, 14 nt, Human
aaguaagaagacau

SEQ ID NO: 2103606 - RNA, 20 nt, Human
aaguaagaagacaugaacca

SEQ ID NO: 2103607 - RNA, 18 nt, Human
aaguaaguaccacucagg

SEQ ID NO: 2103608 - RNA, 15 nt, Human
aaguaagaagacaug

SEQ ID NO: 2103609 - RNA, 23 nt, Human
aaguaagcccuugaagauaucuu

SEQ ID NO: 2103610 - RNA, 20 nt, Human
aaguaaguaccacucaggcc

SEQ ID NO: 2103611 - RNA, 21 nt, Human
aaguaaguaccacucaggcca

SEQ ID NO: 2103612 - RNA, 23 nt, Human
aaggcucugagcaaauguggcuc

SEQ ID NO: 2103613 - RNA, 17 nt, Human
aaggcugaccaagagag

SEQ ID NO: 2103614 - RNA, 17 nt, Human
aaggcucugaaagccag

SEQ ID NO: 2103615 - RNA, 18 nt, Human
aaggcucugaaagccagc

SEQ ID NO: 2103616 - RNA, 22 nt, Human
aaggggcccaaauucuuucagu

SEQ ID NO: 2103617 - RNA, 15 nt, Human
aaggcugaccaagag

SEQ ID NO: 2103618 - RNA, 16 nt, Human
aaggcugaccaagaga

SEQ ID NO: 2103619 - RNA, 13 nt, Human
aaggggcccuggu

SEQ ID NO: 2103620 - RNA, 15 nt, Human
aaggggcccguggga

SEQ ID NO: 2103621 - RNA, 14 nt, Human
aaggggcccugguc

SEQ ID NO: 2103622 - RNA, 21 nt, Human
aaggggcccugguccuuccag

SEQ ID NO: 2103623 - RNA, 20 nt, Human
aagggucuagggagagaccc

SEQ ID NO: 2103624 - RNA, 22 nt, Human
aagggucuagggagagacccuu

SEQ ID NO: 2103625 - RNA, 16 nt, Human
aagggucuagggagag

SEQ ID NO: 2103626 - RNA, 17 nt, Human
aagggucuagggagaga

SEQ ID NO: 2103627 - RNA, 18 nt, Human
aagggucuagggagagac

SEQ ID NO: 2103628 - RNA, 18 nt, Human
aagguauuccuuuugugu

SEQ ID NO: 2103629 - RNA, 22 nt, Human
aagguauuccuuuuguguacag

SEQ ID NO: 2103630 - RNA, 20 nt, Human
aagguagaaauaucugaaaa

SEQ ID NO: 2103631 - RNA, 15 nt, Human
guuuacacugucaaa

SEQ ID NO: 2103632 - RNA, 18 nt, Human
guuuacacugucaaacau

SEQ ID NO: 2103633 - RNA, 17 nt, Human
guuuacagguggacaca

SEQ ID NO: 2103634 - RNA, 14 nt, Human
guuuauuuaucagu

SEQ ID NO: 2103635 - RNA, 16 nt, Human
guuuauuuaucaguga

SEQ ID NO: 2103636 - RNA, 19 nt, Human
guuuauuuaucagugacag

SEQ ID NO: 2103637 - RNA, 15 nt, Human
guugggcugguguca

SEQ ID NO: 2103638 - RNA, 15 nt, Human
guugggcccagaucu

SEQ ID NO: 2103639 - RNA, 16 nt, Human
guugggcccagaucug

SEQ ID NO: 2103640 - RNA, 17 nt, Human
guugggcccagaucugg

SEQ ID NO: 2103641 - RNA, 15 nt, Human
guuuaauauugagaa

SEQ ID NO: 2103642 - RNA, 17 nt, Human
guuuaauauugagaaag

SEQ ID NO: 2103643 - RNA, 19 nt, Human
guuuaauauugagaaagaa

SEQ ID NO: 2103644 - RNA, 13 nt, Human
guugggcuggugu

SEQ ID NO: 2103645 - RNA, 13 nt, Human
guugggcccagau

SEQ ID NO: 2103646 - RNA, 16 nt, Human
guugggagccugaaau

SEQ ID NO: 2103647 - RNA, 14 nt, Human
guugggaggauucu

SEQ ID NO: 2103648 - RNA, 13 nt, Human
guugcuucuggga

SEQ ID NO: 2103649 - RNA, 15 nt, Human
guuggaaaagaauac

SEQ ID NO: 2103650 - RNA, 20 nt, Human
guuggaaaagaauacagaaa

SEQ ID NO: 2103651 - RNA, 22 nt, Human
guuggaaaagaauacagaaaga

SEQ ID NO: 2103652 - RNA, 16 nt, Human
guugccuaauaaacau

SEQ ID NO: 2103653 - RNA, 15 nt, Human
guugcgacggagaga

SEQ ID NO: 2103654 - RNA, 16 nt, Human
guugcgacggagagaa

SEQ ID NO: 2103655 - RNA, 17 nt, Human
guugcgacggagagaaa

SEQ ID NO: 2103656 - RNA, 20 nt, Human
guugcgacggagagaaaaaa

SEQ ID NO: 2103657 - RNA, 13 nt, Human
guugcccaggcug

SEQ ID NO: 2103658 - RNA, 12 nt, Human
guugcccaggcu

SEQ ID NO: 2103659 - RNA, 23 nt, Human
guugcccaggcaggucuugaacu

SEQ ID NO: 2103660 - RNA, 14 nt, Human
aaggcauucucuga

SEQ ID NO: 2103661 - RNA, 17 nt, Human
aaggcauucucugaaga

SEQ ID NO: 2103662 - RNA, 14 nt, Human
aaggccagcuggca

SEQ ID NO: 2103663 - RNA, 17 nt, Human
aaggccagcuggcagca

SEQ ID NO: 2103664 - RNA, 19 nt, Human
aaggccagcuggcagcaga

SEQ ID NO: 2103665 - RNA, 18 nt, Human
aaggccaggggcuuuugc

SEQ ID NO: 2103666 - RNA, 22 nt, Human
aaggccgaagaaggguccuucc

SEQ ID NO: 2103667 - RNA, 14 nt, Human
aaggccgagaagca

SEQ ID NO: 2103668 - RNA, 17 nt, Human
aaggccgagaagcaaga

SEQ ID NO: 2103669 - RNA, 18 nt, Human
aaggccgagaagcaagaa

SEQ ID NO: 2103670 - RNA, 22 nt, Human
aaggccgcuguucacccacagg

SEQ ID NO: 2103671 - RNA, 19 nt, Human
aaggccagcaagguggagu

SEQ ID NO: 2103672 - RNA, 14 nt, Human
aaggccccagagac

SEQ ID NO: 2103673 - RNA, 21 nt, Human
aaggcaugccuggacaaaccc

SEQ ID NO: 2103674 - RNA, 23 nt, Human
aaggcaugccuggacaaacccuu

SEQ ID NO: 2103675 - RNA, 12 nt, Human
aaggcauucucu

SEQ ID NO: 2103676 - RNA, 21 nt, Human
aaggcaugauguuaaccagaa

SEQ ID NO: 2103677 - RNA, 22 nt, Human
aaggauaaacuuuuagaaacuu

SEQ ID NO: 2103678 - RNA, 14 nt, Human
aaggaagugaagag

SEQ ID NO: 2103679 - RNA, 22 nt, Human
aaggaaguuacuguuauagagg

SEQ ID NO: 2103680 - RNA, 11 nt, Human
aaggagagcua

SEQ ID NO: 2103681 - RNA, 15 nt, Human
aaggagaugaagcaa

SEQ ID NO: 2103682 - RNA, 15 nt, Human
aaggagagucuugca

SEQ ID NO: 2103683 - RNA, 21 nt, Human
aaggagagucuugcagugauu

SEQ ID NO: 2103684 - RNA, 22 nt, Human
aaggagagucuugcagugauua

SEQ ID NO: 2103685 - RNA, 15 nt, Human
aaggagauguaagag

SEQ ID NO: 2103686 - RNA, 18 nt, Human
aaggagauguaagagcuu

SEQ ID NO: 2103687 - RNA, 16 nt, Human
aaggagcugagaauag

SEQ ID NO: 2103688 - RNA, 17 nt, Human
aaggagcugagaauaga

SEQ ID NO: 2103689 - RNA, 22 nt, Human
aaggagcugagaauagaaggaa

SEQ ID NO: 2103690 - RNA, 23 nt, Human
aaggagcugagaauagaaggaaa

SEQ ID NO: 2103691 - RNA, 20 nt, Human
aaggaggggauagagagaga

SEQ ID NO: 2103692 - RNA, 15 nt, Human
aaggagggagaugga

SEQ ID NO: 2103693 - RNA, 17 nt, Human
aaggagggucaggaagg

SEQ ID NO: 2103694 - RNA, 21 nt, Human
aaggaggguggaucaccugag

SEQ ID NO: 2103695 - RNA, 18 nt, Human
aaggaggguuagggaggg

SEQ ID NO: 2103696 - RNA, 19 nt, Human
aaggaggguuagggagggg

SEQ ID NO: 2103697 - RNA, 13 nt, Human
aaggaguagaaaa

SEQ ID NO: 2103698 - RNA, 18 nt, Human
aaggaggaagagaaaaaa

SEQ ID NO: 2103699 - RNA, 21 nt, Human
aaggagcuuaccucccaccuu

SEQ ID NO: 2103700 - RNA, 11 nt, Human
aaggaggaaaa

SEQ ID NO: 2103701 - RNA, 14 nt, Human
aaggaggcuggcag

SEQ ID NO: 2103702 - RNA, 12 nt, Human
aaggaagaaaaa

SEQ ID NO: 2103703 - RNA, 13 nt, Human
aaggaagaaaaau

SEQ ID NO: 2103704 - RNA, 15 nt, Human
aaggaagaaaaauca

SEQ ID NO: 2103705 - RNA, 22 nt, Human
aaggaagccacagcugguggua

SEQ ID NO: 2103706 - RNA, 22 nt, Human
aaggaagaucacuuugcucuga

SEQ ID NO: 2103707 - RNA, 13 nt, Human
aaggaagacuaga

SEQ ID NO: 2103708 - RNA, 21 nt, Human
aaggaauaaauugcuccuuga

SEQ ID NO: 2103709 - RNA, 14 nt, Human
aaggaagucuagga

SEQ ID NO: 2103710 - RNA, 14 nt, Human
aagcuccaucucca

SEQ ID NO: 2103711 - RNA, 13 nt, Human
aaggaaagcaaua

SEQ ID NO: 2103712 - RNA, 16 nt, Human
aaggaaagcaauaaau

SEQ ID NO: 2103713 - RNA, 20 nt, Human
aaggaaagcaauaaaugaau

SEQ ID NO: 2103714 - RNA, 20 nt, Human
aaggaaauaaaaaagucucu

SEQ ID NO: 2103715 - RNA, 22 nt, Human
aaggaaauaaaaaagucucuau

SEQ ID NO: 2103716 - RNA, 18 nt, Human
aagcuccaguccugcucu

SEQ ID NO: 2103717 - RNA, 19 nt, Human
aagcuccaguccugcucuc

SEQ ID NO: 2103718 - RNA, 21 nt, Human
aagcuccaguccugcucucua

SEQ ID NO: 2103719 - RNA, 16 nt, Human
aaggaaaucucacccc

SEQ ID NO: 2103720 - RNA, 22 nt, Human
aaggaaaucucaccccauccca

SEQ ID NO: 2103721 - RNA, 19 nt, Human
guuuuuccuguucuuaaga

SEQ ID NO: 2103722 - RNA, 19 nt, Human
guuuuuccuuguauuuaaa

SEQ ID NO: 2103723 - RNA, 17 nt, Human
aagugagagagacaaga

SEQ ID NO: 2103724 - RNA, 14 nt, Human
guuuuucaguuuuc

SEQ ID NO: 2103725 - RNA, 15 nt, Human
guuuuuccacuacug

SEQ ID NO: 2103726 - RNA, 16 nt, Human
guuuuuccacuacugc

SEQ ID NO: 2103727 - RNA, 17 nt, Human
guuuuuccacuacugcu

SEQ ID NO: 2103728 - RNA, 18 nt, Human
guuuuuccacuacugcua

SEQ ID NO: 2103729 - RNA, 14 nt, Human
aagugagagcuggg

SEQ ID NO: 2103730 - RNA, 15 nt, Human
aagugagagcugggu

SEQ ID NO: 2103731 - RNA, 18 nt, Human
aagugagacuuugagggu

SEQ ID NO: 2103732 - RNA, 19 nt, Human
aagugaacacauuguguca

SEQ ID NO: 2103733 - RNA, 16 nt, Human
aagugaaaucaaaggu

SEQ ID NO: 2103734 - RNA, 21 nt, Human
aagugaaaaaggaggaagaga

SEQ ID NO: 2103735 - RNA, 12 nt, Human
aagucuucaggg

SEQ ID NO: 2103736 - RNA, 18 nt, Human
aagucauuuuaacuuuau

SEQ ID NO: 2103737 - RNA, 20 nt, Human
aagucauuuuaacuuuauca

SEQ ID NO: 2103738 - RNA, 22 nt, Human
aagucauuuuaacuuuaucaca

SEQ ID NO: 2103739 - RNA, 17 nt, Human
aagucuucaagggcugc

SEQ ID NO: 2103740 - RNA, 21 nt, Human
aagucuucaagggcugcuuca

SEQ ID NO: 2103741 - RNA, 22 nt, Human
aagucuucaagggcugcuucaa

SEQ ID NO: 2103742 - RNA, 13 nt, Human
aagucuugcugug

SEQ ID NO: 2103743 - RNA, 17 nt, Human
aagucuugcuguggucu

SEQ ID NO: 2103744 - RNA, 21 nt, Human
aagucuugcuguggucucuuu

SEQ ID NO: 2103745 - RNA, 18 nt, Human
aagucuucccugaucaag

SEQ ID NO: 2103746 - RNA, 22 nt, Human
aagucuucccugaucaagucac

SEQ ID NO: 2103747 - RNA, 14 nt, Human
aagucuugugacua

SEQ ID NO: 2103748 - RNA, 19 nt, Human
aagucuugugacuagugcu

SEQ ID NO: 2103749 - RNA, 20 nt, Human
aagucuugugacuagugcug

SEQ ID NO: 2103750 - RNA, 23 nt, Human
aagucuugugacuagugcugaag

SEQ ID NO: 2103751 - RNA, 21 nt, Human
aagucuugugacuagugcuga

SEQ ID NO: 2103752 - RNA, 22 nt, Human
aagucuugugacuagugcugaa

SEQ ID NO: 2103753 - RNA, 16 nt, Human
aagucauuuuaacuuu

SEQ ID NO: 2103754 - RNA, 15 nt, Human
aagucaugugcauuu

SEQ ID NO: 2103755 - RNA, 14 nt, Human
aagucaugugcauu

SEQ ID NO: 2103756 - RNA, 21 nt, Human
aagucaugcguuuaaucacau

SEQ ID NO: 2103757 - RNA, 20 nt, Human
aaguauuuauauauuuauaa

SEQ ID NO: 2103758 - RNA, 21 nt, Human
aaguauuuauauauuuauaac

SEQ ID NO: 2103759 - RNA, 22 nt, Human
aaguauuuauauauuuauaacu

SEQ ID NO: 2103760 - RNA, 23 nt, Human
aaguauuuauauauuuauaacuc

SEQ ID NO: 2103761 - RNA, 21 nt, Human
aaguaauccaccugccucggc

SEQ ID NO: 2103762 - RNA, 16 nt, Human
guuuuggggacucauu

SEQ ID NO: 2103763 - RNA, 16 nt, Human
guuuuggaagcucuga

SEQ ID NO: 2103764 - RNA, 16 nt, Human
guuuugcuguuuccuu

SEQ ID NO: 2103765 - RNA, 22 nt, Human
guuuugccauguuggccaggcu

SEQ ID NO: 2103766 - RNA, 21 nt, Human
guuuugccauguuggccaggc

SEQ ID NO: 2103767 - RNA, 20 nt, Human
guuuugccauguuggccagg

SEQ ID NO: 2103768 - RNA, 16 nt, Human
guuuugccauguuggc

SEQ ID NO: 2103769 - RNA, 19 nt, Human
guuucugauuaaugcuaaa

SEQ ID NO: 2103770 - RNA, 13 nt, Human
guuucugcccugc

SEQ ID NO: 2103771 - RNA, 21 nt, Human
guuucugcccacauuggaccc

SEQ ID NO: 2103772 - RNA, 12 nt, Human
aaguauuuauau

SEQ ID NO: 2103773 - RNA, 13 nt, Human
aaguauuuauaua

SEQ ID NO: 2103774 - RNA, 14 nt, Human
aaguauuuauauau

SEQ ID NO: 2103775 - RNA, 15 nt, Human
aaguauuuauauauu

SEQ ID NO: 2103776 - RNA, 16 nt, Human
aaguauuuauauauuu

SEQ ID NO: 2103777 - RNA, 17 nt, Human
aaguauuuauauauuua

SEQ ID NO: 2103778 - RNA, 18 nt, Human
aaguauuuauauauuuau

SEQ ID NO: 2103779 - RNA, 20 nt, Human
aaguacauauuaggaaaaua

SEQ ID NO: 2103780 - RNA, 17 nt, Human
aaguaccacucaggcca

SEQ ID NO: 2103781 - RNA, 21 nt, Human
aaguaaugaauuuuuaugaua

SEQ ID NO: 2103782 - RNA, 13 nt, Human
uaaaagacuuuuu

SEQ ID NO: 2103783 - RNA, 23 nt, Human
uaaaagacacuguuuacaagaaa

SEQ ID NO: 2103784 - RNA, 14 nt, Human
uaaaaguucauaac

SEQ ID NO: 2103785 - RNA, 21 nt, Human
uaaaaguucauaacagugcca

SEQ ID NO: 2103786 - RNA, 12 nt, Human
uaaaaguuacuu

SEQ ID NO: 2103787 - RNA, 17 nt, Human
uaaaaguuauuaauauu

SEQ ID NO: 2103788 - RNA, 18 nt, Human
uaaaauaucauucagcaa

SEQ ID NO: 2103789 - RNA, 22 nt, Human
uaaaauagaaauauagccaaaa

SEQ ID NO: 2103790 - RNA, 22 nt, Human
uaaaauauuccugcauuuguga

SEQ ID NO: 2103791 - RNA, 13 nt, Human
uaaaauauuccug

SEQ ID NO: 2103792 - RNA, 19 nt, Human
uaaaauaucauucagcaac

SEQ ID NO: 2103793 - RNA, 15 nt, Human
aagugauaauuucug

SEQ ID NO: 2103794 - RNA, 18 nt, Human
aagugagggucagagagg

SEQ ID NO: 2103795 - RNA, 15 nt, Human
aagugagcaaaccug

SEQ ID NO: 2103796 - RNA, 18 nt, Human
aagugagcaaaccugccc

SEQ ID NO: 2103797 - RNA, 19 nt, Human
aagugagcaaaccugcccc

SEQ ID NO: 2103798 - RNA, 18 nt, Human
aagugauucuccugccuc

SEQ ID NO: 2103799 - RNA, 17 nt, Human
aagugauucuccugccu

SEQ ID NO: 2103800 - RNA, 16 nt, Human
aagugauucuccugcc

SEQ ID NO: 2103801 - RNA, 15 nt, Human
aagugauucuccugc

SEQ ID NO: 2103802 - RNA, 19 nt, Human
aagugauucuccugccuca

SEQ ID NO: 2103803 - RNA, 20 nt, Human
aagugauucuccugccucag

SEQ ID NO: 2103804 - RNA, 22 nt, Human
aagugccccugcugccucccca

SEQ ID NO: 2103805 - RNA, 23 nt, Human
aagugccccugcugccuccccaa

SEQ ID NO: 2103806 - RNA, 22 nt, Human
aagugaucaauaaaaugugauu

SEQ ID NO: 2103807 - RNA, 14 nt, Human
aagugaucaauaaa

SEQ ID NO: 2103808 - RNA, 19 nt, Human
aagugccccugcugccucc

SEQ ID NO: 2103809 - RNA, 18 nt, Human
aagugccuacauuaucua

SEQ ID NO: 2103810 - RNA, 11 nt, Human
uaaaaaucaua

SEQ ID NO: 2103811 - RNA, 17 nt, Human
uaaaaaucauaaacugu

SEQ ID NO: 2103812 - RNA, 21 nt, Human
uaaaaaguuaaaaaaaauaau

SEQ ID NO: 2103813 - RNA, 17 nt, Human
uaaaaauaaauuugguu

SEQ ID NO: 2103814 - RNA, 18 nt, Human
guuuuugauagcuuuauu

SEQ ID NO: 2103815 - RNA, 15 nt, Human
uaaaaaguggaaaaa

SEQ ID NO: 2103816 - RNA, 12 nt, Human
guuuuucuucaa

SEQ ID NO: 2103817 - RNA, 22 nt, Human
guuuuucuucaacaucaauguu

SEQ ID NO: 2103818 - RNA, 23 nt, Human
guuuuucuucaacaucaauguuc

SEQ ID NO: 2103819 - RNA, 15 nt, Human
guuuuucuucucccu

SEQ ID NO: 2103820 - RNA, 20 nt, Human
uaaaacuugauguguuaucu

SEQ ID NO: 2103821 - RNA, 22 nt, Human
uaaaacuugauguguuaucucu

SEQ ID NO: 2103822 - RNA, 13 nt, Human
uaaaacuuuaauc

SEQ ID NO: 2103823 - RNA, 13 nt, Human
uaaaacuugcugc

SEQ ID NO: 2103824 - RNA, 13 nt, Human
uaaaacuuuauuu

SEQ ID NO: 2103825 - RNA, 17 nt, Human
uaaaacuuuauuuuaua

SEQ ID NO: 2103826 - RNA, 20 nt, Human
uaaaaaucauaaacugugug

SEQ ID NO: 2103827 - RNA, 15 nt, Human
uaaaaaucauaguac

SEQ ID NO: 2103828 - RNA, 17 nt, Human
uaaaaaucauugauugu

SEQ ID NO: 2103829 - RNA, 10 nt, Human
uaaaaccuuu

SEQ ID NO: 2103830 - RNA, 11 nt, Human
uaaaaccuuuc

SEQ ID NO: 2103831 - RNA, 13 nt, Human
uaaaaccuuucaa

SEQ ID NO: 2103832 - RNA, 19 nt, Human
uaaaaccccaucucuacua

SEQ ID NO: 2103833 - RNA, 14 nt, Human
uaaaaccuuucaaa

SEQ ID NO: 2103834 - RNA, 16 nt, Human
uaaaaccuuucaaauu

SEQ ID NO: 2103835 - RNA, 20 nt, Human
uaaaaccuuucaaauuucac

SEQ ID NO: 2103836 - RNA, 21 nt, Human
uaaaaccuuucaaauuucaca

SEQ ID NO: 2103837 - RNA, 16 nt, Human
aagaucguucucugcc

SEQ ID NO: 2103838 - RNA, 17 nt, Human
aagaucguucucugccu

SEQ ID NO: 2103839 - RNA, 14 nt, Human
aagaucguuaguau

SEQ ID NO: 2103840 - RNA, 23 nt, Human
aagauggcugugccucugccugu

SEQ ID NO: 2103841 - RNA, 21 nt, Human
aagaugggaacgcagaugauc

SEQ ID NO: 2103842 - RNA, 21 nt, Human
aagauggcugugccucugccu

SEQ ID NO: 2103843 - RNA, 20 nt, Human
aagauggcugugccucugcc

SEQ ID NO: 2103844 - RNA, 18 nt, Human
aagauggcugugccucug

SEQ ID NO: 2103845 - RNA, 19 nt, Human
aagaugcuucucacugcca

SEQ ID NO: 2103846 - RNA, 17 nt, Human
aagaugcuucucacugc

SEQ ID NO: 2103847 - RNA, 16 nt, Human
aagaugcuucucacug

SEQ ID NO: 2103848 - RNA, 14 nt, Human
aagaugaagaggau

SEQ ID NO: 2103849 - RNA, 17 nt, Human
aagaugaaaauggaagu

SEQ ID NO: 2103850 - RNA, 16 nt, Human
aagaggcugaaagagg

SEQ ID NO: 2103851 - RNA, 18 nt, Human
aagaggcugaaagaggcc

SEQ ID NO: 2103852 - RNA, 13 nt, Human
aagaggcugaggc

SEQ ID NO: 2103853 - RNA, 16 nt, Human
guggggguuggcuggg

SEQ ID NO: 2103854 - RNA, 19 nt, Human
guggggguuggcuggguac

SEQ ID NO: 2103855 - RNA, 14 nt, Human
guggggucucccuc

SEQ ID NO: 2103856 - RNA, 17 nt, Human
guggggucucccucucc

SEQ ID NO: 2103857 - RNA, 19 nt, Human
guggggucucccucuccug

SEQ ID NO: 2103858 - RNA, 21 nt, Human
guggggucucccucuccugcc

SEQ ID NO: 2103859 - RNA, 22 nt, Human
guggggucucccucuccugccu

SEQ ID NO: 2103860 - RNA, 15 nt, Human
aagaggggcugggcu

SEQ ID NO: 2103861 - RNA, 19 nt, Human
aagaggggaccagaagcca

SEQ ID NO: 2103862 - RNA, 14 nt, Human
aagaggcugaggca

SEQ ID NO: 2103863 - RNA, 19 nt, Human
guguauuuauuuuccuccc

SEQ ID NO: 2103864 - RNA, 21 nt, Human
guguauuuauuuuccucccca

SEQ ID NO: 2103865 - RNA, 19 nt, Human
guguauuuccagugcaauu

SEQ ID NO: 2103866 - RNA, 22 nt, Human
guguauuuauuuuccuccccag

SEQ ID NO: 2103867 - RNA, 17 nt, Human
guguauuuaauuguaaa

SEQ ID NO: 2103868 - RNA, 19 nt, Human
guguauuuaauuguaaacu

SEQ ID NO: 2103869 - RNA, 20 nt, Human
guguauuuaauuguaaacug

SEQ ID NO: 2103870 - RNA, 22 nt, Human
guguauuuaauuguaaacugua

SEQ ID NO: 2103871 - RNA, 14 nt, Human
aagaugggugggga

SEQ ID NO: 2103872 - RNA, 16 nt, Human
aagaugguauauuugg

SEQ ID NO: 2103873 - RNA, 20 nt, Human
gugucaagagggucugagga

SEQ ID NO: 2103874 - RNA, 18 nt, Human
guguauuuuauaaaauua

SEQ ID NO: 2103875 - RNA, 20 nt, Human
guguauuuuauaaaauuaaa

SEQ ID NO: 2103876 - RNA, 16 nt, Human
gugucagcauagaagu

SEQ ID NO: 2103877 - RNA, 15 nt, Human
gugugacaucagugg

SEQ ID NO: 2103878 - RNA, 20 nt, Human
gugugacaucaguggcaugg

SEQ ID NO: 2103879 - RNA, 22 nt, Human
gugugacaaggauugcuacugu

SEQ ID NO: 2103880 - RNA, 13 nt, Human
guguccaccuggc

SEQ ID NO: 2103881 - RNA, 14 nt, Human
guguccaacuccag

SEQ ID NO: 2103882 - RNA, 15 nt, Human
guguccaacuccagu

SEQ ID NO: 2103883 - RNA, 16 nt, Human
guguccaacuccagua

SEQ ID NO: 2103884 - RNA, 23 nt, Human
guguccaacuccaguacuggagc

SEQ ID NO: 2103885 - RNA, 17 nt, Human
guguccaagugugugug

SEQ ID NO: 2103886 - RNA, 23 nt, Human
gugucauauauggggggccaaca

SEQ ID NO: 2103887 - RNA, 18 nt, Human
gugucauaccaggccgcc

SEQ ID NO: 2103888 - RNA, 20 nt, Human
gugucagguggggcagcuug

SEQ ID NO: 2103889 - RNA, 18 nt, Human
gugucauuuaugaaaaga

SEQ ID NO: 2103890 - RNA, 23 nt, Human
gugucauuuggcuuuccagucau

SEQ ID NO: 2103891 - RNA, 16 nt, Human
gugugguagagugugc

SEQ ID NO: 2103892 - RNA, 17 nt, Human
guguggguaccuguauu

SEQ ID NO: 2103893 - RNA, 16 nt, Human
guguggguaccuguau

SEQ ID NO: 2103894 - RNA, 15 nt, Human
guguguauuguuccc

SEQ ID NO: 2103895 - RNA, 23 nt, Human
aagacgugauuuugcuguagaag

SEQ ID NO: 2103896 - RNA, 18 nt, Human
aagacgucccuuuuuucu

SEQ ID NO: 2103897 - RNA, 16 nt, Human
aagacgugauuuugcu

SEQ ID NO: 2103898 - RNA, 22 nt, Human
aagacgugauuuugcuguagaa

SEQ ID NO: 2103899 - RNA, 20 nt, Human
aagacuagaggcuugcauaa

SEQ ID NO: 2103900 - RNA, 16 nt, Human
aagacuuccagagccu

SEQ ID NO: 2103901 - RNA, 18 nt, Human
aagacuuccagagccuca

SEQ ID NO: 2103902 - RNA, 14 nt, Human
aagacuucccagcu

SEQ ID NO: 2103903 - RNA, 21 nt, Human
aagacuuuccccauacucugu

SEQ ID NO: 2103904 - RNA, 23 nt, Human
aagacuuuccccauacucugucu

SEQ ID NO: 2103905 - RNA, 19 nt, Human
aagagcagccuguggcauc

SEQ ID NO: 2103906 - RNA, 17 nt, Human
aagagcagccuguggca

SEQ ID NO: 2103907 - RNA, 18 nt, Human
aagagcagccuguggcau

SEQ ID NO: 2103908 - RNA, 13 nt, Human
aagagcagccugu

SEQ ID NO: 2103909 - RNA, 12 nt, Human
aagacuuguuuu

SEQ ID NO: 2103910 - RNA, 14 nt, Human
aagagcagccugug

SEQ ID NO: 2103911 - RNA, 16 nt, Human
aagagcagccuguggc

SEQ ID NO: 2103912 - RNA, 23 nt, Human
aagagcaggcacauggaggagcu

SEQ ID NO: 2103913 - RNA, 14 nt, Human
gugccuuaccuccu

SEQ ID NO: 2103914 - RNA, 15 nt, Human
gugccuuaccuccug

SEQ ID NO: 2103915 - RNA, 17 nt, Human
gugccuuaccuccugcc

SEQ ID NO: 2103916 - RNA, 18 nt, Human
gugccuuaccuccugccc

SEQ ID NO: 2103917 - RNA, 19 nt, Human
gugccuuaccuccugccca

SEQ ID NO: 2103918 - RNA, 20 nt, Human
gugccuuaccuccugcccag

SEQ ID NO: 2103919 - RNA, 21 nt, Human
gugccuuaccuccugcccagg

SEQ ID NO: 2103920 - RNA, 13 nt, Human
guggccuggcucc

SEQ ID NO: 2103921 - RNA, 19 nt, Human
guggccuggcuccgcugug

SEQ ID NO: 2103922 - RNA, 21 nt, Human
guggccuggccaggagcucuu

SEQ ID NO: 2103923 - RNA, 12 nt, Human
guggccugggca

SEQ ID NO: 2103924 - RNA, 14 nt, Human
guggccugggcaag

SEQ ID NO: 2103925 - RNA, 12 nt, Human
guggccuggcca

SEQ ID NO: 2103926 - RNA, 13 nt, Human
guggccuggccag

SEQ ID NO: 2103927 - RNA, 16 nt, Human
guggccuggccaggag

SEQ ID NO: 2103928 - RNA, 18 nt, Human
guggccuggccaggagcu

SEQ ID NO: 2103929 - RNA, 20 nt, Human
guggccuggccaggagcucu

SEQ ID NO: 2103930 - RNA, 20 nt, Human
guggccucaacccucccuca

SEQ ID NO: 2103931 - RNA, 19 nt, Human
guggccucaacccucccuc

SEQ ID NO: 2103932 - RNA, 20 nt, Human
guggccucugccccgucuca

SEQ ID NO: 2103933 - RNA, 24 nt, Human
guggccucugccccgucucaugag

SEQ ID NO: 2103934 - RNA, 9 nt, Human
aagagccau

SEQ ID NO: 2103935 - RNA, 16 nt, Human
aagaggaucggaggcu

SEQ ID NO: 2103936 - RNA, 14 nt, Human
aagagccaauggag

SEQ ID NO: 2103937 - RNA, 9 nt, Human
guggccuca

SEQ ID NO: 2103938 - RNA, 14 nt, Human
aagaggcaagaggc

SEQ ID NO: 2103939 - RNA, 11 nt, Human
guggcccuugc

SEQ ID NO: 2103940 - RNA, 14 nt, Human
gugggaagggagag

SEQ ID NO: 2103941 - RNA, 18 nt, Human
gugggagcugccuguuca

SEQ ID NO: 2103942 - RNA, 15 nt, Human
gugggagcugccugu

SEQ ID NO: 2103943 - RNA, 13 nt, Human
guggggccuuggu

SEQ ID NO: 2103944 - RNA, 15 nt, Human
guggggccuagaucc

SEQ ID NO: 2103945 - RNA, 12 nt, Human
guggggcugcuc

SEQ ID NO: 2103946 - RNA, 14 nt, Human
guggggcugcuccu

SEQ ID NO: 2103947 - RNA, 16 nt, Human
guggggcugcuccucc

SEQ ID NO: 2103948 - RNA, 17 nt, Human
guggggcugcuccucca

SEQ ID NO: 2103949 - RNA, 11 nt, Human
guggggcuggg

SEQ ID NO: 2103950 - RNA, 12 nt, Human
guggggcugggg

SEQ ID NO: 2103951 - RNA, 18 nt, Human
guggggcugcuccuccag

SEQ ID NO: 2103952 - RNA, 14 nt, Human
gugggagcugccug

SEQ ID NO: 2103953 - RNA, 21 nt, Human
gugggaagaaacaaacccguu

SEQ ID NO: 2103954 - RNA, 17 nt, Human
gugggaagcgucugucc

SEQ ID NO: 2103955 - RNA, 15 nt, Human
gugggaaggacuugg

SEQ ID NO: 2103956 - RNA, 20 nt, Human
gugggaaggacuuggcgcgc

SEQ ID NO: 2103957 - RNA, 23 nt, Human
gugggaaggacuuggcgcgcccu

SEQ ID NO: 2103958 - RNA, 13 nt, Human
gugggaagggaga

SEQ ID NO: 2103959 - RNA, 20 nt, Human
guggccuuccccagccucuu

SEQ ID NO: 2103960 - RNA, 20 nt, Human
guggcgacucuauagacucu

SEQ ID NO: 2103961 - RNA, 12 nt, Human
guggccuucccc

SEQ ID NO: 2103962 - RNA, 17 nt, Human
guggccuuccccagccu

SEQ ID NO: 2103963 - RNA, 15 nt, Human
guggccuuccccagc

SEQ ID NO: 2103964 - RNA, 19 nt, Human
guggccuuccccagccucu

SEQ ID NO: 2103965 - RNA, 14 nt, Human
guuaggaaauaaaa

SEQ ID NO: 2103966 - RNA, 15 nt, Human
guuagaaugaggagg

SEQ ID NO: 2103967 - RNA, 16 nt, Human
guuagaaugaggagga

SEQ ID NO: 2103968 - RNA, 13 nt, Human
guuagaacacuau

SEQ ID NO: 2103969 - RNA, 14 nt, Human
guuagaacacuauu

SEQ ID NO: 2103970 - RNA, 19 nt, Human
guuagaacacuauuuucag

SEQ ID NO: 2103971 - RNA, 20 nt, Human
guuagaacacuauuuucaga

SEQ ID NO: 2103972 - RNA, 21 nt, Human
guuagaacacuauuuucagaa

SEQ ID NO: 2103973 - RNA, 22 nt, Human
guuagaacacuauuuucagaau

SEQ ID NO: 2103974 - RNA, 15 nt, Human
guuagaaaugcaaau

SEQ ID NO: 2103975 - RNA, 14 nt, Human
guuagaaugaggag

SEQ ID NO: 2103976 - RNA, 16 nt, Human
guuaggaaauaaaacc

SEQ ID NO: 2103977 - RNA, 17 nt, Human
guuaggaaauaaaaccu

SEQ ID NO: 2103978 - RNA, 18 nt, Human
guuaggaaauaaaaccuu

SEQ ID NO: 2103979 - RNA, 19 nt, Human
guuaggaaauaaaaccuuu

SEQ ID NO: 2103980 - RNA, 21 nt, Human
guuaggaaauaaaaccuuuca

SEQ ID NO: 2103981 - RNA, 22 nt, Human
guuaggaaauaaaaccuuucaa

SEQ ID NO: 2103982 - RNA, 23 nt, Human
guuaggaaauaaaaccuuucaaa

SEQ ID NO: 2103983 - RNA, 15 nt, Human
guuaggaguucgaga

SEQ ID NO: 2103984 - RNA, 13 nt, Human
guuaggcugggcc

SEQ ID NO: 2103985 - RNA, 16 nt, Human
guuaggcugggcccag

SEQ ID NO: 2103986 - RNA, 18 nt, Human
guuaggcugggcccagag

SEQ ID NO: 2103987 - RNA, 14 nt, Human
guuaagcagccgcc

SEQ ID NO: 2103988 - RNA, 19 nt, Human
guuaagcagccgccacauc

SEQ ID NO: 2103989 - RNA, 15 nt, Human
guuaagauaugaugu

SEQ ID NO: 2103990 - RNA, 13 nt, Human
guuacuuccuauc

SEQ ID NO: 2103991 - RNA, 14 nt, Human
guucaaaaagucua

SEQ ID NO: 2103992 - RNA, 14 nt, Human
guucaaaaugucug

SEQ ID NO: 2103993 - RNA, 13 nt, Human
guucaaaaugucu

SEQ ID NO: 2103994 - RNA, 17 nt, Human
guucaagaccagccugg

SEQ ID NO: 2103995 - RNA, 18 nt, Human
guucaagaccagccuggc

SEQ ID NO: 2103996 - RNA, 18 nt, Human
guucaagcgauucuucug

SEQ ID NO: 2103997 - RNA, 16 nt, Human
guuauugacaaacucu

SEQ ID NO: 2103998 - RNA, 14 nt, Human
guuauuuuuauaca

SEQ ID NO: 2103999 - RNA, 15 nt, Human
guuauuuuuauacag

SEQ ID NO: 2104000 - RNA, 17 nt, Human
guuauuuuuauacagua

SEQ ID NO: 2104001 - RNA, 20 nt, Human
guuauuuuuauacaguagug

SEQ ID NO: 2104002 - RNA, 22 nt, Human
guuauuuuuguuucuuccaaag

SEQ ID NO: 2104003 - RNA, 23 nt, Human
guuauuuuuauuuauuuaaauuu

SEQ ID NO: 2104004 - RNA, 14 nt, Human
guuauugaaaaaaa

SEQ ID NO: 2104005 - RNA, 13 nt, Human
guuagggaauggc

SEQ ID NO: 2104006 - RNA, 14 nt, Human
guuagggaagagaa

SEQ ID NO: 2104007 - RNA, 15 nt, Human
guuagggaagagaaa

SEQ ID NO: 2104008 - RNA, 18 nt, Human
guuagggaagagaaacag

SEQ ID NO: 2104009 - RNA, 14 nt, Human
aagcuagagauaug

SEQ ID NO: 2104010 - RNA, 12 nt, Human
aagcuaggccug

SEQ ID NO: 2104011 - RNA, 15 nt, Human
aagccugaggcuggg

SEQ ID NO: 2104012 - RNA, 20 nt, Human
aagccuagaagagcuucuga

SEQ ID NO: 2104013 - RNA, 22 nt, Human
aagccucaacuagucauuuuuu

SEQ ID NO: 2104014 - RNA, 13 nt, Human
aagccucagagaa

SEQ ID NO: 2104015 - RNA, 18 nt, Human
aagccuauuguaaauaca

SEQ ID NO: 2104016 - RNA, 17 nt, Human
guucagccccuccucug

SEQ ID NO: 2104017 - RNA, 18 nt, Human
guucagccccuccucugc

SEQ ID NO: 2104018 - RNA, 19 nt, Human
guucagccccuccucugcc

SEQ ID NO: 2104019 - RNA, 20 nt, Human
guucagccccuccucugcca

SEQ ID NO: 2104020 - RNA, 21 nt, Human
guucagccccuccucugccac

SEQ ID NO: 2104021 - RNA, 22 nt, Human
guucagccccuccucugccacc

SEQ ID NO: 2104022 - RNA, 23 nt, Human
guucagccccuccucugccaccu

SEQ ID NO: 2104023 - RNA, 13 nt, Human
guucagcuccagc

SEQ ID NO: 2104024 - RNA, 15 nt, Human
guucagcuccagcuc

SEQ ID NO: 2104025 - RNA, 11 nt, Human
aagcucacagu

SEQ ID NO: 2104026 - RNA, 15 nt, Human
aagcucacaguuccu

SEQ ID NO: 2104027 - RNA, 15 nt, Human
aagcucagcccaccc

SEQ ID NO: 2104028 - RNA, 16 nt, Human
aagcucagcccacccc

SEQ ID NO: 2104029 - RNA, 21 nt, Human
aagcucagcccaccccccuca

SEQ ID NO: 2104030 - RNA, 17 nt, Human
aagcuauuuaucuguag

SEQ ID NO: 2104031 - RNA, 21 nt, Human
gugugugcgccuacaggagug

SEQ ID NO: 2104032 - RNA, 22 nt, Human
aagcagguugaggggcuccugg

SEQ ID NO: 2104033 - RNA, 16 nt, Human
aagcagucacuuuucc

SEQ ID NO: 2104034 - RNA, 17 nt, Human
aagcagucacuuuuccu

SEQ ID NO: 2104035 - RNA, 22 nt, Human
aagcaguagaaauaauaugcau

SEQ ID NO: 2104036 - RNA, 21 nt, Human
aagcaguagaaauaauaugca

SEQ ID NO: 2104037 - RNA, 14 nt, Human
aagcaguaaaaacu

SEQ ID NO: 2104038 - RNA, 22 nt, Human
aagcaguaaaaacuguucucua

SEQ ID NO: 2104039 - RNA, 20 nt, Human
aagcaguagaaauaauaugc

SEQ ID NO: 2104040 - RNA, 13 nt, Human
aagcaguaacuga

SEQ ID NO: 2104041 - RNA, 16 nt, Human
aagcagguuuuucucc

SEQ ID NO: 2104042 - RNA, 17 nt, Human
aagcaguggacaccagg

SEQ ID NO: 2104043 - RNA, 17 nt, Human
aagcagugccuuccaua

SEQ ID NO: 2104044 - RNA, 18 nt, Human
aagcagugccuuccauaa

SEQ ID NO: 2104045 - RNA, 20 nt, Human
aagcagugccuuccauaauu

SEQ ID NO: 2104046 - RNA, 22 nt, Human
aagcaucauuauuugcagagac

SEQ ID NO: 2104047 - RNA, 14 nt, Human
aagcauccaugugu

SEQ ID NO: 2104048 - RNA, 13 nt, Human
aagcauccaggca

SEQ ID NO: 2104049 - RNA, 12 nt, Human
aagcauccaugu

SEQ ID NO: 2104050 - RNA, 22 nt, Human
aagcauaaaugcaaacacacaa

SEQ ID NO: 2104051 - RNA, 15 nt, Human
aagcagugccuucca

SEQ ID NO: 2104052 - RNA, 18 nt, Human
aagcagucuacccaccuc

SEQ ID NO: 2104053 - RNA, 19 nt, Human
aagcagucuacccaccuca

SEQ ID NO: 2104054 - RNA, 12 nt, Human
aagcaucuaaac

SEQ ID NO: 2104055 - RNA, 13 nt, Human
aagcaucuaaacu

SEQ ID NO: 2104056 - RNA, 17 nt, Human
aagcaucuaaacuuuaa

SEQ ID NO: 2104057 - RNA, 20 nt, Human
aagcaucuaaacuuuaauau

SEQ ID NO: 2104058 - RNA, 18 nt, Human
aagcaucggagggaauug

SEQ ID NO: 2104059 - RNA, 17 nt, Human
aagcauccaugugugga

SEQ ID NO: 2104060 - RNA, 19 nt, Human
aagcauccauguguggacu

SEQ ID NO: 2104061 - RNA, 20 nt, Human
aagcauccauguguggacuc

SEQ ID NO: 2104062 - RNA, 21 nt, Human
aagcauccauguguggacuca

SEQ ID NO: 2104063 - RNA, 12 nt, Human
aagcaucuccug

SEQ ID NO: 2104064 - RNA, 16 nt, Human
aagcaucuccugagga

SEQ ID NO: 2104065 - RNA, 17 nt, Human
aagcaucuccugaggau

SEQ ID NO: 2104066 - RNA, 22 nt, Human
aagcauucaauuuauucaagaa

SEQ ID NO: 2104067 - RNA, 23 nt, Human
aagcauucaauuuauucaagaaa

SEQ ID NO: 2104068 - RNA, 16 nt, Human
aagcauuacucuugua

SEQ ID NO: 2104069 - RNA, 17 nt, Human
aagcauuacucuuguaa

SEQ ID NO: 2104070 - RNA, 18 nt, Human
aagcauuacucuuguaag

SEQ ID NO: 2104071 - RNA, 19 nt, Human
aagcauuacucuuguaaga

SEQ ID NO: 2104072 - RNA, 20 nt, Human
aagcauuacucuuguaagau

SEQ ID NO: 2104073 - RNA, 21 nt, Human
aagcauuacucuuguaagauu

SEQ ID NO: 2104074 - RNA, 22 nt, Human
aagcauuacucuuguaagauuu

SEQ ID NO: 2104075 - RNA, 23 nt, Human
aagcauuacucuuguaagauuuu

SEQ ID NO: 2104076 - RNA, 21 nt, Human
aagcauucaauuuauucaaga

SEQ ID NO: 2104077 - RNA, 16 nt, Human
aagcauuuacuuugug

SEQ ID NO: 2104078 - RNA, 22 nt, Human
aagcauuggguggguaaauuca

SEQ ID NO: 2104079 - RNA, 14 nt, Human
aagccaaacucugc

SEQ ID NO: 2104080 - RNA, 15 nt, Human
aagccaaacucugcc

SEQ ID NO: 2104081 - RNA, 16 nt, Human
aagccaaacucugcca

SEQ ID NO: 2104082 - RNA, 20 nt, Human
aagccaaacucugccagcca

SEQ ID NO: 2104083 - RNA, 22 nt, Human
aagccaaagcuaggccuggcca

SEQ ID NO: 2104084 - RNA, 16 nt, Human
aagccaacgacaaagc

SEQ ID NO: 2104085 - RNA, 17 nt, Human
aagccaacagucaaaac

SEQ ID NO: 2104086 - RNA, 12 nt, Human
aagccccaggca

SEQ ID NO: 2104087 - RNA, 14 nt, Human
aagccccaggcagg

SEQ ID NO: 2104088 - RNA, 17 nt, Human
aagccccaggcaggcug

SEQ ID NO: 2104089 - RNA, 21 nt, Human
aagccccaggcaggcugugcg

SEQ ID NO: 2104090 - RNA, 12 nt, Human
aagccccauccu

SEQ ID NO: 2104091 - RNA, 22 nt, Human
aagcccaucaauuauagaaagc

SEQ ID NO: 2104092 - RNA, 19 nt, Human
aagcccugagcuuucugcu

SEQ ID NO: 2104093 - RNA, 23 nt, Human
aagcccugauuguguauauucau

SEQ ID NO: 2104094 - RNA, 17 nt, Human
aagcccuaacucagcca

SEQ ID NO: 2104095 - RNA, 9 nt, Human
aagcccucc

SEQ ID NO: 2104096 - RNA, 11 nt, Human
aagcccuccuu

SEQ ID NO: 2104097 - RNA, 12 nt, Human
aagcccuccuuc

SEQ ID NO: 2104098 - RNA, 13 nt, Human
aagcccuccuucc

SEQ ID NO: 2104099 - RNA, 14 nt, Human
aagcccuccuucca

SEQ ID NO: 2104100 - RNA, 15 nt, Human
aagcccuccuuccac

SEQ ID NO: 2104101 - RNA, 21 nt, Human
aagccccuugcucuccccugc

SEQ ID NO: 2104102 - RNA, 20 nt, Human
aagcccuuccaugucgccuc

SEQ ID NO: 2104103 - RNA, 15 nt, Human
aagcccuuccauguc

SEQ ID NO: 2104104 - RNA, 23 nt, Human
aagcccuuccaugucgccucugc

SEQ ID NO: 2104105 - RNA, 15 nt, Human
aagccgccaggaccg

SEQ ID NO: 2104106 - RNA, 13 nt, Human
aagccgcugcugg

SEQ ID NO: 2104107 - RNA, 15 nt, Human
guuaagaaugucgau

SEQ ID NO: 2104108 - RNA, 13 nt, Human
aagccaagcagcc

SEQ ID NO: 2104109 - RNA, 14 nt, Human
aagccgggaacaga

SEQ ID NO: 2104110 - RNA, 18 nt, Human
aauagcgucauaacuaga

SEQ ID NO: 2104111 - RNA, 15 nt, Human
aauagcaugucacua

SEQ ID NO: 2104112 - RNA, 12 nt, Human
aauagcauguca

SEQ ID NO: 2104113 - RNA, 19 nt, Human
aauagcacuuucauugcca

SEQ ID NO: 2104114 - RNA, 20 nt, Human
aauagcacuuucauugccag

SEQ ID NO: 2104115 - RNA, 17 nt, Human
aauagcaacaugcuuca

SEQ ID NO: 2104116 - RNA, 14 nt, Human
aauagagacuguag

SEQ ID NO: 2104117 - RNA, 15 nt, Human
aauagagacuguaga

SEQ ID NO: 2104118 - RNA, 18 nt, Human
aauagagacuguagauug

SEQ ID NO: 2104119 - RNA, 18 nt, Human
aauagaguauaugcacuu

SEQ ID NO: 2104120 - RNA, 17 nt, Human
aauagaguauaugcacu

SEQ ID NO: 2104121 - RNA, 16 nt, Human
aauagaguauaugcac

SEQ ID NO: 2104122 - RNA, 15 nt, Human
aauagaguauaugca

SEQ ID NO: 2104123 - RNA, 12 nt, Human
aauacauucuug

SEQ ID NO: 2104124 - RNA, 21 nt, Human
aauacccaugucuacacagau

SEQ ID NO: 2104125 - RNA, 15 nt, Human
aauaccucuuugaaa

SEQ ID NO: 2104126 - RNA, 19 nt, Human
aauaccucuuugaaagaag

SEQ ID NO: 2104127 - RNA, 19 nt, Human
aauacagccaaagauaauc

SEQ ID NO: 2104128 - RNA, 24 nt, Human
aauacagccaaagauaaucucuca

SEQ ID NO: 2104129 - RNA, 13 nt, Human
aauacaugcaucu

SEQ ID NO: 2104130 - RNA, 15 nt, Human
aauacauucugcuuu

SEQ ID NO: 2104131 - RNA, 13 nt, Human
aauacauuaaagc

SEQ ID NO: 2104132 - RNA, 14 nt, Human
aauacauuaaagca

SEQ ID NO: 2104133 - RNA, 15 nt, Human
aauacauuaaagcag

SEQ ID NO: 2104134 - RNA, 16 nt, Human
aauacauuaaagcagu

SEQ ID NO: 2104135 - RNA, 17 nt, Human
aauacauuaaagcaguc

SEQ ID NO: 2104136 - RNA, 16 nt, Human
aauacagggcaugcau

SEQ ID NO: 2104137 - RNA, 23 nt, Human
aauacagggcaugcauuuugcag

SEQ ID NO: 2104138 - RNA, 12 nt, Human
aauacauuuuau

SEQ ID NO: 2104139 - RNA, 20 nt, Human
aauaccaaaauuauuucaga

SEQ ID NO: 2104140 - RNA, 17 nt, Human
aaguguauuauaacagu

SEQ ID NO: 2104141 - RNA, 13 nt, Human
uaaaugugguaaa

SEQ ID NO: 2104142 - RNA, 21 nt, Human
uaaaugaaguaacuugucuua

SEQ ID NO: 2104143 - RNA, 22 nt, Human
uaaaugaaguaacuugucuuaa

SEQ ID NO: 2104144 - RNA, 18 nt, Human
uaaaugaaguuuauacag

SEQ ID NO: 2104145 - RNA, 20 nt, Human
uaaaugaaguuuauacagua

SEQ ID NO: 2104146 - RNA, 23 nt, Human
uaaaugaaguuuauacaguacag

SEQ ID NO: 2104147 - RNA, 17 nt, Human
uaaauguuaccaaaaau

SEQ ID NO: 2104148 - RNA, 18 nt, Human
uaaaugaaaaucgugaca

SEQ ID NO: 2104149 - RNA, 19 nt, Human
aaguguauuuuauaaaauu

SEQ ID NO: 2104150 - RNA, 20 nt, Human
aaguguauuuuauaaaauua

SEQ ID NO: 2104151 - RNA, 21 nt, Human
aaguguauuuuauaaaauuaa

SEQ ID NO: 2104152 - RNA, 22 nt, Human
aaguguauuuuauaaaauuaaa

SEQ ID NO: 2104153 - RNA, 18 nt, Human
aaguguaugcacgugugc

SEQ ID NO: 2104154 - RNA, 20 nt, Human
uaacaaaaucacuuccauag

SEQ ID NO: 2104155 - RNA, 20 nt, Human
uaaauuauuaugacaccuuu

SEQ ID NO: 2104156 - RNA, 12 nt, Human
uaaauuauucag

SEQ ID NO: 2104157 - RNA, 14 nt, Human
uaaauuauucaguu

SEQ ID NO: 2104158 - RNA, 17 nt, Human
uaaauuauucaguuaag

SEQ ID NO: 2104159 - RNA, 21 nt, Human
uaaauuauucaguuaagaaaa

SEQ ID NO: 2104160 - RNA, 22 nt, Human
uaaauuauucaguuaagaaaaa

SEQ ID NO: 2104161 - RNA, 20 nt, Human
uaacaaacccucguuucuga

SEQ ID NO: 2104162 - RNA, 21 nt, Human
uaacaaacccucguuucugau

SEQ ID NO: 2104163 - RNA, 23 nt, Human
uaacaaacccucguuucugauua

SEQ ID NO: 2104164 - RNA, 13 nt, Human
uaaauuauaagga

SEQ ID NO: 2104165 - RNA, 15 nt, Human
uaaauuauaaggacu

SEQ ID NO: 2104166 - RNA, 16 nt, Human
uaaauuauaaggacug

SEQ ID NO: 2104167 - RNA, 17 nt, Human
uaaauuauaaggacugc

SEQ ID NO: 2104168 - RNA, 19 nt, Human
uaaauuauaaggacugcau

SEQ ID NO: 2104169 - RNA, 20 nt, Human
uaaauuauaaggacugcaug

SEQ ID NO: 2104170 - RNA, 21 nt, Human
uaaauuauaaggacugcaugg

SEQ ID NO: 2104171 - RNA, 16 nt, Human
uaaauuauacuggaga

SEQ ID NO: 2104172 - RNA, 22 nt, Human
uaaauuauaacuuaaaauauuu

SEQ ID NO: 2104173 - RNA, 16 nt, Human
uaacaauaacuacugu

SEQ ID NO: 2104174 - RNA, 17 nt, Human
uaacaauaacuacugug

SEQ ID NO: 2104175 - RNA, 18 nt, Human
uaacaauaacuacugugu

SEQ ID NO: 2104176 - RNA, 23 nt, Human
uaacaauaacuacuguguuccug

SEQ ID NO: 2104177 - RNA, 19 nt, Human
uaacaauaacuacuguguu

SEQ ID NO: 2104178 - RNA, 21 nt, Human
uaacaauaacuacuguguucc

SEQ ID NO: 2104179 - RNA, 13 nt, Human
aauacagaggcaa

SEQ ID NO: 2104180 - RNA, 19 nt, Human
aauacagaaauuagccggg

SEQ ID NO: 2104181 - RNA, 21 nt, Human
aauacaccagguagaacacaa

SEQ ID NO: 2104182 - RNA, 17 nt, Human
uaacaaugcgaauggua

SEQ ID NO: 2104183 - RNA, 16 nt, Human
aauacacgagguauga

SEQ ID NO: 2104184 - RNA, 21 nt, Human
aauagcuauauccauguacug

SEQ ID NO: 2104185 - RNA, 13 nt, Human
aauagucugugug

SEQ ID NO: 2104186 - RNA, 14 nt, Human
aauagucuguguga

SEQ ID NO: 2104187 - RNA, 15 nt, Human
aauagucugugugaa

SEQ ID NO: 2104188 - RNA, 21 nt, Human
aauaguguguucugauuagaa

SEQ ID NO: 2104189 - RNA, 20 nt, Human
aauagugcuuaaaaaucauu

SEQ ID NO: 2104190 - RNA, 16 nt, Human
aauaguggccagacca

SEQ ID NO: 2104191 - RNA, 22 nt, Human
aauaguguguucugauuagaaa

SEQ ID NO: 2104192 - RNA, 23 nt, Human
aauaguguguucugauuagaaau

SEQ ID NO: 2104193 - RNA, 15 nt, Human
aauagcuauauccau

SEQ ID NO: 2104194 - RNA, 17 nt, Human
aauagcuauauccaugu

SEQ ID NO: 2104195 - RNA, 18 nt, Human
aauagcuauauccaugua

SEQ ID NO: 2104196 - RNA, 20 nt, Human
aauagcuauauccauguacu

SEQ ID NO: 2104197 - RNA, 22 nt, Human
aauaguucaaagccaaguuuau

SEQ ID NO: 2104198 - RNA, 14 nt, Human
aauauauucucuuu

SEQ ID NO: 2104199 - RNA, 16 nt, Human
aauauauucucuuugg

SEQ ID NO: 2104200 - RNA, 17 nt, Human
aauauauucucuuuggu

SEQ ID NO: 2104201 - RNA, 21 nt, Human
aauaguucagguaacaggcag

SEQ ID NO: 2104202 - RNA, 19 nt, Human
uaacauguaauuaaguacu

SEQ ID NO: 2104203 - RNA, 15 nt, Human
uaacauguaucccaa

SEQ ID NO: 2104204 - RNA, 15 nt, Human
uaacagucuuacugc

SEQ ID NO: 2104205 - RNA, 15 nt, Human
aauauauuucagaua

SEQ ID NO: 2104206 - RNA, 15 nt, Human
uaacagggccuugcu

SEQ ID NO: 2104207 - RNA, 16 nt, Human
uaacagggccuugcua

SEQ ID NO: 2104208 - RNA, 17 nt, Human
uaacagggccuugcuaa

SEQ ID NO: 2104209 - RNA, 18 nt, Human
uaacagggccuugcuaau

SEQ ID NO: 2104210 - RNA, 14 nt, Human
uaacaggggcuggu

SEQ ID NO: 2104211 - RNA, 15 nt, Human
uaacaggguaaauua

SEQ ID NO: 2104212 - RNA, 18 nt, Human
uaacaggguaaauuauuc

SEQ ID NO: 2104213 - RNA, 19 nt, Human
uaacaggguaaauuauuca

SEQ ID NO: 2104214 - RNA, 20 nt, Human
uaacaggguaaauuauucag

SEQ ID NO: 2104215 - RNA, 13 nt, Human
uaacaggucuccu

SEQ ID NO: 2104216 - RNA, 14 nt, Human
uaacaggucuccuc

SEQ ID NO: 2104217 - RNA, 15 nt, Human
uaacaggucuccucu

SEQ ID NO: 2104218 - RNA, 16 nt, Human
uaacaggucuccucuu

SEQ ID NO: 2104219 - RNA, 18 nt, Human
uaacaggucuccucuuaa

SEQ ID NO: 2104220 - RNA, 19 nt, Human
uaacaggucuccucuuaaa

SEQ ID NO: 2104221 - RNA, 15 nt, Human
uaacguaaauacaca

SEQ ID NO: 2104222 - RNA, 15 nt, Human
uaacuuagcaugugu

SEQ ID NO: 2104223 - RNA, 20 nt, Human
uaacuucccugaaaaaucua

SEQ ID NO: 2104224 - RNA, 14 nt, Human
uaacuauguacaau

SEQ ID NO: 2104225 - RNA, 17 nt, Human
uaacuauguacaauauu

SEQ ID NO: 2104226 - RNA, 18 nt, Human
uaacuauguacaauauuu

SEQ ID NO: 2104227 - RNA, 22 nt, Human
uaacuauguacaauauuuuaag

SEQ ID NO: 2104228 - RNA, 15 nt, Human
uaacuagcuuggaaa

SEQ ID NO: 2104229 - RNA, 17 nt, Human
uaacuaguccuuuacua

SEQ ID NO: 2104230 - RNA, 17 nt, Human
uaacuaguguugcuugg

SEQ ID NO: 2104231 - RNA, 15 nt, Human
uaacuugguuauaca

SEQ ID NO: 2104232 - RNA, 16 nt, Human
uaacuugguuauacau

SEQ ID NO: 2104233 - RNA, 19 nt, Human
uaacuugguuauacaugac

SEQ ID NO: 2104234 - RNA, 20 nt, Human
uaacuugguuauacaugaca

SEQ ID NO: 2104235 - RNA, 22 nt, Human
uaacuugguuauacaugacacu

SEQ ID NO: 2104236 - RNA, 13 nt, Human
uaacuugucuuaa

SEQ ID NO: 2104237 - RNA, 14 nt, Human
uaacuugucuuaaa

SEQ ID NO: 2104238 - RNA, 17 nt, Human
uaacuugucuuaaauaa

SEQ ID NO: 2104239 - RNA, 21 nt, Human
uaacuucccugaaaaaucuaa

SEQ ID NO: 2104240 - RNA, 23 nt, Human
uaacuucugauagcguuggaauu

SEQ ID NO: 2104241 - RNA, 15 nt, Human
aaucacguaaagcua

SEQ ID NO: 2104242 - RNA, 21 nt, Human
aaucacguaaagcuagaaaug

SEQ ID NO: 2104243 - RNA, 20 nt, Human
aaucacguaaagcuagaaau

SEQ ID NO: 2104244 - RNA, 20 nt, Human
aauauuuauuauuuucaccu

SEQ ID NO: 2104245 - RNA, 19 nt, Human
aauauuuauuauuuucacc

SEQ ID NO: 2104246 - RNA, 14 nt, Human
aauauuuauuguau

SEQ ID NO: 2104247 - RNA, 15 nt, Human
uaagacuguguauuc

SEQ ID NO: 2104248 - RNA, 12 nt, Human
aauauuuauaac

SEQ ID NO: 2104249 - RNA, 17 nt, Human
aauauuuauaacagcau

SEQ ID NO: 2104250 - RNA, 14 nt, Human
aauauuuauauuuc

SEQ ID NO: 2104251 - RNA, 17 nt, Human
aauauuuauauuucacu

SEQ ID NO: 2104252 - RNA, 18 nt, Human
aauauuuauauuucacua

SEQ ID NO: 2104253 - RNA, 17 nt, Human
uaagacuaaaucuguaa

SEQ ID NO: 2104254 - RNA, 18 nt, Human
uaagacuaaaucuguaag

SEQ ID NO: 2104255 - RNA, 23 nt, Human
uaagacuaaaucuguaagcucuu

SEQ ID NO: 2104256 - RNA, 21 nt, Human
uaagacucugucucaaaaaua

SEQ ID NO: 2104257 - RNA, 15 nt, Human
aauauuuauguaaac

SEQ ID NO: 2104258 - RNA, 12 nt, Human
aauauuuauuau

SEQ ID NO: 2104259 - RNA, 18 nt, Human
aauauuuauuaccucuga

SEQ ID NO: 2104260 - RNA, 17 nt, Human
aauauuuauuaccucug

SEQ ID NO: 2104261 - RNA, 16 nt, Human
aauauuuauuaccucu

SEQ ID NO: 2104262 - RNA, 15 nt, Human
aauauuuauuaccuc

SEQ ID NO: 2104263 - RNA, 14 nt, Human
aauauuuauuaccu

SEQ ID NO: 2104264 - RNA, 13 nt, Human
aauauuuauuacc

SEQ ID NO: 2104265 - RNA, 12 nt, Human
aauauuuauuac

SEQ ID NO: 2104266 - RNA, 23 nt, Human
aaucagcuauuuacugccaaagg

SEQ ID NO: 2104267 - RNA, 19 nt, Human
aaucagccugcuccagcug

SEQ ID NO: 2104268 - RNA, 13 nt, Human
aaucagccugcuc

SEQ ID NO: 2104269 - RNA, 18 nt, Human
aaucagccugcuccagcu

SEQ ID NO: 2104270 - RNA, 15 nt, Human
aaucacuaacauuau

SEQ ID NO: 2104271 - RNA, 16 nt, Human
aaucacuaacauuaua

SEQ ID NO: 2104272 - RNA, 22 nt, Human
aaucacuaacauuauauugcaa

SEQ ID NO: 2104273 - RNA, 12 nt, Human
aaucagcauucu

SEQ ID NO: 2104274 - RNA, 19 nt, Human
aaucagcauucucacuccu

SEQ ID NO: 2104275 - RNA, 18 nt, Human
aaucagcauucucacucc

SEQ ID NO: 2104276 - RNA, 11 nt, Human
aaucagccugc

SEQ ID NO: 2104277 - RNA, 17 nt, Human
aaucagccuacaggccu

SEQ ID NO: 2104278 - RNA, 23 nt, Human
aaucagccuaggggucagggacc

SEQ ID NO: 2104279 - RNA, 12 nt, Human
aaucagccucuu

SEQ ID NO: 2104280 - RNA, 16 nt, Human
aaucagccucuuaaag

SEQ ID NO: 2104281 - RNA, 10 nt, Human
uaaggacugc

SEQ ID NO: 2104282 - RNA, 12 nt, Human
uaaggacugcau

SEQ ID NO: 2104283 - RNA, 13 nt, Human
uaaggacugcaug

SEQ ID NO: 2104284 - RNA, 14 nt, Human
uaaggacugcaugg

SEQ ID NO: 2104285 - RNA, 21 nt, Human
uaaggacugcaugguaauuua

SEQ ID NO: 2104286 - RNA, 20 nt, Human
uaaggaagaucacuuugcuc

SEQ ID NO: 2104287 - RNA, 14 nt, Human
uaaggacaggcagg

SEQ ID NO: 2104288 - RNA, 18 nt, Human
uaaggacauuucccaggg

SEQ ID NO: 2104289 - RNA, 19 nt, Human
uaaggaauguagcugguuu

SEQ ID NO: 2104290 - RNA, 13 nt, Human
uaaggaagaaaaa

SEQ ID NO: 2104291 - RNA, 14 nt, Human
uaaggaagaaaaau

SEQ ID NO: 2104292 - RNA, 16 nt, Human
uaaggaaagcaauaaa

SEQ ID NO: 2104293 - RNA, 18 nt, Human
uaaggaaagcaauaaaug

SEQ ID NO: 2104294 - RNA, 21 nt, Human
uaaggaaagcaauaaaugaau

SEQ ID NO: 2104295 - RNA, 13 nt, Human
uaaggaagacaau

SEQ ID NO: 2104296 - RNA, 14 nt, Human
uaagcucuuugaaa

SEQ ID NO: 2104297 - RNA, 17 nt, Human
uaagcucuuugaaacaa

SEQ ID NO: 2104298 - RNA, 21 nt, Human
uaagcucuuugaaacaacuuu

SEQ ID NO: 2104299 - RNA, 17 nt, Human
uaagauguucacugugg

SEQ ID NO: 2104300 - RNA, 20 nt, Human
uaagaugugucuucaauuug

SEQ ID NO: 2104301 - RNA, 16 nt, Human
aaucaguguagcccca

SEQ ID NO: 2104302 - RNA, 17 nt, Human
aaucaguguagccccaa

SEQ ID NO: 2104303 - RNA, 21 nt, Human
aaucaguguagccccaagaag

SEQ ID NO: 2104304 - RNA, 14 nt, Human
uaagauucauauuu

SEQ ID NO: 2104305 - RNA, 15 nt, Human
uaagcaguaaaaacu

SEQ ID NO: 2104306 - RNA, 21 nt, Human
uaagcagauuuaacaauucca

SEQ ID NO: 2104307 - RNA, 21 nt, Human
uaagcuauucaguaauaacuc

SEQ ID NO: 2104308 - RNA, 20 nt, Human
uaagcucaaggcgugaggau

SEQ ID NO: 2104309 - RNA, 21 nt, Human
uaaguuacacauuuuucagau

SEQ ID NO: 2104310 - RNA, 14 nt, Human
uaaguguuguaaau

SEQ ID NO: 2104311 - RNA, 19 nt, Human
uaaguuacuauccuggcuu

SEQ ID NO: 2104312 - RNA, 23 nt, Human
uaaguauuuauauauuuauaacu

SEQ ID NO: 2104313 - RNA, 19 nt, Human
uaaguauuucagaugcuuu

SEQ ID NO: 2104314 - RNA, 20 nt, Human
uaaguauuucagaugcuuua

SEQ ID NO: 2104315 - RNA, 21 nt, Human
uaaguauuucagaugcuuuag

SEQ ID NO: 2104316 - RNA, 21 nt, Human
uaagugugaguaagagcuggu

SEQ ID NO: 2104317 - RNA, 21 nt, Human
uaaguauucuuauuuaaugaa

SEQ ID NO: 2104318 - RNA, 18 nt, Human
uaaguaccacucaggcca

SEQ ID NO: 2104319 - RNA, 13 nt, Human
uaaguauuuauau

SEQ ID NO: 2104320 - RNA, 14 nt, Human
uaaguauuuauaua

SEQ ID NO: 2104321 - RNA, 15 nt, Human
uaaguauuuauauau

SEQ ID NO: 2104322 - RNA, 17 nt, Human
uaaguauuuauauauuu

SEQ ID NO: 2104323 - RNA, 18 nt, Human
uaaguauuuauauauuua

SEQ ID NO: 2104324 - RNA, 19 nt, Human
uaaguauuuauauauuuau

SEQ ID NO: 2104325 - RNA, 17 nt, Human
uaaguuucaguugauuu

SEQ ID NO: 2104326 - RNA, 14 nt, Human
uaauaaaaaggcac

SEQ ID NO: 2104327 - RNA, 16 nt, Human
uaaggagaugggccuu

SEQ ID NO: 2104328 - RNA, 19 nt, Human
uaaggagauguaagagcuu

SEQ ID NO: 2104329 - RNA, 19 nt, Human
uaaggaucagaacagcaga

SEQ ID NO: 2104330 - RNA, 17 nt, Human
uaaggauacuuuacaug

SEQ ID NO: 2104331 - RNA, 23 nt, Human
uaaguaauuaucgggaacagugu

SEQ ID NO: 2104332 - RNA, 21 nt, Human
uaaguaauuaucgggaacagu

SEQ ID NO: 2104333 - RNA, 17 nt, Human
uaaguaccacucaggcc

SEQ ID NO: 2104334 - RNA, 18 nt, Human
aaucccagcuacucagga

SEQ ID NO: 2104335 - RNA, 17 nt, Human
aaucccauuuaaaaaaa

SEQ ID NO: 2104336 - RNA, 17 nt, Human
aaucauaaacugugugc

SEQ ID NO: 2104337 - RNA, 18 nt, Human
aaucauaaacugugugca

SEQ ID NO: 2104338 - RNA, 13 nt, Human
uaauaaaaaggca

SEQ ID NO: 2104339 - RNA, 21 nt, Human
aaucaguugcgcguucugaaa

SEQ ID NO: 2104340 - RNA, 16 nt, Human
aaucccgauucacccu

SEQ ID NO: 2104341 - RNA, 12 nt, Human
aaucccuguuca

SEQ ID NO: 2104342 - RNA, 14 nt, Human
aaucccuguucauu

SEQ ID NO: 2104343 - RNA, 17 nt, Human
aaucccuguucauugua

SEQ ID NO: 2104344 - RNA, 17 nt, Human
aaucccugggcauugcu

SEQ ID NO: 2104345 - RNA, 19 nt, Human
aaucccugggcauugcuuu

SEQ ID NO: 2104346 - RNA, 21 nt, Human
aaucccugggcauugcuuucc

SEQ ID NO: 2104347 - RNA, 18 nt, Human
aaucccauucauaacuuu

SEQ ID NO: 2104348 - RNA, 20 nt, Human
aaucccauucauaacuuuca

SEQ ID NO: 2104349 - RNA, 14 nt, Human
aauccccucauuca

SEQ ID NO: 2104350 - RNA, 19 nt, Human
aauccccucauucaggaaa

SEQ ID NO: 2104351 - RNA, 13 nt, Human
aaucucaaauaac

SEQ ID NO: 2104352 - RNA, 16 nt, Human
aaucuauuuauuggac

SEQ ID NO: 2104353 - RNA, 22 nt, Human
aaucuauuuauuggacaugucc

SEQ ID NO: 2104354 - RNA, 23 nt, Human
aaucuauuuauuggacaugucca

SEQ ID NO: 2104355 - RNA, 18 nt, Human
aaucuauuggguucauua

SEQ ID NO: 2104356 - RNA, 19 nt, Human
aaucuauuggguucauuau

SEQ ID NO: 2104357 - RNA, 19 nt, Human
aaucuauugggauuuucua

SEQ ID NO: 2104358 - RNA, 21 nt, Human
aaucuauugggauuuucuaca

SEQ ID NO: 2104359 - RNA, 15 nt, Human
aaucuauuggguuca

SEQ ID NO: 2104360 - RNA, 16 nt, Human
aaucuauuggguucau

SEQ ID NO: 2104361 - RNA, 17 nt, Human
aaucuauuggguucauu

SEQ ID NO: 2104362 - RNA, 15 nt, Human
aauccuccugaguga

SEQ ID NO: 2104363 - RNA, 23 nt, Human
aauccuccugagugaucccauuu

SEQ ID NO: 2104364 - RNA, 11 nt, Human
aauccucuggc

SEQ ID NO: 2104365 - RNA, 22 nt, Human
aaucggaucuggggcucuggga

SEQ ID NO: 2104366 - RNA, 21 nt, Human
aaucggaucuggggcucuggg

SEQ ID NO: 2104367 - RNA, 22 nt, Human
aaucggcccacagcucccaccc

SEQ ID NO: 2104368 - RNA, 18 nt, Human
aaucggcccacagcuccc

SEQ ID NO: 2104369 - RNA, 23 nt, Human
aaucggaucuggggcucugggau

SEQ ID NO: 2104370 - RNA, 15 nt, Human
aaucguuaugugugu

SEQ ID NO: 2104371 - RNA, 16 nt, Human
aaucguuaugugugua

SEQ ID NO: 2104372 - RNA, 17 nt, Human
aaucguuauguguguau

SEQ ID NO: 2104373 - RNA, 18 nt, Human
aaucguuauguguguaua

SEQ ID NO: 2104374 - RNA, 14 nt, Human
aaucuaaaagcuuu

SEQ ID NO: 2104375 - RNA, 18 nt, Human
aaugcugguuuuucaguu

SEQ ID NO: 2104376 - RNA, 17 nt, Human
aaugcugucaacuauga

SEQ ID NO: 2104377 - RNA, 19 nt, Human
aaugcugguuuuccuaaau

SEQ ID NO: 2104378 - RNA, 21 nt, Human
aaugcugguuuuccuaaaugc

SEQ ID NO: 2104379 - RNA, 22 nt, Human
aaugcugguuuuccuaaaugca

SEQ ID NO: 2104380 - RNA, 23 nt, Human
aaugcugguuuuccuaaaugcag

SEQ ID NO: 2104381 - RNA, 17 nt, Human
aaugcuucugacuucau

SEQ ID NO: 2104382 - RNA, 21 nt, Human
aaugcuucugacuucauagau

SEQ ID NO: 2104383 - RNA, 12 nt, Human
aaugcuuggaau

SEQ ID NO: 2104384 - RNA, 19 nt, Human
aaugcuuggaauaucugcu

SEQ ID NO: 2104385 - RNA, 21 nt, Human
aaugcuuggaauaucugcugu

SEQ ID NO: 2104386 - RNA, 22 nt, Human
aaugcuuggaauaucugcugua

SEQ ID NO: 2104387 - RNA, 23 nt, Human
aaugcuuggaauaucugcuguau

SEQ ID NO: 2104388 - RNA, 15 nt, Human
aaugcugguuuuccu

SEQ ID NO: 2104389 - RNA, 18 nt, Human
aaugcugguuuuccuaaa

SEQ ID NO: 2104390 - RNA, 18 nt, Human
aaugcauguuaggaaaau

SEQ ID NO: 2104391 - RNA, 22 nt, Human
aaugcuggcuguuggcuggggg

SEQ ID NO: 2104392 - RNA, 21 nt, Human
aaugcuggcuguuggcugggg

SEQ ID NO: 2104393 - RNA, 23 nt, Human
aaugcauccauuccucagggaca

SEQ ID NO: 2104394 - RNA, 19 nt, Human
aaugcauccauuccucagg

SEQ ID NO: 2104395 - RNA, 15 nt, Human
aaugcaucaauccug

SEQ ID NO: 2104396 - RNA, 20 nt, Human
aaugcaucaauccugugugg

SEQ ID NO: 2104397 - RNA, 21 nt, Human
aaugcaucaauccuguguggu

SEQ ID NO: 2104398 - RNA, 18 nt, Human
uaauuuuuuugagacaga

SEQ ID NO: 2104399 - RNA, 22 nt, Human
uaauuuuuuucaauauuuauua

SEQ ID NO: 2104400 - RNA, 16 nt, Human
uaauuuaacccagcuc

SEQ ID NO: 2104401 - RNA, 22 nt, Human
uaauuuuuuuuuuccuuuuaaa

SEQ ID NO: 2104402 - RNA, 17 nt, Human
uaauuuuucacuucaaa

SEQ ID NO: 2104403 - RNA, 15 nt, Human
uacaauuauaucagu

SEQ ID NO: 2104404 - RNA, 19 nt, Human
uacaauuauaucaguccuc

SEQ ID NO: 2104405 - RNA, 18 nt, Human
uacaauucuacauuguca

SEQ ID NO: 2104406 - RNA, 13 nt, Human
uacaauugaaaug

SEQ ID NO: 2104407 - RNA, 14 nt, Human
uacaauugaaauga

SEQ ID NO: 2104408 - RNA, 16 nt, Human
uacaauugaaaugacu

SEQ ID NO: 2104409 - RNA, 19 nt, Human
aaugcauauccugagccau

SEQ ID NO: 2104410 - RNA, 18 nt, Human
uacaauuauuuuuacagu

SEQ ID NO: 2104411 - RNA, 22 nt, Human
uacaauuauuuuuacaguucuc

SEQ ID NO: 2104412 - RNA, 16 nt, Human
aauguaauugaauaaa

SEQ ID NO: 2104413 - RNA, 14 nt, Human
aauguaauuugugu

SEQ ID NO: 2104414 - RNA, 16 nt, Human
aauguaauuuguguaa

SEQ ID NO: 2104415 - RNA, 17 nt, Human
aauguaauuuguguaau

SEQ ID NO: 2104416 - RNA, 14 nt, Human
aauguaauugaaua

SEQ ID NO: 2104417 - RNA, 17 nt, Human
uacaccgggccuggaga

SEQ ID NO: 2104418 - RNA, 15 nt, Human
uacaccgggccugga

SEQ ID NO: 2104419 - RNA, 16 nt, Human
uacagagaggagaaac

SEQ ID NO: 2104420 - RNA, 17 nt, Human
uacagagaggagaaaca

SEQ ID NO: 2104421 - RNA, 18 nt, Human
uacagagaggagaaacac

SEQ ID NO: 2104422 - RNA, 20 nt, Human
uacagagaggagaaacacau

SEQ ID NO: 2104423 - RNA, 21 nt, Human
uacagagaggagaaacacauc

SEQ ID NO: 2104424 - RNA, 22 nt, Human
uacagagaggagaaacacaucu

SEQ ID NO: 2104425 - RNA, 13 nt, Human
uacagagaaggaa

SEQ ID NO: 2104426 - RNA, 14 nt, Human
uacagagaaggaau

SEQ ID NO: 2104427 - RNA, 23 nt, Human
uacagagaaggaaugucuuuggu

SEQ ID NO: 2104428 - RNA, 17 nt, Human
aauguaaguaaaugucu

SEQ ID NO: 2104429 - RNA, 19 nt, Human
aauguaaguaaaugucugu

SEQ ID NO: 2104430 - RNA, 22 nt, Human
aauguaaauaaaggauuucuag

SEQ ID NO: 2104431 - RNA, 16 nt, Human
aaugguuuucaaaaua

SEQ ID NO: 2104432 - RNA, 15 nt, Human
aauguaaagacaaaa

SEQ ID NO: 2104433 - RNA, 20 nt, Human
aauggauccccagugaaaac

SEQ ID NO: 2104434 - RNA, 22 nt, Human
aauggauccccagugaaaacua

SEQ ID NO: 2104435 - RNA, 14 nt, Human
aaugguuuucaaaa

SEQ ID NO: 2104436 - RNA, 17 nt, Human
aaugguuugcaaggaag

SEQ ID NO: 2104437 - RNA, 18 nt, Human
aaugguuugcaaggaagc

SEQ ID NO: 2104438 - RNA, 19 nt, Human
aaugguuugcaaggaagcc

SEQ ID NO: 2104439 - RNA, 19 nt, Human
aauggagucaguuugcagu

SEQ ID NO: 2104440 - RNA, 19 nt, Human
aauggaguagaccccuggc

SEQ ID NO: 2104441 - RNA, 21 nt, Human
aauggaguagaccccuggcug

SEQ ID NO: 2104442 - RNA, 23 nt, Human
aauggaguagaccccuggcuggu

SEQ ID NO: 2104443 - RNA, 20 nt, Human
aaugagaaaaugucuuuauu

SEQ ID NO: 2104444 - RNA, 17 nt, Human
aaugacuaaaaaacaaa

SEQ ID NO: 2104445 - RNA, 20 nt, Human
aaugacuaaaaaacaaagaa

SEQ ID NO: 2104446 - RNA, 17 nt, Human
aaugacuaaaaauauua

SEQ ID NO: 2104447 - RNA, 24 nt, Human
aaugacuaaaaauauuauaacuua

SEQ ID NO: 2104448 - RNA, 18 nt, Human
aaucuguaagcucuuuga

SEQ ID NO: 2104449 - RNA, 17 nt, Human
aaugagaacauguuggu

SEQ ID NO: 2104450 - RNA, 21 nt, Human
aaugagaacauguugguauuu

SEQ ID NO: 2104451 - RNA, 17 nt, Human
aaugagaaggaauuuga

SEQ ID NO: 2104452 - RNA, 11 nt, Human
aaugagccugg

SEQ ID NO: 2104453 - RNA, 17 nt, Human
aaugagaucccgccucu

SEQ ID NO: 2104454 - RNA, 21 nt, Human
aaugagauagaagauguuugc

SEQ ID NO: 2104455 - RNA, 16 nt, Human
aaugagauaguagcau

SEQ ID NO: 2104456 - RNA, 18 nt, Human
aaugaggucagagccugc

SEQ ID NO: 2104457 - RNA, 16 nt, Human
aaugaggucagagccu

SEQ ID NO: 2104458 - RNA, 15 nt, Human
aaugaggucccaggc

SEQ ID NO: 2104459 - RNA, 16 nt, Human
aaugaggucccaggca

SEQ ID NO: 2104460 - RNA, 14 nt, Human
aaugagggccaaga

SEQ ID NO: 2104461 - RNA, 16 nt, Human
aaugaggucugaaaug

SEQ ID NO: 2104462 - RNA, 18 nt, Human
aaugagggccaagaaaga

SEQ ID NO: 2104463 - RNA, 14 nt, Human
aaugagccuggcaa

SEQ ID NO: 2104464 - RNA, 12 nt, Human
aaugaggaggaa

SEQ ID NO: 2104465 - RNA, 18 nt, Human
aaugaggaggaaggagag

SEQ ID NO: 2104466 - RNA, 12 nt, Human
aaugagccuggc

SEQ ID NO: 2104467 - RNA, 13 nt, Human
aaugagccuggca

SEQ ID NO: 2104468 - RNA, 15 nt, Human
aaugaguuucuuuua

SEQ ID NO: 2104469 - RNA, 21 nt, Human
aaugaguuuuuauggggcuga

SEQ ID NO: 2104470 - RNA, 19 nt, Human
aaugaggucugaaauggag

SEQ ID NO: 2104471 - RNA, 19 nt, Human
aaugaguuaccuacauuuu

SEQ ID NO: 2104472 - RNA, 14 nt, Human
uaauuauguuauug

SEQ ID NO: 2104473 - RNA, 15 nt, Human
uaauuauguuauuga

SEQ ID NO: 2104474 - RNA, 19 nt, Human
uaauuauguuauugaaaaa

SEQ ID NO: 2104475 - RNA, 20 nt, Human
aaugcaaacacacaaaggua

SEQ ID NO: 2104476 - RNA, 14 nt, Human
aaugcacaaugucu

SEQ ID NO: 2104477 - RNA, 15 nt, Human
aaugcacaaugucuu

SEQ ID NO: 2104478 - RNA, 16 nt, Human
aaugcacaaugucuug

SEQ ID NO: 2104479 - RNA, 17 nt, Human
aaugcacaaugucuugg

SEQ ID NO: 2104480 - RNA, 19 nt, Human
aaugcacaaugucuuggua

SEQ ID NO: 2104481 - RNA, 13 nt, Human
aaugcacacuagc

SEQ ID NO: 2104482 - RNA, 17 nt, Human
aaugcacacuagccucu

SEQ ID NO: 2104483 - RNA, 20 nt, Human
aaugauuuccaaagagaaaa

SEQ ID NO: 2104484 - RNA, 18 nt, Human
aaugauuuccaaagagaa

SEQ ID NO: 2104485 - RNA, 21 nt, Human
aaugauuuuacuuagcaaugu

SEQ ID NO: 2104486 - RNA, 17 nt, Human
uaauucccauuuugcaa

SEQ ID NO: 2104487 - RNA, 18 nt, Human
uaauucccauuuugcaaa

SEQ ID NO: 2104488 - RNA, 19 nt, Human
uaauucccauuuugcaaaa

SEQ ID NO: 2104489 - RNA, 20 nt, Human
uaauucccauuuugcaaaau

SEQ ID NO: 2104490 - RNA, 21 nt, Human
uaauucccauuuugcaaaauu

SEQ ID NO: 2104491 - RNA, 23 nt, Human
uaauucccauuuugcaaaauuuc

SEQ ID NO: 2104492 - RNA, 15 nt, Human
uaauucccuaucuuu

SEQ ID NO: 2104493 - RNA, 20 nt, Human
uaauucccuaucuuuuaguu

SEQ ID NO: 2104494 - RNA, 21 nt, Human
uacauuucaccuacuuuguaa

SEQ ID NO: 2104495 - RNA, 20 nt, Human
uacauuccuugauaauguug

SEQ ID NO: 2104496 - RNA, 22 nt, Human
uacauuccuugauaauguugug

SEQ ID NO: 2104497 - RNA, 22 nt, Human
aauuaaguuagggaauggcaca

SEQ ID NO: 2104498 - RNA, 15 nt, Human
uacauucaauguuua

SEQ ID NO: 2104499 - RNA, 21 nt, Human
uacauuaucuaacugugcuca

SEQ ID NO: 2104500 - RNA, 24 nt, Human
uacauuaucuaacugugcucaaga

SEQ ID NO: 2104501 - RNA, 21 nt, Human
uacauuuccaaauucacaagu

SEQ ID NO: 2104502 - RNA, 14 nt, Human
uacauuucugaaau

SEQ ID NO: 2104503 - RNA, 16 nt, Human
uacauuucugaaauga

SEQ ID NO: 2104504 - RNA, 22 nt, Human
uaccagcuacuccggaggcuga

SEQ ID NO: 2104505 - RNA, 21 nt, Human
uaccagccuccguauuucaga

SEQ ID NO: 2104506 - RNA, 20 nt, Human
uaccaggccgccccagccuc

SEQ ID NO: 2104507 - RNA, 22 nt, Human
uaccaggccgccccagccucug

SEQ ID NO: 2104508 - RNA, 14 nt, Human
uaccagguguucua

SEQ ID NO: 2104509 - RNA, 14 nt, Human
uaccagguugaaag

SEQ ID NO: 2104510 - RNA, 15 nt, Human
uaccagguugaaaga

SEQ ID NO: 2104511 - RNA, 16 nt, Human
uaccagguugaaagac

SEQ ID NO: 2104512 - RNA, 16 nt, Human
uaccaguaaaguguaa

SEQ ID NO: 2104513 - RNA, 19 nt, Human
uaccaguaaaguguaacau

SEQ ID NO: 2104514 - RNA, 11 nt, Human
uaccagugugg

SEQ ID NO: 2104515 - RNA, 17 nt, Human
aauguuguauucaguga

SEQ ID NO: 2104516 - RNA, 16 nt, Human
aauguugugguuuguu

SEQ ID NO: 2104517 - RNA, 17 nt, Human
aauguugugguuuguug

SEQ ID NO: 2104518 - RNA, 17 nt, Human
aauguuuaaaaaaguuu

SEQ ID NO: 2104519 - RNA, 19 nt, Human
aauguuuaaaaaaguuuaa

SEQ ID NO: 2104520 - RNA, 16 nt, Human
aauuaaguacuaugua

SEQ ID NO: 2104521 - RNA, 17 nt, Human
aauuaaguacuauguau

SEQ ID NO: 2104522 - RNA, 22 nt, Human
aauguucauuguaauguuacug

SEQ ID NO: 2104523 - RNA, 24 nt, Human
aauguucauuguaauguuacugau

SEQ ID NO: 2104524 - RNA, 11 nt, Human
aauguucauug

SEQ ID NO: 2104525 - RNA, 12 nt, Human
aauguucauugu

SEQ ID NO: 2104526 - RNA, 17 nt, Human
aauguucauuguaaugu

SEQ ID NO: 2104527 - RNA, 21 nt, Human
aauguucauuguaauguuacu

SEQ ID NO: 2104528 - RNA, 22 nt, Human
uacagagaggucaagcccagga

SEQ ID NO: 2104529 - RNA, 16 nt, Human
uacagggagcugggac

SEQ ID NO: 2104530 - RNA, 21 nt, Human
uacagggcaugcauuuugcag

SEQ ID NO: 2104531 - RNA, 22 nt, Human
uacagggcgagacucugucuca

SEQ ID NO: 2104532 - RNA, 14 nt, Human
uacaggggaauauu

SEQ ID NO: 2104533 - RNA, 16 nt, Human
uacaggggaauauuuu

SEQ ID NO: 2104534 - RNA, 19 nt, Human
uacaggggaauauuuuauu

SEQ ID NO: 2104535 - RNA, 21 nt, Human
uacaggggaauauuuuauuca

SEQ ID NO: 2104536 - RNA, 22 nt, Human
uacaggggaauauuuuauucaa

SEQ ID NO: 2104537 - RNA, 21 nt, Human
aaugugcugaaugguuuucaa

SEQ ID NO: 2104538 - RNA, 19 nt, Human
uacaggguagauaaccugu

SEQ ID NO: 2104539 - RNA, 22 nt, Human
uacaggguagcagguaccacug

SEQ ID NO: 2104540 - RNA, 18 nt, Human
uacaggguagcagguacc

SEQ ID NO: 2104541 - RNA, 21 nt, Human
uacagguaaggugagggaaua

SEQ ID NO: 2104542 - RNA, 16 nt, Human
aauguuauagugaauu

SEQ ID NO: 2104543 - RNA, 22 nt, Human
aauguuauagugaauuaucccu

SEQ ID NO: 2104544 - RNA, 15 nt, Human
aauguuagauaguua

SEQ ID NO: 2104545 - RNA, 20 nt, Human
aauguuacugaucaugcauu

SEQ ID NO: 2104546 - RNA, 21 nt, Human
aauguuacugaucaugcauug

SEQ ID NO: 2104547 - RNA, 22 nt, Human
aauguuacugaucaugcauugu

SEQ ID NO: 2104548 - RNA, 16 nt, Human
aauguggcagcugucu

SEQ ID NO: 2104549 - RNA, 17 nt, Human
aauguggcagcugucuc

SEQ ID NO: 2104550 - RNA, 17 nt, Human
aauguggccuaaaaaug

SEQ ID NO: 2104551 - RNA, 20 nt, Human
aauguggccuaaaaaugcaa

SEQ ID NO: 2104552 - RNA, 15 nt, Human
aauguuacauuguuu

SEQ ID NO: 2104553 - RNA, 16 nt, Human
aauguuacauagugua

SEQ ID NO: 2104554 - RNA, 17 nt, Human
aauguuacauaguguag

SEQ ID NO: 2104555 - RNA, 20 nt, Human
aauguuacauaguguaggcu

SEQ ID NO: 2104556 - RNA, 13 nt, Human
aauguuacugauc

SEQ ID NO: 2104557 - RNA, 18 nt, Human
aauguuacugaucaugca

SEQ ID NO: 2104558 - RNA, 19 nt, Human
aauguuacugaucaugcau

SEQ ID NO: 2104559 - RNA, 22 nt, Human
aauguuauguuguguucuaaua

SEQ ID NO: 2104560 - RNA, 23 nt, Human
uacccucaggcauaggccugggu

SEQ ID NO: 2104561 - RNA, 21 nt, Human
uacccucaggcauaggccugg

SEQ ID NO: 2104562 - RNA, 23 nt, Human
uaccucuuuuagucauuuugcuu

SEQ ID NO: 2104563 - RNA, 19 nt, Human
uaccugaacacuuauugcu

SEQ ID NO: 2104564 - RNA, 21 nt, Human
uaccugaacacuuauugcuuu

SEQ ID NO: 2104565 - RNA, 17 nt, Human
aauuacauguaaaacau

SEQ ID NO: 2104566 - RNA, 15 nt, Human
uaccugaucccacuc

SEQ ID NO: 2104567 - RNA, 16 nt, Human
uaccucuuugaaagaa

SEQ ID NO: 2104568 - RNA, 20 nt, Human
uaccugugcguuacuaauug

SEQ ID NO: 2104569 - RNA, 14 nt, Human
aauuauguuauuga

SEQ ID NO: 2104570 - RNA, 16 nt, Human
aauuauguuauugaaa

SEQ ID NO: 2104571 - RNA, 17 nt, Human
aauuauguuauugaaaa

SEQ ID NO: 2104572 - RNA, 18 nt, Human
aauuauguuauugaaaaa

SEQ ID NO: 2104573 - RNA, 19 nt, Human
aauuauguuauugaaaaaa

SEQ ID NO: 2104574 - RNA, 10 nt, Human
aauuauuguu

SEQ ID NO: 2104575 - RNA, 19 nt, Human
aauuauuguuuauauuuuc

SEQ ID NO: 2104576 - RNA, 20 nt, Human
aauuauuguuuauauuuuca

SEQ ID NO: 2104577 - RNA, 22 nt, Human
aauuauuguuuauauuuucaau

SEQ ID NO: 2104578 - RNA, 22 nt, Human
aauuaugucugcugaauaauaa

SEQ ID NO: 2104579 - RNA, 12 nt, Human
aauuagagcaga

SEQ ID NO: 2104580 - RNA, 22 nt, Human
aauuagagcagaugaccccucc

SEQ ID NO: 2104581 - RNA, 18 nt, Human
aauuagaaauuggcugga

SEQ ID NO: 2104582 - RNA, 21 nt, Human
aauuaccacaccaucucccau

SEQ ID NO: 2104583 - RNA, 18 nt, Human
aauuaccaguaaagugua

SEQ ID NO: 2104584 - RNA, 20 nt, Human
aauuaccaguaaaguguaac

SEQ ID NO: 2104585 - RNA, 22 nt, Human
aauuaccaguaaaguguaacau

SEQ ID NO: 2104586 - RNA, 23 nt, Human
aauuaccaguaaaguguaacaua

SEQ ID NO: 2104587 - RNA, 12 nt, Human
aauuauuucaga

SEQ ID NO: 2104588 - RNA, 13 nt, Human
aauuauuucagaa

SEQ ID NO: 2104589 - RNA, 20 nt, Human
aauuauuuauuuauggagga

SEQ ID NO: 2104590 - RNA, 17 nt, Human
aauuauuucagaaaugu

SEQ ID NO: 2104591 - RNA, 15 nt, Human
aauuauuuuaaauua

SEQ ID NO: 2104592 - RNA, 17 nt, Human
aauuauuuuaaauuaua

SEQ ID NO: 2104593 - RNA, 18 nt, Human
aauuauuuuaaauuauaa

SEQ ID NO: 2104594 - RNA, 20 nt, Human
aauuauuuuaaauuauaagg

SEQ ID NO: 2104595 - RNA, 21 nt, Human
aauuauuuuaaauuauaagga

SEQ ID NO: 2104596 - RNA, 22 nt, Human
aauuauuuuaaauuauaaggac

SEQ ID NO: 2104597 - RNA, 16 nt, Human
aauucagugcuguacu

SEQ ID NO: 2104598 - RNA, 16 nt, Human
aauucauauuuaugaa

SEQ ID NO: 2104599 - RNA, 13 nt, Human
aauucagcugccc

SEQ ID NO: 2104600 - RNA, 20 nt, Human
aauucagauauauuuuucac

SEQ ID NO: 2104601 - RNA, 21 nt, Human
uaugucucgugguaggacugu

SEQ ID NO: 2104602 - RNA, 13 nt, Human
uauguccauaucu

SEQ ID NO: 2104603 - RNA, 15 nt, Human
uauguccauaucuaa

SEQ ID NO: 2104604 - RNA, 15 nt, Human
uaugucccuugcugu

SEQ ID NO: 2104605 - RNA, 22 nt, Human
acaggcccggcuccaggcuccu

SEQ ID NO: 2104606 - RNA, 21 nt, Human
acaggcccggcuccaggcucc

SEQ ID NO: 2104607 - RNA, 20 nt, Human
acaggcccggcuccaggcuc

SEQ ID NO: 2104608 - RNA, 18 nt, Human
acaggcccggcuccaggc

SEQ ID NO: 2104609 - RNA, 22 nt, Human
acaggcccuuccucuccacugc

SEQ ID NO: 2104610 - RNA, 15 nt, Human
acaggcccuuccucu

SEQ ID NO: 2104611 - RNA, 19 nt, Human
acaggccucacacacaaug

SEQ ID NO: 2104612 - RNA, 13 nt, Human
acaggcccuuccu

SEQ ID NO: 2104613 - RNA, 15 nt, Human
acaggacucugccuc

SEQ ID NO: 2104614 - RNA, 16 nt, Human
acaggacucugccucc

SEQ ID NO: 2104615 - RNA, 11 nt, Human
acaggagaaau

SEQ ID NO: 2104616 - RNA, 14 nt, Human
acaggagaccuggc

SEQ ID NO: 2104617 - RNA, 15 nt, Human
acaggagagaaaggg

SEQ ID NO: 2104618 - RNA, 18 nt, Human
acaggagagaaaggggau

SEQ ID NO: 2104619 - RNA, 19 nt, Human
acaggagagaaaggggaug

SEQ ID NO: 2104620 - RNA, 13 nt, Human
acaggagcuggga

SEQ ID NO: 2104621 - RNA, 15 nt, Human
acaggcagauacagg

SEQ ID NO: 2104622 - RNA, 20 nt, Human
acaggaaaauuuuaaaaaua

SEQ ID NO: 2104623 - RNA, 16 nt, Human
acaggaaaauccucug

SEQ ID NO: 2104624 - RNA, 17 nt, Human
acaggaaaauccucugg

SEQ ID NO: 2104625 - RNA, 18 nt, Human
acaggaaaauccucuggc

SEQ ID NO: 2104626 - RNA, 23 nt, Human
acaggaaaauccucuggcuggcu

SEQ ID NO: 2104627 - RNA, 16 nt, Human
acaggaaagggaaggc

SEQ ID NO: 2104628 - RNA, 19 nt, Human
acaggaaagggaaggcccc

SEQ ID NO: 2104629 - RNA, 22 nt, Human
acaggaaagggaaggccccaca

SEQ ID NO: 2104630 - RNA, 14 nt, Human
acaggagcugggau

SEQ ID NO: 2104631 - RNA, 13 nt, Human
acaggcagcacag

SEQ ID NO: 2104632 - RNA, 17 nt, Human
acaggcagcacagagac

SEQ ID NO: 2104633 - RNA, 14 nt, Human
acaggcagcauuua

SEQ ID NO: 2104634 - RNA, 17 nt, Human
acaggcccggcuccagg

SEQ ID NO: 2104635 - RNA, 16 nt, Human
acaggcccggcuccag

SEQ ID NO: 2104636 - RNA, 18 nt, Human
acaggcccaagagaugaa

SEQ ID NO: 2104637 - RNA, 22 nt, Human
acaggcccaagagaugaagagu

SEQ ID NO: 2104638 - RNA, 22 nt, Human
acaggcccggcgcgguggcuca

SEQ ID NO: 2104639 - RNA, 18 nt, Human
acagcuucagccaggagc

SEQ ID NO: 2104640 - RNA, 17 nt, Human
acagcuucagccaggag

SEQ ID NO: 2104641 - RNA, 15 nt, Human
acagcuucagccagg

SEQ ID NO: 2104642 - RNA, 21 nt, Human
acagcugugcuguaacacaag

SEQ ID NO: 2104643 - RNA, 23 nt, Human
acagcuguggugagguugggcag

SEQ ID NO: 2104644 - RNA, 14 nt, Human
acagcugucccugu

SEQ ID NO: 2104645 - RNA, 18 nt, Human
acagcugucccugucacc

SEQ ID NO: 2104646 - RNA, 15 nt, Human
acagcugucccuguc

SEQ ID NO: 2104647 - RNA, 16 nt, Human
acagcugucccuguca

SEQ ID NO: 2104648 - RNA, 19 nt, Human
acagcuaaugggacacuaa

SEQ ID NO: 2104649 - RNA, 17 nt, Human
acagcuaaugggacacu

SEQ ID NO: 2104650 - RNA, 16 nt, Human
acagcuaaugggacac

SEQ ID NO: 2104651 - RNA, 15 nt, Human
acagcuaaugggaca

SEQ ID NO: 2104652 - RNA, 20 nt, Human
acagcucaagucuucccuga

SEQ ID NO: 2104653 - RNA, 23 nt, Human
acagcucaagucuucccugauca

SEQ ID NO: 2104654 - RNA, 21 nt, Human
acagcucagcuuuuugucuuu

SEQ ID NO: 2104655 - RNA, 16 nt, Human
acagcuaugggagccc

SEQ ID NO: 2104656 - RNA, 17 nt, Human
acagcuaugggagcccc

SEQ ID NO: 2104657 - RNA, 21 nt, Human
acagcuaugggagccccaggg

SEQ ID NO: 2104658 - RNA, 13 nt, Human
acagcuacacaga

SEQ ID NO: 2104659 - RNA, 21 nt, Human
acagcuucauuuccugugucu

SEQ ID NO: 2104660 - RNA, 19 nt, Human
acagcuucauuuccugugu

SEQ ID NO: 2104661 - RNA, 17 nt, Human
acagcuucauuuccugu

SEQ ID NO: 2104662 - RNA, 22 nt, Human
acagcuucagccaggagcuggg

SEQ ID NO: 2104663 - RNA, 21 nt, Human
acagcuucagccaggagcugg

SEQ ID NO: 2104664 - RNA, 20 nt, Human
acagcuucucauccugcagg

SEQ ID NO: 2104665 - RNA, 17 nt, Human
acagcuucaugccuuug

SEQ ID NO: 2104666 - RNA, 19 nt, Human
acagcuucaugccuuugua

SEQ ID NO: 2104667 - RNA, 20 nt, Human
acagcuucaugccuuuguaa

SEQ ID NO: 2104668 - RNA, 22 nt, Human
acagcuuccccucucuccuccu

SEQ ID NO: 2104669 - RNA, 21 nt, Human
acaggaaaagcugcugacagu

SEQ ID NO: 2104670 - RNA, 20 nt, Human
acaggaaaagcugcugacag

SEQ ID NO: 2104671 - RNA, 19 nt, Human
acaggaaaagcugcugaca

SEQ ID NO: 2104672 - RNA, 18 nt, Human
acaggaaaagcugcugac

SEQ ID NO: 2104673 - RNA, 21 nt, Human
acagcuucucauccugcaggc

SEQ ID NO: 2104674 - RNA, 20 nt, Human
acagcuuccccucucuccuc

SEQ ID NO: 2104675 - RNA, 16 nt, Human
acagcuaccaugacaa

SEQ ID NO: 2104676 - RNA, 22 nt, Human
uaugauauuuuuuuaagucuuu

SEQ ID NO: 2104677 - RNA, 23 nt, Human
uaugggacucaaugcacugacau

SEQ ID NO: 2104678 - RNA, 16 nt, Human
uaugggacucaaugca

SEQ ID NO: 2104679 - RNA, 13 nt, Human
uauggcagugucu

SEQ ID NO: 2104680 - RNA, 16 nt, Human
uauggcagugucuuuc

SEQ ID NO: 2104681 - RNA, 22 nt, Human
acagcuaaucagcauucucacu

SEQ ID NO: 2104682 - RNA, 12 nt, Human
acagcgcugggu

SEQ ID NO: 2104683 - RNA, 20 nt, Human
uauggucaucuuuuucucua

SEQ ID NO: 2104684 - RNA, 14 nt, Human
uaugguauuugagu

SEQ ID NO: 2104685 - RNA, 22 nt, Human
uauggucaacacuuaaggguuu

SEQ ID NO: 2104686 - RNA, 13 nt, Human
uaugguauaaugg

SEQ ID NO: 2104687 - RNA, 20 nt, Human
uaugguauaaugguugacug

SEQ ID NO: 2104688 - RNA, 17 nt, Human
acagcgagacuccgucu

SEQ ID NO: 2104689 - RNA, 18 nt, Human
acagcgagacuccgucuc

SEQ ID NO: 2104690 - RNA, 14 nt, Human
uaugauauuccaua

SEQ ID NO: 2104691 - RNA, 16 nt, Human
uaugauauuccauagu

SEQ ID NO: 2104692 - RNA, 18 nt, Human
uaugauauuccauaguau

SEQ ID NO: 2104693 - RNA, 19 nt, Human
uaugauauuccauaguaua

SEQ ID NO: 2104694 - RNA, 20 nt, Human
uaugauauuccauaguauau

SEQ ID NO: 2104695 - RNA, 18 nt, Human
uaugauauugcauaugca

SEQ ID NO: 2104696 - RNA, 14 nt, Human
uauggcagcgaaag

SEQ ID NO: 2104697 - RNA, 18 nt, Human
uaugcucuacccuugugu

SEQ ID NO: 2104698 - RNA, 14 nt, Human
uaugccauuuguuu

SEQ ID NO: 2104699 - RNA, 23 nt, Human
uaugccauuuguuuauuuuuaua

SEQ ID NO: 2104700 - RNA, 22 nt, Human
uaugccauagcaagauugcuua

SEQ ID NO: 2104701 - RNA, 14 nt, Human
uaugccagcucagu

SEQ ID NO: 2104702 - RNA, 17 nt, Human
uaugccagcucaguccc

SEQ ID NO: 2104703 - RNA, 20 nt, Human
acagauuuggugaauuugaa

SEQ ID NO: 2104704 - RNA, 15 nt, Human
acagcaauuccucag

SEQ ID NO: 2104705 - RNA, 19 nt, Human
acagcaauuccucaggcua

SEQ ID NO: 2104706 - RNA, 17 nt, Human
acagcaauuccucaggc

SEQ ID NO: 2104707 - RNA, 15 nt, Human
acagcagagguucuu

SEQ ID NO: 2104708 - RNA, 17 nt, Human
acagcagccccugcaca

SEQ ID NO: 2104709 - RNA, 15 nt, Human
acagcccgcaugcag

SEQ ID NO: 2104710 - RNA, 20 nt, Human
acagcccgcaugcagcagcu

SEQ ID NO: 2104711 - RNA, 22 nt, Human
acagcccgcaugcagcagcuug

SEQ ID NO: 2104712 - RNA, 12 nt, Human
acagcccuguca

SEQ ID NO: 2104713 - RNA, 13 nt, Human
acagcccugucag

SEQ ID NO: 2104714 - RNA, 20 nt, Human
acagcccugucagugcagcc

SEQ ID NO: 2104715 - RNA, 21 nt, Human
acagcccugucagugcagccc

SEQ ID NO: 2104716 - RNA, 18 nt, Human
uaugaaaaauaugauauu

SEQ ID NO: 2104717 - RNA, 14 nt, Human
uaugaaaaauauga

SEQ ID NO: 2104718 - RNA, 16 nt, Human
acagaaagguuuucuu

SEQ ID NO: 2104719 - RNA, 10 nt, Human
acagaaaaca

SEQ ID NO: 2104720 - RNA, 11 nt, Human
acagaaaacaa

SEQ ID NO: 2104721 - RNA, 12 nt, Human
acagaaaacaac

SEQ ID NO: 2104722 - RNA, 14 nt, Human
acagaaaacaacaa

SEQ ID NO: 2104723 - RNA, 17 nt, Human
acagaaaacaacaaaaa

SEQ ID NO: 2104724 - RNA, 18 nt, Human
acagaaaacaacaaaaaa

SEQ ID NO: 2104725 - RNA, 19 nt, Human
acagaaaacaacaaaaaau

SEQ ID NO: 2104726 - RNA, 21 nt, Human
acagaaaacaacaaaaaauaa

SEQ ID NO: 2104727 - RNA, 20 nt, Human
acagaaaacgguuaaaacug

SEQ ID NO: 2104728 - RNA, 13 nt, Human
acagaaaacuaga

SEQ ID NO: 2104729 - RNA, 14 nt, Human
acagaaaacuagaa

SEQ ID NO: 2104730 - RNA, 17 nt, Human
acagaaaacuagaauuu

SEQ ID NO: 2104731 - RNA, 11 nt, Human
acagacaggag

SEQ ID NO: 2104732 - RNA, 13 nt, Human
acagacaggagaa

SEQ ID NO: 2104733 - RNA, 14 nt, Human
acagaaaaaaaaca

SEQ ID NO: 2104734 - RNA, 16 nt, Human
acagaaaaaaaacaca

SEQ ID NO: 2104735 - RNA, 18 nt, Human
acagaaaaaaaacacaca

SEQ ID NO: 2104736 - RNA, 21 nt, Human
acacuuguaauuuuguaucuu

SEQ ID NO: 2104737 - RNA, 18 nt, Human
acacuuuugagacuuuuu

SEQ ID NO: 2104738 - RNA, 17 nt, Human
acacuugguuggguccu

SEQ ID NO: 2104739 - RNA, 20 nt, Human
acacuugguuggguccucac

SEQ ID NO: 2104740 - RNA, 22 nt, Human
acacuugguuggguccucacau

SEQ ID NO: 2104741 - RNA, 19 nt, Human
uauauauguugauuucuug

SEQ ID NO: 2104742 - RNA, 19 nt, Human
acacuuccuguccagagag

SEQ ID NO: 2104743 - RNA, 14 nt, Human
acacuuccugucca

SEQ ID NO: 2104744 - RNA, 16 nt, Human
acacuuccuguccaga

SEQ ID NO: 2104745 - RNA, 13 nt, Human
acacuuccugucc

SEQ ID NO: 2104746 - RNA, 20 nt, Human
acacuucugugagaccccca

SEQ ID NO: 2104747 - RNA, 23 nt, Human
acacuucugugagacccccacac

SEQ ID NO: 2104748 - RNA, 22 nt, Human
acacuucuucuuggucuuauuu

SEQ ID NO: 2104749 - RNA, 15 nt, Human
acacuuccaccagcc

SEQ ID NO: 2104750 - RNA, 19 nt, Human
acacuucagagagcuggua

SEQ ID NO: 2104751 - RNA, 20 nt, Human
acacuucagagagcugguag

SEQ ID NO: 2104752 - RNA, 16 nt, Human
acacuuccaccagccu

SEQ ID NO: 2104753 - RNA, 17 nt, Human
acacuuccaccagccug

SEQ ID NO: 2104754 - RNA, 21 nt, Human
acacuuccaccagccugcacu

SEQ ID NO: 2104755 - RNA, 14 nt, Human
acacuuccauaauc

SEQ ID NO: 2104756 - RNA, 19 nt, Human
acacuuccaccagccugca

SEQ ID NO: 2104757 - RNA, 22 nt, Human
acacuucaggcucuucuccuuu

SEQ ID NO: 2104758 - RNA, 19 nt, Human
acacuucaggcucuucucc

SEQ ID NO: 2104759 - RNA, 15 nt, Human
acacuucaggcucuu

SEQ ID NO: 2104760 - RNA, 14 nt, Human
acacuuauugcuuu

SEQ ID NO: 2104761 - RNA, 20 nt, Human
acacuuauugcuuugaaacu

SEQ ID NO: 2104762 - RNA, 16 nt, Human
acacuucagagagcug

SEQ ID NO: 2104763 - RNA, 17 nt, Human
acacuucagagagcugg

SEQ ID NO: 2104764 - RNA, 18 nt, Human
acacuucagagagcuggu

SEQ ID NO: 2104765 - RNA, 20 nt, Human
acacuuaaggguuuuagaaa

SEQ ID NO: 2104766 - RNA, 13 nt, Human
acacuucagacug

SEQ ID NO: 2104767 - RNA, 13 nt, Human
acacuucagagag

SEQ ID NO: 2104768 - RNA, 18 nt, Human
acacuuacacuuuaugca

SEQ ID NO: 2104769 - RNA, 21 nt, Human
acacuuacacuuuaugcacaa

SEQ ID NO: 2104770 - RNA, 16 nt, Human
acacuuacacuuuaug

SEQ ID NO: 2104771 - RNA, 16 nt, Human
acacuuaacagaugca

SEQ ID NO: 2104772 - RNA, 19 nt, Human
uaucaauuaccacaccauc

SEQ ID NO: 2104773 - RNA, 14 nt, Human
uaucaauuugucau

SEQ ID NO: 2104774 - RNA, 16 nt, Human
uaucaauuugucauuu

SEQ ID NO: 2104775 - RNA, 19 nt, Human
uaucaauuugucauuuuga

SEQ ID NO: 2104776 - RNA, 20 nt, Human
uaucaauuugucauuuugaa

SEQ ID NO: 2104777 - RNA, 21 nt, Human
uaucaauuugucauuuugaag

SEQ ID NO: 2104778 - RNA, 14 nt, Human
uaucacacaaagca

SEQ ID NO: 2104779 - RNA, 13 nt, Human
uaucaccuccccu

SEQ ID NO: 2104780 - RNA, 20 nt, Human
acagacguaugcuuauuuua

SEQ ID NO: 2104781 - RNA, 15 nt, Human
acagacguaugcuua

SEQ ID NO: 2104782 - RNA, 15 nt, Human
acagacgucccucca

SEQ ID NO: 2104783 - RNA, 16 nt, Human
acagacgucccuccac

SEQ ID NO: 2104784 - RNA, 17 nt, Human
acagacauucugccagg

SEQ ID NO: 2104785 - RNA, 14 nt, Human
acagacaggagaaa

SEQ ID NO: 2104786 - RNA, 15 nt, Human
acagacaggagaaau

SEQ ID NO: 2104787 - RNA, 21 nt, Human
acagacaggagaaaugcaucc

SEQ ID NO: 2104788 - RNA, 17 nt, Human
uaucagaauucucagaa

SEQ ID NO: 2104789 - RNA, 20 nt, Human
uaucaccuccccuccuugcc

SEQ ID NO: 2104790 - RNA, 14 nt, Human
uaucaccuccccuc

SEQ ID NO: 2104791 - RNA, 15 nt, Human
uaucaccuccccucc

SEQ ID NO: 2104792 - RNA, 16 nt, Human
uaucaccuccccuccu

SEQ ID NO: 2104793 - RNA, 18 nt, Human
uaucagaguauccacugu

SEQ ID NO: 2104794 - RNA, 14 nt, Human
uauccaaucuuguu

SEQ ID NO: 2104795 - RNA, 12 nt, Human
uauccacccagc

SEQ ID NO: 2104796 - RNA, 19 nt, Human
uauccaacaucaacaucuu

SEQ ID NO: 2104797 - RNA, 12 nt, Human
uaucccauccca

SEQ ID NO: 2104798 - RNA, 16 nt, Human
uaucccaucccauccc

SEQ ID NO: 2104799 - RNA, 16 nt, Human
uaucccacggaaaaug

SEQ ID NO: 2104800 - RNA, 19 nt, Human
uaucccacggaaaaugcca

SEQ ID NO: 2104801 - RNA, 21 nt, Human
uaucccacggaaaaugccaau

SEQ ID NO: 2104802 - RNA, 13 nt, Human
uauccacccagcc

SEQ ID NO: 2104803 - RNA, 14 nt, Human
uauccacccagccc

SEQ ID NO: 2104804 - RNA, 15 nt, Human
uauccacccagccca

SEQ ID NO: 2104805 - RNA, 21 nt, Human
uaucuauauaguaccuuugcu

SEQ ID NO: 2104806 - RNA, 23 nt, Human
uaucuauauaguaccuuugcucu

SEQ ID NO: 2104807 - RNA, 23 nt, Human
uauagcaauccauguuaguuuuu

SEQ ID NO: 2104808 - RNA, 18 nt, Human
uauagccuaggugacaga

SEQ ID NO: 2104809 - RNA, 14 nt, Human
uauaggucacuccu

SEQ ID NO: 2104810 - RNA, 17 nt, Human
uauaggucacuccuggg

SEQ ID NO: 2104811 - RNA, 19 nt, Human
uauaggaacauaugaaaau

SEQ ID NO: 2104812 - RNA, 12 nt, Human
uauagcuugaaa

SEQ ID NO: 2104813 - RNA, 16 nt, Human
uauagcuugaaacaua

SEQ ID NO: 2104814 - RNA, 17 nt, Human
uauauaguaccuuugcu

SEQ ID NO: 2104815 - RNA, 18 nt, Human
uauauaguaccuuugcuc

SEQ ID NO: 2104816 - RNA, 14 nt, Human
uauauagcuugaaa

SEQ ID NO: 2104817 - RNA, 22 nt, Human
uauauaguuuauugacaauaau

SEQ ID NO: 2104818 - RNA, 17 nt, Human
uauauaguuuacuauuu

SEQ ID NO: 2104819 - RNA, 15 nt, Human
uauauaucuaucuua

SEQ ID NO: 2104820 - RNA, 14 nt, Human
uauauaugugugug

SEQ ID NO: 2104821 - RNA, 21 nt, Human
uauauauucuggcugauaaaa

SEQ ID NO: 2104822 - RNA, 13 nt, Human
uauauauuuauaa

SEQ ID NO: 2104823 - RNA, 14 nt, Human
uauauauuuuaauu

SEQ ID NO: 2104824 - RNA, 14 nt, Human
uauauauuuauaac

SEQ ID NO: 2104825 - RNA, 15 nt, Human
uauauauuuauaacu

SEQ ID NO: 2104826 - RNA, 11 nt, Human
uauaauuuaau

SEQ ID NO: 2104827 - RNA, 16 nt, Human
uauaauuuaaugcaug

SEQ ID NO: 2104828 - RNA, 22 nt, Human
uauacacuuacacuuuaugcac

SEQ ID NO: 2104829 - RNA, 22 nt, Human
uauaauuuaacuucagagggaa

SEQ ID NO: 2104830 - RNA, 15 nt, Human
uauaauuguuuuuua

SEQ ID NO: 2104831 - RNA, 18 nt, Human
uauaauuguuuuuuaucu

SEQ ID NO: 2104832 - RNA, 20 nt, Human
uauaauuguuuuuuaucuuu

SEQ ID NO: 2104833 - RNA, 22 nt, Human
uauaauuguuuuuuaucuuuuc

SEQ ID NO: 2104834 - RNA, 15 nt, Human
uauaauuuaacuuca

SEQ ID NO: 2104835 - RNA, 15 nt, Human
uauacaggggaauau

SEQ ID NO: 2104836 - RNA, 16 nt, Human
uauacaggggaauauu

SEQ ID NO: 2104837 - RNA, 19 nt, Human
uauacaggggaauauuuua

SEQ ID NO: 2104838 - RNA, 23 nt, Human
uauacaggggaauauuuuauuca

SEQ ID NO: 2104839 - RNA, 21 nt, Human
uauacauaacaggguaaauua

SEQ ID NO: 2104840 - RNA, 22 nt, Human
uauacauaacaggguaaauuau

SEQ ID NO: 2104841 - RNA, 23 nt, Human
uauacauaacaggguaaauuauu

SEQ ID NO: 2104842 - RNA, 18 nt, Human
uauagaucacauaacaga

SEQ ID NO: 2104843 - RNA, 22 nt, Human
uauagaucacauaacagaaugc

SEQ ID NO: 2104844 - RNA, 23 nt, Human
uauagaucacauaacagaaugca

SEQ ID NO: 2104845 - RNA, 13 nt, Human
uauagaucagcca

SEQ ID NO: 2104846 - RNA, 15 nt, Human
uauacaugacacuga

SEQ ID NO: 2104847 - RNA, 16 nt, Human
uauacaugacacugaa

SEQ ID NO: 2104848 - RNA, 17 nt, Human
uauacaugacacugaaa

SEQ ID NO: 2104849 - RNA, 20 nt, Human
uauacaugacacugaaaugc

SEQ ID NO: 2104850 - RNA, 22 nt, Human
uauacaugacacugaaaugccu

SEQ ID NO: 2104851 - RNA, 23 nt, Human
uauacaugacacugaaaugccuu

SEQ ID NO: 2104852 - RNA, 14 nt, Human
uagucaccuuuuaa

SEQ ID NO: 2104853 - RNA, 20 nt, Human
uagucaccuuuuaaauccug

SEQ ID NO: 2104854 - RNA, 21 nt, Human
uagucaccuuuuaaauccugu

SEQ ID NO: 2104855 - RNA, 22 nt, Human
uagucaccuuuuaaauccuguu

SEQ ID NO: 2104856 - RNA, 14 nt, Human
acacuaagggugua

SEQ ID NO: 2104857 - RNA, 21 nt, Human
acacucaaaagcugggcaggu

SEQ ID NO: 2104858 - RNA, 22 nt, Human
uauaacuuaaaaaaaugacaga

SEQ ID NO: 2104859 - RNA, 18 nt, Human
uauaacuuaaaauauuuu

SEQ ID NO: 2104860 - RNA, 20 nt, Human
uauaacugccuuaaaacuuu

SEQ ID NO: 2104861 - RNA, 18 nt, Human
uauaacuuaaaaaaauga

SEQ ID NO: 2104862 - RNA, 19 nt, Human
uauaacuuaaaaaaaugac

SEQ ID NO: 2104863 - RNA, 16 nt, Human
uauaacugaaggagaa

SEQ ID NO: 2104864 - RNA, 19 nt, Human
uauaacugccuuaaaacuu

SEQ ID NO: 2104865 - RNA, 16 nt, Human
uauaacucaucauaaa

SEQ ID NO: 2104866 - RNA, 17 nt, Human
uauaacucaucauaaaa

SEQ ID NO: 2104867 - RNA, 18 nt, Human
uauaacucaucauaaaau

SEQ ID NO: 2104868 - RNA, 19 nt, Human
uauaacucaucauaaaaua

SEQ ID NO: 2104869 - RNA, 20 nt, Human
uauaacucaucauaaaauaa

SEQ ID NO: 2104870 - RNA, 21 nt, Human
uauaacucaucauaaaauaaa

SEQ ID NO: 2104871 - RNA, 14 nt, Human
uaggcaggaccugu

SEQ ID NO: 2104872 - RNA, 15 nt, Human
uaggcaggaccugug

SEQ ID NO: 2104873 - RNA, 18 nt, Human
uaggcaguuagagaugcc

SEQ ID NO: 2104874 - RNA, 22 nt, Human
uaggcaguuagagaugccuccc

SEQ ID NO: 2104875 - RNA, 24 nt, Human
uaggcaguuagagaugccucccug

SEQ ID NO: 2104876 - RNA, 14 nt, Human
uaggcaucccaggg

SEQ ID NO: 2104877 - RNA, 16 nt, Human
uaggcaucccagggga

SEQ ID NO: 2104878 - RNA, 19 nt, Human
uaggcaucccaggggacca

SEQ ID NO: 2104879 - RNA, 21 nt, Human
uaggcaugagggaucacaggg

SEQ ID NO: 2104880 - RNA, 23 nt, Human
uaggaaaauuggacauuaagcau

SEQ ID NO: 2104881 - RNA, 14 nt, Human
uaggaaauaaaacc

SEQ ID NO: 2104882 - RNA, 16 nt, Human
uaggaaauaaaaccuu

SEQ ID NO: 2104883 - RNA, 17 nt, Human
uaggaaauaaaaccuuu

SEQ ID NO: 2104884 - RNA, 19 nt, Human
uaggaaauaaaaccuuuca

SEQ ID NO: 2104885 - RNA, 23 nt, Human
uaggaguucgagaccagccuggc

SEQ ID NO: 2104886 - RNA, 17 nt, Human
uaggaguucgagaccag

SEQ ID NO: 2104887 - RNA, 21 nt, Human
uaggaguucgagaccagccug

SEQ ID NO: 2104888 - RNA, 13 nt, Human
uagggaagagaaa

SEQ ID NO: 2104889 - RNA, 14 nt, Human
uagggaagagaaac

SEQ ID NO: 2104890 - RNA, 15 nt, Human
uagggaagagaaaca

SEQ ID NO: 2104891 - RNA, 17 nt, Human
uagggauagucaccuuu

SEQ ID NO: 2104892 - RNA, 20 nt, Human
uagggauagucaccuuuuaa

SEQ ID NO: 2104893 - RNA, 21 nt, Human
uagggauagucaccuuuuaaa

SEQ ID NO: 2104894 - RNA, 23 nt, Human
uagggauagucaccuuuuaaauc

SEQ ID NO: 2104895 - RNA, 16 nt, Human
uagggauucaggcugc

SEQ ID NO: 2104896 - RNA, 18 nt, Human
uagggauguucuggcccu

SEQ ID NO: 2104897 - RNA, 15 nt, Human
uagggauucaggcug

SEQ ID NO: 2104898 - RNA, 13 nt, Human
uagggaagauaau

SEQ ID NO: 2104899 - RNA, 16 nt, Human
uagggaaaaguucaua

SEQ ID NO: 2104900 - RNA, 13 nt, Human
uagggaaaugaaa

SEQ ID NO: 2104901 - RNA, 16 nt, Human
uagggaaaugaaagaa

SEQ ID NO: 2104902 - RNA, 21 nt, Human
uagggccuggucccugggagg

SEQ ID NO: 2104903 - RNA, 23 nt, Human
uagggcuacaaaaccugauguua

SEQ ID NO: 2104904 - RNA, 11 nt, Human
uagggcugggu

SEQ ID NO: 2104905 - RNA, 12 nt, Human
uagggcugggug

SEQ ID NO: 2104906 - RNA, 13 nt, Human
uagggguugcuaa

SEQ ID NO: 2104907 - RNA, 17 nt, Human
uagcgcccaguugggug

SEQ ID NO: 2104908 - RNA, 21 nt, Human
uagcgcugccgcaccccagag

SEQ ID NO: 2104909 - RNA, 22 nt, Human
uagcgcugccgcaccccagagu

SEQ ID NO: 2104910 - RNA, 21 nt, Human
uagcguuggaauuaaaacaau

SEQ ID NO: 2104911 - RNA, 23 nt, Human
uagcguuggaauuaaaacaaugu

SEQ ID NO: 2104912 - RNA, 14 nt, Human
uagcgcccaguugg

SEQ ID NO: 2104913 - RNA, 23 nt, Human
uagcgacauugcagucugcuucu

SEQ ID NO: 2104914 - RNA, 15 nt, Human
uagcgaggcucuaac

SEQ ID NO: 2104915 - RNA, 19 nt, Human
uagcgaggcucuaaccaca

SEQ ID NO: 2104916 - RNA, 21 nt, Human
uagccuuagaagucacacagu

SEQ ID NO: 2104917 - RNA, 14 nt, Human
uagccuguggcagu

SEQ ID NO: 2104918 - RNA, 23 nt, Human
uagccuguggcaguaaagagaaa

SEQ ID NO: 2104919 - RNA, 17 nt, Human
acaauauuuuguggcuu

SEQ ID NO: 2104920 - RNA, 16 nt, Human
acaauauuuaaaauuu

SEQ ID NO: 2104921 - RNA, 14 nt, Human
acaauauuuauugu

SEQ ID NO: 2104922 - RNA, 15 nt, Human
acaauauuuauugua

SEQ ID NO: 2104923 - RNA, 16 nt, Human
acaauauuuauuguau

SEQ ID NO: 2104924 - RNA, 19 nt, Human
acaauauuuauuguauuuu

SEQ ID NO: 2104925 - RNA, 14 nt, Human
acaauauuuuaagc

SEQ ID NO: 2104926 - RNA, 15 nt, Human
acaauauuuuaagca

SEQ ID NO: 2104927 - RNA, 16 nt, Human
acaauauuuuaagcau

SEQ ID NO: 2104928 - RNA, 17 nt, Human
acaauauuuuaagcauu

SEQ ID NO: 2104929 - RNA, 18 nt, Human
acaauauuuuaagcauua

SEQ ID NO: 2104930 - RNA, 23 nt, Human
acaauauuuuaagcauuacucuu

SEQ ID NO: 2104931 - RNA, 14 nt, Human
acaaucaaaggaaa

SEQ ID NO: 2104932 - RNA, 19 nt, Human
acaaucaaaggaaaauagu

SEQ ID NO: 2104933 - RNA, 23 nt, Human
acaaucaacucuaauagugcuua

SEQ ID NO: 2104934 - RNA, 20 nt, Human
uagccuuagaagucacacag

SEQ ID NO: 2104935 - RNA, 19 nt, Human
acaaucagccacauucuag

SEQ ID NO: 2104936 - RNA, 14 nt, Human
acaauauuguuucu

SEQ ID NO: 2104937 - RNA, 15 nt, Human
acaauauuguuucua

SEQ ID NO: 2104938 - RNA, 10 nt, Human
acaauauuua

SEQ ID NO: 2104939 - RNA, 13 nt, Human
acaauauuuaaaa

SEQ ID NO: 2104940 - RNA, 14 nt, Human
acaauauuuaaaau

SEQ ID NO: 2104941 - RNA, 18 nt, Human
acaauauuuaaaauuuau

SEQ ID NO: 2104942 - RNA, 17 nt, Human
uagcacuuauguuacug

SEQ ID NO: 2104943 - RNA, 19 nt, Human
acaaaucuaagggaaaaag

SEQ ID NO: 2104944 - RNA, 22 nt, Human
uagcuuuauuuuuuaaguauuu

SEQ ID NO: 2104945 - RNA, 19 nt, Human
uagcuuuauuuuuuaagua

SEQ ID NO: 2104946 - RNA, 20 nt, Human
uagcuuuauuuuuuaaguau

SEQ ID NO: 2104947 - RNA, 13 nt, Human
uagcuuuucccuu

SEQ ID NO: 2104948 - RNA, 14 nt, Human
uagcuuuacccuca

SEQ ID NO: 2104949 - RNA, 15 nt, Human
uagcuuuacccucag

SEQ ID NO: 2104950 - RNA, 19 nt, Human
uagcuuuacuguuuguuau

SEQ ID NO: 2104951 - RNA, 18 nt, Human
uagcuuuauuuuuuaagu

SEQ ID NO: 2104952 - RNA, 15 nt, Human
uagcuuggaaacugg

SEQ ID NO: 2104953 - RNA, 20 nt, Human
uagcuuggaaacuggaugag

SEQ ID NO: 2104954 - RNA, 16 nt, Human
uagcuugcaccuuguc

SEQ ID NO: 2104955 - RNA, 19 nt, Human
uagcuugggaggcuucccc

SEQ ID NO: 2104956 - RNA, 12 nt, Human
uagcuuccauga

SEQ ID NO: 2104957 - RNA, 19 nt, Human
uagcuugauaaagggccaa

SEQ ID NO: 2104958 - RNA, 19 nt, Human
uagcuugaaggaucuguuu

SEQ ID NO: 2104959 - RNA, 13 nt, Human
uagcuucugaccu

SEQ ID NO: 2104960 - RNA, 17 nt, Human
uagcuucugaccucagc

SEQ ID NO: 2104961 - RNA, 18 nt, Human
uagcuucugaccucagca

SEQ ID NO: 2104962 - RNA, 19 nt, Human
uagcuucugaccucagcau

SEQ ID NO: 2104963 - RNA, 24 nt, Human
acacaggcccggcuccaggcuccu

SEQ ID NO: 2104964 - RNA, 23 nt, Human
acacaggcccggcuccaggcucc

SEQ ID NO: 2104965 - RNA, 22 nt, Human
acacaggcccggcuccaggcuc

SEQ ID NO: 2104966 - RNA, 21 nt, Human
acacaggcccggcuccaggcu

SEQ ID NO: 2104967 - RNA, 20 nt, Human
acacaggcccggcuccaggc

SEQ ID NO: 2104968 - RNA, 19 nt, Human
acacaggcccggcuccagg

SEQ ID NO: 2104969 - RNA, 18 nt, Human
acacaggcccggcuccag

SEQ ID NO: 2104970 - RNA, 17 nt, Human
acacaggcccggcucca

SEQ ID NO: 2104971 - RNA, 16 nt, Human
acacaggcccggcucc

SEQ ID NO: 2104972 - RNA, 21 nt, Human
acacaggcaacugaggcagac

SEQ ID NO: 2104973 - RNA, 13 nt, Human
acacacagaggaa

SEQ ID NO: 2104974 - RNA, 22 nt, Human
acacacagaggaagagcaggca

SEQ ID NO: 2104975 - RNA, 13 nt, Human
acacacagacaca

SEQ ID NO: 2104976 - RNA, 23 nt, Human
uagguuuuaauaauuuuuuaauu

SEQ ID NO: 2104977 - RNA, 16 nt, Human
uaguaaaaauaaaauu

SEQ ID NO: 2104978 - RNA, 13 nt, Human
uaguaaaaauaaa

SEQ ID NO: 2104979 - RNA, 15 nt, Human
uagguuuuuuuguau

SEQ ID NO: 2104980 - RNA, 19 nt, Human
uagguuuuuuuguauagua

SEQ ID NO: 2104981 - RNA, 15 nt, Human
uaguaaaaauacaaa

SEQ ID NO: 2104982 - RNA, 22 nt, Human
uaguagagacaggguuuugcca

SEQ ID NO: 2104983 - RNA, 15 nt, Human
uaguagagacagggu

SEQ ID NO: 2104984 - RNA, 14 nt, Human
uaguagagacaggg

SEQ ID NO: 2104985 - RNA, 15 nt, Human
uaguaauguuuuaua

SEQ ID NO: 2104986 - RNA, 18 nt, Human
acacaaauuaucuuaaaa

SEQ ID NO: 2104987 - RNA, 15 nt, Human
acaaugcagaugcca

SEQ ID NO: 2104988 - RNA, 19 nt, Human
acaaugcagaugccagagc

SEQ ID NO: 2104989 - RNA, 20 nt, Human
acaaugcagaugccagagca

SEQ ID NO: 2104990 - RNA, 12 nt, Human
acacaacaaaaa

SEQ ID NO: 2104991 - RNA, 13 nt, Human
acacaacaaaaau

SEQ ID NO: 2104992 - RNA, 15 nt, Human
acacaacaaaaauuu

SEQ ID NO: 2104993 - RNA, 13 nt, Human
acacaacacacac

SEQ ID NO: 2104994 - RNA, 16 nt, Human
acaaugaugaugauaa

SEQ ID NO: 2104995 - RNA, 17 nt, Human
acaaugaugaugauaau

SEQ ID NO: 2104996 - RNA, 19 nt, Human
acaaugaugaugauaauga

SEQ ID NO: 2104997 - RNA, 21 nt, Human
acaaugaugaugauaaugaug

SEQ ID NO: 2104998 - RNA, 14 nt, Human
acacaauacaauaa

SEQ ID NO: 2104999 - RNA, 14 nt, Human
acacacacacacag

SEQ ID NO: 2105000 - RNA, 12 nt, Human
acacaauacaau

SEQ ID NO: 2105001 - RNA, 22 nt, Human
acacaagcuuuuuuacacaaau

SEQ ID NO: 2105002 - RNA, 14 nt, Human
acacaaguaaaacu

SEQ ID NO: 2105003 - RNA, 18 nt, Human
acacaaauacuuauucau

SEQ ID NO: 2105004 - RNA, 14 nt, Human
acacacacacagga

SEQ ID NO: 2105005 - RNA, 15 nt, Human
acacacacacacagg

SEQ ID NO: 2105006 - RNA, 13 nt, Human
acacacacacagg

SEQ ID NO: 2105007 - RNA, 12 nt, Human
uaggguggcccu

SEQ ID NO: 2105008 - RNA, 15 nt, Human
uaggguuauaauaau

SEQ ID NO: 2105009 - RNA, 17 nt, Human
uaggguuauaauaaugu

SEQ ID NO: 2105010 - RNA, 15 nt, Human
uagggucucuucagg

SEQ ID NO: 2105011 - RNA, 15 nt, Human
uaggguaaggugccu

SEQ ID NO: 2105012 - RNA, 18 nt, Human
uaggguaaggugccuucu

SEQ ID NO: 2105013 - RNA, 16 nt, Human
uacuuuguaugauauu

SEQ ID NO: 2105014 - RNA, 20 nt, Human
uacuuuguaugauauuccau

SEQ ID NO: 2105015 - RNA, 22 nt, Human
uacuuuguaugauauuccauag

SEQ ID NO: 2105016 - RNA, 22 nt, Human
uacuuuguaagugagagagaca

SEQ ID NO: 2105017 - RNA, 14 nt, Human
aauucauguuucuu

SEQ ID NO: 2105018 - RNA, 16 nt, Human
uacuuuuucauucuuu

SEQ ID NO: 2105019 - RNA, 15 nt, Human
uagaaaacaggaaaa

SEQ ID NO: 2105020 - RNA, 17 nt, Human
uagaaaacaggaaaaaa

SEQ ID NO: 2105021 - RNA, 22 nt, Human
uagaaaacaggaaaaaaacuuu

SEQ ID NO: 2105022 - RNA, 23 nt, Human
uagaaaacaggaaaaaaacuuuu

SEQ ID NO: 2105023 - RNA, 13 nt, Human
uagaaaaagcagu

SEQ ID NO: 2105024 - RNA, 23 nt, Human
uagaaaaaggagcuuaccuccca

SEQ ID NO: 2105025 - RNA, 13 nt, Human
uacuuuuccuucc

SEQ ID NO: 2105026 - RNA, 17 nt, Human
uacuuuuccuucccuca

SEQ ID NO: 2105027 - RNA, 11 nt, Human
uacuuuuggaa

SEQ ID NO: 2105028 - RNA, 13 nt, Human
uacuuuuggaauc

SEQ ID NO: 2105029 - RNA, 14 nt, Human
uacuuuuggaaucu

SEQ ID NO: 2105030 - RNA, 18 nt, Human
uacuuuuggaaucuagaa

SEQ ID NO: 2105031 - RNA, 20 nt, Human
uacuuuuggaaucuagaaga

SEQ ID NO: 2105032 - RNA, 22 nt, Human
uagaaaauuuaaaacauuacuc

SEQ ID NO: 2105033 - RNA, 17 nt, Human
uagaaaauuuaaaacau

SEQ ID NO: 2105034 - RNA, 19 nt, Human
uagaaacucaccauguaaa

SEQ ID NO: 2105035 - RNA, 12 nt, Human
uagaagaaauga

SEQ ID NO: 2105036 - RNA, 14 nt, Human
uagaagaaaugaaa

SEQ ID NO: 2105037 - RNA, 16 nt, Human
uagaagaaaugaaauu

SEQ ID NO: 2105038 - RNA, 17 nt, Human
uagaagaaaugaaauuu

SEQ ID NO: 2105039 - RNA, 19 nt, Human
uagaagaaaugaaauuuua

SEQ ID NO: 2105040 - RNA, 20 nt, Human
uagaagaaaugaaauuuuac

SEQ ID NO: 2105041 - RNA, 22 nt, Human
uagaagaaaugaaauuuuacca

SEQ ID NO: 2105042 - RNA, 23 nt, Human
uagaagaaaugaaauuuuaccaa

SEQ ID NO: 2105043 - RNA, 18 nt, Human
uagaagaacauccaagga

SEQ ID NO: 2105044 - RNA, 22 nt, Human
uagaagaacauccaaggagaaa

SEQ ID NO: 2105045 - RNA, 21 nt, Human
uagaagaauacaaacauauuu

SEQ ID NO: 2105046 - RNA, 15 nt, Human
uagaagaaaaaagaa

SEQ ID NO: 2105047 - RNA, 18 nt, Human
uagaagaaaaaagaaugu

SEQ ID NO: 2105048 - RNA, 12 nt, Human
uagaagaacugc

SEQ ID NO: 2105049 - RNA, 11 nt, Human
aauuuggaauu

SEQ ID NO: 2105050 - RNA, 15 nt, Human
aauuuggaauucugu

SEQ ID NO: 2105051 - RNA, 18 nt, Human
uagaccaagcuuguccaa

SEQ ID NO: 2105052 - RNA, 20 nt, Human
uagacacaggauagauaacu

SEQ ID NO: 2105053 - RNA, 14 nt, Human
uagaccaagcuugu

SEQ ID NO: 2105054 - RNA, 19 nt, Human
uagacauuuguaaauguaa

SEQ ID NO: 2105055 - RNA, 22 nt, Human
aauuuuaagugcuuuguaaugg

SEQ ID NO: 2105056 - RNA, 13 nt, Human
aauuuuaauuuau

SEQ ID NO: 2105057 - RNA, 15 nt, Human
aauuuuaauuuauuu

SEQ ID NO: 2105058 - RNA, 18 nt, Human
aauuugggggaaaauuua

SEQ ID NO: 2105059 - RNA, 18 nt, Human
aauuuggccugcacuaau

SEQ ID NO: 2105060 - RNA, 10 nt, Human
uagacagagu

SEQ ID NO: 2105061 - RNA, 11 nt, Human
uagaaggaaac

SEQ ID NO: 2105062 - RNA, 13 nt, Human
uagaaggaaacua

SEQ ID NO: 2105063 - RNA, 15 nt, Human
uagaaggagacagag

SEQ ID NO: 2105064 - RNA, 17 nt, Human
uagaaggagacagagcu

SEQ ID NO: 2105065 - RNA, 23 nt, Human
uagaaggagacagagcugguugg

SEQ ID NO: 2105066 - RNA, 17 nt, Human
uagaaggauguacauuu

SEQ ID NO: 2105067 - RNA, 21 nt, Human
uagaaggauguacauuuccaa

SEQ ID NO: 2105068 - RNA, 20 nt, Human
uagaaguaggaagugaaaau

SEQ ID NO: 2105069 - RNA, 16 nt, Human
uagaaggguuauauuu

SEQ ID NO: 2105070 - RNA, 19 nt, Human
uagaagggccaguccugcc

SEQ ID NO: 2105071 - RNA, 22 nt, Human
uagaagggccaguccugccugg

SEQ ID NO: 2105072 - RNA, 16 nt, Human
uagaauuuuaagugcu

SEQ ID NO: 2105073 - RNA, 18 nt, Human
uagaauuuuuaauguuuu

SEQ ID NO: 2105074 - RNA, 16 nt, Human
uagcacguuuaaaguu

SEQ ID NO: 2105075 - RNA, 18 nt, Human
uagcacguuuaaaguucu

SEQ ID NO: 2105076 - RNA, 19 nt, Human
uagcacguuuaaaguucug

SEQ ID NO: 2105077 - RNA, 20 nt, Human
uagcacguuuaaaguucugu

SEQ ID NO: 2105078 - RNA, 14 nt, Human
uagcacucacaugc

SEQ ID NO: 2105079 - RNA, 15 nt, Human
uagcacucacaugcu

SEQ ID NO: 2105080 - RNA, 17 nt, Human
uagcacucacaugcugg

SEQ ID NO: 2105081 - RNA, 18 nt, Human
uagcacucacaugcugga

SEQ ID NO: 2105082 - RNA, 13 nt, Human
uagcacugagcaa

SEQ ID NO: 2105083 - RNA, 15 nt, Human
uagcacuuucauugc

SEQ ID NO: 2105084 - RNA, 17 nt, Human
uagcacuuucauugcca

SEQ ID NO: 2105085 - RNA, 20 nt, Human
uagcacuuucauugccagug

SEQ ID NO: 2105086 - RNA, 23 nt, Human
uagcacuuucauugccagugucu

SEQ ID NO: 2105087 - RNA, 12 nt, Human
acaaaucaaguu

SEQ ID NO: 2105088 - RNA, 13 nt, Human
acaaaucaaguuu

SEQ ID NO: 2105089 - RNA, 15 nt, Human
acaaaucaaguuucc

SEQ ID NO: 2105090 - RNA, 17 nt, Human
acaaaucaaguuuccaa

SEQ ID NO: 2105091 - RNA, 19 nt, Human
acaaaucaaguuuccaagc

SEQ ID NO: 2105092 - RNA, 20 nt, Human
acaaaucaaguuuccaagca

SEQ ID NO: 2105093 - RNA, 22 nt, Human
acaaaucaaguuuccaagcaaa

SEQ ID NO: 2105094 - RNA, 19 nt, Human
uagccaccccagaaauggu

SEQ ID NO: 2105095 - RNA, 13 nt, Human
uagccacucagga

SEQ ID NO: 2105096 - RNA, 14 nt, Human
uagccacucaggag

SEQ ID NO: 2105097 - RNA, 16 nt, Human
uagccacuuaccuuca

SEQ ID NO: 2105098 - RNA, 17 nt, Human
uagccacuuaccuucaa

SEQ ID NO: 2105099 - RNA, 21 nt, Human
uagcaaaauucuuaaguaugu

SEQ ID NO: 2105100 - RNA, 18 nt, Human
uagcaaguuacagugaug

SEQ ID NO: 2105101 - RNA, 21 nt, Human
uagcaauccauguuaguuuuu

SEQ ID NO: 2105102 - RNA, 17 nt, Human
uagagggugcugcccca

SEQ ID NO: 2105103 - RNA, 13 nt, Human
uagcacaaaaaaa

SEQ ID NO: 2105104 - RNA, 13 nt, Human
uagaggguuccug

SEQ ID NO: 2105105 - RNA, 17 nt, Human
uagaggguuccuguaga

SEQ ID NO: 2105106 - RNA, 23 nt, Human
uagcaaaacgcauggagugugua

SEQ ID NO: 2105107 - RNA, 22 nt, Human
uagcaaaacgcauggagugugu

SEQ ID NO: 2105108 - RNA, 14 nt, Human
uagcaaaagaagua

SEQ ID NO: 2105109 - RNA, 17 nt, Human
uagcaaaagaaguaaca

SEQ ID NO: 2105110 - RNA, 14 nt, Human
uagagccagggucu

SEQ ID NO: 2105111 - RNA, 17 nt, Human
acaaauacucuuaggaa

SEQ ID NO: 2105112 - RNA, 15 nt, Human
acaaauacucuuagg

SEQ ID NO: 2105113 - RNA, 23 nt, Human
acaaauacucuuaggaagagaaa

SEQ ID NO: 2105114 - RNA, 15 nt, Human
acaaauacuuauuca

SEQ ID NO: 2105115 - RNA, 16 nt, Human
acaaauacuuauucau

SEQ ID NO: 2105116 - RNA, 17 nt, Human
acaaauacuuauucauu

SEQ ID NO: 2105117 - RNA, 18 nt, Human
acaaauacuuauucauug

SEQ ID NO: 2105118 - RNA, 21 nt, Human
acaaauacuuauucauugugg

SEQ ID NO: 2105119 - RNA, 17 nt, Human
acaaaaucacuuccaua

SEQ ID NO: 2105120 - RNA, 17 nt, Human
uagagccugcuggaucu

SEQ ID NO: 2105121 - RNA, 16 nt, Human
uagagcuagucuuuca

SEQ ID NO: 2105122 - RNA, 17 nt, Human
uagagcuagucuuucac

SEQ ID NO: 2105123 - RNA, 16 nt, Human
acaaauaauaagcaaa

SEQ ID NO: 2105124 - RNA, 22 nt, Human
acaaaauauaaagcaucuaaac

SEQ ID NO: 2105125 - RNA, 23 nt, Human
acaaaauauaaagcaucuaaacu

SEQ ID NO: 2105126 - RNA, 10 nt, Human
acaaaauaaa

SEQ ID NO: 2105127 - RNA, 19 nt, Human
acaaagguauaauuuuaug

SEQ ID NO: 2105128 - RNA, 14 nt, Human
aauuuuaccaaguu

SEQ ID NO: 2105129 - RNA, 17 nt, Human
aauuuuaccaaguuaua

SEQ ID NO: 2105130 - RNA, 23 nt, Human
aauuuuaccaaguuauauaaaga

SEQ ID NO: 2105131 - RNA, 14 nt, Human
acaaaaaacaauau

SEQ ID NO: 2105132 - RNA, 15 nt, Human
acaaaaaacaauauu

SEQ ID NO: 2105133 - RNA, 17 nt, Human
acaaaaaacaauauuua

SEQ ID NO: 2105134 - RNA, 18 nt, Human
acaaaaaacaauauuuau

SEQ ID NO: 2105135 - RNA, 14 nt, Human
acaaaaagcuuccc

SEQ ID NO: 2105136 - RNA, 15 nt, Human
acaaaaagcuucccc

SEQ ID NO: 2105137 - RNA, 11 nt, Human
acaaaaauuau

SEQ ID NO: 2105138 - RNA, 12 nt, Human
acaaaaauuauc

SEQ ID NO: 2105139 - RNA, 20 nt, Human
acaaaaauuaucuauuugua

SEQ ID NO: 2105140 - RNA, 17 nt, Human
acaaaaauucacaagcu

SEQ ID NO: 2105141 - RNA, 22 nt, Human
acaaaaagguaaaacuuuuuau

SEQ ID NO: 2105142 - RNA, 18 nt, Human
acaaaaauacucuaauuc

SEQ ID NO: 2105143 - RNA, 19 nt, Human
acaaaaauacucuaauucu

SEQ ID NO: 2105144 - RNA, 20 nt, Human
acaaaaauacucuaauucua

SEQ ID NO: 2105145 - RNA, 21 nt, Human
acaaaaauacucuaauucuaa

SEQ ID NO: 2105146 - RNA, 12 nt, Human
acaaaaauacuc

SEQ ID NO: 2105147 - RNA, 22 nt, Human
acaaaaaugaaagcaugucuca

SEQ ID NO: 2105148 - RNA, 16 nt, Human
acaaaagugcuuugga

SEQ ID NO: 2105149 - RNA, 21 nt, Human
acaaaaggguuuaaacugauu

SEQ ID NO: 2105150 - RNA, 16 nt, Human
acuagaacugaauuuu

SEQ ID NO: 2105151 - RNA, 13 nt, Human
acuagaacucucc

SEQ ID NO: 2105152 - RNA, 15 nt, Human
acuagaacucuccau

SEQ ID NO: 2105153 - RNA, 18 nt, Human
acuagaaagugaauaaaa

SEQ ID NO: 2105154 - RNA, 19 nt, Human
acuagaaagugaauaaaaa

SEQ ID NO: 2105155 - RNA, 22 nt, Human
acuagaaagugaauaaaaauua

SEQ ID NO: 2105156 - RNA, 15 nt, Human
acuagaaaucugcca

SEQ ID NO: 2105157 - RNA, 19 nt, Human
acuacuagaugucuuuagg

SEQ ID NO: 2105158 - RNA, 17 nt, Human
acuacuugggagcaccg

SEQ ID NO: 2105159 - RNA, 19 nt, Human
acuacuugauggucagaca

SEQ ID NO: 2105160 - RNA, 21 nt, Human
acuacuugauggucagacaca

SEQ ID NO: 2105161 - RNA, 18 nt, Human
acuacggaauaguuggcu

SEQ ID NO: 2105162 - RNA, 15 nt, Human
acuacgugacugugg

SEQ ID NO: 2105163 - RNA, 17 nt, Human
acuagaacugaauuuug

SEQ ID NO: 2105164 - RNA, 18 nt, Human
acuagaacugaauuuugu

SEQ ID NO: 2105165 - RNA, 19 nt, Human
acuagaacugaauuuuguc

SEQ ID NO: 2105166 - RNA, 23 nt, Human
acuagaacugaauuuugucuuua

SEQ ID NO: 2105167 - RNA, 15 nt, Human
acuagaauuuauuca

SEQ ID NO: 2105168 - RNA, 16 nt, Human
acuagaacucuccauc

SEQ ID NO: 2105169 - RNA, 14 nt, Human
acuagaagggccag

SEQ ID NO: 2105170 - RNA, 23 nt, Human
acuagaagggccaguccugccug

SEQ ID NO: 2105171 - RNA, 16 nt, Human
acuagagguuuuauga

SEQ ID NO: 2105172 - RNA, 19 nt, Human
acuagagguuuuaugauau

SEQ ID NO: 2105173 - RNA, 22 nt, Human
acuagaauuucauuuauuuugu

SEQ ID NO: 2105174 - RNA, 13 nt, Human
acguacacacaca

SEQ ID NO: 2105175 - RNA, 22 nt, Human
uccccacucccuggcucucaga

SEQ ID NO: 2105176 - RNA, 16 nt, Human
uccccacugacagccu

SEQ ID NO: 2105177 - RNA, 19 nt, Human
uccccacugacagccuccc

SEQ ID NO: 2105178 - RNA, 14 nt, Human
uccccacugccugc

SEQ ID NO: 2105179 - RNA, 18 nt, Human
uccccacugccugcccac

SEQ ID NO: 2105180 - RNA, 20 nt, Human
uccccacugccugcccaccc

SEQ ID NO: 2105181 - RNA, 22 nt, Human
uccccacugccugcccacccgu

SEQ ID NO: 2105182 - RNA, 20 nt, Human
ucccccacccccuccccagg

SEQ ID NO: 2105183 - RNA, 21 nt, Human
ucccccacccccuccccaggg

SEQ ID NO: 2105184 - RNA, 22 nt, Human
ucccccaccagcuaaggacauu

SEQ ID NO: 2105185 - RNA, 18 nt, Human
ucccccacccccucccca

SEQ ID NO: 2105186 - RNA, 19 nt, Human
ucccccacccccuccccag

SEQ ID NO: 2105187 - RNA, 22 nt, Human
ucccccaacccccaccccacac

SEQ ID NO: 2105188 - RNA, 14 nt, Human
uccccagugaaaac

SEQ ID NO: 2105189 - RNA, 15 nt, Human
uccccagugaaaacu

SEQ ID NO: 2105190 - RNA, 22 nt, Human
uccccagguggcugacccaguc

SEQ ID NO: 2105191 - RNA, 17 nt, Human
uccccaguuugcagaaa

SEQ ID NO: 2105192 - RNA, 15 nt, Human
uccccauacucuguc

SEQ ID NO: 2105193 - RNA, 16 nt, Human
uccccauacucugucu

SEQ ID NO: 2105194 - RNA, 17 nt, Human
uccccauacucugucuc

SEQ ID NO: 2105195 - RNA, 18 nt, Human
uccccauacucugucucc

SEQ ID NO: 2105196 - RNA, 19 nt, Human
uccccauacucugucuccc

SEQ ID NO: 2105197 - RNA, 20 nt, Human
acucacauuuauucugcuca

SEQ ID NO: 2105198 - RNA, 19 nt, Human
acucacauuuauucugcuc

SEQ ID NO: 2105199 - RNA, 20 nt, Human
acucacauggcuauguuuua

SEQ ID NO: 2105200 - RNA, 13 nt, Human
uccccgcuggcug

SEQ ID NO: 2105201 - RNA, 15 nt, Human
uccccgcuggcuggg

SEQ ID NO: 2105202 - RNA, 16 nt, Human
uccccgcuggcugggg

SEQ ID NO: 2105203 - RNA, 17 nt, Human
uccccgcuggcuggggg

SEQ ID NO: 2105204 - RNA, 18 nt, Human
uccccgcuucugccugca

SEQ ID NO: 2105205 - RNA, 22 nt, Human
acucacaugcuggacaggucug

SEQ ID NO: 2105206 - RNA, 14 nt, Human
acucaaugcacuga

SEQ ID NO: 2105207 - RNA, 23 nt, Human
acucaauauuuuccaugaaaaug

SEQ ID NO: 2105208 - RNA, 16 nt, Human
acucacauggcuaugu

SEQ ID NO: 2105209 - RNA, 19 nt, Human
acucacauggcuauguuuu

SEQ ID NO: 2105210 - RNA, 15 nt, Human
acucaaguucaagga

SEQ ID NO: 2105211 - RNA, 17 nt, Human
acucaaguucaaggacc

SEQ ID NO: 2105212 - RNA, 12 nt, Human
acucaauauuuu

SEQ ID NO: 2105213 - RNA, 15 nt, Human
acucaauaaaaucau

SEQ ID NO: 2105214 - RNA, 18 nt, Human
acucaauaaaaucaugua

SEQ ID NO: 2105215 - RNA, 15 nt, Human
acucaauauuuucca

SEQ ID NO: 2105216 - RNA, 18 nt, Human
acucaauauuuuccauga

SEQ ID NO: 2105217 - RNA, 21 nt, Human
acucaauauuuuccaugaaaa

SEQ ID NO: 2105218 - RNA, 22 nt, Human
acucaauauuuuccaugaaaau

SEQ ID NO: 2105219 - RNA, 14 nt, Human
uccccuaaccucau

SEQ ID NO: 2105220 - RNA, 22 nt, Human
uccccggucccuugagaccuca

SEQ ID NO: 2105221 - RNA, 17 nt, Human
uccccgugggccauggc

SEQ ID NO: 2105222 - RNA, 13 nt, Human
uccccggcucgag

SEQ ID NO: 2105223 - RNA, 21 nt, Human
uccccuccuugccuccugugu

SEQ ID NO: 2105224 - RNA, 12 nt, Human
uccccuccuugc

SEQ ID NO: 2105225 - RNA, 18 nt, Human
uccccuccuugccuccug

SEQ ID NO: 2105226 - RNA, 20 nt, Human
uccccuccuugccuccugug

SEQ ID NO: 2105227 - RNA, 14 nt, Human
uccccuccuucucc

SEQ ID NO: 2105228 - RNA, 18 nt, Human
uccccuccuucucccuuu

SEQ ID NO: 2105229 - RNA, 13 nt, Human
uccccucugcugg

SEQ ID NO: 2105230 - RNA, 14 nt, Human
uccccucugcuggc

SEQ ID NO: 2105231 - RNA, 15 nt, Human
uccccucugcuggcc

SEQ ID NO: 2105232 - RNA, 21 nt, Human
uccccucuuauguaccucuuu

SEQ ID NO: 2105233 - RNA, 13 nt, Human
acuauguugauaa

SEQ ID NO: 2105234 - RNA, 12 nt, Human
acuauguaucaa

SEQ ID NO: 2105235 - RNA, 15 nt, Human
acuauguacaauauu

SEQ ID NO: 2105236 - RNA, 16 nt, Human
acuauguacaauauuu

SEQ ID NO: 2105237 - RNA, 18 nt, Human
acuauguacaauauuuua

SEQ ID NO: 2105238 - RNA, 19 nt, Human
acuauguacaauauuuuaa

SEQ ID NO: 2105239 - RNA, 21 nt, Human
acuauguacaauauuuuaagc

SEQ ID NO: 2105240 - RNA, 22 nt, Human
acuauguacaauauuuuaagca

SEQ ID NO: 2105241 - RNA, 12 nt, Human
acuauaauguaa

SEQ ID NO: 2105242 - RNA, 13 nt, Human
acuauaauguaag

SEQ ID NO: 2105243 - RNA, 14 nt, Human
acuauaauguaagc

SEQ ID NO: 2105244 - RNA, 16 nt, Human
acuaugauuuggaaaa

SEQ ID NO: 2105245 - RNA, 16 nt, Human
acuaugcacaauuuaa

SEQ ID NO: 2105246 - RNA, 15 nt, Human
acuaugauuuggaaa

SEQ ID NO: 2105247 - RNA, 21 nt, Human
acuauaauguaagcucuacug

SEQ ID NO: 2105248 - RNA, 18 nt, Human
acucagaagacacugaug

SEQ ID NO: 2105249 - RNA, 13 nt, Human
acucagaagccug

SEQ ID NO: 2105250 - RNA, 14 nt, Human
acucagaagccuga

SEQ ID NO: 2105251 - RNA, 15 nt, Human
acucagaagccugag

SEQ ID NO: 2105252 - RNA, 16 nt, Human
acucagaagccugagg

SEQ ID NO: 2105253 - RNA, 17 nt, Human
acucagaagccugaggc

SEQ ID NO: 2105254 - RNA, 18 nt, Human
acucagaagccugaggcu

SEQ ID NO: 2105255 - RNA, 17 nt, Human
acucagaagacacugau

SEQ ID NO: 2105256 - RNA, 16 nt, Human
acucagaagacacuga

SEQ ID NO: 2105257 - RNA, 15 nt, Human
acucagaagacacug

SEQ ID NO: 2105258 - RNA, 14 nt, Human
acucagaagacacu

SEQ ID NO: 2105259 - RNA, 16 nt, Human
acucaccucugccuca

SEQ ID NO: 2105260 - RNA, 17 nt, Human
acucaccucugccucaa

SEQ ID NO: 2105261 - RNA, 21 nt, Human
acucagaaauuuaauucaugu

SEQ ID NO: 2105262 - RNA, 18 nt, Human
ucccucccccugccccuu

SEQ ID NO: 2105263 - RNA, 14 nt, Human
acucagagggagga

SEQ ID NO: 2105264 - RNA, 19 nt, Human
acucagacaggaaagggaa

SEQ ID NO: 2105265 - RNA, 12 nt, Human
acucaucuuagg

SEQ ID NO: 2105266 - RNA, 18 nt, Human
acucaucuuagugccuga

SEQ ID NO: 2105267 - RNA, 22 nt, Human
acucaucuuagugccugagagu

SEQ ID NO: 2105268 - RNA, 14 nt, Human
acuccaccacccaa

SEQ ID NO: 2105269 - RNA, 13 nt, Human
acuccaccaccca

SEQ ID NO: 2105270 - RNA, 21 nt, Human
acuccaaaccuccuguuagcu

SEQ ID NO: 2105271 - RNA, 15 nt, Human
acuccaccaacccau

SEQ ID NO: 2105272 - RNA, 20 nt, Human
acuccaccaacccaucagaa

SEQ ID NO: 2105273 - RNA, 18 nt, Human
ucccucagucuggcccuu

SEQ ID NO: 2105274 - RNA, 14 nt, Human
uccccugcacugga

SEQ ID NO: 2105275 - RNA, 20 nt, Human
ucccucagucuggcccuucc

SEQ ID NO: 2105276 - RNA, 14 nt, Human
ucccucagccccuc

SEQ ID NO: 2105277 - RNA, 15 nt, Human
ucccucagccccucu

SEQ ID NO: 2105278 - RNA, 16 nt, Human
ucccucagccccucuu

SEQ ID NO: 2105279 - RNA, 17 nt, Human
ucccucagccccucuug

SEQ ID NO: 2105280 - RNA, 11 nt, Human
ucccucuuucc

SEQ ID NO: 2105281 - RNA, 13 nt, Human
ucccucuuucccu

SEQ ID NO: 2105282 - RNA, 15 nt, Human
ucccuccccugcccu

SEQ ID NO: 2105283 - RNA, 16 nt, Human
ucccuccccugcccuc

SEQ ID NO: 2105284 - RNA, 17 nt, Human
ucccuccccugcccucg

SEQ ID NO: 2105285 - RNA, 16 nt, Human
ucccuccccugcccug

SEQ ID NO: 2105286 - RNA, 17 nt, Human
ucccuccccugcccugg

SEQ ID NO: 2105287 - RNA, 19 nt, Human
ucccuccccugcccugguc

SEQ ID NO: 2105288 - RNA, 13 nt, Human
ucccuccccugcc

SEQ ID NO: 2105289 - RNA, 16 nt, Human
ucccuccccugccauu

SEQ ID NO: 2105290 - RNA, 14 nt, Human
ucccuccccugccc

SEQ ID NO: 2105291 - RNA, 17 nt, Human
ucccugaccucccucua

SEQ ID NO: 2105292 - RNA, 16 nt, Human
ucccugaccucccucu

SEQ ID NO: 2105293 - RNA, 21 nt, Human
ucccugaccucccucuaauuu

SEQ ID NO: 2105294 - RNA, 14 nt, Human
ucccugacccugca

SEQ ID NO: 2105295 - RNA, 16 nt, Human
ucccugacccugcaga

SEQ ID NO: 2105296 - RNA, 18 nt, Human
acucacccccaaggggca

SEQ ID NO: 2105297 - RNA, 16 nt, Human
acucaccuaauguuua

SEQ ID NO: 2105298 - RNA, 17 nt, Human
acucaccuaauguuuau

SEQ ID NO: 2105299 - RNA, 16 nt, Human
acucaccucuaaaaca

SEQ ID NO: 2105300 - RNA, 20 nt, Human
acucaccuaauguuuaugag

SEQ ID NO: 2105301 - RNA, 23 nt, Human
acucaccuaauguuuaugagcca

SEQ ID NO: 2105302 - RNA, 11 nt, Human
acucaccucug

SEQ ID NO: 2105303 - RNA, 13 nt, Human
acucaccucugcc

SEQ ID NO: 2105304 - RNA, 14 nt, Human
acucaccucugccu

SEQ ID NO: 2105305 - RNA, 15 nt, Human
acucaccucugccuc

SEQ ID NO: 2105306 - RNA, 15 nt, Human
ucccugaaccauccc

SEQ ID NO: 2105307 - RNA, 15 nt, Human
ucccugaaaacccag

SEQ ID NO: 2105308 - RNA, 16 nt, Human
ucccugaaaacccaga

SEQ ID NO: 2105309 - RNA, 17 nt, Human
ucccugaaaacccagag

SEQ ID NO: 2105310 - RNA, 18 nt, Human
ucccugaaaacccagaga

SEQ ID NO: 2105311 - RNA, 19 nt, Human
ucccugaaaacccagagag

SEQ ID NO: 2105312 - RNA, 20 nt, Human
ucccugaaaacccagagagg

SEQ ID NO: 2105313 - RNA, 17 nt, Human
ucccugaaaauguuuuu

SEQ ID NO: 2105314 - RNA, 24 nt, Human
uccgugcuuguuugcucaccuggg

SEQ ID NO: 2105315 - RNA, 12 nt, Human
uccuaccucagc

SEQ ID NO: 2105316 - RNA, 13 nt, Human
uccuaccucagcc

SEQ ID NO: 2105317 - RNA, 18 nt, Human
uccggcaguucugggugc

SEQ ID NO: 2105318 - RNA, 20 nt, Human
uccuacgucaaacaugaagu

SEQ ID NO: 2105319 - RNA, 14 nt, Human
uccuaccucagccu

SEQ ID NO: 2105320 - RNA, 16 nt, Human
uccuaccucagccuag

SEQ ID NO: 2105321 - RNA, 17 nt, Human
uccuaccucagccuaga

SEQ ID NO: 2105322 - RNA, 12 nt, Human
uccuacucugug

SEQ ID NO: 2105323 - RNA, 21 nt, Human
uccuagccugugccucuggga

SEQ ID NO: 2105324 - RNA, 13 nt, Human
uccuagccacuca

SEQ ID NO: 2105325 - RNA, 17 nt, Human
uccuagccacucaggag

SEQ ID NO: 2105326 - RNA, 13 nt, Human
acuccuguacacu

SEQ ID NO: 2105327 - RNA, 15 nt, Human
acuccuguacacuga

SEQ ID NO: 2105328 - RNA, 16 nt, Human
acuccuguacacugaa

SEQ ID NO: 2105329 - RNA, 17 nt, Human
acuccuguacacugaau

SEQ ID NO: 2105330 - RNA, 18 nt, Human
acuccuguacacugaaua

SEQ ID NO: 2105331 - RNA, 18 nt, Human
acucgagucacacucaag

SEQ ID NO: 2105332 - RNA, 14 nt, Human
acuccuuucucauc

SEQ ID NO: 2105333 - RNA, 12 nt, Human
acuccuuagaga

SEQ ID NO: 2105334 - RNA, 11 nt, Human
acuccuuccug

SEQ ID NO: 2105335 - RNA, 21 nt, Human
acucuuauugcccacgcugga

SEQ ID NO: 2105336 - RNA, 19 nt, Human
acucuucuuaacuuaaauu

SEQ ID NO: 2105337 - RNA, 20 nt, Human
acucuucuuaacuuaaauuu

SEQ ID NO: 2105338 - RNA, 18 nt, Human
acucucaggaucaagaaa

SEQ ID NO: 2105339 - RNA, 19 nt, Human
acucucaggaucaagaaag

SEQ ID NO: 2105340 - RNA, 15 nt, Human
acucucagugcuucu

SEQ ID NO: 2105341 - RNA, 22 nt, Human
acucucagugcuucuuacuauu

SEQ ID NO: 2105342 - RNA, 22 nt, Human
acucucaggaucaagaaagugu

SEQ ID NO: 2105343 - RNA, 14 nt, Human
acucucauucccca

SEQ ID NO: 2105344 - RNA, 16 nt, Human
acucugccucugccug

SEQ ID NO: 2105345 - RNA, 15 nt, Human
acucucauuccccag

SEQ ID NO: 2105346 - RNA, 11 nt, Human
acucugccucu

SEQ ID NO: 2105347 - RNA, 12 nt, Human
acucugccucug

SEQ ID NO: 2105348 - RNA, 14 nt, Human
acucugccucugcc

SEQ ID NO: 2105349 - RNA, 16 nt, Human
acucgugugcaacaga

SEQ ID NO: 2105350 - RNA, 14 nt, Human
acucguauaugucu

SEQ ID NO: 2105351 - RNA, 23 nt, Human
acucguauaagcauggagaacag

SEQ ID NO: 2105352 - RNA, 16 nt, Human
uccucucuaaccuccu

SEQ ID NO: 2105353 - RNA, 17 nt, Human
uccucucuaaccuccuu

SEQ ID NO: 2105354 - RNA, 18 nt, Human
uccucucuaaccuccuuu

SEQ ID NO: 2105355 - RNA, 19 nt, Human
uccucucuaaccuccuuua

SEQ ID NO: 2105356 - RNA, 21 nt, Human
uccucucuaaccuccuuuacc

SEQ ID NO: 2105357 - RNA, 18 nt, Human
uccucuccacugccuucg

SEQ ID NO: 2105358 - RNA, 17 nt, Human
uccucuccacugccuuc

SEQ ID NO: 2105359 - RNA, 17 nt, Human
uccucuccccucuaagg

SEQ ID NO: 2105360 - RNA, 19 nt, Human
uccucuccccucuaaggcc

SEQ ID NO: 2105361 - RNA, 20 nt, Human
uccucuccgcaguuccuguc

SEQ ID NO: 2105362 - RNA, 21 nt, Human
uccucccaccucagccucccg

SEQ ID NO: 2105363 - RNA, 13 nt, Human
uccucccccugcc

SEQ ID NO: 2105364 - RNA, 16 nt, Human
uccuccccagcaggug

SEQ ID NO: 2105365 - RNA, 14 nt, Human
uccucccccugcca

SEQ ID NO: 2105366 - RNA, 15 nt, Human
uccucccccugccag

SEQ ID NO: 2105367 - RNA, 17 nt, Human
uccucccccugccagug

SEQ ID NO: 2105368 - RNA, 20 nt, Human
uccucccccugccagugccu

SEQ ID NO: 2105369 - RNA, 23 nt, Human
uccucccccugccagugccuuac

SEQ ID NO: 2105370 - RNA, 10 nt, Human
uccuccccag

SEQ ID NO: 2105371 - RNA, 13 nt, Human
uccuccccagcag

SEQ ID NO: 2105372 - RNA, 22 nt, Human
uccuccccauuagagucagccu

SEQ ID NO: 2105373 - RNA, 19 nt, Human
uccucccugggcagaaagu

SEQ ID NO: 2105374 - RNA, 14 nt, Human
uccuccccucaagg

SEQ ID NO: 2105375 - RNA, 24 nt, Human
uccucccccugccagugccuuacc

SEQ ID NO: 2105376 - RNA, 20 nt, Human
uccucccaccucagccuccc

SEQ ID NO: 2105377 - RNA, 18 nt, Human
uccucccaccucagccuc

SEQ ID NO: 2105378 - RNA, 16 nt, Human
uccucccaccucagcc

SEQ ID NO: 2105379 - RNA, 15 nt, Human
uccucccaccucagc

SEQ ID NO: 2105380 - RNA, 14 nt, Human
uccucccaccucag

SEQ ID NO: 2105381 - RNA, 13 nt, Human
uccucccaccuca

SEQ ID NO: 2105382 - RNA, 17 nt, Human
uccucuuucagaaaaca

SEQ ID NO: 2105383 - RNA, 18 nt, Human
uccucuuucagaaaacag

SEQ ID NO: 2105384 - RNA, 21 nt, Human
uccucuuucagaaaacagaaa

SEQ ID NO: 2105385 - RNA, 11 nt, Human
uccucuuuguu

SEQ ID NO: 2105386 - RNA, 15 nt, Human
uccucuuuguuuugu

SEQ ID NO: 2105387 - RNA, 21 nt, Human
uccucuuuuaucuuggacuga

SEQ ID NO: 2105388 - RNA, 13 nt, Human
uccucuuuuucca

SEQ ID NO: 2105389 - RNA, 21 nt, Human
uccucuuuuuccaucauaauu

SEQ ID NO: 2105390 - RNA, 12 nt, Human
uccucugccacc

SEQ ID NO: 2105391 - RNA, 14 nt, Human
uccucugccaccuc

SEQ ID NO: 2105392 - RNA, 15 nt, Human
uccucugccaccucc

SEQ ID NO: 2105393 - RNA, 18 nt, Human
uccucugccaccuccccu

SEQ ID NO: 2105394 - RNA, 22 nt, Human
uccucugccaccuccccuaucc

SEQ ID NO: 2105395 - RNA, 23 nt, Human
uccucugccaccuccccuaucca

SEQ ID NO: 2105396 - RNA, 19 nt, Human
uccucuugccacugccucu

SEQ ID NO: 2105397 - RNA, 12 nt, Human
uccucuugccau

SEQ ID NO: 2105398 - RNA, 14 nt, Human
uccucuugccaucu

SEQ ID NO: 2105399 - RNA, 15 nt, Human
uccugaccugucuca

SEQ ID NO: 2105400 - RNA, 20 nt, Human
uccugaccugucucaccaug

SEQ ID NO: 2105401 - RNA, 21 nt, Human
uccugacggcgcccccagugu

SEQ ID NO: 2105402 - RNA, 11 nt, Human
acucuuuggau

SEQ ID NO: 2105403 - RNA, 22 nt, Human
acucuuuggauagcaugucuuu

SEQ ID NO: 2105404 - RNA, 22 nt, Human
acucuuugagauagaagaacug

SEQ ID NO: 2105405 - RNA, 23 nt, Human
acucuuugagauagaagaacugc

SEQ ID NO: 2105406 - RNA, 12 nt, Human
acugaaaacaua

SEQ ID NO: 2105407 - RNA, 14 nt, Human
acugaaaacauaaa

SEQ ID NO: 2105408 - RNA, 17 nt, Human
acugaaaacauaaaaag

SEQ ID NO: 2105409 - RNA, 18 nt, Human
acugaaaacauaaaaagu

SEQ ID NO: 2105410 - RNA, 19 nt, Human
acugaaaacauaaaaaguu

SEQ ID NO: 2105411 - RNA, 16 nt, Human
acucuuugagauagaa

SEQ ID NO: 2105412 - RNA, 19 nt, Human
acucuuugagauagaagaa

SEQ ID NO: 2105413 - RNA, 19 nt, Human
acugaaaagacucaguguu

SEQ ID NO: 2105414 - RNA, 20 nt, Human
ucccaaagugcugggauuac

SEQ ID NO: 2105415 - RNA, 16 nt, Human
ucccaaagugcuggga

SEQ ID NO: 2105416 - RNA, 15 nt, Human
ucccaaagugcuggg

SEQ ID NO: 2105417 - RNA, 14 nt, Human
uccauuugugugug

SEQ ID NO: 2105418 - RNA, 22 nt, Human
ucccacaggcccuuccucucca

SEQ ID NO: 2105419 - RNA, 21 nt, Human
ucccacaggcccuuccucucc

SEQ ID NO: 2105420 - RNA, 17 nt, Human
ucccacaggcccuuccu

SEQ ID NO: 2105421 - RNA, 15 nt, Human
ucccacaggcccuuc

SEQ ID NO: 2105422 - RNA, 20 nt, Human
ucccaauuaggaaguguaac

SEQ ID NO: 2105423 - RNA, 14 nt, Human
ucccaauuaggaag

SEQ ID NO: 2105424 - RNA, 15 nt, Human
ucccaauuaggaagu

SEQ ID NO: 2105425 - RNA, 19 nt, Human
ucccaauuaggaaguguaa

SEQ ID NO: 2105426 - RNA, 20 nt, Human
ucccaauucauccucacuca

SEQ ID NO: 2105427 - RNA, 14 nt, Human
ucccacaaaggaga

SEQ ID NO: 2105428 - RNA, 17 nt, Human
ucccaccaggcugcuca

SEQ ID NO: 2105429 - RNA, 15 nt, Human
ucccaccacagcagg

SEQ ID NO: 2105430 - RNA, 17 nt, Human
ucccaccacagcaggug

SEQ ID NO: 2105431 - RNA, 19 nt, Human
ucccaccaacccucagagc

SEQ ID NO: 2105432 - RNA, 22 nt, Human
ucccaccaggcugcucagggcu

SEQ ID NO: 2105433 - RNA, 20 nt, Human
ucccacccccuucucugcuc

SEQ ID NO: 2105434 - RNA, 21 nt, Human
ucccacccccuucucugcucc

SEQ ID NO: 2105435 - RNA, 22 nt, Human
ucccacccccuucucugcucca

SEQ ID NO: 2105436 - RNA, 20 nt, Human
ucccacccccaucucucccu

SEQ ID NO: 2105437 - RNA, 17 nt, Human
ucccacccccuucucug

SEQ ID NO: 2105438 - RNA, 19 nt, Human
ucccacccccuucucugcu

SEQ ID NO: 2105439 - RNA, 18 nt, Human
ucccaccgguugcuucug

SEQ ID NO: 2105440 - RNA, 19 nt, Human
ucccaccgguugcuucugg

SEQ ID NO: 2105441 - RNA, 20 nt, Human
ucccaccgguugcuucuggg

SEQ ID NO: 2105442 - RNA, 21 nt, Human
ucccaccgguugcuucuggga

SEQ ID NO: 2105443 - RNA, 12 nt, Human
acggggagaaaa

SEQ ID NO: 2105444 - RNA, 23 nt, Human
acggggaggccaagugcaggcug

SEQ ID NO: 2105445 - RNA, 14 nt, Human
acggggaggccaag

SEQ ID NO: 2105446 - RNA, 14 nt, Human
acgggguccuucaa

SEQ ID NO: 2105447 - RNA, 17 nt, Human
uccaugacugcauuuua

SEQ ID NO: 2105448 - RNA, 18 nt, Human
uccaugaguuugcccugg

SEQ ID NO: 2105449 - RNA, 22 nt, Human
uccauugguuuaccugugaaau

SEQ ID NO: 2105450 - RNA, 14 nt, Human
uccauugugugagu

SEQ ID NO: 2105451 - RNA, 21 nt, Human
uccaugaauguaucaggaaau

SEQ ID NO: 2105452 - RNA, 15 nt, Human
uccaugaauguauca

SEQ ID NO: 2105453 - RNA, 16 nt, Human
uccaugaauguaucag

SEQ ID NO: 2105454 - RNA, 15 nt, Human
uccaugaaggcagag

SEQ ID NO: 2105455 - RNA, 12 nt, Human
uccaugaaugua

SEQ ID NO: 2105456 - RNA, 13 nt, Human
uccaugaauguau

SEQ ID NO: 2105457 - RNA, 14 nt, Human
uccaugaauguauc

SEQ ID NO: 2105458 - RNA, 12 nt, Human
uccaugaaaaug

SEQ ID NO: 2105459 - RNA, 21 nt, Human
uccaugaaaacguuuuauugu

SEQ ID NO: 2105460 - RNA, 22 nt, Human
uccaugaaaacguuuuauugug

SEQ ID NO: 2105461 - RNA, 11 nt, Human
uccaugaaaac

SEQ ID NO: 2105462 - RNA, 15 nt, Human
uccaugaaaacguuu

SEQ ID NO: 2105463 - RNA, 18 nt, Human
uccaugaaaacguuuuau

SEQ ID NO: 2105464 - RNA, 19 nt, Human
uccaugaaaacguuuuauu

SEQ ID NO: 2105465 - RNA, 15 nt, Human
uccaucuggcagggu

SEQ ID NO: 2105466 - RNA, 21 nt, Human
acggccuucaacugaaaagac

SEQ ID NO: 2105467 - RNA, 23 nt, Human
acggccuugcugggggccgcccu

SEQ ID NO: 2105468 - RNA, 20 nt, Human
acggccugaugcucccuccc

SEQ ID NO: 2105469 - RNA, 22 nt, Human
acggccugaugcucccuccccu

SEQ ID NO: 2105470 - RNA, 14 nt, Human
acggcucacugcag

SEQ ID NO: 2105471 - RNA, 15 nt, Human
acggccugaugcucc

SEQ ID NO: 2105472 - RNA, 18 nt, Human
acggccugaugcucccuc

SEQ ID NO: 2105473 - RNA, 19 nt, Human
acggccugaugcucccucc

SEQ ID NO: 2105474 - RNA, 20 nt, Human
uccagucugcugcccuccau

SEQ ID NO: 2105475 - RNA, 22 nt, Human
uccagucugcugcccuccaucc

SEQ ID NO: 2105476 - RNA, 13 nt, Human
uccagucuuccac

SEQ ID NO: 2105477 - RNA, 18 nt, Human
uccagucuuccaccugga

SEQ ID NO: 2105478 - RNA, 19 nt, Human
uccagucuuccaccuggaa

SEQ ID NO: 2105479 - RNA, 20 nt, Human
uccagucuuccaccuggaag

SEQ ID NO: 2105480 - RNA, 15 nt, Human
acggcucacugcagc

SEQ ID NO: 2105481 - RNA, 16 nt, Human
acggcgcccccagugu

SEQ ID NO: 2105482 - RNA, 17 nt, Human
acggcgcccccagugug

SEQ ID NO: 2105483 - RNA, 16 nt, Human
uccagucugcugcccu

SEQ ID NO: 2105484 - RNA, 18 nt, Human
uccagucugcugcccucc

SEQ ID NO: 2105485 - RNA, 19 nt, Human
uccagucugcugcccucca

SEQ ID NO: 2105486 - RNA, 22 nt, Human
uccaucccuacccccuaagagc

SEQ ID NO: 2105487 - RNA, 14 nt, Human
acgacuucagggca

SEQ ID NO: 2105488 - RNA, 22 nt, Human
acgacuucagggcagggcucug

SEQ ID NO: 2105489 - RNA, 14 nt, Human
acgaggcugggcca

SEQ ID NO: 2105490 - RNA, 17 nt, Human
acgaggcugggccaagc

SEQ ID NO: 2105491 - RNA, 19 nt, Human
acgagggauguggagcaca

SEQ ID NO: 2105492 - RNA, 22 nt, Human
acgacaaagccaaacucugcca

SEQ ID NO: 2105493 - RNA, 20 nt, Human
acgacaauagcuuuacccuc

SEQ ID NO: 2105494 - RNA, 15 nt, Human
acgacugcccggcag

SEQ ID NO: 2105495 - RNA, 17 nt, Human
acgagugggaaggacuu
